United States Patent 10,982,187 (BOS TAURUS VARIETY 'HO840003150607238' AND METHODS OF USE THEREOF) - sequence listing, part 3

SEQ ID NO: 24211 - DNA, 201 bp, Bos taurus
ggatcttgcttcttgacctcctgaataagtgggatgcaaagatggcagttaacatgcaggagagaaaagcctttctgtcctccatgaaactctcatacataacttgacattacctggtgacctctgagaaatagatcccctaaggggagtggcacccactgcctcttccccctcccccaaactgcagtccctctagtgata

SEQ ID NO: 24212 - DNA, 201 bp, Bos taurus
tctaagagcaagtcctatgctgccttgcaacacaaccatcttgttgggcctggatttgtgattttaatcttttgttcagaggagcacaggcctccctcacgttacttcgagttatcaaacggtattgtaaggaaatgccagaccttgtaccccgggcaatccagcctccaggaaaaacagagctggtcatacatccaggcc

SEQ ID NO: 24213 - DNA, 201 bp, Bos taurus
acctttgagggggtcggtgaagagtgagtgacctgtagggagcatgaggcagcttctgagattctgcgagtgctctgggtgctgattacatgggtgtcaacattcttcgactggtacttttatgacatagaccattttatgcatttgttgtatatttcaatcaacatctcatggagcagataagtgatagaccgtgagtga

SEQ ID NO: 24214 - DNA, 201 bp, Bos taurus
taggggaaggtcagtaaagaagatgccaatctgcatacagttttttgaaaggctagacaagggaaggaaaagcagtcttatcacaactgcccaacagaggggagagcaacctcatccacctgaattccttcctgcggtcttccttgcccatagaatagaagtccaagaatttcagtgtgatataccagaaccccgttttct

SEQ ID NO: 24215 - DNA, 201 bp, Bos taurus
tttctctcggtacttcctccatgcatccgtgaccagggcccaccttctgtcttatggatgaagaagaaatcaaggacagtgtgtgtggttgtttcacacagggtaaattgggcaagggccaagcaaaggtttaagggagacatgggtattcatccagctgaagagtccacaggcaaatcctggctgtgctttggacactaa

SEQ ID NO: 24216 - DNA, 201 bp, Bos taurus
aagtaaagtttggaccagcatattccaaagaccaagtggtttgcgaaccaccgatatacagaaattagaacaagattaaaagacacatgatttaggccatggcatttactcttccatgtccatgtgatattgagcaaattagtcgtcttttctgtacttgagttccctactcttaaatgacctaatggccttggtattcca

SEQ ID NO: 24217 - DNA, 201 bp, Bos taurus
aagctttaaaaaccagaagtattgttggtatggtggttcacaagtttggtgccaaaataagccttgagctgccacttgataccagttttgtctcagtgcttccatcagctccatatgcctctgctgcctactgattatctctgctgcattttgggaatgtgtgtgtcttcactctgtgtcacggagcaatcatcgcatgta

SEQ ID NO: 24218 - DNA, 201 bp, Bos taurus
aacagcattgaaaggcccagataattaatgtaaaagtgtgtggagctttccagaaactgcaggtggtacagtgtagctggatcacagcatcctggaagacagatggagataaggccaccaaaggaagcaagaaccaactcaagaaggaccaacatgtcatcagctgtgaatgccatatagagggttctggaaagttctgaa

SEQ ID NO: 24219 - DNA, 201 bp, Bos taurus
tccaacttgggggtcccagaacttgaagcaaatgaagagctgtttgtactgctaaagaactcaatactgccaccttctggcaagaagaaaacgtgtaagcagcagaatttgaaacctgtgttaacagaccctccttaatcagttcagttcagtcgctcagtcctacctgactctttgagaccccatggactgcagcacgcg

SEQ ID NO: 24220 - DNA, 201 bp, Bos taurus
aaactagtcaggtgggactggaacggtgcctctgaggtatttcacaaacacagggaacaaacacatttggtgtcgcaatcctggccacccggagctgccgtgttggctgttttttgagaatagacagtggataaggagcttgagagaggacggggtgggaggcctagggtggccatcttagagacatgtcagctctcagga

SEQ ID NO: 24221 - DNA, 201 bp, Bos taurus
cagctttccctccagcatgaacacactgcttgggactgaccacccctgggaagggccacttcccttcctgcagcaactcaccaggcctttttcttccgctcgtgcttggactcaatcatgcgaacaatggcttcctcttcataggtgtggccacacactttatttttcactggtttcttcatttccaactgtaatcaagaa

SEQ ID NO: 24222 - DNA, 201 bp, Bos taurus
tatggaaaacttagaagtaaactatatatcggcctttatttcgaaaaccattactgaatatccaaaataacaagtaattacaaatttctgtttaaccgaatagcgatgaccatcacttattggccactcataggctaggtactgctccaagaattctccacacattatctctttttaatccccatgatatttccataatgt

SEQ ID NO: 24223 - DNA, 201 bp, Bos taurus
tttttcctgaacttggagaaaagtccatctgcaacaacagtcaatggagcatggagttcctacaacaaaaacaaagaccactcagctaaatggtgagaaatacacagtgaaaagactgttcttttaaagtgtacataagcaaatttaaacacattatgggacattacagagtacctggagataatgctctcatgaaggagc

SEQ ID NO: 24224 - DNA, 201 bp, Bos taurus
atattagcattccatattgtttcccagaggaaatggctctgaaaggttttttgtcctttttagcaaatattttgtagtggctgtgaaaataacttatttataaaaatcttttaaacgctagtcattatgacagcaaagtcaatctagtcctgtaactattgttaagtagttatgaatgtggaaataaattcgagctgtttt

SEQ ID NO: 24225 - DNA, 201 bp, Bos taurus
tctcatttatctttccatctcctgtgctttatacatagtaggtcctttatgaaacagcactgggcagagcagagagcaaaggtgatactctgagggtcgtcggaggaggaaggcagctcttgaatgtggatgaacagggggccacatgggccctgccgaggaaaggaaacgaacgcacagagtccactgcgttaaggagca

SEQ ID NO: 24226 - DNA, 201 bp, Bos taurus
ccagatgtagttcagcactgcctaaattcttgatggcttgacttccttcatcttataaaactgataattctctatgctgtttacatgtccttctttcccattaatccataaacttcaacagctgagaaaaaaatccttgttaatatttatttattcatcagccagcatagaacctgaacggcaaattctgacatgaataaa

SEQ ID NO: 24227 - DNA, 201 bp, Bos taurus
cagagcttatgaaactacaaatccttcaagaagagatcaaaggaaaggatactttgtgtcaacctcactctattgcagattagttttctcttctcttcctggggttggtttgcttataacttgaacaaggaaacattggcccctggagagagacagagatctcagtaaatgaagtcaaagggtaaataagatgaaaaaaca

SEQ ID NO: 24228 - DNA, 201 bp, Bos taurus
agacaatgctgggtgcttatcatacttaatcttctgaaggcgtatgagggtcaagtgtcactgttattgctacagatcagagaggttaagccatctgcatgatgtggcaaagtgaaacccaggtgtgcttgactccagagttaatggcagtcaggctcacaaacacaacccttttagaagataaatggggtgataaggttg

SEQ ID NO: 24229 - DNA, 201 bp, Bos taurus
accaaaggacaaccaaactacataatttgtccagaaccatgaatgtctcaccagaagtagctcagcgctccctgccaggccattcaagcagtacctttagaagctagggtgtgatggacttgcatcctctattttactggatgtttggaaacatgccatttttacagagctagaagctaggcctgcttgcaggatgggtgg

SEQ ID NO: 24230 - DNA, 201 bp, Bos taurus
tactgaatgtgcccgtgtctgtaattaagaaacagttcgctactctcctctccataactgcccacacttaatgggtgaagtccctgctctattgagatggaaagaatctctaaggggagaaaaagacaataatatttcacagcacacaatgaattgttgaggacgccatgtgaaatttgtgggtggaaagtgctggccaag

SEQ ID NO: 24231 - DNA, 201 bp, Bos taurus
tgcttttctctagcaagtaaacataatcttaaatctttattaacctattaaggcaatgtgtctaaagtgagggtacgggttagtgaaaaaacaggtcaataaggtgtctgctgagtgaagcctgaattagatcctgtgcattcatgaggcttagctgtagtgctgagaaagaaaagtgacggaggatccgagttccctggc

SEQ ID NO: 24232 - DNA, 201 bp, Bos taurus
ggggctgggtgactgttgtgtgtggcggtgacgtcatgacacgtgtagcagcattcctggcctctatactccagatgccagtatcacatctctcccccaactgtgacaaccaaaaatgtctctagatggtgccaaatgtcccctgtgggggtgttgccagaatcgtccccagctgagagccactgatttacagcgagaaat

SEQ ID NO: 24233 - DNA, 201 bp, Bos taurus
atcctcagatttcgctgtgagagtgaaatttgcaggcttttcccagtggagctcttgctggagatgtttgcaggccaggaaaattctttcttctctaatgcgaggcagatgccacttacctaaaggatgatgtgatgagagagacactgtggtcgggtttctgggatctactctgtatgcagagtggctggggacatctgg

SEQ ID NO: 24234 - DNA, 201 bp, Bos taurus
ggtggatgtattgggaaattaatggctttggggacctgcctccaaggaaggatgcagttggtggatgaacatcccagtgtccctggcctttggtgtgatgatcctgaagcatgttctgcagctgtttatcagcaggtgtcctgtctgaccgagccccagatgactcatcaagaaccctttgctggccttcctcccttccct

SEQ ID NO: 24235 - DNA, 201 bp, Bos taurus
gtttgttggactgaaatgatgtacttcagagtccattttggtgaatctaagactgaaagcccatggatggtggtgttggccacgacctgagagctgtgatggcgaacctgcgcctggactgtgtgttgatttcattcagtgtgaattcctgccccttcctgccctcctttcccccagtcttttgatcttttccttcccagg

SEQ ID NO: 24236 - DNA, 201 bp, Bos taurus
tgtcccatttcaccagagagtcattgatccctggaactgctgacaaatcacaactagaaaaaaattgctcctgacaatgagaactggaattcgattgctcatttcctggcccaggcagaaactaccttgattgctttccaaggagcctaccctccaaactgttttgggggaaaacaaggcaaacaaaatttaataacattt

SEQ ID NO: 24237 - DNA, 201 bp, Bos taurus
gggcaggtggtttgtgggcctgattttttaggtgtttatcatggggtgcccactagaacagctgctgggaaaaggcgccctcaaggccttcgttatacattagttcccaaacttcacagttcctgatattaaactgctttgattggagattatagtgtttcatttaaatttcaaatgacacatcgcaatgtacttttaggt

SEQ ID NO: 24238 - DNA, 201 bp, Bos taurus
taatgagccacaatgctggagaaaatatgtgagtagtttgtgaaataagctagggtcttaatagacgcaattcattgaggatttaattaatacttattttctccacattctactatctattaggagtctcctgaccctacggtagtacgtccacacattttggggtcttcactggagggttatatagaattcctattataa

SEQ ID NO: 24239 - DNA, 201 bp, Bos taurus
agtaactcaagagattgctccattctgcattgcgatgcaatcatacacacttcaacaattgggttccagccttgggaagcaaccacagtttgatgtttcttttttttcactcttggatacttttgactcttggatactcccctcaacctaaggatattcttttgaggcctccttatcttttagtaatatttaattccttgt

SEQ ID NO: 24240 - DNA, 201 bp, Bos taurus
ctcagactgcatatgctgtggggcaactaagcctgaaactgagcctgaactctctgcagtaccacaactagagagacgcctacatgccgcaacaagagcccgcgtgctgcagctaagacctgatgaagccaaatacattttttaaaaatcaaaaaagaaagataagcacctgtgaactgcagtctgataaattgcactttc

SEQ ID NO: 24241 - DNA, 201 bp, Bos taurus
gatttagagatgtcttttgttaggttcatgaggtgacttttggaataacttccattttcttgcccagataagtggggaggggagacacgctagagatggaatttaattgccagtggtcaatggtaataattaatcattctatgtaatgaattctccataaaaaccagaaagaagagggttcagcaagctaatggattaaca

SEQ ID NO: 24242 - DNA, 201 bp, Bos taurus
gagaaacatataatgcttagccccaaaaggtatggtaatgtttaaatgagttctacagggacttctctggtggcacagtggatggtaatcctcttagccaatgcaggggtcatgggtttgatccctggtctgggaagattccatatgtcagggagcaactgagtctatgagccaaaactactgagcccaggctctggagcc

SEQ ID NO: 24243 - DNA, 201 bp, Bos taurus
gaggaacatacaggctacagtatgtggggctgcagagttggacacaaattagtgggtcttcacacattctgttccatatgccttgaatccttttccctcctacttgtctcagtttacttttatttccctctagatggcaaatctgtttccacagagaaaccattgaaaactcatcaatgcgcatgcacggaaccatggttc

SEQ ID NO: 24244 - DNA, 201 bp, Bos taurus
agttatgatgaaaagagactgcttttagtcctagtaggtgaaagaatcaactaggtgtgaaatctaagcaaccagaacaaagatacacaggctggcagacatgggtggagtgagggagtttattttcaacatctctgtagggtcatttgtgtgtagatgtaatgcaaagttaacttcaaggaaaaaggacatagatttaaa

SEQ ID NO: 24245 - DNA, 201 bp, Bos taurus
caaaagaagacacctagtaagcaagacttccacaagactttgctgtggaaaggtgcattctaatacattcatattttaatgttccactattattatagaacactttactagatgattaccctttcattaattatcatatggaagaagaaacaaagttccttgacaaaacaaaatctgtgtaggacagctaaatttttgcaa

SEQ ID NO: 24246 - DNA, 201 bp, Bos taurus
gctctttgcatcaggtggccaaagtattggagcttcagtttaagcatcattccttccaaagaatattcagggttgatttcctttaggattgattcttggtggtggggggcaggggccgtgtgccaatttttaacaggttggggcagccaggaagtaggaagtaggaggggcagtctggcttcttgccctgagaaagggcac

SEQ ID NO: 24247 - DNA, 201 bp, Bos taurus
ctctatttcaaggtcagttgactagcaaccttaattccactaccttcattcacctttattatgtaatgtaagatatttacagctgccagagattagaacacgggtgttttagggaggtcattgttctgtctaccacactctctttaagaaatattatgcaaattgtttttcctggctctcgttgaaatctcaggcaggtca

SEQ ID NO: 24248 - DNA, 201 bp, Bos taurus
tgtacctacccccagcccagcccaggagactgcatctaactccagtgttttcttatgtctcacagtcacccctcatggaagtcagtggttgtgtcattagcgccctctgaggggtcttgacataggaagcactgttcattcaatggcacttgatgtcagaattctgagcctttaaaaatgttagctatgtttttttttttt

SEQ ID NO: 24249 - DNA, 201 bp, Bos taurus
cctggcaggagcttcctctgggcctctctacttccactgaggccatgctccacgccctctcattcccaaaccatttccgtcccacagctgacgtgtctgctggacaggcacaccagtggcccacactcgcttgccactctgccacctccttcctgtttggagctctagaaggccccccacacccctgcctccatggatact

SEQ ID NO: 24250 - DNA, 201 bp, Bos taurus
gacatatcaccagactatatccatcgcactggatcagtcacattcttctagtctcccctctgctcctttattcaaaacaggtctccttctcccatttgcatccctggatatggacagcgattattcctaacctctgtctccactgggtcttctctattattttctaactcatctcacatttttcctctgggatctctttta

SEQ ID NO: 24251 - DNA, 201 bp, Bos taurus
tgaggttgtggatccatcatcagctgtacccctgcgaaggtgcatcctgaggacggtcatgtcccgtgtgcaaaggcactggcctcgcctcatcccagcaccttgttcttgcttgtggtcagtggacaggttccctgagatgtgtaattcaacatcagatgagaaaaaaagtataaggacaggcccactagtttctgggct

SEQ ID NO: 24252 - DNA, 201 bp, Bos taurus
tttacatgtctagcctacatcaaacatgaggctgttgtctttcagctcatttccttcataataaagacgtgaaagcagcgtttcctgagttcactgtcacgcccagcgctggaggtaacgtgggaaaccttccccccattcttccttctttctcctcaagccgcctgcaatcttgtgacctagaatgttaggcggtataga

SEQ ID NO: 24253 - DNA, 201 bp, Bos taurus
tgctgcttggtatgtctagttgtttttgacaggacatgggacttttttttttttttaagtttgagtccttttttttggtgttgtattcatttacaaagtgcttgactcgctctgacctgttgttaagttacttgtatatcagctgaatgttttcaggcaagctattaagcttttttttttttttctcaaaggaaaatctga

SEQ ID NO: 24254 - DNA, 201 bp, Bos taurus
ttaatgttgttgctctgtgtataaatttccctaaaccatctattggttttgaatgttgaatggtactctaaggcatatatttttctgggccttgattttcctggttaggattctgttgtaagataggtctttgttgaggcaagtaacaatagttcaccatttcaataagggagtggcctttcggggttctcccaaatttga

SEQ ID NO: 24255 - DNA, 201 bp, Bos taurus
gaccttcttctgcctgctgcgacccccgcgcagggctcagagaagctcacctgatccacagattaaactcggcagcaacttccaggaaaattgtcgacagaggccagaggagcaccggcagcccagagaggccgaagttgtccggcctctgagaaccatgggctctgcagactgggtccgagcgctctgaggaggcccagc

SEQ ID NO: 24256 - DNA, 201 bp, Bos taurus
gggcagatgtctgttttctggtccctgcatgtccacaaactcccagtttatttggctacattagccactcccctaactaacagtcacctaagatgtcccatctgcagtggtttagaaaatatatcttaaatcaattttatcattttaagggcaatataaaatatatttaacaaaactagttcttatattactttatgtgga

SEQ ID NO: 24257 - DNA, 201 bp, Bos taurus
ataacaacgttatacagtcaacacgatactgtccactgcagacaagtgggcaattatcctaacgtaaagctcccaccaagcgttacttagggaattaaagtgttccagaatctggtaaagctatgtgaaatatttcctcttttacaaccctgattcaaataggattcaagcacattagcaatttgtcatcttgggcaagat

SEQ ID NO: 24258 - DNA, 201 bp, Bos taurus
ctaactttgtcctgagagaattcgtcacatttctttttctgaataatctctttaatgttcaaaaatcattactattcttccttgagttcccaaattcaccaccataccaacatttctaattaaagagtgacaattctgttcccatattttattaaacacacgtaccagtgcatgcagaaggatatgtatgtatgcacatgt

SEQ ID NO: 24259 - DNA, 201 bp, Bos taurus
caggctaaaaaaggctattgaaaagttgattcactcattgtgtggggccagatccaagtgtaattgcagtggagaaattagcattccattattgcagagcagttctgaaaaactgtgtcttggccaatttgtttctcaaatctgtgtaacattatcgaacgtgagtcaggcggtaatatttttcaggctatgcctacttag

SEQ ID NO: 24260 - DNA, 201 bp, Bos taurus
ttccagagagaccaggacagctcacatcaggcacttcgtcctgtgcttatccaattccagaaccctattggttttcactagtttctctctcgatccccacgtttcactatctgtagatgattactgaggaaatttgaccttagttttctgtcagaggtaacatattacatattttgggaagacattaaatttttctaagaa

SEQ ID NO: 24261 - DNA, 201 bp, Bos taurus
aaagcaaatgaccacaatgttgtcttgacataatgttgtttgactttgactttgcataaattagtagcctggtgacatttatggagaagatacttgggcaagtgtttctggagaattgcaatatccttttcactcgggagtttcatgttaagataaggtcttggctgtttctctactgtataaggcttcagatcatatatc

SEQ ID NO: 24262 - DNA, 201 bp, Bos taurus
attcacttacgtttcccacccgacccctgaagatactaagtgtttaacacctgttccaaaagttagggttgggagccatccagtgtaagcaacatcaactgacaaaaggcagcaggttctagttacaaagcgagagcaaactgaagcccagcacccaggtgagcagtggtttaaatcttaaagtaaattaattaattctca

SEQ ID NO: 24263 - DNA, 201 bp, Bos taurus
tcctagggctgagtaaacaacaagaaggatgctgttgctttcatctgagattaaaatgggtgtaagagcagcaaattcaggaaaagtcttcatacgctacagactgagaagttaattaggagtttgaaagggacccatgaggcttatctccatgtgtctcacggaagccttgctctttcttttggatttctttacagcgaa

SEQ ID NO: 24264 - DNA, 201 bp, Bos taurus
aagtagactcaggagagtaaattgatttttctagtgtcagagagggaagggccctgtgggaggacagggagggagtagcaggtcttagcccccactccagagctctggaagacacgtgcttacaagcctacaaccctgaaaaggagaactcaacaggtacaagtattaacaacaaatagactatgagtacaaggaatatat

SEQ ID NO: 24265 - DNA, 201 bp, Bos taurus
atagcggaggaaggcctccatgagagggcagtgaagcagagatgtgaagtgcatgaggataaatgtgcagagctctagatgaagagcattccaaacaatgtgaatgacaagtgcaaatggcctggggtcagagcatagctggtgtgctggaaaaacggcagacaggcctggagctggatgaagcaaggagagtgggaagga

SEQ ID NO: 24266 - DNA, 201 bp, Bos taurus
aatttcctgtggcaacaagtagaatttgtggggggaaaaaaagagatagaaaatttgcccagacagacctgaaaatagaaaagcctggtttagtgacttacgaacacacctttttgtaacttttgattatccttggtttgcatgtacattaatacatttcataacccatctgctgtaactggtggaaaagaagttcttcga

SEQ ID NO: 24267 - DNA, 201 bp, Bos taurus
aacaccattactcaaaagacaacttttttatttttccttcttcttttaaccagaaagttacattttggtataaaataaatgaattttcaaaaagctagagattaccagatagtttgaaatggcagattcagtctcaaaatctaaaccaaattaaaccctaattccaattgtcagtttccagagcaaatgaaaacaataaac

SEQ ID NO: 24268 - DNA, 201 bp, Bos taurus
gaattgctgacatagtccaacctcctcatcttaaataattcctggttcctgatgcaaagtccagcggtcttccattacactccactcaaattgtcactacctttggtaattattatgattttattgtttttcccagtctttaattatccaagtgagtttggtctgtaaaaattgaatcagaaagctaacaagaactgactt

SEQ ID NO: 24269 - DNA, 201 bp, Bos taurus
ctggagtggagtgagtgggagtggacacctaggctggaggtgccccagtttctctctagttgcctcacatgagcccgttgtactgggccgcagttggccccgtctgtgtatattgcctgtggtcttgccttgggtgttgtttctagactttaatcccctgaggcatgaaggcccagatgaccagactcccattatctgtga

SEQ ID NO: 24270 - DNA, 201 bp, Bos taurus
tgcccccaggatctttcatgaaatctgtctctggcacctgcctctcccttggtttctgtctctgctgcccccgagtgatgctaaatcagcaaacacaagcaccacgttccactccaacactctcattcccttaaaacctgctgcagatgacacctctgtgttcagctatcgtcatggcagatagttaattactccactctg

SEQ ID NO: 24271 - DNA, 201 bp, Bos taurus
ggttttccctgatgaagagctttaaggtgttcatggctgagaccaggcaggcgtcacaccccagaagttcgtagagtgccctgagcacagccactgccccttcacggtttgacaacatcagcctgtatcattcactcttccaggacccatttatgccctcaaccagccagctaccatctcggagaaagagaaaagcagaga

SEQ ID NO: 24272 - DNA, 201 bp, Bos taurus
acacaagcaaacactaatttactgatcactgacaggcagttaccataaggatatacaaccttacgtcttgaacaggatttcggttttcatggttgtagctgaaagctatgcactaattagcacatattaatggaatatgctcccccttcattagtgctaaaaatctggtagccttgctaaggtccacacacttatatacac

SEQ ID NO: 24273 - DNA, 201 bp, Bos taurus
ggagcgggtgtgataggagccctcagagccagaacctgagaggcggcaccactccgggatcacctttgcccctcgaggttgttagccctggagttctacatctcgaacacgctagtctatacgtcttctcacctgtcgtggaccccaatccgatcccagcctgtggtcgtggtgcacagtttggaatctgtgaatttggtt

SEQ ID NO: 24274 - DNA, 201 bp, Bos taurus
ggatgagagcaggatggagttggtggcagaaagggggtgtgtgacagcagcgccaaggagatgggggagcaggttgaggccacagggtggccttgaagacatgggtatagccttgatgtttgtgtgtggtgctcatgcttgtttgagtctgactcttttcaaccccatggactgcagcccaccaggctgctctgtccatga

SEQ ID NO: 24275 - DNA, 201 bp, Bos taurus
cccactagtaagagctgagggggtttagaaggcagtagctgatcctgtctgggctgcctctgtgctggcgaggctgaagcatcttatgttaacctgttcccaccacctaatgaggctcagacgaggagagtgtggcaggagagcttcccatcacgccactagctgggatttctacgcaggcagcctggtcgcagaagtcac

SEQ ID NO: 24276 - DNA, 201 bp, Bos taurus
gaacctcagatttgggatctcccttacaaatgagctacaattttatttttaataattacacttttgaaaaaagaggccccagatttgtcattagaattaatgtttgttatgacaaaactatcatagcagactctatcacttaatatttgaaaactaattatttgataaattctccagttgtaaacagtgtgtctgcattac

SEQ ID NO: 24277 - DNA, 201 bp, Bos taurus
ggaggcctggggacaaggcctgagcagaccgggtctagcagcaagtctgctacagctaatcccccggtatcctgtctggccaccaggatggaaaccgccttgactctccaggcatccctagaggctgctttccctctgcaatctgattcttctacaagcggagggccaagtctctgagagcaggagccaggaaatacgggg

SEQ ID NO: 24278 - DNA, 201 bp, Bos taurus
ctcatctgagaagagcgctatttctcaagcaactgttttccagcagaaatctggccattctaagaaaacgttaacaaactcataaagacacttgcaatttgatttatgttcagtgtaatctggccttgtagttcttgtaattatctaaatattaaagaataagatatgtcattgagaaacattattaattatatatttaag

SEQ ID NO: 24279 - DNA, 201 bp, Bos taurus
gggtctgaccgacaatgaggcttctccctttaactgcttctgtaaatgtcctctttcaagtctgattcatttcactttcatccagaaattacactgcagatggtattactaattactcattttgttcataaattgactgcttctgggaaaattttaatataaatataatatataatgtaaatatataatagaaaacaaaac

SEQ ID NO: 24280 - DNA, 201 bp, Bos taurus
cacgttccaacagtgaaccagaaatttgcacatggtaaactctaagggaaaaaataagctacaatatgtgtgatgataaattattaagtagaatttgcccgtatcaaaatcatgcaatatgacattgacttttgagctgctcatgaaaaagtcttgttataactattcaaaagcatatttaccttgggaaaggaggggggt

SEQ ID NO: 24281 - DNA, 201 bp, Bos taurus
tgtggcccctagacaggagagcttgctgcagtgggatgctaggagaagcaggggaagggccaccaagggcagaaagcccaccatgaagaatcctggccagcccgcttgcaagattcctcaaggactttccctgctgtcccagaagaaactgttaacaagtttaaaggtcactcaggccacaaggatccttggcctaggtca

SEQ ID NO: 24282 - DNA, 201 bp, Bos taurus
gagattcaaagaggcatttgggccaggaaggaacttagaattggaaagacaaccatgtaccaaagaaataactgtagaacagcacagaaatcatcacaatgggaggccagggagtataagtgcctgcgtggagagcttcagcctgagaacaattgtcctgcagacctgagatcaaaaggtgtgatttgcttgcacaacaga

SEQ ID NO: 24283 - DNA, 201 bp, Bos taurus
accttgaatacccttttgctagtaactgatggattcagtggttagtaggagagaagttttgactaagtctgtagcccacccacaattgaaaataggaagtgttaatcctccaaatgtgaaggattttaatttattaagttttggaaaaacaacaaagagcataactttttaagatttactaatcaagtgaggaactaaaga

SEQ ID NO: 24284 - DNA, 201 bp, Bos taurus
agcagaaagcatctgtttgggatcagagaattaacttggggcacacggatttgggtagcaacccagtgtcccaatagaagtaaaagttgggggcttttaacggcaaagaagataaatgtgcattaaaaagaattttaattggagttaaagatggaggttagccttggctaaacatgattgattgctaagactattactaga

SEQ ID NO: 24285 - DNA, 201 bp, Bos taurus
gacctcaagagtaataacagccacagagcaactactatgctctttaaaacagatggtaaaaaaaaaaatcacaatcaactgtgtttttgataaaaataacgtgcataaaatatgtgaaatttgactcagttttccctttaagtatagggatcttaggatcttgatcctaaggatcttggaaacctggacttgttactaaag

SEQ ID NO: 24286 - DNA, 201 bp, Bos taurus
gactttcgtttctgtgagaaacacgaggcagaagcggaaaaaaccgcacccagttggcctgagacttgtagggaccatacacgcataaactcagacatcgaccagctacatctgacctgacagctgtccatcagacttcaggtgaccttcttttcaccccttcgaagtaagtcatacgctgcaaaacttccacaagaaaag

SEQ ID NO: 24287 - DNA, 201 bp, Bos taurus
acagttagatgtcagccccacctcccacctgccactcgaccttggccatgagtcagcctccccccttggccctctgcatttcaccagccaagtggtgacaattgtgatcacctgtcttcctcacctgatctttagagctttcacgggtctcattttcagagagtgtttccacatccttgacagggcatcgctaccctacgt

SEQ ID NO: 24288 - DNA, 201 bp, Bos taurus
acaagctttctgattaagtcaggccccaccgaagtcatctcccctttgagtaactcaaagccaactgatttggggtttctaatcgtacctgcgagtccctttcagcttggccacgtctgctggccagcagccatgggtctccctcgtggctagcaggtggagattgtggggtcaccttagaattctgcctcctacaagatg

SEQ ID NO: 24289 - DNA, 201 bp, Bos taurus
gacagggatgtatcagccggcagtggacttcccgcaggaccgaagccgctcacagggagggtgggctggaccactgcagaggtcatcgaagaacactatgtggccttttaaatgccaagcaaaattagatcttggggacaacagggtcagacctcttcccgggcatcttgcggttaccctgaacctgtgttttcattagta

SEQ ID NO: 24290 - DNA, 201 bp, Bos taurus
aagtcccatgtttttctgactctgctttggggcaagaatgtacatatgtgagccctacccttagatctgtagttccttgtggccttcctacaattgtttggcaggagtcgcatgtcccccagaagcctgttgtgaatggacgcgtcatttggagggccacaggtcacatgaagcactttgccaccacgcgttagaccagac

SEQ ID NO: 24291 - DNA, 201 bp, Bos taurus
tggcagggcaccttgaccaacagtgaactggtgtcaaatggggaaaacgagaaagtgtctattataccagaggccccatttgagaaaccatgagatcagacagtagccaagaaatcagagatttcacggaaggcgttaattttctgacctagaagaagggctcttgattagagctctggatttttgaagtctgcaaataat

SEQ ID NO: 24292 - DNA, 201 bp, Bos taurus
ggaaattgaaaatcggtcaggctacttactccttaattctgatttagagcagccataaaactcaaaatatacctgctcagtgccctagcactgaaaaggcgtctatgcagtcctctagaaatgagaataaaggcctgtgttctggatcaagtggcctcagggtttcaggaagagcccgggactatttttctttcagtgggg

SEQ ID NO: 24293 - DNA, 201 bp, Bos taurus
acagtaaattaccagcacaaataactctattctgaccattgttattgattgtgatttttaggcatttttctagttaaatctgtgaggtggtgttagagaaggaggcgatttcagatcattttgaccaaataaatcactagcattctcatgatatacagggcttctaagtgaatttaaaaaggcaagtttcataaccaagag

SEQ ID NO: 24294 - DNA, 201 bp, Bos taurus
gctgaatgtgattaaaggagatagaaacttccagctctttcctctgggaatgttcttatgagccagaactagaaatatcctccttgtgccttgactaataaaagaggaatgggtaataactcattaatttgtagcagacaaggatcaaagcaagagggaaatgttgagataaaactttccagagcctgggcatttaaatgc

SEQ ID NO: 24295 - DNA, 201 bp, Bos taurus
taattttatcagtaataatcctctctcacttggcccttaaattcctgaagattctcacagttgagttaaaagcacgagctgtagaattttaaatctaacaggtcctattagtgagatgttattttctctgggatcattttttttttttaactatccctgggacttccctggtggtccagtggttaagactttgccttccaa

SEQ ID NO: 24296 - DNA, 201 bp, Bos taurus
cagcagacagccgtggaagtgtttctgaagggagtctttgtatcatcactctgaaaaaggaaaattactgtgtttgatccaaaaagaaccttatctgagcgcacttcctctaatgtgctctatctaccttgtaggtgcatagtacaggcagaagatgtaaatcttggcagctcagggcagagggtcttacctgctagccta

SEQ ID NO: 24297 - DNA, 201 bp, Bos taurus
gggctgtgagaatgaagaagctgagctgaggggctgttttgaggcaggagggctggttgacggatgtgggttagtggttggggtgctccacccagggcccctccactcctctgagctcaccgaggtcactgttctctggggtcttgtctgacacactgccctatagggtcaaggccaacaggagctcagccaacaatgtaa

SEQ ID NO: 24298 - DNA, 201 bp, Bos taurus
atatgtattatataatcatagtaggtctagatatagagactatactatatataatatagtacacatagctatcttataactggcataattcaatatgtgatatggacagttgacaatcatcagacaaagcactatatatgtatatgtgcgtatagacatagatacagattactgtatctgcagggtatattttaccttata

SEQ ID NO: 24299 - DNA, 201 bp, Bos taurus
ttaggctcattgagggatcttataaaattataaccctgttttccatagcaccctgcgtagtttccactgggttgggaggtagtccatgaccaaggtcttttggaatgtagtagtaatgtctccagagaaatgaggcagagcatctttttaatgagttcaaagacacatgaatggagaaatttttaaaagttcagacagaga

SEQ ID NO: 24300 - DNA, 201 bp, Bos taurus
tatcacaaaacaaaggcttaaaataaccaaatttatttcgttaacagctttgtaggtttgaagtcacttatagttctcactggcctaaaacctaggtaccgccagacttggttcctttatggcgactccagggcagaatttgttccattgctttttccagtttctagaggccatccatattctctggcttgtgccctcctc

SEQ ID NO: 24301 - DNA, 201 bp, Bos taurus
aggccccttgccacctggatcagactgtaatgatttggacttgatctatccctttacctttagaaaccccctactttatttttcactaaatcatcaaaagcctcatgtacattattatgaataccaaacagagaggtgatttattattactttgcatttattttgtattttccttcaagtacctaaaggggttttacaaaa

SEQ ID NO: 24302 - DNA, 201 bp, Bos taurus
tggtagaagccagcaaaccatttgttttccattttgactgtctacacgagtgcttctcctatacataagggcaataaatccccaaagcccagagtaatgcgatgctgttgccgttgtgcatttttatggtcattgtagaggaaacaacttatttccatattcattgattcatttgaagcccagggtgccagtgggactctt

SEQ ID NO: 24303 - DNA, 201 bp, Bos taurus
aactcaaactgttcagcctagactaattgatccatcattaaaagagtggcaactagacatcaccacctccagaggcgatgcaacaagaagacatggcaccgtctatgaaatatcttggactaactgatcttggactgaaagtgtaaaaatacaataacagagtaagttaaacttcaccacaaggaagtaatcaagcaatct

SEQ ID NO: 24304 - DNA, 201 bp, Bos taurus
tttttttcattttcagaaatgagatctattatttcaattttaaaagactatctttttcacttgatatcgtcattgttaattcctccaattgtcagctcttgtcatcacatttttggatcagctgttaagtcacatcagcctactgtgctccagccaggcccctgcctcttttgccctctcaggttctcacttccatgagcc

SEQ ID NO: 24305 - DNA, 201 bp, Bos taurus
tctcatagtcaaatgtttatttaatactgacagtatcaagcactgttctagatcttgtcatataaatgtggggtacttgagggttttttcctaaagcagaagtgttgatgaccttgtagacttcaggaggaattgaattttgttgaaggactttataccatgctgaggacttgcaaatttgtatactcacgctggaccttt

SEQ ID NO: 24306 - DNA, 201 bp, Bos taurus
taacgattagtgaggttttgtgaaatgacagatagcattcttggattatattcaatttaaaattacaattaaagaaattaaaaatcacttaactccacatttggtgtcaaacctggggcttaacgggtttcccacgcgtctgagaattcattagcgttccttctcctttgttctttctcgtgtcttgacttcatgcttagt

SEQ ID NO: 24307 - DNA, 201 bp, Bos taurus
atggagtttaggaattaagtcactgggtgacatgctaccatcttttgctgaagaccaaactcaaatcctgctctcatttaagtggccttttccagttactttagtgttctatgaactctctaaactgtgactttattttctatccttctcacaaaatccattatgtattccactagattgtacaattcatggggccaggcc

SEQ ID NO: 24308 - DNA, 201 bp, Bos taurus
gtgtgtggtttgtcttctcattctcttaacactgttttttgcagagcagaagttttaaatttaaatgaagtgcagcttatctgacatttctttcatgggtcatatttttggtattggatctaaaaacccattgccttctttcatttctaatattagtaatttgtgtccactctctttttttattagttgttctggctagag

SEQ ID NO: 24309 - DNA, 201 bp, Bos taurus
cagagcatgttacttgagcttccttaattttttttccagtatggacaaatattcattttaaaaatccctttagaaaatataatctaaaatccagtcctcattaacttcacttagattcacatcatggattaactgaaatgaaatatcaaccctctgttattgagtatatatggaagtacttttctttactgcagtgaatta

SEQ ID NO: 24310 - DNA, 201 bp, Bos taurus
ataaatgagtagagaagtaagtcaatcaataaacaagacaacttaagattgcaggtgcaatgaaaaaacactacagagcaatgaccccaagagtgacttctgaaaatggtaagtaaggtggttggaagagacctttgaggaaggatgtttgagctgacacctgaataataaagagtttatcaggtgaagatctgaaaggac

SEQ ID NO: 24311 - DNA, 201 bp, Bos taurus
ataagtaaacacgtagaagcttcctagaaaaaaacaatacgtaaggcggggggcggggggtggggatggtgggctcctggcctttgaaatccacctaaggcgatactaagtgaagtctcctacctgaagtccaccgccctcgccagtggaggaaggcaacgtgtttaaacaggatttgcttgtattaataggcacttctat

SEQ ID NO: 24312 - DNA, 201 bp, Bos taurus
catgtatatatcactagcttccccaattatcaactcgtggcatacatatccttttccatgttatttttgggaaaatcccagacactgtattattctatccgtaaatatttcagtacgtatctctaaagataaccacagtattattaccaaacctaaaattagccgtaattcattaatattatcaaatatctcatcagcatt

SEQ ID NO: 24313 - DNA, 201 bp, Bos taurus
tttttgttcatgagctggcttcaaatatttgaaagcctgtcatggggaagagggattaaacttgttccacaaatctccagagtagaaccaagactaatgactaaaagacacaaaagacagcttttagctctatatagaaaataattttctgacattcagagtcgtcctaatgttgggctgcctcggtgtagcacattccct

SEQ ID NO: 24314 - DNA, 201 bp, Bos taurus
gcttatctggaagcaaacagtggaaaagaatctaaatacataaaataactatagaacacaaaagacattaaagacatttccctttggtgaaaaatcagtgcataaaatttaaaagagtggaccaacagagaatacttggtttctaatgatacatgcagttcgtctttatgctacaccttccatgaaataaacaggtaaaca

SEQ ID NO: 24315 - DNA, 201 bp, Bos taurus
ttaatctggtataatcttttttcttccctcagtagggtacagggagccctctagcctccaagcctgtttcctactgaggtacatattggccagcatacagctgctcagaacaactatttgcatctacaatggggtcatcccaccacgttcttttcagatcaatatgattggtacaaacaatagtttgattttgattgctct

SEQ ID NO: 24316 - DNA, 201 bp, Bos taurus
tttttgtcctttttacaggggatggggaagtagagaaagaacaacagagatgtgtttgttttcaactctgtcttgctacacagactctgaatttatatgatgttgtcttctaaaatacattggaaagtatctgtatttaagtctgttattagtagacagtgatttttttaaaaatgtagctaattattggacaaaaacaca

SEQ ID NO: 24317 - DNA, 201 bp, Bos taurus
ggttgcatacactagccctttctgtctctataatcaggttcctagtggaaagaaaaagaaggaagttagaggctaggatgagtggcttcagaggtaagaaagaggacatagatgataataatgaacaagctccttgattttagcaaatctaactactggaagaaaggataaacatccttcattaagaaaattcggagactt

SEQ ID NO: 24318 - DNA, 201 bp, Bos taurus
ttctagctaggagagtataactgggtctggacttgtcttcctgctataaataatcaaaactggacaaaaatatatgggcctgctttcagccattgagtaacagccctgcaggactgcgatcccagagaacaactgccctggctttctgcctggaggcactttcctacctggcatgcagggcattgactgagtcagggccac

SEQ ID NO: 24319 - DNA, 201 bp, Bos taurus
atacaatggccttctgtttataatatcagtaggtatcctgctccagaagttccaaggtcttaaaaaacagaaaacaaccatttcagttggtttatgtggagaaccattagttacactgatttttaacttcactatttttaagatgatctagaaatgcctagccacttattggatatattctaagttgaaaactccataggt

SEQ ID NO: 24320 - DNA, 201 bp, Bos taurus
gaaaccttttccccctaaagttaagcaaagtttgaagagctacagttctctcctcggtgaccttgtaaatccgtcccaggttgttggccagtctggtcatttcatctcgaccagctgctgtcttcatgtcaagggggatttggagcattccatgggtcaggagaaggtaatatattctgggccatttctaatccatgaaaa

SEQ ID NO: 24321 - DNA, 201 bp, Bos taurus
attttatcacacaaatcagcgccatcataatagctatcattcattggcttagtatacccagttcttttaggcatattatctgtgttcactaggacaatgatttgttttttaaacagatgaggaacctgaaattcaagagtgtttaactgagttgtctaaagttacctgactaataagtggccgagctataaaatgaatcca

SEQ ID NO: 24322 - DNA, 201 bp, Bos taurus
tttctttctacccaactgtgtgttttcagtgaactaaaatgtcagcttccccaccctaccccctgtatcctgttgacagaagagtatgtttttgtactttgctatactgttctctcaaaatagtgagggaggctcagtaaagtcacctggggaataccactgggttaatttgaaaaaatctcagattctgagctttcactg

SEQ ID NO: 24323 - DNA, 201 bp, Bos taurus
gtctcatcataaactacttattcgggagcaaacagtcactgtagtcacttggtattaaaaggtacaactcacagctgctgttcacatccccaccccaagacatttagcttatcagatttcaagcctccccttaataccaccataagagaggaaaatctagtagtacgaagagcacataggtggaaataagtattcctaccg

SEQ ID NO: 24324 - DNA, 201 bp, Bos taurus
gtcttagttctgagcctgggcctcaagaggcttatgtgctcctgctcttttggaaagtttagagcttgaagaattgagtcatcccaactaaaccaccctctacctggttgactgtatacttatgagcaagcccagctgagatcatctgagtccaggctggaccaaaagaacccacccagctggacctagcctaaattgcca

SEQ ID NO: 24325 - DNA, 201 bp, Bos taurus
tggttcgactccggctcgaaggagacaaatgtacttttgtcgagcctcctctgatttatcatcctttccacgcaggggtttccctgataatccattacgtcccagaaaacaggtgagagctctttcgcggcagctttggtctatggcagcctcctgggtgtgaaatcttttgcgaatcccagaatcagggacatgaagtcc

SEQ ID NO: 24326 - DNA, 201 bp, Bos taurus
taaacatgatcagcaaggatgatttctcttgttttactaacactgatagagttctaatgtctgagtcaggcttgtaggttacataagtcaccaaccatgcgggtgctcaagcagttgtaaatcctgcagctgtctatacctgcacctcccagagccacagaacacactggtattttacaagtgaggtgcagactgcactgc

SEQ ID NO: 24327 - DNA, 201 bp, Bos taurus
ttcactggtcttgggcttttctatattatagatattaacttggaggttcacttaagatttgatttcaggtaccaagatgcccttgatctatgagtggttccctcagtgaagcagatggattagatgctgtgagggaggaagccacagctgcctgcaggtcagaccagctgaatccacttgagagaccttggtggggagaaa

SEQ ID NO: 24328 - DNA, 201 bp, Bos taurus
caatacaacactactgtagagcctcagtgtctattgctgtgcccagtgccaatctacagcctctctgtcacaccccagcgccttcttccctgttgccctgtgctctatgtcagagtggcttgtgtctgctcctggaggctcttgccccctggcttcagtttccactgagacttctctagagagaataagtacttgaattga

SEQ ID NO: 24329 - DNA, 201 bp, Bos taurus
acttgtagcgaccccatagacggcagcccaccaggctcctccatccatgggattttccaggcaagagtactggagtggagtgccactgccttctctgagaagtcatgcatagtaaaagccaaaataatgcatgaaatttcccaggtggtagcacctcacatccagagagggccagtgaattgctcaaatgcaggtacctgg

SEQ ID NO: 24330 - DNA, 201 bp, Bos taurus
gtttggcgtatggttcctcaaactcagaaaccccaacacatgccttttaattgtggctgtgtgtcttccgtttatcatatttttctaggaaattattctgcaaactatactgcactagcacacacaaaaaaagtgaacatacttatccaggtacttcaattatgttactattgcacaaaagagttaaatatcactgctcaa

SEQ ID NO: 24331 - DNA, 201 bp, Bos taurus
aaatatgtaacaaagtattacacttctctttgagtcagtaatataactctttaatatttttgattgatttatgctggaaattttctctttgaaatgatcagaacatatttaaaattataagttacaagtaagagattttaaattattttatgcattgttaaaagcaagatgaatgagagaaaaattgaagcaagcttgaag

SEQ ID NO: 24332 - DNA, 201 bp, Bos taurus
tttcagttgcaaacattagtgcttaaaactgagtatgaactacctagaaagaaaagcaaataactgtgttatcagtgccatcatgtattatgtttcagtacatctgtgttttcaggaaagagcatttaagttttaaaattaacattttttttcagaatgttaatataatagtctattttcttacttaaaaccagaaattct

SEQ ID NO: 24333 - DNA, 201 bp, Bos taurus
caagtgacagaaaaccactgaaatagcaaagactacagaatggtttctttaagtctaatgtttgcctgcctattaactggaaaacggtatttaccagattaacaagttattcatttttttgtttttaatctttctaattcacttggatattttatcagaccactcagtatttggtcgaacactaatttaggttgccacttt

SEQ ID NO: 24334 - DNA, 201 bp, Bos taurus
aaagtgaattctcaaaatagcctattcttgaactgacagaaataactttactctgaacgttttaaaaaaaatctgaattgatagtctatgaaaaatggccgctgcccatgttcacaggctctgagcaggggaggtgctctcctgttctcttctagcagcacagagtatggtcatctcgaccttcacatccatcatcacaag

SEQ ID NO: 24335 - DNA, 201 bp, Bos taurus
taaatatcccactgcaggaccgagtgctcccatgacatacatgatggctgggaagacagaaaaggaaatgtgaaatataacctcatgctatctctttcagcagttgtctaatttcagtcataccacgcttacgtcacagttacatccagttaacaatttccaaaaacagagaactttagagagttctctaaattgggcttt

SEQ ID NO: 24336 - DNA, 201 bp, Bos taurus
gactgtggggagtagagactggccgagaccctcagtgggcatctgcgcaacaacaggtgtggcaaggtccaagacggacagctgacaggatgcagcagacgtgaggccaaaggatgcaagtaagtaaaactgatgaaggaaggggttcagttgggaacagaaaggaggccaagggttagatgaggaagaaaagccagggaa

SEQ ID NO: 24337 - DNA, 201 bp, Bos taurus
ttgctgaatctgtcaatcaatcacacctccaataacaatcaatcacatccaataactgtaggtcccttgagtcagaggctccaggcccccgtcatttctccacgagcatcattcaggttacccaggaatcaggatttccaaccatgaagaggttggcccatcagtcattcacagcagttagaactcagccgcgttcatttc

SEQ ID NO: 24338 - DNA, 201 bp, Bos taurus
gatcatagtttgttttgtacatgagtagcaatgttttctttgtaatgatagccagaactttgacactgcacaggtatttctcttgaggctgtgcaagtgtgtgtattcttatttatttccccatctgaactgaatgataaatcaaccacgtggactaagtgtaatcctggcaatttagaaagccctgtattcctagtgctg

SEQ ID NO: 24339 - DNA, 201 bp, Bos taurus
tggagaagacatcagtcttttgtaagtctgagatttttcaatttaacatgaaatctttggcttcttgggactcttctccaggggactgtaaagggcactggtgtcactatgtaatttcttcaacaagagcttgtcttggagcatcgcagtggctgggaatgaagaaacttctgtttcagttccaacctcaccagcagcttc

SEQ ID NO: 24340 - DNA, 201 bp, Bos taurus
tggactgtagcctgccaggcttctttgtccatggaattctccaggcaagaatactggagtagattgccatttctttttccagggttttggtattatacccgctgccaagtccaaggtcttaaagattcacccctacgtttacctctaatagtttcatggttctggatattatatttaacgcataagtcacttaggcatttt

SEQ ID NO: 24341 - DNA, 201 bp, Bos taurus
gtggatgctgaaataggggatgcattttaatttcccatttaccctcacctatctttttcaaatctcagctactattttttagcggattgcttagtgtgtgttgtgcttagtcactcagtcatgtccaactctttgcaaccccatggactataacccgccaggctcctctgttcatggagattctccaggcaagagtactgg

SEQ ID NO: 24342 - DNA, 201 bp, Bos taurus
aaccagaggcaggatgtttcccccaaacccggcccccagcctggagagaacctacttttcccactcagcacctctagcttgggagcttataaagggctaacgaagaagctctataggccaacataccttggttctgtttccagcgccctcactaaagggctgcttggtgacctcaggcaaattacttacctactctgatcc

SEQ ID NO: 24343 - DNA, 201 bp, Bos taurus
tttttgcaaggccatctgatagggagcaatggccccaaggagatattccacccaaagtccacagatttacagtcacatacatgtttattttagggggaaataaccccaaatttagtcaatatgatagtataattaaaatttgaaattactgtcaagaaatgcaaggtataattggataaatgtttagtgttaaaacaattg

SEQ ID NO: 24344 - DNA, 201 bp, Bos taurus
actgttataggatgaaggagtatattattaattcaacaaaatagcatctacaatacttacattctgtgtcttttatcttaatattggggtttatgggtaccttgtccttttttgttgttgttattcattaagttaggtctgactcttttggctcctctgtccaagggatttcctaagcaagaatactggagtaggttgcca

SEQ ID NO: 24345 - DNA, 201 bp, Bos taurus
cacatcaagttcaaatttggatccaaatagggtcctgatgacaggattagcataaagaagatcattttttcaaaacatttaggtacaattggagaatgaggtgatgcattttgatgatttgtgttaatagggagacgttcggggctggactataatattctcttccttctctcccttctctacatctctttaaagtcacct

SEQ ID NO: 24346 - DNA, 201 bp, Bos taurus
catttgtgcttggcagcccaggtataggagcaaacagacaacattgtgaagtcagttgtgctgagcaggtgtggcagcagttcaaagcccaggcagtcatggagtctggaaaaagaatgagccaaccaagttcgaaagcagtgtttctaaacagagatctaaatacagctatataatcacagagctaatgaatgactcatc

SEQ ID NO: 24347 - DNA, 201 bp, Bos taurus
ctagttccctgaccagggatcaaacctagaacccctgcattgggaactcaaagtcttagccactggaccaccaggaaagtccctataattttttgagatgaggatatatcattttcaaagacttaggatgattaagtcatggatcactcagagtttttaccttataagataaaataatggagatttgtcaaggctactcag

SEQ ID NO: 24348 - DNA, 201 bp, Bos taurus
ttaaaagcgtgcaggccctgcacacactctaatttttatcagcaaccctgccctggaacaactgccataaaacacttcaccaaatcctcccaggttgggacatacagttttgaggggtaggaggccgctgtccccctttgcctggcaaaccaataaagccattttttttctactacacccaaaaatctgtctctgagattt

SEQ ID NO: 24349 - DNA, 201 bp, Bos taurus
ggtatggaaaaaacagatagctggcttcaacttgagtagattttcattgttttgttttatgcctaatagatacaaagagcaattcttctctagaatagattgggcttttcttctgttttgctcctataccatacttaccctttatgacattaaaattttagttagtcacctgcctacatttttgtttaatttgtgtctttt

SEQ ID NO: 24350 - DNA, 201 bp, Bos taurus
gcctgggccctgtggcagaggttcctttgtccttatttccatggtgtccctacaacagtgcccttgaagtcaagtgagtaacccaggaaggacattgaatacaccaggtatccagggggccaaaccacagtggcgatttgtcgatgcaaactcagacttgtcggcagtttacactgactgctctttcatcttccaccatgc

SEQ ID NO: 24351 - DNA, 201 bp, Bos taurus
atgggaaggggatagcgccaggggattggctggcgggctaggcgcccgggcgggggaggggcaagtgagggcacagtgaatggcgctgtccctaccttcgctcgcatagagctctccggcctccaccagaccccactgtctaccttgatcacttaggaaacgctgctcgggttctgacccgaaccacggttgttatttttt

SEQ ID NO: 24352 - DNA, 201 bp, Bos taurus
gaagtctccctttgcaaatcttattttatggcaccataggaagctttacagtgatcactccagcactgcttcactttcttacaaaaggctatgtcattcgcttgtaccatgaggccagaacagacacttacaaagccattacttacagtgttgtactttcggaaaaaagtacagtatttcaccagaatgatgtgaagattc

SEQ ID NO: 24353 - DNA, 201 bp, Bos taurus
cataagactgagactgatgggaactaagcaatgatttaaaggagagttgtaacctatattttagagcgatcattggccatgttagaatggatgaaagggcgttgagttagaggggggacaactgagtcttgtggtaacctagatgaaggccatagcagcaggggtgaagtgaggggcagaaggtggagatttcaaggaggc

SEQ ID NO: 24354 - DNA, 201 bp, Bos taurus
agcaccgttttttttttttttttttttggctacagactcttcagaagtgtcagttggggtttttggtccctttgtctctcttgggttcagaatttgcccccactgctagttagttttagtcccatatagtttctctgtattttgttgctggagaagagatgtgtccaggtccaagcactgcagcaaagggttccaggtccc

SEQ ID NO: 24355 - DNA, 201 bp, Bos taurus
cacagacttcaggcttggtctgtcctctctcgctgtctggtttcaaggctttcacacctccctctgacaccctccctcctgggccccggccagtcagccctacctccaccctctgtccttaagcatctgccagaccagatgtgcacaggtgcagcctatgagccccctgcagcctggcctccaggccacacaccaccctct

SEQ ID NO: 24356 - DNA, 201 bp, Bos taurus
aatcctaagtctctttccagatgggccatcccttcatccatgtccttgggcacattccatggcttctgttctctctcttccccaccctttgaagactgcaaggatctagagtggagtagggggcccccatcttttttccaggcttgctaacttcactgtgattctgtctcatcctgttgttgtaagcaacacctccaaatc

SEQ ID NO: 24357 - DNA, 201 bp, Bos taurus
aacagctctgctccatagagagaaaggccaatgcagcgggtttgtataacccagcctgtgtcgctgccttcaaggagtttaccatctggctgctttagcatgggaagtcggcctttggagcacaagctgcctcagggctgtggtgctagtaggccggggaggagccaaccctgagggaggctgtggtgatggggggcttct

SEQ ID NO: 24358 - DNA, 201 bp, Bos taurus
tactagcagcccttcctcttgggccatatcatcaggcagatcctttggtgttagtgtttggtgtaggtggtgagaaaagatgcaatgtgaagactgtggtaaggcccagtggagggatcacaatgcagggctctggagtgctgacacaaggccatagaatctgcagaagagaattatagaatttttgagaaacagttactt

SEQ ID NO: 24359 - DNA, 201 bp, Bos taurus
ctgatgtccccattaaatggattgcaatatgattttatcctttctttctgatttcaaattttgtgcttttgttttctctccttgtttatcgcctctttctgctttgtgtctatccgcttgtttctgatctgctgcctaaatttagtcttgcctttgtccctactcagtgtttctacaaagtcagttcttatgccaatgtat

SEQ ID NO: 24360 - DNA, 201 bp, Bos taurus
gttacgtgactgattgggttgttcatattccacatgtttggcatgtataagcagactctggttatgttttcagatagggaaatgcaatgtgttacatgtgctctcttgggaccccaaaactaatggtgtcaaatggatttttctcatttgatccccatgaagacagtttaatttcactcatttttctagtcccacaaaaat

SEQ ID NO: 24361 - DNA, 201 bp, Bos taurus
tccatgtataaattgatgcaggaaggaaaggcagaagaaaatatgcaggaatgaaaacaaatatttgaatgcagtgaagtagttctaagccaaaatatgtcgaggtatagtgatttttaaaaagatcttcaacttgcagaatactttacaacattccctgccaaaaattccaggtatgcatcagggtcttttatcatttta

SEQ ID NO: 24362 - DNA, 201 bp, Bos taurus
atggagagaggactcatatctgcctcaataaaatgagacctaaatttggctcactaggaatcttatttctaaacaataattaaaagaatggggtgattttcttatttttgttggaaggctgatttattgatactagcattttctcattcagcatccaattgattttaagactctgtgtcacttaaacttttatgggtattt

SEQ ID NO: 24363 - DNA, 201 bp, Bos taurus
gcacacaggcaatcactatgatgggaaagtggaccaaggggaaaatccaaaggacatctgagtctgtcctgtcctagctgttactcaatgtgctgagatagtgtgacatcaagccttctctcatgtgttcagccatccaggcttttcccagacgtcctaatgaattgtatcactgcccattactacacattcctgctcact

SEQ ID NO: 24364 - DNA, 201 bp, Bos taurus
tttgtctctatgaaaaatattttgttttcacattggaaaaaaaagacccatatattcattccaacagctttacggaggcttggccacccagtgagtgacaagttacacacatcagtcacttgtcaggtcattgcatgactctttcacagatccagatcacatcagggccaaacatctttccttaagattagatgtaaaagg

SEQ ID NO: 24365 - DNA, 201 bp, Bos taurus
cattggattgcagagttggacatgacccagcgacttcactttcacttttcagaatgggtaccaagtgtgaagataacttttgtcattagcaaatgccccggaaagtcctctgctgtagaggaagcttcaataaccaggctaacgagctcctcaccgtgctatgaggaacatcacctagacaagtaagtttcctggtttttt

SEQ ID NO: 24366 - DNA, 201 bp, Bos taurus
ggccccaccaattcaaatttagggtaacttgcatgaaatcgagaggcagggactacacaggctgtctttattaggagttgggttatatgagctctgggccggctcccattctctgtggctatccaggcaagccatctcacctatttagcatggctgggtagaccaaggaaagcactgacaactgggtgcttttcatggcta

SEQ ID NO: 24367 - DNA, 201 bp, Bos taurus
gccacccaattggaaacgaggcaagattcctatctcccatccatggcttgagaaaagggataaaatgatagaaaaatgcactgtatttaaaatatcagtatagaagaagaaagaacattcttctactgttccactttaaagagatgcacttttattttttttaatgaatttttatttatttaatgtaaagcaatgaagtat

SEQ ID NO: 24368 - DNA, 201 bp, Bos taurus
gtcagtggctgaagtttctatgccactaagattcacaaaaacttgagattaatatattgaaatagatgctggtggatacaaactatttgaaacacaaggtcctgaatttaatacaatatcagaggtatttctaattttgaaggacaaggcaaaaatgaaagttttaaaagaatttgtaaaagtttactacagcttaataat

SEQ ID NO: 24369 - DNA, 201 bp, Bos taurus
agacattcagttcactatcagatataagcatccatttcaggtacaactggttttatgggctgttacctttggtgttaatattcatacatcgggaaagcacatttatttcaagagaacagataatcatggacatttctccaagtattgaatgtccctgaacttgggaagtttctattattctggaaaatgacttaggaacac

SEQ ID NO: 24370 - DNA, 201 bp, Bos taurus
aaaagctttagagttaatgttttaagatattgctattacatgagaagtgaggcaataaaaagtaattattttaggacagttttatcagcaatttacaacatgccacatactggctgtttgcaggtatttctgtactcatgctcacactctgtttcttagtatcagaaagaacctttccttctgatcaatgagtgggttgtg

SEQ ID NO: 24371 - DNA, 201 bp, Bos taurus
tttgaagggatatcatattatgagccttattagtgtgctcatgtgtctcagactagccagccctccttactgcagactctggacagactttgaaagaatacgctatagtttcagataattacttataataagaccaggcagacaatgaagctccaaaccaaaaatacaaaatcagcaagaaaaatttatacagtattttcc

SEQ ID NO: 24372 - DNA, 201 bp, Bos taurus
ttatgaatgctcatttagtttataaaagattataatctgattactgttttcctgtcaaagctcatgtaacaccaggtaacatgtaaaagctttactcctgaagtttctcagcattcaaaagtgtttcactgttacctgtacctttcagtgatatagcaattgttttataaactccgggattaaaacggtgcaaggtaggcc

SEQ ID NO: 24373 - DNA, 201 bp, Bos taurus
aaatgaggtgatgaactaagacttctgagcttatctgtaatttaaaaattaaagaacagagagttgaacagatttttcagaactggcaatatttttacacgtgagagaggtagtctatacttttctgggtggaaggaaattctgtgaatcattaagttaaaatcaaattgggaaaaaggtcgattgagggattcatttttc

SEQ ID NO: 24374 - DNA, 201 bp, Bos taurus
gggtatcttcctgactcagggatcaaacccaggtctcgtgcattgcaggcagattcttttctgtctgagccaccagggaagccccagttatctgccaaatccatttcctaaacaactacctgagtgaaaggttaaatggcaatatgatatcccacttaatcacattgcaatttctttatatatctattactctctccatac

SEQ ID NO: 24375 - DNA, 201 bp, Bos taurus
aagagtactagagtggggtgccattgccttctccaagtctcttacacagtttatgtcaaattggtattataatattcttcggtagaatttccttttgtttgatgttattatcttggcttgtgatttcctttgtggaatttgagaaataacatttaaatctctttaatttaaaattcataattgccaatattaatttttgta

SEQ ID NO: 24376 - DNA, 201 bp, Bos taurus
gaattttgtgagtggtaggatgcagagcacattgtcagaaaccagcagtggtactatcaaaacgtggattaattagtctctgtccaaaactacggtaaatgatgttctccttcagagaaagacattatgattcagctccttgtggatgatgtttaaatagctgatttctgtgtaggatcctttaattctatcaaagtacag

SEQ ID NO: 24377 - DNA, 201 bp, Bos taurus
gtactaaacctgcttttagctttaattttttattcaaaagttaaatgggaaacatgaaatagtttggatcaaatatcacaacaaatgaaaaacgtgcagcggatgattcttttaaatgcattattcttatgtcctgggccagacgactttgtcagacaatcctgtttatgtctgttggaaaagagaatatttcttatatat

SEQ ID NO: 24378 - DNA, 201 bp, Bos taurus
acaaattaaaatagcatacaagatagattaaggtgacaggcaaaataatagttttgcatatagttgtcctctagccaagcattgataaaatcctgaaaagttacaagtcaggtaggtatatatatgttgggatttatttctatatgtgcttccattaatattcaaattacatttattaggtaaatttcctttcatattatg

SEQ ID NO: 24379 - DNA, 201 bp, Bos taurus
aatttgtgccaatgagagcagcaaacgaaaatgtcagagaaatgtatgcttccgcactacttactgttcctctgaagcattttcaattttactcctaaaactgactcattaatgctgttctcaggactaattattcattcaaccactggttcacaaatagtcaatgaataattactacatagtaggaactatgcttagtga

SEQ ID NO: 24380 - DNA, 201 bp, Bos taurus
actttgattttgccctggtgagacctgtcctagacttatggtctctagaactgtgagataaaagacttaaggatgttgcttaggccactaactttgtgagcatttgttacagtagcaaaaacaaaaacaaaaaaaaaaacccaacaaacaaaccattcaggggccattatcgaaatagagacttcatagcaattttctgac

SEQ ID NO: 24381 - DNA, 201 bp, Bos taurus
ggtatctggaaataatattagaatggaaaagatatgaaatagtccttgggagaatgaaataataaaattattattaggtagcactaaggagtcatctgacatttaaagtcataaatttaaaataagactgatcagggactcccctggctgtccagtggttaagacttcacctttcaatacagagggtgcagtttcgatccc

SEQ ID NO: 24382 - DNA, 201 bp, Bos taurus
acacgactgagcgactgatctgatctgatgctattttacagctttccctagtagctaagtggtaattaatctgcctgagatgcagaagcagcaggaaaagcaggttccatccatgggtcaggaagatctggaagagggcatggcaacccaatccagtattcttgcctggagaatcccatggacagaggggactagtaggct

SEQ ID NO: 24383 - DNA, 201 bp, Bos taurus
aaattaaaagcaaacaaaaaaactgtgtccagcatttgctgtctacaagtgatttactttagatttaaggacatacatgggctgagagtgaaaggatattctaaacaaatggtaatcaaaagagtagggattgccttacttacattagacaaaatcagttttaaataaaaactctgacaagacaaagtacattacataatg

SEQ ID NO: 24384 - DNA, 201 bp, Bos taurus
tgttttagtctatggaaaaatgaattcattcatcgttcatttgttcttgttatgtattcatgcaacggatcagtcaaaaggtatttattgaatgcgttagtgcaatgcattacactgtattttgattttcatattgagttatattttggtagatattcaccaccaccaaaagatttcagacagttttaggtaggtttaggt

SEQ ID NO: 24385 - DNA, 201 bp, Bos taurus
ttctccacatgtgagcacttgctgaccaccgggatatgaactgtcctaatactgatgcttttatcgacccatttgacacttatgatgcttgcagaaatgatgaagcaaaaactaacgcatcactaagagaagtgggacatgtgggaattggtatgttgcagctcactaagtcttaaggcattaagcctaaggattaaccca

SEQ ID NO: 24386 - DNA, 201 bp, Bos taurus
attattcattctaaaaatatgctgagtcaaaggaacatgaaatttgaagggatagaaaaagagggctagacttccctgatgctcaactggaaatttcttctggtgtcagaacatggctgtgtagcaactttaatcccggtggattttgaaaaaatacaaggatcttcagattttagtagcccctgattactgcctttgctc

SEQ ID NO: 24387 - DNA, 201 bp, Bos taurus
ccaggactgccgcagggagctcattgaaagttaatggccttcctctgagtggaggctgagggcggcaagatagaacactcctgaccttccttccctctttcaaacccaggttaccagttaatgaccgtttaacctctcctgctccattctttctcagattcaaagtggtaatggtaatttcttttccctgtgattaaaaaa

SEQ ID NO: 24388 - DNA, 201 bp, Bos taurus
atgcagaaaatggtataataaatgcatctgccccatatggttaatgtgaacattaatggaatgtgagagagtgcatgttaagcattagcacagggcctggttcttgttagtcgtacctgctcttattgtcagttattcactttatattcccggtttcaacccagtgcctaatatataatagttgttcaacacatatttact

SEQ ID NO: 24389 - DNA, 201 bp, Bos taurus
tagcttccaggtgacagcctaaagtgcctagaactcagtttaatgattatgtgactttttaaattctcttttctttgttatgtatgatcttatcacttataagtgagcacataacaagtttattcagttttaaacaagataactaaaggagagtgcttctgaaagcagcaataagaaaaggtatgtgtgatttttattatt

SEQ ID NO: 24390 - DNA, 201 bp, Bos taurus
cttttagtgtctattgcagcgcctctagtatattctttaaaaaatatttctgttgtgattatgggttttgttttcgaaaacagtgaaaagataaatcatataaggaattaaggaattatggaattcttaaaaatgcaattattaattttggccagatcacaagtttacatggctacagagaccaggtaggtaatgtgcaga

SEQ ID NO: 24391 - DNA, 201 bp, Bos taurus
gggtagcagactaaggaggaattaacaaagtttgtttacaccactttcttagccttgaattccatggctgtactgatgagattgctttcgatactcctggattagggagcataccttcatgtgggagatttatttcctcctttcaaggggaaaaagttgggtcagagtgtggttgccttaataatttcccctaactgtctg

SEQ ID NO: 24392 - DNA, 201 bp, Bos taurus
tcatcactatgtgccatgtaagaaggaagaatagcaaagtagatgagattattctactcaaaatcacaccatgtgtccagcagcacctgggtccaaatgccttcagtgtgggttgatggaagaaatgcgagacagatcttcatgggcagactcttggcttaaaagtttttctaataaagcccattattttacccataccaa

SEQ ID NO: 24393 - DNA, 201 bp, Bos taurus
ccacagattcatttgttaccccacccagtgaccagtaacctgactctaacaatacaacttaactttatatttggagagaggattataattaagttcttactattataccagatttgtcatatattgatgtttttccttattaaagtactttaaaatatttcaaagtttatcttcattttttcatttttttaaaatttgaaa

SEQ ID NO: 24394 - DNA, 201 bp, Bos taurus
gactttgataatctatcactcaagcaccatgttaaatgagaagcttctataacaaccttttgttctggcttggtcactctttaggaaacaacatctaagtatctgcatttcttggtttcagttttcacctagtttctttggctttggccatcctctggtacctgcaagcatttaaagtataattatattttctgtgatttt

SEQ ID NO: 24395 - DNA, 201 bp, Bos taurus
actggagaacgttttgttaaaactcaaaaattatattgcaagtgtgacaaataatttaactggaacagaaatttctggaggccaaattgactatctttccgggaagccagggtgagtgaacattactggggatagtttatttctctggctctctcttatttctctggctctttccatttggccaaagtctgggaaagggca

SEQ ID NO: 24396 - DNA, 201 bp, Bos taurus
aaaagtcagacagtgtcatggccagacaactctcatatgtaaatatctgacaggaataataagggacactcttaacacatggaagtggtccagaattacatggctgaatttttctgaggccgtattttctgacccttatcattatttattaataccatgaactgaagtcatagagatgtcaggatcatcttttcctccttt

SEQ ID NO: 24397 - DNA, 201 bp, Bos taurus
ttctgaaagtggggctagacttttgaaattcaaaacccagaggaaaacccagagtttttttctctctgctgtctactctttctccaaggaagtgataaaattggaataacagaaggaccactgagtaaaagaaaatatcaggagaacacacacacattatacatgtatgtattatatatacattataatatatacattata

SEQ ID NO: 24398 - DNA, 201 bp, Bos taurus
aatactgaatccttttcaagaatgttcagttggttaccttttttctaacttggaaattttaaaatgaaaatagattcttgaggataccccaaagtagactgaaagtcttattttttcccctctaggctgatcaaatccctcaggcaaagctggtaaagaatcagataatgtatgtatagaggccatgaaatatcatggaga

SEQ ID NO: 24399 - DNA, 201 bp, Bos taurus
gtgttcagtaatttgatgagataaggatgaaactaagtctcagaattataagaagaaaaatgccacagcatttcactatagccacactctgcaggacttcaaaagtcaaaaaaccaagaacaagttagagaggattaatctttataacaatatcttatactagttaacacttcagtttcacaaaacatcatttaattcggt

SEQ ID NO: 24400 - DNA, 201 bp, Bos taurus
gtatctatgagttctcacagtaatttttatttcagtttggaaaacattacttgaagggcttccactggggcagagcctatgattaagccctgggaatatgaaaacaaatcactgtgagaagctcatagtcacatagcttgttttagtccagaagtgctcagtcctcaaaatatattgagggaaagcataatcccatcagtt

SEQ ID NO: 24401 - DNA, 201 bp, Bos taurus
caggggatcttctcgatctagggattgaatccgtgtctccagcattgcaggtggattctttgtcactgagccacctgggaagccccaaattgaagaatgcgcatattaaataaagagaaataactatgacataagtggaatacacacatgcaattgattaatacttttggaagaaactaatctctgtaagctttgtcttgg

SEQ ID NO: 24402 - DNA, 201 bp, Bos taurus
attaagctttttattggctctaagataataagcagcccttcagaatgaggaaacagaagttctacagatgacaaactttctggtactgaattctgaaacgaatttctccagtggggttttatataattgacatcaagacagttttctgaaaagcattttctagtaaatacagcagtaggttatataattgtctttaataaa

SEQ ID NO: 24403 - DNA, 201 bp, Bos taurus
ggtggcagggagggaaagggcccaccctggggaacttggggtacacagcagcattgccaggcaacgcccggaatcttaggccaggaggaacaccactcttcctggtacctccagtgctggttcctagtgtactttcggccacaatccgaattacttcacgagctgtgtatgttccagctttctagtgacagatgtcagaga

SEQ ID NO: 24404 - DNA, 201 bp, Bos taurus
gcaagtaaactgaggccaggagttcagatgatgctttcccactatgcccttagtcctccccaacacacccccttctcaggcagctgcaacactgctcagggttggtgcaggaagtcatcccttggggtcactcagatccacccagtttacacttagaaggggcaatgatcaccaagtggtagaattaggggccagctatca

SEQ ID NO: 24405 - DNA, 201 bp, Bos taurus
aaatcatgtaacaaagcactgcagaagtggaggtggggctgagggagaggggcaccaggaactgaggggagcctacataggaataggcagcaagaagctgaatcctcaggcctgcagatgaaagggaatgaattctgctaacaaccagagtgaactgagaagtgaattcttccccagtcaagcctcccaatgagaacacag

SEQ ID NO: 24406 - DNA, 201 bp, Bos taurus
atgatggaaatgaggctgaacaataagcaacaaaacgccacactgggaaaacctctgactatcatgttggggtctggaagggccagccttccccgtggcagtttgcaggacccaacagtcaggcttcaagggagacagagccccttcatcttcctggaagttcattcaaactgggttcatgcctgaggcaggccattcata

SEQ ID NO: 24407 - DNA, 201 bp, Bos taurus
agtgaagaaatgctggagaccagtggagtatatagactggttacttcaattatcacctcctggggttattataattatcagctcacaaggatctggcagtaagtcaggtaataggaatgaaaagaagcagacaattttaaagatattgtgaaggacagttagtcgcttcagtcatgtccgactctctatgaccccataggc

SEQ ID NO: 24408 - DNA, 201 bp, Bos taurus
tagaaataggtacagaatgtaattaaataacacagttttaacagacccataatttggtttgccatcttcaaaaatagttttaagcaaggagagatcataaaaagcctaacttaactcagtatattcctactagtcaaaattgatctgaaagttcattttctacttttcagtaatagaaaagaaataaaatgattaattttt

SEQ ID NO: 24409 - DNA, 201 bp, Bos taurus
agttagttgtggaagttccagtaggggatttcaggtagagagggaaacctgggaaactttgggagaccgctggaagttcatgattactcaagagaagtctcataactttgtggaatgaagcaggtttgcttaactataaagccataaataaaagtactagatatgccccagatcattaggtgaaagaaaaatatcaccacc

SEQ ID NO: 24410 - DNA, 201 bp, Bos taurus
ttgaatcagacatcagccaacttggggctgtgacataccagacaaatattgacagttgctaaggcaactgggataacttattgcccaaaggataatataggcgccaattgtgcatgccatgtttctcacataggggagagacagacatgaatgaaaaaatgtatttcatgatctctcttcaactgtggcttaaaaacaaca

SEQ ID NO: 24411 - DNA, 201 bp, Bos taurus
aaagaagaaaggtaatggtgtcagtcaggggagttgttttaacatctctttgaattaaatcaaaagaaaacaaggcagccaccacaaaaccagagaaaataccttcaaccaaattagtcaacaaaatatcctcatgaatttcagaatataagtggggcctaactagcaaaacccaaaatacctcatgtgatatcttttaaa

SEQ ID NO: 24412 - DNA, 201 bp, Bos taurus
gcacattttttcataacttaaccaggaacctaaggattttctttgtccctttaccattacatctaatggatgctaagttctggccaagcagtctcctaagcagctctcgcctttgcctcttccttttcagatccatggtcacacatggcttcagtctggcctcttattagctcaagcctgaccaaggtcagtagtaacctg

SEQ ID NO: 24413 - DNA, 201 bp, Bos taurus
catcaatggtcaatgaatgtttattattatgattacaatatgtcttggtactacctatcaggccaaaaatgtaaataaatccaagccactatttcttaagttatttctgactcaaaattagataacaggtccttaggttgctaccattacatctggagaagccagatttgccatcaaaatatcttgagaaaaccataccaa

SEQ ID NO: 24414 - DNA, 201 bp, Bos taurus
agtcttttccaactggtgaaaatacactggatcacagctggaaggtaagccaaactttgggtgttcctctctgactatttccacccaagggaagaactaccacgaaactgctgtttctctggctgatactgaggccctgtaggaattaaaatagtctaaggaaagtaaacagctgatggcgcaagtctcaagattaagctc

SEQ ID NO: 24415 - DNA, 201 bp, Bos taurus
acaaggcacatcttgcctgcttcattctctccctcccaggtgcgatctaaatcatctcctatgtcccatttttctttaagttctctgagtttggcagacacgaggattgagccctagatcataccttcaggtttatgaggacagtaatctgtcatcagcacctgcagtaccttttatcggcctccaactgcatgaattcct

SEQ ID NO: 24416 - DNA, 201 bp, Bos taurus
ttagttcactattggatgtatgtgattcactttggaccaaagagaaaaacccaagtttggaggaggattgagggaggaaacctatggtcaaccgagctgtatctattgctagatgtgaactagaagcttgtagctgtagtgccatgtggggacccaggcttaaggtgatgttatggatggtagaatggagaagtgaaaagg

SEQ ID NO: 24417 - DNA, 201 bp, Bos taurus
cattgcagctttggtgtgaattgttttaatatattgggttggccaaaaagttcatttgggcttttccaaaacatgggttttaacataatatggaaaaacctgaagaaacattttggccaacctgctattatctcccccaggataattgatgtggtgaaagaggaggtatctgcaaagcagctcatctcgtttacttaaaat

SEQ ID NO: 24418 - DNA, 201 bp, Bos taurus
ggggccaagatctatagtcagaaagctgggaccccaggacagccaatggtgtagtcccagtccaaacattggcaggctgaaaacccaagaagagctagtgctacagttcaagtgcaaaggccgggaaacaagccagcgtcccagctcaagacaagtcaggcaggaggggttcacttttacttgagggggggatgaaccttt

SEQ ID NO: 24419 - DNA, 201 bp, Bos taurus
ccctagccttctgccttcacctgttccactcctgtgcgtacggccacagtagtctcttcactctagcacaggtcctaacgagctttagaaaaccaccgaccaggaatgtctcggagcctttgtgatgggtcaccaaggcttgcagaatagtttctctgaaaacaattttatcttccttctttggcattagaaaccaaaaga

SEQ ID NO: 24420 - DNA, 201 bp, Bos taurus
gggtcccctgctctgaacttggcacttgatgtgtgtaacttaaactggaagttctttgaagacaggaactgtttaatcctcatctttccacatctgggcctgacttccttctcaggagtcccttcccaaagttttgcagagttgaaataaacttttctatatcactcagcatgctcttggggggacttatttgagctccag

SEQ ID NO: 24421 - DNA, 201 bp, Bos taurus
ttaaattcactcaaggagaattagaaggctctcaggggctctgagtgattccaacacccctacttttccttccccagtcgaaaatcgctatccttatgcggccatgtttgacgagaccatgatttaacaagtggaagttccaatttcagagagctgaataaagccagcttcttgaccctgccctgtctcagtcgtgattgg

SEQ ID NO: 24422 - DNA, 201 bp, Bos taurus
tggagaattctggctttcagtgtgagtaaaggaaagaagaggtaaagattggtttgaagggaataaagggaataacaggaataattgtgagtctaggtcagttccatattggtgactaagagaatatttaggagcctgggcctcatacatttaaaaagcaatttcccaccttaaattaataagaccaactggtgcacatca

SEQ ID NO: 24423 - DNA, 201 bp, Bos taurus
cagttgtgcccaagaagcaaacttaattcataggatgcttcagagatctaaaaaaagagatgaatttcaaggttgtatgctagtttgtgaactgagttcactttagttaaacatcactatatccgcatgtttcgtggggttctctctcttcctctttacctactctgaaatgaatcgacatgtcatctatgaataccgtag

SEQ ID NO: 24424 - DNA, 201 bp, Bos taurus
tccagctcattttgcctacaacagaatgatcttcacaatcatctcatagcccttaagggactccttttgctaatgttttcaattaacatcagagactgtgaacaagctggcctttcctggccctcccagtctgctctctcattgcttttcctttacagacttgatcattcacagtttactgcgctgtgtcccttcccacct

SEQ ID NO: 24425 - DNA, 201 bp, Bos taurus
agtgggccttgaggtcacctagcaccaccgaccctggcatctaagccagctgtggtctgagtctggtcttgttgccttgagccctcaggggttgggatccgcctgatgtccttgaaggcaggcctatcgtcaccatgttggtctagatctctaacatgattttttcccctggattttacatacacctgtaagggtgtctgt

SEQ ID NO: 24426 - DNA, 201 bp, Bos taurus
tcaatgttttccaggtagacaaagcagttgtgagtgaagagtgtttcaagaagagatagcaacatgtgaaatagcatagtggtgtgaatcagtattcattaaaaaaaaaataattcaatcacctttagtgagttcctactaattgccaggctctgcaccaatcatggaactgctgggattccattttgccctgcaggcagc

SEQ ID NO: 24427 - DNA, 201 bp, Bos taurus
tggcaatccactccagtattctggcctggagaatacaatggacagaggcggctgatgggctacagtccataaggtcacacagagtcggacacgactgaaacgactgagcacatgcgcactcagggccaccctcaaacaattaggttccagacatggccgaaaaatactccagttttctgtcactcactgggaaatatttga

SEQ ID NO: 24428 - DNA, 201 bp, Bos taurus
accgactgcctgatggacagacagacagagggatgattgcagcatgtgaagaaaaatgtaccagtggggttgtatgtatcgggcagtgggaacacaaggtgggaagcatcgacatttgtctgcaggaggtgaaacttaaattaactcccgcaaaatgagtcattctgcattacacagaaaaggaaggcatgagaagacata

SEQ ID NO: 24429 - DNA, 201 bp, Bos taurus
cagtgtagcatccaaaagcctctggcatttccagaaaagagttttccttgtcaggtcccatctacacactttaactgggcctgcacatggcagctgtacaatggcatgatagttgcatgtttgatcacctcaccctgcaagcccagggagtaccctcaccaaggaatgcagccaggtctgtcagatcccgttatctaggtg

SEQ ID NO: 24430 - DNA, 201 bp, Bos taurus
tgtttctctttctctgtaatgtacacatttgttgctgaaacagaatgaattcccaacacctcatcaaaagaaatatttgaatgtagaaaaataatcaatctctttggagttgataccatttgtttcacatagctcagaacttctttgcctagtctgaacctctataatgtcatcaggaaggaatcagacttccttaatcca

SEQ ID NO: 24431 - DNA, 201 bp, Bos taurus
agaatggtcttctcaccagtagtcaactgttaggctcactttacactatgacatccctcctggttcactccccaacaagggccagcatcctacatccctgtagaatgtgtgagaatgtcttgataccttccatactgcacagatggagtcctccctttgcataaacactgtccaccaaggattttgttctgagatggccac

SEQ ID NO: 24432 - DNA, 201 bp, Bos taurus
ccatggatttttgcagggttgggggagtgtctattcaatcccgtgcaagtcacaggccctacgatgatattgagaagaacaaagacacagttaccaagcccttgtatggttttgttcagctcccagtcacaaagctgtttataagtaccttgacccagccagtaatctacagtactttttccagctgtttgttttggcgtt

SEQ ID NO: 24433 - DNA, 201 bp, Bos taurus
gtaaaattcacctctgttggctttagaagcatatcctttcttttactgtaaaaaaaccttagcacatattccaaagaatttgaattttctagggtgaaacgtaaaattgtgtttattaacaaccttatactgataacaaacacatacatgcacacaaattcaccatctcttaagtctatttagaattcagaaaaacaagag

SEQ ID NO: 24434 - DNA, 201 bp, Bos taurus
agttctactgaaactaacttccacctgtgatagcattcactagaggtgttttgtaaagggtgatatataagcatgcagaataatcgttagataaactaacattgtaaaagaaaatatacatgacattaataatagtttaggttttaaattgttaaattgttctactagcaaaatgcattagtatgtgcatgccagttgact

SEQ ID NO: 24435 - DNA, 201 bp, Bos taurus
gggagaacttgtaaccatcccgtaacaggggatgaaaggagaaaaggagatttttctgttcctttcctagaaaataatctacacagatgagataaaagcatacacccttacaggctcccactgaaaattttattaaaaatggtggtttctttgttcctaatggttaccaaagaagaaccatccttcacttgtatgtcatga

SEQ ID NO: 24436 - DNA, 201 bp, Bos taurus
caatacttagcaagcaaagtaagttgcctctgctcagttagaacttcttttcaaatttcttgtccccctgaaccattttgtattttaaagtgctgtcgtggtggagttcagggataaagaaagagatgagctatttttctttttagttatattgccctccatctgattgtttcaggttgctgtgtattcagaatatagaca

SEQ ID NO: 24437 - DNA, 201 bp, Bos taurus
tttttcttttaatgtgattcaaatatatttttctagcaaaaatataattactgaacagtgaccccatagttgatgatgaaaagcatattgatgttgggggaaaaaataaccaccttgtgtactctctccacggtcagttgaaatcatgcacaattctgtttgagctaatagctccgaaatatgacccattatatcttttga

SEQ ID NO: 24438 - DNA, 201 bp, Bos taurus
ccgggccccgaggcctgtgctcgtgaggacggcggtcccgcaggcagtgacaggcctgcgccccgaccctcctgcctgacgtcctgggcccgcgtgtgcgcgcacacaccacacccgctccagcggcggtgggagctttaaataaacacaggcgaggggaagagagggcaataagcagcctgtgttctcacaccatacaca

SEQ ID NO: 24439 - DNA, 201 bp, Bos taurus
cttggaaatggggagcagcagagctagggtttctgcggagccacgttcatccacccccaggtctgagtcagggagggcaacaccgagggaggagaagacgacttgagtccagttgtcctctcctcaggtgcctggtaggaactgcgatgggaggtgggaactctgtccgtggtcttcgaggaatctcaggcaacagatgag

SEQ ID NO: 24440 - DNA, 201 bp, Bos taurus
acttgctatgtggaggatcttgggtgagataacttaatcgctctgaatctcagtgtcctctgctgtggaatagaggtaataatacatgccttatattgtcatttaaaaatgaacgcacttcagctgaagactactgggaaaacatctgtagttacacaggttgggtttattacttgttgcaccgaggagaacacacacttg

SEQ ID NO: 24441 - DNA, 201 bp, Bos taurus
ggctacagtccatagcattgcaaagagttggacatgtatgcgactttgcatacatggtccttagtctcgaggacttgaagtcttattagaggaaacacacgaggcagttttaagcattcatcagtaataacataagaaagtgtaagaatataatacataagaataatatacacgtatcaagggcctactgagtaatatact

SEQ ID NO: 24442 - DNA, 201 bp, Bos taurus
tgtatttctcgagggctgtgtgtcaaaaggagggtctccatgttagctttcatgagaatatgctacttgatagtggtgacagttggccagttagaggttataagataaatactcttatttttctagcatgtactgtatagaaaactggcaacgaaaccaaggaaacatatatattgccatatatattgggctggccaaaaa

SEQ ID NO: 24443 - DNA, 201 bp, Bos taurus
gtcactgatgcttctatcatgcagtaaacccagaaaattactatttgttgaaatttctcactgcttcaatttatgcagaaatataatacagttttatgagtctggagtatttctggttacgagagaagatggctatgtttgatttcaaggccatttggtcacatttctaacctgttaatttttttttccaattttttcact

SEQ ID NO: 24444 - DNA, 201 bp, Bos taurus
atatatacacacatgtgtgatacacacacataaagattacaattgttcccttccctttggttaaaaagagggtgtgttgaaagagatataaattgggagatggggagagagaggaaagagaaaatcaaaattggctcttagaaaggatctgataaattttcattgaactgttaacaatgaaatatatttagtgggtccgaa

SEQ ID NO: 24445 - DNA, 201 bp, Bos taurus
agctcactacccaaatctttgagaaaggttggcctggaaacataaggatatcactgtgaattttgatattcgtccagagtgatccagtcaggtatagtcagtggcccaaaggcacactgtactgaagtcctgcaccaggatccaagacccactgggaccctctttcatcctctagtcctcgtagttagaccctcttagttc

SEQ ID NO: 24446 - DNA, 201 bp, Bos taurus
taatgtttctgtggaccttgattttttgtttctgtcacatctgaagacaaatactatgactagcttagatttctcccacttagcaagggttgaggccacagaacttctagagtaattcatcatcagatatcactctcagcggaggaagtggtgatgctgatgattaagcagaaggcattcccctatcccaccccacctcca

SEQ ID NO: 24447 - DNA, 201 bp, Bos taurus
tctgatgaacaaagtttggagtcgaaatgatacttctcattggatcatttggccatgtctacatggatatctatagaccaggcccttcaaattgtctagatacaccaaggatgaatcaattgtgtgaacaccaagatggaatgttaactaaatggaagttttcatttaccagatgggggcttccctggtggctcagctggt

SEQ ID NO: 24448 - DNA, 201 bp, Bos taurus
tttgtaatccttatagttttcatatatcattaactatgggagtactcactaaactgttaaaaaatggtattcctaaggccttgttttaacttaacttaaataattatatttaggatatatacagactggaattctagctgtcaggtattatagggaagaagggaatcagtttattccaaaagactagctggtggtgttccc

SEQ ID NO: 24449 - DNA, 201 bp, Bos taurus
tttttccaatgtgggctaaattcagcttgtttcaaggataatctggcaaccatacctttctcctcacaccgttcattcaatatacagatctaatctgcctgcctttctttcactcaacctctgtgtgtgtgtgtgtgtgtgtgtgtgtgtgtgtgtatggtgggacaagaagactttttctcaactttctatcctgtaaat

SEQ ID NO: 24450 - DNA, 201 bp, Bos taurus
tttctgtatgctgacgcatctaaagttaacatgataatatttatcatcaagaaatatatctgattgctagtgaaactaggaagatttaacttggaaaagaggaataatttagaagtaaaggaagagtaattaaaatcaatcaattgtttgcttagcagaagaagagacaacagaaatagaagtgaaattaatgatacatta

SEQ ID NO: 24451 - DNA, 201 bp, Bos taurus
taaatgacatccaaagaatacaagtcctccccaggtcaggaaaccagagccctacaaccacaggcttttgtcaagggtctaccatgacttgcagtcttttcattcccatataaacctggctggtagttgtgtttaagaaagataatccaatcaaagtgtgttcagcaattccacataagcatatctatatgctaacctcag

SEQ ID NO: 24452 - DNA, 201 bp, Bos taurus
tttgcaaaacatatatgtgataagttaatatttaaaacatacaaagaactcatataacccaatggtgaataaatcaaataaaccatttaaaaatgggcaagggaactaaatcactaatcttcagggaaatacaaatcaaaaccacaaggaaatgtcacctcacacctgttaggtgactgttatcaaaagacaagaaatatc

SEQ ID NO: 24453 - DNA, 201 bp, Bos taurus
gttaagagttgaaccaagacctaaaaaataaaggagttaaggatactaaaatttagcagaaatgtgtcctaagaggagatggtgcaaaagacctagggcacacaaatttctgaactgtttgagaaccagcaataaagctgacctaactagaagagagtgagtgaagattgaatatctgagagttaataaggagtggagcag

SEQ ID NO: 24454 - DNA, 201 bp, Bos taurus
tcgtggatctcttgtgtatcatgggttttcccatgatagcctgaaaatgcattcagttcctagcctttcaaaaggaatattttaccacaccactaattacgaagtattttgttcaaggggtgagagcagttaaaatatccccatctgtttcaagaatctcattaaggtgcatctatactagttcactgagaaactatttca

SEQ ID NO: 24455 - DNA, 201 bp, Bos taurus
attgtgtttaacaatgaatattatataaagcaattggccataacataaacctattcaatttttctagacttaaaaatacctgaaactgattttgagtttctcagttcacctggctactattgtctgcaagacagacacaattgcttgctcagagcaaggaattttataaacatgagtgaaagcaccatcaaaatataatac

SEQ ID NO: 24456 - DNA, 201 bp, Bos taurus
ttgtttttctgtttaattctgtatatacaagcactatttaatagaacttatgatttatttgggttcaaacaaaagtagatcattgagacaggattaatatgcaaattcagaagtagtttcaggaaaaaaactcatggagagtgggagagtaaaacaacaaagatggcaatgggatattatttcaaataagtgtctactctg

SEQ ID NO: 24457 - DNA, 201 bp, Bos taurus
ttacattagagtcagagagagtaggaggaaccaggtacacagaataaaaatgagattcaattaggtagaaagaaatccaagaaactgagtcacagatgctcagtgaagaaatcatttcagagaggaagcagtttgactgttttgaatgctgttgaggtgttgattgaagaaaaataaggaaaagaaatatctttgggcttt

SEQ ID NO: 24458 - DNA, 201 bp, Bos taurus
atactaaattctgctgttcttgtttgatcatgcagcaagttcactttaagtacagactttataaattttaaatgtgagacagtatgtctccatgaatatcctttgcaagactcatgcatcaagctgctattaatcccagtaatggattctttttcttctgacatagctcttcagctttgccatctttctctgaccttctct

SEQ ID NO: 24459 - DNA, 201 bp, Bos taurus
catcatctctaattcatgaaacaatcctgcaaaggaggcattatattgtccacttcataagtgaaataacaaaacattgtctgagttaggttcatacagtcagaaaacaccagattaataaagcttttagaaagcagtaggggagacttcttttaaccccaaatctgtaattcattcattataccatggttaatcaatatt

SEQ ID NO: 24460 - DNA, 201 bp, Bos taurus
caagaaagacttagagattcataatataagaagaaaagataaattgaaagagaaaccttgaaacacataacagacaagcagtctagaaagagttcatatacatatataaattaaagacaagtgagacagaggcaaacagctcaataagaaaatggtaaagaataggaagagataataaagaggtgtaaatatctacgaaac

SEQ ID NO: 24461 - DNA, 201 bp, Bos taurus
ctcagtcactgaatggtgtccagctctttgcaaccctgtagactgtagtcgcaaggttcatctgtccatgggatttcccaggcacaaatatggaaatgggctgccatttctttctccagttttcttcctttagtcatcataaatacacctatttaactcagtgtaatcatctctaaaacttctctgaaaatgggtagcaac

SEQ ID NO: 24462 - DNA, 201 bp, Bos taurus
cccatccttgaattttcttcctcttgactgaatcatacttgtacacttcttaagtattctcaacccctaccatggggacctgacttcttatctaaatggtttatttgaaatatttttaaatgaactactctgtgcaaatacaatgaatagccatataaaaataaacaaatatcaataaaatcagaacaaaataaatatttc

SEQ ID NO: 24463 - DNA, 201 bp, Bos taurus
taatctatctcggataggggcaagaaaaaattttcagggctagtgtattgttttcatgtgataaatctcaaaaggttatgatatgctttctctcagtatctctttcatagctgttgatttgcagttcaggctttatcaatgtggtgtttctcaaaaatggggtcttttgcaaatcacaattacttgatgcactctataaaa

SEQ ID NO: 24464 - DNA, 201 bp, Bos taurus
ccagtagattaaaagaatgaaaaacagtactgtaggagaaaatagaaacttctaactgcctgaagggaatactagaccttggctatttaattgtataaggctataaacttttccttgtttaagccatgatgagttcagtttatgtcactaattaagtcctaattaacacatttgtgatctctttgtttaattctttcaaga

SEQ ID NO: 24465 - DNA, 201 bp, Bos taurus
accaaaccattctatcttggtgaattactctatcatttgtcttcatagggatggatggacacatgacctggagaaagccaatcataaagggcacttttccattactacaatttctggtagaggtatggactaatcagagacctttcctcatatttttctaattaaaatagaatggtagaactctcattcttttctaatttt

SEQ ID NO: 24466 - DNA, 201 bp, Bos taurus
aggcctggaatgtgagactgtagcaaagggccagtagctgaagataggcaaattacaaggtccaggggaagtaatggtgggtaatagctagaaaggcaagggtaacattataaatggccttatgtgacattctgtggatttgatttgctgatggtgagtatttgttaggcagaaagtacaggattagatttacatttggaa

SEQ ID NO: 24467 - DNA, 201 bp, Bos taurus
taacatggatgatattacatgtgcatgggttagttgtttgatctctcaagccagtaattaaagaaaaaaaaatgaactatttaaacaagtgacatatgtacatataattacccgacagtccaccgctatctgaaaatactaaaaacatcctcttagaggtaaagctgttattgtgtcttaaaacagtaaaatagcctttcc

SEQ ID NO: 24468 - DNA, 201 bp, Bos taurus
aagatgtctggaactcaaacaggaatctgcagccttaccatcctgaggacctggagggcaaagttaacacaatcccctggattgtgaaatgtaggtaatacatacacttaaaggagggaattgtagcgagatgctccaaaatctgtgcaaactcgctttagatcatgccaaattatacagaagtgtgggagatcccagcgg

SEQ ID NO: 24469 - DNA, 201 bp, Bos taurus
taacaagagcatcaacagcaatagcagtgacaactttgctaaatctatgtcaagcatagtacaagtgggagaatcacctataactttattacagttcttatgctgaatcccttaggtgtgcaacaagcaagaaggttaatgaaacaaaaaagtcttcctttgtttattacccaaaatacgtgattatgtgattatggctat

SEQ ID NO: 24470 - DNA, 201 bp, Bos taurus
ttataattaatacaagaaacactgataacataattgcccatgaaagaaggaatgaactgtaagtccttaaatataaattatatcacacatattagcatggctgtaaacagctttaaaccttttataacatgttatgagacaaaagatgtctctcatcaaggatgattctcaaggtattcaggagactattaacaaaaagcc

SEQ ID NO: 24471 - DNA, 201 bp, Bos taurus
tgatatattaaaagaaagctttaattaactacatgaatggtttatttgattttattttacatttgtggaaaaaaaacactagaaaactagaatttaaatcctcatataaaatctactaatgtctctgttgctttgtaaggattgcttcaagggaaatgttgaatttagttaacaagtctgtactacttatgtaaattagag

SEQ ID NO: 24472 - DNA, 201 bp, Bos taurus
tttggtacaaattctaaaacaatctgtaaaagagcttttgaaatcctaaaattgagatctattacctgatttttcccaccccacaccaaatggtagctttctttgtattcagacgattcattcaacacagttattgatttacaagtgctttggaaacattccctaattgatctttcctaattaatgtacgatatagctatg

SEQ ID NO: 24473 - DNA, 201 bp, Bos taurus
tatctgtttcaggagcgactaatgatgagaagctcagtcatagattagctcccagattactggttttttttcccagggtgaaaatgacatggccattgctcagtaagcaagaggattaacagcaataacattcaactcaaatttctcatttggagtatgagtataatgcttcctcgatgctccagtaaaatttttattttt

SEQ ID NO: 24474 - DNA, 201 bp, Bos taurus
atagcttttcatactgagagtcgatatgactttttaaaataattcttatgttatctacactgaaaaatgtatttatcttccttgtattgtgaatagagaatttagaaagcagactgagtctacttaaaactaattatccagatataaagtgaaagatcccttcatttattctggcatttatagacatctgatattttaaat

SEQ ID NO: 24475 - DNA, 201 bp, Bos taurus
agtcatacatagatattgcccccatgtttctaaaagccagcattcaataaacttcatctccataacctggatgagttgaaatattgtatcatttttactggccatgttctaatgtcctgttgggaatagtttttatgtacttcataacaaaacttacagatccctggcattcaagaaaagagatccttaatcatttcaagg

SEQ ID NO: 24476 - DNA, 201 bp, Bos taurus
tagatacagaaagaaacaattttgtggtcatgaaagccagaaatccaggctagagaaagaagtggtggtggaagggtgtaaagatgaaggaggtaagaaggaaagatggattgctaacctcaagctactctcctggccatctcctgattatgaggctcagaagcatccaatcacaaaggataaatttggacttaactttag

SEQ ID NO: 24477 - DNA, 201 bp, Bos taurus
tattcaggtcccaccaatgtaattacactgtgtagagaaaatatgctctggaatatatacagtgatgcagggctcttttttcaagtcaaccaaattaatgcgtactgactaaaaatccatttttatattcttttgaaccagtgaaaaaagtataaacagatcatataattaaaagtagaatgcagtgatttttgaactcaa

SEQ ID NO: 24478 - DNA, 201 bp, Bos taurus
cacctcgctgcctgcttcaacaataaaggaaatcaatgcttgtgttgcacgaaccttgagtgttctgtgtcatcagtaatttctgtctatactgcctacctttcaaatcctgaactcaggagttttataattaaccttgactcagaataagacagccacacaaatgtcgtttgatattactgattatttcgggataaagag

SEQ ID NO: 24479 - DNA, 201 bp, Bos taurus
ccaatttacaagaaaagatttttcccaaagggataggctgacctttccaagttgagctgttcagaaaggagaaaaaaaaaatgcaatacactcagatgccgggcgtttctggcatttgtggcagaagaaaaaggaagtctgtgatttgtgtttgtcttaggccctgccttagtcgtggttgggtctgatacattttttctc

SEQ ID NO: 24480 - DNA, 201 bp, Bos taurus
aagaattagtctgtggttataactaaagattaaaaagataaagtatttatctagaggagtttcccaatttcatgaccacaaaggaactctataggcaaattattattgtaacactgctctttgattccattttctcttatagaaaaacaattagactcaaaaatggtcattttaaaagaacctaccactcagagaaagaag

SEQ ID NO: 24481 - DNA, 201 bp, Bos taurus
atggctaattggaagagaaaaaacatccacaacccacatggcctgatcacatcaaaacacgccatctgtcactcctatgctcttagtcaccaccccagcccacaaaagtctctccatcatcaatgaacttatatttgtttgttgattactgatcattattatctgtttattctgatagccttcattttcggtacaaagatg

SEQ ID NO: 24482 - DNA, 201 bp, Bos taurus
tcatctccctcctttatctggaatgacctctttccgctcagtctctttaatgtggcccaaacctccagctccaggaaatcctcactgatctctcctttgacttttctcgtactctatggttgaaatggagcaggtgagatgggttaaaatcttggctttgacacaactggcagatcaactttgtattcctatgcctccaag

SEQ ID NO: 24483 - DNA, 201 bp, Bos taurus
tggcatttagaaggtacccagagctgccaaatcaataaaggaataaagtgagggaaactctcagatcttcttggagaaagagggatttgaaatgccttctcacaaggcaacttcttggaggtggtgccttcataggagtaggggaacttgatgataacaatataatgataaataagggaacaaggggaaaaagaagaaagt

SEQ ID NO: 24484 - DNA, 201 bp, Bos taurus
gtacctgcctgatgaactcaaatttagtcatctgaatgccaatcctactggctgtacttaggagcatatttaaatgggtgaatgcaaaactcttactgaaggcacttatttattaaagcataggtgcgaatctaaatatggggtaggatggcaatggttcagatttgcggggggacagggaggcatggctcagctgctgac

SEQ ID NO: 24485 - DNA, 201 bp, Bos taurus
caagcacaaatgaccatatactctgtttctatcatcttattttgaccccaagttctaagggttctaagcatatgctggaaggttggcaggtttcatccacgtcttctagttcaggtgctcgtcttctgagtgtagaggacttttatcatatagggcagttccccatcaacacccttttctagcaagaaaccagagatcatt

SEQ ID NO: 24486 - DNA, 201 bp, Bos taurus
gagtttatctaaaacaaatattaaaagtaattattaacacttcaacctaatcacagctatagttgtgatactcttttttatttctcacacaatatattcagtaaacatctttttaagtcttttatttttctgtgtaattatagtgtatttcttctggcatcttatttgaatcctaagtatatcctaatatacattcagcaa

SEQ ID NO: 24487 - DNA, 201 bp, Bos taurus
cccccctattaaataaaccaacaggtcacatagtctgtcttgaatatgtagccttatatcctgttgctctgtcttcacgtgtcatgggtgtcagagatggtaaactcctagaggacaagcgctgcagtccgtgccgacatgcattagcaccactggaagatgaaaataaatgtagtatccacagtagttccgaggattcca

SEQ ID NO: 24488 - DNA, 201 bp, Bos taurus
tctttcacgatgttctgaaactgagattgtgcattaatttgagctacttcttctgagcaagtgaatgtcttatagataattgactcaattaaagaaaaaatattttcacttttttgttatagaaaatttaaaacacaccatacaatccacctggctgagtcctttttctcaggtgaaatacagggcattagactagtactt

SEQ ID NO: 24489 - DNA, 201 bp, Bos taurus
ttttcctctcctttactcctttctgttttccactgagttcttttcagcaggtatccagagcccgtgatcagaaagtatttgtgccaacatcaccacctctgtctttgggggtaaagtattttgaatttagtaaccacagataatttaaggagccaacaagcagtgggaggaaactgttcttaaaaatgaattcccaaaggg

SEQ ID NO: 24490 - DNA, 201 bp, Bos taurus
atacatttgggaagatgccccaaaactggctctgaaggctcctctcagggtaagccagctctgagctgcctgcttcttctcgggtccaagccctaggcccaaggagttctgcatcctgaccttgggcagaagggtcatcgatcagtgcggcgcagagtgacagcgacagctaggcagacgggtctggctctcgaagcatgg

SEQ ID NO: 24491 - DNA, 201 bp, Bos taurus
agagaattaactcaaatttaattgggagtgaaataagagaggacgctgaaagcttgggcttttatggtggttagtagatgaagccagagttggggtttagggttttgctactcagacaaaaatggagtttttgtctttgttacagcctcactggacagaaggagcagttgaggagagacctatcctttcaaccttttttat

SEQ ID NO: 24492 - DNA, 201 bp, Bos taurus
tcacaagagactagctgtcactataagtcaatatatgagacttagacttcccaatctcattcctcaacttttctggtcttgtaactgaataagatgagagacaaggtgggcagtggggcatagaatgtattggtcatcataagtgctggaactgttacattactggtctcttgatgtgacagatttagttcttggagatca

SEQ ID NO: 24493 - DNA, 201 bp, Bos taurus
gtttgctcagttcctaaagctagattttagctttggctgtgactagtatgccagttctccccttatcttgcagtgtcagctgtacacccacccctttcctggcactcttgcttaggataactctttcctttctgaactttcacaaccagtctaatacttactgtgtacctctcaaactggcctacttcctccctaagtagg

SEQ ID NO: 24494 - DNA, 201 bp, Bos taurus
ggaaatgctcagtgagggcagagggcctggaagaggagacaagagtgtattcctcaagcagatgccagaatgacaatcatactacgcatcctgaagcctacttcagaggcctctaacacccctaaacctgtacccttaataccaccccatcctcataagcatgctcacatacatacacacacacacacacacacacacaca

SEQ ID NO: 24495 - DNA, 201 bp, Bos taurus
aggctacctaacctactgaccatctgtcaagtctctgcctcaccgccaccaaaaaaaagatacatggggtgaggagatgaatttaatagaaggttttaaatttacatcttaaatatagaagggcatgtgcacatgtgctcagtcgtttcagtcgtgtccgactctttgtgaccccgtggactgtagtctgccaggctcctc

SEQ ID NO: 24496 - DNA, 201 bp, Bos taurus
tacatccctcactttcccacaaagactaacaatggacctggagcacatagaaattttatcaaaagaggagagttcagacatcagctagtatggatgggacccactgtattggaaaaatacagtgtattggaaaaatactgaatggggaaaggaaaagtcaattcgcaaaaaaaaagagagagagagagagacttttgaaat

SEQ ID NO: 24497 - DNA, 201 bp, Bos taurus
agatacagatatttttaaagggcctcaatataggcttatgaagggttaattaaaaagaacttagagataagttttcttcttttatgaactgtatagtacttctatgtgtaaaactctgttctgggccaaaagattaagaaaatatgtaagataaagcaccagcatttaatgagttattgtaccccattgcccaagtgaagc

SEQ ID NO: 24498 - DNA, 201 bp, Bos taurus
tgcagctcctcctggcaggcctgctggatggaattgatgatctcaggcaccttggccacccagctgaacaatggtgagatcaagggccaggtggtggctcgttgtcccgggctcccgcttactcccactgcctgccctaggggtggcggggagtcaggggccagcttggggtgcagcagggcggggcatggctcccctggc

SEQ ID NO: 24499 - DNA, 201 bp, Bos taurus
ggacagaggagcctggtgggctaccgtccattgggtcacacagagtcggacatgactgaagcaatacagcacgcttgcatgcatgcagtgatgaagaaagcaagaaaaaactgagcatggtgattcgtctcctatcaccctttgcagtttatgaaagacttcggtatatattactaattctcacaccaagtccatgacaaa

SEQ ID NO: 24500 - DNA, 201 bp, Bos taurus
caatgtaagaacaaataaattcaattaagaaaggagatgccatgctcctcctttgtaaagattcctgatcagatctgcagctgttacaaaatgacagctttgagatgtgcagttacagctgtgcttcttcctaaatgctgctagtatcaggttggcttgcaggaggcattcttagaagggcaacattaggacaccacctcc

SEQ ID NO: 24501 - DNA, 201 bp, Bos taurus
gagatgtgactggcccaaggtcacatggctggtaagttaagggcaccagagtagtgttctaattctatacccagcagataagcagtagggctgaatcaacatgcttatccctggccctttgtcttaaacatgctactatcattctgggaactaagtacttagttaatataatttgatttaacatttagaacagcattactc

SEQ ID NO: 24502 - DNA, 201 bp, Bos taurus
tggcctccagtaagtcactcttaccccaggggtgtttctacactgtacttaaaacaatcacaacacttatagattatattgtaattaactgattgtttgtttacaagctttttaagagaggagcctgtattctgtctacctggcaaagtacttgagagtttctcagaatctgttgagtgagtgaaagcccaggcaagactg

SEQ ID NO: 24503 - DNA, 201 bp, Bos taurus
acaagattctaaaaatatatattaaattaataactgatttgtggcaaaaccttaacattttcagaggtgaatagcttggccctggggccatggtcaaatatcatctagtctttgataatttaattgaaactaacattggtgataaaaatacaggctgtttttcagggacaacgtttgatttgggagactgggaggggcctg

SEQ ID NO: 24504 - DNA, 201 bp, Bos taurus
gttaagacacacgttccaaatggaggagccaagcctttcctccccacgctggctcttttgctagcaatgaatggcgcttttcagaattctccctgtgaacgcaactaattctgtaagagcctgctctgtgtgtacagctctcacctggaactgggagtgttgtggtggataaaggctaacaagaaggacgcaaagggacga

SEQ ID NO: 24505 - DNA, 201 bp, Bos taurus
gcctctgccaggccacccaaatttgaccctaacaagattaaagttgtatacctgaggtgttccagtgggaaaatcagtgtcacaggtaccctggctgccatagtcattctcttggatctgtctccaaaggaggtgggtgatgacatggccaagacaactggtgaaaagttgggagtacagtgaaactgaccattcagaaca

SEQ ID NO: 24506 - DNA, 201 bp, Bos taurus
taacaattttctccccaacatgttccactgtaatttgtattttcatatttatctgcccactgttaatttcaatgttatccccttctatgcattaataaaagtcaccaataaaatttaaatatgactcttcccatttactcattttttacatattatttgctcactaataaaaccttgtctgttttgccctcaaaatgattg

SEQ ID NO: 24507 - DNA, 201 bp, Bos taurus
cactggagtattcatctaggggcccttccttccctagccaagtggcagagatgtgacccaatctaggctgataaagcactcccttcctgaacctaaatcctgaacaaagaaagacaaaggccaaaatttgctggagctcattcttgcctatggaagtgccttgataagattgcacagtggttcccactatgggacacctcc

SEQ ID NO: 24508 - DNA, 201 bp, Bos taurus
ttgagtctcctatcagcttggcattctttctaaaacatcctttcttgcctccctaccctctccccatcccattagttgaagaaagaacacatacacctttaaatagttgaattttagtcatagagagatggataaaaaagtaagcatgagactacactgttaaaaatcacacatccaaggacccagagaacagagagtaaa

SEQ ID NO: 24509 - DNA, 201 bp, Bos taurus
aaccccaatattacagttttcatcattttctcaattatatgatccaagatatatggatcaccaaaacagggtaacggtggctgataagatagaggacttagtcactgaccatcacagaacaggggtccctatcccaggctattaagatcttattcttattctggggaaataaaggaatcagggagccataacagcattaag

SEQ ID NO: 24510 - DNA, 201 bp, Bos taurus
actaattctaggaaatggccagccacagactgaacagcctcttcctctctggaaaactcccaaaactgttattctgttcagttgcaatcaaacagggacaaccaaatatacctaaaggccaatcacaaacttctccacactccttctgaaagtcttaacctaatagactgtccccttttaactttatttagttcactctcc

SEQ ID NO: 24511 - DNA, 201 bp, Bos taurus
aggagaacagagaggtacagaggaattaaaaaacttctcagcatcccacagtgagaaagtgatgggctctctgaggccataatccacatgtccttccttctaatacactcctccatagatagagcacacgcaccactggctctcttatggggccttggaatagtcttgatgcatgtgtagtgaaataaacctggtcatcag

SEQ ID NO: 24512 - DNA, 201 bp, Bos taurus
acacaattagctgccaaggagcagcatctctaggtaactatccagatcatttttattcatggtaaccaagttaccataagagagtgtcttgccccattgtgtttcttctgaatgacgctagacttggagaggaaatgagaaacgcggttctactaaagaagaaaacaggaaacaaaaggtgtcttcaatttaagatgagct

SEQ ID NO: 24513 - DNA, 201 bp, Bos taurus
taaatgcaaccctgattcccaccttttgaagctcacaccttattattaatatatgtgtttgcatgtgtgtatgtaaaaccatactgtatataaacatataagtgtgtgccccttctctattcactccattctctattcactgtgatatttcttttattgtaaatgtttgtgtatagatatataatgtatttatgtatattt

SEQ ID NO: 24514 - DNA, 201 bp, Bos taurus
aataagctattttgtgtttcttctagcctgaaggtgggtgtagttctgcactgggtttggtgtaatggtccaggagagagaagaaagagagaggcatcgtcagtgtgattaagagtgtccagctttgtcctccactgtaatcagaattgaggcagtgttgtctgatcaaaatggataaacaaacaggttcttttagctctg

SEQ ID NO: 24515 - DNA, 201 bp, Bos taurus
gacagagttgttgataagaaaatgttgacagatttagaagacagtgcaatgcaagacctttttttttttaggtaccaacatgtgtgactatagcaatgagcacattgtgaactgattaagcatgattttagagaaatgctgttctaaaaactttatgattgtcccttttctagtaatagtactaagttctcttttgactgt

SEQ ID NO: 24516 - DNA, 201 bp, Bos taurus
tgctttttcaggaggtatccaggttcatggccattaccttccctttatcccaaattcaaacaagtccagcatcctttcagcagaagcccaagctcaccagtggcctgggtgtcacaggcataataggaaatcatttcacaggcatcagagaagcactgaatgtatgcagtggcctggactgggggctcctgggtcatcacc

SEQ ID NO: 24517 - DNA, 201 bp, Bos taurus
cattttggtgctcaataaatatttgctcatgataaagaaaacaaaacttcataataaatgctttagaaatagaagttaattaatttgtatatacactatgcacaaaacactggagtcaatactatggcaattataaagaaaaataagacacaatatttgttctaaaatccagtgtgctaagtgaagcatagagacaacata

SEQ ID NO: 24518 - DNA, 201 bp, Bos taurus
ttaagcatcttatttgtataattcttagtatcaagtacagagaaagcccagttgtcccttgacagcttcttctaaattcttcatttcctctattatcttctgtaccattttaattttctttattctcttagctgtattttcaagaatcttcatctattgttaactaacttccttatgtcatcagcttttctgcagaatagt

SEQ ID NO: 24519 - DNA, 201 bp, Bos taurus
atttaaaaattaaaatctcctaatccttagcctggtacacaatgctttctgcagtaagtctcatcataataaattcccttatgtctctactttcccaaacttacagttcacttcccttacctccatttattaaaattcgacttagtctttcatatatagctaaaatgctcatcacaacttgcactattctcatattcctaa

SEQ ID NO: 24520 - DNA, 201 bp, Bos taurus
gcaaatatttaggaattcttgaaaatggaaaaaaaaacactaagttggtatagagttattatatcttttgcttttctgataaatctataaggaatatagaacatctcacatatttcatcacataccttcaagccaagcattgctcctgaatctcgaggtacacttccatcttttaaacgcttatttaataaaatgcgacca

SEQ ID NO: 24521 - DNA, 201 bp, Bos taurus
caacagtagactaggctctctttgtctagaactgagtcaaggctgtcgaaagctacaacgaaaagatgagcttttcattctgtaggttccacagtagaaacgaatatatagcagaggaacagagtaactaaagagctacagtggacacttagtaagatcacaaagagtatctttatgctcatgatctgttgactattactt

SEQ ID NO: 24522 - DNA, 201 bp, Bos taurus
tgtagttttatcaggttagcagccatttgtgcatttctgtcgtgaagaaaatactttttgcacttttagggcttttgttttgtttttcaattgggctgtgtctggcctctcagttgtagcatgtgactcttaattgcagcatgtgggatctgcaacccaacctgggattgaactcagatcacctgcattgggagattggcg

SEQ ID NO: 24523 - DNA, 201 bp, Bos taurus
cagtcacttagatttcagcatggcttggttctgcagtgaaatttcagtatataaattatccagagtgatcggagtacagtctggctacttaaaccagtttgatacttcttaactcattaaatccagttttaactgttattcaaaattcattgccaggtcagttggtgattcagctctgttctggccactaggcactgccct

SEQ ID NO: 24524 - DNA, 201 bp, Bos taurus
ctgtgaccttcagtagaagaatgcagcctaccaaaggcaacctctgcaagaataaatattaatatctgcatctgctctcttctgtccctttcatctgcctaggctcaccaccaacccaactcaactagaagctagaggcaacatcagacttctagggcagaacatggtagagaagagtggactctggttctggaaaggaaa

SEQ ID NO: 24525 - DNA, 201 bp, Bos taurus
gaaacacccaccagtggtacacttctgagaagtaaagaggcactaaaactgtgattttgatgatgggtggcaattacaagctgtttttcgtctagtttttcgagcaaagtctagggaagattctttcagtaccgcgaatagccacgatggatcccaacggggtctgtctttttgaaagatggcattccaccaagttctgtt

SEQ ID NO: 24526 - DNA, 201 bp, Bos taurus
aaagcatatgccatgaatttatcactgattaaatatatggcccaacatgttttattatggtaacgttggggaaaaaactgacctgactcttagtacaacacggtccacagacctgtagcatcagatccctgggagcctgttacaaatgcaaaatcttgggcctcaacccccatccctactgagttagaagctctggggtag

SEQ ID NO: 24527 - DNA, 201 bp, Bos taurus
gatttggtgaccatgtttgcattatttttaaggctctgttggtaccaagtgctttaacagtcttgaagtacgaagaaaggaatgtacaaacaagacctctacactacgtatgtgaaggggaaatggcctcgtggaaaaagagtcatttaaatggagaaaaggtaagagatctgaatcatcccccaacacaaggaaatacag

SEQ ID NO: 24528 - DNA, 201 bp, Bos taurus
caccatggaaactcgctcctgagcccacattcctgagttcagctcactgccatgcacccctctccttgtcccaccacccgagggggccactccaaccaggttctgcctctgtggcttgaatgtggctcaggcatcagtccctttgttcctccaactccagagggtacctgttgagctctctgcaggccttctgaagcctca

SEQ ID NO: 24529 - DNA, 201 bp, Bos taurus
gggtgttcacctctctcccctgccaagcagagctccttgagggaaaggactatgtcttgttgacctgcggctccccagcatctcacagtaccctggcccacggaaggggctcaatgaacatttgttgaaaataacataatttaagtgtgctttctacttactagggagtacccaggttctaaatacagagagtaggccttt

SEQ ID NO: 24530 - DNA, 201 bp, Bos taurus
gagccaccttgggaacctagctgatgataggggggttccatctcctaacttgtccatgtaagtattttcacatctgtgcagagggtgagggagggtcttatagaagtaaaggagagttgttgttcagtcttttcagaactctaaattgtgtttaccacttactccctccccaactatttttgggccatacattgcagcttg

SEQ ID NO: 24531 - DNA, 201 bp, Bos taurus
tctttaagatctttagagtatgtgttgtacatgaagggtcattccagagcctctcgcagcatattttgaaaatggaagtccattcaatgttctcaagcaggggagtcacatcaggccttttgatttggtttttaaaggatgactctgacagttgtctgcagattggactaattgtgtgtgagggcagaatctggagaaggg

SEQ ID NO: 24532 - DNA, 201 bp, Bos taurus
aaattcaaggagagcctatctcttctacgggttgtgtcagctaggcctgcttgaccaggactaggaactccccaggtggagtcctggtcctggctggtgactgggataccttctccacatggccattctcccttcaaacattttctctttattcagtaagttagcctagcctaagcaacttctgcctggtggctggtttcc

SEQ ID NO: 24533 - DNA, 201 bp, Bos taurus
aaaaggtaaactttaaaaaaatgtataataaaagtgataaagaaaatacagaagccaaagaaatgtttagacattagggccacaggccacaccagttgatgaacatgttttggactacatgaacaaacctcagcccagggatagtttctgctgtcactaacaagcttccttccaccagtaatgttgctcgcatcttggccc

SEQ ID NO: 24534 - DNA, 201 bp, Bos taurus
tatgaaatgaatgtcccttctgtccagcttttctgccacaatttctcctcagagactctgctctaaataaaagccttcctctaggcttttatctgtcattctcatggtcaagtcatatccatctcgtgagatcgcttttcctcttttttttttcctgaggaaaaagggctctacctctctctaacttctgtttataaacca

SEQ ID NO: 24535 - DNA, 201 bp, Bos taurus
atccaataacgtttttttaaggaaagaattaacattgtctcataaacagtagttgctcaataaatatttattacatttaattaaaaaattcagatatttactataagtagccctaagtacctttcttattcttatctatttcataattgattgtctttactttctggttttattcattatgcgcagaaggagatctaaaaa

SEQ ID NO: 24536 - DNA, 201 bp, Bos taurus
gagatataacactcaggccacaacaggttctaaatgtttttcttttaacgatgaaaaggagatggtcttcaaatatcagcatgatgtctagttaaaagtatgggtacagaactttagctggccgactgactgagtcaacgggagaaataatggaaaaggagtgtggattcagagagccgagagagcatgcttgtgtggaaa

SEQ ID NO: 24537 - DNA, 201 bp, Bos taurus
tgttattagactatgaaagatagaaggaaaaacaggccccatataatatgaaaggggaagtctgtttgctagccatgatttggttctgttctctattctccgctccctctttcactgggcccctgcttcctgctgcaggattgtgaggtgtgttaccaatatctggaatgaggtcttgagctacaaagttctcaataaaga

SEQ ID NO: 24538 - DNA, 201 bp, Bos taurus
ctcaatgagtcaagaatctttgtttcatcttgatttcatgattctcctcctttggggagggtcgcctcaatctccctgccctctgccaaattgcttctctactcccattccagtttaagctctctttactggcaattgagtgtttcatggtgaaattcctcataacaaactttcttggacaaaaggccaatgccagatctt

SEQ ID NO: 24539 - DNA, 201 bp, Bos taurus
ttgaattttggccaaagtgttctgggtggaagataacacctcctgctcagcaacactgtaagcaagctcagggtttggtctggcagcatctctgagaggaaaggcatggccctctgctccagtcattcagaggctgatgagtgaagtcactttggagggctgactctccgagctgtgatggaaccaaattcagacttgctg

SEQ ID NO: 24540 - DNA, 201 bp, Bos taurus
acggtatctaccatcagacggtatctgttcaggccctccctggcttcatgggactatgcagacattggatacatttgccatccctcaggcccaggcctcaggagtcaggcagtgttcacttccgtctctcagaacgctacccctgggggctctgatcctccacataagaagcgtctctctctgccttgctggagagacccc

SEQ ID NO: 24541 - DNA, 201 bp, Bos taurus
gtatggtagtagtattcataggtggtgttttcactaaaaaaaagctgcttaatttttgattacccagtgatatttgaaactagagttgagattttgaccaggtaacataaggattggtttttaaggcagcctttttagtcaagtgtgcttcaactttatgtgaaattacggatcgtgtggacaaagatgagataatgtaat

SEQ ID NO: 24542 - DNA, 201 bp, Bos taurus
caaaatttcccaaggttgatgtgaggcaaccctggaccagctccctagcatttaaaaataattccaatattatcagttttctgtgaatcaggcatttatgagaaatcagcctctccgtccttagggcttgtcttcttgagggcacacttgtggggttttccattttatatcctccagttgcctttgcaatgctttcaccaa

SEQ ID NO: 24543 - DNA, 201 bp, Bos taurus
aagtacaggcccctgtgggactgcacaggggacagccacatggggccgattcattattcgaatgtggagtgtagaacctcttctcatatggaaatggttgtggcatgattccgagtagctaaactgctctctgtaagaatatgacgttcaaaggcagaaagctggactgtttgacttaccaccacatccctgaatacagaa

SEQ ID NO: 24544 - DNA, 201 bp, Bos taurus
agtaaactgtcttagtaatttaacacagtgtcacacagctagtgtcagaatctgaacctgaacccaaactttgtgactccaaagtcccatgctctactctctgaataaaaacaagctattattaccctatatttgttttcagaattttccttccaagctactcttaagttattccctcattttatctcatcttgggtaaga

SEQ ID NO: 24545 - DNA, 201 bp, Bos taurus
gctaccactgtaagcagatttggcaccccaatcagacctgtgatgctgctcgacaggagagggctcagagtttacgtctgagaactatacgttcttcatctattagttacagtcaagagtctggagcagcaggtatttacagctaacttctagtaaaatatttggcacatacagaacacctgttattttaattcaaaaatg

SEQ ID NO: 24546 - DNA, 201 bp, Bos taurus
ttttactattttctgtgatggaaaaaaactcatttctgtcaacttgagtaatacctgaattatatatttctttttaatagcctttgagcttgagtgttcaatttttgggactgttaaatcattaaaccatgactatagataggtattaatccttatgataattagtaatatttctttgtcttcagttgtaccatcgaaaca

SEQ ID NO: 24547 - DNA, 201 bp, Bos taurus
aacctgatttatagtaacagcaaagagctaaacaattacttgtatttgaaattagggctttgtagagttttaataatgatggtaataatttatgtaccttctccatctgcagttgtggaagaactgtgtgtacttttggtttgacctacaagcttatcatcagcttttctaccaagaaacccttcacccttttaaagtatg

SEQ ID NO: 24548 - DNA, 201 bp, Bos taurus
agttggtgtatatacaaagattcagtagaaatttgttctaatcttggatctgttactgtctttctgatatagagccatttatttttgccttttttggtcttagtttacttatgtataagaaacaaagcgtccttttttagcactaatatgtaattctgtgagtttatgatattggagattttttaatctgtaactgtatat

SEQ ID NO: 24549 - DNA, 201 bp, Bos taurus
ctttcattattttactttgttgcttaaatttttggccattgggaatcccttcaagttgattcccatgtcattctgatatatccctatcattttttgataacttctttattttctggccacaagatgtttcaggctcaatagtatttttttccccatcccatctctagcattagtcatttctgcagagttttgatttctttt

SEQ ID NO: 24550 - DNA, 201 bp, Bos taurus
gaaattctccaggccagaatactggagtggatagcctttcccttctcaccccagggatcgtattgtcagtggattctttaccagctgagccaccagggaagcccaagaaggtcactgggcccaggacaccatcagggactcagtttgtaacaggaaaaaaagtgtgtagggtaatgaaagaacatgaactctggaggtaca

SEQ ID NO: 24551 - DNA, 201 bp, Bos taurus
agttaaccaacagtacaacagaatacttaggaataaaaaaaataaattatagattcatgcaaaaacatggattaatctcaaaatcacaatactgaatgaaggaagctaggcaagagagagcaagagagcacacctgtaatgattccatttatacagaatccgagcaaatgaaaattaatcagtaacagtatcagtgattac

SEQ ID NO: 24552 - DNA, 201 bp, Bos taurus
tcataatcctttgaatttcctggccatcatttataagcatggaatatgatgaaacactctaacaagttacagtcaagtttagaatcaaaattagtatatgggaaaaattatgtgctatatagtgtgatatttaactcatgcacaatagttgaagataagactaatggaagctatggtattgtaaataccgaacaacaacaa

SEQ ID NO: 24553 - DNA, 201 bp, Bos taurus
agcaggaaagctgggctcacttgtgagctgtattattcagtaacacactctgcatggaacagggaaagtaaataactgaacacatactttataattacacgcggagggaattcaaagctgtggtggggagcggagtttgggggcctggggcggcagctgcagtttctggcttctcccctcatatgctgaaagcatgggagg

SEQ ID NO: 24554 - DNA, 201 bp, Bos taurus
tccatggggttgcaaagactcagacacgactgagtgactgaactgaactgaattttttttcacttgtaatcataagataaatattggaggtggaatataacaagtgtcaaggccttaaaatatagaattgtctgagctgaggtgtggtaagtggtaatgagaaatctgttcccacctgccatctgaacatctgggttatag

SEQ ID NO: 24555 - DNA, 201 bp, Bos taurus
ttggtcaaatttgctttctgtcgaacatcattttccatagtctaaaataaatataaacagcaagtaataagtcattagtgaaaaaacataaagcgagaaacgtgggataaaatggtgtataacataactccatttattaagaattactccaatggcaaatttgagcaatgcaaaatgcaattacttttgcaccaacctagt

SEQ ID NO: 24556 - DNA, 201 bp, Bos taurus
tcctgaaggataaggagttaattaggcaaatgaggtgacctaagaagtggtctcagcagaagcagcagccgatgtttttctttaaagactttttgagcaatcccactcttgcttaaggtttaatcaccagatgcagaaagtctgttgattccctaactgcctgagctctctcccttggggttaaaaaaatgcatatgctgc

SEQ ID NO: 24557 - DNA, 201 bp, Bos taurus
aaaagtctgactagtttaaaattttacgctcaaatgtgatttaaatctcacctgatcattccctaccctgtgtctcaggacaggccaccacagtggtttaagatagttggtatgctttctcctctgctgggtctcgctcttggggagatgggcagtgagagggaaggggtgaggagcaggctagaggaaggccagaagagg

SEQ ID NO: 24558 - DNA, 201 bp, Bos taurus
cagcccaacgtatcaacactgccaaggttgagaaacctggaacagactcctagagccttttcctgtgccctctctcttccctatcccttcttttccttcacgagggccactccccctggtgtagtgattgtgccaggccagcctctctcagggcttccccggtggctcaggaggtaaagcgtctgcctgcaatgcgggaga

SEQ ID NO: 24559 - DNA, 201 bp, Bos taurus
agcatcctaagttgcatttgtcccagggtcctttgtcacaggcctccagatgagctttcaaacatattctgcttcccaggatggcctcttccagagccaaattcctggagtctagcaggtatgaaaagttaatttgtgcctagaaatgaggagactgtgtcacagagggataaacaactcacctggcctgtgcaactagca

SEQ ID NO: 24560 - DNA, 201 bp, Bos taurus
aagcaaaagcgtttgaagcaatttaaaatgtccttcgagaaatgaatattatggggcacaggcttagaataacaagaaaacattcaaatgactccaaggacgtgtgtaatcacagggaaaaatgttttagcaacattattcactcaacaaatattcaccagaatgcgacatggcttgttcccacaggaagtgaggcgacag

SEQ ID NO: 24561 - DNA, 201 bp, Bos taurus
tcagcctcttctctagcttcttcttctccttctgttcccggatctggctcttgaatgggtcgctgtgcttgggctcctggggcccatggtacagccaatcgcgggagagctgcaggagatcctcctcggctgggacgcagatcagggtgtgcgggccagggctgcccttccccagcagggccagcctgacccacaccaggg

SEQ ID NO: 24562 - DNA, 201 bp, Bos taurus
cctggagaatcccagggatggaggagcctggtgggctgccgtgtatggggtcgcacagagctggacacgactgaagcgacttagcagcagcagcattggtatttaagctataaaacttctggaagaagtctgcaagaaatgggtggcatttttatcaggaaagagtgggacagtaattacactgagaagcagagggctggc

SEQ ID NO: 24563 - DNA, 201 bp, Bos taurus
atccagagttaaatgagcagttagaaaaaatggaactctagcacttgaaggtaaggttccactaactcagaaagtgtggaaatgttggctaaaaggccctacgcctggctcagaactgactcctcctgcagtcacagtcataattctgggatgagtcaaagtactcccgtggggtccacccaccagtagctggccatggtg

SEQ ID NO: 24564 - DNA, 201 bp, Bos taurus
tgaagaacctatgactcagcaatgtctgcctcctctcttcacacaggcagggtatgactagaaaatggcggctataccgtgtgtgtatgtgtgtgtttgaaggccatcgcctctcacaatcatcctgtacatgatagaatcacaggagttagtagtgaacttgtgggaatgacagtcatttgaatgtcagacctggggaac

SEQ ID NO: 24565 - DNA, 201 bp, Bos taurus
ctgtctcaacacgccttgtgacctcagttaggtgatttaactttctgggctttaactagtcagctataaaatgagaggcgtgacctggaagccatgtttctcagcctaaaccagatcacaggccgggatgacgctgctctcctgaggaagcctgggcctgacaccctcccaggccgtaaaccctgcccctggatgagaaag

SEQ ID NO: 24566 - DNA, 201 bp, Bos taurus
ctacttggcgcctcggtttcctctttgctacccagggggtcaacttcaatgactcttgtgcaacctgggtcatatacgtaaagcacttggcccagagcctgccattgtgacctaagtgtctggggagaaacccacagtacaaaagccactgagcaggaggcagaggcagagaagggagggccctcactgggcttcctccga

SEQ ID NO: 24567 - DNA, 201 bp, Bos taurus
ggaacacaggttctatctctggtccggggaagagcccacgggctgagggacaactaagcttatgagccacagcccctgagccaacgcgctgcagctacagaagccagcgcgccctagagcctgggctccgcaactacagaagccactgcaatgagaagcccacggaccacaaccagagaaagcccacatgcagcagtgaag

SEQ ID NO: 24568 - DNA, 201 bp, Bos taurus
gctttacgtacccccaggcctcggctctaccccctttctctctctctctctgaggacctccggtacagggaacttgccattcgaccgctctacatgcaacgctccactcaggccaacccctagactaaggtaagatcccgacggtgttctagaggcgccctagaacccagtcctctccgggtcccggggaccccggcctaa

SEQ ID NO: 24569 - DNA, 201 bp, Bos taurus
gcatgagtgccaacatgctttcagttatgttaggccacagaatcttcctatctacacaataaaaggaactaagccaccagcagtaagagtttaggtcttctgctctccgtttcaaggcctttgctactttatgttgtttatctataatttatttggctagtagtacttgactctgattattttttcaaagaacaagtgcta

SEQ ID NO: 24570 - DNA, 201 bp, Bos taurus
tgctctcataactggcctctctgcctccctctcactaggaggtttctttctttgtcttaccattcataccatggagcctggagatagactccatctcctcttgattcttcttgccatggccaaatcattctccttaccttcttcctgaaaaccctggatttgaatttcaatcagattgtaacctgtatttctcctgtgaca

SEQ ID NO: 24571 - DNA, 201 bp, Bos taurus
agggtatggcagaatggaaggttggtatgggaaatgttaaggtaccaatccagatggcttccgctcatgggacattggcaagaaggcagtcagatggccacgactaaccgcgaaggacgttggctcagaaggaagagaatcaggtgtggaattcggcagcagtcttctccagtcagagtggccagaccaggattggaaccc

SEQ ID NO: 24572 - DNA, 201 bp, Bos taurus
ccagccctctctctaggccccaagtctgcacaagtagagcaggcacctttcaatgtggaacacgatggtgttcttggtcaatggttttccctgaacttgttcaactgttgtggccccgcagccagaccaataaaatctcagtctttcggggtagggcccaagtgctgatatgttttaaaaagcctccaggtgattttaaag

SEQ ID NO: 24573 - DNA, 201 bp, Bos taurus
aggctttgaaaacggcccctgtaaggaaaataacacatgagtcaggaggcaaacgagttctcagtagcctttgtgtgtcattttatcctaggcaatacctatggcatttctgcagggtgggcctgctttcatcagctgccagggcatcgtgggaagacactagctctcaaagatctggctggaaaaacaccccacagcttc

SEQ ID NO: 24574 - DNA, 201 bp, Bos taurus
ataagatctttaccagttactaatgtacagaactttccagcctaaaaggcctagtggcacaaatagctattacactgtcaaatcctgagtgacaataaaagtcctggaattaaccccaatgtgcattaaaggctgcagctactgcatctgcagcctagacacatttctgaaaaaccttataaaaaaaagggctacaatact

SEQ ID NO: 24575 - DNA, 201 bp, Bos taurus
tttaattttggggtggggggaggtatactttcaacacagcaaagaagtgactgtgcaatctcacagaaaggagaaacctccctgactcaagggccacagttttctatccagccacacccctccatccgcacacatgacgtcctacttcaaaagctgatgtccaaactcgggcctcccaacaggtgctcaacacatagctgt

SEQ ID NO: 24576 - DNA, 201 bp, Bos taurus
gctgcccacaaacaatccaaagtcagtgtgggcaactagatgaaaccagaatgatccatacctaagagtcacagggccaaattctgaaagtaagaatcttagggggtggctttagtctcacacatgcaggtgagagtatcttcaccccagtgcgaggccctcctcaaagtgtgttcgcatgctagtaggctttcacagcca

SEQ ID NO: 24577 - DNA, 201 bp, Bos taurus
gaaccaaaaagagataaccatgaagataaagcctatatgttaaggaatgcaaagtggaaagatgcaaaaacccaaggtcctaaagacactactgagataccagaactatcctatatctggacatttgttattgagataacatgtctttattgattaagcaatcattagatttgcttacagttttcagttattcattgatga

SEQ ID NO: 24578 - DNA, 201 bp, Bos taurus
acgggacttaataactcactgggcctgtgtgaactgagattttcctggtaaaacgccttgcctttatcagtttatattttaaagcttctgtttcaggacaggaggaaaacctattttcacaaaggccaagagggtagcctcttcatctgcaaagagaaagccactacagaatgaataaacaattgataaagcttttcaaat

SEQ ID NO: 24579 - DNA, 201 bp, Bos taurus
acaggtttctttaaaggagaagaaagtgtgctgaattcccactgattttaatgtgaccctggtcggtttgaaggtctcggcttccataaatcaagtgcctacagcggcttttcccttttcacctctctaacccttcccacagctccatctcaggtccggacttgcacgactgagtgaggcggccggctgcccagcggtcag

SEQ ID NO: 24580 - DNA, 201 bp, Bos taurus
cacctgtggaggaggagggccactgaggcggaaggtcagacaaacggctgctccatcatgatgaaatttcagaacaaagcaaaaaactgcatatcctttttatgatacattttggcccacgatcattattcccacattccaaagttgctaatcttcatccctttaatttattgcaaaactttgtgacaacttaacaatgta

SEQ ID NO: 24581 - DNA, 201 bp, Bos taurus
ttaaaaaaaacaacaagtatttcaaataggtggcattctcttatgagatagcagttggacttctcaatgctcagggccgttgtctgccatcatgttgacccagccatgacaagggctgaatgatgaacatattgagatctatttagagaagctgagctccttggacaatgggaaaccatccaggcctttcatcagtttcct

SEQ ID NO: 24582 - DNA, 201 bp, Bos taurus
tcaaagagaatcaaaactaagttatactgtttagactggacagtaaaaagcaaagaaaacattaaaaaaaaaactcaggatgatggttaattcaagaagtagctcatgattacacagatgtctattctattatgagttgttaaactgtatttgtatattcatgcacttttcagcatataatttatattttttatgtaataa

SEQ ID NO: 24583 - DNA, 201 bp, Bos taurus
attgccaatcattgttgcaagttctgatatgttagctcatttaactcccaaaacaactctgcatcaaacagacattgttcctctagttttacagataaggaaactagatactgagtgtttaaataatattcccacaatcacatagctgagggaagaagagagacctcagatcaaattggtaaaggtctttttttctagcat

SEQ ID NO: 24584 - DNA, 201 bp, Bos taurus
tctccagaaaattacccacttcagctgaatgttaaattgagattttgacccaaatttggttaacttcaaagcctatactcatttaggcctggagcagagacggagggcagagccctgtgctcaggatgccagaagacagctgagtcagcccttcagctgctgttccagttccctgttggctgcctgggcaaccatgagccc

SEQ ID NO: 24585 - DNA, 201 bp, Bos taurus
cataatttaatcacacccattaattgtggacttcctgcaaacacagctgcaactggagcttgccttctgcaaagaaccacaaagattcacacactgaaaatgtaagtatactatttagttcaccgatttatatcaattctgaaataccaaggaacttaaaatgggttgtacacttaagttttaatgtcagttctaatttca

SEQ ID NO: 24586 - DNA, 201 bp, Bos taurus
gcctttcccttctccagtggatcttcctgacccaggaattgaaatggggtctcctgcattgcaggtggattctttaccaacttcgctatcagggaagccctcagcccctacactgtgtatcaaagggaatttcatctgtgcccacacttctactttttgataaagaatcatagtttttgcattttttaacattactcactt

SEQ ID NO: 24587 - DNA, 201 bp, Bos taurus
tggatgaggacataaagatgaggaataccagggcattttgaggctgtacgtttggagtgataatacttgtctgtaagaccaaggaatttggcctagtgtctagcactagagaagtgaccactgaaaagaagggaaatactaggttggtgcaaatataattctggttttggaccgtgaattttaagttattattaataacta

SEQ ID NO: 24588 - DNA, 201 bp, Bos taurus
ccactggccctccactgtccttccaaagtcatggacctcagtgggttttagattaatcagttcaggagagcagaaataggaggtctaggactaccatgtggggatagtgaggcccagaatgagttaaatgactctttacagcatttaagaacctcaggcttacagggacaattgatagctctttgagagtgttaaaaatgc

SEQ ID NO: 24589 - DNA, 201 bp, Bos taurus
aattctttaagcatccaggcagaaaaaaaatgacctacaaaagaaggaagttaaactgccctcagatttctctataggattattaactgtccagacacaatggaagagtctccaaaatttggaaataaaatttgactcaagggtgttagaccgaagtaacctgtcttgaattcaaagtctgagacaaacatctccagacat

SEQ ID NO: 24590 - DNA, 201 bp, Bos taurus
gtagagagtaataactgcattgatttgtagatcacatatcaggagctacagttactatgggtaccttgtgtccttgtggccatttccagtatttagaaaatggtaggcaaagtctgagtgttcccaggtggtgctagtggtaaagaacccactcgccagtacaggagacacaagaggcatgggtccaatccctgggccgga

SEQ ID NO: 24591 - DNA, 201 bp, Bos taurus
tgaaaatggctggtagtgactttgagttcgatatggttcagaaaattcatgaaggaatgagtctgaaactgtatccacaaaggccactcagctccatctcagatgccggaaacatctgtcagaacaaagaatgaacgtcaaactcctccaaggtttccaaagaggcagagagcatgtacacggtgcgtcagcaggaccctg

SEQ ID NO: 24592 - DNA, 201 bp, Bos taurus
cagacagagacagtagctcttgagatggttgtggtgggtttgaagccattgaatggatcctatatttcaagatatcccctttctaggcctcagaatgtgaaagattcttttcttgctactaatatgattttctgagtgtctgctgaagacatgcaacttgaagccaagctgtaggactatggccttttctggagggagtga

SEQ ID NO: 24593 - DNA, 201 bp, Bos taurus
attcatctccaacttctttaattattgtatctttccttctaaccctgggtaaagaatagcttaaaccttaattctaatgctttggaattttatgagtttcattaaaaccccagagagtcatttaattttatggggttcaatgctaatattcaaatgcatttcttctgcaatagatttttaccttgtattatagagactgag

SEQ ID NO: 24594 - DNA, 201 bp, Bos taurus
caggcctcttaaacattcagctgcatgcttgaactgggggaaatcacagctgctcctcgcttttgataatgccagggaaattggtaaataaataaataaccggggcccagggttcatttactaaataccccaatatgtgcaagcaaaccacatcagggacatcaaaggaaaagaaaagcctaatttagtaataacatggtc

SEQ ID NO: 24595 - DNA, 201 bp, Bos taurus
atagcggcctgagtctgatatgctggttggttctgggaaaatcccttactcagcttcatttttcaccatctgtgtctcagtttttctatttgtaaaccaggcataattaaaactgcccactgggcctttcacaggcatgtagggaggattagcaagaggctgcaaaccttccttagctctttgaaagagaggcactacaag

SEQ ID NO: 24596 - DNA, 201 bp, Bos taurus
gtagacggaaagagctcgggtgcctcaggctcaccgagaagcaagttccctaggaaagctgtgtcactaggaatctctgccctggtttttgaacgaacaaagtactactgtatattgtgcaagaccactgaaaattggcattgcttgtcgtggttactccgtcctagtacattccagtgaaatggtaaaaacactttcact

SEQ ID NO: 24597 - DNA, 201 bp, Bos taurus
cggcttactaaccatatgctcttctaagactcagtgtcatgatttataaaacagggataacaaatgaatctacctcctagctttatgaagcaccttactcactaattgggacggctaaagttcccagtttgcgttaacttctgcaatttgacatgatggacagtttggcaggggactgaaggagctggtgttggccatgga

SEQ ID NO: 24598 - DNA, 201 bp, Bos taurus
gaatttctctaaaagaagccatgttttaaaagaaacacaaaatatgttcacatattctcacggaaaagatggaaataatagagactaagtagtttctccaatttattttttttcaataatttctctgtaaaacgtaagtggaaacctataaattttgttcattttaacatgtgtaaaaattaaagcagcaagcaataagaa

SEQ ID NO: 24599 - DNA, 201 bp, Bos taurus
tgtgtgagtggctggccgagcctgcttgcagaagatgccggagagtaaccacacaagctttgggcaattggacatctcatgggtgccccagaagacacgtatacacacaggcccgtctctctaggtcgagctccaaagatggaagccccggcagcggggcgagtcagagcaagtggtacctcaatctaccactcaagagcg

SEQ ID NO: 24600 - DNA, 201 bp, Bos taurus
gcaaactccaggatatagtgaaggacagggaaatctgggtgctgcagtctttggagtcacgaagagttggacatgacaacttagtgactgaacaacaagtataaagggataaaatgctaaagagtggaatacaaatgtgatgaaaaatgaaatatatatgtgtagatattttgtttatatgcatgtgcaaccttggataat

SEQ ID NO: 24601 - DNA, 201 bp, Bos taurus
attgataaatacaattttagaattgataaatacataaagatagaaagcaggttagaagctgtgaaggttaattataagtgtaaacttgactgggccaaaggttgcccagatacttgttagcagttatccctgaaagtgtctgtgagcatttaaatcattacatttaaatgagtgcattgatctcatcaatgctagtgggta

SEQ ID NO: 24602 - DNA, 201 bp, Bos taurus
ttagcttcgtttgtccttcccaacctctcctctccacagctccacccctgccagtacttgttcaaatacacttataggggaaaagaatattgaagacattcccacttagacaccttcatatgaggaagaaggaatgttagaaaatgtatttaactaacaattgtttagcacctgctgaaactgtaaaaaatgtttgatagg

SEQ ID NO: 24603 - DNA, 201 bp, Bos taurus
tttaagtagaagagtaatgtgttcatattgcattttggaaatatggccgtgtggagaacattcacaaaaacgaggcagcctagagaccatgaatgtaacagagggatggtgttgcgtgcagaggacttcagatgtgaagcaaaagatattgccaatggcttggaaagcactgggtgtttagtggtgcccttccagctatgg

SEQ ID NO: 24604 - DNA, 201 bp, Bos taurus
gagactatatattttttgccaggaggagtcctttctggagaaatacctcctagtttcctcccctctccctttaccaagatctgcagtgcactttcagctacgctgtctttttgcttctgagaaagcaccttcctttttctgtgtgtgcctgtgcatgggagacacatatgtgtatataaacctgtgtcttaaaaaactgtc

SEQ ID NO: 24605 - DNA, 201 bp, Bos taurus
gttttgtaatattaatatgctgtataagtgtatgttgcattctttttgtcagcttctgcatgaggagacagtaggaagcagtgcagtgaggtggttacgagtgtgaatttggaatctcagctctttcccgtccactctgttgttctgagtaaactatttgaactttgtggggcttgatttccctctgaaaagtgggaagaa

SEQ ID NO: 24606 - DNA, 201 bp, Bos taurus
attcgggaagtctggccttgcttgatgaatgaggaaagtgacaatgccaatcagagtgacccctgcagcctccctgctgctccctcaaacagtcaccatcgcatctatccccctggtttacgttttcaattctattgtcactcagctgaggttagacctactgtcactaaactgtcactgaattacattgttaatccaaat

SEQ ID NO: 24607 - DNA, 201 bp, Bos taurus
agaaggtaaaaagtgggtttgaataatgaaatacaactagcctgccaagaagtcatctctactatcagaaacctacacatgaggcccttatttttatttcctctttctaaatacatgttggtctctcatgcccatcttactgatgtgtgggcaataagagtaggccagtcagaagacgttaaatgcactattttgattgca

SEQ ID NO: 24608 - DNA, 201 bp, Bos taurus
cctctattaaattttttctttcagttttaacctgaagagttttaaaaactctctgcatgtctaatcttacctacccaatgccactatctcagacgtacaaccacttgcaaatttggggtaacgtatcgccttatagaattgttcaaattttaaatgctttaacgtatgtggcatactaagcatggtgcccaagaggtagtc

SEQ ID NO: 24609 - DNA, 201 bp, Bos taurus
cccactcatgtcagggcagagattagacatggaagagaattgcaatcagaagagggcaaactaaataaagaaaagaaaggggaacagcccgggaagtgtcagatgcaacagattaaaacctgcagttaatgcgaacaccgtgcatttgaaacttagaacaagcacaagaaaaaaacaagggactatctgacactgaattga

SEQ ID NO: 24610 - DNA, 201 bp, Bos taurus
agaatctatagggtctaataaacaaaaacttatttactttgcctgtggactggaatggagatgagcaaaaagttggtagggactcagaatatcttgaaagagctttaagtctgaataatcacaatgaattagtttgacttccagagagcttttttatgcacatgagggaaagtcagtcatgtctgactctttgcaacccca

SEQ ID NO: 24611 - DNA, 201 bp, Bos taurus
gaagagaaaggctactcactccggtattctggcctggagaattccatggacagtccgtggggtctcaaagagtcagacacgaatgagcaactttcactttcacttccctatgccctaataaattcctttctcttcaagttaaccaagataaaagtattttaaaacaaaaaatgaaacagaaagcttttagtaatagtgact

SEQ ID NO: 24612 - DNA, 201 bp, Bos taurus
tagtgaatgaggctacctaggaagctgtgcaagcttcctgatgggagggactggtggtgggtggaactgggtcttgtgtggttatcaggggccatgctcgctgaagctttcatctgcttttctgctgatggttggggctgctgtccctccctgttagctgtttggcctgaagcaacccagccttggaacctacagggttca

SEQ ID NO: 24613 - DNA, 201 bp, Bos taurus
atccaattaatatgtgaaaaataaataaacatacctttctgtgctttgattagttccttcccaattgctagagtcacaaaggctgtgccattcagaactacgtcagttattgtcttccaagcattaggagagagtctttcagagggagaaataaaattccctgctgcattgtttatcacaatctaacaagtgaataaggca

SEQ ID NO: 24614 - DNA, 201 bp, Bos taurus
aaactaaaggccaggaagtaagaagtaggagtaaatcactggtgacgaaatacaggcagtgtgaataataaattctgaagcatttgctgataaaataccacgtatgcaataactcccctgctgaggcgctgggtcccacccgtcacctctgacttgtgtcgtaataactctgttctactgacaagaatgagtcatctagac

SEQ ID NO: 24615 - DNA, 201 bp, Bos taurus
tgaaatctgaattggacatgggaccctgcatcctttgtggtgacctcatggcgtgactctcatccctcctttgaaagggacacattgtcatcatctgtccgatcttctctaaagagagcagggaagatggcagagtagaaggatgtgcactcatcttctgtgagaactccaaaattacaattcactgctgaacagccatca

SEQ ID NO: 24616 - DNA, 201 bp, Bos taurus
tttttggccttctacttcctttcttcatgtgcccccatgagatatttgccaagtctctgagtcctatttctacagtattatcgttacgcattctgcgaactggctttctaagagtcttaggaagaaaaacattgagtaaaagcatttgcttacaaaatacagtattttaagcggttgaccttgatttgttccaaatctttc

SEQ ID NO: 24617 - DNA, 201 bp, Bos taurus
acccagctgcagtttgctaatagtcacaaagacagctgttctaaatattctgtgctgccttaccactgttttgcattatacttgtctcattttttccccatggcttttgtatttcttgccatgtcactgcaatgagaatgtttaaaaggagtgaaaaatcctgtaaacaggtcacattatgtaagagaatggaaagtgtaa

SEQ ID NO: 24618 - DNA, 201 bp, Bos taurus
accatttccaaaaaggaattttttgggaggaaatgatagtttggaaattgtagttttgagatgtgggtagcaaaattgtcattatctttagaccaatccacccaagaacactgagccctcataatatcatggctctgcatagaaacataaattagatatggcagaaaggagataaagtgtcatagtaatttttttataaat

SEQ ID NO: 24619 - DNA, 201 bp, Bos taurus
gccaccagggaataaagcaatgagatgtgtcacatgattatcttgtaggcacttttctagatgttatagaaatcagaaagacattttctttgatagcatcgaagaaaatgcatcagtcaaaatggtgatgataaataaaggagaggcatacatttttaaacaggttattttagaatcatgtgcaagtttgatttaatgaaa

SEQ ID NO: 24620 - DNA, 201 bp, Bos taurus
ttagctattttgattacccaatatgcagatttttgtaaaatttccaaatatgactatgcaagtctgaatgtgtatctgatgcttttctaagtgctttaatttgggtcaggatacttctagaaagtaattattgttataccaagttttaccattaaaacattggaatctaggggtgggtaatttcttacaaccacaattcac

SEQ ID NO: 24621 - DNA, 201 bp, Bos taurus
ttttatgaatattgcatattagacttcaaatttgagaacaatgacaatattgaactcatttttattttctccatactcagcagtcagtacacacacaacatggatgcttaattaaggtttgttgaattaacagtattaaaataaccagtgaaagaataaattatgtgcttctattaacttattctctaggtaaaatagcta

SEQ ID NO: 24622 - DNA, 201 bp, Bos taurus
gcacagcttaatgcatccaaatttaaaaaaccaaccctctaggaaagaatgaaaatgtcacctcctgacaatttccttttttaatcagtgctttccttttcatggaaggacatagaattccagaagcacagtaggagtccattctggtatttaccactttgaaaacaaggggcagtggtggtggggggtgttggtggggga

SEQ ID NO: 24623 - DNA, 201 bp, Bos taurus
cgattcatctgcgaacgatcaggcccctccggcctccctgatttcacccctgacaaccccgctttgttcttcatgctccaaccacaccggccattctgttcctcaaatgtgtgataatcggtgatactgttccccgccccgagtgctcacgcacgattctctgcagctccctctccgcgttgcctggctcactcctgctcc

SEQ ID NO: 24624 - DNA, 201 bp, Bos taurus
caaccagagatggaggctgggtcacaacagcaaaagcaccagatcccagcgactagactggcagttagtgacaagggccctggccctttggcgctgcagaaaagaacttccacaaagacaggagtggtgaagcaagtacagtatttattaggaggaaaagtacagtacgtatggatagacacatgggcagactcagagaca

SEQ ID NO: 24625 - DNA, 201 bp, Bos taurus
tgaagtgtcgtgaggatgaaatgaggatggcctaagagaagctgaaaaattcacttcgaatgaggatgttaagcttaaatctaagctctgacacgggcagaagagttggccattggaaaagatggaagatgagctctgaggagatgaaggtcctactagctcagtagggtgttaccagtgatgccaaggaatgcatctgcc

SEQ ID NO: 24626 - DNA, 201 bp, Bos taurus
aaacaggttggcctcacttctgacacagggaaatggaggcacggaggaagtgtcagtgacagaagggagatgtctgatgcaatcacaaacaccagagtgatgccaaactttccagctttctgggctcaatattattttaataaccgataaaataattgtctgcttattttgaattttatcacagaaaacttagaatcctct

SEQ ID NO: 24627 - DNA, 201 bp, Bos taurus
gaatagactgaggactgaggatttataggggagcagtaatattctctatgatactaaaatgatagcttaccgtcatagcttattattccacacccatagagtacacaccaccaagagtgagccagctatggatctgggtaatttcaatgcaaaaatgcaggttcaccaatggtaacaagttgtttgggggctagggaatat

SEQ ID NO: 24628 - DNA, 201 bp, Bos taurus
tacctacagggggactggccatcactccagcaccatcctcactcacctgcagtcacattcacaagggccctccctgggccctggcctcacccactaacacagagatgccagttccagaatgcccactgtccttcatccagacactctgggaccaggttctgtacgccacagcgctggcactagtccgaggacccttgggcc

SEQ ID NO: 24629 - DNA, 201 bp, Bos taurus
gggagagaaagcctttaaggcaacaagacattatccaagggaggggtttaggcttatcccctcccctgcacacacggcacacacttaggcgagagggccagctccaagggatctaaaaaactgagtgggtcactttcaaccctggagaccagtgtctcaattctgaccacaggcttgctgagcagagatgtgccggccagt

SEQ ID NO: 24630 - DNA, 201 bp, Bos taurus
aggatgtgacgaatgatgtgactgaaaaatgaacagggccaaagggaatgacggtgcaaatgctgggttggtcagaaagcttgttcgagtaagatgttatagaaaaagcttgaagaactctttggccaaccgcataacacggccaaatgtccagtgacttggaggaagaagggcagtgaaaggaaacgtgtacagctggag

SEQ ID NO: 24631 - DNA, 201 bp, Bos taurus
atctcattgcaatattttctttagccacattttattacagaacaggaataattctctgaagcctactttggcaaatatttccatctgtttgttgtttaatcttttatttaccctttaaaacaaaactacagtgtgtttgataaaatgataacctattgtaattgatttttaatatgctgtcctgtaatctctttaatttct

SEQ ID NO: 24632 - DNA, 201 bp, Bos taurus
tccacaatagtgtaggagggctcccttctctctctataccctccccagcatttactgtttgtgaatgtttcgatgacagccattccggctggtgtgaagggatatatcattgtagttttgatttgcatttctctcataattagtggtgttgaatatcttttcatgtgccttttggccatctgtacgtcttctttggagaaa

SEQ ID NO: 24633 - DNA, 201 bp, Bos taurus
gcttacctttgtgtttgcttatattaattccatgggtataaatgtctacctgattttttctggattcataaagccttgggtagcaattaactctcaaaaaattttaaaataaatattagaagtagtagctttatatttaagactgcattctctgacagtcatttcaaatgttatcaaccatattttttctttgtatgtact

SEQ ID NO: 24634 - DNA, 201 bp, Bos taurus
acaacctacctctgaacaatatcttcacagtgacctaagattctgtcaatcctagtagtttcagaattttttcagagtaaacacattgtaaaggtccttagtggtgactagaagattgtgaagtatgaccgtcatccttgagttaccaacatacaggacacggggagacaagacacttgcccttcccctctcccctctttt

SEQ ID NO: 24635 - DNA, 201 bp, Bos taurus
gggcttaaacaggataaatttacttcttctaagttctagaggtttgaagttctggatcaaggcatcaacagggttggctttgggttggtctaattctaccagcctctatccttagcttatagatggccaactttatactctgtcttcccattgtctttcctccaaacatctgtgtactaacaccctgtctttaaaaggaca

SEQ ID NO: 24636 - DNA, 201 bp, Bos taurus
cttgtctagtgccccaatttttgaatgctaccagaggacacctatacataacctggctctgtggtcagcagggcttgtaggcatggggcctacaagatcacgaccagtagataaagagtttttaaacagctccctagcccttatgtaccagaggcgatagacccacaagctcagtctttctgtgacagaggcctgttagct

SEQ ID NO: 24637 - DNA, 201 bp, Bos taurus
tcatccagagtgtaggctccaaagagaaaagggctcactcatctcccacttcaccaaagccttccctgaagccacactttaggtaagtgagggtaaaatcggctttcacatagagctcagttaactttctcaaatctgttatcacaaaaaattcagtttgccagtggcttacttgtcaataaaggaatgggtaagtaaaga

SEQ ID NO: 24638 - DNA, 201 bp, Bos taurus
tcatttgaagccatttactaccacaacagcagaaaactgtttgcatcatccacatgaaccagctttgctgctccaagtccagtgcacagttgccaagagcaatgtgagtcattaggcttcaagcagatgctcagactcagaaggtgctgggcgttgctcgctgtgcgagcacagcgcgcccgcaacgtcgaggcaatcaga

SEQ ID NO: 24639 - DNA, 201 bp, Bos taurus
gtcagctgctttcattcatgtattcgatatagccacagccgatgctggaggttctgtaagccagtgaagaagaaaaagatatggtctctgcctcaaagagcacactttctagtcagaaaggcagtcatacagcgataaccacattcaacgggggcaaggccatagtaaaagcttgaaaaggggactgtgagaacatggtgg

SEQ ID NO: 24640 - DNA, 201 bp, Bos taurus
cctggcctccctcagattaaagtcctcccagagcaaagatgacagaaaagctaattatgcctgaaagtgtcagatcagagctcataaaagaggtatccttcgaagtgggccttaatggatgaggaacaattttccaggaaggaatcagagacattcatgcaaaaaaggtaacggaataaagacagtgaggtgatgatgtgc

SEQ ID NO: 24641 - DNA, 201 bp, Bos taurus
gtcatttgtacaaggctggaagatctatcacatgataaaatgttcagatttctgcctgaaggcagtaggaagtcaggggggtctttaaggaggtaagtgacctgagggcttcttacgtgaaggcagttttatgtggtgtataagacaggctggtgtggggaaagagcaagaaggagaaagacgttcaaggacaacctccca

SEQ ID NO: 24642 - DNA, 201 bp, Bos taurus
cggaactggccaagtgttacttctgctgtgttctattatttaaagctactctcaacatgggccagattcaagagggaggtggctatcagggtctgaatcctgggacgccactgatgtcacagccctccacagatgagtgaaggtagcagtggaaactgtaggcgtggttggaaagaaacacagcgtgatgagaacaagaac

SEQ ID NO: 24643 - DNA, 201 bp, Bos taurus
attaaggttaagtgaggtcacaagggtggggccctgctctgatgggattagtgtccttgtaagaagagaccccatagagctcaagttttctctcctcagggacacaaggaagtcgtgtggccatgcacattaagatgacggcgtctgcaaacccagagagctctcgggacttgcctgggggcctagtgattaggcctctgc

SEQ ID NO: 24644 - DNA, 201 bp, Bos taurus
acagtttatctccctcaccagatgataaattctgagggcgtggcctagaccagaactatcttcagttcatctgcactgcctgacgcatgcaggcaggtatgtccatacgtgctggcctatggtgcagggaacactctgtaagtgttggctaactgaatggatggctctgtctactatgaaaggttgtctcatctctgtggt

SEQ ID NO: 24645 - DNA, 201 bp, Bos taurus
gaccaaaatcccctcctggaccctctggcttagctggattctcgtctgcagtcacgccctgctggttctcacactccagaggacagacgttccctcaccttgtaggaggccctacatatacttaccagagatcaagttgaagagcaccaatataaaagtttaaaaaatgggaactatattcgatatcttgggataagctag

SEQ ID NO: 24646 - DNA, 201 bp, Bos taurus
ctaagtgttcctgtgccagcattaaggaactcagcacagacagcgggactctgggcttcctaatgagccaaagcgactctttgtaaagggattaaaatgggttggcccaaaagttctttcaggaaccctaaacgaactttttcggccaacccaacagaagaagaaaaataagaaaaggagaaagggtcagcaaatctcagg

SEQ ID NO: 24647 - DNA, 201 bp, Bos taurus
ttctcagtggtaaggtaagcactggaaatgccaatgcaacccttagatgaatctttcagaaccagcctagttcctgaaactcctcaagttctcctccacccgacagcaggcctcacggagctctggaagcgtttcacatttcccagttattaatacctcccttccccacttctctgtgccctctctccaaaaacaaacaaa

SEQ ID NO: 24648 - DNA, 201 bp, Bos taurus
tctacaccttagtatttccagttgaacttagaaggtcccttaggtttgacagcaatctttctttgtatcttttcttttttctgctagaaaatatcttagccgttaaatgattgtactcttaaaatcatgatgaattgtttaagagaactcaatgtagactatttataacagatcttcctgtttataaaacacagatctatc

SEQ ID NO: 24649 - DNA, 201 bp, Bos taurus
ttgagaactatcctctcctcaacttctacatgcacttaaaaaataatttaaaaagcatgtcagttgcttcctgttaattttcctttgcacatgatagttcacaacataaaaataggtttcacagtttagtattccattaaaatgcagccaccttccagatttcagcagcccattctctgggaaagcaaattttctttgtta

SEQ ID NO: 24650 - DNA, 201 bp, Bos taurus
tcagaatcctccctcaagctgattagcatgaaaacccaaccatcccaaacccaacccaaacccaaccatggcactagtagcgagatgcctcaggccaaacggctatctgggtgagaccacagctccatgtgccaccagggaagctgcttcaggacacccctgagtccccagctgctctaagacccagccctgctcatcaga

SEQ ID NO: 24651 - DNA, 201 bp, Bos taurus
agttagaagaagtctatgaaggaaatgaaaaataagaaatcacaaatttatgattcagtcatcaatttagcatttataatcagacatgtcttatgtattgctgtttttgttgtttagttgctaaggcatgtcatactcttggtgattccatgtattgcagcatgccaggctcctctgtcttccactatctcccaaagtttg

SEQ ID NO: 24652 - DNA, 201 bp, Bos taurus
agttcatgctcattctactctactgcttgaaaggaaaatcactggttaagcacttcttccattctgctctactgatgggatgttggccattatacctttacgcatgataagtatacttatacttcatggaaatagaagtaggtcttaagagattatagaaaattgattttgtgttaaaaggccacttcttaaagcaaacca

SEQ ID NO: 24653 - DNA, 201 bp, Bos taurus
cacatttatgatgaaaactattcagaaaatgggcccagaaggaatctcagttcagttcagtctctcagtcgtatccgactctgtgaccccatggactgcaacatgtcagatcactctggccatccccaacttccggagtatacccaaactcaggtccattgagttggtgatgccatccaactgtctcatcctctttagttc

SEQ ID NO: 24654 - DNA, 201 bp, Bos taurus
gggacagaaagggagattcagaggctcaaagaaaaatgtgaaatacactcgttgcaggcagaacaaagagaaactagaacagatggtcctagtcaccctgttgcactccacaacctgagatgcacatgtgttggagcatacaggagctggttgctgaaactcagcctttggctgacagacttaaggaaaggcatagagaca

SEQ ID NO: 24655 - DNA, 201 bp, Bos taurus
ttatggcctgtagggtttctgctgaaaggtcagctgttaaacatatgaggtttcctttgtatgttactttttacttcttcctagctgcttttaggagaaggtgatggcaacccacttcggtactcttgcctggaaaatcctatggacagaggagccttgtgggctgcagtccatggggttgctcagctcagtcagctgaac

SEQ ID NO: 24656 - DNA, 201 bp, Bos taurus
tgcctctcttggcttggcccacttctcccttgaggtgttctttcagttctttcttcagtgaacttgcctttgccagggctaagacctcagatgctttgtgttcttatttagaactgaggcctatgagaaagggtgttcttcgactctctccatcccaggtaacagaaggataaaaaagtccaaaggagctgaggattggga

SEQ ID NO: 24657 - DNA, 201 bp, Bos taurus
accccgactagcattcaaagttataaaaattatatgagtaataaaattaaggcttttatagatgtagggtaataaaaacataaatacagaggacaataagtaaaaagatctcaaggaaacactatgaagtgtttgcgaaacacacacaaaaattatacatgttgctaagcaagtatgaaataaactcaaagtttaggcagg

SEQ ID NO: 24658 - DNA, 201 bp, Bos taurus
gatttattcaaatggaggttcaggtatccaagatggagaagtgcacaatgcttctgaagacctgggctcagaatcgtacagtgtccctctgctacatcattctggccaaaaccaagttacaaggccagtctggagtcagagcaaaagacatggatacaaagaagccaatgattgcagctatcaataaaattggtattgtat

SEQ ID NO: 24659 - DNA, 201 bp, Bos taurus
acagggtggaagtaagggagaggccagaatctaaagggcacatgaacccaaactgctcagcttctgaaggtgttaattttccactcctttcccaaaaagagctagttgattgtcttttattagtcaaaactattctaatacaaccaaaggggggaaaaatcattctcacttgttgataaagatataatattacaattaagc

SEQ ID NO: 24660 - DNA, 201 bp, Bos taurus
gattagtttccaggtggtctttggccaatcattctaattcagagtccttcctggtggctcatgcatcgctcagccaagatggatgctagcaaaagggattcggggaagtggacagacatgcggtttctccttcgaaccgttccacactcttccggttggtggtggcttattagttctgtattccttatcaggatctcctgt

SEQ ID NO: 24661 - DNA, 201 bp, Bos taurus
ctgttgtacatcttaaagagacctgtgatcatttcctttcattccatctgctgaatgacatattcatgtgtttactgttgctgtttcctaagcacctccactctatgctttactatttaaagttttgatttgccataagtataaagcatttcaacagttatgtgtaatgttatcttacagagcagttccaggtgttccccc

SEQ ID NO: 24662 - DNA, 201 bp, Bos taurus
agaaggaggtcagaggcctgctctcttgcttctgaagcctgaacaagactacttccattttaattttctgaacagctatatatttaatttatgggcttccctgaaagctcagttggtaaagaatctgcctgcaatgtaggagaccccggttcgattcctgggttgggaagatccactggagaaggaattggctacccactc

SEQ ID NO: 24663 - DNA, 201 bp, Bos taurus
ttgaggtctacttttcctgggcttcagggttgaactctttcttcattttggtttgtgccttcataaggtttgtccaatggtttatgtaagcttcatgtacggtgtgacttgtacttgagttctagtggaagaaggtgaagttttcttctttgttttcttctgataggcttggcctagtgaggtggcaatcctgtatgctga

SEQ ID NO: 24664 - DNA, 201 bp, Bos taurus
gcagggactttatggtccacacacaacaagcagcctatgagaagcccaggtgtataagacacggggctacaaaggaaaggcggccagtgtgactggagtgttgagagcatgaaagagaagcgatgtcactggagacaaaggtcgggtccggatgctgcagggccttgggccacattaacaaattttgatttcaagtgcaaa

SEQ ID NO: 24665 - DNA, 201 bp, Bos taurus
agtatcctggcctcccagaactctttatcactctatattcttgctttaaaaggggtgtctggagagcccttgccagcgcttgcagaatgaataaaggtaacccaaggaggccggtggttgaatttggtctctgtcaccaggaggaaaccaggttctgcagctggaaagaattaaaatgtaatagttggcagtgctttattg

SEQ ID NO: 24666 - DNA, 201 bp, Bos taurus
agacttggttcatgatggtcatctgggcccccgagtcgacgaaagccttcagaggatgcccgttgactctgcagttgatgtagagcatagccacctggccaaagctctccggcgcctcttccatggctatgctcatgttctcctcgatgttctgctgccggatctcctcctctatcttggcttgggcctccagatcgaacg

SEQ ID NO: 24667 - DNA, 201 bp, Bos taurus
gtgagtgtgaaatgaaatccatattagggtaaaattccaaggtgaagaaaagatttaaaacattgcatcaaagttctcatttgggccctatccaaaatacgtgacttctttttcagaaagcctttatgtccgtcctaatgtacaacataaattgaagcacagtctctgtggaggcctggtaacctggcaagactcacagaa

SEQ ID NO: 24668 - DNA, 201 bp, Bos taurus
attcaggcctttgatgctttattttcatcttgactctcctctcagagagaagttgtagtttgatttttttttagttgcttattgtggaaacacagagttacacacacacccaaaagggccctcacctcccagacagttaactctgaaagaatctgaaggtccttttgttagtctattgtctctctgcacagaggctgttac

SEQ ID NO: 24669 - DNA, 201 bp, Bos taurus
ctaaattatgggttcattttagtgtatgactgtcatctctgggttactcaaaatccatgtctatctgtctatccaacaaaccacttactccacgtcatttcgaaaataatgtgggcgtaaatgttcaatcagatgaattaactcatcagtaaatttagaggaaaatcctccttacatagttggagacaaagatgagataag

SEQ ID NO: 24670 - DNA, 201 bp, Bos taurus
accaggagtcagtcaaatcgttcatttaataggcaatgagtgcttttagggatgcttcataatcttacaaattttcaggtgaaattttctgtaccataacaacacctagatatttatgctgttctagtttagtggctctaatggtgggagtttcagtgatgtcaggctggtaagaaggaggtgtagcagtagcggaaagta

SEQ ID NO: 24671 - DNA, 201 bp, Bos taurus
gtgatgcaaagtgttctgtagtgatacctgatctgccacaggctcgggtgcctgctaatcttgcactgtacccaaagctcttataaagaaggggatgagggaaaaaaaaaacaacaagggaatgagcttgtttgggagttattcccatttgagcatggagaaaatacagctttgcatattttctcttattttgtcctcttc

SEQ ID NO: 24672 - DNA, 201 bp, Bos taurus
atgtggtctttaattctgtactttttaaccccaccttttcaaaatttgcatttaaacaagtgcggaggtctgtcgtttgacctctgccctctgacctttttcctctcccttagtttaatggtcgctgccttaagacttttgaaaagtatagtctttgttggagaagttgccaatctttgcatacagccttgcctctccttc

SEQ ID NO: 24673 - DNA, 201 bp, Bos taurus
tcttgcattggcagatgggttctttatcagtagggataccttggaaattctattctttgcagcaccaactactgtcaaatgagaatgcagacccagtgttgtaatttctgaaaaatttcccctagaaaacctgaaatatcagatttttaatgtaaatcttgtataaatcttgaatcataaatattcacaactaaacccatc

SEQ ID NO: 24674 - DNA, 201 bp, Bos taurus
ccataagaaaaaaaggaaatgtaatacatgacttaaagaaagtagcaagtgataacatatgctatagttaatgacacgttctccagttttccaatctttaaaattcttaaatgaaaatgtttccatatttgtaagtcccataccagtattttttctgtcctatattaaaaacaatcacaggaacaaagaggtacatgaggg

SEQ ID NO: 24675 - DNA, 201 bp, Bos taurus
tacaggagtatgcaaagaatataaagaattttatacagctcagtctgttttattaaaacctgtattggttgtcacatagctcattaattgtgagaccttttatttgacattacagttgctttctgtactcttctgctgctgcttttgtcctacttttttcaatatctcagctaacaagtgtttgcatatttttaaaccaaa

SEQ ID NO: 24676 - DNA, 201 bp, Bos taurus
tcggtatctgcatgtcccccgcgataagtgggggtggggtgctgaggctcaggctccgagggttggagcccaggcagaagaccgggattggctgtgtactatctggaaatggcagtatggcacagatgagggggccaggaaaaagcctggccctgccaggaaggcaggagatgattgtcgctggaaccctctaactccaca

SEQ ID NO: 24677 - DNA, 201 bp, Bos taurus
agatatctctgccctcatctttatctctgtattcttactgaaccacaaaattcctaaagaatgagacttgtatctgtttaactccatcagatgtatgaacatcagatggtctgggtttcatttttgtttccattgcagtggaattgtggtatgttttggacagaataatagctggttaccacaattgaccagagagctgca

SEQ ID NO: 24678 - DNA, 201 bp, Bos taurus
atggctgaagttaccatctgtactgattttggagcccaagaaaataaagtctgtcactatttccattgtttccccatctattttccatgaagtaatgggcctggaaacttgaatttaaatattcagatccggcctgcttaaagaaaaagaagccatcctcttgctttttaaaaatcttttcatcttttcctcctccccaag

SEQ ID NO: 24679 - DNA, 201 bp, Bos taurus
gaagagccacatgtgactccctcactccctcagccagcctgggtttgctcctgccacacacaaggcctttgcacttgctggcccaccctcctggaccctctctctgctgcatttggacagcatgctccgttatccctttacttactagctcgcaggccccttaccgtaagtcccaggactgctggggctgtgtcctgttcc

SEQ ID NO: 24680 - DNA, 201 bp, Bos taurus
ctccaggcctccccttcccgtggagagccagatgtgggacccaagtttgccgcgcttgccccgcagccaccctgccccttctgccacacagccctcaccccctctgctctggcctccgactcttcctggctctacctgagccgaccgttccctctacctgaaatgttcctccccctccacgcagaagagactcactccgtc

SEQ ID NO: 24681 - DNA, 201 bp, Bos taurus
ggcttaggcagccccagctcactcctcagtagctggcagacagtcctcaggaacagaacaggagatgaaaactcaacagcatttcccccaaggcccgggtcctatgttccaagaggatctaccagaagatgcctttaaatggtaaacacctctatggtacctcagggccccaagaatttgctcagcctctcctagacacct

SEQ ID NO: 24682 - DNA, 201 bp, Bos taurus
attagatcaataaggtggggttaatatgatggccaacatcatctcaacaacacctgagataacatggctagaagctaaagttctctaaggaaatcctgaaaagtcaaggggcctgtgagtacttatggagaagcaaggtttttgaatctcatcctgaaaaaaataatgaattggggcagatgggaaaggaaggaaggagat

SEQ ID NO: 24683 - DNA, 201 bp, Bos taurus
aggatttggccctagaggaggaaaagtgacctaatttttcctacctgcatgtgtacatagggaaaggggttaaccataaacagtgacttcttataattgttagtcatgactgtatgaatatcccatgtcccaatctacatgggatttttttgttttaatcaagttccaaactcagttttaaaaaaattaactgatttgtat

SEQ ID NO: 24684 - DNA, 201 bp, Bos taurus
cttctcttgaaaggagacccagaagttaggacctggggacaaggaggcagagaaggtgggagaagccataagtgtttataatgtactctcttttcttttattctcatcccatgatgaaattctcatatattatttacttggggtggactacatgaaagttctttggaaaaatatgtggcgagttgtaaagggaaaatgatg

SEQ ID NO: 24685 - DNA, 201 bp, Bos taurus
gccagaaatgtggattctggctacttcattaacttttctgggtcttttttgttgtcgttcgagtcgaggtaggtgttagttctttaggcataaaatgttacggtgattctaaaccacagtgcaccttcatattctctgtactttcaagacagcaggtatagtaataaattggaactgttctggtgctttctttcctgaagt

SEQ ID NO: 24686 - DNA, 201 bp, Bos taurus
atctgttatactgtgtacgatgttaaaactcacaagccactaacttatctttgttaatactgtctggatttgttttcatttcctgcagcatcattatgttgtctttcttcctaactttgcttaccactttataatatttggtcaactgaaggtattgcctccataaactagttaaccataaggtttctacagcagaacctt

SEQ ID NO: 24687 - DNA, 201 bp, Bos taurus
gctttagtatgtaaatttataaaagattagctttctacaagcttacttagacctcagaaatgttccaataaagtaatgagcgttggtaaaattttaacctaaagttttatcacctctttacctttttaactccaaagaaaattattattttgaaaaactctactgttgcaagatttttttcatttcactgatgctggctat

SEQ ID NO: 24688 - DNA, 201 bp, Bos taurus
acattacacagttttgttcgagtcttacggtgtaattaccattacacggtattataatgtaactgcaaacacttattgggcagaggaccatatttcattcatattataactcttgctaatcaacatacagcatataataggtacttaagacttcacatttttattctctacctttctagactgcatttctgttactcatta

SEQ ID NO: 24689 - DNA, 201 bp, Bos taurus
taatgtgtgtaagactggcctggagaccttgaaagaatgcagattatgacttggtgtgtctggggaagcctaggctgctggctttcaggccatgatttgagcagtgagggataaccctaagaagactgaacagataattcagtcctggtgtgaatggtccatagtgggctaactgggagctgcctctaagtggaccattag

SEQ ID NO: 24690 - DNA, 201 bp, Bos taurus
actggtgggtcagtcatcttaaaggccacatgccatccagtgagactgtcctgtcagctttccccacttcctgctaccatctcaatacagaggtcattcagggtggcctaggttggaaatgacctttctatgatagtcaggtcttgtaactgttttccttacttattctttataacaaagatgataattggtgaatgtgag

SEQ ID NO: 24691 - DNA, 201 bp, Bos taurus
tctccaagggaacttccgtacatgaactggggtctcctgcattgcaagcaggttctttaccagctgagctaccaggaaagccccagaaagattaagcctacacttagtctgaaaaatacttaaaaaaatgtgccttggtagatcagagcatgaactccagggaaagagctacagggtataggttgaacattcttgaaaatg

SEQ ID NO: 24692 - DNA, 201 bp, Bos taurus
atatttttaatcctcacataatcctttaaaataggtacaactattactcctattttaaccaaagcatgaagtagttaaggcatttgcccactgtttaatacttaatagaggaatattcaaacacagctctaattctaacatctctcttctctaccactgttctcccctgctcctgggaatgtaaagtcatattagtcctag

SEQ ID NO: 24693 - DNA, 201 bp, Bos taurus
tgcggtaggcggtttggaagccttcgggtcagcgttggtaactgcaggagacctggcccttgtcctcatggggcctggtggaggtggcggctgtgtactcggaaggaagcagatagagcaatggagaagaactacagaaagacataatcatatattctttcatccattcagcagagatttattgaggcagtaccagacact

SEQ ID NO: 24694 - DNA, 201 bp, Bos taurus
gggtagtatacccatttagaacaaatgggtaagagtaaactggttgtgattatatttggacttaccaaacacattattaagaaactactattaaacattttcacagataataccgtacttaattttcgaaaaagtcagtttttcctactgtacagattttaaaacaagaagctcctaaagtaagcatgatgtacctgaggt

SEQ ID NO: 24695 - DNA, 201 bp, Bos taurus
gtccaccctctgtagcagttcatgctcgtatttgaaacctaaacaaaagcctgcaattgtaagtggttttgacttggccttgtcttaagtatttaaatacattctccttcagatgtaataaggatttttcaccttcttcttataaatggcctgtgtgccaaaccatagccatgaactgagcatacgtacttggattcaaag

SEQ ID NO: 24696 - DNA, 201 bp, Bos taurus
ctctgcatacagaagtagcaaataagggcccaatccagcttgagtgcatagtgcaaggcttctcagaggaatcaatggagggacttgaaaggtgtgatgatacaataggtaaggccaaattaacaacatgtccagaagctttcaaaaagcagcttccacctatgcatccaaaaacctctaacaagactcacatcaagctga

SEQ ID NO: 24697 - DNA, 201 bp, Bos taurus
tgaactaagagtcatcaccttagggtaggtttagcccttagcagttaatattctgctctgcagttcggctttgtggcaaagccagggatgttgtcattgcgggctttaagctcaggaagatttcgttttttttaatatagagaatgggaggcagagcaagcgcccaaaattgagataaatgtaggcacttaccttgaccac

SEQ ID NO: 24698 - DNA, 201 bp, Bos taurus
ggccggcagcgtacttcttgtggccagggaagactggggaatttctcaaataaagatattctaatgagactgttaactccttcctagatgtgtggaaatttcacagttgtgggtgggccaccatggtttgtatcaatcagaggatcatatagtaatctggcttcccaagtggttcagtggtaaagaatctgcttgccattg

SEQ ID NO: 24699 - DNA, 201 bp, Bos taurus
cggtcacctagccattcttctcaaaggaaaatacctaaggtttgttatctatctatctatgtatctatctgtcatctatctaacgtgtctaaagtcaactatgtcttcatccaaggattattcccgttaatattttgctattattccttcatctatattgtctagtaaagcctatggtttttccagtagtcatgtatggat

SEQ ID NO: 24700 - DNA, 201 bp, Bos taurus
taccacagttatttgtgtacagctattccaagtatcttattgatcaaaaccatcatcactgaaattcagtaaactctcttactagaccaattctactcctaattctcctttagtctgtctttctgtctttgtaacttgttcttaaaactcccaagtgaatataagcaaacatattttgttatagctgttttaactcctcac

SEQ ID NO: 24701 - DNA, 201 bp, Bos taurus
gccccattgtttttcaaacctcagctttctgggaattggtgtttctgttgctgaatttcttggctgagaaattcagcttacatttgtggctaggacccctcacttaatgaggagaaactctgtggttgtgatgttcctcctgtttgtgctcgtgtgtatgggtcttgtctaggctgcctttttgtccctctgacccactga

SEQ ID NO: 24702 - DNA, 201 bp, Bos taurus
gtttatttcaaatatatttttctctagaaaggtaccatgcatctctgtagtgggactgcccatgctacaacatagctaccttgtggaatgccacctgttgtgcatggcaactcaggaagaattcaacaatatttcacaacttacgttagggagagattttaatgtgtgatagacataattacaagtcctagatcagcaaga

SEQ ID NO: 24703 - DNA, 201 bp, Bos taurus
gtgctataaaaaatatagcacaatttatataatttaattcttaagaaaatattgagctgaagggtatgaatgtattagtgaaagagccagactagtttggaaaaacatttccgtggagttttgtgcttttcaattgaagcactaaaactaaattttagtcttgttgacaacaccatggctttaactacactcattctttct

SEQ ID NO: 24704 - DNA, 201 bp, Bos taurus
ttaaatatatgtacaaaaaaaaataaagttaagctctaagtgcaaatagcatagaattactatttcccaaagtgttcctgattaactccagaaatatttataaagtgcttacacaaaatgccttgctttcatgaaactacaccctagtggagaacacagaaagtaactgtaaaattgtaaaaacacgaacataattaaaag

SEQ ID NO: 24705 - DNA, 201 bp, Bos taurus
attatacagtcaggttagtttatgttcagctctaagacattaatttagttgaatgtactaaattcaaaatgtactaatactaaagaatgcttaaacaagcaggtagaatctaggaacattttttaagaaatactgtatctaaatgataacttcagtgtgtaggcaataaccattgctttgatatacttaatataaattcaa

SEQ ID NO: 24706 - DNA, 201 bp, Bos taurus
agccagctttcaaaaaccaaaatgaaaggtcaaacaatccaataaaaatgggcatgacagtcgagaatgcatttttccaaagagaatatcaaataaaccagtaagtatatgcaatgattctgtctctttagttttagaaaaattaaagagtaagacaacgccaccaccaaaagcacaatgtgacatcacaacatatagcac

SEQ ID NO: 24707 - DNA, 201 bp, Bos taurus
cactacaactagagaaagcccctcgggagcaacagaaaccagtacagcgaaaaataaataaaatttaaaaagaaaaatgaaggccaacctaatcagataatatgttttcatagacatttggaaggtattgcttaaatgcaaaggcttgactacactggccagtaatttaggtgttatgaacaagacatctacagggaagca

SEQ ID NO: 24708 - DNA, 201 bp, Bos taurus
ggtattaaactatcagaatttttaaaaagtcatcaataatgttaggctgcagagcaaatgtaaagctatagccatagtcatgttacatactagaaatttggtggctgtatttgcagttttctcactggcaggaaaaggacctattctggtaatcaatacccttgctccactcaacagagtaaagtggacctgtagattata

SEQ ID NO: 24709 - DNA, 201 bp, Bos taurus
gtatgcatatagtcatgctttagtgaataccttagggtttaaagtgcataactttcaggcattttattccttccatctgggcttagccattttttccagagatctcagatgctcataaataacagattccttgaaacatttttgacagagtattagataaaagattggttaaatatctggcagataggtatctgtgtcagc

SEQ ID NO: 24710 - DNA, 201 bp, Bos taurus
tatttttgatagattttaaaacatgtcttcaatcttgactgtaactgatcattcaaaagtagggaagctgtttgaatttaaagtctctgatttgattaatccaagagtgcccaggcatatgttaagccatttataacttataaattaaaattaccaattctacacaagatattaacagctacttctaattatactgaaata

SEQ ID NO: 24711 - DNA, 201 bp, Bos taurus
gactacagctatctctgagcataatttatgctgttaatagagtaaacaaattagcggcctacataaggcaaagtatgagcaaatattttctttggtggtatttgaagaatctctcatttcctcaagccagatgacagagctaaagattggacacataattaattgcaagagtagttgaacttaagaggaggctaattttgg

SEQ ID NO: 24712 - DNA, 201 bp, Bos taurus
ctatgatttttgcctgaatgcctaccctgttttcaagcttgtgtataactagagtcagcatcacattatacagtcaactataaaacaaaacttgagggtagatggagagtttagaaggccttaaaatatcacccctattgccaatgacaaaattagttccttttcatattaatttttggggggttaaaatggctagtctaa

SEQ ID NO: 24713 - DNA, 201 bp, Bos taurus
tcattcccaacatatacatcataaaagttaaagagacactccacttcatttttcagatttataataattagataaaggctaaaattgggaatataaaaatgatcaacattcctacacaagagaaatatataacccattgcttttattgagaatatggaactaagggaccttgtaaactgagttcaaggtactgtacttaag

SEQ ID NO: 24714 - DNA, 201 bp, Bos taurus
agactgtgtgaaaccacatttagacaagactgattgaaatgcttacctcccattgatcctggaaatggagctgagggcaacatctagacatgtgttgggactgtggcaaagattgttagagtacatttggttttgtgtgaaacagttgcaatatgctatgagtaaaaagcccatttgaaataatttgtatgaggaaaaaga

SEQ ID NO: 24715 - DNA, 201 bp, Bos taurus
atgctgtctgggacgggtttacatttctctgaaatgggttgactagtacccttcttcagaacaagatcaattaatatctcttccactcctgggactccagtatgcctcatctagaacttgactagagtcagagattgactccttgcctcttcaagaataaaggctcggtttccattcagttgcccagggagtatggtgggt

SEQ ID NO: 24716 - DNA, 201 bp, Bos taurus
tgagataaaacataaaaagtgctaagcctagagcctagacatagttggaactccattaagtgttggccattagtattattacatgctttcttgagctatccattgccacttttttggcatatggttaatgcactcatcagcatttgcataaatggtgttttaaaaatatgtgtgataagcatcctttgtatttgcatagca

SEQ ID NO: 24717 - DNA, 201 bp, Bos taurus
tagaggtatgtgcctgtcaggaagagaaagccaactccatgtttgcagagtcaagatgaaatcaaatgtcatatggcttcacaggggccatatgttgatgcctcttcctataggaggaatcgctgagtcgttcgaaacagagtgtaaaaataacaaacgggctgaatgagcaggcacagtcagggcctaggaagtgtaaga

SEQ ID NO: 24718 - DNA, 201 bp, Bos taurus
ggcattaaggaaggtagagattaacatgggctgaggccatctaggaagactctcaaaacaaaccaacagtatttataggccccttctatgttcaaagcttcgtgagggctggagagaagtgtgatcacagagatgggacttaagcaggatcccagcggatgagaaaattactgactggccaagaagtgaaggtaaagtgaa

SEQ ID NO: 24719 - DNA, 201 bp, Bos taurus
taatagtgaccttagccagaattcccatctgtgaaccaacacggccaagcacaggcagcctgagcaccagaggaaatttccagtgagaacacgaaacagtctcatctggatggaggcttgtgccaatgtcaggagggacagaaacagtacaatactgggaagtgtggcctgtgtttggccctgtaaggtccacgagttcat

SEQ ID NO: 24720 - DNA, 201 bp, Bos taurus
gcgattcatggggtcgcaaagagtcggacacgactgagcaactgatctgatctgatctgactgtattttgcaatttaaaattttctgtttggttcttttatgtatcttttatttctttactgacattttctatttcttcatttgtttcaagcacgttcataaccgctcactgaagcatttttaggatatcttctttagcat

SEQ ID NO: 24721 - DNA, 201 bp, Bos taurus
tgttagtccaagatcagagtggtccagttgagactatcttcctggtttgcgtttgtttgcatttttgcagaatgtctagcggcagagagaaagagagagaaagagaaagaaactaaggaaggagagagagagggtgtgtgtatgctctccactgggattaatgttaattaattgaggattaattttaattatatgagaggt

SEQ ID NO: 24722 - DNA, 201 bp, Bos taurus
ccagctgtattttatctccatagcagttgtcaccatctgatatattatatggtgctctttttcatttttcttttttctccaatagaatacaaattccatgagactagggctttttgtctattttgttcatttgtgcttcatcagtgcctgaaggagtacatggaaactacatggcttatagtaggcactcaaatatttatt

SEQ ID NO: 24723 - DNA, 201 bp, Bos taurus
aggatgccaaccatgaaaaggacctgggaggatgcgaacagatcattcaaggcaaggaccgggaggtctgcttcatgacctggctctgccacccactcacctcgtggccttgactaagcgtgccatcctcttcaggcttcagtgctcttatttgcaaaagagggtaaaatacccacctcagggtgttgttgcaagatgcaa

SEQ ID NO: 24724 - DNA, 201 bp, Bos taurus
tggaggaccagtggttaagactcagtgcttctaatgaaggggacaaaggtttgatctctggccagagaactaagatcccacatgtgtcatggtttggccactaaaaaaaaagagtgccatacataaggaaattgcactcagtagaatgttattgaggtcctacataatgtatatattatgtatgggaggggttttgttggc

SEQ ID NO: 24725 - DNA, 201 bp, Bos taurus
gaggagtgtggttaattatgatggctacacataagaagagtcctgggacctctcttaggtcaagagtcacattgatagtttataaattcttcaaggtaagatggagaattgaaattaaaatcagcaagagaacttaggtcatggtgtttggggaggggaacataaatcatgctgaagtggtgaggtgagtgaataagagtg

SEQ ID NO: 24726 - DNA, 201 bp, Bos taurus
atatagatacaccttgggataaggtaattaattcaactattggttttattaggtctgataagatgaaagattaaagagtcattttcactgttttctgtgacactgaatgtttagtaactacaataatattttggctttcagaatgtgattggttgaaattcacctgaagtataattttaaaatgtctgaaaattattgtgt

SEQ ID NO: 24727 - DNA, 201 bp, Bos taurus
gtagtttattgctaatctcgtagcactctgattacaaaagatgctggatatgacttcagttttcttaaatttttaaggctgaccttgtggcctagcacgtggttaatcctggaatatgtcccattgctcacgagagtaacgtatattcagctgcttttgaatggaatgctctataaatatcagttaagtccatctgctcta

SEQ ID NO: 24728 - DNA, 201 bp, Bos taurus
cggatgatttttcagttagatttggatgtgtataagaggtttctagaggaagaagtagggagaagggaatccaagaagtaactgtaggcccaagtgtagaagcacaaacatgcaatagtaggttctggaagcaagtggtctatgcctagggcacaagtgcaaagagctgtgggcaagaagcctggaaaagtaactggaggc

SEQ ID NO: 24729 - DNA, 201 bp, Bos taurus
taggttctagcctaatgggtgatcttggccaaatattcaactctcttggctttgtttttctcgcctgtgaaagaagattcaacgacactgtaggtttttatcaagcaggcctgcacagttcctttcacggctgaaggcatactcctttgtggagtgattttgttcctcctctgccttcttgaatctgggctggccttatgc

SEQ ID NO: 24730 - DNA, 201 bp, Bos taurus
ttggaaacagaaggattcttagctgtggagggattatatttggatggtaaatggagttctaaatgtaagtgagcaaacctttaaagtgaccacttatctgatatggctgagtgaacctgagaggggatgatggactgggaagctaatataggtgaggaaatggagatcacaagcatctagaaaggtggagcaaagcatcag

SEQ ID NO: 24731 - DNA, 201 bp, Bos taurus
gcaaaaggttgaataagatactcctttaaaaaactcaccatttggctaaatttagggtggtgaacaccaacaggccaagaatattctttggccttgggcctatagcattttcatttgactgggaattggatgtatttttatttcctcttgactcttatcacctttgtctttagaggcacaagactaggtactgataattgg

SEQ ID NO: 24732 - DNA, 201 bp, Bos taurus
tttgtctgttcaagcaccaatgccataatgattctattactataactttacaataacttctggcattttcatacagtgtgttttcctcgtcctttctcagaactgttttggacttttgtttcttgtatgttttagatttggattattagcatccactggagatggtgactgcagccatgaaattaaaagacgcttgctcct

SEQ ID NO: 24733 - DNA, 201 bp, Bos taurus
agccctctaaatgcttataaacaatccatgtactgctttacgtggggtaaacatcaagcttattggtttataatacataaagttacgagactgagaagacccttgtctcttctggaaatcaggataaactctgtgtcgcatgtgttggacacgtgctcatgctctgtgattcctcatggattgccatttgggtttcccaat

SEQ ID NO: 24734 - DNA, 201 bp, Bos taurus
gaaacaccataatcaaccatgctaggcacttgccccaagtcctgtcattgaggaagttaaaactgaaaaatacccaacatgaggagagttggggcaaaggtattaacaaacaagtgagccaaacactacagcagaggagctgctggctccttaagtaagcctagagtcactagaacttgcctttttttgcaactggaaaga

SEQ ID NO: 24735 - DNA, 201 bp, Bos taurus
tatatgtgagttctctacccatattcacattagaaaaactgagaaaatgttaagatattaacttaaatataacaagaaaaaacctatcagatgttaacattaaaaacatcaagtaggcttttcagaaaagtctacttacatgtttgtttaaaaaaggcccagaaggctaacgtcagagctgtttcatttgattctaagagt

SEQ ID NO: 24736 - DNA, 201 bp, Bos taurus
tacaagatggtttgtgtgtatctcttatgacctagtggttcttatacataaagttcaattttttttatatggtataaaatgccctttaagatctggctcagtgtcttcttatcaacctcatttttcacttcccatttttttcagttctgcacacagtcccacccatcgtttcatatgcctcaattacttccttctacacat

SEQ ID NO: 24737 - DNA, 201 bp, Bos taurus
attcttcacgccccaaatatccagttccaccgtggggttcaggataggttctgggtcctggctgaaggacgttcaggaaacatcagggtcctaattctgagggaatggtattctgctcagggcaagaagaatgctgttcttttgtaagaaacccacatcattcctagaaggaagggactatgaaaataacaccgttctctt

SEQ ID NO: 24738 - DNA, 201 bp, Bos taurus
actgcagcatctgcagtgattttggagccccaaacaggttaggttgtttatttgagattttacttgtttcctgaggaaggcctgtactgatgtcaactccacatacaaccctgtgtgttagttactcagttgtgtgtgactctttgcaaccccacggactgtggcccgacaggcttctctgtccatgggattctccaggca

SEQ ID NO: 24739 - DNA, 201 bp, Bos taurus
tccacctttggattcctgagctccatggaagaagtacaacggccctgagcttgccatgttgtgaggaagtccagaacacatggaaaagctttttgtaggtgctctggctgacagtctcagacgaggttccagccaatggacgtgtgacatcatcacagacaccaaccaccgaccatataagagtggagatgcttccagatg

SEQ ID NO: 24740 - DNA, 201 bp, Bos taurus
cagcgcaataaataaattgaatcattcaggcaaaacgggttaagggaactgatgtgaataaatggctccttctggccttccctagttatattaataaacacctcatggaaaatcttaaccctatgcttgtcaaactctgaagcaatccattgctctttctctccttggattttctaagagcggaacaaaaagatatctgat

SEQ ID NO: 24741 - DNA, 201 bp, Bos taurus
cacagaggggacatgcaggaagcgtcccacccaatccacccattcccacattctcattctcccttctgcagtcaacgtcccagccaggtcaaagacacacactttgtgtgtgtcattgagagcagggatggaggggtatgtcctgcaattctggcttgatctcccttcagagaacaaaggaaagcagagagaacgacttct

SEQ ID NO: 24742 - DNA, 201 bp, Bos taurus
ggccttggggagtgctgtcctcagcagagagctgggtttcatcagagatggcagagtgtagagaatggatcaaagatgtcatggagttcactaggcagtcaggggttcaaatggcccagagggaaggttggtgagagaagcgtggagatggggaggagagggtggcgggtggagatgggggaggagagggtggtggatgga

SEQ ID NO: 24743 - DNA, 201 bp, Bos taurus
ggaggagatggccacaagcctgggcaattattaaaaagcaattaatctctaggacgagtggtttggggaaggtcacgccttcttccattttatttgggtcgctttaggatcttggcctaagccgtggtttctgcaacttctgcactcggtaagaatcacagagtatccaaggaagtttttatctgtcctatagcacattca

SEQ ID NO: 24744 - DNA, 201 bp, Bos taurus
gtgtttatgaaggccatgaggttcctgtgagctgtggtggacactcattacatgaacagtgcctccctgcctgctgctcagtctgggttgtcaggctatccatggcagtaacctggcctttgcctcatgtctgcttcctctggagtagcagggctcagcctctctcctttctgggttgggagggcagttggtgagggcctg

SEQ ID NO: 24745 - DNA, 201 bp, Bos taurus
tagctcagccaatggcgagccactcagcaatggagctgggacttgcagctcagccgcctgacctcaaagtccatgcagccaactccctctccgggatctccctctagaaagtattttgacacctcaaacatgagccttggagtgtcctcctctcttctagggtgcagttcaagtcaagattagaaaaactgctgtagagat

SEQ ID NO: 24746 - DNA, 201 bp, Bos taurus
ggctttgcaggccatgtatggtctctttcccatattcttttcttaatacctctttacaaacataaagctattcttagctagaaggctataaataatacggcgtggactacatttgaactgcaggccgcagtttgccaactattttcagagcttctgtctttgcccaccgtggccaggagtggggggccaacagggcacaat

SEQ ID NO: 24747 - DNA, 201 bp, Bos taurus
caagctgagtgatagtgcaacacccctgggcctctatgatcatgaaatctaaactcaaatccttttatactcaaccttcaccagatgttctcctactgaggaatctggggcctctgggagctgggtctctgagggccttttatcaggttccagtgtgacagaattcacacagttgatgtggatgaaaaatgtgcatcctct

SEQ ID NO: 24748 - DNA, 201 bp, Bos taurus
tgccacagaaaccatccaggacagtccggctccttcttctgtcgcctaagtggcagttcattactactaccatttgctaaataacacagcacaagcttgacgtgggacgggtccttggagcaggaagcggtgactttgctctcaggccaagtcctgtggggtgaggacagacccggggtgataggggagacgcccgcctgg

SEQ ID NO: 24749 - DNA, 201 bp, Bos taurus
agaggggccaggaaaaccccactgcctggagcctgtgtaaatcagagtgctgtgagtagcttaggtaccccgaacccttccctcattcccagcaaacctctttgaggaaggccgaggttaagagcggtaacaaaccacaggtcagcacacaggtcacttagcgcttgcacacctccccagagacacgcagggccctgcaga

SEQ ID NO: 24750 - DNA, 201 bp, Bos taurus
tctcaaacctcacatgcttatctgctatgtactcaaagtctcctagttctgttgtgaaagaggaaaatatgtaaataattgtatgcatttatttttttttgtaaaaaattaggaattcaaacagacaccgtcatctttttcaatgacataaatctcctggaacatcattatgaatctaagggggaacattggaagctctta

SEQ ID NO: 24751 - DNA, 201 bp, Bos taurus
tcctgctgccatctatttttgtactttaaatggagaagcaatgactttgtaacatgtagctgtgaaccttaactaggaacagtagaaatggagtgggtttgcatagtgtatcatcattttcagatttatttggctagtgtagacagagcattaggagaatgtagggaactgaagctgctctgcagatctttgaacacatca

SEQ ID NO: 24752 - DNA, 201 bp, Bos taurus
tcctcacaacaagactggctacataaatttgtggggcctcatgcaaagtggaaatgcagggtcccttgtttaaaaattattgagaacatcaaaatgacactaagccaagcatggggcccttctaagtgcaggactccctatgactgcatgaagccagcctgcctcccagcctctcagttcttgccatgcctctgccctgac

SEQ ID NO: 24753 - DNA, 201 bp, Bos taurus
acaagaggatatgtggccttggagcctgtgagaaagacctccctccaggaacgagccagagtgtggagaacaacagaggccgagagctcgctgcctctgaatgtctcctctgttccccttgacgtgaacttcttcctcaataaccttttacataatcagggcccctgaaggttagctgggcttcccatactgtcaccctga

SEQ ID NO: 24754 - DNA, 201 bp, Bos taurus
gcaagttattgccttgattttcatctgtcttccactgatttacttattagattcctccagtagagagtatctcttctagctttggataaaccactgtcctcaagtgtcctcatcagcgaggaaacgtacactgaccttcattttctgttgtttaaacttataaaaacaatagttttttttttttttttttttcacatatat

SEQ ID NO: 24755 - DNA, 201 bp, Bos taurus
gagtacatgcccttgccttttctagcttctagaatttgtctgcttttcttggctcctccatcagtgaaagccagcaactttgggccaagttcttcttagctggctgtctggtcctccctcctttgccttcctccttttttttttttcccctgttttacttttgaggacccttgttacatttggcccacctaggtaattcaa

SEQ ID NO: 24756 - DNA, 201 bp, Bos taurus
ttctccatttctagcccacagctcaggacgaggtacatagtaggttttcagccagtatttgctggttcagcccctcccagagccctggaccatctctaagttgagttttttctgattccagtaaacactggaagccacccacatatgatcaagttggggcttcagcaagaattgaatcttgtcccaacctttccatccttc

SEQ ID NO: 24757 - DNA, 201 bp, Bos taurus
cttgacctggggctgtcaggcaggccctgagcattgagtactgaccccaaagctgtcacactaggtcatcaagaaccggacagaagattcttcctgccctggaggggcttacagcaaggccctgcgagagtgaccctaagcaacaagcaggcatattcctcccgcctccaaggaagggcctgggctcagcggtcaaaacag

SEQ ID NO: 24758 - DNA, 201 bp, Bos taurus
ttctgtatcaagtcagctcatgactattcttcctggtgtaaaactaactgagagattcaattggacaggagagactcaatttgtcatcatgagactagaccagcagtgcactcctcagctaaatagagaatattcactagacacaaaattgaccgtaagctgtaaatgggaaataagtttaaaatggctggtacaagtaga

SEQ ID NO: 24759 - DNA, 201 bp, Bos taurus
cagctaagtatttgggactcaattgcaattcaccttgaattactacaatcaattcctattgcaaaggaagactgccttacttttaaaaaggaccattcaagctttctattaagtaggaagattatgattgcatgtctcttcttccctctgaagaattgattaaactttaagcatctcacattaaattaaaggaaaaaaaaa

SEQ ID NO: 24760 - DNA, 201 bp, Bos taurus
attctgagtaaaataaagtataaacaaaaaaatcccacagttctgaagtagtcattattaatattttagtgtagttctttacataaatggggtgtacatgtgaatctgtgtatgtgcctgcctgtgtgtgtataaaattcttaattactaaattatgatacatcataaaagtataccagaaaagtaattttgatatcctgc

SEQ ID NO: 24761 - DNA, 201 bp, Bos taurus
tttcgtgcgctcctgcaccatggcagccgccactgtgtcctgtcactgtttaacacctgcctccttccactagatacaagggttttacttccttcactgcaatggcctctcaatgcttgagaaaagtttgtggaagagacggatgaaaagttggatagggctcagccttcccatcttaaccttgctcactccaccgggaga

SEQ ID NO: 24762 - DNA, 201 bp, Bos taurus
atacgtctttgtgcatttctttaactaataccatagtagttggatcacatacttttgaaatgaaaagatgaaggtttaggcactaaattctgttgtctgctttgatcacacaagttgtatgaaaagaatatttaaaacttttaagtgtcaaattaattattcatgtattatctaaaagtatatatgcatattatatttata

SEQ ID NO: 24763 - DNA, 201 bp, Bos taurus
cattatacttcattatggttaagaggttatcacctcaaaggactggaacgtgtctcaggcaagatacttttagcagtgtctcatctatgaggccaggtatccagcaagtccagcttcccagagcatcagaggggagtgtcagagctccatggcgggcactaagtcacaccaacgccacaggcctacttaagccctaagcaa

SEQ ID NO: 24764 - DNA, 201 bp, Bos taurus
ttgatggtaaagaaatattatcacattaatttttttatttatgagtctgttccgatttaaaaaaaaaaaaagagagagagagtgggggtaaggcaagctcttctttactcaagaaggcctctacccaatgcaggggaacgacaattagaaaaagtacaattttgcaaacactggtgcaatacttgattaagacaaggcgta

SEQ ID NO: 24765 - DNA, 201 bp, Bos taurus
agcactggccagatggttaaggagcaatcatgagactgacactcccctagatgaccaagctctgaaaggggacaggtgtccttgaggccccaactccaaaggaggcatcctttgctagtcagtggattgggctgatcaaccagtgctgtctttcttctggctccctggaaggtcctggcctggagggtcagtgacctggtt

SEQ ID NO: 24766 - DNA, 201 bp, Bos taurus
tcctaaaatgaatagcttagaatgaaggagggaacaaaagcaagggtgagggtgggaaaaagtgagagacagactcaaggactgagggatccataagtcacgtggacctttgctacagggacagagggcaggaggactagagcaaagctggggagggcaatgggtacttcatctcccaaacctttatttcagaatcatttc

SEQ ID NO: 24767 - DNA, 201 bp, Bos taurus
tactatgtgatgtgcaaggctgtattggaaggccattcagattctgctggtctctcttgagatactcactctgggagtcttcagcagccatataagaaccctggcctcctggaagctgcgtgtggaggaccacagaggagggacaagatccctgagagctccagtggtttgtgtctctcccagcccagactccacacacat

SEQ ID NO: 24768 - DNA, 201 bp, Bos taurus
ggactgaggtctcagctcctcttctggccaccagtcagggctgttctccattcccacaggctgcccacaaccctcctccagggggcccctccaccttccaattggcatgcttatcaattcttctctcaactttcacttccgccaccagccagagaacactctacttttaaaggaattgcttgattagatggggcccacccc

SEQ ID NO: 24769 - DNA, 201 bp, Bos taurus
catgagtggccgactaaccctttcacttttacaatactggcatatcagaggtctagccccattttacagaggagaacatcaaggcactgagatgttagctctctggccctgggtcatatgaataagtgccaaaagcatcatttaaactgagattttcttgactctgaagtctttacatccagaagacagagccccctgatc

SEQ ID NO: 24770 - DNA, 201 bp, Bos taurus
agacactgtagaataagccttaagtcccttcctagtaatcttcaagtactttgacagccatttgtcttgtgatctcctcttccccaactagtttttctacagattataaatgtacctatttctttcaactatgtctgatatgatggtttttaaatttctccttggctcctttccttgagacaccttctggtttgtcaaaaa

SEQ ID NO: 24771 - DNA, 201 bp, Bos taurus
gacggaggttatggatcaccacaaggatggaagctccttacactcgcagaatgctctctctgttaggaagtcatttgggcctcacagtaaccagagacgatgtacagggttgtagtggtgttcccattttctagaagttccacattgcttggccattccatcacactcaagactttactcataagtgaaaatcttttgagc

SEQ ID NO: 24772 - DNA, 201 bp, Bos taurus
cctttgctgggccaaggccaaggagctcctgttacagccctgctttcttagttaattaaacattcagcctgcgtgcccagagatgcttttatgctacattgtttttcagctacagggggccctaaagacaccaaatctaggttgaatctccatgccttcctctcagcatcctactaagactctctctggatgcccagagac

SEQ ID NO: 24773 - DNA, 201 bp, Bos taurus
agccctggcttctgagaagtccttctcagcacaccagggggctggaaaagagatgagagaccagagggaggggcctgcttccttgggggccagggatctcggagagctgctagtttgggcagaggctaaaagtgaggaagagttacaaagaaaatacagtcttgcctggccttaagcaaatcatttctccagaccctgagc

SEQ ID NO: 24774 - DNA, 201 bp, Bos taurus
ctatgggaaatgattgattttcaaagtagaagaaaagaaggcatgggtaccagagctgatgggtgggggcaccccactcagggggcaacagtgaacaaccgactggggaagccaggggtcattaagtgtgctttctacacaggggacttgtcccactgccttcctccccttcctctctgccctgatatcagccacaagcag

SEQ ID NO: 24775 - DNA, 201 bp, Bos taurus
tgttataagcagtccttgatgtgtttttgatggttccagcaggaaactctgaagttagagggcatcccacactagataaaaaatagatgttgcctgtcaactgtgcttataactgaaaaaggcagtccaggactctcacaaatactagaacgtatgctactaaatcaatgtgttccctgggcctctaaggcacaggttgac

SEQ ID NO: 24776 - DNA, 201 bp, Bos taurus
ctgcagtctttataaagaataaggaatcttgactccttcacctggatccagatggtttcattgatcacatcggtataagatggacaaagggctactttttggttgttattgtcatttccttggttgtgaagaaggcctgaaagaaggaagttcaggatctttatggcatgcatgaaataaagctggaggcctgtgctctta

SEQ ID NO: 24777 - DNA, 201 bp, Bos taurus
ttctcttcaattgtatacaccatttcctgtgataattttaatattaggtgcctacatgatggcacctgctgatccatgacaataagcttctttgaaaaccatatgtgagctgattaagttcttaacctgtcagactacagaaattgctttcctatcatgaaatttcacaatgttaattagcacatacaaacacaatatgtt

SEQ ID NO: 24778 - DNA, 201 bp, Bos taurus
aggaaataggagctaatagagtccaagaacaaaggttgtcctttaaatagagatgagatgagctgggacctcattaactactgataacttcctagtgccatgtagataagggaaaaggagcagaaaggggaagtcaaaggtgttagtcaagacggccccctccctcctttcccttcctacccccacggaggggaaaggcca

SEQ ID NO: 24779 - DNA, 201 bp, Bos taurus
gtgggctgggtggctaggtgggtgcaggctgctggcggtcgggctctggggcaggggttcttcagctctgtccagaaagctgcatgcttcatggttttgcctcctcccacctcagtggtgcagaccctggcccataactccacggccaccctgtctgtcatccgggactacctggtccaaaaactgcagaaacagagccag

SEQ ID NO: 24780 - DNA, 201 bp, Bos taurus
aacaagtaagtgggtaaacaagtgagtgaatgagtgagtgaaggaatgaatgaattccccccaagagtattccatggcccacttaggatggcccacagacaataatttttctcttagacctatgcactgggaaaacgttagcctgtgttgagaaactgatgttcactcattcacttattcagtgtatttatggagaaccca

SEQ ID NO: 24781 - DNA, 201 bp, Bos taurus
acagacgtgtgtgtttgtgcatgtttgcaggcacagaaacacatagggcacacgcaaaaaggttaagcaaagtcattaatcagagacacattcttagaactgtacaaggaaaatgctttaggagatgaaataagcaatttatttcaatttacttaataaacatgtattaagaatctatcaagtgactgagagaaggaatta

SEQ ID NO: 24782 - DNA, 201 bp, Bos taurus
cttggctggccttggttgcttcatcttgagaatggagatgacagagaatgctaattcatctcattctcctgaaacctctcaaggggacagcggactagtacataaggtcacaaaacatgggctgcttaaaaggctagagaattgggaacagggcaaaattagggcagttgtgggctggctggtgtcagaaggagtctcatt

SEQ ID NO: 24783 - DNA, 201 bp, Bos taurus
tagagccagacaagtttctacctgaactttcactctacctgtgactggatggaggagccagaatagagacttggtaaaggaaaatgccttctcttttctgcttccagaccataaaaggccaagagaaaaggaagtgctgatggtggtggggaagcaccaataagaagagatggtccttgggcagatgggagctccaaaacg

SEQ ID NO: 24784 - DNA, 201 bp, Bos taurus
ctgcccattcatcatgttatttgcaagggagtattttaaagtgcatagtggatcatactattgcctggcttatagtctgttagtgtacctgcattgtctttagcagtggttctttggaggaagaatgttgcagaccttttgaaaccctctccagagagtctcatagtctaaaatattcaatacctatagaagctgaaacca

SEQ ID NO: 24785 - DNA, 201 bp, Bos taurus
cagggttaaatagttgtgacaaagaccatttggcctgtaaaatatacaggaaaagtttaccaatacttcctctagcatgtatcatcctatttcctttggtaaaggcctgtaccaggttgaagagatgttttatatctattgatatgtactttcattaagtccagtcagtgtattatcactccagctctcttgttttaaaat

SEQ ID NO: 24786 - DNA, 201 bp, Bos taurus
caggccaggtccaaggaagcacgtggatgggaaactcttacttgccccttgttccccactgatgctccgtcagcccttttagagccagaatccaagggtggggggagtcttgaacgaacctttaggccacatgttataatttccaattggaagtgagaagaagagactttgttttgggctcacagctcaaggtagaaccag

SEQ ID NO: 24787 - DNA, 201 bp, Bos taurus
attccaggcccagtggggagttcacccccaccacccctcccctgctcatacctccagctgctcccctagagcgtgtcctgaggacaaatctttccttgagccaaggagctggccaagactccagcagctccagttctgtggcctccctgatctccttgtccttttgatcaggtgcttagacctttgtccgagtgagatttt

SEQ ID NO: 24788 - DNA, 201 bp, Bos taurus
acattcaggtcggatgatagccatgcccatgaagatgtccacacgaggatgggcctccctgtctgttctcctagacgtgcaatattggccttcaagtttccggtcacagacttgtagaactggaaagagacacgtagagcctttgcagtgtttcttattctcttttggatcactggcccttttgagaaacttctgaaatgt

SEQ ID NO: 24789 - DNA, 201 bp, Bos taurus
cagcagagcagctgtcttttctagacctgagttctgcaagcagcctcacagttccagaatgtgggaggtggcagataaccagtttgtttggttgtagaacttgatctcatagtaactttaatggttgaaagtcacccccacttcatttttacccccatgtgatttcttcagccccttgagttatagaggaggaggtgttct

SEQ ID NO: 24790 - DNA, 201 bp, Bos taurus
tatccgcgccgcggtgatgtgaatgtctgcctgcttcctcaccctgctgctccttgcaccactttccagagaagaagtgcaacgggttccgctgcccgaacggcacctgcatcccatccagcaaacactgcgacggtctgcacgactgctccgacggctcggacgaacagcactgcggtgagtcctcacgtcgggctaaat

SEQ ID NO: 24791 - DNA, 201 bp, Bos taurus
tcttctagagctcccttttcttataggcacagagctattacatagtttataccagaagagaaaaaaagaaattttccagttgaaactcaaatggttacatctgaatgtggaacttaaacttctgtataaacccactgatggaagcctggtaggggctgaacaactcggacttggtcttttatttttttttcttttggtaat

SEQ ID NO: 24792 - DNA, 201 bp, Bos taurus
cctgccttcacacagctcacagtcagaaaaggatgctcaagagcttgaactttcaccattaactctactggggcacagttaacgcctctactttcaagaatgcctttcttcagaggaaattgacacacctcagaagtcttgactccttcaacccccactgacctttgcttcctttgccttattactgttaaacaataaaaa

SEQ ID NO: 24793 - DNA, 201 bp, Bos taurus
cattcttaggtctttgaagattcaccgtgatagcctgactgtctacccccattcctctggactgttcagtttatggacttctgggtctatatgctcaagtctgcaaggggttcacctgcaagcatgccgattctgattctactgtgcttagaactgtgcctgccacgtaacgggtgctttacaaattattgctcattctgt

SEQ ID NO: 24794 - DNA, 201 bp, Bos taurus
acacaagcagcatttgaatcaaatgtcctaagacaattgagatcacaacgtgcccaggtgtgacttttctccagggctcaccagctccggaaccaccttcaaccttccctcctacccctttctcttcaggctgcttccatctccctttcctgcccgtgaactcctgttttgaaagccagccccatcacccttacctctgaa

SEQ ID NO: 24795 - DNA, 201 bp, Bos taurus
tcttagagacacagttgattcccagttcctatgttcccccttccaccctcctacccctggtcagacctttgttctctcagagctccgctaaataagataccgggttggccaaaaagttcatttgggtttctcagtaagatattcggccaatccaatactgtgacaaattcaccaatgccaagatgttaataagatttaatg

SEQ ID NO: 24796 - DNA, 201 bp, Bos taurus
ctgaagcaccctagtggtgtgggcagggatagaaagtgggaaatgggaacagttagaaccatgttggctgaatcagttacagtgcaaccgagggctcagtaaggaagaaacccacttgttcccaccactggcatatgcgtcaccatgacacacagcgtctagccccaacaagcaacaagcttgtgttccaatccacgcatc

SEQ ID NO: 24797 - DNA, 201 bp, Bos taurus
ggggtatcagggaaggcttcctggaggaagttatattttggccaagagtagaccagtgaatgggattggtcagagtaggtaaagtgaagagtttccaggcaaagaatggcgtgtgcatggacccagagcatgtggcccaacaacagacctgaaaacatacagtctaacgagagcaggaggaactaaagaggcagaaaacaa

SEQ ID NO: 24798 - DNA, 201 bp, Bos taurus
tttcaagaagctgacaaagagcttgccaactttgtgtggcaaatacaaagttgtatttgagctcaaataccttgagcttgcctgtatcaattgtttgagatgggtagcttgaggttgcttggctttcctatgacagcgatatcaaaaaggggcaggaaaggctgctactcactcaaaggtctatttgagggcaaacatggt

SEQ ID NO: 24799 - DNA, 201 bp, Bos taurus
aggcgggagcccatacttcgccattgtctgaagggctgggggatggacctccagccaaagaaagcagatggagaccaagcctctgctggacacccagcctctacccacctggcccaggaatccactctgagtgggaattctaggtctgcagaaatctgggacacccagtttagccctcttgaaggggagggaatcacactc

SEQ ID NO: 24800 - DNA, 201 bp, Bos taurus
cgctcttgtaaactgagaagtgagtgtccctcccgactgtgatccacagtcctgatcctgcacagtcgtgggcatggaccctccaggatgccctggccttctcagggtcacagggatgccagaaatgtcagcttcctgcttgagatcagactctaaccttgtgggtccctcaatcagggcctgtgtggtgctgagggctca

SEQ ID NO: 24801 - DNA, 201 bp, Bos taurus
aggagcttactgtgatcatcaccttctccgggcctccctctgtgtgccttccatctcctctcaatattcacatctgttttccaaggtggtacttttcttccaagacttccccaataagtaatctctcagtgaccagtgatgatagtaaacgcaccaaaacagttctgtacttctcactgtcttctgtgctttagtgccatt

SEQ ID NO: 24802 - DNA, 201 bp, Bos taurus
caggtagacacagctggactccggtctgactgacccctcccatgaacaaaggaaggcaaataaatcctgtgtaacttggtggttattacggcccaggaagtgtgctaaatgctttacatttattctttcatttttacaataaacttgggcacagatgttataatcactgtggtaaaaataaggagactgatgggttagtca

SEQ ID NO: 24803 - DNA, 201 bp, Bos taurus
cctcagaagtggctgtgttcacttaggaaagtgcttttgatggagacatcttgaaattcccagtcaggtccgaacaccagcaccgaggccagtgtttgtacagaagcttctgcggaaacagtattggggtggaagtgggctgtggggagagtcagctgacttggactccaacacagctattgtggcctcaggctgcactga

SEQ ID NO: 24804 - DNA, 201 bp, Bos taurus
gctgcccgcacttctctagcccagggtcctggccttaccatgccgtcggaacagttggagcgcggactggaagcgtccgagtcgccgctgtagtgttcgctgctgcggccggggggcaacgggccaggcgcgtaaaaggcagcggcagcgccgggaggcgcggcgtcctggtcgcgaagtagcgcctgcaggccttcgata

SEQ ID NO: 24805 - DNA, 201 bp, Bos taurus
aggacagttatcctgttataacagggcagcatacatggaataaatcaggggaatattgggagtaagctgcttctagtttttgcccttttctgttgaatcaatcataaatatagctgtgctgaaggcacctcagagtctgcaacatgtttgacttttagccattaagtcccttgtagcaggacatccagatggatgaagacc

SEQ ID NO: 24806 - DNA, 201 bp, Bos taurus
gctgctggcaggcctgtgggctggtcgggcccgggttggaccttctctggggaaggcacagtctccacgctctcagtcaccagggtatgggcaggaatctgttctgcagctgttctggcctcagctggggggctgctgggactggaagggccctgggcctgtatggactgtgggacccctgtctcagtcatgaccttcgtc

SEQ ID NO: 24807 - DNA, 201 bp, Bos taurus
gctagtaactgtctcattagccaggcggtgaatccatgtgggtataggtggctgtttccacaaccagtgaaattcctgttcctcacttgatcaaatggcccagagcgccatctcaaagtaagaataataacagcactgattattatcagcctccatgtgtcaggctctgtaaggccccatttaatcttcacaataatccag

SEQ ID NO: 24808 - DNA, 201 bp, Bos taurus
ttccgcatttagaaaaaaggaaagttaagcacagaatggtgacttgtcctatgcgacataagcggtagaggcaggactggggacttgtcttttaaacacagctatattactactggtaatagcactactggaatatacatatatattctctggtgaaggacagggaaaactggtgagccgcagtccatggggtcgaaaaga

SEQ ID NO: 24809 - DNA, 201 bp, Bos taurus
catgtgaccctgggccagccactgaaccatgatgaaactccatttcctcatgtataaaactggtctaataatggtgtgcttctcactgggtgttgtgagcgttgtacctggtgaacactgggccctgccccttgcttccctgtaagatcaggtctcaaactcagcagcccaattttaaggtccattttgctgctcccagca

SEQ ID NO: 24810 - DNA, 201 bp, Bos taurus
agagccatgaccatagaagccaggtcacctattagaccatctgtcctggcttagggacctaatctgttctgctgactctggggctgatctaaatcagaccaatttttctccccttccctatataaccaaagtttatatgatactcccctcaaaatgaagaataagggaaatgtccaggaagatgcttacctggatgtagaa

SEQ ID NO: 24811 - DNA, 201 bp, Bos taurus
cacctacactggttctcttaccccaggactcggcgcggtgcagggcaccgaggagaggcacgaagagaaacctctcccttcacctccatgctgccgcccgtgagtatgaggctgacacgatggtggccgatcggagggcttcctgctgtggtctctgctgagtctgcaagctggtgaccctttcactagaattctggcccc

SEQ ID NO: 24812 - DNA, 201 bp, Bos taurus
gaggtaggggtggtggtgatgggtggtcaaattgaatatgagtaaaaggaggaaatgtagtggggtctgtgcccttaggtaatttgttccattgctgatgtcagcatttcatagtctacttggaacccagtaaaatacctcatgaaagttacaaggccttcacagaagggaaattcaccgtagcccccatccttctacctg

SEQ ID NO: 24813 - DNA, 201 bp, Bos taurus
ccttaggtgggtagaccttcataatagagctagagttttgaagttaggtcagaaggtagagtactgggagggcaaggcagaagggaaccagaaagaaggcatggccagtgataaaccttttgaaagaaatgactttcaaaagctgtgcagctgatatgcagttataagttgtgattgtgaaatgtgcctggcagcccacag

SEQ ID NO: 24814 - DNA, 201 bp, Bos taurus
gggagacgggacagtgcaggtggcctgagacgcatcaggcaccccttgccctcttcccctgtagttgggtcagcagtgctcaggagtacaggggttcttggggccttctgagggggtgggcttgggataactaagaatcagaggcatttctttgatccacaggagatggaaaatgcttggaatgagtacctaaagctagaa

SEQ ID NO: 24815 - DNA, 201 bp, Bos taurus
ccctcagaacacaggtcagcttcccaggacttgggtcagtggctggagggcaggcagcgggtccccaccatctctgatggccagcaaggccatgatggcagaacgatgacttgacttccagcctaaaatggggaaggggccaccagaccagctgccgtgtttgtggccctttatatgagtcgtgagctcatgatagtctgc

SEQ ID NO: 24816 - DNA, 201 bp, Bos taurus
cagaaattgacagcgctttaaataatcgaaagtaaactagttatcctcccttcatcatccttatcaataacctctccaccttcccccgctccccaatttcaccgtctacgtttccatggcattcgtccattgtatgagggacctagttttacgtttactggttactgcagtgtccatgacaccgcgctaggaactagtaca

SEQ ID NO: 24817 - DNA, 201 bp, Bos taurus
taactctcctttcaggctttttggaaaagctgatactaaagtttccccgctggaagccaatcttccctgctgagaaatatgtggaatatggtgttgtcagtgggagagttggtaaagacttggatgaggttttcagataatacccagttaaaagtactgtgttcctgttaaagaaaaaaaaatctattaaaagcccatgct

SEQ ID NO: 24818 - DNA, 201 bp, Bos taurus
aattcatttattccaggacttattctaccacaaatacaactgcttcttaaataaatgatgcacttttcatgattttttttgctataataaaacttttagagattattgaaatttatctactcttgtttcttctatccacatgccatttttggagatcagctcctgggactgaagaacaggccacttggatttacagcactt

SEQ ID NO: 24819 - DNA, 201 bp, Bos taurus
ggagtcttggccaaacacatccagtccagccagtgttcctctatgggccacccaggaaggactgactgtgtttgactctggccatcaccaaacctccatgcttctttctgactctgccttcagccaagatcatgtagattccttcccttatgacatcccaaccatggctgtctcctcatttcacactagtcatttgtaacc

SEQ ID NO: 24820 - DNA, 201 bp, Bos taurus
acttagcaatcataatttttgttacgttcccctaaagaaaatctcccgcttaaaaattttgacaggaggaatgtgtagggacaatgaaagtgaggggacctgtttggggacctatcgatggactctgtgtaaacataggctgtctcttctaattcttgcctcactgctcagggaacaagtcggggttatttttcttccttt

SEQ ID NO: 24821 - DNA, 201 bp, Bos taurus
aggactggcctgggagtggcaggtgaggccacctggagaagtccacatcctcttgtatgatcccatcggttcttgtggggaatttgccttggaggcattcaaaattctaaggaagcagcatggatgggtgtgggtggcagcgtctcagcggcaccaatgtttactttgaagagaaaatgtctgctttgtaggcaaatgttt

SEQ ID NO: 24822 - DNA, 201 bp, Bos taurus
tagcttcaagataaatccatcttttcctgggccccacctatgatcagaatctcagaagggtggaaatgtgtgtggattttgttttgtttcagaatttctccagatgagtcttaatggccaatccctgggctcaaccccacctttgggaactgctgtccggaatctcttgttttcgtcctgcctgtctgcttaacgcctcaa

SEQ ID NO: 24823 - DNA, 201 bp, Bos taurus
agcttaacagaaccaatggctgcacacatatcccatcctccatctctcatcaccaccctccactcccatcccacactgcaatactctggctaacttgttcaagacatgaaggatggtacataaactgaatgcttgcaggacaacatattcctatctcttacgctggccaagataatggttaggcaccaatgtacagaaaga

SEQ ID NO: 24824 - DNA, 201 bp, Bos taurus
tgctggagtaggcctgggtgtttgagaaatggcacagaaataaacacggctagaatggagtgaacaaaggaaagatcaggaagaggtgagaagggactcaggctagatcctggaggcccctggaagccactgcaggcactctgggatttcactctgaggaaacatgaggattcctcctgagacatccgaggagtcttgtca

SEQ ID NO: 24825 - DNA, 201 bp, Bos taurus
cgactgaactgaactgaattcaactgagagttttgagagtccaaaacacctggattctggagccaagttgcctggaattgaaccctaactctgccaccagcgaactggtgcacagtgtgcacagggacagtgcatcttagaggcagatttgagcccaagtaatcaaactatatataatcaaactttgtctcagtgagaaag

SEQ ID NO: 24826 - DNA, 201 bp, Bos taurus
cattttccttggcacctttgcaagatcgttctctctttactgttgtcctgagatggttcaggcagggctggacacaatcacaaacaattcatgatcaatcatggaggtataaaattcccaaagttcacttcataaatcaggaatgcattcagaggagaatggttttgtatcccacactaggagatcctagattttagagga

SEQ ID NO: 24827 - DNA, 201 bp, Bos taurus
cccaaaggagccctccagaacaaggttttcaggtgaagcagcaggccaagagggaaaggtcatctacctgcattagtgacaaaaaaagagctttttctctcttttatctgttgaattcccaggccagttaatttttccagttcctttttatttttttacttacttgtcacctggtcttggtgaagtacctgctttcttacc

SEQ ID NO: 24828 - DNA, 201 bp, Bos taurus
aatatcatccacaaattcccttctcttacatatcagttggttttatttgctcatgttcccgtcccatatgcaaagaggagttttacatgattgtgtttatacctatgttaggctattacgattcccaggaatcattctcacataggaagaacccccagagaatctggctttgaatgtagaaattccacaggattgggggaa

SEQ ID NO: 24829 - DNA, 201 bp, Bos taurus
cgtgtgctgggccattgtgaaacaagtctcattcttcagagtttggtcccattgcaaggagctggcaacgtgggcactcatgaaatattaacatgttacactgatttttttttttataagtgtggccaacagtggatcaattatattagtatgaaaagcttttcataattcatttggggagcatcaagatctcatttccag

SEQ ID NO: 24830 - DNA, 201 bp, Bos taurus
ctactgcactctctccattcgccagctttgcttggcgaataactactaacagagaagatggaattctgagatttaagtggcttttgttctttatgtatcacgttaggcactcatacagaaatgcaacagcaggcagaagctggataatcttcacagatgacaggaaattttcatctgagaatagtactctctgaattgcaa

SEQ ID NO: 24831 - DNA, 201 bp, Bos taurus
gagtcatgtcaatgtatggcaaaaccactacagtattgtaaaagtaattagcttccaattaaaaagaaaaaaaaaaaaaaaaaaaaaccctttccctcttcctggaggaaatcttgcctttcaataaacagggcccttgtcccaactaagagagccgaaactgttgggggccgggggcggtgtgggggctgcggagcaggg

SEQ ID NO: 24832 - DNA, 201 bp, Bos taurus
aaactgcctcaccaatatccaatattcaagtttagtataagatcacttatcatttctccaaaccactaatggacatgtatgggaagatattagtcctttttttgatatgatatttattatttaaaaagttgccaggagaactgggttatgaaagtcaattcagcaaatatttactgagcagctacttctacttattctaaa

SEQ ID NO: 24833 - DNA, 201 bp, Bos taurus
tgtgaagaaatatagcaataaatcagccctctgtgagctcaggagagaggcctgtaacagatcctccccttgcagctctcagaaagaaccaagatacccaccccttggtctcagacttgtggcctccaaaactgggagcaaataaatttctgttgcctaaaaacaaatgaaaaaaaacaattccatctttcctattttccg

SEQ ID NO: 24834 - DNA, 201 bp, Bos taurus
tttttttttttctgtttttctcatggttagactggagatttgggagaggaagaccacagaggtgaagtgccctttcattgcctcctatcaagggttcacgctatggatgggagttatcactggagacgcaaccttgatttggccaaagtagtgtctgcgtgaggttcctccataccctgatcactggaagccagtcactaa

SEQ ID NO: 24835 - DNA, 201 bp, Bos taurus
aaacaaacatggttaagaaatttttacttcagtaaaaagtactaaaaatgcaactctgaaactgcaacttccctgaaaagagagactgaaaaacaaacacggctaagaaatttttactttcagtaaaaagtactaaaaatacaactttgaaattgcaacttccctgaaaggaggaattcatattcttaaaattagagaaaa

SEQ ID NO: 24836 - DNA, 201 bp, Bos taurus
ggtatctgtatatgctcttagaatgtttttgtcttttgcctactgtctaaacggactgtttgggttttttattacagtgtttcgagatgtctttatgtattctaaatactagtcctctgtcagatatgtgctttccaaataatttctcccagtctgtagcttctctttttatcttcctcactttggctttcaaagggcaaa

SEQ ID NO: 24837 - DNA, 201 bp, Bos taurus
acaggtactaactaactaggtctttcatgaaaataaagtggcatgatgtgaactttccaaaagctgggggctacctgtatatggtttaattctgggccttcgataagtcagacactgaaatgagaaagatcacccccttcctggagaatctcaggaagtaacagacagctgtactgagtggaactgtgtgcgatctgtgcc

SEQ ID NO: 24838 - DNA, 201 bp, Bos taurus
ctcaacaactcctccttgcatgcacgtatgcatgctgaaaaaaaaaaataatcgtacgacagtatttcaaggacatttgaacatggtagtcaaagggctcagtttagttgggaaatccctgcaagaacatttttagagggtagtgcgtccagccgcgatacacagccatgattgaagcaggctgctccagcttactcttcc

SEQ ID NO: 24839 - DNA, 201 bp, Bos taurus
gtggctctgacctcaaccttggaaccagagggtccccaaaaaaagcggggtaatcctgtaaaaggctgatattctagacccctgtacaggcccctttgcagtgttccttgctcactgttatgcagggtgaccaactgagctgcaagccacccctccctcggaggctctagaatggcaaggaagggcccagctgcaggtgcg

SEQ ID NO: 24840 - DNA, 201 bp, Bos taurus
caagctttcattatctcttgaatatattaaaatgctgcataatcctttcatcatagaaaatttgattttgatacggttctggtgattgtactgatgggagtatagtttccttgaattttgttcaaatggtttttctaacttcacagagcaccctcttctgctgtgtccatgtaatgtcaaaaagtggcactctgccttcta

SEQ ID NO: 24841 - DNA, 201 bp, Bos taurus
agagaattttacggactgtatagtccatcgggtcacaaagagtcagacacagctgagcaactttcactttcactttggaggttctgggggttacaacttgacaaaacctttgggggccactataaaacctgctgcaatctggtaagaaaagaaataataataccactattttacagatgagaaaactgaggcatagagatt

SEQ ID NO: 24842 - DNA, 201 bp, Bos taurus
tattcacatgatctttttcatttaggacggcttgtatggctgtacatgggtcggcagtggtgtgcctcaaggacaggggctctgggtgcagcagacatgggtatcacataagcactcttgaaggaggtcgccattaaccctaccatagagctgccagaacttaactggactgggaaatagactattgcagggcacaacaga

SEQ ID NO: 24843 - DNA, 201 bp, Bos taurus
caggggccctataaaaacaactctccccccagtacacacatacagtatacacaccactctacttatcaggctgtacactccctactgaaaggtcacgtgctgattacttgaactgaaaacatacaaaatatctgaccaactctccaatgatatcatggcaaatatatggatttaggggtagactgtcactaaacattgaca

SEQ ID NO: 24844 - DNA, 201 bp, Bos taurus
gctgtttgacattttggcctcaaggtctaccacaccttgacaatagtatatctctttttcttagttcatattctcaagagaaaatgtggtcagccaataacgaattgtttctcttgggttggccaaaaagtttgtttggatttctccataccatcttaagaaaaacccaaatgacattttggccatcccgatacttgggtc

SEQ ID NO: 24845 - DNA, 201 bp, Bos taurus
ggaggagacatcaccagctctactagagaaaaagccagccatggacgtcagggagcggggctggggagaaggctatctgcggtttaggccggtgggcttcctagagttaggatgagctgggcttcctagctcaatcttaaaacctattcccatgacagctcgtcgggcctttagtgggaggcgggggtgggggcggagcat

SEQ ID NO: 24846 - DNA, 201 bp, Bos taurus
gtgtccatgattgtatttttaaatgtctgtgtacaaggcgggtctgtgtgtgctgtgtgcgtgtgatgggtgagtatgcctgtgtacgtgtgttttaaatatatgtgcacaagagccctgtgtgtgtcctgtgccctgtgtgctacatgcagatacacgcatggacgttctagtgagaaggggttcccagacctggccagt

SEQ ID NO: 24847 - DNA, 201 bp, Bos taurus
aagaggaatgagagtagatggcggtctgcaggggaacccaaggatggcatttttccccacacctccttcctgagctggccgggttgggctggggcaccggctgcttgaagccatctggaggagtgagccacatccaaggttgtctatagaaaagcctcaagtcaccagagacatagattgcaaatgccaaggccaaaggag

SEQ ID NO: 24848 - DNA, 201 bp, Bos taurus
ggacgaggccactcccaacaaagagaagaggcccggtaagtgtgtccaaatggaacaaagctctttgaactgcagttctagttatgagcatggcacacttggtgtaggagggcctcacagacagcctggcaaatgaatagctatagaccttatgggggcctcaaatccccactcacctcatcttctgactcattgtgtggc

SEQ ID NO: 24849 - DNA, 201 bp, Bos taurus
agtagaagagaatgaacacacaatctgagcactttctaatgaggtggctctgctgggaaagaccttgttgaaaaagaaaatactcagttattgattgcctatgtgacatccacaaattgctcctgtttgcctttatcatcagctttggcttttagagtcttccccaccaccatgtgttatcttctgcctaatgtactatca

SEQ ID NO: 24850 - DNA, 201 bp, Bos taurus
cactctccacagctgccgaaggtatctttgaaaaatataagtcagatcatttccctgtctgcttaaaactcaccagtgacttcccatctgactcagagtaaagctcagctctaccttccaggccatccggggctgccggcccactgcctctctgccttgatttctgcaaactcccctactttgagcattttgttcagctac

SEQ ID NO: 24851 - DNA, 201 bp, Bos taurus
gtgcaaactgcaaggattattaaggggtattaacttgggtctgcagggaccataccattattaaggtactgagccaggtaaacagatcactccaaggcctcaactctaagaagtccatcgaattagggcatggtaactgccaagtggcataactggattctactgtaactgacataaagagaggaacatatttaaaaggac

SEQ ID NO: 24852 - DNA, 201 bp, Bos taurus
tcaggaaggaggtcattgtcagacacagatgtttgctccttgaaggcttgagtagtgggagagagctgggaagctttctgagcaggggtggggcctggacggaggtgatttgaagagctggggtgaggacttagagctcactgggtcttttctgtacctaggatctgaccaacagccacttcttcttgtttgattttgaaa

SEQ ID NO: 24853 - DNA, 201 bp, Bos taurus
tggagaccccaggtcagggccttacttgagggctaaaagggccataggaaggctcacccgggaggttaaacagagaaggcgtctaggaatacattcgtgcttctggggccctgtgagacctgctggtggaaggcacggctgaggacaacaagccaaggtactgaaaatggaaaagcagtggcagacacagagagggcccat

SEQ ID NO: 24854 - DNA, 201 bp, Bos taurus
tcaggatgaagtgggagccacatgtgcttagggccttggccacagctccctgtgccttgagtctcagcacagccctcagtatgaaggtgtaggagaggaatatgaggaggaggtcagatcccaacagagtccagcctccagcaaattggtagagacgattgatggtaatatcattacaggagagcctggagacagacatat

SEQ ID NO: 24855 - DNA, 201 bp, Bos taurus
ctatatcaggccctattgaaagttttcatctccttttcattccaggctcctggactcacctttcttcattgtctccttcttacaattttcctggcctcaacttgggacttaccagcttccgaagtttgcactgcctctatttctggttgttggaaaaaggacccgaactggcctcttcaaaggctctagaggctgatttta

SEQ ID NO: 24856 - DNA, 201 bp, Bos taurus
atttgaaaaaatcaataaaatagataactctttagctagatatctcaagaaaaaaatacatagaaggcaaattactaaaacaagaattagagaagagacggtactactgaattaacagaaattaaaagattataaaggctatgaaaaattatataccaacaaattagataatgcaaattaaatggacaaattccttcaaac

SEQ ID NO: 24857 - DNA, 201 bp, Bos taurus
caaagccagcaaatgagcttcccatcctcctcacagaaaagctggagtttctctccatggtgcacacaaagaatcaccttcagctgcttccctgagcccaccaccacctccctgagcctctcggctatgttggccaggtgccgattgggccgcaggttcccaagccagtagctggtctggcacacaggacacctgctctgc

SEQ ID NO: 24858 - DNA, 201 bp, Bos taurus
aaaggaattaatttcattgacagttggtcctaggaatcaaatgtgatattttgttctcagggaatgacaatccacatgatggccactttgaatttgatcaattttaatccagactccttcattttgatggggatcccagaactggagcagttccacatcttgtttgggattcctttcttctccatctaccttgtggccctt

SEQ ID NO: 24859 - DNA, 201 bp, Bos taurus
aaactacaaagagagcagttggaatttagggcattttggagataagtagaagaagatgaaactaaataggattaacttcctcttgggcctgaaattgctagatttcctaagctatttactttatcctaaatattttctgcagaaataacaatcacttttctattttagaaagattattatggcctcttggtcttcctaggt

SEQ ID NO: 24860 - DNA, 201 bp, Bos taurus
acacacatttacactgtcacacatgcatacacaagcacagactttacagacagacactaataatgacctttagagatactaaatcctaaagaactttggtattctgtatacattaaattgtttctaaatgagaccctaagattaatgtattaaaatccaatacatttccagttttttgtgaggaagacattgatgctttga

SEQ ID NO: 24861 - DNA, 201 bp, Bos taurus
taacttgtaatattaatatatctgttatttcagcaatatttattgagccctaaggtagatattagcagtagcaaggtagatattgaagttagctctgtgatcaaacaggataacaaatatttgtccataaggagcttgcatcctaaaacctttattttccatttacaattacttgattaaaatagaatttcaagtgtggta

SEQ ID NO: 24862 - DNA, 201 bp, Bos taurus
aaaatactctccaatatatgagtaaacgttcaaaccctgtagtaatgaagaaggtaaaaattttaaagatacagaaaaaccatttaagggcccattattagataataaaaaaataaaaacattacaattgccaggaatataaagaaataatgcaatatgatcacgtattgcacagttggaaaaacaagagacaaattgggc

SEQ ID NO: 24863 - DNA, 201 bp, Bos taurus
gcaggctgcccaaggtggcctcatgaggtttttatctctttcagtggaaactccatgaggctctggaacatctgaagaaagagcaggaagaggcctggaaactggaagttggtgagaggaaacgaactgccaactggaaggcaagttgccccctgaggaaaagagtctgtatggtccctgtgttgtcctgaagctggcttc

SEQ ID NO: 24864 - DNA, 201 bp, Bos taurus
aagctggcgtgctgcaattactgaagcctgcccacctagagctggtgcttcaaaccaagagaaacctgcacactgcaaggaagaaaatccacacagagcagggaagacccagcacattcaaaaataaagaaaaagaataagcttaatcacagaagtgagaaaaggcagaaacaaaggaaaactgtctaacaaaactaaata

SEQ ID NO: 24865 - DNA, 201 bp, Bos taurus
catatctttattttccattttaaactgtacataacaatatatgataaacaattacattaattctaaggctaatcaaatccatagtcctttaacaggttttgaacaaaatattgctgtgacagtgatgttttaaagcagaactggccattgttacagagcttttgtaggctataaagccatttaaaggaaagaaagcaatta

SEQ ID NO: 24866 - DNA, 201 bp, Bos taurus
aatcctgaaatgtttgctgtaagctgtgtcctttgaaggaataatatatttttagtttttcttcggattttcaccaatttctaatgggttaagtcttattacctgtttcaaaactgggtttttaaagatgaaataatcccattgctgtattgttatcttcttaacattattaatgaggttgaacagttagggaatgttttg

SEQ ID NO: 24867 - DNA, 201 bp, Bos taurus
ggccagggtggggcagggatggaaaggcaaacagggaagatttcttgcagaaggaggaggaagggaagtcagagtgtgtttgggagaagggaaaggtggactgtgatgaggagtggccttgccagggcctgatgggaagggaagtttgcggtgtgagggtctgtctacctggaggcctcactgtggtgtcttttgcagaga

SEQ ID NO: 24868 - DNA, 201 bp, Bos taurus
attttgcaaaaacggcagtggaacatgtttaaaatcaccatttgcttgggcgttcctattaaagaatattcttactatccacatgaagtggaagtatgttgtgttagttcattctagggtatgaagtatatcagaaagtaaatgtcactgaaaaggaaaaatactttgaaattacacttgagaatcccaaaaatgatagga

SEQ ID NO: 24869 - DNA, 201 bp, Bos taurus
atgtccccatatatttcctgaccaactccaggatgtaacttggtgactcgaagccagtcaccttggctgcaaatacactcacacattcagtgaccctctccccacccccttcaagtaagacatccagtaaaacctttcactggggcccagcagtggcttttcctggttacatacaacagtttataacatatatatacacac

SEQ ID NO: 24870 - DNA, 201 bp, Bos taurus
agtgcttggcagtcctgtgctgagcgccgatacaggtcagcctggaggctgaggctgtcaccagggtaccctgggtccacaggcttttgccagcctctgtctcaggatgaacgtatgtgctgggggctaagggcggtcagttttgctcccctccttgccatcctctccctgcagtcactgggcctgggaggcgtcatgctg

SEQ ID NO: 24871 - DNA, 201 bp, Bos taurus
ttttttttaaagaaagcattctagagggggaaaaaaactggtggaaaatgctagtaaagtctgaacataccaatttcctagctttgcaaccttgaaggccatgtcttttgtggggaggggtaaatgacatattgaacatgtttgctgtatactgaagccaagaaattcatttagggctcagcacaggagtggggagagcat

SEQ ID NO: 24872 - DNA, 201 bp, Bos taurus
ggggcaggtagatatttgttcacctaggacctggagcagaaatggaggttgacagcaaatgagagcaagagatctctttggggtaattaaaaatggcttacactggattttggtgatagttgcacaactcagtaaatttactaaacagcattgaatagtgtacttaaaatgggtgaattttatcatatatgttatacctca

SEQ ID NO: 24873 - DNA, 201 bp, Bos taurus
atgatgatgagagcatatgtccctttgcattccagttctatagcaatggtcaccctctcaactcccttcccactcccaaatgtcagagacaaaataatagaatgggtaatgcacttctatggaggaaaaatggaaagcaatggcaactgttgtgagctggagtactcatccacctaaaagaagaatcattcattcagttcc

SEQ ID NO: 24874 - DNA, 201 bp, Bos taurus
ggccatgtatggagccatttttggttgtcacaaatgggggaggagtgctactagcatttggtggacagagaccagggatgccgctgaatatcctacgatgtgcagataggcccccacagacaaaacccatgctcaggcgtcaaaggtgccgaggctgagagaaactgctccagggcaaagcagagctccttcttctctttc

SEQ ID NO: 24875 - DNA, 201 bp, Bos taurus
aaatctatttctccaaaattgggtaattggaatttttttaacctgacaagactttcttgtcatgttacttgatgtcagatttgaggaaacacttttgattagttaggaaaaacttcttcctttatactatgaaatagttacttttagagaagaaacatttaagtaataaatagctcttttaaaagcatggtccacttatat

SEQ ID NO: 24876 - DNA, 201 bp, Bos taurus
agtgaataaaccttagttcttgattatgtgtattatcttagcttttgtgatttcatattgctcaagaatgcagagaagttaaatcttaagccatgaagtggatgtttggcaagagtcaagtagaagttgacttacttaaaaaataagagggctttatatccaataagaaaatagtctcagaactttcctgtttgttctaat

SEQ ID NO: 24877 - DNA, 201 bp, Bos taurus
tcataccgtaggttgttcattaaatgtgcgctgaggtcaactcagggactgctgaggcaattctggctcatccctacttcaggatgagcctctaatgagcggtcccggtagttttatgtttacaactccatcactgctgtttgaactctattgatgtcatcaagcgactgtccttgaaattcttaggaacaacagctactt

SEQ ID NO: 24878 - DNA, 201 bp, Bos taurus
gtacatgataagcctcactgtgagtgtctgataaacaggatggagctggaggggccagcagagcccgtattaggtggggctgtgagtttggcctttatatccagagggcacgaggacattagcaaagggggaatgtagaagagaggaggtggcttggcttagatccagcctcactcctcccagcctgtgaacacccagctg

SEQ ID NO: 24879 - DNA, 201 bp, Bos taurus
gcctgaaatatttacaatctggccgtcgactgagaaaatttgtagatcactgatctagtaacacacctgatcatctgcctggaattacttttggtctttgagtatgtgaaattatctgtttccttgagcagtttaataggcactcacccagactggtgcctatcctgtttgcttctttgaaaaagaattgttaggcctggc

SEQ ID NO: 24880 - DNA, 201 bp, Bos taurus
agtggttgttgttttcataaagggtttgggtaaatgtatacatatctaagtgtatgaagagttacctggtcgtatgaggtggtaaatcttaagtggcccaagatgatgtgaataattgctttcgaggttctgaggacatgggttctgctacctgttcttaccacagtgtagctggcacgaagcatctttccaggtgtcctg

SEQ ID NO: 24881 - DNA, 201 bp, Bos taurus
aggcttcttctcttctttcttgaatgtccaaggaaacttaagagtgtgggtgtagtttacaaatactaaccataatatacacttgtattgacttcaatggtatttggtatacttacacgtgtgattctcatttcatactcagatcagatcagatcagtcgctcagtcgtgtccgactctttgcgaccccatgaatcgcagc

SEQ ID NO: 24882 - DNA, 201 bp, Bos taurus
catttctgtttcatgaaatcctcttgttatgaaattcctcaaccctgtcaattcaaatgtgctcctgtataaaaggatgtagagaacatagattggttaggttcctcatgtgcacagtttacctcagttaatacaagagttcattaatgcagtgtaaaggttaaagttttcagatagtttaaaaatactttcacttgaata

SEQ ID NO: 24883 - DNA, 201 bp, Bos taurus
tgctaaaaaaaccagtagctcaacttgaagaggaaatttaaaaataccttgagataatgtcagtgaaaacacaaccatacaaaattaaaaatgggatgcagcaaaagcagtcttaagagggaagtttatagcaatataggccttcttcaaaaaaaaaaaaaagaaaaagaagaaaaatctcaaacaacctaacctatcatt

SEQ ID NO: 24884 - DNA, 201 bp, Bos taurus
ggtcaggaataggagacagacctcttttttcctgtacaccttttcatactgtttgaatttttaaccaaatgcttgtattagcctttcaaaaaataatttagaaataaaagagtgggatagtttatataacccttaagtgagctacagtaatatttttaaactctcttctttattctttagttatagtgaaaatggtatcat

SEQ ID NO: 24885 - DNA, 201 bp, Bos taurus
gggatgaggggagccacagttgggacaggttgggccagagagcaggagactgcattttacagatgagcgagagtcctgaggcacaaggaaggtaactgttatgcccctcctgggcctctgtctccccatctgatgatgagcgtgcggacgggactttctgaggctctgattttccctttgggcacagggaggaggaggagc

SEQ ID NO: 24886 - DNA, 201 bp, Bos taurus
agggactctgcctgcaggcttgagtttcacctgggtcatgttgcatgtcagatggtgtcccgtaactgtcaccagatcccagagatccactcccactcgcccccacagaggccctgagaatgggggctgcagagtggggaggaatgtgactgactggctgggaacaggatggggcctgcgttgcttcggtggtgctgggcc

SEQ ID NO: 24887 - DNA, 201 bp, Bos taurus
tttagctccatactaaaaaaatttcctgtccttaaacacacagatactctagaaaagtgggaagaatacatgatatgtaaaaactgaaatcagccaaactatcagatactcttgacaatccatactctaaaggaccactcttttttctcttaggctttgtgttctttcccaccaggtaatcctagatttggtgttactgct

SEQ ID NO: 24888 - DNA, 201 bp, Bos taurus
attaaattggtacaacttctttggaaaactcttaggaattattttagaaatctgaagatatatttgccctaatatccaataattcacaactagaatgtctcctaggtaaacatgtgcttttgggcactaaatataaagcactgttcttagcagcattccttgtcatagcctcaaacagccaaaaactccaaaatgctcact

SEQ ID NO: 24889 - DNA, 201 bp, Bos taurus
tattaagaaacaatgccccaaatatcactactttgatacctgccagattaattgataaatataaatcaattatcaacacattttctatcagtatattttattttagagtccaaagttggaagttccagctagagtcatatgaaacttaaaacacaaagtactctttgcattgggattttaaggcatcatttcaaagatatc

SEQ ID NO: 24890 - DNA, 201 bp, Bos taurus
tttatactcatattttatgaaaaggcccaaggtcagtttgtttcaaagtttgtaagtcttgttatctatttggctgaaccacactgattccatcttgtcaactctatctcaggccagcagtcctatcctctcccctttctatgtgattgaattttagcctactcccaggactgtgcccaagccagataagttcttgtcaac

SEQ ID NO: 24891 - DNA, 201 bp, Bos taurus
gttttcaaaatgtttaagtacattaaatgacagagatgcattttattttttctgaaagttactggcaagattctgtattattacctttttttgcttatttattggatatatgggtcatatgaaaatgatacttggttaaaccttgagaaaacatggaaaaaaagaggttattatatttaaggagaaagaaaagaaagaagg

SEQ ID NO: 24892 - DNA, 201 bp, Bos taurus
gggccctgtatgcaaactctgcagaaggctgctcagtgttatttcttggcaaaggagcccagtagtgacaagtaagtgttccctcccactctagactcagccttgaaaacagaagctgcctgcatcagcaagatttcccgtttatctcaggaaatttgtgcccaggatgatgtctgtaaagcagtaaataacattattcct

SEQ ID NO: 24893 - DNA, 201 bp, Bos taurus
atgggagaaccaccagcaagatctattatgagcttccttttattaaataagcaaaaacagaagggatcttgtttgtttcaggtttctaggcattaaaatagaacttttgaataagtttcaaaaggggacagaatctaccatgtgtgtgacattttcatatgtcatgtcattcatagttataaaaaatctgttaaattagtg

SEQ ID NO: 24894 - DNA, 201 bp, Bos taurus
tgcttggtaggatttaaagtgcaggcactcccttatcagagtctttcccaaccagagagcagaaatactgacgaaggcaaaagtttgacagagaagactagtgtttttgatattgataggcttctctggtggctcagacaatctgcctgcaatgcagaagacccgggtttgacccctgggtcagcaagatcctctaaagaa

SEQ ID NO: 24895 - DNA, 201 bp, Bos taurus
ttggcacctattaaataaactaattcaacaatctttattgaatacctgtgggagctccagggaagttccctactttcataggtcttacattctaaagtggcatgtgacccatcactgttgatatttagctgagatcccattctaggtattttttctagaactgttcggaaagaggtgtgctgtcttccactgagtccctgt

SEQ ID NO: 24896 - DNA, 201 bp, Bos taurus
ttattttaaaaaagacacaagcagctctacaaagatactctatctcactagtagttgggaaactggaaattagaacaacaatgagatattgtgtcggccatactggcagaattcttttgtgaatagtgacatcaaatgatgagtcagaagtgaggaaatggatactcttacccagatgagtcagaaaaacaaggctgttga

SEQ ID NO: 24897 - DNA, 201 bp, Bos taurus
attgtatacatatacactatgtcagttaattcttaaaagcacaatatgagaaagatctcattttataaatgaggaaactacggcacaaagaagttaagtaatatgcccaaggtcacacaaatggtaaatgaaagatcactacagatctctcatatacatatgagataacactgaaaacaatttattttttggccaataaat

SEQ ID NO: 24898 - DNA, 201 bp, Bos taurus
gcttgctggtctgggccttttgccatagggttatttaattttaaatatactgtgattgacccaatgttatctaactttgaataaaccctcctatttgtgttagataaaactgcacttttgctgccacggtgttagtaataacgcaaatattacccagccatatgagaagtcgataaattatgtttaataaattacaaacag

SEQ ID NO: 24899 - DNA, 201 bp, Bos taurus
tccctgatatcactgcttttaccctcatctttccactattcaggattcaacaaaactgaagtaaaagtaatattaatatggccaattttcttgtaaacttgaaagtgctctaaaaataaactgtgttagaaaaaaaatagtaatataaaactctggttagttttcttctttctattttcttttttactggtttggcccagt

SEQ ID NO: 24900 - DNA, 201 bp, Bos taurus
ccccagagtgtggctggctcaggacaaactatttcctgatttggaagaagcagttccgtgtgccactgacagtggtgttacatgaaatgcttctgaggccaccctaagttttgttattcagaaccaccctctctagtctggctttctagaagctccatgaaccacattctgatgtcttcctaccctgtgacgggtctgggg

SEQ ID NO: 24901 - DNA, 201 bp, Bos taurus
accatgtgaggtcctgtgccattataattcacattttaaattttattaaaaccttaacacacatacactcctgtgaggtaagtactattaatgccctcattttacagatgagtaaactgaggcacagagtgaataagtgactggcatatggtcccctgagaaggaactgtattttatccgagcctgaccacagcgctcttt

SEQ ID NO: 24902 - DNA, 201 bp, Bos taurus
caaatgtcctctcctcccctcccccaatttcttccttctcttccactttgccttctttaaaatattaatcaggactaagtaaaagagaataaatagcttgtagaaatatagagttctgtacatttttgttgttcttagtagctcacaaattatgaattttgtcaagatttatctatgaatcctttcccctccatttgatta

SEQ ID NO: 24903 - DNA, 201 bp, Bos taurus
ctttacaggttaacacaattggagaagatatgattcacacaggacaagtttcctgtcttgctgtgttcctataaagatctgactcaagtgtgaggatccaatttaaaaccagcctcttgcctggatcaagattgaagagggggtggaagtggtggccgtgtttaagctttcttaaatataaattacttttatggaacaaat

SEQ ID NO: 24904 - DNA, 201 bp, Bos taurus
acctttgaaaatgatgaacaattcagaaattaaacattttaaaaagcagtattaaactgtgattgaggatactgtggagttgttttgatattactgacttttgaaataactggtagttatcaagttcgtccagactttctctcaataaaaataaataaagaaattccaaagtagctttaaggcagacgtatgagcactgtt

SEQ ID NO: 24905 - DNA, 201 bp, Bos taurus
gtttatatatgacatctgaattgaagcctaaaaattatttcaaaaaagtgatgctgttcagactaaagaattggaaattgtgctaaaaatccactcctatgtattaggaaaggattatatagcaaaaagtaggctacatgagctaatgtaaacaattcagaccttcagcactttctctgaagggaaaaattttttaacctt

SEQ ID NO: 24906 - DNA, 201 bp, Bos taurus
tctttaaaatttagcagtttaatatgcttgtccatttggctccattcctcttcaaacatacctagagctcacactgttggtgggagtccagggcccatttgtttttcactttccattggctttctggatcagatgtttgcttttcaaatgctcctttagattttgaaaagtatagtctctcaaagtaagatacatgaaata

SEQ ID NO: 24907 - DNA, 201 bp, Bos taurus
ataataaacatattctaaaattgaaaaaaactctgaaataatttgagcattgcatatatctgtctggcacattgaaaactgacacaaagctacagagaactgatgatgccagacttcagcatacaccattcatcttcactaaacaatactagaggccaagctaagggctatgatattaacatctactttcaacaacacatg

SEQ ID NO: 24908 - DNA, 201 bp, Bos taurus
ttggcctccaattaaaataaataaatttatattaaaaaaaaagctttattgaaatcctttgagaaattcaggtttgggtgtagaggtaggcataggtcatccatctccttgcatggccctgaaataaatctttctctgctccaaaaaatgaaaacaagttaacttagaaaaagtcaagttgatgtttaagacattatattt

SEQ ID NO: 24909 - DNA, 201 bp, Bos taurus
ggaaagtaagcttctttcctcctccagtctcactctcagggcccagatgcctttggtaccaaggcttcagaggtcgcagtgtgcaaggtagggtactatggacataaaagtgaccttgaaggccaggcagacggatctggactaaatcttgccaatgcactcttgaattaacccctaataacagtgggctccatttctccc

SEQ ID NO: 24910 - DNA, 201 bp, Bos taurus
gttagatgcatgttttaaagcagcaagtaaactagctctgatttattttgaatgccatttcagaactattttgagaagagaacacatgatttttcaagagcaggccatagctaatggagaggattctgttgtgtccactcaagtcccccttcagacctgaagaacttttgcccccacctgccaggagactagcatctgtca

SEQ ID NO: 24911 - DNA, 201 bp, Bos taurus
gaaatgtttggcctaatttctcaaaataaagtcatttttatgggtggtgaaatttctcatgccccacttgctgaaggatttcatgtaaacttaaaaagtttacaggaatttgatcctcatcacaggcactgtccaaattttaagggatgaaaagaagttcaatagatacctgtttaatgctttcacttactaaacaagtat

SEQ ID NO: 24912 - DNA, 201 bp, Bos taurus
gaagcagcctaagatcccccgccccattccccttggggccgctgtgaacgttctgtcccaccaagcagctctgccaaaggggactcagagctttgacactaaccctctctaaaggccaattaatcaggagagactatgaagaagtattactgaaaataaaggacatgatctctgtctcttttcttctttgtgctataagaa

SEQ ID NO: 24913 - DNA, 201 bp, Bos taurus
agaaggtttaagccagtatcagattgtcctccaagtttaagccctcctgaattgaaagctcaattaaaaacaaacacacacagttgggggccaactctaacacatctgtgagctgaatttggcctaccagatgcaagcttctggaatcctctttccggaatttcagaagtgaaatgaagaagcatctccaatccagtctag

SEQ ID NO: 24914 - DNA, 201 bp, Bos taurus
tttcaaacactgggcgcacctgaaaaacatggcttcatctggctcagtccaggagaaagcgtgttaagagacacaaaaaacacaaccatttacttttttatatgttgggggagatagtcatgaacagtgttgggtctaatggataaaaaggaatttttttgggggggtattaaaactctgccaaaggaaactgaattctcc

SEQ ID NO: 24915 - DNA, 201 bp, Bos taurus
acaattagctgtctatgcaacttgaaatttccattttgccagctgagtaatcagttgactggagtttctcattttggatgcatttctaagccttttgtgttcaggttttttaaaaatgtggattctaaagtaaataaacagtgcgcttaatcagatgtatcctttttagaaacaccctcttcccaaacatacagacaaacc

SEQ ID NO: 24916 - DNA, 201 bp, Bos taurus
gggattgaactgcatctcttttgtctcctgcattggcaggcaggttctttactgtgagtaccacctgggaagcccacaaaacagagtacaaatctcaaacgtttccgggtgccattgtgcctttgatagagcaaaatcaagtctccaaaatataagaaaggcctggaaggtattaaggatcaaaattagcatcttttttgt

SEQ ID NO: 24917 - DNA, 201 bp, Bos taurus
aggcttgtgttttggcctctgtttagctgtgttaggcctatgagtgacagcttccctgcttgaagcacacagaaagcacagccttcctcattcactgacaggactgtggccttttcacacgttccttccacagcagtgtttgtccccaaacactggaactccacacaatggcattcctacttcaacacccccaccaacagc

SEQ ID NO: 24918 - DNA, 201 bp, Bos taurus
ttctaactttttttctttttcacttacaagggcagagctaagtagattcaacagagactgtatagttcacaagcctgaaatatttatcctattaactctttagggaaaagcttgccaatttctattttgtatgattatatcttgtgttttccttaatttatgtcatagcagtaagacatgttagaagactgagacaaactg

SEQ ID NO: 24919 - DNA, 201 bp, Bos taurus
tcacctaccttaatccatgcagcactgtggattaaggacaccagtgtgccccaggattctcaaagaggatcctggaaacttcttgtttcttcttttttgctgtctttactaaattctattgggccttagggggatttgcatctgaaatgggcaacctggtgtttttctcaatgaagacatcagatcaaagttcagttagtc

SEQ ID NO: 24920 - DNA, 201 bp, Bos taurus
gtctcagctctgggtgacagacacatgaatagtaaaaccccatcataaaattattctgcccaggaggactggagatggggttgtttggagaaagtagaaacgatgggccaatggactccagagtccagaggttcaaagccagagcaggaagagccttgtgtgaggttcagaacttgggagcagatttcaactagcagagaa

SEQ ID NO: 24921 - DNA, 201 bp, Bos taurus
gcgcaatggcaatgcgaggctctatatgagtttcactccagatgaacttaatctctggatgaaaccacccagacccaggggctgcctggcccagggttccgttcttcccacactgggagaaacaacataattagaaatgcaatgagatgaggtttctgttcctctctccagttacttcctccccatcatttggcctgggac

SEQ ID NO: 24922 - DNA, 201 bp, Bos taurus
cgaactcgaaatagcctattaaatgctgtagaggtggcgcacaaggtaaaatgatgtgaagaatgagatcaaaagttgaatcaagcaattagaaaaaagtatacaagataaaaatagagccataattccacgggggaaccagatgtgcttttgtcaggggggaaatctatatgcatgtggttctgtcatgactaaactggc

SEQ ID NO: 24923 - DNA, 201 bp, Bos taurus
tcttttctatttcataggtattcctgcgacacatggtaaacccactagttattcaataagggtagataatacagttccccttgtaactcaggccccagccatgcagccactacagatccgaccaggagttctttctcaggttggtgataataattcattatttttgcttatgtgctgtccttctcatactcaagtagaggc

SEQ ID NO: 24924 - DNA, 201 bp, Bos taurus
tagctaaggttcctgactcagtcctagaactcatgggtctacatgaatagaacccccgattttctagatttcagagcatttgtcctattccaactcatagcaaagaccctagagaactggcacttagtagtaaaacaggggctgttaaggaattctctgacaacctcacctccaaccactaagtacacaactgtgagcagg

SEQ ID NO: 24925 - DNA, 201 bp, Bos taurus
ttcactcacctcatcctcgagaaggccttgagttttggtaaaagcggagggcagacacacaaaagagaaaaagaaatacgaagaatcagtgctcatgttatacagttccgctggtcgataaggacgtagtacagtggcggctcacccacactactttgataacgatttgcgtgcagtcaaaacagtcaagcaggcacactg

SEQ ID NO: 24926 - DNA, 201 bp, Bos taurus
tctttaagagaatgatggtgtggatgacgctgagtggctgtggcatcgggaattcagggtgatcttggcctagagcaccttggggataaagaccagcagctctagccctgcctctgccctgccagggtttcagcaggcctagccccacggcaacagtgttgagcaaaaacttctccacacagagggccagttttgatgctg

SEQ ID NO: 24927 - DNA, 201 bp, Bos taurus
ctgtcagtgggggtaccagagtctattacatcaactgttgtaaggattaaatgagtaaacgcatgcagtgtggcccacagacctgtaatgaactgggggtgataatggatatgagattacatgcatgcaaagcatttggtgtatactaagcactcataaatggtaacttctgtgttgtaggaaaaaattgccgggagaatt

SEQ ID NO: 24928 - DNA, 201 bp, Bos taurus
atcatcccaaaccaaaacaagttccagcattgagcgcaatacatggcacacggtgcaggcacttttccacaagtgtttgctagtgacaatgggtgaaggacagggttaattatctcttgccttgtcttgcgacagatggcgtgtcatgtacgcagagtcagatatttatgtctccaggaatcctttcacaagagaggtgga

SEQ ID NO: 24929 - DNA, 201 bp, Bos taurus
cgcagggctatgtctatgtccatcctctctattgagtgtagtccaaagagactgaaacgatctgacgattatgcagaatactgctgggacttgatccaccatatgatatcattttgtcagtgatgaaagtgaaagtgttagttgttcagtcgtgtccaacacttttgtgactccatggactgtagcctgccaggctcctct

SEQ ID NO: 24930 - DNA, 201 bp, Bos taurus
cacatacacacacacacacacacacacaccttccgagtctacccagcagcttcatccctacagcaatttagcccacgagggcggggccccagttaatgcaagtgactctctaaagaagtctctactgaaaggtctttgctgctccaggcttaggggactggaaacaggccttcacatctattattggaacgccctcaggaa

SEQ ID NO: 24931 - DNA, 201 bp, Bos taurus
gtgcacagagagaaccctgctgtgcttgttgaatggtggagttaggtttgtttgtttccgtgggctcccacttctgagaggacagaggctgcgtgcagaggatgtgccccagcttggaactcacgggtcttcgtcctgtccccagccctgccactaacctgccccgtgactgcaggcaagtgatggtccttcccacacccg

SEQ ID NO: 24932 - DNA, 201 bp, Bos taurus
ttgagggagcatcttttcaaatcttacttagaccaactgacttgcttttcaaaaacaaaataaaatcatatgtttccattataaaggtacacacacttattatagaacattttgaaaatagagaggaggaaaaaattcacccatattttctccatctgtaaataatgattattagcagttggtgtgtttccttcatatatt

SEQ ID NO: 24933 - DNA, 201 bp, Bos taurus
tggatggacagtctcagggcccagcagcctcagtgcttcgctgaccagggcagcctgtttccctgggaggagggacctggattcttccttcttctaacaccgcagctgggcctgcaaaatctgctccccctgccagctggaaagttggcatttgtagctggaatatctttttctttcagtgttgtttttggggacacagca

SEQ ID NO: 24934 - DNA, 201 bp, Bos taurus
ctctacatgggtgtctcccttcctgccctgccaatgggttcatctatctgtactgcttttctagattccatgtatttgtggaattccacatattccatatattttctagagtccacgatatttgtttttctctttctgacttcactctgtatgacaggctctgggtccatcaacatctctacaaacgacccaacttcattc

SEQ ID NO: 24935 - DNA, 201 bp, Bos taurus
gcaagttggggaatgacgaagcgtctccagcagacgttcccccgacaagagctcacggtaggacacaggtgagctctggtcctttcttgggccttgaggcggagctggtttgtgagcacagttacccaggctcctcggggagttgcccggtgctgctgtgactgggcctgcgataacctacacctcacccaggagggtgtc

SEQ ID NO: 24936 - DNA, 201 bp, Bos taurus
ataagagataacaactgcaaagaatttagtgtcttgaaaaaggcagaggaaaagaaggggggggaaacctagtctatgtacaagtgagttgatttaataatggaagataacctctttcactataatctcaaagacttcctgtttcttcaatcatttgttatgctatcttgcctattttttttccacttctgtttcccatat

SEQ ID NO: 24937 - DNA, 201 bp, Bos taurus
ttgtcaagctttatacccgtttcagtccattttcagcacatcatattattcttccatttaaatttcatgtatgtcctttacacacacacacatgctcacttacatggtgatagtgattgtctaggtattagaaaagtattttaaagaatgaatcaaagaattataatttgtttctgaaatatataccatggactagattgt

SEQ ID NO: 24938 - DNA, 201 bp, Bos taurus
tcctgtagcatctctctgtttttctggtcatcatccatgttcagtgtttgtttttatgttgctataagtataacatggacacaactcaggagaatgcaaactgtttacaacaaacagcctttcttcttccgaggttcattatgtcagtgtgtagtcttctttattctttccttttagtttttgtacctaacgcatttgctg

SEQ ID NO: 24939 - DNA, 201 bp, Bos taurus
gaagctggcagttttgagcttttcaaaaatataaagaataagaaagccatgcatacacgtacacataaatatccactacaaatagaagagacaaagctactgggcaatttcatttctgctaaatggaaaatctgaaataaatggtaacacttgttggaaaacttttttttttttttttagtatgtgaagtcaatttaactt

SEQ ID NO: 24940 - DNA, 201 bp, Bos taurus
gtagtataatccaattgcagaggttctcccccaagaagtgaggattctgaaccccacgttaggctccccattccaggtatcttgccctagaaagatgagcgaccagaatgtctgactttggaggccagtgaggtttgagtacaggtgagacagagatctttagggaaaatagacccctctcttaaaggacatgctcaaaat

SEQ ID NO: 24941 - DNA, 201 bp, Bos taurus
ggactgacagtttcatttataatttcagaaaaacgttatgctttaggacatttatatctctggccttagtcacagctgtgttatctcatgtaaaaacacacgagaacactttatgatgagttaatcattcaggaagataaaaaaaagatacttcctgtattcccaagttattgaggttcattagaaagaacaaagatttgg

SEQ ID NO: 24942 - DNA, 201 bp, Bos taurus
caaatgttggatcttttgatattattccaaagatacatgtgacttgtttaatggttttgatttttgctctgcttctcagattggatcaattcagttcagtcgctcagtcatgtccatctcttcactacctcatggactgcagcacgccaggcttccctgtccatcaccaactcccagagcttactcaaactcatgtccatc

SEQ ID NO: 24943 - DNA, 201 bp, Bos taurus
aacataatgaaccatctaaacaatgagaccccatgtgggccctatcaatatttagtttaaaggtagtctgtgatctgggtaatactttggaggtgcaagattaggcctggtgacaccagttaggaaattttaagagtagaggttgacagggatgattacaatagagatagaaacataaaacagaactaatcatcgcccttt

SEQ ID NO: 24944 - DNA, 201 bp, Bos taurus
gtatgttcataatttccatatcatgttcacatgatttcaggactctcctttgtaacatgagacacaccaatttttcaatgtggtctccctttcaacactctggtcttcagtttttgagtttctacagtttcaaagttgcctcagtttcagctttttaggaactacaataggtttaattatggctcccacgtatggactctg

SEQ ID NO: 24945 - DNA, 201 bp, Bos taurus
agaatagaaatttaaaagaggcatcactctggaagtgcctaggaaataatctattcacttctgtaagttgtccccaatattgatagggttgaactccagattgaataactaaatgttgtatagaaatgacatattctcattttatagtacttgtagaaaatttgaaaacatgttaaggaaagaaagcaaggaataaaatat

SEQ ID NO: 24946 - DNA, 201 bp, Bos taurus
attattttatttttaaaatgcactctgcatatgtggaaataatcagggaaactcagggatgcacaaactggggtaaggccagaaggaatttaatcgaggcatttctttttttctctctctcttttaaaaccatcatttcactggatttcaaaagccatcagatttgcttcaggccattaaaaggcaaattggacattaatt

SEQ ID NO: 24947 - DNA, 201 bp, Bos taurus
ggagagacctcaaaggacaggaactttttggcaagcccaaagatcaaagaactaagacagaagttcttagttttcaagcattcaagaaaaccaagagggaaaatgtctatgagttgagaagcatggccttctttgttcaaagctggtaatggaattaatcttttttttgtgagcaaatggactaaataagaaaaataagaa

SEQ ID NO: 24948 - DNA, 201 bp, Bos taurus
taaccccccatgtgcggtttcttaggttaatgcaaggattctcgtaaaagagcaagtcttgtacacttttcctcccattctggtggacagtcggactgatggtctatgcttgctagaggtgatgatgagagaatccattcttttgatagatacataaataaaacaatttttctagtaggatcgccatggcttaccaatcca

SEQ ID NO: 24949 - DNA, 201 bp, Bos taurus
tctcacagaatctctactggcaggtgattttctgtccctgagtttagaggagcaaatcgacatttgaagagtttaagtaagtgactcactgtcacacaagcgactgtactggtttacgattcttggttgcctgacttcaaaacccatgttcttaaccatgagtctccatgaccttccattccacagccacaaataccccct

SEQ ID NO: 24950 - DNA, 201 bp, Bos taurus
aaccttaagtgacttggtgctaaatgaatgtcatcatgtgacataatagactagaacaataatctagcttttcaagtcagagcaaatattaacatttaaatagctaattcctgtgctcacttgatttttctcattcttttttaacggctaacagagaatgaacatctcaggagtgtaccagttctatgagaattaaaaata

SEQ ID NO: 24951 - DNA, 201 bp, Bos taurus
aggccaatcgtgagttcacacagctttggtgggaacagcagcacatctcagtgatgtgaggagcccaaggagtccttgtccagatgggattagtaatatcactgtaatgcaaatatggcccagctattgtaggaggctgatttatatctggaaatgactttcctaactccatgagagaagtgaaacatttatggtagtagt

SEQ ID NO: 24952 - DNA, 201 bp, Bos taurus
attttcagagacaggttgaggcaatgggtaaattcgaatagagattctatttctcccagaccctatgctcatttcacctcatctggcttcaatcccagctactcgttcttgcttttatttcccttctgtttctttccttgagttgcatttctgatgccaggtgggagcaacagctgaacacggtggaggcgtaagatacgg

SEQ ID NO: 24953 - DNA, 201 bp, Bos taurus
cctgagaggaattcaggatgaaagccgggatgaggtgctctgttctttggcaaaactaccatttgatagatatgtatctcgggataaattttaatgaacatagatccttgtatcttcccatacagaaagcactaaaatcattcactgagatatctgttccttggaccagcattaccatgatgtatgcttggctgttcatat

SEQ ID NO: 24954 - DNA, 201 bp, Bos taurus
tccccgctagtggactgactctggcctctgccgtctgcaagttctcaggcttccttccacccctggggtcgcgcgccgctcggggagagtcgcccagcggtgagggcatcgggccctggggaccttttctggcgctctggctttagaaaccggattcattatttcttccctggtgcctctcaggcccacgcgtcaccagcc

SEQ ID NO: 24955 - DNA, 201 bp, Bos taurus
caggagcagtgggtggccgggaaggactgagaggccagacggtaacctgtccgggtaaagtgagaacagcttcacgtggcctctggggctgtgtctgatttactcttccttctgcctattgatttccagtctcctctccttgatgctattgctcctctacgggtattgctgggtttgtccaccatcattaattcattaact

SEQ ID NO: 24956 - DNA, 201 bp, Bos taurus
gcatcgaacccaggtttcctgtattataggcagattctttaccatctgagccatgagggcagccaagatgtatatatgtatccggagtccaagaaaaaaaaatatatatgcacttatattaataaatgtccagagacatttggaagttatctgctacagttgatatttataaacaagggaccatggaagttccctggtggc

SEQ ID NO: 24957 - DNA, 201 bp, Bos taurus
agaaagcccaagaagcagggcagactgcacactgaaaacatggaccacaggcagcttgccccaaagcaggcctcggagcagtctgacacttacctcagggtccttcatattgaaatcaggttccaagtggttgtcagctaaaccaccaactcatgtggcattaatgattcctataagttggggtcacagctcattaattaa

SEQ ID NO: 24958 - DNA, 201 bp, Bos taurus
aatccattaactgcagtgaaccaagctactagtctgtctccccatcccgacctgaaggcagaggctgtgtccagggcctcacagaatcccccaggaggccgggaacagggacaggcaaagtctggtgaggagctggaattaggcatttcagtccccttctctgtgaaaactgggcatttgggccaggaggcgtctggcgtc

SEQ ID NO: 24959 - DNA, 201 bp, Bos taurus
gctgggatggtggtaagaaaacaggcagcgagtcaggttcccagggactgaaatacaaaacccagctacttcctggccaggccttctctgactcagtctcttcatctctaaaatgggactattgacccacgctcacgtgcgatgagtttgtaaagcccgaggcacttagcatgtggcctgtgagtggtgatgtttagttat

SEQ ID NO: 24960 - DNA, 201 bp, Bos taurus
cccttaggatttctggtggattggttccaggaacccttcagacatgaaacccacagataagcaagtccctcatataaaatgccatagaagagtcggcctttcagatccgtggatgtggagagctagctgaaacaactttaagtccgtcaattacttactcaaattctgtgccctgaccctgccccctataggccttgtgaa

SEQ ID NO: 24961 - DNA, 201 bp, Bos taurus
agagagctatgaacagattttctgcctatgtagctccaaagcccttccaggggtcacgctgcaaccttggcctcattagcatgtgacgctcaccaaccagatgggcccatctggtttcttattaatccaaaagtgagatggagggagcagccttctagggaaccagcagtcttggataaaacagcctgcaagcatgccaat

SEQ ID NO: 24962 - DNA, 201 bp, Bos taurus
gtccgatgagcagctaccttgtaggggagacacaagctataaacaagtcagtgaggtttccttgcaagaagaactaggaaaacaacaaatcaaggaatgtagaaggagaggcctaccttgtgagaatctgatagaatccaggagcaggaacctcaagggcaggtgctgggacaggaagcccttaaggaggaacggcactct

SEQ ID NO: 24963 - DNA, 201 bp, Bos taurus
cccctccccaaggcaattcagaaatcactaatggccgctgaccactcacttccttcaagcccttctctctctgtctgaaagctaaggcttcagataggaatacccaatctttctaccaggcaaggcaactccccgtcaaaacccatactgggacaatcctggtagtctgtcacgaaaatggtgagttcagcccaattgctg

SEQ ID NO: 24964 - DNA, 201 bp, Bos taurus
cgtcactttgaagccccgtttgcattccatttttaactagagggaagaggatggaggtctttggtttctatgacaacccagatgggccataatacaagatacttacaaatgttcagtcgcagggatgccaaatcaaattaaggcagagttagcactacttcataaaaactagatgggggagaaaacaaaatacttacggca

SEQ ID NO: 24965 - DNA, 201 bp, Bos taurus
gtaacttcaactttattccatgggaaacctggcagaagactttgagagcaaaacagactttagcaatttcattggcttgggctctatgggctagtatctacgacaaattaacacaaatcatatgttaaatgtaaaggtaatgagaatgacaaaaggtaaattttcacattaaggtctataaacctggactgttttcaaatt

SEQ ID NO: 24966 - DNA, 201 bp, Bos taurus
tcaaaggatggagtacattccatttcacaatgcaactctgatttatttaagcagtccacaatttgagggggaggttaaataaacttttcatatttgaacagttatagatttacagaaaaattatgaacctaatacagacagttcccatagcctcacacccaggcaaataataatttccctcattattagcatcttacatta

SEQ ID NO: 24967 - DNA, 201 bp, Bos taurus
gacactaccccacgcggccctgcatggctcagtgagtccccctactctcagaactgtaagtaatgaaccatcttttcgactgactatccttctcatctgcgggccttattgtacctgaataaaacccaaatcctggttactttttattacagttttgcatataccttttttctgaggggagagtccaggcttttaatacgc

SEQ ID NO: 24968 - DNA, 201 bp, Bos taurus
ttttcatctattcattttgcagatctggggttatttacaagattcctaactcatatgcgtctatttctttgatctagtatttttccctcctcatctccacataagttttgatattaaatgtatagttagatacattaataaatgtacattaattgatgtatctaactaatgggcttctctggtggctcagatggtaaagaa

SEQ ID NO: 24969 - DNA, 201 bp, Bos taurus
tgcctcatctttagttaacatccatcaaacatgctcactggttataaaacacagcaattagggctagtccttcaccggccaagtcatcacttctctataatgtaattttctttcacattcaactcatcctcgtgcgcccaccttctggaactcttccatacaggccagcctttccttccagttactgctgtcgagaagctg

SEQ ID NO: 24970 - DNA, 201 bp, Bos taurus
tcggtatagctacgtcgctggataatctagtgttcctctgcttgcgtacacatatggatacctggtgtccatcagtggcctcaaggattgtctaatgctggttgtaaacaaaagcataagaactcatgaactgcaggtggacagagtagtttactgggccactttggtaagataagatcattaaattgaagatattgtcac

SEQ ID NO: 24971 - DNA, 201 bp, Bos taurus
ttcctcaaggtctgaaaaggatgcttctaattattgaaaagacatctttgctttctgtgatttcaggtgtcagctcctgagctttagaacatggctgctaaaagcaatgtgactgaaatcattttcttgggattctcccagaaccagggtgcccagaaggtcatttctgtgctgtttctcctcttgtacgtggccatcctg

SEQ ID NO: 24972 - DNA, 201 bp, Bos taurus
ataagctcatttaatcctcataacatccccacaagatagattattacttttcttctcatttcttcagaggaagaaagtgagaaacacatttagaaacttacagaagcatagtcagccaataagttgcagagttaagacttgggcccaggcagttctgctatagagtctgtgggcttcaccatagtatcctgacacataaac

SEQ ID NO: 24973 - DNA, 201 bp, Bos taurus
catagtaaaagtgcagtaaccaatgtttgagtatattgaatttaagcaagtaaacaaagatttccctgcttaagtagtttgtttgctgaagttcttacctctcagttgcagtctgcttgccattttatggaaggtcaagattattttgctgtctgtaatttttgtccatttcttatttttccaaaattatgaatattagag

SEQ ID NO: 24974 - DNA, 201 bp, Bos taurus
gagcctacttatcaatatgttgatttaataatcacagtctgaaaccacaataatgtttgcaccaacctgttttattatgactcactgcaacttctatttaacatatcgctgatccatgtagcataaattactccctgtcactttgagggtaaacccatcccactcagtgtttcatcagtaactttggtacctctatttgca

SEQ ID NO: 24975 - DNA, 201 bp, Bos taurus
aactgaaataatgtagaaattagtgaaaaaatgaatatacgttggagtttattaagcagttctccatattaaatgtccacaaatccttggtctaagtcaacttatttcacttcagttttgtgcaaatgcaacattcctgttccattctttctcttattgcccatatccaaaatatacatttcagaactaatcttgctgaag

SEQ ID NO: 24976 - DNA, 201 bp, Bos taurus
tgaagtcagtttacggtcaggcaatgatgtcactgtaactctctatgacatgaatgctattctcgcttctgacaaggaagggcccaactttcaccctccaattccctggtcctggtgaacgggaggcagatctcagctgacagttccttcagggccaggtttccagatcccacccagctgtcatcgctgagggagccgggg

SEQ ID NO: 24977 - DNA, 201 bp, Bos taurus
ggggctaaggacacgtgtagaaagcgtgtctagctggtgggctgcaagaagggacgcccccttcacgcatcgctcaacctccagggcctgaaacacctgcgaaccaatccaagttggagtgaagctctggagctcacagctgcagagccaggagctgcaactttgtgacacccagcccatctcagccaggtccattccctc

SEQ ID NO: 24978 - DNA, 201 bp, Bos taurus
cccctcgacatctgcgcttgcccacgagcagcgtctgttctgtctgacgttgttgctgttggtctactccatctatgtgcccacccctggcctggtcataagtgtcctgaaagcaggaacgtccgctctccgtcagctttagtgcctcccctaacagatactctttgtttgtgaccgcggaaaggcagtaaggaggcttgc

SEQ ID NO: 24979 - DNA, 201 bp, Bos taurus
cttactctgtcacgaattgcttcagtttattaacttgtgtttactgagtgaaatctccttcaattgtaaagtgagatcatccttaggatggctgctccactgtgcaatggcaaagactgaatatgataatggatgcaaagctgctttagcaacactctgtataaagtatggtatttgctgtttctttcttacttcctcccc

SEQ ID NO: 24980 - DNA, 201 bp, Bos taurus
ccagcgacctcatcccacagatggtgaccaggatgtaggcacaagagaccaagatgactgagactgtggggacggtggtcaaggcggaaaagatgagcagaatgacgttggccacagtggtgtctgagcaggccaggtggagcacaggggggatgtcacagaagtaatggtcaatgacgttgggaccacagtagggcaagc

SEQ ID NO: 24981 - DNA, 201 bp, Bos taurus
agagcaaaccagagctaacaggtgcgggatggagccccagggctgggaggattgcaacagcgtagctgggaccctcagaggccaggcctgcgaggtttccaagtggtcacctccctctctgtaacatccatttccacatcgtcttttttttttttaattgggggatgattcctttacaattttgtgatggttttggccaca

SEQ ID NO: 24982 - DNA, 201 bp, Bos taurus
tagcagttataaagcactttcacttgcatcgtgttaacttttcctcacagaagtccttgctatagtgttattgcttaccctagacaggaaatgctgcaatcaaaacaaatgagaaagttacatgacagctgagggttacatgacaattgtcatgacaaatgacaactgagcaatgactctcagggtctggaaacccgaagt

SEQ ID NO: 24983 - DNA, 201 bp, Bos taurus
ttctgcaaattaccttcagatcatagtaactttaaatctggtgtggcagttaacgttgattgtcaacttgactgggccacaaggtgactggatatttagtcaagtgttattctaggtttttctgggagagtgattttgcataagattaagattaaagcagatagcccttcttaatatgggtgggcctcgtccaatcagttg

SEQ ID NO: 24984 - DNA, 201 bp, Bos taurus
gtagccatatcctccagagcaaatgagaggcaacatatgttttttatttatccacataatttctcaaggctctgaaagctggtttcaacacaaaccaagcgtgaggcatctcagctgggcatccctgggcatagggaccacctatgtctatggtggtttcagataactcagctaaggctgaggatggcttttttctcaaag

SEQ ID NO: 24985 - DNA, 201 bp, Bos taurus
caggcagcggaatccccagttctcatatcagccacaccaccaaaaacagaagtcgtgatctccagctagctgaggccatgtaactgagctcagagtaaataaagagactgaaggggatggttcgcgcaatttgcaggaagcacccagaaaaggcaggcgtgccgtctcctctccccctgagggccagggctgcagcagcca

SEQ ID NO: 24986 - DNA, 201 bp, Bos taurus
ggccgtggcagacaccaaaaaggcggtcaagtatcagagtgaagctcgcagggtgagccccgcatctcggagggaccggccggcttctcctctccctggtcgcccccatccatgtccctgagatctccctgccttcctctgtctggcctcctccaagagccttcgtcagctctccctggagaatagctccccttccctccc

SEQ ID NO: 24987 - DNA, 201 bp, Bos taurus
tgttgtgctccagccaccttcctcgtttgtttcactcagaatttttcttctcgtaaaccattgtcccgtttggaagtgtgtacattctgcctgtgcattcggtaggacagcctggtgtgtgaccaaggctgaagcagagggttacttgggttacataaggctctgtaacgggcagacgtcactagggtcttgtgaggacta

SEQ ID NO: 24988 - DNA, 201 bp, Bos taurus
cccaagtgaaaaggaaagatagggattattataccccttttgacagataggaagactgaggcacagagaagtgatgtgacttgctcaaagtcactcatctttggagaaattgggaccaaaagcccagtattctgattgtacgcagactgctaaggcagagtagatcaggagactcaccgggatatctgggcgatgtcatag

SEQ ID NO: 24989 - DNA, 201 bp, Bos taurus
cttcatccagtcagtggggtcaaaagagttggacaactgagcaaccagcacacacaagaagaatgaaaagccaacctcaaactgggagaaaatatagtcgaacttgtaaagatttcaggattggtgttcggaatatgtaaagaactcatacaattgataagaaagagacaaacaacccaacagaaaaatgggcaagagaca

SEQ ID NO: 24990 - DNA, 201 bp, Bos taurus
cagagtgtgttaaacatggccctttgtcaactgaaggcagaggcgggacttttaaaacacagcttggaatactttagaatgttaactaaaacacaaatacataaggtagcagagaggaggccacaggcacaggctgagtttatgtttctttagtcttgcttcaaagaggtttgcgtttactattatccccatggggttgca

SEQ ID NO: 24991 - DNA, 201 bp, Bos taurus
aacggggagaccagagcagctgggccattaaacatggatggaaaccaacccatggaagaaagaggtggcacttctcctgttggccagagggagggacaagtaagatttagcaaaggtcagcagggctcatactgagcagtattcggtctcaactactcacacccttcacattctgtcagttggacaaaaaaggcatggcct

SEQ ID NO: 24992 - DNA, 201 bp, Bos taurus
cctgacgaaacctgcatccagcagggggctggtggggagacagggaacctaaggaatgctgctggccggagccagctttgacaggaaggcataggacaaagcgtctttgtctcttctcagagccagtggtgcagaggtgagaaaacccagagttggggcttccccgtgctgagctgaggcagaagcatgtaggggcaagaa

SEQ ID NO: 24993 - DNA, 201 bp, Bos taurus
cttatcctgtccagggagtgttctcatactaactttaccttgttatatttatttcaatatttatatgtatgaatttttgaagttgcatgcgtttgtacttgtctctctatctttgatatatgtttaggtatgtgcatcttatgttagactgattcttagatcaggtacctttattaaccagttgccctaaaagtttcctga

SEQ ID NO: 24994 - DNA, 201 bp, Bos taurus
aggtgcgcacaggaggaccagctagaggagcagcaagggctgggatctcatccaaaggctgacgataccagccaggagtgtttttatgggggagggatgtcggggccatagaggagaggaagaagtgaagacagtatctctagctgccaggtttttttcttaaatagcatcactgcctaggcccacttggtccctctggga

SEQ ID NO: 24995 - DNA, 201 bp, Bos taurus
ccagacagacccacaaattgtgggtggccctgtttcctgtggtaactcccagcaaaagacctacagctgtgagtgggactctaggaccctctaatgcagtaatccttggtctttctggatttgaggcccattgcagtcttactaaatccaaggtgccctttctccagaaaatgtcacatatgcatgtgcacagaaaaattt

SEQ ID NO: 24996 - DNA, 201 bp, Bos taurus
attttataccatgagtgtgtatctaacacgagtgcattaaaagtcattagctctgtcacctcctgttgtgtagaataggcctcccaggcgggtcagtgttaaagagtctgcctgcaaatgcaggacacgtgcgtttgatccctgggctggcaagatgccccagagaaggcaatggcaaccccttctagtattctggcctgc

SEQ ID NO: 24997 - DNA, 201 bp, Bos taurus
tcagtggagggtgatgaagaatgcagagggtgtctgtttttgtcccacctggacctaatgggaggagcatggagggtccttgggcctggggttgcccctcccccacccccactgcgttcaggaattttcagagacgttctggatatggactcgggagggactggtggccagtgggaaagcacatgccaaatgaagctgtct

SEQ ID NO: 24998 - DNA, 201 bp, Bos taurus
ggggacattctcagcagatcctgaggccacacagcaaacagcctggggagggggacggcacccacctacagagccatcttctgcagaaaagaggaactggcgggccttatgttggcctctttgtgacaaaggccttcatgtaaagcctagcctgaccaggagttgagtttccttcttctgacagtcactgcccttctgtgt

SEQ ID NO: 24999 - DNA, 201 bp, Bos taurus
ttcctccatcagtggaagcccaaactgtgtctagagtctatccgatggaaaacactcagttcaaaatgtccacctggctttgctggtagtcttaaccaccaaatcaaatgggccatacatgtggcttgataacacacacacacatatagtattcaaaagtgtgcagaaattgacacaatccaaatctcaaagtggtttgta

SEQ ID NO: 25000 - DNA, 201 bp, Bos taurus
catgcagattgatgtggccaggcatacaccagcgggggaggtcaggatgagctcgtgagggaggcagaggccgggtcacctaggggcctctcaggccatgtctccacaagcgattccctgaacaagcttgaaagaggcccagagtcccccaaatgaaagaaatatactgtgcatgtgactctgggaagggagcccctcagc

SEQ ID NO: 25001 - DNA, 201 bp, Bos taurus
gtcagaagcctcccagggcctcatcaagcccccgaagaacgttttcaggagcccagcaaggatcactttaggccctggtccacggactgcggccagctgcagacggcagcttcgccaggatggggtctgtgttacagctgaagaacaagtctgcaccaggtacccaccgggccaaaccctactgtaccctccagtctggcc

SEQ ID NO: 25002 - DNA, 201 bp, Bos taurus
gctcggccgggaaactatttcctttcataaagaggcatgtaattagcctggggaaacgggaggaccccacagtcaatgtgtcctttggctacactgacgatagaggaggggccccagggggatgggaagcccccctcccagcctcccggcctctgcaacacacgaacccttgatgctctgcctgtttctctcgtatacaca

SEQ ID NO: 25003 - DNA, 201 bp, Bos taurus
ctccaaaaaatgaccagaaacaggcctcccagaacacagtcgtcttggaaggtcccactttgttttttacataggaggaaggcccttctcttcatcacttccagagctagaatttggaaagtgggggcatggagttgaggaaagaaacgaggagattccaggcctaggttctatcctcactttgccacttcctagctgtgt

SEQ ID NO: 25004 - DNA, 201 bp, Bos taurus
tagtgagccctctgggttcttctgtgggaaaggagacatgacaaaaaatggtagaaggatgaatgaatttttatggcagagaaggccaaaatggaggtttgggggaataatccatgtacagtatgagagcaagcaagattagagaagaaggaataagtatttgggaaacctaagaggacagggtgactgactggataaaga

SEQ ID NO: 25005 - DNA, 201 bp, Bos taurus
acggcatcgtgcaccgcgacatcaagcccgggaacatcatgcgcctgctgggcgaggagggccagagcatctacaagctgactgacttcggggccgcccgcgagctggacgacgacgaaaagttcgtctcagtctatggcaccgaggaatacctggtgagcggcgtgggggctggcccgcgccctgggactctcggcgccc

SEQ ID NO: 25006 - DNA, 201 bp, Bos taurus
tgtgtactccaaggacacaatgtggcccgagaatctggggcctgtttttcccttaaatattgaattcccactgagcaaggaggttccttttataaggaaatgtgtgttctttcactggccagacaaagcaggcaggctcttgctggtgcccaggggtcatgcaaagcccctccctgcaggattcatcatcctgacattggc

SEQ ID NO: 25007 - DNA, 201 bp, Bos taurus
catttcctagacagggcttcccacagctgtcagatggtaaaggacacgtccagtgattaattggtctctctgcacacacaccttatctgctgaggccaggtctgagcctgatgccttcctcgggagcccgttgcatccccagagccgacattccctgagccagaggtctttcctccctctcccttcaggggagctctgctt

SEQ ID NO: 25008 - DNA, 201 bp, Bos taurus
ttggccttgtgcatcacacccagctgcttcacgaagatgtgattactgagtaacagtggatgccgcctacgcaagtgtaactctcccgtgctgaagggtgctcttcatcactgctgccgacggccctctgctgggaaagaggtggtcagcccgggctccagggctccagggattgggagtggtgatcctcagggttccagg

SEQ ID NO: 25009 - DNA, 201 bp, Bos taurus
ccagtagcattttacttggctgagcactccttgccccttggcgtggtttttcccttgtcctcagggatgccactcttctcgtatttctttttactgctcaagtcgctctttcaagctgcttttcagcctctcctgctctgaattataaatgtctggcttctctggggtttggttctggactctctcgtcactctgcactct

SEQ ID NO: 25010 - DNA, 201 bp, Bos taurus
taaaatatcatgtccagaattttttcttctgttgccacattttgtgtaatttctcaacatagatgcacacatcaaaagagaaaaaggcctgtacaattcaactcttcaactcttcgatactgccttcagtccttcctgggggctcgctgttttgtacactgagagagaggcattcaaacactttaggcctggcttctctga

SEQ ID NO: 25011 - DNA, 201 bp, Bos taurus
aggggaagaggtatcttccctgacgtggggcctgtgaaagaccagtcttatttacatttttcttctccttcctatggaatgctgtctcatctggagagaggaggccctcctgtagggacagcaggtgtcaaatctttagcttgacactcatacatctcacttgctgcctctgagcaaacctctccacctctcaggacctcg

SEQ ID NO: 25012 - DNA, 201 bp, Bos taurus
tgtcacttggataagaaaacacacagcccaatgattgcaattccagtctcttatccagttgaagcctttttcctttcttccagctatgcttggaggcctgctgtttgggagggggactgctcagggtaccgtgctttgttggacccccttctctactcagagctgctgttggggcccctctggggctgggcgtggagggga

SEQ ID NO: 25013 - DNA, 201 bp, Bos taurus
attaatctctcagttctcagctgtgcctggtgtttctgtgtttagttatctggtacaattgctttactttcagctggaattctccacatccacaccttcttagttccacgttcctctaattcctgatgtttctgcagcttcagcacaaaaggctgcttttctccggcttcccagtctcaggcttgggatcacattctccct

SEQ ID NO: 25014 - DNA, 201 bp, Bos taurus
acagctttgcattctaccaaggatgaagtggttcatctcacatatttgcatgtatttgaatctttgctgtcagctctaactcataacatcaagttgggcctgttcctcagtctttcccttgcccatcttccatgagatgaacaccgacttttgcatatcttttcacccccagggtggcatctgccagaccacacattccac

SEQ ID NO: 25015 - DNA, 201 bp, Bos taurus
aaaaatttatttagtggattcaattcagatcagcaatatttatactaaacttccagtgcaagtataaaacagggccacttttagaagtgttattcaaagacagaatgtcatcatgatacatcagtagagataaactttgaatgtttagtttttcaaatataaaatgaccttttagagttttaatattaaaacttgtagcag

SEQ ID NO: 25016 - DNA, 201 bp, Bos taurus
ctgggacttgtgcttgccctgaaaaactaatgtccttcccttctggacatcccagaatcagtcctacatacttctgtcaaaacactcttcttattagccattatctctcttgatgataaagtattctaaacacttgaatttctggcttaaacggctatttacagcttcatttttctctatgttagcctttatccttaaaga

SEQ ID NO: 25017 - DNA, 201 bp, Bos taurus
aaaaatattctcttttgttcagcttatagttttttgttattaaaaatatagaattgttttcctaatgtccaataccatgcataaaatttaaacatatcacaatatcctagaaaataataatttctcatattttttgaggacagcttaactgtacatgtgtatttagcacactgacaagatcgatttttatttcttttttta

SEQ ID NO: 25018 - DNA, 201 bp, Bos taurus
aatatccttttgatctattgggtttcggatttagccagaaaaatgcaaaaccaattagacttcactatttggattcttcaaatgataggttgcctattttttcctaacactgaagattttaaatgttgtcaagcaatagtgagtaacatttgtattttaataacatattgtgttttaaaagccacaaagtgattttattta

SEQ ID NO: 25019 - DNA, 201 bp, Bos taurus
tttaatccacacagtcaaagactttggcatagtcaataacattcctacacataggttattgatttggggggatgagagcaatggtattcctttgctgtctgaacagtaggcatcttttttgttaatataactgatacttcccagggttctaattaattacatacaatgagaaaaattacataggttttaagaagtagaatg

SEQ ID NO: 25020 - DNA, 201 bp, Bos taurus
agaagaaataactgaagaactgaagaggttcacgaggcaggaaatggaaagaggattttctttatctgaggggcacacttggttgttaaggtacaagaccagagcatagaacggtacatgaaggttgtaagaactgttcagaaagcaatctgcactattatttcatctatgaagagggaaattaaaaacaaaaaaaagtac

SEQ ID NO: 25021 - DNA, 201 bp, Bos taurus
cttattttgatttgcattttggtgctgtcattattgtgtcctgtggtcagtgtactgcagttctcagagccaatatttaacttatatcaaaatattaatacgctttcactaaaacatgcattgcagactggaacagagatcaacctaacagccatgaaagtatcaaaaattttgctctgcacctcccttcagattacaatg

SEQ ID NO: 25022 - DNA, 201 bp, Bos taurus
ctctgtgcttagaagaatcatttattcaaatattttgcctgaccaaataagcactggacttggaaccacataatctatgcttaaagttgtctcctgcttttattagctgtgtgtgaacttgggttgttctctatgcatagcagagtggaaattaagtagggaggttattattatcacttcactaattagaaaaatatcggt

SEQ ID NO: 25023 - DNA, 201 bp, Bos taurus
aatgtgtacccacagggcacagagtgtcttgttttctttttaactttggaccattagcatctgcgatttctagtacaatttattctctgcttccacaaatcctcaaatcactcttgtctatatgacacactgagggtcttgaggaccttcagatgttactcttaggttctaaacaagctgcagcatgagggttttgagttg

SEQ ID NO: 25024 - DNA, 201 bp, Bos taurus
catatgagaaacatcccatttgacaaatgatggagcttagattcataattttggttaagttttatattaatagttcttttttactttaatgttcacagaaatgaccctagatgttcttgaaaatagtgcatgctttcttccttgtcccttaatgtgtacaatgcctaggaaatacattgtgattgaaagtaaaaatgctag

SEQ ID NO: 25025 - DNA, 201 bp, Bos taurus
tatcagaggaaagaaccgtggcctgctctgaaatgcacttgtgtgttaaggcatgaagtgtgtctggagcagagtgagcagggaaagagcagaatgatttcaggaaaaagagaaagattggagacactttgtgtaaaagattgagcatgctgccaaaggcattatattatgaaacttggataagagaaagacaaagcccca

SEQ ID NO: 25026 - DNA, 201 bp, Bos taurus
agaggattccagtccccactgagcttgcagttattggcagcatctctcttttttctcttcctccttgttctcttttggtggacatatatatggtccacttaaatacttctaaatccccccaaatatgtccataatgaatatagtacactgtgttgatttttttaactgtaactgagtatgctgagcaggatttttttttat

SEQ ID NO: 25027 - DNA, 201 bp, Bos taurus
ttacttatttatatcaacatggacttgtgaatatttattttatactttgggttctaatctgattttttatatttattttgtggctcaaatttttccagctttggccattaggagttctttcagaaccagtgttcataccgaatgggactcttgggcttgagatctctgtagtctcacttgagtccacattcaagtggcctc

SEQ ID NO: 25028 - DNA, 201 bp, Bos taurus
tgtttaggaaagtaggaagctacaaataaaacagagaaattgtaaacttgtttacaaaacagaagtaggctcacagacatagaaaacaaggttacaaaaaggcaaagcatgggagagataaattaggactttgggattaatgtatgcacactactatatattagatagataaccaccaaggagctactgtatagcacaggg

SEQ ID NO: 25029 - DNA, 201 bp, Bos taurus
aatgagttacaaattacatcctcataaaaacttgtacacagatattttggtagttttattcacaactgccaaaattttgaagaaacccaaatgtatttcaatagatgaatagacataaagactgtggcatattcatatatgaatattattcagcaataaaaataagtgagctatcaaaatataaaatgatgtggaggaact

SEQ ID NO: 25030 - DNA, 201 bp, Bos taurus
tttcaaatgaacccagattgcttcatctgcccatacatagaaatgttatgaaattattaacctgagatgtctgcacattgtcatcaacagtaaacttctgatttttgactacatggttttccagcaaataaataaataagctcatacatatcctagtatcacctttatctcttcagagcagattctcagaactacctgaga

SEQ ID NO: 25031 - DNA, 201 bp, Bos taurus
atagggtggggggggcccacaggctgagagcaatagtgtaagggaatgcaggagggatgttctgccacatgtcttgcagcctcagcttttatagtaaatcaggttagtttccaggttatctctggccagtcatcttgtttggccatgtttggtctgactcagggtccttcctggtgtcacgtgcctctctcagccaaaatg

SEQ ID NO: 25032 - DNA, 201 bp, Bos taurus
gaaactactacagtgtgcaaacattttcttataggttacacaattaagacctggaaatcatgccttactcttttaatcctactgatattctcagttcacacctccttaactcatcttttatgaactgctagatcccctaagttctttctattaactataaagaccatttatactctcaaggctttttaaacagcttcagta

SEQ ID NO: 25033 - DNA, 201 bp, Bos taurus
tacatctaaaataaataatcattaaggatatattatacagcacaaggaaatataggcattattcggtaataacttcaaatggactgtataaaaatatcgaatcgttatgttgtgcacctgaaactagtataacagtaaaatgtgtacttcaaaaaatttttaaatactcaaaataagaaaataagtagcaaatatttctgt

SEQ ID NO: 25034 - DNA, 201 bp, Bos taurus
caaggctggcggacacagtgagaagtggtcaaagggatcatgtcatgtaacagactacaatatgccaatgacatctaatacacagctttctggttaaattccataaactttgaatgatatccttagcacttcagggttcgaccctgcctaccacagtttttgctaatttctgaaatattatctttccatgaagaagcattg

SEQ ID NO: 25035 - DNA, 201 bp, Bos taurus
gtcaggagccattggcctttgtgaagctaatccactgcccaggatccgcggcagcccaggagctgctgtccaacacagagtcgatccactgcccaggagctggaggtacccaggccttgccactgctgctggtctctccagggccaatcttctgtcaccaccagccccgcactgggaactggggtcactggtcactaccct

SEQ ID NO: 25036 - DNA, 201 bp, Bos taurus
aattataaccttaccacacagagtattcttggttgaaagtttttcctttcattgctttgaataaacataccacattctactggcctgtaagttcagttcagtttaatcgctcagtcgtgtccaactccttgagaccccatgaattacagcatgccaggcctcccagtctatcaccaactcccagagttcacccaaactcac

SEQ ID NO: 25037 - DNA, 201 bp, Bos taurus
aggttctaataacacagagatgttctaattctacaacttcagacttcaaagtccttgattgtggaaaacgaagagacaagcagaagacgtgaagaagtccatgggtcgtgacgagaagctgttggtgcagccgccatcttgaagcaccaggagcttcttaagcttaattgttctgcctcagctctggcaggactcaacttt

SEQ ID NO: 25038 - DNA, 201 bp, Bos taurus
aactggggctcaggaaaccagtgtaaacatgctgacaatctagctactgcttccagtaataaagtccttcttctctgatccaggaatcttgtgtcttttgtcatcatctatgaaactgatgcaaattagcttggcagcttgtaagtacagtaaaatctcagacccttcacagttcttgaccaggagttggcaaatttttct

SEQ ID NO: 25039 - DNA, 201 bp, Bos taurus
tgaggactaatcaggcctcaccctgcatttgggcagacgagaagacagtgactctttcatagcagctgtgcagagaaaatcccagggcctcactggtcagaacagtacaccctttccccgcttccctttctctcgctgtgaggctttgctgtgcttcctgctttggcctctgaaagcaaacagcgtgccaagggtcccctc

SEQ ID NO: 25040 - DNA, 201 bp, Bos taurus
ttaataatacccttatagaaagaaaataagacatattatcatttgaatgtcttcgtttccatttgtactgtggcaggtatgtgcatttctcatttttctcacaacttttggctaagcagagataagcattactccttccaactagcagataaactagaacaagatggagttaaataacttactcaaatataagagtcagac

SEQ ID NO: 25041 - DNA, 201 bp, Bos taurus
tttagatatttgtttttaattcaaacaacaaatcctttatacttgagcaaggggatcaatttatctgccttttaaaagaccttcttgtcttttaattcttcatctctctgggttgtgcaggttttctttctgagaactgagcctattattttttccagtggttcctactgcgctgatgaagagttacagacagagtattca

SEQ ID NO: 25042 - DNA, 201 bp, Bos taurus
ttgttccttcagtttggcccgagtttccctgtttcttcatatagcttattattattattatttgtcatgatagaaaacaacccagacactttcaccagtcgttatatagcctggcctcatacaggggaaggccttcaccaatcagtttgggtagagactctggggacctctcaagccttagcagcagcagcatctctggaa

SEQ ID NO: 25043 - DNA, 201 bp, Bos taurus
gtgttcaagatgtgagggtgagggaaaaggcccagcacttgatgtgaggcatgtctgggtcagagtcacactgtgagatcatgtagaatgggagcgatcactgtggccatctttggaaaatacagtctgtctcaaggatacagtagagaaattaaaacttccatagttgtggaaagaattcagataatgaagtcctgaatg

SEQ ID NO: 25044 - DNA, 201 bp, Bos taurus
taaactgttttaaaaaagaggactttatatgacagcattgatatctggtagggtaaaggtattgccttggctcttgttttcggcccatccacttaaaaagtagcattagaattaggttgtcagtttacacttgcacactcacacattcacacactggaaataaatcgaataaatggaataattgggagagacttgaaattt

SEQ ID NO: 25045 - DNA, 201 bp, Bos taurus
aatcagcatctttcttgaaacagaggcattgcagcaagagcagcagcagcagcagcagcagcagagatatttacagatcttagtgagccatctgctcttaagagtgtggatctcagcacattccataactactcctctattttcctcttttctctttcccccctcctccctcttttttaacttctctttcgtaagtgaaga

SEQ ID NO: 25046 - DNA, 201 bp, Bos taurus
gttaaaaaatttgttaaatatgttaaatgttaaatccttcaaaaggatcagttcttcggtgctcagccttctgagttaaaaaattaaaattataaaaaagcgaagagaaaaataaatggaagaaggaataaagaaaggaaaactccacagaactgcaaaagcccaacatagaagcagaggtttctaacaacaataaaaatt

SEQ ID NO: 25047 - DNA, 201 bp, Bos taurus
taaatgggagttgctaattttcactccagaatattatgaaaaactggaaaccaaatataataaacatggctcgctcttaaaattaaaaaaaaaaggaactgtttctggaagaaataatgcttcccaatagatttagcacaaaaatgggaaatgaacagcattatatgtttcttaaaaatgcctttcattgagttcaaattt

SEQ ID NO: 25048 - DNA, 201 bp, Bos taurus
agaaatctttttcaaacaaacagaaaatgagataaaacaatttataaccagcagatctgacatataagaaatgttaaaggaaattatttatgtggaataaggtaatattaatcaaaaatttgaatcactattatgaaaggaagagcatcaaaaaataaatgaaagttgaaatacattttgtttttaaaaactgatgtctaa

SEQ ID NO: 25049 - DNA, 201 bp, Bos taurus
aatgatcctgtattcctaaaagcttgcctcttaaacagttcacagaaaagattcacatctttgcagaaaataagatcttcaggtgagctgtctagaaggggaagaaaacagaaccccaaccatgagaacacaaaattgagtctagaataagaagctagaagagtaaaatatgctatatgaatctcatggaatccaagccag

SEQ ID NO: 25050 - DNA, 201 bp, Bos taurus
tggactgcagcctaccaggctcctctgcccatgggattttccaggcaggagtactggagtggggtgccattgccttctccgtggctacagtaaggtgatatataaatcctttctaaaccttagaaatctctacatacaagattatgtcatcattgaattaagactgttttacttcatccattcacatctgtaagtctttaa

SEQ ID NO: 25051 - DNA, 201 bp, Bos taurus
tgaaaagagcttcacttcttagcagactgagcttaaaatagtttcttttgaaattgtttcattaaataacaggtccttttacccaatctaatactttcaccttagaatattgtttactcagatttcaaacaccttaaattatttcttcagcaactaacttattttggctaataaatagtagttttgcataatgcctatgga

SEQ ID NO: 25052 - DNA, 201 bp, Bos taurus
tacctgaataaacaactgactgcaaagtgcttttgtagtatatttaaaatcaaaagctgaaaaattctaccaactctctaaaggttcaatgtgttgcttttatattttaaagattcacactagggataccaagatctacaatttctttgattagataaaaaaccttggattttaagtgtcatgtaattggcatgtaatttc

SEQ ID NO: 25053 - DNA, 201 bp, Bos taurus
tgaagtgatgggaccagatgccatgatcataattgtgtccaaactaaatagtggaaaatttgataaacaagctttatcggtaacaagctttttgatcaaattcttaaaacttaagctatctcatttgtcgttcagtttctttatttaattaaaggtactaggtctaaaattattattctaaattaactaccatatataata

SEQ ID NO: 25054 - DNA, 201 bp, Bos taurus
ctttctctaggtggcagctctgctttgttactactatccctctcatgaattcccatgacagtaaaatgctttttctcactgaagtgaattccaaagcctgtgatcatgtggtttctttgagttaagtcaacttttgttgctattcaaaaatttttgagataagtaaaaatgctatattcatttcattaaagaacattagct

SEQ ID NO: 25055 - DNA, 201 bp, Bos taurus
gattttcctttcctcctcttttttaaaaattttttgatgactcatcaggatatagaaatacattggaaggaaccaggtccatgtattgccctctaatcatatatgtcccctttttgtaaatatgcctccttctttctttatggaggttatttaagatctccagtttgaacagatctagaaaataaataattttaaacaatg

SEQ ID NO: 25056 - DNA, 201 bp, Bos taurus
taatctaggtggtcataagaaaatctaaaatcttacatttgtattaaaaatgaatgaataaaggaagcaataaacagtttctgctatatccatggtagaccgtcaatcaaaaaacaaaactgcctacagaagaatatataatgatcacatgcagaatatataatagtcacataaaatataccaatatatgctattatattt

SEQ ID NO: 25057 - DNA, 201 bp, Bos taurus
cttttgatgaaatgcaacattataaaatatagccaccttatggtgactggcctttttcatttcttttttcttgttcacttctctgttataaatctgcaaagaaatggataggagcagcttttactctagatagttttgaattagctacataattcttatgcagaaacattacttaaagaacaattcttttccctccctaaa

SEQ ID NO: 25058 - DNA, 201 bp, Bos taurus
aataagggaaactgtatgaagagggagggattaaatgagaactctgtatgttctgttcaatttttatcctaaactaaagcttttctaagaaataaagtctgaattttaaaaatctttaagagaaaaaacagaatgaacctctgaattaatgccctcacaacaagaaaaacttccacatactgaaaagagaatactgagtag

SEQ ID NO: 25059 - DNA, 201 bp, Bos taurus
ctttgccttgtgaagactaaaacattaagcaccctgggcagttttcttaggaatatcactgagatattgggctggagatgtgtacatgcatcaggagagcacatagacgaagttcatgtgtaaaggacagagggattaaggttccaaaataacaggaaaaaagttaaattgatctgagaaatcttttgagagaggagaatg

SEQ ID NO: 25060 - DNA, 201 bp, Bos taurus
tcccaggtgttccttaatccccaaattattatcattttttgcatccatttttataaaattatatcagccatttcatgatactactggaactttattcacttttatttgcttgacttttgcttacaagtgtactgtgtatcatgagaaacactggactggaagaaacacaagctggaatcaagattgttgggagaaatatca

SEQ ID NO: 25061 - DNA, 201 bp, Bos taurus
gaggagagagagttgtttgcttaaggatttcagtattgggactgtgacaactggttgcatggcagaatgtaggctctattttgaagaaacgtactggatatgcaaagtttagaaaaagtaagctgtccatgcttctccactaactgtaagataaaatccctctgcttttattattttttaaaaaaattttatccaagtgta

SEQ ID NO: 25062 - DNA, 201 bp, Bos taurus
agaagcaatgggccaggccagtggtttaggagtggctagctaggtttgaaagtgggaccctgtaaagttcatgttcatcattactgttaaagcctatgttggggggccatctaaaggctccagatattttgacgtgagccaagatctacatggctatggttgaggcaggagacagatggacccccagggcaaacagtagga

SEQ ID NO: 25063 - DNA, 201 bp, Bos taurus
aaaggagattcctgaaagaattcaggaggctaggatggtgaagaggggatttgttaggagggcagagatgaagcgtgaagctagaaagtaggcaaaaggagactggcagtaacactttttccccaagagtgatggactgggtcaagattcagggaggttttgctggcagtgggtcagcaaaattaaggaaaggaataaaag

SEQ ID NO: 25064 - DNA, 201 bp, Bos taurus
ttgtatgttgaatcctaatgcccaacgtgatcggcatgtggcctttggggtgattagattatgagagtgacacacatcccctgtggtgggattaataccttcacaaaagaggcctgagcgctcccttgtcccttcttccatgtgaagttgctgcaaacgacaccatttgggatgaggacctcactggacaccagatctact

SEQ ID NO: 25065 - DNA, 201 bp, Bos taurus
cttgcctcaaaatcttcctcatggcttccccatcactgaaaaaggaagtgtaaagtcttctgcattccaagaagaaactccaagcataaaggcctggagacagcagcatatttgctctgttcaagaaacaggaaggagacccaagtggcgaggcaaaatcagacataggacagggtaggccgatggggaagggagatggga

SEQ ID NO: 25066 - DNA, 201 bp, Bos taurus
agatacatccctttggaagttgtagttgcaaaagtcatttcaagaacagggtatagttttgtgatagcttgaaggcaagagagcacatggcctattctggaaactataggaatagaatggctctgtcataggattgaagtggtaaaagaagacatgggagatgaagtctgaggccgggtggatgaactatgacatcctaag

SEQ ID NO: 25067 - DNA, 201 bp, Bos taurus
gattctttccctctcctatgaattccatcaattattctgttgccttcccatacttcccatctctcagaatccctttttcctttttggaccgtggccattcgcttttggaatgctgaaaaggagccaagagaaagctgttctccaacttcacagtagcttaacaaagacatagatatggccatcattgcaggttgacaaatc

SEQ ID NO: 25068 - DNA, 201 bp, Bos taurus
aaaacatttccatgctatagcttatgactcttgggctaactcactgaatggccacactggcagctttgagcctgtttttgagtataaaaggcaaaaagacgataacttgccctctgtgtggtatctcattttgacttcgcagtcaatttgggggcctattaaataatattgtcaaaaaagcagtgtgaaaaggactgacac

SEQ ID NO: 25069 - DNA, 201 bp, Bos taurus
cccagtgggatgaccacagccatctccagataccaccaaaaggccccttaagagacaaacttctgaggctgagaagcactgggccctaggtcgtggcagcgtcttgcaggtcacacaaggaagtgtaggagatcactgtgacctgacttgcattttgaagaaattactatctgctggatccatgcagagagaccaactggg

SEQ ID NO: 25070 - DNA, 201 bp, Bos taurus
ccagagcaaagataggtttatttgaggagcatgatggcggctccctaactgggagactcgccatctgtaggagcctttcctctccctgaagggtatgcggccatgcgtgtatgctaaattgcctcagtagtgtccgattctgtgcgatcttatggactgtagcccaccaggctcctctgtccatgggattctccaggcaag

SEQ ID NO: 25071 - DNA, 201 bp, Bos taurus
atatagggataacactatttttcactgcttggaaaccctacccaagaatataagcattgtgaaaaaagacatttgatatgatgatagcaagcatttgctacagtaatatagacactattttcatcaaagtagtccgtaagctgttcgtcagaaggagaacacagattatgtactcttaatacagaccacatgcaagtagaa

SEQ ID NO: 25072 - DNA, 201 bp, Bos taurus
gtttttgaccagagccatggttcatccaacccagtaaattagcatgacggccttatgatgaatctggtggttgcccactatgttgccacttttcaacttcatgttctttacataagttagaggcctcaagacccctggtgctctgtacaactgtttagggtgtgccctgcataagagagcctgtccggcaggcttagatct

SEQ ID NO: 25073 - DNA, 201 bp, Bos taurus
tgaaggccatgactcaccaaggatggtaggagctaccagatgctggaagaatcaagaaagaatgactccctagagtcttaggaatgagggtgaccctaccgacacttcagtgtcagacctcaggccttcagaactgtgagggaatatacttaagtcttcttatgcaattcagtttatgataatttcttagaatagccctag

SEQ ID NO: 25074 - DNA, 201 bp, Bos taurus
gattctcaaatgctatgttactgccatatagcgtcatataacataattgctttgtgcaagtgaaatctcacaaggtctacaacctctggatacgttcatcgttccattgaaaaccttccatctggtttatgttatttctttttacggttgaggaaatggaggtacagatgggcatagagatgaatggtcaaaaattagatg

SEQ ID NO: 25075 - DNA, 201 bp, Bos taurus
tgaccaattaaaaaaagtcagatcttttggagcaggtccaaccatcagcatagtttcaaaaccattccatgtgattcctgagtgaagtcaagtttgagaaccagaactttgggccgtcagggtctaccagaatgaaagaggttggaagaaggctttgcatggcctcattggctccaggcccctggaagccagctgaggcca

SEQ ID NO: 25076 - DNA, 201 bp, Bos taurus
ttaaatcaaccctacttcaatagaaaaaattaaaatagagcgagacagccttggttagacaacaatgtgacagagtcagtaagtgcagaagaaatcagagtggcaagaacaactgtggactagggtagctggaaaaggcttcatgcaggtgatgggacaaaatttggaagtctcaaaacatcctttagctaattttacatc

SEQ ID NO: 25077 - DNA, 201 bp, Bos taurus
gagttttcctgtatcttaatatgtcattttaacatccagtgtaacattcagaagcacattttattgaattattgaatctcagggccattaagtccaaatccttatctgatacctgaacaccatttaaaatgccttttacttttaatttactttttagtgcacttttttagaaaggttatttaaggattccatgtgatacac

SEQ ID NO: 25078 - DNA, 201 bp, Bos taurus
tccctcttctgtgagagaaattaacttacacatctatgatttttctttagttgacttaaggagctaaaggcaaaatgtgtgcataatacacacatatatacacacaattttctgatgatgcacctcgtgtgaaatgcagagaatgtttaaagttgatgaaaaggaaaacaaggtatttaacaaaatacaaataaacttaat

SEQ ID NO: 25079 - DNA, 201 bp, Bos taurus
attgttaactcttggctttcagggcccatccattttccccaggctttcggaaagtgcaagacttcaaagcaacatttcagtgcaaacataggaagctttgattcacctgtggggcctgggtttttttgagtaaatatttcgcaaacccctctcccaacatccagccttctatgacctcagcaattctggtcgttccaggac

SEQ ID NO: 25080 - DNA, 201 bp, Bos taurus
gactggaagaagccatagaaagcgcgtgtgcaatgagagattcatttcttggaagcattcctggcaaaaatgcagctgagtatgaggtgatcattgtgatcgagcctgggctgctttttgagatcatggaggtgagtcacagtttgttccttttgaaatggggttcatatcaaagtgctccatgtaaaatctggtttcaga

SEQ ID NO: 25081 - DNA, 201 bp, Bos taurus
acctatttacttaccattctgaatatgggcattaagaatatgcttcaagtgttctattgacctaacaaaaaaacgtgcttccttgcatagaggaagcaaggagagagaaagaagaggtattattcaatagttgcttcaaatataaatggagacttcttacatacatttctacataaacccaagaatgttacaagaacatgg

SEQ ID NO: 25082 - DNA, 201 bp, Bos taurus
cctttcattatagctggccaccacaggggctggtaaatatcactctgaagagtggcacatgttttgtggtgcatcaaccactgtgatgactagagagccctggcccagagtaatttttcaaggccttcaactttagttaataagtccatcatgtgcagttttcattgtcactgtcactgtgctgtcacagacacgcacacg

SEQ ID NO: 25083 - DNA, 201 bp, Bos taurus
cggctcagaatgacccagagaacaggtgtgagactgaggtcaggagccttggataagtcaaaattctacaggagctttgtgacccaggttatgttaaattttgtgaatcccagtgttttcatttgctcatagcaggttttgagggtaaaattgatatgaacctattttgactattgtcacgttttatatggctttttttcc

SEQ ID NO: 25084 - DNA, 201 bp, Bos taurus
tcctccgtataaatacaccatacctttttacatgtttctgtacataaacagtttctgctgcctggaatactttctctgttccattccttcatgaaacctctcatgatgcctccttcccctcaggcagatgctggtattccttcttggcatctgtagcccttagcatctatctccaggagagcagtgtgcagcctgcactgt

SEQ ID NO: 25085 - DNA, 201 bp, Bos taurus
ttgcatccaagtttcttgccagtaagatggtataaatttgatcctttttcctgtgtaagttatttttcttacttttagaagcattttgaatgccttcttcacctttgatatctttaggcatgctgtgagacttttaaaactaaattatttcatttcatttttggttaattctgaaaagttgatcatgattttttaaatatt

SEQ ID NO: 25086 - DNA, 201 bp, Bos taurus
tatgtgtttctaattcctttccttatctgaagctcattcttcagtaaatgctttagggaaggcccataaggaataatactttctgagcttattcagattggtaataatttgtctgtgccccttgtactttccttttccttttcttctcttaatatcttaaacatgttactctattttcttctcccataaagtgttgctgtc

SEQ ID NO: 25087 - DNA, 201 bp, Bos taurus
gtgtctataaaaataagctttgtatctgttttcacagtgtttgcctccttgaaacattcttgctttcaaatgggagaatgagccagggccacttcacttctagcctctggcccctggtggtcaagtgtctaggattcctggttttcatccaggctactcagggaactaactcctgcccaagtcctgggcagggaactaaga

SEQ ID NO: 25088 - DNA, 201 bp, Bos taurus
gtgcacatgctcgccggcctggcgggaatcttttccagtgaagtgatttttcactttgtccgaggaggcaggagaaaaggctcgatcatctgtcagacactggagggggttgggggccctaaaacgcaaagggtttcagctttgtctgggcttccaggggcttggggtttgtgtatttttagagttatttattcttgactc

SEQ ID NO: 25089 - DNA, 201 bp, Bos taurus
ctcagaacgtacatagactctccccttgtggatggtggcaagaagacatttaatgcagccatagcccatactcagttggaggaccatgcatcatggttcggtgctttgcgccattgactcagaagaacatgatgcccagagagatgctgactgctcagaataggttcaagggcttgactggttgaccagctgcttgagaat

SEQ ID NO: 25090 - DNA, 201 bp, Bos taurus
tgatcaattttttttaaataagaagatgtagtaccaaatgtctcatctttcccttttttttttttttattataagtgctgtaagatttaatttctttatgcacatctgaagcagtgtgccagaaggtttacatttgctgaatctcagtactggatctgtgtgagttgctcagttgtgtctgactctgtgaccccatgaact

SEQ ID NO: 25091 - DNA, 201 bp, Bos taurus
cactccagtattcttgcctggagaatcccatggacagaggagcctggcaggctacagtctacagggttgcaaagagtcagacacgactgaagcgacttagcacacacgcaggtagactactttattttgctacaaattactaaactactgcaggtgcaaggggaagaggatgtggttttggatgtgactcttaatgacatt

SEQ ID NO: 25092 - DNA, 201 bp, Bos taurus
aaattatttttattagaagttatattcctcagacttgatctttaaccacagaaatgacggaataacagtgtttagatttacctgtactcatttataatttctttttccttttgatcgtatgcctgttcttcatgcatattagctggaagatgaattggtttttagccaccccaaattcagggttcccccagctccctggtt

SEQ ID NO: 25093 - DNA, 201 bp, Bos taurus
tcccttctcaacctcgttctgtcctgcattgttgcggggcctttcaggcatacatgtgcccccacctccagcccagggtcttaccttgtttccatctcccacagatgactgctttttggccatcccttgtgagagatgggccagaggcagagtcctgtgatggtcccagaagcagctcaggaccatttggataggacatct

SEQ ID NO: 25094 - DNA, 201 bp, Bos taurus
tgtcagtccttctgagggggcaaggggaggcgctgggcacctccacagacccagaggaatggcctgaccccgtgaggcctcacttggggtagggagctgggtgagtatgtcacactgtgaaggaaactgcagtctgcttcaggtcaaagaaggggcaggaagcccatccagctgcagagaaggccttgagagtaaaggtaa

SEQ ID NO: 25095 - DNA, 201 bp, Bos taurus
gatcagctctattcagggcttcaaaaccaggccaagacagtacaatttaaaaaaaaaaaatttttttttttttgtttgttttgtttatatcagctcataggggaaggaggggaaggcatagggttcaggcctcaaagtgatccacatctttcctgccaacattccattggccagaatgaggtcacatggccaactagtcac

SEQ ID NO: 25096 - DNA, 201 bp, Bos taurus
tcatgtaagatcttggactcccacaaaattgtctctggacgtacccagagtcagtgtccctcccccatcaccatacttgtgggccatgctcttcctctgcttgctcccatcctccaaaaagcccacatgagagtccagcacgtccacatgcccaagtgagaccccagggtccctgtctccctacattaccactgctgccgg

SEQ ID NO: 25097 - DNA, 201 bp, Bos taurus
cccctctgtgaatactcagaggcacattgctggtctacagtacccacccattgcctcccagagcctggtgtcctcagggccagaacaagtactgcccagacccactggctgaaaggaacgccttggtgcatgggctctggggaactggctgaaccttggggtcagagaacaagacaacttgaacaaaaacacaggtaaggc

SEQ ID NO: 25098 - DNA, 201 bp, Bos taurus
ggttggctaggctagtaccaattagtacatcttggccagaagcagaattaaagcctacactgctaaccataagtaaagaaaccttggaggaagacctgagcgacaaccatggcagcagtaacagcagcagctacaatgctgtgggagggcctgaattttgtcacttttttttggctgtactgggtcttcattgctgtgcac

SEQ ID NO: 25099 - DNA, 201 bp, Bos taurus
ttggagagtcagccactcatttgagtttctgacgcctcacaggtgtgaggcacctggagccaaattccacaaggtgtgtgaggtaaggccccttgaggtgtggggcaaaagctccccagattttaaccccagagaagtgggctgggggcagatgtggcctggggctggctggcaggcatgcctggtctgacaaaagccgtc

SEQ ID NO: 25100 - DNA, 201 bp, Bos taurus
aaaccagaataacacaaatcttcaccatggccttgccagacctgacccctgttgcctctcccactactttccctccacattcacttcactccagccacgatggcctttttttctgtctctcgtacaaaccaagctggcttcatttcaggtccttgcacttgctgttccatctccctagaaggcctttcctccagatctttg

SEQ ID NO: 25101 - DNA, 201 bp, Bos taurus
gagcacggtttccacagctgtggcctctgggctggtctctgcagtggcacatttctcagatgaagggcagccagctgtcagaggccatggggctctccccgcagcacgtctccttttccctctgtcacttctcttatgttccagcatctttctcacaggagggggtattggcctgtcccacctccaaattcgaagctgcca

SEQ ID NO: 25102 - DNA, 201 bp, Bos taurus
aatgttctacccacaaggaaacagcttatggaagctctgggcttggtaaccaatggggatcttagaataagcctttcctttctggccccgccccctcacctgaagcaggagtcttgaggctaaaagaaaatgctcttgcctgatctttctctgcacggccacccccacaaagcctctaatcaggtgcctcagacaaacttt

SEQ ID NO: 25103 - DNA, 201 bp, Bos taurus
gagctgtccttctgggcacctattggtgcaatccaaacttctcgtgtctgtcagtcctgtggacagaatgacagagcaataccctattctgacaagttctctctgttgctgctcgttacagtatctgaggcagaaatttcaaatgtagtttgtattgctgcctgacttgggtgctagaaaacattttcagatatttctctg

SEQ ID NO: 25104 - DNA, 201 bp, Bos taurus
ctttgaatattgctttctgagaaagtttaaatgtattagtatttgattgagaccgttgtacatttttaaattttagttaactaaaaatcttgctagtggaggtgctcaatattttaattagcatgattattgaaaggaaaaaaggtaaaggacctcttctgaaacaagtaaaacatatatgtagcaactcgattgtaaagg

SEQ ID NO: 25105 - DNA, 201 bp, Bos taurus
cagggaacaggtgtgtgagtacctgtgtatgagcacgaaggagaaggctcaggctgaccgcgcagggacatgccatcccccaaagtttggccctagtctcgcctccatttcttctagtttaagagatagttccttgtgtcacttcccttaagacaaaacaaaagcattacttagatttaattgatattttggcttggccaa

SEQ ID NO: 25106 - DNA, 201 bp, Bos taurus
gccccagcttctttccaagctttctgaggtcccactgcccccaaagttgcagactgtaagaaggagaggttatggaatttctccccaccaggaaaagaaagttggtaaaacatgagagtttggctgctgagactttcactggcctggctggggggcggcagggtcctctggagctgttacatttagttcaaatttctgctg

SEQ ID NO: 25107 - DNA, 201 bp, Bos taurus
acacagctcctattataaccctactggacactgctgatgccagggagaaacattggagtgaagccctggatgtagacaggcccccccatgatgccccttatccgcagcccagaggcgtgcaggagagtgtgtgtctccctgagtcaaacctgtgcttccaggtgactcgggctgccccacaggacaccctggcctctttct

SEQ ID NO: 25108 - DNA, 201 bp, Bos taurus
gcgccctctagtggcgctgggagcctttcctaggcagctgagcggtcggaatgggtctgggcagccaggacaagcttcctcctgggcctaccttgtaaagagtatctttaggagccacctacctactgttgctgagaacccgtctgtgaaatgagtgggggaaaactggaaagaggacttgaaatccaatagctgcaattc

SEQ ID NO: 25109 - DNA, 201 bp, Bos taurus
gttacaaggagatagtagatgtgataagttaatatctgctgaattgaaaaaaaatgaaaaccactaaaagaaaaaagtcattttttatgatgtattctagatataactttttcctaatattacctaatcatgatataaagaactttctgcctcttgggtgaaaattaaaactgctctttctcattctctaataggaaatag

SEQ ID NO: 25110 - DNA, 201 bp, Bos taurus
atggacggtgggagctgagggaggcctggaatgagttctctcgattctcatggctgatgtttccatccagctggaaataatcacccacgggccacacctgccaccacggggactgattcccaaattaaactctgtgggaggggtgattgggtcaggtgcttctcccatcatctgcgatcaggtgagtgggacctatgtggg

SEQ ID NO: 25111 - DNA, 201 bp, Bos taurus
gattatcccatgggaggtaaagtagaaaaacatactccccacagaaatgaacatactcaatcattgtctagaattttctgaatgaattggggaacgtcaattagggggcacaggagactagaccacccaataaggagtgccacgtcatcaatgctgcccaaaccagaaagatggcttcatgaagtggatttatggattcta

SEQ ID NO: 25112 - DNA, 201 bp, Bos taurus
tctggaactctgctgggcacctcccttccctttgatgacttccactagctcttcatgcagagtccaagttggtccccagctccacatgtgcataatgacacctcagctctagtccctcatcactgaggggccagaggttattattattatttaattgattgatatttcaaaatcaacttcagtgaggtataacttaataat

SEQ ID NO: 25113 - DNA, 201 bp, Bos taurus
tctgccctgcctcagggaggcagagtcgctcagcgcccctcgctctcacttgcctcagcagtgtttctgggggtttctgagtcccagttttcacataagcacatgagcctgaaaggcctagtgacagctcattccttggtcatttaagccttgtctgctgcctccctggcccttcctctgccatcatctttaccaccttgc

SEQ ID NO: 25114 - DNA, 201 bp, Bos taurus
ccagtgactccccaacaaacagcaccctcttctctaccctggactttagaggcactgagaaataaatcagaacaggaaagaaaaacatccccctttttactgataggggccagcttggaggataagactctgggtcagggatcttgctaatactgaactcccgaaagaggcagattttgggagcctgcctggacctggtgg

SEQ ID NO: 25115 - DNA, 201 bp, Bos taurus
ggaggagactgtccctggcgagtctgcagccctgcgtgaatggtatagagttccaggggtgtgcatattcctggcaggtagaggattagactttttctctttattaactcccacgggggccattgaacagaagaccgactctggtagaaattgccggtgtcttgaagggccaaagaattgatgcttttgaactgtggtgtt

SEQ ID NO: 25116 - DNA, 201 bp, Bos taurus
ccaatgagcctttctcgtcctaggctgctgcctccagttgtgtgggtcaaaggtgataccacatgtggttggcagctctgtgctttgataataacatgttttgttggccagccacagagcacagtttaagacaaaggaatgtagacctccgctccttgatggaagaatgtcaaagaatttggggctaccttttgaaatcac

SEQ ID NO: 25117 - DNA, 201 bp, Bos taurus
gctaggtttctcagacatgacactctccagcaaataacaccagctccaataatatttttatttctcgcatgccatctctggccctgttccagggaaatttcattgcatggggaaggtggaattagaagcagcaagttgttaattgacatgaagcacacctgcatattggccccctcttcccacctcccaccttctacctaa

SEQ ID NO: 25118 - DNA, 201 bp, Bos taurus
tctccgtccagcagatcatgtcttacggcaccatcccccaggccgaggacaaggtgtgtggaatttgcttggtgtgacactgtctacacctgctcacaaatgatcccttaatatagctggcccatgagagcagagcctcatttcctggaacctggctttatggttcctgtctggtatccctccagtgtcctgcccaggcca

SEQ ID NO: 25119 - DNA, 201 bp, Bos taurus
tcctgtctacctgacagagaaatgccttctggctcagatctgtacatggcaattcagtaactaaagccctgggaggccagggaggctccacttcaacccatatccccagcgtccaatttttgtgagcgtcaggaatgatactgctcagtatggccttgggcatagctcacagagattgggttcatcaccccagccctaaat

SEQ ID NO: 25120 - DNA, 201 bp, Bos taurus
tacttcatcccctgttttctctgaaaaatccttaatattaccttgggttttactgattaattggctctcatttggggaggtgacatgcgacacattttcttagatattaattacatgggggaaagtctggtaaagttagtgtgtgtttctagttgtgtttggtttgctggcctagagaaggcaagggtgccaaggagaggt

SEQ ID NO: 25121 - DNA, 201 bp, Bos taurus
gtgtcaggattttgacgcccttggccctagccagctgttgggtttcactggtgagggttttgtatgaacatgggactgagggtcctttttggttatgttcgccgctgccttttctttggcccgtcctcctgctgcttcaaacgctggggatcttgtcaatggtcatgcctttccccagtgcctgcccctctgccaaacgga

SEQ ID NO: 25122 - DNA, 201 bp, Bos taurus
gagcctcaccgttgtcttgggaaggctgcaggcccagatgcttaccccctgtttcagatggggaagctgagtctcagcagtctgatgcgatcattgattgccaggcccggaatcctgtgtcctctccacacgctgtctctgcccgcgctccctctgctgaggcggggctgtgccctggctgcctcgctcggtgtcctggct

SEQ ID NO: 25123 - DNA, 201 bp, Bos taurus
attaaaaactctttacaatgcatgtttcagaatttcatctctcattgattctcatgtgtgatcaacttttcccagaatcagttaacccaagttgccaagtcgcagatttctgtggctgcttatgacagaatatgagaaaagatgcggggagaacaatgttaaaaagcaaaacatacatgaaggaacctactagggagtcag

SEQ ID NO: 25124 - DNA, 201 bp, Bos taurus
cagcaaaatcattacatctgagaagcaggctcagcaaatcgatgagatgcatcgaaaactgcaatgccggcagctagcactggtcaacagaaagggcccagttctccatgctaatgcccgattgcacaatcaatgcttcccaagttgaaggaattaggctacgaagttttgcctcatatgccatattcacctgccctcttg

SEQ ID NO: 25125 - DNA, 201 bp, Bos taurus
ttgactccagatcacactggcctatgaccaggcaggacttattcccagtccactaacagccagactactgtctgctacagcccactccccaggccctgcacccattcttcagttcttccaagcattaggactatagagcaaatatcattgtccttaactatatgcctcacttaatcctcatgagtaactttaagcaattct

SEQ ID NO: 25126 - DNA, 201 bp, Bos taurus
aattctatctcttttgtactaatgggagatcctgtctttagtaaattttaaattcctttatgtaactgaccccatttctggacttcttattcatgtgttacttgttgaggctttataacatgtttcaattatataatgggtctgtcatcactctacttttaaagagttcttctgatgattcttaattatattcctaaactt

SEQ ID NO: 25127 - DNA, 201 bp, Bos taurus
gctccagattaaaagattttaaagagacattaaaatgaaatgcagaattccctggtgatccagtgattaggactccaggctatcactaagggctcaggttcgatcccagttggggaaccaagatcctgctaactgctcagtgtggccaaaaataaaataaaataaaaactaaatgcaatgtgtaataaaggattgggactc

SEQ ID NO: 25128 - DNA, 201 bp, Bos taurus
tggtgaggtgggttgattagtcatgtggttggtagaacatgtagcaacagagctacgtatagtagccattagttgttcttttttttaattgccggcattcgtttcccctttattggagatagcaccccagcttttgtttgtggagttaagcctctctcctgtgtgcactctgtgtgggacagtgaatcaggggactctccc

SEQ ID NO: 25129 - DNA, 201 bp, Bos taurus
ccaggggctcttcctaacccgggcatcgaaccaggagttatgtctcctgcattggcaatagggccgttttcagctttcagatcctccttagcttaaatgctgtcttttctatatactttaatttctgtgtatcccacttctttcctgggatctcacagagtatatacctttactgcagcatttattttcttggtttattat

SEQ ID NO: 25130 - DNA, 201 bp, Bos taurus
taaagtatactttacagtagtctgtgtctgttagatttttgagatgggatttctgttttaataatgattttatatgctagtagatattggttccattttccttgtctatagttaaaagtattagaccagtttgaagatgactgaactgttttgttttttttttaagttgctattttataatttatgcactttgcttctgtg

SEQ ID NO: 25131 - DNA, 201 bp, Bos taurus
caaaagcaataaaatcacaaaaaccagctaagatttgaaatttggggtaagctagtacaatttcctgcttttaatgtatacatattttagatttgacaatcttttccacatatagtcagataggtttatagaagcatttcaacacaccaaattaaaaagctgttaattcatacattttatgacttcaattaattattcaaa

SEQ ID NO: 25132 - DNA, 201 bp, Bos taurus
ccagcggagaagcagcgcagatgcctgcgcccgccactagcaagtggggctgggcagggaggcgtgggctgcatggcttagagtaaggataggccggaatactctcacgggtaatcacagcgaactaatttgggctagcaaaccagactgtgggatagctaccacaggaaaagccctaagacactgccaggcccacacaca

SEQ ID NO: 25133 - DNA, 201 bp, Bos taurus
atagtgcaataaattttgatctaaatatcaatcaaattaaaacttggtacgctttggagcaactggtcatagccagaaagggtattgtattgtggcattcagagcattctttttctagtagcaaaagggtcatgaccttataagcatagagaacaaaatgtgtagggaaagagcaaatcagccaacgtggcatggtcagct

SEQ ID NO: 25134 - DNA, 201 bp, Bos taurus
cttggtgtcttatctccagtacctggagagctacagtcttctctgagtgggcccataaatgagtcagggagcagttttgcactttttctgttgaaaagagctggtgggcttctccacctcagggcctgatcacctgtgctctttccaggtcttgtccaggcctgctcaaaagtctggactggctcttggaaggagttgttc

SEQ ID NO: 25135 - DNA, 201 bp, Bos taurus
tataactttgcaagtgtgtgatgatgtagatcatgacaaatgcattgcaagtgggtggagaatgctggtcaggaacttttatccccagctactgccctctccctgtcttgctgggaaaaagaattaatgaaagagaagaaatgggcagtacagggaggtttgcaaccggttgctgcttctctatgtgcagtctggcagcag

SEQ ID NO: 25136 - DNA, 201 bp, Bos taurus
aaaaaagcaaagttgtctccctctaaaatatgaagatcattgccctatgagacaagggtgaatagagagaacacatatttaggacagaaatggaagtcttggaaggaaaaatcttttaatttaattaaaatcattactaatctcagatagactcatagcatcctttaattggtgcagtggatttatggcatttgcacatta

SEQ ID NO: 25137 - DNA, 201 bp, Bos taurus
atctgtttaaaccaccggaaaaacccaggccctgatttttaggactgaagatatatttaaatttgttgtaggtgttcatggacattgagatagtttcagtattatgtcagtttcttgaaaggtgtgttatttaactttgcaacatctctgtgagatggataaggggaaattttcattttttctgtagatttaacatgtaaa

SEQ ID NO: 25138 - DNA, 201 bp, Bos taurus
ggtactgtcatgcttgctataaaaatttcccttttcttcaatccctcaaactacatataagttgtaactgaactgttcctctataaaagaaacaggtaattggctgaaatttggctataaaacaagtattcccatccaaattcttcctatggctctctgaaattgtgatagcttgtaactctactggtcatacattaagca

SEQ ID NO: 25139 - DNA, 201 bp, Bos taurus
gccttgatcacaaacctggagtcagtcctgtgccacctgagaccctgccacgtgatgcttccagccctgggccaggcctttcagacgatgggcccctgacaagccactcaaccaggacaagaatttgggggcaaagaaaagaaagttcacaaatctcttcacattagttgagaggtgagcagaaaatagtgtttcagagac

SEQ ID NO: 25140 - DNA, 201 bp, Bos taurus
aggaagattgtagatctggaagcatgtttctgatgtgttttgaaagccaaaatcaggataaatatattaaggagaaattaaggaaggtataaacttgtatcttggtagtccaagctgaagtttttggtatttgacacacaaaacatttcagttttcataattcacatataacttaaaatgtctctttttaaaaaaaagtgg

SEQ ID NO: 25141 - DNA, 201 bp, Bos taurus
gctctcagcaaactgcttctgtaattgaggctggctgcctccaggtggcaccagagtgccgtcatcctgaagcggatccgccctgggatagaagcaagaacagtttctctcccccaccagttcatttccgcaactactgccaagatgaatcttcttaatgatgaggtttcttctctgctcaaagcccatcagaggcttcct

SEQ ID NO: 25142 - DNA, 201 bp, Bos taurus
catggtttaacaccctggaagaagcaaatcacatgtatttcttgttaaaaaaattaaatgcctttcttcctgtgtgtaatatgttttaacccactgtaagtccaatatttaaaggggactgtggtttagtggttaagaccatagactctgaagttaaagtaggttttaattcctcctttgccacttaactatctgtgtgac

SEQ ID NO: 25143 - DNA, 201 bp, Bos taurus
tatatggtatttcagaaaaataacaaattggtaatattttattaaatggagatattttaaattatttacataaccctatttgtcccattcaagcatcccacagcacaagaacaaaagaagctgatttattagacatacgccagggtgaaaatttttctcagaattcttggttgggctgtgataagaacacaaatttatcta

SEQ ID NO: 25144 - DNA, 201 bp, Bos taurus
caaagagttggacatgactgagcgactgaactgaactgatgttaacaataaacgccaaaatgtcttgtcatataaacagcaatttactgagtgtctgctacagaccaagtactcttctagaagccagggatatagaaataaaacacagttgctgcctgcaagtatacacaatatattataaagttagagaaggaaggcggc

SEQ ID NO: 25145 - DNA, 201 bp, Bos taurus
aatggtacatttgctaaatgtttaaaaaggttagttacatttacatgagctaccactgccctgttttcatctccagctgttactcctattggatgttaccatatcattaaacaagtttctgtcattattgaacttacctataaaattaacttaaaatactattttttgcctcttaagttactgataatgctcacatattaa

SEQ ID NO: 25146 - DNA, 201 bp, Bos taurus
tgtcatagaagggtgggatagtaggagatcaggagtcttggggatttagttgcctgatttcttgcctaaatgctagtgcaaatgatgcaaagcactccaagggcttctgttctgccactgtagagtatatttgttgccttttggctgtgaagcatccacacatttcctactagcaccgcaatgtcccttcattaggaattc

SEQ ID NO: 25147 - DNA, 201 bp, Bos taurus
gttaaggtttatggtgtagtcttcctctgcacggcttttgtgagatattttacttccaaactaggaagattgctcacgtctgatgctcaagagtgtggcacgttgagaagctgcagtaacatcctgccgcagctatggggcggcccctcggggtggccaggaaggggggctgggcactgatgaccgcaggccctgagctgg

SEQ ID NO: 25148 - DNA, 201 bp, Bos taurus
taccacctcttcctccctctataaatcttcctttgaagtttctctccctagtaagacttgatctctccttctgtcataatgtgttcctgtattatagccacgtgcatttataatcagtggagttgaaagggtcataaagatgtcataaaggactccaccattagttggccccggtggacttgagcaatttacataattcat

SEQ ID NO: 25149 - DNA, 201 bp, Bos taurus
ttggtctgccttaatttagtgaagcagcttgaaaatatttcatctcacatttcaaatattttgttccaaggatactgagtaataaaatgtactccccaacatcttgaataataaatccatttattcatgaggcagctaattttgtaaatttcatgtaatttaggtttttctgatctgatctaagattttccaagaaagagg

SEQ ID NO: 25150 - DNA, 201 bp, Bos taurus
gtcagaaaaaatatttcccaacttcaactggcagagagtgaaaagctgcttatcttctgttttctcaatggtgttcaccattaacaataggcccagtaacggaagaaccataggtatggtaagtgtttcatgacttctgaataccgaggaaggaaattgcttcatagagaggaaagcatttgtctttaatctcaaacggga

SEQ ID NO: 25151 - DNA, 201 bp, Bos taurus
acccagtgggctgccaggctgtgcttcactcatgcagaggctgcctgcccatggagtaaggtccctgagcagctggctgggtggtccaggatggctggtatttatggactggtgggtgggtaagtccctaacactaataggctggaaggagaactccaaagggatgtttcccagtgccagggtccttatggcagaacaagc

SEQ ID NO: 25152 - DNA, 201 bp, Bos taurus
ctgaacttaacgttttgcaggatgtgattaaaataatgtgattaaagtacacacctttaattcaagtctatttgcacaactctgtgaagagatggacacacgtcttctcttatatacagaagtgaggtggttttctaaaggtagatcactggctagagtttctgagttatgagagtcactccagagatttcttttagaaaa

SEQ ID NO: 25153 - DNA, 201 bp, Bos taurus
agttttacctgatttcagaggccatgtgcctggaattgagatagggcaggaaaaaaatcttcacttaggacaatatcttagacatagtcatggataagatgaagtccagctgagcagcaggccagatgggcaaacctctgacttgctatgagttatctatccacttggcacttggtttcagcacattgcttcttgctctaa

SEQ ID NO: 25154 - DNA, 201 bp, Bos taurus
tgaagctgtagattaatttgggtagtatggtattttagcagtatttgttcttccaatccaagaccgtggtatatctttccatctgtttatgttttcatttccttcatcagcatcttacagttttccatgttcaggtcttttacctacttagatttatccctatatgttttatattttgctgcaattgtaaatgggatagtt

SEQ ID NO: 25155 - DNA, 201 bp, Bos taurus
ttttgataattctattatttaaaggttcgaggtgaagtaatgaaattagtacatctggcttaacacagccacattacactgttcacatagtaacagttgtttagagatgcagttttactcctgagtttgttcatgcttgaatatccagatgaaaaataaactggagtcttacagtaaatttgttgttgaactttatttagc

SEQ ID NO: 25156 - DNA, 201 bp, Bos taurus
tcttgcatctgtattccagggcctgagcgctccatcactgaaaggatccaagcagatggggagtccttttttcaaagttaatactctttagaggacgaaactagaggaagtgattggtaaggcctcttccaaatctaagactcaatgacaaaattaaatggccaccaacatgtcttctatatctggaggccaaaagagaca

SEQ ID NO: 25157 - DNA, 201 bp, Bos taurus
tatgcagcctggatggaacttggacagacctgttgctggtcactttgcttatttctgttttatccagagtttgcagcaatcatgatctgaaaggatgaagttagatttggcgggttcttggggttctcaaggcaagaatactgaagtggtttgccattcccttctccagtggatcacatttttgtcagaactctccaccat

SEQ ID NO: 25158 - DNA, 201 bp, Bos taurus
atgtctgacttgtggtaggcagttcttggtggaatgatgatagtagtaagcatgttgattttttctcagacaggattagtgtttttccttgttcctttatgtttcagaaggctaggattgatgtgcatttgaggatgggagaagcagaaaatttgtattatgaaagaaaggttattgtaaggataaaattaaacatccttc

SEQ ID NO: 25159 - DNA, 201 bp, Bos taurus
tagacgtgctaatgaactggatagagggagagagaaaatgggaagaatcaaggttaatgcctgcatcagtgtatagcgatgacaaaaaaaaaagaaaagctgttcccatgagctttcattctagtgagaggagagagggatacgttccgttagtttcaggtatatagcacagagttacacacatgtaaagttataaattat

SEQ ID NO: 25160 - DNA, 201 bp, Bos taurus
tcacgaatgctcggcgtgggcctcatccccagcaggaggagcgtactgtatcacagcttctcattcttaaccacggtccctcttagaacgtccgttcagattctctttcccaggtggccagcaccaaagatttaaccttgggacgggggaatgctctgcctttcttccagtagatttccggctcttaaactgtattcatct

SEQ ID NO: 25161 - DNA, 201 bp, Bos taurus
gacacacaaaagggccagcctgggggctggagagcacttgctcagggagtcctcagcagagccccaggaattccatttcaatagagcaggaaggggaagtggtggcctataacctcagggaatatttccagatgacccacccatagtttctcctgctttgaggaagtggcttagcccagaacagcaccacccatgagagaa

SEQ ID NO: 25162 - DNA, 201 bp, Bos taurus
tcataatcttgaatgtttctgcctgatgactttggccaaatgtgtgagcacatacccaaggcttgcctgactatggccctataaccagcaggttggttccacttgagatttggacacactcagaagggcagtgaggggaatgatgcttctgttcttcagtgatggtgttttgcctactatgctaagcaacagactctaact

SEQ ID NO: 25163 - DNA, 201 bp, Bos taurus
accattggctatgataggtctcccacatggtaatataaagttactgagcataagaaactacgtcaagtacagggattaatagagctgaaaagattataaactgatactgaactaaagcggagataaatttaagatccttatgaaatcttaagatatcaaaaagtcaaataagtgaataattttggtggtatttaggaaaat

SEQ ID NO: 25164 - DNA, 201 bp, Bos taurus
tgtaccacattcaacaaaattgcaggaggtctgtatatctgctcttctgttggtcttccttgagctcttaataactgcctcatgtggctcttcaaaatgagaatcttgatgtcaatcactgtacttgaatattaattttatattattctgggctcacttcagctaaagccgattttaaatgtggttctagagttgtctaac

SEQ ID NO: 25165 - DNA, 201 bp, Bos taurus
aagcatagtttgagaagcctatcataaatagagatgcatggagacgctgagtttctagagagcttatgtatcataagtaagactttttcagttgatttaaagtcttcaggatggtctaagcctgaaaccaaaaagaaaaccaaaataaagctgataaatttgactaccaagaaatgtaaaatttcagtttattttacaaaa

SEQ ID NO: 25166 - DNA, 201 bp, Bos taurus
ataattaccacttctggtcaaaggtgagagggaaattagcatcacaatggcaagttttctctctgggtgttgccagctcacacagttccacgggtgattgcagtgtgttaagcctccgtttacaagcaggaaagctcagcagagcccatgaggacagcattaaaaattcctaatcatagacaagcatttcagacattcatt

SEQ ID NO: 25167 - DNA, 201 bp, Bos taurus
gctgaatggcctcaatatttcgaagaaactgacagtctagtgacttcctcccgctttggagcgaagggcgcttggagtttgaagcgtcggggaggtgagcctctaaaatccgaggccccggctgctaatattccccggggctccagatcccccaattttagaagtcagtgagtcactggctctatcgtacatttcgctgag

SEQ ID NO: 25168 - DNA, 201 bp, Bos taurus
ctaggtctctttaggagcaatactcagtcttttagtttcccttccttgtccctcagctctttctaaaattgtctctgggcttatgcagaaatagaacttatatgaccttgtggtgaagcaaagccaaagtttcccaaattcaaacacagtcttgggcctgtcctctgaatcctctggtctcctgatgttcctattgtagat

SEQ ID NO: 25169 - DNA, 201 bp, Bos taurus
ggaaatttcattggcaaattggagtagttggtatcttattcagtcaaaaggactatactgatttttatcaaactaaatttgatgggatgctatttacaacgtctatgtacttagtcctgtgtagtaaacagacttaagtatgtctttttcccatcatatttatcagttatgcaaaataagatgagaacaaggaacaatgag

SEQ ID NO: 25170 - DNA, 201 bp, Bos taurus
actattcatggaatatcttctctaacactgagtctgcaagaggtcaacacaaaagttttgtgataaatgctgactgtgtgatcacttgaatgatgaacacgtattttgtatcttgcccagagttttgccatgattttctaagtctctctccttattcagtccttaacgctggttcccactgctaagtcaggcctctcacac

SEQ ID NO: 25171 - DNA, 201 bp, Bos taurus
ctttggagtcagttgaagagtaagaattatagatgtattttttaaatgatagataaatttgataatatttgtaaagcgtgttataaattggaaaggattacagaaattattcttctgatgttaagactgaggaagaagtataatcatagcaaagaggagcaaagtaattctataattattagggtctgagtcttgtgtttg

SEQ ID NO: 25172 - DNA, 201 bp, Bos taurus
ggctatttttttcttccaatatctcagaaaaatgaacactgaagagtacagtattggctagagaagcttctactcttactcatactcttgccttccatctgcctgctaaaaaactggtaatatgatacacattcaggaccaaggacagtaattgggctacatttctccaagttattccttagtagaggaggggttgaagtg

SEQ ID NO: 25173 - DNA, 201 bp, Bos taurus
tatttcaaggcaaaatgaaggcacatatctttaggaacatgagattatgacaagcttgcctcaaaatttgattgcagcatcattaattctgccattctgtaagcatccagtcagggatttatacacctgtttccctttcctaaatacagtcttccaaaccaactgggggttttcttgggacctcccttctcatttctcttg

SEQ ID NO: 25174 - DNA, 201 bp, Bos taurus
aagggcttattcttaaaaaaccatttatactgagaagagcagaggaagctgactttacctgatgactcagaactagaaagcactgccatgcacactcatcgggacatctctgctatgaggatgcatagatgcatcattccctcagtctccggcttgggtagggtgtgctgggacaagctctccacctttgctgcactcatg

SEQ ID NO: 25175 - DNA, 201 bp, Bos taurus
gaggattagcaaaactgttcatttaagccaggagttgtacctcatgaaaatgaatttgttctgtcttgatccagtggtggtgttggaagggccaagactcaggagtccagacttgattattttcacacagaatagatccaaatgccacatagtcaagtaaagtacaaatatgagattaaaatgagcctgtgctctgctggc

SEQ ID NO: 25176 - DNA, 201 bp, Bos taurus
ctctcaagaaccctttacaattttaaaagttgttgaagaacctaaagtgcttttgtttatgtgagttgtatctgttgttataggaattaaaactgagggggaaaagtatgggatttatacacgtattcatttatatatagcaataaaaaatccatttggtgttaacataaacaatatttttgtgaaaagtaagcatatttt

SEQ ID NO: 25177 - DNA, 201 bp, Bos taurus
tgccttatacagatggtgaggatatctgtgcaagaaaaatgagctaaaaacttcatttaaatagctttgggatagtatctttttgaatttccagagaggaaaacccacaactgcatatgtaagagaacaggaaaggatgttttcattttttttataaatgtgcttagtatgactcaagggtaattgttatgcaaaagagag

SEQ ID NO: 25178 - DNA, 201 bp, Bos taurus
caagtgagtcaactctagagcctcagtttgcccagctggaaaatgggaataatagaaggatgggcttcagcttgggatcggcttaactgatgtctgacccgtggccagtgctccatacatggtagctactgttcttattattatgagggctattattatttgacccttcgggtactgaacgtctggacttcggccattctt

SEQ ID NO: 25179 - DNA, 201 bp, Bos taurus
ctagctcaaaggtcaggtcctgtttgtcacctggcttgctacgtacactccttacatcacccacttagaagtgtttgatcattagtccctctggccatttcaaagtctggcacgtgagctaccgcccccttcttccattgcctcctgcgtgtgtgtccacctgccaggccccaagccctgattctggagatggcagcatgt

SEQ ID NO: 25180 - DNA, 201 bp, Bos taurus
cttagaactgtaaaaaccatttttagctcgggggctacacaataacaagcagttgccaagggctagatgtggtccatggaccatagtttactgacctctgtttgagtatattctagccatttagtgttcctggggacatggaagatgcagccgttctagacaaaagcccaaaggggctcggagggactccagtagctcccc

SEQ ID NO: 25181 - DNA, 201 bp, Bos taurus
tcactgagccttcagatctgtggccacacgagtgacacttgggaggggcaggggatcatgaataggagtggatggtagccatagaagcccttctggaaccctccaggctggcctagactgctggacttcagctctgggacatgaatccaacatttcagaatttctcagaagtacctcaggactcttggtcctcatgagggt

SEQ ID NO: 25182 - DNA, 201 bp, Bos taurus
aagtccagtggttagttttctgtacttccactgcacggggcatgggttccaacctggtcagggagttaagctcctgcatgccacatggtatggcccccccaaaaaaaagagaaccaaccattaagaaataataaataaataacacaaaataaaattcatagggaaatgtaaaggccccagaataactaaaataactttgaa

SEQ ID NO: 25183 - DNA, 201 bp, Bos taurus
tttaaacttggagctcaagttcccttctgctctttcagtaggttcatgtcatcattcttttaaatacctaccctattcaccccatttctctcattattacctcctcctaccccagctcacataacttctgcttcagcccctcagttgtttctccacccctatctacagctgctgtggacaccattgtcaatccaatcagca

SEQ ID NO: 25184 - DNA, 201 bp, Bos taurus
ggctggcaccttccagtctgatctgaggccctaaaagagagcgcagcagcccacttttattcttttggatggtaagttggagccaggctcaggatggctcgggaggacaggaggccagggtggcccgtgtgtaacttccagcccagaggaacaagggtccccttgtggtagcctcaggaacccaactctatagccaatgga

SEQ ID NO: 25185 - DNA, 201 bp, Bos taurus
aatcagctgcacacagcttcaaaactgttttctcccacctggtggcctgacactctccagcccatgcaggcgtacatgtgcacgcgcgcacacacacacacacacacacacttcacctcttggcccaggaagccaaggcaatgagtttaaattctgccttccaacctggatcccagacaaatgacttggcttctttgagcg

SEQ ID NO: 25186 - DNA, 201 bp, Bos taurus
cagcccatatttagtgtatttttcacgtcacggaaacctggactgggaacagaatgccacattcataaaacaggtgatgacaaggggctttgtgacaaaacgctgctagacgcacaaaggctgtcccctctactgtcagtgggaggcgtgctgctccaaaaaggagacctgaggggagattcaagggcgagtcagaggcat

SEQ ID NO: 25187 - DNA, 201 bp, Bos taurus
aattgtgtagctaacagagtgtgacttgattataagccactggtggccattaatagatgaaaggtgtttggatttcaatagtgtttggatttcataacccaccttcacagaagtagttgagcttagtcaccacctccatttgcaacacctgtgatcatgagtcccacatggcaagcaagcaccccagctttgagcttttag

SEQ ID NO: 25188 - DNA, 201 bp, Bos taurus
gggagaaacaaggggctgagaggagaaaaaacactccaaaggatctgtaaggagagaggggaagactggggcatcacaggctgaccatccacgtgctgtgcgggcactcacatctgtcccgtggtctaaagcctgtgattctgaggcgtgtcacctggctgccatggcaaccagggcccccgtttcccgggagaggacaac

SEQ ID NO: 25189 - DNA, 201 bp, Bos taurus
cgtcagcgaaactagtcagttaactgatgtacatcacaatgtgtttgcctattaaaaattcagattatcaggcttctacctgggaatctgtgtttttacacgtccccaccccagaaattcagatgggtgactgaatatgagaagaatatagaagaatgcagtagtctacagatgaaagaataaaaagatatattttttaca

SEQ ID NO: 25190 - DNA, 201 bp, Bos taurus
ggtgtgtttctgtcatgcagtatggcctcctgaaaaaggctgtcatacataattcctagtctcaaaaggtgtggactttagcagaggagaggaaagtcccacggggcatagcgtttgatggagtgctgtttctaaggcagcttatgtctctctttacagatgacagatattgtttgatgagcagtttttctcctctgtgtt

SEQ ID NO: 25191 - DNA, 201 bp, Bos taurus
cccacccccttggccatgaaagcacagagtcctgaccactgggaattcaccctttacatgctctcccatggagcaaatctctccagactccctcaccccacccttttggtccccatttcggtaaaggacaccaggccaccctccctttagtccaagctctaggagtctttggaaacccttgacttcttttataagtctgag

SEQ ID NO: 25192 - DNA, 201 bp, Bos taurus
catggaatggcaaagagtcggacatgactgagcacgcacacacatttttccatgcacttatcagccatttgtacatttagagaattgtctattcaggtctattgcctgtgttttcagttggcttgtgtttttattattgagttgtaggcgtctcttctgtattttttttttttttggctgtgctgcgttgtctggtaggat

SEQ ID NO: 25193 - DNA, 201 bp, Bos taurus
taggtggggtcttagcagagggggtgtgactttctctgactcccctgtttcagcatatttcattagaacaacagctggaatggagaggagccaggcctttgggttgaccagcttctcagatctcaggcaggaactgctctgctctgtctttgtccagcctccagggaggctgcttcctcagaggacggacattggtgtgct

SEQ ID NO: 25194 - DNA, 201 bp, Bos taurus
ggagtttggcactgaggctgtcttcccttgacagtactagctttaagaggaaccgtggctggtgggaccgacgaatgagtctgaatgcagagaggcatcccgaggcccccagtgactgcttctagaagaagggtccaaggaggtgttctgtgccctggctgccctgtggcaggttttgctacagctggagaagtagcccaa

SEQ ID NO: 25195 - DNA, 201 bp, Bos taurus
ttgaaagaatgacatagctctaggcaacaacataaagtgatgagaaccaaatggttccaagactgcagccaagttgactttcactagaccttgggccacagtgtaagctcattttaatacatcagcatgctaaatgacatacaggtgccatgactgttccacaattgactgtaaaggtcagtaagtgagcggtggcccaac

SEQ ID NO: 25196 - DNA, 201 bp, Bos taurus
aagcggcatacttaacataaaagcctgtttaattgctagcaagtggtagaataatcttttgaaacaatatagcaaacacaattaattgaaataatctcaacgtgtttcatgtggtaataaccacttatgtaagagtaacaccataggaaagaaagacaggagagaggtggtggtgtatgtcttaagtggcaagctttacta

SEQ ID NO: 25197 - DNA, 201 bp, Bos taurus
gaggatgatactgcggctgaaagttattagctctccagtcacatgacagacagctgtagaacttttaaaaaaataaaaagaaagctaaaacctctgagcactctttaacatcagctgtcagctctgacactgggctgcagaccaatattacatggcagctaataaagcaatgagcttaaattgggtataggctattgattt

SEQ ID NO: 25198 - DNA, 201 bp, Bos taurus
gaaaggaagaaaaggagacaggccggtggtctggggactgggggctgggctgggcggcgagcacagaggaggagttggagttgtagtaaggtgttggtagaaagacaggaagaaacagtcgttcttctggtggaaacaggaggtgggaagtttacgctgtggcgggggagggggaggggtttgaggagatgggtgactggg

SEQ ID NO: 25199 - DNA, 201 bp, Bos taurus
agttctaaagggcacctgccagaaccttctgcccgccccacccctggtcctgcctggccacaggagagccttctcagagatgagcagagggccctcggggtgtccatctttcccccgattaaaacaatttttttttaactgaaaagagcttcgtattttcccaaactcacagatggggccatgggggagatgtgtgtacaa

SEQ ID NO: 25200 - DNA, 201 bp, Bos taurus
ggtgtgggcggtttcctccctccgctcctccccatctgtgatgagcatcaaagcctaagtagcaagggctcgtgtgactcctaaagaccctcagtgacccggtgtcacgggaggggcgagtggagcgaccacagctggggggccttaggggtgggtgggagctggcggagctctgggtctgcgtcagggaggagcccaccc

SEQ ID NO: 25201 - DNA, 201 bp, Bos taurus
ctgggactcagtgccccgccagacctggagccagctcagtgttaagcatgttcatgctgttcgctgagctgctactcagggcctcgtgtgctgcagatattgtctttgctccgcccacatgtgcacgtcccattcaaccaagaagaaaacagtcccagagaggctgtcactttgcaaaggtcaggaagagccctggagtgc

SEQ ID NO: 25202 - DNA, 201 bp, Bos taurus
agccccaaggactgtacctgaggccacacggtgctctcccctcccctcctgggggcgggattcgcaggtgactcctgtcttggagaaagtcaccagcagaccacagagcaagacacatgtatggggccgagtgaaggcaacacaagaccccgagctgtgcctttaatgacattgtttggtatgggagttgcatctcagtaa

SEQ ID NO: 25203 - DNA, 201 bp, Bos taurus
gaggaaacaagttctgggaggttcctcagctccccaaagcccctccgctgaccagtggacatccaaggcctcagactttgcctgtacagtcaggcctggaatctacagctccggaaagcaatgtctgtacctctctcagctgactgggtcttttaggagctgcccatccacaccaggggatcccagcactgaacatccaga

SEQ ID NO: 25204 - DNA, 201 bp, Bos taurus
gtcttaaccctttggggtccaggccagtgaccatgggagggcctgctccctgccgaggcaggcgtaagcactctgcccaccaccgagctgccagaagagcccactgactggcgactggccagaacagcacccagaatcttccaggatgtgctgcccacccaagcatctgtccatctttgaatgagcagtgggaatgagggg

SEQ ID NO: 25205 - DNA, 201 bp, Bos taurus
tgtttttcaaaagttatagataagcctttttcataaaagcaactttttaaaataaaatatacagtagcaaatacagtcccaggcctatactcctgcccatactggaattatgctcctcagaagctgtcatattcattgtctagtgcagaggttggatacctctggcccattgcttgttttcctaaataaggttttattgga

SEQ ID NO: 25206 - DNA, 201 bp, Bos taurus
cggctccaggcagcgctaccaccaccgatgtgccatgcaggcctgctggtttccaaaacacccagagcctgcaggcctggccgccccaggagggccagcctgggggcagcatgcgctccatgcttagcctgcactcctactgcctggggtcccagcccaccacttcctctttcttctccctgggtcccatgcctgccggcc

SEQ ID NO: 25207 - DNA, 201 bp, Bos taurus
gcagtgacttcacggcctggagctgacctttttatgtggtgggcagtgtgttgcctatgaggttttctcctggccgttgctgtgccccagggtggggtccgtggcacttagctgtgctcagaatgcatctgcgagtcctctgagccccctacatgtgtgctgcttgactcttcagatcatgctgtcaccagaggcaaggaa

SEQ ID NO: 25208 - DNA, 201 bp, Bos taurus
gcctgaacaggtcagggaactggggaggagggcctggctcctagagctcagtctgctggtgtatgactggggtacctcagggcacagctcttgttaggagttggggagacagaagcttgttggcccccatggtcagggaagactgtctggaggaggaggcagcgatgaccttgggccttaaagggcaggtgcttttggagc

SEQ ID NO: 25209 - DNA, 201 bp, Bos taurus
ctattcattctttgctgtccctacctggatcttgggaagtaagctggccaccagatgagctaaaaaggccacaaacctgcacgctgggcatcgaagtcccacatgtggtcacatagaagtggagacttgggcagaggtcagaatcaaattcctgtaagcagagtttcccaaacatcagcctctttaacgtacttcgggttc

SEQ ID NO: 25210 - DNA, 201 bp, Bos taurus
attttggccacattcagcagcgtgtggaatcttagttcccctgccagggattgaacccataccccctgcagtgaaaggcagagtcttcaccactgggccactggagaagtccctccaggactgtattttgtccctggtggagcttgaagccctaaattcctaaaggcctttcaggggactgtttaaaacagagagggcaag

SEQ ID NO: 25211 - DNA, 201 bp, Bos taurus
ggaacaccttgctccactgcgagacaccaggtccatgtgggtgggtagcaatggttgtctggaagccccaccttttcaaggcctcacatgctcctgctgcggtttacgaggaaggacacacaggctggagacaggagtctcctgccgtcactccacctccctctctggcctccctcatccttccttctggagccgccaccc

SEQ ID NO: 25212 - DNA, 201 bp, Bos taurus
tcctcctggcccagaaggaccccatcctgtgtacgcccttcctcttctaccacagagccacctaccaccccctgaacgacaggcagaaggcctcgggcgcgcgcaggaagagcccctacgcccctgacaacccgccgggaaccgccttcaccgacatgaaggtgttcgaggtccacttcccctgggaggcctacactctgg

SEQ ID NO: 25213 - DNA, 201 bp, Bos taurus
gactgcaaaacgtctcttttggctttctgctccagcatttagaatgtttctttctgtgcatccagttccctctcccagcataagccagctcagagccccctctctctctctgcagcctaccaatgtctcctctcctagaacctggagcatggccacaatgttgagacacccttccactgaaaccagcagaaatggtctcaa

SEQ ID NO: 25214 - DNA, 201 bp, Bos taurus
cccaaggtgacctttaaagtgctggcttctgtaatcaaagcatcacaccttggcagagggaatgactgacctgtgagattctgcctcaggttctgatagtcactgtggccttggttatggtcttgattatgtttgcagcctttaggtcaaacaacagccctgccatctatggagaatttattctgcatcatgcacttggct

SEQ ID NO: 25215 - DNA, 201 bp, Bos taurus
aacttatgcccttctggcccatctcttggctcaactctgttcaaagaatgcttacaaggattaatgagattacaaaaattgagtgttctgtaagaacagccatagttatcactgagagacaaactgaaggaggagaaactgaagtaatggagactggctaagaggtaatttaggaggactattacataatccaagaaaaaa

SEQ ID NO: 25216 - DNA, 201 bp, Bos taurus
ccagcctccaaagggatatgtttgaattttcacctttcatcttagtaagatttcttacaatgttatttagccaatcattatttttaggtattccccactgccatcctccaaagagccaaagagcatgttatttatattgttaaatgaatatttatttatagacttaaagtggatgaattactatagttgtttcaactttct

SEQ ID NO: 25217 - DNA, 201 bp, Bos taurus
acgatgttattcaacgtccagagcctaggagatagaggccttgcagctcctcttctcaccctgttggaacctagagatcaccatgtagtgaagaagcccggttcactctattggaagataggaggccatgtggaggagaaccaaagtgccctgaaatacaacatagtcaactgccaaatccgtgagtaaggtacatgttgg

SEQ ID NO: 25218 - DNA, 201 bp, Bos taurus
ctctgagtagtctaggtaagtgtataagttagtctgagttattcatctggattgttctttaaatagtgacacaaaatttacattattttaaatagctaatgtttaattttgatcttagcctccacagcatagcaaatataaaacatacatgtgtcgagacatgaagcagagaggaggatgccctcggggggccagctgtac

SEQ ID NO: 25219 - DNA, 201 bp, Bos taurus
ttgacctgatcgtctctcccaccctctctgttctctcgcttctgtcactacatgtacttcattcattcgctctcttcctgtcatagtagcctctttgtcctttctcaaaggtagtcatgaatcctgcctcaggacctatcagtcaggagtcctcccatggggcttttgtttggtctctttactttgcccaaacaagctttc

SEQ ID NO: 25220 - DNA, 201 bp, Bos taurus
ttgtaagagaaaatgggaaggaagctgggtgagccatgctagtctgactccgaaagaagagaggaagggaagagggtcagatggaagtgtcttggatgtggggcacttttaaggaaagtttggcaaagccactggggtggcctgtgagcgcccacttttcccagaagctggcctgcctttgggttcttgctgtgctcagtc

SEQ ID NO: 25221 - DNA, 201 bp, Bos taurus
tcatgacttaaggggatttgaggagaacaaagggtgattgccagagttcattgccaatagggcatctttatagaaactacaacatgttttccaagccatacttctcctttttttgcccagggacaatgttgtctgttcacatttttatctcatattctttcctatccttggaagaggataacttatccatccttgtaaact

SEQ ID NO: 25222 - DNA, 201 bp, Bos taurus
tttgaaaataactttctcactagaggaaaactataaagaacagttgtattaaaagcaatttacctctaatttcttcatgccgtttgctatttctttctggcgattgttgctgtgtataaacaagaatgtaatctcccaaatagaagctttttctgaattagcaatgaggccccacagaggcttttcttgactccatgaatc

SEQ ID NO: 25223 - DNA, 201 bp, Bos taurus
cacatctcttatggcaccaagttgtgaatcccacatttttctcccttgctgtgagctctgtgactgtgcacatccctacaggaaagggatctcatcagaagtttttgagagactgaaccagacctgtcccatctgaccaagagagctgtccgtcacactggcatgtggatcctcccctgatcccaaataacctttacaggt

SEQ ID NO: 25224 - DNA, 201 bp, Bos taurus
tttaggatgttgaccagggctgtagtcatctgaagactcgctggggctagaggactggattctaagatggttcacatatgtgatctggttgttgcagaagccctccctactgaagcatctgctgggctgcttgagtatcctcacaacatggtggctagcttcccccagaccaagctacccgagagaaagccaagtgggagg

SEQ ID NO: 25225 - DNA, 201 bp, Bos taurus
gtgagcatgttaggtacagagctggagcagtaacagaggagagcagagcagtagtggagtaatgaagatccttgctgttattttctggagggagaaagcccggctcccctaagcaaagtaagatggaaagaagttactaaagagtagcttgtctcacccacccagcctgacagccagacaggtgagttagcaaatgctaca

SEQ ID NO: 25226 - DNA, 201 bp, Bos taurus
atctgtgaagtgggtttaatttttgcctagttgatttgtaaaaaggattaaatgatttagcttatggaaagccatgagcatagtatcccggccttggttactgctcagaaaatgacagtcttattctttgacatcacaggctccatgttgcctggaccttcttgtcaaggagataagagaatccaggagtcagaggggcct

SEQ ID NO: 25227 - DNA, 201 bp, Bos taurus
cataggccagatgtctatttctacatcgtagctaccctaagagagggtctacaattgctgtgggaaagagggcttgaaagtcctctttagtaaaatcccagatgtcgttggctactccctatgatgcatcttagaaagccaagcgaagggaatgtctatgccctaagggaaacccagctttcctgacctttgcggtctgca

SEQ ID NO: 25228 - DNA, 201 bp, Bos taurus
agctcctcatgtgagggtgtttgtctgccttgcttggtgatgtctgctatcactctgggaggtttgccctgtttgtggccagaccttagctttcattttctagttgaatgaagatggttaggtgagagccagcgaggggtgggggcaaatgagtgcatgtggccaggatgcattatgtaattataataatattgacaaata

SEQ ID NO: 25229 - DNA, 201 bp, Bos taurus
cacggggcaaggcgtcttcacaatcacatcacttggcctggagcgtcgccctgtgttgtccacgccccacagggtgaacctggcagggagaggagggcatcaacagagagaactcaccgggttctggctgacaacccagccttgcccagatggacgggtttcccctggctgctcttgccacccagtcgtgcacttaccacc

SEQ ID NO: 25230 - DNA, 201 bp, Bos taurus
attgatactcaggctcacgcaactcagtccacctcacggctgggagtgttcataaagtggccatgacctggcaggacccatccagccctttggccaagcttccattcttcttcaacaggctgtgtggactgggctgcaataaggggggtggggtgagagctttgaatccatgatgtgacttctagaaaagcaggccctcat

SEQ ID NO: 25231 - DNA, 201 bp, Bos taurus
atacagaggtgaacagaagtgaggatggtgaagttctgcatcatgagtttatactaatgaatatatagtcatcacagttgatgcgagtgctctgaagaaaggagtgtggcccttgggtgtatatggttaaagagagcctgtctgagaaggtgaggtctaagccctgggggagatctttccatacaaatctgatcctatctc

SEQ ID NO: 25232 - DNA, 201 bp, Bos taurus
gatcacgcagctggtgatgctgatcaatgtcaaggtcgtcttgttcacaggacttcggggagagcccactgaaaacaagacaagagcaaagcatttggtggtaagaatcttggcagtaaagggccttttgctgcccaacctggcaaataggggagggagcatgcaaacacagcccaggtgggagatgtgtctagtccatga

SEQ ID NO: 25233 - DNA, 201 bp, Bos taurus
agtaactgctattcaagcagcatcactgtgctctgacggtgaattctaaggacaagatcacccgctacaaacttcggtggccttggtcaagaagccgaaagcacagtgccttctggatggctccgtttcacagcggagcctgctctctgggatccccagtttatatttctgtggggcctttctcagaaaagcacagagagt

SEQ ID NO: 25234 - DNA, 201 bp, Bos taurus
gaggaagaggcgggtacgacagcataccaagaaggaattaagagaggttgggaggatggagagtgatggaagagacagggaaatgctggctgggccaatggttcaaggcaatgagatgacaataaaggtttggtttcatgatgatttgaaggtcccaggagatgagggccgagaagagaggagaacgtgaagtcgctcagt

SEQ ID NO: 25235 - DNA, 201 bp, Bos taurus
gtgtatatattttttgaattatttgttttcatttttttctgatagatatccagaagtaggattgctggatgatatggtagttctatttttaattttttgaggattaactatagtattctgcatgatgactgtaccagtttacattcccacaacagtgcacaagcatttgggacagactttccttgccactgttttgcacat

SEQ ID NO: 25236 - DNA, 201 bp, Bos taurus
ggagtgaaagaaagttatagccttactgacttgaggaagaaaatggggctggcaaagcagctggagggatagaataaaaatgatgtggagaatggggccatggagggtgggatttgcccctatgtctgaacatacattctgcccagtgcttagctgacaactgaaatccacattcatggggaaagctttagggggcctggt

SEQ ID NO: 25237 - DNA, 201 bp, Bos taurus
atacacatgcatatatacatgtgtgtatatatacacacgcatactttgaggcagcccaatcaactttgaaattgcttagaaaccaaatcacatttgagaaccacaatttataagccacaaagcattaagaaaatttctcagagaagaaatgagctttttgcttctttaccagtctccagggctctattcaattcagaaaac

SEQ ID NO: 25238 - DNA, 201 bp, Bos taurus
ctttttccactcttatcaggtgagaatatacatatgactttgtatccccaaactaagtcatcaataatactgacatattcagtaccttaagacagatacatttttagttctttcagaacaaaatataatgtatttgttatagtattttcaagtcaactataacatagatgttagagaaaacatctgtatcttcagtggcat

SEQ ID NO: 25239 - DNA, 201 bp, Bos taurus
ggaatgaacttataaatatgccatctgtaaaaggaaagtgttttcttttattaaagactatcgccaatgaacaacattaccagttaagaattttttgatagcagtctgccaaatgtatagttacattcccaaacattttgtttttcaggtagagggaaagtaatttttctggggattatttattgtaaatgaacaaaaata

SEQ ID NO: 25240 - DNA, 201 bp, Bos taurus
cctaacccacagaggtctatgatgggaactgggctgcaaagaggaatgaatccatagtgctgtgttccccaaatcctgctgcggatttaaagttgaacaatgaattgggagggcagacataaatataactggagttaaaagtttttacactctttttggccagtttttagttgaaaagtttattgcctgtaggtactgaaa

SEQ ID NO: 25241 - DNA, 201 bp, Bos taurus
ccacctcctgggcaccatgccttctttccacctcatcaggcacactcatccattcaacaagtatttcctgaacacctacttgctggaaatcagaacagtgtgtaggacggttgaggagctgccctgggggagctcccactggcctgggtgagactatgagagagacacccgcgtgcactgtaatttcagagtctccaaggt

SEQ ID NO: 25242 - DNA, 201 bp, Bos taurus
cagacaagttgtaatataaatggagggtggaagacgccagactggtgagaaggggaagtggcagcagataaatgcataggctaacattagtcactgatgcttcgtctcatatctcttactaccactgcagtcttcccattacgttcctcttccagaccatcctgaaaactactttcattcttctcccaaatacccatatca

SEQ ID NO: 25243 - DNA, 201 bp, Bos taurus
tctgcagcaactacagctaacatcatgtataatggtaaggaactggaaccttttgtactaacctcaggtacaaggcaaagatgactttgctcaccacttttaaatatcaggctggaagttctagctagtgcagtaagagaaaaggaaataaaaggtatagagattgagaaggaagaactaaaactgtctttattcacagat

SEQ ID NO: 25244 - DNA, 201 bp, Bos taurus
cctctttaagcaaggcgtgtacagtccttataatggaaacaggtttcaggcacaataacccacatgctcacttatcccagaagcactaaagcagtttggcgagttgtttaccatccaggtattcctgattcagcagttttcatacaattatgatttaatttccctatgctctaccctcccaaaaagtactaagaaatcgaa

SEQ ID NO: 25245 - DNA, 201 bp, Bos taurus
ttccttttctctggatgtcaagcataatctttgggaagttttatttacttctgctttataagaagaaacaggtttttctctctgctttctttagaagactacttctcttttttctagagtgtttgtgcttctaatgctaattaaccctgtttctcaagttggagtctcaatttcattgctctttatgtgtatttgaatgct

SEQ ID NO: 25246 - DNA, 201 bp, Bos taurus
gtcatttaggggaatccatcttcaagtcttccatatatactaattcctgaaattgatttgcctcagtaattgccaggcagttgtccaagagtcccctttcaaatggcctttctctgattttataaaagaaaggcttgtttcttattaaatctagattgactctctggctcccaaacaaagaaatactctgaaatactcaaa

SEQ ID NO: 25247 - DNA, 201 bp, Bos taurus
tcggttcacatactattgaagcctagtttggagaattttgagcattactttgccagcatataagatgacatagcaggaaagaagtaacaggtctctaaaacccaagcccctgtctccagtcagaacctgaccatgacgatggtcaaagactagttccgtattcatggctccttctaaagagaaaaactccctgcagcttgc

SEQ ID NO: 25248 - DNA, 201 bp, Bos taurus
ttaggaaaccagtttccaatctgagttatctgattttttacatttccatttgtggtctctttaagaggacagtggaactagggacacaggaaggagaatgcccaccaagttcccttacaaagagcattatggcagtgacctaatctcaggttttttttttccctaaggatcctcccagatcttgagggcagtagttgtgtt

SEQ ID NO: 25249 - DNA, 201 bp, Bos taurus
actggctggtgtggcacacggacacacgaatctgtagtttccaatgagtgagccagcacgttagttaagatggtgtgtcagtttctttttgctgctgcaataaattatgcaaacaagtggcctgaaaccatgcaaatttattctcttatagatctggaggtcaaaagtccaaaatcactttcacaggactgaagtcaagac

SEQ ID NO: 25250 - DNA, 201 bp, Bos taurus
gacttgagatatctaaaaccaaattcacatgtgatccagggctctcaacactacaaggacatgtagtgacagcccctgggtgtgttgctgaacatgttacgtgcaaaacacacacctgttaggtgccctttgaaggcgagctctgacacatttacttactcctttgaatccttaaattcagaccataggaaaggtcacccc

SEQ ID NO: 25251 - DNA, 201 bp, Bos taurus
gattaggagaagctctgctgcaagaagaatgatctctggggactctggggaatcagccctcatgtgcttggttaggtcagccctcttagacaacaaatactcttccatatgctaacttcagattgaaggttccttgcaaacaatggctctgccctccgttggagcttccttggaaccctaaatatttggctctctggattt

SEQ ID NO: 25252 - DNA, 201 bp, Bos taurus
caggcttaacaggcagggactccggcattgtggctctctgtccagcgtccctagctctgaggggacgtgaagcagcggccctcccacgtcccttgagctggggctgctcactcggtcaactggagaacttggctgctggagtttgctaagaaggatacactgcatgaccgctccacaggcccctggatatttgtccaagaa

SEQ ID NO: 25253 - DNA, 201 bp, Bos taurus
aggagacttggtagaaacagcacgtaccccccacacccaagcagagtggcaatgccaggctccttcccagggagccacactcctcatctcagcatcaagccgctctatcccttttgtctgttttatttttgtttaaactttttattttatattggagcatgctgtgatagtttcaggtccacagcaccatgacccagccat

SEQ ID NO: 25254 - DNA, 201 bp, Bos taurus
gggctcaggtgatggctactgctatcatgggcttccacctgttaaccaaccaacgtcagcctcccagaagggcaagcagggcagagagaagccctcaagttgtcgtgagggaatatcagccccaaacagccaactcttccagcacagcctctcccatccccacgcccactcaaaaggagatccttatttctaaccagacta

SEQ ID NO: 25255 - DNA, 201 bp, Bos taurus
gtaaaagggtatcagttttggccatcacctcacttaaaggggaggacagcaacgaaccagcagagagtacagtgctagttacctcaatgccactgtgatagctggccactcttctctcttccttcagaccaaaattacccagcaccaaaaaggagaggaagtaatcaagtcagaccccaacagaggcacatcatctctcag

SEQ ID NO: 25256 - DNA, 201 bp, Bos taurus
tagcaaccgccccacccgagtcaggaaaggaaagctgcttgccctctggtctgggttcagacttcacccaggccaggccccagtgggggctggtgtttcttatgggtaattgccccttattcttctcccacggagtcagctcccttcctccccaggatgcagggagaagaagctggccccaacccagcgtgctcctgtccc

SEQ ID NO: 25257 - DNA, 201 bp, Bos taurus
ataatggctttggaataattatgtttgtcaaagtagccctgattattcgaacttgtttaattatttttgctattttatgcagggcaaaaaatacagttgcgtggtccttattgacaggtgctttccctgctttctaagccttaaactctatgatcagtgcctgcttttgtggcaaaagaacaaaaacatggcttcgtggct

SEQ ID NO: 25258 - DNA, 201 bp, Bos taurus
tcgtcagggagtcccaccagtcaacagatgacttagtgatcaggacattctggggacccagtagaggaaccctggttcagccagatgatggtgagggaagaaatgaggtgtcagcagagtgggtaggctggggtagggttactgtatttcagagagagtttgagcctaggccagagggtggaggggaccctgttgtgactg

SEQ ID NO: 25259 - DNA, 201 bp, Bos taurus
cctgtctcccttggtaatccttgtaaactatgaagtagatgacatcatggctctgctccaaacctccattagctcctttcccacctagaatgagatcgaaacttccgatctaggcagctagggcctccaagaccctcctgccctctccatttgccacctgaggcttctgctccatttctcaccccctcccaggcttccttt

SEQ ID NO: 25260 - DNA, 201 bp, Bos taurus
atcttcacaaatagtatgtattatcttctctttcttacagcagagtgaactaaggcttaaggaaattaaataccttacttaagatcacaaagctattaagcggtacagctgggatttgaaaacttctcacttctagaattgtgtcagcaaaaatggcaatgaaatctccccatggcatcttgtactgagggttggggagag

SEQ ID NO: 25261 - DNA, 201 bp, Bos taurus
tattccgcaagaggaaggggaattaaggccaggcctttggaatttatggaaactcacccaagttaatcctgagaagcagatgtagagggacagcactaagcacctggcttcctgagcacggccgcttttcacccaagtgtcagtgcgtggactcaccattgagctctgtaacaggtgccctccaggagaagaaaccaaggg

SEQ ID NO: 25262 - DNA, 201 bp, Bos taurus
tcctttttgttctattcagcggagtcagctaggccatctttcaaggtcaggagacatttcaaactttctaattgggccagttagtctaatgttagtatgtccttaaccttcgttactgagaaactgtacttaaaagcatttttagtgaatccttccagggttacccgtttttggcctatagaaacagaaactagggtttag

SEQ ID NO: 25263 - DNA, 201 bp, Bos taurus
gtgtggagagctcgactcatgtggcaaaattagcatgagcaggtgttggagggataagtagagaatgaccatgaccccaaagtagagactgcaggaagacggatctgggattgggcttttctaagtgagtaaaacaaaaagacaagggcatctgaggtatttgcaactgggccaaactagaaggaactgaggatgtaaggg

SEQ ID NO: 25264 - DNA, 201 bp, Bos taurus
cactcttacagtgacacctagaaaaatgttagatcaaatacttgggtatctcatgactcaggcaaatggacatattaattaaccattacatggaattacgcaattattctacttttcctgggccctgggaatacatatttaaaatttgatgaataataaaaatggctttcacccagaatagcattttcaattggcaattct

SEQ ID NO: 25265 - DNA, 201 bp, Bos taurus
attgaatattttaggctctgcaggccacactgtggcatattcctttttgtttttattgctgctattttgtttttgcttctttacaactcttttaaaaatgtaaaaccattcttggctcatgggccacacaaaaacaaacttccagccaaatcatctaaatggacttatgacctatatgaatttatgggtttgctgaatagt

SEQ ID NO: 25266 - DNA, 201 bp, Bos taurus
tccccttgccctaaccatgctgccatgacagcttccaggtacctccgcatgggtcaggtgagacaggaatcaatcttttatttattcccaaacagatgccggtcttctgtgcccacaggcagagaccacaggtcaccgtagggcaggaaatccgtgtaaaagcgagaggggaaaagctcctacaggaaagccttgtccttc

SEQ ID NO: 25267 - DNA, 201 bp, Bos taurus
gaaagccattgtctacattttgaacagtttgttacagcagaacccaattccaggaatctagaaaactattcagcctattctctgctgattgatttgaatgtgcaaatagatctggaattcatctcatttcctgcagcactaaatatttcaagaagatgaatttatctgggttttaatatgcacagtgccacctgacctgcc

SEQ ID NO: 25268 - DNA, 201 bp, Bos taurus
ttacacaaaaataatcaccatgcccttttctttttaaaattgtatatttttacccaattttggaactcaggttttaatctcagtctgctcatccagagttgtaatattgtgctttgtggctatacccacgcacaaaaaaacttaggcatggatacacagtatattgaaaaacaaatgaattaaaagttagcagctgtattt

SEQ ID NO: 25269 - DNA, 201 bp, Bos taurus
cctgcgtattttggaagtgggctgggctgccagtatcattgcttcgaacagttccttgctccacagcaaacacaacagggccctgcttttgctaataacccgaccattcctgtgtctcctttcccttcatcccccgcctcgcctactctctgccctgtatgcatcttgcctcattcatcggccaaattaaagctgtgatta

SEQ ID NO: 25270 - DNA, 201 bp, Bos taurus
ccttaattttctcaacagtaaaatgggaataatgatggcagttgtctcatgtttatgtacgttctaaatatccaataaatgatccttattattgcaagcagttaggaagttttactctgtactctaccagtgtagagtaagcaggttgtttatcattcttttctgcagttctctatcttactcagaatttcaaacttagaa

SEQ ID NO: 25271 - DNA, 201 bp, Bos taurus
caaagcaatatatacataatataatcccatttttctaagagcaaacaacctaaaaaaatatatcccacaaaacatgtgttttatatgctatatgaacatggagaaaagcacagaatagcgtatgctaagttgttcacactagttgcttgagttggaggaggggatgtgggggaaggagagaaagttaagttttagaagggc

SEQ ID NO: 25272 - DNA, 201 bp, Bos taurus
caattcctcacttcttaggcgaactcattcatttctacaaattaggactgagacaaatacttatgcaataattcttacccacttcctactttattcggatcaatttttcttacaggggatctaggaaagcgctacacttagtgtactggctaatatgctttgggccataacagaaaacagttatattagttagagtttgac

SEQ ID NO: 25273 - DNA, 201 bp, Bos taurus
tccggggtcggggtcgggaccgggacctggaccacctccaccttctcctggggcagcagctcctcctccgccatattctccatagttaccgcctccttgctaggcccgcccggggaccagcaggggctcactgcggagtgagagaaatggcgtgaaagcccagagggccggatccgagaagtggggaagcaaatggggagg

SEQ ID NO: 25274 - DNA, 201 bp, Bos taurus
atgaatggctggggcctcagtttggaacttggtgactctggctgtcacagcaagggggaatctgagccaggacagatagctggacaagagttggagcccataccagttgtgggccggcatgagtccaagccctagggaaggaataaatgggctgaggggttagtggggtttgggtacttgggatagtatagggaggaactg

SEQ ID NO: 25275 - DNA, 201 bp, Bos taurus
acagtccaggttcctctttccaggggttggaaagagtcagacatgacttagtgactaaaccaccaccgtcacccagcagtggaccctaaaggaaaatataattacctttgtattccaagcttggtaaagaaggtcataattagtaacatgtatttgaaaatgttaagatagtcataatttattctgactgtgtatgttagt

SEQ ID NO: 25276 - DNA, 201 bp, Bos taurus
ccaacttccatgggtgaatagcatcattggcgttcccattatatgtattcatgaaagttacatgacttctttaaaatccgctgatgtggctgggttttcagtctagattggtatgaccacaaaacaatgtatttccattaaagggttatttcatttttgagaactgttttgcttttcctccactttaagattagttatagt

SEQ ID NO: 25277 - DNA, 201 bp, Bos taurus
tagcagaaagaaattttattaaataaagaaataattgtcaagaaatttacattttttaacgaggtcaatgatgatatttagaagtcccatgagagtatatcttaatgactgttataactttcagattgtcagtgtagggatgttttaattccaacattgctttttaatacccagggctttcttctggagtggtgccctgtg

SEQ ID NO: 25278 - DNA, 201 bp, Bos taurus
tttttttggtgatggccattttgactggtgtgaggtgatatctcattgtagttttgatttgtgtttctcaaataattagcactgttgagcatgtgcctcttttcatgtgcctctcggccatctgtatgtcttctttgcaaaaatgtttattcaggtatcctgtgcattttccaattgggttattggggtttttttgtttgt

SEQ ID NO: 25279 - DNA, 201 bp, Bos taurus
attttttcgtctccagtaattacgaaaagcatggaatcatgtcaacattcctcagcttctgggaaaacaaacacttgagcacttgagttttttcccagcaatattaattaagagaaggacaacagggaaaagagatttcagtgagtggactcaggcgtctcgcataaataactgggaagtgccagaaacgacttgtgaact

SEQ ID NO: 25280 - DNA, 201 bp, Bos taurus
ttgaaagaaaagtttgcagaagatagccttctcttcctcctcctcttcttcctttttgcatagattattatacagtaccctctgccttttgagtatgtgaccaggaagtaaataaatatgtattggtactcattagaagtatatacacaaatgccgtatatgtttgcttcacattctgccacttggtttttcttgcaggct

SEQ ID NO: 25281 - DNA, 201 bp, Bos taurus
ttgtcagtgactttgggctgatccactgtacactgatttattaaaaaaaaaaaaaagaatagtactgttaataaggagtacaatcgcttttttttttttttaaaggaaaagcatctttttaattatcttttgttcattgaataattccccttaggaactaataaaatgcattttatgggttatactcggctgtgtttgggg

SEQ ID NO: 25282 - DNA, 201 bp, Bos taurus
tcctcctcacaacagcacactgtatcttccccagtagcagcttccctctctgcgccccatccccgccctctcaagggttacttgccttctgagaattccctgcattttccttcttgtgtagttctctgttcaacattttaaaggcaactctatcaattgagaagagtctattccaaatgtaccatctaatctttgcaactg

SEQ ID NO: 25283 - DNA, 201 bp, Bos taurus
tttaagcaacaggcctcccaaccctcaactctacataccaaatctcatgtagaacttatcagttagaagaaataaaaaaggaattgctctggtttaaatataggcaagaggcctggagactactctttagcgtctctcccaataatccatccctccagcccctatggcacctttgacacaaccaatttcttttaatacaaa

SEQ ID NO: 25284 - DNA, 201 bp, Bos taurus
cccactgaggagaagcgatgctaccagggaagctgtgggcacagcgagcttgcaagggaagaccagcatccgctgtggagtcgggcccagaaacaagggcaggaagagcgccgcacttaccgctctccaccttaaatttctcatgccgccccttcaggccgtcgatctcggactgctggtcagcaaggaacttctcaagtt

SEQ ID NO: 25285 - DNA, 201 bp, Bos taurus
tgcctgagattctaattaaattctatatgccctcatagggacctccctggtgctccagtggttaagaaagacttcatgcttccattgctggggtcatgagctcagtcactggtcagggaactaagactctgcttgctgcacagtacgtccaaaaaataaaataaacgtgtattaaaaacaattctacatgcccacacccaa

SEQ ID NO: 25286 - DNA, 201 bp, Bos taurus
ggaaattaaacaacacactcttgaataaccaatgggtcaaggaagtaatcaaaagataaattagaaaatatctcaaaacaagggaaaaagaaaatatgccaaaaattatgagatgcagtaaaagaaacattaattgagaagttgatagtgataaatgcctacatttaaaaaggaaaggaaaagcctgactacacctcaaaa

SEQ ID NO: 25287 - DNA, 201 bp, Bos taurus
tcctttctcacaggagggaagaagagaaagatggtgcagaggcaggagggtttataccatcagaagggagtacaggtctgatcacctcagtatggctttttcttcattcacctcacttggtgcattggacctttcaaactgaatggttgtaggtttgtttgtttgtttcagagcagtttaggtttacaatagaattgagga

SEQ ID NO: 25288 - DNA, 201 bp, Bos taurus
ggtgggccagaaacacttatcagagtgcccatgagcagagacgataatgtgagcccatcaactggctctcatgccaaaaacatccctctggaagcaggaaaggaagacctttcctcctgctctggcctcatggtgcccctctaggacctggtgctgacaaagtctaaaactgatccaggagaaatcaaaggagacgtgttt

SEQ ID NO: 25289 - DNA, 201 bp, Bos taurus
aaataatttagtttctcagctttaccacataatatttatcaaatgctcactaatctaacttcttagagttttcaacttctaagaaaatacttttatcttccttaaatttcttagatgttaataagaaagctaattttaaaaataatatttttcattgtatgtgaactttggagtgagttttattgtggcatttgttagcca

SEQ ID NO: 25290 - DNA, 201 bp, Bos taurus
ttggtcagaagcacaggtaaccagttggacccaagactgacatctgaagtggaggagggtatggtggaactgagctcttttccagtggaatctgattcaatctccagttaggtatagggccagaaatgaattgacttcttggacaccttgctggcatctgagaattgctcattggtttgggaacgccccccacccccgacc

SEQ ID NO: 25291 - DNA, 201 bp, Bos taurus
ttgcttccatggccttgcatgatctgctcctccccgtacgtccaaactcaccatgagccacttttactcttgctcaccattcaccagccagtgttttctcacagttcctcaaacggcctgcctggaactctaaattctaaattcatgcctcctcaccctctatagttgctcctttactgagatcaagttcccagttattct

SEQ ID NO: 25292 - DNA, 201 bp, Bos taurus
aagatggtttgaaccaaacgcagaagtttgtgtacacctattcatatgtaaaataggcatcaggtgctaattgtttgcaagcgctcaattccttttgaatcattctgtgctgctttttatggttttcagtcccatggagtaattactctgagagttcacacatctctgtgtagccaaacaactattctccacgctaatcaa

SEQ ID NO: 25293 - DNA, 201 bp, Bos taurus
aattcctctgtcttctcagattttttggaactttctttgtctctgtgaaattaggtgaaacagttacctgtcccagtcttgaaggtgtgccctgtctagggggatccctgtacatgtgcccagtggctttggtggaagagctggacctgaagtgaacacaatgcatgccttccctcagggtgtgctggtagctatcacctt

SEQ ID NO: 25294 - DNA, 201 bp, Bos taurus
atctgcattaaaatataaaccgaagatgtcttatgatcagcgtatattgtgcccacagtccaactcaagtcattcataatgactttagtgtctcaacagaaaaaaacaaaaatataccacccctcttctaaatatattagaagtcaaagcaacaactataaagtttgatgtgttgtttgaggattaaaggaaggaaggaaa

SEQ ID NO: 25295 - DNA, 201 bp, Bos taurus
acagcaccacagatacatgtgactcttggttaacacaaaacctccctaaggatgccccttcaaacatggaggagaagcgaggtacctctgctctcagagccacaccaaacatctgaacggacacgggccagtgtctcctcacccacgaatcccagactctgcttccctggcaccattagtgtcctcttaggccgaatgcac

SEQ ID NO: 25296 - DNA, 201 bp, Bos taurus
cagcgttaaaggtcttatggccaaaggaaaggatcctgaagggttggtggtgggatgggggagagttgaattttaactcagccaaactggggactaattttcttggcagttcaaaagctcttaatgaaggctttctgccagacagaagcagcgtgggccactgggcaggcatgctgaggccatccttcagagaacaggctg

SEQ ID NO: 25297 - DNA, 201 bp, Bos taurus
tacaaagatgctaaaacaggatgtaactgcagcctgcggaggaaacacactggctgatctggaagtagagtgtcctgagagggcctgggaaggctaggtccagaggtgagggggccaggtgtgcgctgagactggagagttaaggtgttgctcacctagaggaccaattaggaaagtactttccaggggggaggaaagaac

SEQ ID NO: 25298 - DNA, 201 bp, Bos taurus
gcgttaatgaaaaaggatacgtgttttagggttaaacacatattcctcttccagcaaaatgaaaggtcatcctgaggcaccttgggtcaccaaaggcctcgttgtctctctgctggcgtttgacggtgtcctgtatgactccatcctcctgttactgaatgcaggttcctgtgtttgatacacagtgaggccaaaccgaca

SEQ ID NO: 25299 - DNA, 201 bp, Bos taurus
agtctgaacgtgagacaacagagccagtagccagagacccagacaggccctaaagccaacgcacttcccatcttcagtgggctcactgtacagtccaggatgcgctacacggcacctcgtggggccgctggcgacactctagcgccatcaaccttagtctacttcatctactccccgtttcttcttccatctttccttgac

SEQ ID NO: 25300 - DNA, 201 bp, Bos taurus
actactaagaaggaataaaagagaagtgtaaggcatatcctaggatggaggggaagaaccgaaggcagtcctagcaagggggcctgctccccaaggctggcttcggggctcccggagacagggcggctgcagcaggctggctgagagagtcagctgggctgccccagccacttgctccacagcaggagggccaaaggcact

SEQ ID NO: 25301 - DNA, 201 bp, Bos taurus
ggatctaaagagaatgacttcttggggcccattcaaaatatcttccatgtggttagaccaaggacccgaatcactgctctctgacttcattatgacttcacttagaaatgacttagggccccctagccccgtcgcctagaggggccttcatgagcctggcaactgaacggggcaggagttccctcgtctgtggcccagcag

SEQ ID NO: 25302 - DNA, 201 bp, Bos taurus
ttaaaacagacaaacgtctcctggaggagataaatgaaaggcgagaatccaactgcctggtggaaagaagcaatcaagtcagcttattgagagttcaaaaaaggcatttccatggtgcctacaagtcccttactcacgaccaggtcaaaaaacctgttcctgacagtgacaggagctcctgggtcaaactgagtctcttcg

SEQ ID NO: 25303 - DNA, 201 bp, Bos taurus
aagtgtggtgtcaccatctgtcagcacctcaccaggctgccccgtcccggtgagcagcccttctgcgaaggacggactcagagccagggtcccaggggccgatgtagctgagagcaggacacacggagtgtgcatcttgtacccgcaggcgttttgccacagctgtctttcaactccagcgcattcctgaagggagcattt

SEQ ID NO: 25304 - DNA, 201 bp, Bos taurus
agccacaccctgcagcaggctctggccccagacacccccagcaatctcggcctgagcagtaccagaaccggggagcctttggagtgagtggcctgagagggagagaataccttagccacagcttggcatgcaggtatcagtcagagggaagaaagttgggctgtgagagaacttcctcagaattgagtcaattttcagaaa

SEQ ID NO: 25305 - DNA, 201 bp, Bos taurus
tgtccagggactggggtggccctaagggaggtcccggtgcccgcttgacacccgtttctagtaggagggtgcaagttcctgttcatcttgggacacccctcttgcaccatctctggggcccagagtggttgtgggtggcaggagcgtgtcctgcaggggggtctgagggggcggtgattcaggtcctccgggtccagcggc

SEQ ID NO: 25306 - DNA, 201 bp, Bos taurus
acccaaggatagaacccacatctcctgcattgcaggctgattctttaccactgagctaccagggaaggccaaaacagcaaacgtaaattctaccttaccagcaattacattcaatataaatggattaaacattagtcaaaagcagagactgtcaaaactgattaaaaaaaaaaaaacaggtttcaactacatgctgtttac

SEQ ID NO: 25307 - DNA, 201 bp, Bos taurus
ggaaaacagctggcacctttccagctcagatccatgtggacaaagtgtaacataagcaggttggtataaacactgaaaagatcttggatgcccacagatatctgaatcactccactgtaagatggcatttcagagcaggaagaaaaattctctttcatacacatattacagggctttccactggtttttgttaaggccaca

SEQ ID NO: 25308 - DNA, 201 bp, Bos taurus
aaaaattagtagacaaacagagctgctgctatttccctcccctcccacatcagatcagatgctatagatatgccaagtcctctgccaatagccagcgccattgattcctggcacctacttcctacttctttgctctctgagtctcttcttcgtgcagttttgcttccgagagtccacaagaaacagtgggtgggtgcaaag

SEQ ID NO: 25309 - DNA, 201 bp, Bos taurus
tgggccctggggctctccgataggaaatactggggagatgaagaagagcccacgttgtctgtgccaactcttcctttccccacaattctcttttgctctcaaggccatgccccatcctgtctgctgtcagcacactcttgctgcctttctggcactgacttttgctgacgtatttgtcctgcagccatccaagtttgggcc

SEQ ID NO: 25310 - DNA, 201 bp, Bos taurus
gtagcctagtttatccatcctactgtgaatggacatttgggttgtttccagaatcaacgatgctgctgtgaacacggctgcacacgtgctcagtgcagggcttcccttggacacagggctggagctcttggttcctgggctacgtggatactccttcattctcccccttatacgggtgggcaagtcgtactccacttttcc

SEQ ID NO: 25311 - DNA, 201 bp, Bos taurus
atgaaagcaaagccagacataaaagatcatgtctctatataattccacttataggaaacgttcagaataggcatatctacagagacagaatgcaggttactggttgccagaagttgggggaagggaggaatggagtgactcctaaaggttatggggtttcttttgggagtgataaaaatgtctgggaatgagatgggatgg

SEQ ID NO: 25312 - DNA, 201 bp, Bos taurus
taactgaatttaactgtacagttcagtggcactaagtacattcatacttttgtgcaactatcacaatcatccatctcctaaagttttcacctttgtaactggatctctaatataataagtattttttgaagatttttgttttcatgaaatctaatttatcatttttcattccttttggggatttatttttgagttttatct

SEQ ID NO: 25313 - DNA, 201 bp, Bos taurus
ctggccagcattcaattcaatcctcacattgtttccccttgtttctgtcacccgacctaggacatcaggttacccagctgagtgttcaccgattttgtccggggccatgcgatcctgtccagggagaagcagagatgtaaattattgaggaaacctcaggttctcaacaactccctagccatccccatctgcctggaaact

SEQ ID NO: 25314 - DNA, 201 bp, Bos taurus
gtttaagatgctcaccaagggatagcaccattttccaggcacaggcctttgtgttaaaaggcaccattaaatcagtgggcacgaagggctgctggcgctcgggttggagaggccatgaagggcaccccacctgttgaacctgggttcggttcagttcagttcagtcgctgagtcatgtccgactctttgcgaccccatgaa

SEQ ID NO: 25315 - DNA, 201 bp, Bos taurus
tgaaaaaacagggatggagttgatttcttttgtttatggatgttaaatgctgctgcattttcttgcctctcaagagaagcccataaaatcaaaggccccatagagatcgggactcaagggacctccgtcattgtaaggagaagggcaagaaagagattttagtttttcccataggcctatttactcctggctattttagta

SEQ ID NO: 25316 - DNA, 201 bp, Bos taurus
cacttcaggatgggtacaaggtcaaaaggaaggcctcggcggcaactctgaaaatcgtgtctgcttgaacagattcatctgacatttgcagggacctcagggaaggccccttttatttattctgtctccaggaccagatgcattgattgccctttaataggttccgaagaggaaagaatggccagactgtaggagttttca

SEQ ID NO: 25317 - DNA, 201 bp, Bos taurus
cgtaaccctctcggttatcttcccctctgaggagcccatctctggcgcagtccgcctgctccccacacccacccaggcactcttgcttctgcaggatcctttggggaatacaagattactcccaactgggctcccagttcctccccatcctgacacatcaccaagacacccctgcagggacagggcgcgagtggaactaac

SEQ ID NO: 25318 - DNA, 201 bp, Bos taurus
cttggccctatggctgtcaggggacatcgcatggaagcttctgcccagcacacacaagtgtagggagccctaactagaggtgagttcagtctggaccaccgctgggccctggaaatcccccctcacgtcactgtgtgccgagaggcagcaagatggccgcagtcccgactctgctcggagaccccagcaccatctcagctt

SEQ ID NO: 25319 - DNA, 201 bp, Bos taurus
aatttgaactatcatgtcaaggaacattatctctcagctgatggccaatttcatccattgtgtgatgtagagctcagattcctctgctacagcaggctgccggcttcaagtcttctctcactgctaagtggactgatagtgcagtccatcagcatggtgtccagatgtgtatggctcctttcaaatggggggctaaaaatc

SEQ ID NO: 25320 - DNA, 201 bp, Bos taurus
taaacagtagatagaaagactaaacaagagaagcagcgatatgatacttacaaattttatcttgtgaattcttccttgcactgtatcctgaaccaagatcgggaaacccgccaacattttcaaaacagaacttcttattaatatagagaaaaaggagcagcatcaagataataaacaccccaacagcagacaaaaatccaa

SEQ ID NO: 25321 - DNA, 201 bp, Bos taurus
gcaaattctaagtctcagtcagatttctcctgcttcttttccctgggcataatttaaggaggtcttttctttaagaaaagttcagccatcttcacactccagatccagctccttgtccatgtggctggcagctcagtggactgcagtttgttctgctgcccagcagtttagattaagagaccagaaaaggaaacttaccct

SEQ ID NO: 25322 - DNA, 201 bp, Bos taurus
gtgggcttcaggtcataggtgcctggccttcctctcctgcttatggctgcagccccagcatctgcagctatgcctggatcagcgtggacccaccattcatattttttgataactgaatcgacacacttgggaagcatttatgcaaatttacctgtagcataaatttctcaggtgtagcgttaatctctctctccccagcca

SEQ ID NO: 25323 - DNA, 201 bp, Bos taurus
cagtggctccttattgttcgtaaagttcaaactcattagctttgcaagctctttagaacctttgaaatcctttcccaggatcctctcaccattcctacccttgtttcttcttaccattcaggttcttctccctttcaaagtcaccctcccttggacgtgtaaggtgctccctaagcactgggtgtttctctgatcacagct

SEQ ID NO: 25324 - DNA, 201 bp, Bos taurus
ctgtgggttctgcagatctggataaagaaggtagcaggggccgcttgggtgaaggtggctctggacactgttttaggcaaaacttttgatgccactttgatattatcacattggccttcaaggaaaggtttgcttcatggctgagcatggcgttcatggtgttgggtggaatgaaagcccacccgtgggcctctgggtact

SEQ ID NO: 25325 - DNA, 201 bp, Bos taurus
attaataagcattataaactcacaagaattctcataaatcatccagacggctgtggttttagctcaaagagaccatctcccctccctgtggcatctcctcttctcctgcctccattcaacccaccctgcatcacaacaacacatacatgtgcacacacacagtaacgcacaccgattgtcagcacacacgtgaatacacgg

SEQ ID NO: 25326 - DNA, 201 bp, Bos taurus
tccgtaagggctggtactcagtagcagctctgggccaacatcttccaaagaataccacttgggagtgcccaggatgccggttatcccttgtttgccttccatggaccagttcggcccattcatgtctctctctttccagtcctactgtggagaagtaactcaaagcacagaccgtctttgtgatgggtcagttaaatcaac

SEQ ID NO: 25327 - DNA, 201 bp, Bos taurus
tacttttgtgcattttctgcatagacaatcagcctgtctgtgagtaatgacaatttaccccttcctttctaattctgtaagtcctatttttcttttcatgcggaatcactaggaccattagtaatagcaatcgtctaagaataccacatctcaaaggaatgtgctctctaaaagttctccactaaatgatattttctcacc

SEQ ID NO: 25328 - DNA, 201 bp, Bos taurus
gttggaagatgaacacattcccctccctctgtgtgtgaggaggcaggagagacccaactatttaatatgttcacccaaaggacagtccaacaaatcatcctaaagtggccggcattagggaaacaagttcagcgtgcggttgctgatttttatgctatgatccatcttattaaaacagagacactaagattaacaaaccga

SEQ ID NO: 25329 - DNA, 201 bp, Bos taurus
gcccctcgcacataatgattccttctccagagctaatcttcatggatggaggtttgacttctgcataaagttaaccctttcatagatacagtttccttaagacacacctgaatttgccagggcctcctagtttcaccgctgaatcatcagatgaaaacaaaaatgagaaaaaagcatcaaggtcattaattacagaagggg

SEQ ID NO: 25330 - DNA, 201 bp, Bos taurus
ggcctccctaaccgtcagcccatgtttctcttcctgtgagaatgctgaactctggccccatcgggcgtacagggaaggcagagccctaagctgtcaggccggctgtacctgttccccatggggctgacaagatttggctaagcctgtgaagagagactcctcccgcccacccctgccagccggtaacaactgccaggtgcc

SEQ ID NO: 25331 - DNA, 201 bp, Bos taurus
ccggggctggagggatcagagccgtccggccacggtgccatgaataatatactccccctgtccgcggaactcttcagaggcccccaaagcaacatttggcgtcatcaaaggagtcctgttgggaaccgtgttttattacaaccagagcatccgccgggcggctgccggctcatcgcctgttcctctggctcccgaagactt

SEQ ID NO: 25332 - DNA, 201 bp, Bos taurus
taaaatgtccattaagacaagaataaaattctctgaggcaagaaataaaatgagaaaaagatcacagaagagagaagtgttgcaggcctggaatgaaggacgctattgcttgaaagggaaactaaccttgcttcctgctgggcagcagcccgggagcctttgcagtcaggcttcaggcagaaacgtttgcttaacggagcc

SEQ ID NO: 25333 - DNA, 201 bp, Bos taurus
tcacagtcggaaatgactgactgattgaaaaacaacaacagctcccacacagctccgcgggtgggtgaggctggtgttggggccagtactggcccactggggagtgaggctgcttctcagagtctctggttgcagggtgtctggtgcgttagggcttgttctggtgcacagacgtgtggggagtggacactctgatggaca

SEQ ID NO: 25334 - DNA, 201 bp, Bos taurus
gtctgagatccggttacaggcagggccacattccccgcaagatgtactggaagggaatccgtttccacgccttcttcagcttccagagcggcatgctgtgtcttgcggcccctcctgcgtcctccaagccagcaccctggcacacggcctcagcggtctcaccacctttctgctgttctcaggtctccctctgcatgcttc

SEQ ID NO: 25335 - DNA, 201 bp, Bos taurus
tctggaaaatgaaacacagtcttggatctggaaaatattctctaaatgtgatgctggaagtcacacaagctgcctttaaagagctttctaaatccaggcactgtgctacagggtttaaatgggcctattttaactttgcttcacccagtgaggaaagcacaaacctttacatggaagtaagcatatgtaaagcttacatac

SEQ ID NO: 25336 - DNA, 201 bp, Bos taurus
ggtggaacagcatcagcaagtgagaagtggacactcaactgaaaaagatgagtgctatcaaaagatctcaaaagacagaaccggagaaaaacttaaaatgtgagggaccgcgattaaactttagcgtcaatatagtagtaataggcaacaacatagaatgggcaggtctttatctgttcacaactgtgtggaaaagacaga

SEQ ID NO: 25337 - DNA, 201 bp, Bos taurus
cacgagagaagacgatgttcctgcctctcgagatttttttaaaaggatgaacatgctgaatactgaatgcaataaagcacctacaaatatcaacacactcttccacggatataactgctctcagcgttttgatcacagatgaaaacttattaagtgccattaatactgatcattactcacgtccaattgtaacattcctaa

SEQ ID NO: 25338 - DNA, 201 bp, Bos taurus
cagtctctgtgggtgccaccaagcctttacaggaccgccagactcagtgctgaatctgtattctccaccaaacaccatcttcagagtgaaactaactcggtggcccaaaacactctagcaccttccatcctccaggcacctgaccctcgcgcagtgggggcccgggaggcttcctctcacattcctttcttccacgctgat

SEQ ID NO: 25339 - DNA, 201 bp, Bos taurus
aagagcactgtgttttctagggaaaaaaagaatacgagcaaacagaactcagtcaaatatagctgaaaaggtacagcagaaggtccttgaagtggtacacagagattctaaactcctgaatgtttgactattttccacttccttattggtgcaaatgagaagatacaaatcaacaaggactgagaggtctcctggtcgtca

SEQ ID NO: 25340 - DNA, 201 bp, Bos taurus
atgggcaacacacgggacatacatgggccatacatgagccatacagggaacatacacgggacatacaggggacatacacgggacatacgggggacatacacgggacatacatggccccagcatgccagaaggggtgtatttctgcggggtgcatgttatgtgctgggacccaggatgaaggtccccaactgaccgtctctc

SEQ ID NO: 25341 - DNA, 201 bp, Bos taurus
gatggtggtgtggaggagacagaaaaagaaaggggaagcagagagggaggctatgagcaatttatttctgctcttgaaacagctgcaccgattcattcagaaaaaaaaggtgccattccagggtctgggtacgtaggcaagtcctcctcttgatggttctcaccttgtggtggaaggaaatagatgaataacacgaagaac

SEQ ID NO: 25342 - DNA, 201 bp, Bos taurus
ctacgtcccctcttctcctcccctcttctctgcccccggctgggtcagaaacatctttgagcaggaatgatcccggaagaaagagggccctgccttacccacagtcatggcaagcccacagcaggacccagctggagagggaaatttccctttaaatcaggtgtgaagttttgattatgacctgagcctggacactttggc

SEQ ID NO: 25343 - DNA, 201 bp, Bos taurus
agagtggaaagaactgtagaggggaaagaaaaggggaaatacagtgtggggaggagagacgagaggactgtgttgaggagaaaggggagaaggaccacagtgacggagggatcagcagagacaccaggactgagaacctctgatacacagttaaccttgggttaacctctgataaccgtctcacatcccaaccttctcata

SEQ ID NO: 25344 - DNA, 201 bp, Bos taurus
tgtgcacttcacctgcagttgctccgcagatacctgaagagcagcaagtcaggaggtttgctctggcgctttaacgctggaccagtcccatgaccttggccctgggattgttgaggcgtctcagagtcctccaactccaagggccggatctgggaagggcagagggaatgggttgacgaggctttctcttgggcactgtac

SEQ ID NO: 25345 - DNA, 201 bp, Bos taurus
gttaaatgttattgcaaattttaaaatttgattacagttttgttttttaaggattcagctacaagcagatctgacgggagcttttctcagctgcagtggtattcttcctggcaccacccctcagcggtgctaaccagcgcccgcatcccttctcacttccagataagggtcaggggtgagaaacagcagcgcggcacggga

SEQ ID NO: 25346 - DNA, 201 bp, Bos taurus
tctgtgatttattcagctattccccagtcggtggttggtctctctgcttgtatacttccatgctcccaggacagatgctaaacacaggccaggctctgctcgggtggaatggggttaggaccccgagacctccacagcccctcagaaaccccctgttacttggcccactctggggtgccctcaaggatgctccagccccac

SEQ ID NO: 25347 - DNA, 201 bp, Bos taurus
gccccattatcttgaatatttagaaatgtccccaggattacgcaacattaaggattaactttgcaaccaaccgtgatccgatttctgatgctgtaagaaggccttctcttgacgtagcagatggactaactgggcaacaggtctaaagtctgtcttttattgcacaagacgagggttgcgggggcagagggtaaccccttc

SEQ ID NO: 25348 - DNA, 201 bp, Bos taurus
gattcctggtggtcggggaactcctgtgagtagagagtctcgccgcgttccttcccctcccacctccaaaccaaaggtatctcagtccacctatttgcagggattggcgctgtctgcaaggggggcactttgcatctcacactccagctggaggttttgctacaacaatggaacataactctggggggaaaaatgtccccg

SEQ ID NO: 25349 - DNA, 201 bp, Bos taurus
tatgtattaagtttccagccatcttactgcatgctcctatttctattgttttccaggaattccaaaagcatatttatatactcacaggtggcaaaaacattataaaattatttttgtggttgtccagccatggtaattcttttctgtctcatcaaagtgaatattgattagaaattattatgggggaaaaaaagacaacca

SEQ ID NO: 25350 - DNA, 201 bp, Bos taurus
tatgcttaatttatcaattaaactttatcatgggtatatatgtatggaaataacagtacatacaggtttcagtgccatctgcggttttagggatccactggaggtcttggaatgccttcccagtgtagggaaggcttctgtatatatatatatatatagaaacaatagggttttccagtcttaggaattcactcctttgat

SEQ ID NO: 25351 - DNA, 201 bp, Bos taurus
ggaaacgtttgagcttctggaggaaatctcccggtattgtagaatccccctgtgactgggtccccatggtgtttttaatgcttaaatttccacactgagattttcctacacttgcaccagttcccatacggtttccacttgtgagtctctgctccaatcaactgcacttccctgtattctccttttaatgtcttcagtctt

SEQ ID NO: 25352 - DNA, 201 bp, Bos taurus
ttgatctgatttctctttttaaaatttcaggtttatatattcatctgcctagtggacactttcactgtaagtgaaattcaacacatggtagagaatttgagtgttggagtaagggagacataggttgccagctgtcccatttaattgtttagaaaccttgccgaagatatttaaactctatgtgactcagtgttcattctg

SEQ ID NO: 25353 - DNA, 201 bp, Bos taurus
gtgaggttctgtagccaagacctgcaggaagtcaccagagtctaagacaggttgtatgcttccctagaggagttggccttaggttgtggatcccttggcagagccaagttgcacaggttcccaggaaggtgtggacagtgatccacagcttggccacagctgtgacccctggggtggagaccacagtgaccccttgtcctc

SEQ ID NO: 25354 - DNA, 201 bp, Bos taurus
tgcattcaaaattgccccatcaccagcaactatttattggacattttctattaatgcataataaatgagtcaaagagcttagagtacacctggctttatacgatgtgcttctgaaagccaagtgtgtaataaaagggattattttatacatgattttataaagcactggatttaaacatatagaattcttgtaagtttatc

SEQ ID NO: 25355 - DNA, 201 bp, Bos taurus
cagggttgagggcagtgagtgtagcagtacattaatggaatcttttgaaggaggtcctcattatcttcattacctccaccatagtttggccccaggtaaacagtgaggagggaacatagcttcccccatcaacagaaaattgaattaaagatttaataagcagggccccgcccatcagaacaagacccagtttccccttca

SEQ ID NO: 25356 - DNA, 201 bp, Bos taurus
tattataatgttttaacagaatctctatttacttgttaaaaatgagtatttacttactaaaaatgagtatcacctatctttgtccttcttcattggctttacttagtttactttgtccaggcaaaattcatacatgcaacttgaagtaaattgtttgacaaaaaaataccagaagaaagaaacttgaattactgattagat

SEQ ID NO: 25357 - DNA, 201 bp, Bos taurus
tcaaactagctgttgtgatttgtaagggaaaaatacactgcttgaatgaagcagaatacaagtacctgtactgacttgttgcctttaggcaaatttgattactctaaccttgtataaagagctaggattatgtttttcttaaactttccaagaaggtagactgggaatatgtttctacatcttttgacatttaatgcatgt

SEQ ID NO: 25358 - DNA, 201 bp, Bos taurus
ggagaacgccaagggcaagggcgagtgccggctgctctttccagaagctggtcggcgaaagggtggcgaagcatggggtcctgtttaacagagacagagcgtgtggcagaggggaagtagtcagtggacagggaattatgaagggaatgggtctgtctctgtctccaagagagccgagggtgggatcgggggtgtagatgg

SEQ ID NO: 25359 - DNA, 201 bp, Bos taurus
acccactcaagtattcttgggcttccctggtggctcagctggtaaagatccacctgcaatgtgggagacctgggttcaatccgtgggttgggaatatcccgtagagaagggaaaggctaattccatggactgtataatccatggtgtcgcaaagagtcagacaggactaagcaactttcactagtgatgggtattacagtt

SEQ ID NO: 25360 - DNA, 201 bp, Bos taurus
gaaaaaaaaatgagctatcttttctttctctctgcccatactcaacatctagtgaaaacaggaatgagaaaagagctatatgatctaaatcgcagatattggaaaaaatattgtttataaaaacattgcaagagaatattattttaaaaattggggtttggcaaagcaatttatagattcaatgcaatccctatcaagcta

SEQ ID NO: 25361 - DNA, 201 bp, Bos taurus
acaaagaatcggacatgactaagcaactaagcacagcacagcattccacttatcaggatggatatatgctacttttgaagacaagaagtgaccttttatcatccctgaggtatataaattggttattgcctattgcagtaaaaattccaagaaaaataattaaacaaattatgtataaaccactaactacatctatatgga

SEQ ID NO: 25362 - DNA, 201 bp, Bos taurus
gataatttaacacttatcttaaaatctaattagcagttaatcttataaacttatcatttgaggataggggtagggcaagtcagattggatgaaatttaacacaagcatgatgacttgaaattgaatcagctttagtttatgtatagtgagcttgctcattctgtcttttttccttaatacaggtgatcagtgggcatcttg

SEQ ID NO: 25363 - DNA, 201 bp, Bos taurus
ggtggagcttatataacaaagtagcctgtggccaagcgagtacctcacgaggcacatgcacagtgctgtaagtgatctcggttgttacctaattatttacaaaacttgcagcaaaagtgagaggccctggggcaagagcttgacctcgtcatcttggctaatttgctttttccctacagagagtttgatagggattgcaat

SEQ ID NO: 25364 - DNA, 201 bp, Bos taurus
gtcacttacagatgaagaaaaacatggccagagaatctgagtgaccttcccagaagcacacagaataacggtccaccccgagctcgttcagcccactggtacccgccagggcccctcccggtggtctattgaaccccccgtaggcccaggataggattcaggacccgtccccacagtttcaccatgtgccctctgtctcct

SEQ ID NO: 25365 - DNA, 201 bp, Bos taurus
aacagacatgccacattctctcctctcacgggggacccaacagacgcacccatgggcagcagtcatctcaccactctttttaggtggagctcatacaggcctaccacacaacgcagtccacggccaagcaagtgcctcgtgacacacatgcgcagtgctacaagtgatctcagctgttacataagcctcatgaaggcacag

SEQ ID NO: 25366 - DNA, 201 bp, Bos taurus
tgcgcaaccaacacaccgacaaccactctgtacccagacaacacctccggtttcactttcagtattcaataaactatataagatattcaacactttattacacaagtctttgtgacagatgattttgtccaactgtaggctaatgtttaaatgttctgagcccttataagataggcttggctacactatgatgcttggtgg

SEQ ID NO: 25367 - DNA, 201 bp, Bos taurus
tccaggctcagtccgccagcaggggcttccctcatctgtctgcaccctccttctgccggagcaagatacccttcctctctcccctgccacctccagcaggataagtgccccgcacctcgccactccgcctctcttcatcctctccctctcctgccagccaaatcagttgaaggggaccacaccaatggaaacaatcagctg

SEQ ID NO: 25368 - DNA, 201 bp, Bos taurus
tgaactcacgttctgcccaagcagaggggccctgagtgggtggtgtgtttcatactctgaaggggcggggttagggaaagtcagcctctacctcccactccgtaccctggcctgctacccacttggaacgacaagctttccgctcgagcctcttggactccccctaacgaagcctatcaacaggcccgcctactctcagtg

SEQ ID NO: 25369 - DNA, 201 bp, Bos taurus
agactagctaaataggaatgttgctacaatgctctttctttccaaatgtacgtgattcatttgtgaacagaaaagaatcaggtttcaaattaaattcctgatctctgggcctgcttctaagtttataagaggcagcaagattgttaaccaaagttaatgggacttcctggctagaaggttaaatttttacaagagtatggt

SEQ ID NO: 25370 - DNA, 201 bp, Bos taurus
cacatttctttgtaaacctagtgaccaaccgactctcaagctcaggtctatctggacaaacagctgaggaaggatcactcaacaccagttttagttcattctctctgaataaactgagtcttggcttagcaaacattacacacgactccttaacatatggacagcaaggactaaattttcagcagggaaagctttccagtc

SEQ ID NO: 25371 - DNA, 201 bp, Bos taurus
gtcatgatatgtctcccaaatatgggctgaattttgggccaagagaggaaactgatcaatggaatatttcttgccatatcagtaaacaaggatgtcacagtcattaccgattgcaaccctcttatgtgacccagtgagccctcagggaactcaggaaggagaagaatccctgccatctagcagctattagactgcagccac

SEQ ID NO: 25372 - DNA, 201 bp, Bos taurus
cttaggttgttggatcagtctgttataaaaagttatgagtgtgagagaatgattgatagctggtaattctttctgattttattggcaccagataaaaaggagcagtagtactgtgtcctgaagtctggaaccatgtccaaaaggcctgccgcctagttcccaaaagcgcctgagctttatgatgatgtctcttttcttact

SEQ ID NO: 25373 - DNA, 201 bp, Bos taurus
atgactcttgggttttccctttgcatgttttggatactcttttagataatttggctatggtgttgtatcacctcatttgcctcaaagagatttgccccaacgcttgattggaataagtggatgtgctgatggttttgagaatatgacaatcctgaagacatctttctggcttgactatttttcttacggcattgatgatat

SEQ ID NO: 25374 - DNA, 201 bp, Bos taurus
ctttcaattaattattactattcttttgacttaaccctctacttttgtctaggggaaaggaataacttcagtatgaaggattcctatccaagaacttggaagttctaagaaacattccttcaaataaatctgaaaatcagtagttctggagagcagtgataaccattgttattgacttcccagttatttgaatggctgagt

SEQ ID NO: 25375 - DNA, 201 bp, Bos taurus
ttagtcaggtccatgtcaggaacactcaagttttctagagagatgcgagactgaagtccatcaggaccaggcgtgggtcctccaactctccttattttatagaacaaaacccattggtttgcattcacggaaatattttttggaatattgaacaccactgaaaggttttttcccagtgcttctgtgcttggctaagtcctg

SEQ ID NO: 25376 - DNA, 201 bp, Bos taurus
aaatataagagcatttaacttgtgtgcaaacttattgagattatacaattcgtatttcctggcttatctgtggagggtgctttcaattggccagaggtggtaaacactaaccagattcagaaagctaggaaggaggaaaacagggtccctcatggctggggtgtgcttgagggacaagcacagaccctcaaggagggcctg

SEQ ID NO: 25377 - DNA, 201 bp, Bos taurus
aatgtgaggagcagggccaggtattttaatcaaccgtgtaatcaataaacatacattgattgaacaaccatttattccaaaatattaattaggtatctccatgagtcaggccccaggccaggcactgggaatatatcaatgagtaagacacagacctaatgtaaggggcacacagcatagttggaaaatcagaggaggaaa

SEQ ID NO: 25378 - DNA, 201 bp, Bos taurus
caagcctgtgtgcctggagcctgtgctccacatgaacagcagtcatcttaacgaggagcttacacactgcaactcaagggtggcccccatgcaccacaacaagagaaagccgctgagcaacagccaagacccagcgaagtcataaagaagtacattttttaaaagataccaaagggttttagttaattacaggggactggc

SEQ ID NO: 25379 - DNA, 201 bp, Bos taurus
agaaaagaaagatgacaactgcagatcaccagggcagctgcctcactggttcccattaggggctatgtagctatccaaaaagcaaaccttcttcttcaaggacggtgatgttcaatagtctctctcatggactcggaccaaagtcagtctgcatgaggaaaaatttaagtagttgtttatccaacttgtattgcctctttt

SEQ ID NO: 25380 - DNA, 201 bp, Bos taurus
cctgggtcctgctgccttttaatcagtctccctttgcaggagttgcttctgttcttttgatcactaaggtaaaattttttttgtttattcacttgaatttgtaataaatgaatttttcctttcccttttgacagctagctttcttagtctattgctttcattttgttatttagaaaataagatttgatactttctctttca

SEQ ID NO: 25381 - DNA, 201 bp, Bos taurus
taatgggcggaaaactacattaccatcatgtttttctcgacccggtagtgaagcccacgcgggtatgggtgtaaaggggcctgcttgtttggcagcgggtgtagagtaactggcattggtgcgaggggctggaaggagggctgagtaaacactgcaagtaacagtagagaaagatgccgtgggctttccttagacttgctt

SEQ ID NO: 25382 - DNA, 201 bp, Bos taurus
attaaatatgtattatatttgaattgcttatagagttagcataaacattgagaaaatattcctaattttttatatttataatattaccaagtaaattgacgtcaggggccaagaaaattcacacagtgcaaaagcatgttgcattatgcttatttgaaaggaaattgctctctgttttctacatagcaccagtattatttt

SEQ ID NO: 25383 - DNA, 201 bp, Bos taurus
ttctatcagcaaagcatatttggacattggaagttgctggttatactatgagctacgaatgttatttttaaaaggtggatatgccatacttcccttttcctgtagtcacagaaatagttttcatttctaatggggactttttagatttctttatttcaagctgttgcctgtcaatgtacaataaatttggctttgatattt

SEQ ID NO: 25384 - DNA, 201 bp, Bos taurus
cacacacgactgagcaactgaactgaattggactgtggcctaccaggctcctctgtccaaggggagtttccaggcaagaatactggagtggttttccatatgcttttccaggcctctagtctgtaggaacccattttcttaattcctgtaacctgaaggatcgtttttctcacgatattagctacttaaacttctgaaaga

SEQ ID NO: 25385 - DNA, 201 bp, Bos taurus
ggatatgtgtggcaaaagacctgatggtttactttcagacttcagtgaagcatagtgtggatttaggggggaacaggaatgttaggatttcacaaagaacatgaagtccagacagacaaaagatggcgtgggaatgatgataagtcacctcagaataggaaagaggttatgcagggagctgccatgaagtatattggaatt

SEQ ID NO: 25386 - DNA, 201 bp, Bos taurus
taaaatgagagatgtagaagataggaaaaaacattaaaaaatcataagaactttggtactacataagaagaattaaacattttacttaaagaaatttgctatgaaaggtcatttgtcccctttctgctttctagataaggtctcaagaaagagtatattttttgtatatttttactgtgtaatatgtatctctgatttatg

SEQ ID NO: 25387 - DNA, 201 bp, Bos taurus
gagggccctgggtatttgggatcgggaggatgagacaggtgctaggacacgagtgaagaaagaggagtgggaaaatggcaaagacacacttgcagctctgaaaggttgtgggccagttctttctctgtaataaaggccttaagtcaatagtactgggcactctggagaaatggttttgtatttttgtcttaaattcgtgtt

SEQ ID NO: 25388 - DNA, 201 bp, Bos taurus
gcagaaacacagggttatagagcagttatactcccagactgtatttttgctttgtattgactatgataattttctggtgggcagggccattatattttgtcaggtagatactttcattttttatactaaatgtctatgagtagcataataatcgctgtttttttgttttctttctggattaggaaatgaaggcccagaaag

SEQ ID NO: 25389 - DNA, 201 bp, Bos taurus
tttagacagaaaattgctatcctttggaaactatgtttcagaccaagttgtataagaaactttagtgtatgcgtattggggtgggaatatttaacctcagtgctcacctgcttcccaccagttctcgcatgctgtctggccatgtggtggaacattactgtcaatttccagcttgcacatttcctaagggaaattatggtg

SEQ ID NO: 25390 - DNA, 201 bp, Bos taurus
cacacactcctcctgaatgaactagtcttcctactgttagctgttcctaaaagtcctcctgttaggctcaccagccttccagtcagccaagggggcttgtctttcccattcaggaccccaggactgggatgcccataatgtctttcaaactgctcacacccccagcaagatctctccccatttaatctccctttttctctg

SEQ ID NO: 25391 - DNA, 201 bp, Bos taurus
tcagattttaactgccagcttgaacccataggtggaggccgtccatagtatctggtgtcaccattttacagacctggaaactgagactcagcctgtaaacatgatccgtctaaggccacagagctgaggaggatgaagaaacaaacccttgagctagagaagacgaaaactgaatgtcctggagaagtaggcagatgggtc

SEQ ID NO: 25392 - DNA, 201 bp, Bos taurus
acctgagccaatcctcagacccagaactcactggccaaagagaactgaggtcccctgaggacgttccctgcaataaatgccatggcaactgtgtacactactaatttcccacatcattgcaacgtgggtaccaatggatgctgccatcttgagtgtgggcaagtcctggaaggacgtgctccttttcattggaaatctgtg

SEQ ID NO: 25393 - DNA, 201 bp, Bos taurus
ttactcctcatggttttttaaaatgataaaagctgaaagattaaatagtcggcccagaccgcagagttggtatcctaactctcaactctgatttcaaagctcctgttgcccatttaaaaaaacaaacaaacttaattcttaaggaaaaaaccaccaattatgctgccctgtatctattcaggaaagttcacctggaggtta

SEQ ID NO: 25394 - DNA, 201 bp, Bos taurus
gccttagaaacaaatttaggtagaataaagattatcccataaacacccccacgctcactcatattccagtaacttcatgggaattcttgctaagggcggagtcacaactaggatgggagaagttgcacctgactgcagggtccttgcggccatgcagcaaaagggataatcctcattccactgcagcacagtaaggccaag

SEQ ID NO: 25395 - DNA, 201 bp, Bos taurus
tgactggacaaaatctggaacctgacatactgacccccttgagttcttctgaaaatcacaggtgttagtaagcacgtgaccaaaaccatctgcatgaggtcagcctcgagaaacgtcaggtgtgggtcctgctgtcctcttcccaaactggaaaggagtgtcagcttgaacactgggaagcagcaagggacggaggcagga

SEQ ID NO: 25396 - DNA, 201 bp, Bos taurus
tttcttaggcaggattggagacagaaggtggtttagtaagaaaatgtggtctatatgttctaatgatgaatatattcacagagcagcttcattctgtaacgtgccaatgagttgccagaatattacatatctataatccaatgtaaattcaacatttaaaaataagtagaagtaatttttcatatctagttgagcaaatga

SEQ ID NO: 25397 - DNA, 201 bp, Bos taurus
ttctgttttgtaaaaagttcatttgtatttttttttttagatttcatatgtaagtaatatcatacagtgtttggctgtctgacttactgccgggagccagcgtgaggaactccgcccatggcaaaggtcatgaggaaggaggctcggcatatgcaaagatgggatcgagcctcaggagtccccctggaaattctagagcac

SEQ ID NO: 25398 - DNA, 201 bp, Bos taurus
gggaaagatgagctggctaacttactccattccaaaagcttttgtaacaaaagttgaaatgaatgaaaatgattgagtttgtaggcctggtctgcagatatgaaaaactgctggagactgttgagtgtggaatggctttaatttacagcatggatttcggcccacgacacacctgcttttggttaacttttacagaagaga

SEQ ID NO: 25399 - DNA, 201 bp, Bos taurus
cctgcccaagatttacatgattgttttttttaacctgcctgctccttgccactctctccatcactcattccatctgtttgaacacatggctttggagcctgagttaggaaacactcactctccctcctgtctgtctcacttcctcacacccctgccatactcacaacactcttgacaccagatgagggggtggtttgcaca

SEQ ID NO: 25400 - DNA, 201 bp, Bos taurus
acacagccaaataaagaaataaatattaaaaggtaaagacttatttatgcaggattttttcttttaagaccaattctttacgatgcctgtgtcttctggagaactgtaaagagggagaggagaattcagtgctttactgtgaatgaaatacttttcagctcaagttcccaagagtgggatttatctgaaagtcagttataa

SEQ ID NO: 25401 - DNA, 201 bp, Bos taurus
tggcagcaaatcttgccagcggatctcagagaaaacagaagcaaaagagtttcctcaattcctgccaccaaatttcagacttgatcttatccacgtctgccgtttcctctgtcctcctgttccagtgggagacgtgtctccttcaaggctgcttctccaggctgctttctggatcacagtgcatcttatgtcctcaaggac

SEQ ID NO: 25402 - DNA, 201 bp, Bos taurus
agcccaatataaaatttcataatttatttcagattttcaggtaatcaaaaaaaatgacacttaaaccagcttttgattcagcaacaaaggaagaagaaatttatcgtaccacctcagtcttcaatacctgttacaggagtatgttacagataatacagatagagttgtaataaagatagggttataacaaaactatgacta

SEQ ID NO: 25403 - DNA, 201 bp, Bos taurus
gctgttaaagcatggagtgactgcttttctccccaaaacatttcccccaaatattgaactgacatgttttgcaaataataaaagtgaaatgcctttgaagtagtagcatagaaaatgtaatcatcctgtcccacaaagagaggaaaagaaactctgtccagtaggtgacctactaaatttctcaaaactgcattgatttaa

SEQ ID NO: 25404 - DNA, 201 bp, Bos taurus
ttatctgcccagaaaagcaaagcaccctttgagatgagcttggctattataaaccctggtgttttctactttcctagagaaaccccctccactaaatccaggtcaaactttggcaacaatcactgcataataaactatcaaaatgtgttttaaaaaatccctcatcaaaataactccaatgtaaatgatttaaaacaacat

SEQ ID NO: 25405 - DNA, 201 bp, Bos taurus
aaattagcattgctgtctctaattggtctaacttgtatcatgtgatgtttctgaactaatcaccatccctggtctggttgatcagacttgggtcacatgtctacccttagaataaatttcaccagaatcacaaaagattgaggatgagaaagagaaagaaatcagaggccatttccagaaaatattgtgattagatgtgga

SEQ ID NO: 25406 - DNA, 201 bp, Bos taurus
tagtgaaatggagaaaactgggtgtattaaatcataagtgtggcaagtgagcaagtggggtaagtcaggagggagcagaggagggccctagagcttgagccagtcccatgggtcctggttggtaagttggttcttggaagtgatagactttcagattctctcctaggagtcaggctatcttttaaaaggcctcccttctta

SEQ ID NO: 25407 - DNA, 201 bp, Bos taurus
aaaaacagaatttgctgacttttgactacccccagaatttgactcagcaatttgtggctttctcagtagatgaacaagagatctgattgagaaatcgagtatcactccctgataacttacaaaagccatacccccttcctctttcaacccgcctccctctttcccactgcaggaaggaaaggaacctgctttcatctaagg

SEQ ID NO: 25408 - DNA, 201 bp, Bos taurus
tggttctgagtacatggcagacgtttaaaaaaaaagagtatagaataaccaagtgactgatgaatgaaataacccagtttgatatttgtgtttatgaaggcgggaaagaaaacagtgttacggcattcccattgcttttttctcctctgttgccaagcagagtttgagtgtggtttgttggagtcacaaacaactcttctg

SEQ ID NO: 25409 - DNA, 201 bp, Bos taurus
atggtcagagtttttttttttctaatatacataactagcataccaaactgatggtgctataaatataattacttagggtgaggccacattttttaaagtcgatttaaagagaaattttaataagcaaaagtaataagatagcgaaagtcattataacttttttttttttaggccgcactgtgaggcatgttggatcttagt

SEQ ID NO: 25410 - DNA, 201 bp, Bos taurus
aaaaagaaatcatgtttctcttccacttgaacaaccaaaaaaccgtacaaaatatatgagaccataattttttcaccagagatgatccttgagacccagaagataaaaaggtgggccttgtgcttgcctccatttactgatttgtgagaaattccaggttgtgggtcaggaagggcaaacctatgtggagcctggcaaact

SEQ ID NO: 25411 - DNA, 201 bp, Bos taurus
cctgctgggctcatcccctcccaagtactgaagcgatttaatttgtgcttgtcttcaggatgtaactgcgaagcaaccacacatgtggtgtctagtaattgttcagcaacctttgctcagtggggcaaaggtgatgtggcgtactgagaactgtgcttggaatctattttagccgagtgatagagcttgctgaaggctttt

SEQ ID NO: 25412 - DNA, 201 bp, Bos taurus
agcccatggcttttcactggctgagtccttgccaggaaaggagaggagtctttcttcttcgttttggttctgttatggtcacagggtgtcagaactcccattctggtctcccaactctgtttaactgagatttctgtttattaattttttatgcttctaagaattgaagtctggttaagaggatgggagaattttggttaa

SEQ ID NO: 25413 - DNA, 201 bp, Bos taurus
cttgacttcacattccaagatgtctggctctaggtcagtgatcacaccatcatgattatctgacatgtatttgtaaattaaaccacattgagggattattgagaagggcttttgggccaactgttttgaaaggaagaagtctttttgcttaatcctatgacatgtgcaaagttatttttgtgaatttcacttattaaaatt

SEQ ID NO: 25414 - DNA, 201 bp, Bos taurus
caggccctcctgtctctagctgtacctctagttcagttgttgctgtgcactgcgcaaaacagagatgccaggcctttaggaataaggttggccattcagccgtccaggtctgaaaggcaacaaatctaagataacaggaagaggctagtcaggcagtgaaataaggcaggttcatttcggtcaacacagagagaacttctt

SEQ ID NO: 25415 - DNA, 201 bp, Bos taurus
ttcagactacatccatggtcctcattctacttcctgtttagctttgggccaaagactgcattcaaaacaggcaggtgacaaatatacccatagtgacctccaaacgactaaaatggtaaaaggggcacagagagtccaaggctcctgatcaccctccccagacactcaaccataggcccctgggctccaagaagggatctg

SEQ ID NO: 25416 - DNA, 201 bp, Bos taurus
ctcaagctcccatccacaccaggagagaggaaaaccccagaagaaacatgataccatttggctcaacttttttttcatcttccctgtagatactggatgcgttaccaggtctcttgactgcggagttcacactgacagtatttttaagatattgcctcattaggacatatttccttcagtctgcaaatgggacttgctttc

SEQ ID NO: 25417 - DNA, 201 bp, Bos taurus
atacagacactatttaaactgtgttacaaaagcaacaggtaccttaattggagataatcaaggatgcaatatgtggggttagcttatctcaattttgtgaagttgttggaaaaatgcttttcctgcaatctttctttattggaattttcctgaaattgcaatgggagctctgcaaaacctgttatttacaactgtgtatct

SEQ ID NO: 25418 - DNA, 201 bp, Bos taurus
tcctatatggccttataaacatagctcctgtaaaacgactgaaaggaacatgcatttacagcttgtcttcacaaggattagaaacttcttacgggaaggggttaggcctttccctctgctggctaccacacaaggcagatttacaaaagctccagagatacctctttattaattcactcaacagacacttggtgagcctcc

SEQ ID NO: 25419 - DNA, 201 bp, Bos taurus
gtggggttgcaaagagatggacatgaatgagcaactgaacaacaaatcatttaggaaaaaatgtatttcccataaaggagaattatttctgcagaagttttaaacttgctttagttactaagagactcttttaggagaatgttttataagtgtgtctaacttgacaaaataaaaaaagaaatgtacaaatctttagaggag

SEQ ID NO: 25420 - DNA, 201 bp, Bos taurus
gttcactgtgctaaatgattgtcccatttagcacttatttgctagcttgatttcttgtttctggactaattatttttctttaaaggggcactggcaaatagaagaggctgttagtctaaacatttactgtgggttctattatcttctctttctatttcactaacaacaaatacaacattgacttaaacaacagcaaacggc

SEQ ID NO: 25421 - DNA, 201 bp, Bos taurus
ggccagagaaataggcttgggaatgggcaaggctgaaatcagccccagaggctaagaattgggaagcccagcaattgtggtttatcagagccaggctggtggaagctggccactggtttggcactggagaccaactgtttactattttctctgcaccggatgcaaatatttcaccttgaatagcaaaacaaaaggcccttg

SEQ ID NO: 25422 - DNA, 201 bp, Bos taurus
ctgatagaacactgatgatatgtgaccctcatcctcaaggtgctcacgttcatggtacatgaatattaaaatacagttcaaagatgaggggcctttttttggggaggaatggatataaaaatggaatgaatgtggagcattgtacatttccttcatcttagaaaggaaattaaaaggccttcatcttagaaaggccttaaa

SEQ ID NO: 25423 - DNA, 201 bp, Bos taurus
taactaacacctaactgtattataaaagtatgaaacagcttccttggacggggtaatgggaaaaggtactgattaagcaactttgcaaatgagctgaattcataaaactaaagttaaaaaatatcatgtataagctctgcatgaagttgtttctcacctggggacaggttacagtttgggtgttgctttacaagtatactg

SEQ ID NO: 25424 - DNA, 201 bp, Bos taurus
agaagcacggtttccacacaggccattaaatgtgaccttacttgggcttgtacccttgctgttcttcttaattttcagttgctgaaggtggaaaatcacttactaacgtggtgccttctacggttttctgaggaattagcaagacctggactgggcagttttttaggaacattacacataaaaagcgttctagattttttg

SEQ ID NO: 25425 - DNA, 201 bp, Bos taurus
gaatcgtaggctttgtgataactgagaattatattcagaacttgaaacagcgatggaaaaaagagaccagttgttggccgtaaacaccttctgagtatgcatctctaaaaacagctactagggaaaaggtctgggacctgtgattccaggtctctggaggtgggtgagtgggcaggtgctggaggccctccagactaattt

SEQ ID NO: 25426 - DNA, 201 bp, Bos taurus
atggatgtggggccttgggcatggaagaaagggaaaggtttgtttaaagaacaaagggactgggcagcacaagatgcaagttagaaaatacaagaggaatgctttctattgaagaacatgtatgtgtcctgaggacccaggccatgctgaactactcacaaagacagaccagatagatggaagaagccacttctgaaccct

SEQ ID NO: 25427 - DNA, 201 bp, Bos taurus
ataaggccactagttttcctgattgcatttcaaaagggtggtccagaggtccctgaaaaagaccttcctgggctgtaaaactggccagaggctgggaggtttacacatcaaagaggcagagaaagaatgacaaggttctaaagtaaataaggaaaaagaggtccgggcctagcctcaggaagaaaacatctgaagtgtagt

SEQ ID NO: 25428 - DNA, 201 bp, Bos taurus
cccctttccttggaaaggaagctaagggtaagtaatcctctcctccctttcccctctgggccctccagcctgcttccagggccccccactgtgagaacccggctaaaagttggaggacaaggagcccctagatgtgttccagagcttagcccccagggccaggtgggaaagggtggaagaagaaataggacctggcacatt

SEQ ID NO: 25429 - DNA, 201 bp, Bos taurus
tggaggctagaaacaggaatagcggcacaggtgagttaaatttgaaaaatgtatagaacctcaattagtctctgtaaggaggaaagaaaatctgtgcaaaggaatatttgttgcaatacagaaaaaaagccttacatcttcttacatggaaatttttctttaaagaatccctcactcattaaattgttacaaaatggaacc

SEQ ID NO: 25430 - DNA, 201 bp, Bos taurus
gtggtcatcacgcctttttaataatgttagctgtgttgttgtgaataaagtccagtagtgtggagaaggctgtgtctgggacatggagacttacttcatccccagttctgcccccctggttctccagtgcctgcccagcttccccattcttatcctagcccaatgaccgtctcccattcccacccatacctaccaaggggc

SEQ ID NO: 25431 - DNA, 201 bp, Bos taurus
actagtcaacccaagatgtgtggaaattggtcaaagccctctgtggctctcttgatgcccagggtttcctttcccgttgcattcatgagtagtccacttgttctggggagtggcccaaatggaagtgcagcctgaggccagctgtgaggattgctgggagcatttgtttgtgtgacaacccactccagtattcttgcctgg

SEQ ID NO: 25432 - DNA, 201 bp, Bos taurus
ctggagtttcagctagggttaggttgaggtattgatgaaacatgaattggcagaagtttctttttttatggagactggctgatgatacatggggatctttcagactcttctggccactttatttgaaatttcctctgaaaatgtttttaaaaagaaattcctttcagtaccttgactataacacatgggtcagcaaattat

SEQ ID NO: 25433 - DNA, 201 bp, Bos taurus
ttccattaattctcgagccaggcttttatgactcaggggaggcctgggagagtacagcttttccacaaacaagaggtaagcagcagacacgatggggaggggtctgtcccaggaaggccaatagggtcctccttggttacacgggtactaagatcttgggcaccaagcagcacatggctcctctactcatgttctattggt

SEQ ID NO: 25434 - DNA, 201 bp, Bos taurus
agggctgcattcattggtctagagtgtgactcacagctaactcagcttgtcggttcagttcaggtccatatggttggaggactgagatccttgtgtatttgatggccatccccctgcactggtctctactgttagaagctgcccacatttgtgctcatattttccatgtggcctcctccaatagccaacttgcatgcaggg

SEQ ID NO: 25435 - DNA, 201 bp, Bos taurus
aaaggtgcaaatagaataaatggttattgttaaagtagaaaacaaattaatagagaaggagtaataaagcttacatgcgcaaatcagggcaatagattcataatgtgcaaaggaatttctcatgacattccagcctctgagtcagagaaatactgaaaggggtaagcctggagatttggaaaaagaatttctgaaggctat

SEQ ID NO: 25436 - DNA, 201 bp, Bos taurus
ttatgctggagtaacagggaacctgttttctatctgtatcttccctttggcaatatgaatgtctgacctttggccttttttaaaagaaaattttttggccgtgccacagggctcttagctctctgaccaggaatcaaatcagctccccctgcactggaagtgcagagctaaccactggaccaccagggagtgcctggcctt

SEQ ID NO: 25437 - DNA, 201 bp, Bos taurus
cagggaattccctgccatttccaagaacacaaaggaagtagtaccttaggagttggtccagagtactttattgagctggttatactctgacagtcctgcccgtttcccaccagtgagtgcgtattttacacttgtgttctcactggggcactaaacagcttcagatgttcccccagcagttggtgtcttggccttggtacc

SEQ ID NO: 25438 - DNA, 201 bp, Bos taurus
gtagcaggcattatgtcgggctgccagaattaaataggaaaaaaaattttaattctaattgtgctacactctgtggcctggtccatgcacttgaaagtgatatgtgcccaaggaaagatgaaggcatcaggtattgagccaacaatgattccagaaagcaccctaaatcataaagaataatgacttggaaggcttaaaggc

SEQ ID NO: 25439 - DNA, 201 bp, Bos taurus
tccagggcgaatgcctgatctccagtgccattaggtataaaggtgtcctgggaacaatcatcactctggcaaaaacagaagggccagtgaaactctacagcgggctgcctgctggtctccagagacaaataagcttcgcctctcttaggatcggcctctatgatactgtccaggagttcttcaccacagggaaagaaggta

SEQ ID NO: 25440 - DNA, 201 bp, Bos taurus
gttgctgtctgaagcatgtgttctccctcactgggcatttgcgtcttgcacaattgacgtggtaagataaaactttcacattttgagtgaggggtgttctcattgcctctgtatagctgtctgtatacaactcacagatgatgtccattaagttgatcctggatatttgggttcatgttaaaacatcgactggaaaagaat

SEQ ID NO: 25441 - DNA, 201 bp, Bos taurus
tatcttgaatcctattttgctatggaggcctcagaataaggatttcagcctgaaggcagccccacaaactgaatccccatggacgcagcctcaagaaagctatgaaaggcccatgctttgggcatcgatctatgggctacctggtttctacaggtagatgtcaaaaactggagactctgagatttcaccttattcgcaagt

SEQ ID NO: 25442 - DNA, 201 bp, Bos taurus
tgtcttttcccttccctcgctctctccagggggccgcatgtgtgctggggaaagtgatcaagacctcctgtcctgcgctgccggccacagccggactccttctgctgcctctcaatccagcagaaactcctctctgtggggaagcagccaaggaaacgaccacgctgagtgccaactctgggccaagtaccctggtgggca

SEQ ID NO: 25443 - DNA, 201 bp, Bos taurus
ctatcagagggcattaaacaggacacgtgtataagtgaaagctccccttgttcttcaccaagcactgtctgattgccagtccaccttcagggagaacatattctgatcatgctagcatcacttcacaaaccgtatatcactaaactcggattcaagagatgcaagaaacacaaggttcgatccctgggtcagggagatccc

SEQ ID NO: 25444 - DNA, 201 bp, Bos taurus
gagttactatcactaaaataggaagtttttatccttctccaaaattacaggatgttaaaagtatatgacattaaatggataaaatgtctccttcatctgattcctacctgtaatttttttaaagcctgttgcccttggtacttgtatctaatagagcacacagttacatatttggttttaaagtgtaatatatttgattca

SEQ ID NO: 25445 - DNA, 201 bp, Bos taurus
atcaagtagactattaccagacgaggagacagcatcaggtgtgttagaagagtttgagatcagcagtaaacaaacccatgaaaaaatgaccgctacctacagctctctgagcttttattttggcatttagtcctggaaaagaaaaaagccttcatttctctctgctcttggctggtctcccttgggaccaataactagcat

SEQ ID NO: 25446 - DNA, 201 bp, Bos taurus
gcaaaagcttctaggggttcaatatttcagtggggcttgggaaagaccaaaatagtcttattaaaaaaaacacataagagtatttcccacattcaggtatcagagtaagtatttgcacaacagtggaatgtccagggtcttgattatagaagagaaaagtatccgagagcccttcactttgggacattgtgtcccagcgta

SEQ ID NO: 25447 - DNA, 201 bp, Bos taurus
tctctcatggtcctactttaaattttttctttcagaagtcatgtcttagtggaacttctccaggcttctagcaaacagtccaaccaaggcctcagtctgtcacctcttgaagctccagtctactcgtacagctcactcttctggttctgtttttttctttcattattcgcaattaggttagaacctttactacacagttca

SEQ ID NO: 25448 - DNA, 201 bp, Bos taurus
gggacagaggaccctggtggactacagtccatggggtcgcaaacagtcagatgcgactgagtgactaacactttcactttcacttcacagtatgctttgcgatgatgaggattatattaataattttctagctgttccatatgccacgagaaggtaaaaaggctgtcccttagaagcatgattcagcagctgctatagaac

SEQ ID NO: 25449 - DNA, 201 bp, Bos taurus
aaataacagtgactatagtcggatgtgaaaagagtcagaaactcagaataaccagggttcaggggctagtaagattgttgggttggattcaaggttggatgttacaggtggtgatccaagtagacacagggagtgtggaatggaggtcctgctgttggggtgccgaaaattaggcagaaggcattaccaactttcatgtaa

SEQ ID NO: 25450 - DNA, 201 bp, Bos taurus
aagagtcattcttctcttattcttgacttaaatggaaatgctgttacaatttttctagtaagtgtggtggtgtttgtgtagattcttaaaatttacaatagggataatatctttttattttgtataattgttacaagggtcaaatgctctaatagattaaaatgttatgtaaatgttaaaagctatgccacagttacctgg

SEQ ID NO: 25451 - DNA, 201 bp, Bos taurus
tatcatgctgtatgttggcagaaatataggtgttttgtagcttgcacttaaatggctcactttgtaaaataggaaaaatgaatgaccagcagatgtgacataagccttaaaaaattctactcagcagtcaactttagctacaaaatttgacaagcttgggcaatactaggttttagacagtgagtctataatttgcacata

SEQ ID NO: 25452 - DNA, 201 bp, Bos taurus
tatccataatacttcagttctggcctcagtcaaaactatttcactcataatgcccttaagaggaatatttgtaagagagagacagaataagatgttgttcactagagtgttttctgaaatcctaatgaaagacttgaaaaagcaagattgggcagtacaaagtttgtaaccaagtatcaaagttaatcacactcttctgcc

SEQ ID NO: 25453 - DNA, 201 bp, Bos taurus
aaacacttgctggggccggagcatgtatgtaagaaagtcagtcctgtgattaggttgaagcaggtgctggtcaaaagatatacagagagcaagagaatagtcctcttgggtggcctggacatacagcctgtatgtgtgtgtgtgtgtgtgtgtgtgtttagtgaaagtcactcattcacgtctgactctttgtgacctcat

SEQ ID NO: 25454 - DNA, 201 bp, Bos taurus
ttttacagaagcattggaaacatcgaggggaaaaataatccatatccaagaggtttatttttctgaggactagtctctggcctctccatattgaaaagaatcacctatgatcatcctgccaccgggtgactggctggtttccttggacatagagccctgttagtgagtcggtgttggcctttgctgttgactggtggatgc

SEQ ID NO: 25455 - DNA, 201 bp, Bos taurus
ctttactactaataagagtctgagtctctgggtctgttggtcaagtagactcaattatggaataaaaacactgaatcacccagacaatggtgtcataatatgcctcttattgtttagttaataatgctaaatggtttctttagttatccaaggatagttcctcattgtttaatatcttttatgttataaagcaacagtaca

SEQ ID NO: 25456 - DNA, 201 bp, Bos taurus
tgggcctcctgcactgacaggcagattctttaccactgagccatcagggaagctccaatcctagtccatggaaaaactgtcttccatgaaaccagtccctgctaccaaaaaggttggggccactgagttacaagtcaatagttagaatagcaggagggtgagatggctacttgaactagcatgatgtcagtggaaagaaaa

SEQ ID NO: 25457 - DNA, 201 bp, Bos taurus
tgtgattggtcagtggccaggtacctaagtatgacccatgtgagaaaggcaatccatcatatttcagggcattgataagaccagagattgtagcataattgaccaatggcctaggaccagtaaaaatattctcttggtattcacagtgttagcagctggtaatgattaaggcaccttcaaaagccattatgccttgtacat

SEQ ID NO: 25458 - DNA, 201 bp, Bos taurus
ctgttcactatatatacattattgaacagatataaaaaaaacagtcctcttctgtttgcaaaatgtgcagaactctgaagaccatcttactcactagtgtattgtttgtgttgaataattaatagaagttttacctttcatatatccagttctaaaagtttactatttctttactttgccttgtgttacactagtggttct

SEQ ID NO: 25459 - DNA, 201 bp, Bos taurus
aaaaaaaaaaacaatccttaagtgtgccatgctctgaatacaattaagtgaatgctggttagaaaatcatgatcacatatgggaccaaatagctgaatttcagtgaactattttcattaactttcaggctgtaactatggcattggctagctatgccatgtgattccattgcaaatatgtctggaggaagagaccttgatg

SEQ ID NO: 25460 - DNA, 201 bp, Bos taurus
caaatcttacagtaataggaggagtaggtcactagaatgtgtcagtagggggtgctcatgtatagggtaccactgtgacttccgcaaacatcatctgactgggggaagggcacaccagaagcaccaattctgagaaatacatgtttgaagaaaaattcagaacccattactgaaaatacgccaaacagaagaatcattatt

SEQ ID NO: 25461 - DNA, 201 bp, Bos taurus
ttggaagtgacagtgtagttaccatagtgactaaaatgctcaggtgtgggctataaaatataaaaaacacgagtagcctgagtttcagagatgcaggggagtatggaacttataatggatataaatgaaatatatatctctgttgacaattccaataatcgaagtttgcaatctccagtgtaatacttctttctttaaatt

SEQ ID NO: 25462 - DNA, 201 bp, Bos taurus
tcttctgataggcatttatgtgatacataaatattttcaccttctcctaagaaaataatccatatacttctctagagtttttagggccaactttcatcaatatcatcaaatctaaatatttcctgttagccactctctgtgaggcaatgtagatccataaattaggccatctgtcttttcacaagaaaaggataaccaaac

SEQ ID NO: 25463 - DNA, 201 bp, Bos taurus
tttaaaaattatttcctgcttaatttgaaaattaaagaaatacttctctaggtaacaaaaattatagtaaaaagaagatatttggagttttaaagtgtttgcaaatggagaagaattaagtgcatttaaataaaataattcttatgcatgttttaaaatacaactgtttaaaatatatatttattctgcaaaaattgttgc

SEQ ID NO: 25464 - DNA, 201 bp, Bos taurus
ttctttgtttgccctctgctcggttcttttagttgccgtttcctctaactgcctttttggacccccttttccctactctaactatctaacaaaatgttacggggagaagtgcctaaaattctaattaattggtttgcctagtagtctattatagaaggaatgttgaattaagaacatgcccttcaaagaaaaaaaggaaaa

SEQ ID NO: 25465 - DNA, 201 bp, Bos taurus
cctttttatagaataaataaacatttgtctattttctagaacaggggtctgcaaattatgacccatggttcaaagttggcctgtggactctactttaattgtacatttgattaactaggaatagttttcatatatttaagagttgttaaataaagtcaaagaagaatgtgtgacaggattatatatggcctccaaaaccta

SEQ ID NO: 25466 - DNA, 201 bp, Bos taurus
atactagcactccttttatattcttttcttttttgttttctcttcttaccaatcagattttgtttgcattatttcactagcatcttaaacctaagactctctttgtggtcttgaatcttgcactaatgtacttccttctactaaccaccctccttaaactatgaagaagagaatgaggacagcctgagagaaaggatctaa

SEQ ID NO: 25467 - DNA, 201 bp, Bos taurus
tccttcatggccatttccacagtaccttttttacacaacaattcccatcttgacatttgtttttagaagtaaccaaattgatacaatcggtataattgataagtctctggccaaactgttgaagaaaatacaaggcacaaaaaacaaatatcaagaatgagagtggacatggtcacagatcttaaagacttcaaaaggata

SEQ ID NO: 25468 - DNA, 201 bp, Bos taurus
tcttttcctcttaataaatactttactttcttcactactttttgtctttatggaaattcttttcttcaaagcccaagagccagggcctttaccactgaccgctggtctagtggctaaacattggtgcttttaccactgcgacccaacctcaatctccagctgggaacccgggccctgctctaagccactgcaagctgcggc

SEQ ID NO: 25469 - DNA, 201 bp, Bos taurus
acaagggaacctaagagttcaggaatgatctttttgttaccacgctgcctttgtctctaagtctttagacaccaccagcattaggacaaagcacctcaccctgaggaaactcagagtcagcaggagatagagtgctcacaatgggctgtgcataggtgcattttagctacacaggcagatttaatcttaaaattccctgcc

SEQ ID NO: 25470 - DNA, 201 bp, Bos taurus
gtctcacagaggcacagaagaaggccatggctgaagactgcctgggaatgcaaaggtgtgtaacagcaggactacacagatgggcctgagtccttgactgaagctcccttctgagcctgcaaagcactgattgcaccccaagcctggtatggggaggggacagatttgccctaatgaggcccgccagttatttaaagtcaa

SEQ ID NO: 25471 - DNA, 201 bp, Bos taurus
aacctctaggtctttaattactgtaaagttgtaacagcccaggaagatatcctctgtggaagtcagagacaagatacacccagaatattgcagaacacttggaacctcaagggtctctcagaatcttctgaggctcatcaggttctggaagatgcatttatgaagaccattgttatgatactttccgtataacaagtgggc

SEQ ID NO: 25472 - DNA, 201 bp, Bos taurus
acagaatttttttaaaaaacagaaaattagatactcctggacccagttctaaactataagagaaaaatacactggatctgggaacagggtggcaggattattctaatcagaataactgaagaaaaaggcaccttgtacactgttgggaaatgtccactagaaatatgatattgaaaagaggaaagaagctgactgtagtat

SEQ ID NO: 25473 - DNA, 201 bp, Bos taurus
tgaatatatatgattctctcacatgacatttagcaacatccaatcctatgacacaacacaatcttaaatattatcttgtatgtgcttattagctcagtcacgtcccactcatccgttttctggtatatatagtttaaatgaattttaattacaataaaaagtacagcagttatttctttcctagaagtaagagaaacacta

SEQ ID NO: 25474 - DNA, 201 bp, Bos taurus
ggctaatttaaataagtttattggtccctggggcacagggtctgtctcctgttgtcccgtatttgacccttctggtgattacagcagtggtatcctggccggagtatgaaactgcagtaatggaggaggttaaagtatagattaaataaactgctcaagggcatggactggcctcaggccaggaccttaaaattaatactt

SEQ ID NO: 25475 - DNA, 201 bp, Bos taurus
gtcatggtttttggtgatagaagaaaaatgatatgggattctgttcagaacatcttcattgaaagaaatgtcttggccatttatcaagagagtgcaaataaatatagattcatatggtctaaataaaaaataagatatttaattattttttactaagaaaccaactattaatacaaattatattagataaaggaaacatag

SEQ ID NO: 25476 - DNA, 201 bp, Bos taurus
caacttcagagaagattataccatgaatctatgaaacaaccaaacaatgcaattttattgtcttaaagatatttttcttattaaataatactgaatgaacctgaacctctactcaattatccacttttatttctctcatcatttccctcttccatatctgaggaggtgaaatccactcctaccatatactttcagccaaaa

SEQ ID NO: 25477 - DNA, 201 bp, Bos taurus
atgaatttcagcagaaaatcatattagcctattatagctcctaataaatgatgtcataaaatcaaatccatggctatactgtggatctaaaaatcaaaacgataggttatagaatataacataatagggtatgtccatggcctcagaatttttttaaaaaaggtctataagaaaaagcccaacagaaacatgtgtaagaga

SEQ ID NO: 25478 - DNA, 201 bp, Bos taurus
tatttatcccattactgtataagccagcattaagatttatgataggtgaaagcacagatgatggcattaggctctcatgattcgatccaattggtcaggtgttagaacacactcaagctagagttgttttgagaaaattaaatgggatcaccacttcaaacccaataggatgttgacccaaaatatgctggtggcacctgt

SEQ ID NO: 25479 - DNA, 201 bp, Bos taurus
tctgaaacacacatatctaaaacacaaaaaactttctatcgtatgtatcagaacagtgataccattactttttgaaatgtttaatgattttttttcagccatgtaatatttttaagatgatgcaactaagaattattatagaccataagtaagaatgttatcttctatgtgtgacaatatattcttttttatacaggctat

SEQ ID NO: 25480 - DNA, 201 bp, Bos taurus
caaaaatttgattcaaattcttgataattttgtggaaatgtgtgtgtttcactgttactgaactcagacccagttgcttgctgctcaaaggtcaatgtgagtgttggttagaaaggaaaggtttatttattcaggaggccggtaacctggggaaaaggtgggactcatgtccaaaagacagctccccactgctgatcaggg

SEQ ID NO: 25481 - DNA, 201 bp, Bos taurus
tggaatatcaattttgctagtctttaaaaattctgaaaaaaaagatcacagagttttagctgagtagttaaaataaactaattgattctttaaacaaaaactgatttaccgcctatcacctttcaaagaaatggaagcctggggagagagcaatggacaaaggagacagaaattcctatctactttaaagatgaagagatt

SEQ ID NO: 25482 - DNA, 201 bp, Bos taurus
aattcagtgtgttccctccccttaaagcagacccactgaagtgtttaaaaaagagatcctactctcacaaattaaatcctcatctttctagggaagagagattgatggtcaaatatttttcagtaacttcttgaaaaatttgtttaaaaatggccttcatattgagagattattgatgatttattaaaagttcacatgctt

SEQ ID NO: 25483 - DNA, 201 bp, Bos taurus
cgggatattcaaagtagtttcaatatggcctaaaatatctgcttacatgggttaccttgaaaacaactggattgtaaaaatctgagtttggcactggaaggctcccaagaaaatgggccccagccaactacaaagtaaacacagtggcagtatacagggatcaccactgactcatttatgtaacaggtggatcatgtttcc

SEQ ID NO: 25484 - DNA, 201 bp, Bos taurus
gaatttgggattagtagacagaaactagtatatataaaatagataaacaaggtcctactgtatagcaccagagaactgtgttaaatatcctgtagcaaaccataatgtaaaagaaaaaaagaaaaagaaaataactgaggctattggttcagttcagttgctcagtcctgtccgattctttgtgactccatggattgcagc

SEQ ID NO: 25485 - DNA, 201 bp, Bos taurus
acagacattacaagaaattcaacaataaatagtgtcttgtccttgttcctgaattatctctattttgctggaatggctaaattcatgcctcacttagattgtagtattatgaatatcacttcagttcagttcattcgctcagtcgtgtccgactctttgcgacccctgaatctcagcacgccaggcttccctgcccatcac

SEQ ID NO: 25486 - DNA, 201 bp, Bos taurus
tgtgggagacgtgatgaagaggcaggcccgtgagacctttcacgttcagggaacagcagtggagtcacagcaggaatcatcagacgactggagtcaggaaaacgagaaatggccacagctacatgtacaagtacaaagtctaagggcaaaactaaaatccatgggactttaaacaaccatctagagtaatctgaagggtgc

SEQ ID NO: 25487 - DNA, 201 bp, Bos taurus
aacatgaagtaggaaaatatgaattttagaatgccttctagttttatataaacttttattcaaatagagattaatctcactattcaggagtaatgatcacgttgacactgtgaccaaactaaaagggcactcagaggtagataacattttcctttctaaatgtcttttcttcatgattacatcagaaacttcacatttcat

SEQ ID NO: 25488 - DNA, 201 bp, Bos taurus
agcacaccttctgaatattttagtagtgttctcctccacagaatccccccctcccctgtgttgtaatgcatattcaagttaaatcagatcatcaataccagagtccttgagcataattgataggatagcatggaagtaatgctcatacaatacaaatttactggttaaatagagggcactgaaagataacatacccacatc

SEQ ID NO: 25489 - DNA, 201 bp, Bos taurus
acttggatagccagcttgacagttttgatgggccattattgtagcttaaatttcatttttggaagatttcatttgacatttcagacttattatgctacctggaaagctggagttccatagggctctgcctttgatctcaggtcatcatcaattaatgccaatgatccacagcatccccctcatataaacgtgaactcaaaa

SEQ ID NO: 25490 - DNA, 201 bp, Bos taurus
aaacacaatctaaatatgataaagatcagagggtcttagatattgaaaagtgagagtaagaaaaacttttgaaagaaatgaaagtgaatgttacagctccaaaggagcagacctaaggaaatccatggcctgcgccatcaggacagaatggaagagtaattcaaacaagagatggatacactacagccatcgtctgttcta

SEQ ID NO: 25491 - DNA, 201 bp, Bos taurus
ttttttttttccttatccaagctactactctggagtccagaatcactccactattactgttgctacagaaactcccagaaaattccaggtactgccaataattgcaatgtcattgaagcccaaaacaggaagttttttccaatttatagccttttgattctctaacaatatcccctacgatagacataggagcaagccagc

SEQ ID NO: 25492 - DNA, 201 bp, Bos taurus
ccaaagcaatttttgcccacatcctttatcagtagaaaccataatgaatcgtgttagtagccagcatttattgaaaatttcatcttagaatgttggccagatgtcattatagcagaattaagtgcagcctgagagccttgctataatgtacagaatctctcttcatcactgttctggagttgttttgggtctgcctccaaa

SEQ ID NO: 25493 - DNA, 201 bp, Bos taurus
taaataactgtgctccctgttgctggtattttatcaagctctgtttgttataactgcgcattatgttccatacaagacagcgtctttgagctctcttttcgtattttcctactacagtttaactccgtgaggagcaataccaatgtgccaccaggatggagaagaaatagcaggacccgctgctattaaatactcccacct

SEQ ID NO: 25494 - DNA, 201 bp, Bos taurus
ctttgtagggcaggtcatgagcaatggagtggcaatttttataagcttctccatatcaaggataaggttagagtgcataaaggggaaagaaggatgaaagtaaggagacatatttcagtcagcagagaacttttctctcggtttccttggtttctaaaccaaatgacctggaaactgaaattgaagtttgtttcagttttc

SEQ ID NO: 25495 - DNA, 201 bp, Bos taurus
gaagcatacatttagaacctgactggataagagaaaagtaatggaaacagggagataaatataggttgtagtagtcagaaaatgcctcctaagacttgagctgcacaagaaaagaaaatatatatgttgaatataactatcttggatagtttattctggatgtttgttttgtctacttcaatttcaagatttttgagaaca

SEQ ID NO: 25496 - DNA, 201 bp, Bos taurus
cagtattcttgcctggaaaattccctggacagaggggcctggtggactctggtccatggagttgcaaggagttggttacagttgagtgactgagtgcacacacacatctaaagatctttgccttactcaaggctgcaaagcttctcttctatgtagtcttctagaacttttatactcaaatctatgaagcattttgagtta

SEQ ID NO: 25497 - DNA, 201 bp, Bos taurus
tcttaagaagctagatcatttggacctgcgtcttagccaactgtccaaggtcagcaaaatgctatggcatgttctgtttgatggccccaggcaggaagccatggcattctcactattaatatctcttgacctttcgacttacaaatagaagcatccctgtggccatttttttttcctgtatatccctgaaaaaccaaggat

SEQ ID NO: 25498 - DNA, 201 bp, Bos taurus
atcaagtataagctgcagctctttcccacatgaagctcactcagtgttttcattttccaggattgactcactctcagaagatgaaaggtggccgggggtgggggggtggcggtgggggagtggtctgaaatgatctaaaataactgcagtgtacaaagcagctgattaaattattttgaagggctgatgaatgctttcaaa

SEQ ID NO: 25499 - DNA, 201 bp, Bos taurus
aaatagttattgctaaagagtttcagacagaatatttagagatctagaagtaaaattgacagagagctatatttatagcagtgccctacctctttagccaacgtctgctggaaaactgcacgaatggagagacaacactgatggaaattctttatcagttgagggtggatcgagccactcagctgtgccacctcttcatgg

SEQ ID NO: 25500 - DNA, 201 bp, Bos taurus
actgtaaatatgcaaaatccaaaccatgatactgtcaaaagtctgagcagaggacaagctgatctcagccacctctgtactggtcgcatcttagaggaaatggtattgacagcctttctgattaatctaggtgggctgtcctggtgcctttctgcaatcttcacaccaaatgaacacaggtagctattaaaccagtgcagc

SEQ ID NO: 25501 - DNA, 201 bp, Bos taurus
accccaacaggttctggaacttcaggggcttcttctaatcagcactgtttccagtctgtctcttacattacaaattagtgtgaaattaggtgggtggctgcgaccggcgcacttaggtgtggcagagaggagctaccccacgtctgatgtcaggggcagaagccaggaggaccccatgcccgaagggcggcagccaagagg

SEQ ID NO: 25502 - DNA, 201 bp, Bos taurus
ggtcattcccactttaaatgaagaatgacactattgtacatgcagtaaagtaggaggaggatcactccttaccagctctgtatagatataaagctgtaaatgtaacgtgtgaactactcaaagcacaaattttcctcaaactcatagtcactattcataaatatgagggagttgctgtcacttacagactggttctgcgta

SEQ ID NO: 25503 - DNA, 201 bp, Bos taurus
ataaatggatctctgttctgtggaaacaaacagttagagctcttgctccaaaatgactactgtgtgatacatgatgatacattgcgcatggtgtggcatagcagatgattgttacaagtcttagtgtgctgagaagagcttcagagtatacatgcaacatttcctctgaaaacacacaaatctttaatttttgtgagctag

SEQ ID NO: 25504 - DNA, 201 bp, Bos taurus
tagtatctccataattacttttgaaattactagccacctgtcagcgcagggattactactatgaagaatgtcaaatgggaattaaagttttgtattaggtcaccagcattctaccatagacatattgtagatggataggactgtttcagcacacagttttattagatacaataaatttggaggcgacatactctcctgtta

SEQ ID NO: 25505 - DNA, 201 bp, Bos taurus
agcctggtaggctacagtccatggggttgcaaagagtcggacatgattgagactaacactttcttacttaatcttctcaagaacaaatgatgtaggtactatatttttaggctcaattttcaaatgtaaaactgaggatcagagaggttaagaaaattttccaaggtcacataggtggtgaagtgggaaatttgggaatca

SEQ ID NO: 25506 - DNA, 201 bp, Bos taurus
attaggagggaaaacgcatgctctgggccacctttgttttttccatagtttcctttgtgctttcgctatttcttcctgtagagttctctttcagtctcttcgatggccatgggatttttgtgtggttctttatggctaactcactgtgtttgaaaaacttatgtccattcctgaccttggtcttatttactccatttctct

SEQ ID NO: 25507 - DNA, 201 bp, Bos taurus
catgacatagtcataagtgtaatatgcaatcagataacttatcccaggtctatacatggtagagctgctaaatagaacagttaaatgctttgactgaatgtgcaggtgctttcactgatatgccacaaaaatcaaattaattaacatatatgacacatatgtatctaaagtagtatacactaagttatgactgatgataga

SEQ ID NO: 25508 - DNA, 201 bp, Bos taurus
aaagtggcaggaagttagttttgaagaatcactcagcaaaacaacagtaacagtgactataatgatgatgatgacaaactaactccatcagaataatgtgtcaggttcaatggatttaagctgtaaagagagacttaacatgctgaatgggaagaatggcaaggactagacactaggctggggtctagatttatatcccta

SEQ ID NO: 25509 - DNA, 201 bp, Bos taurus
ttagcaagaaaggaaactcaggtttagaagtacaaaggaaatggtagaagaatggagagttatttggagacaaaccttatgaaattcagtgaatgagagcataagtttcaatttatgatatggaaggaattgaggcatacctaaatgttgtttataagggcaaagactaagggattgagagaaggatactaggaattaaga

SEQ ID NO: 25510 - DNA, 201 bp, Bos taurus
tattatggttaccaaagaggaaatattggagggagggataaatcaggagtttgggattaacatacatgaactactatgtaaaagataaaaaaaaaacacaataagagcctaccatatagcacagggatctctactcaacattctatgatgacctatatgagaaaagaatctcaaaaagaatgggtgtatgtctacgtataa

SEQ ID NO: 25511 - DNA, 201 bp, Bos taurus
accaacaacctgcttgtcccaagctggcagaaagttctcacatgaggatcccatttttttagctaagccaattaatacctaagagttaggtgccactgggttggggattttgtgatgttgtacaatgtacctcagcaactaaacaacaacactgtgctatttttattcctttcataaaatttctgtatagtgcagacaccc

SEQ ID NO: 25512 - DNA, 201 bp, Bos taurus
atatccatctttttgtattcctttcccacataagtcatcacagagtattgagaaaattccctgtggtatacagtaggtccttattagttatctgttttgtagacagtactgtgtatatatcaatttcaatctcccaatttattcctcagccctttcccatcctggtaaccataagtttgttttctttatctgtgactttat

SEQ ID NO: 25513 - DNA, 201 bp, Bos taurus
tattttacatattatagtgtaaaataattaaacatacttgttacatttatagtgtactgacataaaaaataactgaaacacacataaattcagaacacatctatctttgtaacactgaagacttaatatattgacttcccatgacaaatgcttcacaattttcctggaatttttttcatattaagatttctttatgtttaa

SEQ ID NO: 25514 - DNA, 201 bp, Bos taurus
ttgggaaatattcatttttttcttcaaagctcccacccacaccccccccatccccaaccagccttgtaatcttaccatacattaggcagggttcttgaaaatttaaatcagattaaagcacatcttgttcaaaatccttcagttagtataaaatccagaattcttcccatgccctgaaagcccattcccgtttttcccatt

SEQ ID NO: 25515 - DNA, 201 bp, Bos taurus
ctatagttattagaatatatagagacaggataagatttcatagtctggaattttgttttattcttcctcggctatttgaaccatatttctaggcaatgtccatttaaattatgcatcttgaatgttgagctcctttagaaacaaatgaattggtggaatgacattaataatcagagtttgagtgctaggaattgattttcg

SEQ ID NO: 25516 - DNA, 201 bp, Bos taurus
aacgaaagcacagaaagcagaaagagattttttggttacatttatcatctttgtccttgcacactcttacttagatgggtaaggccccagccccatttttactaatattgtggagaaaaaaaaaattttttttatttcaatgtcttatctggaagctgtcattggccaatgtccactagctaaaatctcccttctatggtg

SEQ ID NO: 25517 - DNA, 201 bp, Bos taurus
agctgtaacactggtctgttgtttcaaatccttgctgtgatgagacaaaatagactggaatagagttagaaaatagaaatagaaatctatgcatttgcaagaagtaatatcaaagttcttagaatcccagatatcatcaagttcatctcccagtcaaaagcaaggcattgaactgtcaggtcatttatctaaggaaaagca

SEQ ID NO: 25518 - DNA, 201 bp, Bos taurus
gtgctatctttatgatttctaacttggtatcatagcttgaaaagtcttttgaacatgaaattataaaaatattcttcagggtcttcacttttgtatatgccaatatctactacataaattttagttatcctcaatttatataaacagaaataaaattaaatattcaacactatttcctgaatattctgtcaccttcaacca

SEQ ID NO: 25519 - DNA, 201 bp, Bos taurus
ctggaattgaaaaattagcaactgtactgagaacagaatagcaagcaagaagcttaaataggaaatcatgggaagagcgttttagcagcaaaagcatttcctgaataatattaaactttggaaagaatttgaaagatatctcttctaacagattcttatcagatttgacacaatgtagccatacttctgtaaggaactaga

SEQ ID NO: 25520 - DNA, 201 bp, Bos taurus
ggtattcaggccctcagtagactggatgatgcccagcgcttggtggggatgatctcctttactccgttgacaacagtgcaagggagtgttaatcgctcaatcatggccaactctttgcgaccttgcggactgcagcccaccaagctcctctgtccatggagctctccaggcaagaatactggagtgggttgccatgccctc

SEQ ID NO: 25521 - DNA, 201 bp, Bos taurus
aaatcgttatcatgtattttgggaaaagagacaatactgatgtagtctagtaatagtttcataatatagagacagtaaaagccattggtaatatgctgatgagaacataatggagtcagtctggtttagatttctttcagattttagcacatagtagcaaattctctaagcctgtttccttcacaataaaggagacacaag

SEQ ID NO: 25522 - DNA, 201 bp, Bos taurus
tttcatgggcccattgccaaattatttgggaattattactgcactaaaaaaatcttttggaaaattttaacgttttgaaatttatatttatttctgaattctgtggttgagctgacagggaaagatataactgagaaattgatttaccagatattcattctatttataaaagacttcacagtaatattctaagtgatggat

SEQ ID NO: 25523 - DNA, 201 bp, Bos taurus
accttttaggcatcctggctaatcgatgaatttcctgactcgagttagctgctcgttcttggtcctgttagctaagatcatccggggatccgggtgtctcgtgtggaaaatgtggccacctggtgcaatctgttcattacaagctctgagtgtcattgaagtgtcaccacaaacacaattttcccattagacatcaattgt

SEQ ID NO: 25524 - DNA, 201 bp, Bos taurus
atagcactaataatctgctgtataaatgtaatccctttgatagcatttaactgtaatggacacgtttttctgcatctaattttcagatacagagttaacgttggaaatctggagaagcattttatacaaattgaaagattgggctttctcttcagttttccagatgtattgtctcatctgcatacttgaaatatccacaat

SEQ ID NO: 25525 - DNA, 201 bp, Bos taurus
ggttattgagaaatcaaaacatttagattctcatggaaatttgcctaaagcaggcatgaacatactgaggtgtaaaataatgattagttcatgactagaaatgttgccctgggatttttttggtctgttttggattatccttaatgggagcaaagaatacaaaggattttctcaacatgtacagagttgtatttctcacag

SEQ ID NO: 25526 - DNA, 201 bp, Bos taurus
aagataaaggagttattgtacatgagaacaatttccaagtttctgaaaggaagtaaacactaaatctccctataaaggacttgtaccattctgggatttactgaaagccagacatccatctatctgcttgcactaaggaatctttgcttcaaatcacaaagttagggaggaagtattctgagattagagatctatattcaa

SEQ ID NO: 25527 - DNA, 201 bp, Bos taurus
taaagataatggatatgaattctggctgccaattggcaatatctagcccatggagtagacctgatgacttttgtgctgtttctaacattccttccataagagcagtcaatagcagctgtacctacagtacgcactccagcccagtatgggaaagaccaagtaacaatgaaaagaacctgtgcaacccagatggtcctacct

SEQ ID NO: 25528 - DNA, 201 bp, Bos taurus
gctgagggcagatatatggatggccataaaaaggaattagaacaaataattttaaactcttcagatatttcttttactagttctcatctctgcccttcctgtacattgtttcccctcgtccctctgaagactgactttttttttttgctttgtgcacaagcaaattacagatgaagcacagctctctagctaatatgtcgg

SEQ ID NO: 25529 - DNA, 201 bp, Bos taurus
gtacggtagaattgggcaagctgttaaacaagttaaatttgttcatgaaatgcaactttgaaaatgagatgtgtattttaatgaatgacagagctgaggacgaactttatactgaatctgtaatgtggatctatggtatttttcttttgcagaaacagggaaagaacttgaagagctattttctttgaaattaatgccatg

SEQ ID NO: 25530 - DNA, 201 bp, Bos taurus
tggcagtttgtacaaatgcaaagggtatagttgcatacaccatggttagcttaaactggcacagaaaagcatttctttttctgacaagcagaagcccacacggagcaagataaacatacagataaagaagactaaacacaatagaagtgtgccaggaaatgcattaggtagccatcccacggtcttccagggtcaaatata

SEQ ID NO: 25531 - DNA, 201 bp, Bos taurus
cttacaaggcccgcctgcagtccaacggctgggacttgacctccctggagccccagctagcccctcaggtccttcgccgcatggaggacctggaagtgggaaagatcacggcggggttcgagcaaatcacgcaccaggcagtgagaaaactcagcaaagctgagatgcagaaggtcctgaaagaggcctgaactccacgag

SEQ ID NO: 25532 - DNA, 201 bp, Bos taurus
caaagagtcaaacacgactgagtgactgatctgatctgatctgataaactggaactacgttattcattttaatatttgagtcataaacatgccaatctcagtacacttttgccatcactgggtattaactttttctaattggatgggtaaaagatgattttttttattttattgcatttatttgatttttagtcaaattag

SEQ ID NO: 25533 - DNA, 201 bp, Bos taurus
gacctttcaggtcagaggccagtggtggcttttcatgcaaaccataggacaggatggagatgctcatggtcttcacgcttcctcccatgggcagtgactccggtgggccacgctgactctaggaggactgggacagtggcaaatatcactcagttccttagaatcaataaagtgttagtcactcagtcatatcagactctt

SEQ ID NO: 25534 - DNA, 201 bp, Bos taurus
agaagggtaaggcaacccattccagtattcttgcctgcagaattccatggacagaggagcctagcaggctacagtccatggagtcacaaagagtcggacacgaccgaatgactaatactttcactgtcactctgcctttatctcacatgctagcaatgtaatgatcaaacttttccaagccaggcttcaacaatacgtaaa

SEQ ID NO: 25535 - DNA, 201 bp, Bos taurus
gaagtactgcaggcaaacggtaagctatgctatcaggcagagttgaaacaggtcgtcaggtttgtgagtgtagaaaggaaagaagtttcaattggactccgttcaacaggacatgggcccggaaggactgcttgagtcttatgatagaaagagaagttatataagttgaacaaatgcgcctctctttcaggaatgtcttac

SEQ ID NO: 25536 - DNA, 201 bp, Bos taurus
tttgaaataatctgcttcatatacaacaagtttttggttgtcttaatattttaaaaaagaaaaatttctatttccatttgagaagactatatactataatcaaagctgaaagagaaaaagatagctattaaaaattcaaaaaattataccattgaatacttcacatgtaataggaaccttttaggtggataatatgaagaa

SEQ ID NO: 25537 - DNA, 201 bp, Bos taurus
aacccataaaaacttataaaaatcaatttcttacagtatctactggatctcctatttcacgtcctaaagtggaagtgtttgagctacctgagctacaggtacgagcaaatgtaacacaggtccaaacagctgcagacattagatgattctagattcttctaataacacaatgaatggcaatggtggctgtagccatgaaat

SEQ ID NO: 25538 - DNA, 201 bp, Bos taurus
cccacaacaaagtcttgataaatatctctttttattttctatgacaaaataattagttcttcactccttccagaatctgtttcagtagatagtacaaggtcagcctcttaaagtttttctcctaactagctagtgaattttcctagcaccatttatatcttaaacttaacttctccacagaatttaagttttaaaaattta

SEQ ID NO: 25539 - DNA, 201 bp, Bos taurus
gtgaggcatacagatcattgagtcagtttttcatgctgttaaaacttagtccaaagcagagattctttttttgtttctttgcttgttttcaatccttattccttagaaatatttgtcttttagatgtattaataagacacaaagaatatgtattctacaccatttcatgtatatgagaattatatttttcaaagcaatata

SEQ ID NO: 25540 - DNA, 201 bp, Bos taurus
ttccacttgtcaaatccagtgaaaccctttcagaatttaatcatactggatttctctggaccttctgatattgttaacaatccttcctttctaaaacattcttctcctttggcactttcccccttaggcctctaagacacaccttttttgcttatctctctctctctctctctttttttttttttaccccagccattcttt

SEQ ID NO: 25541 - DNA, 201 bp, Bos taurus
aacacaaaaattaagtgaagtggggaattgggccaccatgacaacttcagaaaaaaggagccatcttctaagtacttttacacaaaagaggaaaatgaatgaatgagaattaatgaattaaagagaatttagagttttggacaaagttctaactaaaatagtatatcatacaacgtaacctcctcatttaataaatatgtt

SEQ ID NO: 25542 - DNA, 201 bp, Bos taurus
agaaatatatataaatgatatataaatgaacttatttattaaacagaatcagacccacagacttagaaaagaaacttaagaggaaagagataaattaggaagctggggttaggatatacacacaattatatataaaatagatcatcagcaaggaaatactgtatagtacataaagctctacttaatattctaaattaacct

SEQ ID NO: 25543 - DNA, 201 bp, Bos taurus
aaatgccaaattctttcaatttgaaagaattgaaagtcattttctgagaaattacagttaatagtaaccaaactgtgcttgaagacttaatttatttaacgtgaaacagtaactttgcttacttgcaatggttagactttatgaaagagctgttcaaaaacagtcatatgaacatcacttttttttctgaaaaatatctta

SEQ ID NO: 25544 - DNA, 201 bp, Bos taurus
cattcctttgatatgcaccttaactctctggggccagtgttctttccatttcactcttgagttccttcagggtgtacagctggggacagatgctgtggctattggcttgatggcctcaacaacctttgcttaatgtatggcaggtgacattcttcacccacaattatttacagtttccattatctcagtgaatctctctaa

SEQ ID NO: 25545 - DNA, 201 bp, Bos taurus
cctgaagattctaagtgattattttccatttctatactattctcaacttggtaacaaatgatatgccactgacagctatccagagaccataatttgaaaatgctctaaaatttggtttctcagtgattctggataacatggcataggatttaacatcatgtttgagaaatacacaccttttggttccactccctttatttt

SEQ ID NO: 25546 - DNA, 201 bp, Bos taurus
gctctgaagttatcctgactttaatcttattttgattaaaaagtgacattgggacatcgtgtttgtttgtgtagcagttcagtctcaactgaagattaattacaaggtgaatccaggcacaatagttcttggcttccctgatgactcagtggtaaagcatcggcctgcaatgtaagatacccaagttccatccctgggtcg

SEQ ID NO: 25547 - DNA, 201 bp, Bos taurus
agaataaatttattaaaattaaagtcaacgtgaaattaaaaaaaatatggttattttgcaaattgcagacaacagaagatagcaaaagagaaaaaaaaatgttttgcttttaactttatgggacgttatcccagtaatatttactacttgacagagctattgcatacccttttaagctttagtgatttcagactgttagtg

SEQ ID NO: 25548 - DNA, 201 bp, Bos taurus
attcaggctgacactcctggaaatcctccactggtttctactccccacccccaggtctaaaacataaagaaaacattctttgaaaagtacagttgggtttaaaattgtaggaattaattttatctttatgttccaataagaaaatttcatgcttgaaatgtaggtttcaatgagctatccatcaaagacagtcatcaccta

SEQ ID NO: 25549 - DNA, 201 bp, Bos taurus
tggatccatatgagaaaggataaagaggcatttaaagtcagtaaaatatttagaagcagtgggaagcatccaataaccattttaagtgcttgccatgttccggatcctgccatacagcttaaggtgcttatttatctggtattttttatgcacatacatttggccaggaatagttctagacatgagggatataacagtaag

SEQ ID NO: 25550 - DNA, 201 bp, Bos taurus
taaaattttctgctgaggtcaggattagtttaggaactgagcgcatagcatacagccttcctggtgatctcagctaaagctggtctagaccacagagctgtccaacagaaagtcctgtgttgatggaaatgctctaattcactacccaatgtgagactcattagccatatatgactgttgagcagctgaaatatggtatga

SEQ ID NO: 25551 - DNA, 201 bp, Bos taurus
agtttccttgagatactcaaaagctctactctctcccttatcctaaacaatgtcaaacattatagtttttgttatagcagcatttaaatcttgggtgttcgcttctgtctggattagtttttgcagcataccaagttagcctaagatttagtagcctaaaatgacatcgttctgtgagttgactactgttgattgagtggt

SEQ ID NO: 25552 - DNA, 201 bp, Bos taurus
attaaaatcatgttttaaaaaggagattagggattttttaaaagctttctatatattacatgaaaaaagagcaaaggcaaattagaaaaatatagtcagcatggttgcacaaatacacaaacatgcaaataaaactctgaaagttgttttctttgagtgatagaattatgggtaattcttattttctcatttgcagttttt

SEQ ID NO: 25553 - DNA, 201 bp, Bos taurus
gaaaaattcacagaaataatatttgagctcctggctgagagaagctggatggtggtgctgtgctgcaatgggaatggccaacagatggcagcagcctgaatgcagcatcgggagtcaggagtgtagctggcaactcgctaaggttgaagattaatggtctcacaatgtacaaaggtacacagaggacactggggccccgaa

SEQ ID NO: 25554 - DNA, 201 bp, Bos taurus
ccatacccaggtctgcttcatcctagagcctcaaagggtacacataacaatatctttgagctgtttttcagatactgaaaccttcaccaggtaagacaagataactatgaagttgctcagtcgtgtccaactctttgcgaccccatggactgtagtctaccaggcttgtctgtccatgggattttccagtaagagtactgg

SEQ ID NO: 25555 - DNA, 201 bp, Bos taurus
tattttatttcctaagcagtagaagttacttaaggtttatgagcaaaaggatgttgtgactgacactcagagctgcgacagtatcagtaaaatgaaactgctaaaaaatatttaccatcattctaaaagcatttaatttcactagaagatgctgtaatttagttcctcctctgaaagttcccttgcttattcttatattaa

SEQ ID NO: 25556 - DNA, 201 bp, Bos taurus
gattcattttttaaaagccatctctttctgaaactcctaaagactcactgatggatcagtgttagttcagcaagtacttatttaggacatagtacacgttctaggctctgcactcaacactggactggcttaacgggttgttgaggctcccctatctaaaagcccactcaggaaaatatcagatgagagaatttgctcact

SEQ ID NO: 25557 - DNA, 201 bp, Bos taurus
agtgattacttgcagaattctgtggtgcagaaaagctggatttcattttttagcttattctttaaaattactaggtgatggatctttcctaagctttccttaaatgtccttactcatctccattctttaattaaatatatttcactaaaaaacttcatctatgcataaataacaatacattcagcaacccttctatatagg

SEQ ID NO: 25558 - DNA, 201 bp, Bos taurus
caacagtaactgagtaaatgttggaagccagtggttggtggagccagaattctaacccagccagagggactcttggccttcggctcttaactacttattatgctgccctgtaatttgttactcaactggcttataaattagtggctcaagcatttgaacatgaaaccttataaacaatttaaggctacgttggatggcccc

SEQ ID NO: 25559 - DNA, 201 bp, Bos taurus
tttaactgagataacaaagtaagtaggcactgcagacaaaaccatgtatgtgcagaaaatatgaaaatgtatttggaaataagtatatttgcattaagtctagtttgttcatcataatttatgctgtttctaattttatactaggaatgcttttctataggacacatacttaaaagaccaattctttaaatctcttaatgg

SEQ ID NO: 25560 - DNA, 201 bp, Bos taurus
tcaggaacccacccacaggcaattgcatttgtggctggggagctctgaccctctctggctatagctgattggaaccaggtaacagctgtccccagcccaccccccagattgtggcctgaagatcagaagaaaagacacagacacaaccatcaaatggtacggatgtcaatgacataggtcacaaatcaacagtcagtacct

SEQ ID NO: 25561 - DNA, 201 bp, Bos taurus
agggctggaaggggcccaataaggcactgtggggcctgaagcaagaaggcaaatccaccttcagggtggatccttcaggggtgggtgctgatggtgggcacccatcagtcaggggccaggcaagcgccctagaaataagagctgcacataccacatcagaaaccagatgaggcaggactactgtgaggctggtgaagagat

SEQ ID NO: 25562 - DNA, 201 bp, Bos taurus
ctgggttgctcagagtataagccctgtgtctgccaggactgttgcaacagctttcttaccggcatccctctcattcttggccggttacatatccattcagcgcaaaataaaggtcatgagagttattcaaggaaacctactagaggttagactaagagttacctgagtgactatgggcccccaaagcaggggactcacatt

SEQ ID NO: 25563 - DNA, 201 bp, Bos taurus
caaaaagttaacatggatccattggcacctaccaatggtattgaccaagcacatagttaaactttattcagttgaaaaagtgtgtctatgttgtcattcaatgccacataaatagtactggagtccaactagaaaattgaatgcaggtgatttgacgactttgtacttttattcaatattttagtaagttgacataagcca

SEQ ID NO: 25564 - DNA, 201 bp, Bos taurus
tgacagccggcccctcgcctgagagcggagccccgaggtggaacggggtgacaacctgacaacgctctcccaaaacacgagcgacaggaataaaaacaaccgggcctgcaacttcagtgaaccagaaaacaggaaaaatctggctcagaaagcgcagaggcggccgcgcgggctcaagcgccagcggactccaagcgcagc

SEQ ID NO: 25565 - DNA, 201 bp, Bos taurus
gtgatggttttgtggtgcccatgagaggaggtgagctcagggtcttaccatccttcggtcttgggaattgcttctcttcatagtactaattgaactaggactgttgattttgaattatttgaaatagttttcttaaatttaagttacaacattgtaattctgacaaaaacttgaaacaataaaactggtaaaataatcttc

SEQ ID NO: 25566 - DNA, 201 bp, Bos taurus
agcaaaaagacagatttgaagtcaagggcaattaaacatcttcctaatgacctttctacccagcagctcctttccactcccgttgtctcagctgtgattctaatctagattatctcacatctgcctggtacactttaaaaaaaaacattttattttgtattggggtataaccaattaacaatgttgtgatagtttcaggtg

SEQ ID NO: 25567 - DNA, 201 bp, Bos taurus
ttaaaagctagctcttcaaaactatccagtgaagtcttttattcttttttacttccttctgattcttctaaagcatggggaattttataagtcccctgctttcaattctccatatgacagtttacagtgaaacctgaggcttccgtttcaaaaacagagtcacttttaaagaacaggtgtcttgccattttcagaaatggc

SEQ ID NO: 25568 - DNA, 201 bp, Bos taurus
ctggcagctctgaagctggtgtcagcacactggtcattggtaccaaggaccagtgtgtcctgaagctagcgcctgtccagcgatgagtgaagttaatcctcaagtctctgcctgcagggccctggatgttccagagcttgtgtcacccaacaggaagacaggatcagggcctgcggattccagggctcatgcctctctcct

SEQ ID NO: 25569 - DNA, 201 bp, Bos taurus
aagaagaagtcatcaataattgaactcactatccaaacagaacacttgacttatttgtattcctttcctgtgtgtataatttatatagataattatgataatgtaatagtgattatgaatcaaatttgtatcctacttattgcatctgttgctataatgtgaacatatctcatggcataaaaagttattcctaagccttat

SEQ ID NO: 25570 - DNA, 201 bp, Bos taurus
aggatacagaggaaacataaaggtgtggggcataaaatattgggtcactgaggaactggaaaaatcatcagggaaatcaaatctccatctcaagcggattttgctcatccctgttttcctctctgcagactggtttatttactctttcaagaatatgaattaattactcactcaattcaagcagatatgttattcaagcac

SEQ ID NO: 25571 - DNA, 201 bp, Bos taurus
accttaagagatacatacatatgctctatattttcttgagctggctgtggtattttgcattcttccatacaatctatattcattttaaaattgcaattcactgtagtaagtttattcagaataatccatgatctttaagaattctctacacttatatgccactgtgcataccctatttgtgaccatcttttttaccttaat

SEQ ID NO: 25572 - DNA, 201 bp, Bos taurus
gtgagggacagggatgcctggcgtgctgcagtccagggggtggacaagactaggcaactgaactgaactgaagatgcttggttgggattaagaaataaggtaaaagaatttgcagtcttcatatgcaaacacagctgaataaaataaaaccataacttaaaaataagtctatgctttaaaaagtaaaacaatgagagatgt

SEQ ID NO: 25573 - DNA, 201 bp, Bos taurus
aatgtaagtatagttgtatgtatacattcatatggctaccagagtctttctctccatatatatacacacaaaaatgtgcacactcacacactcacatacgatgtcaaatgcatgccaggtactaagttagtcagagggaacataaagtgtgtacaaatatgaacctgtattttttatataagttcaaaactaagaaaaaat

SEQ ID NO: 25574 - DNA, 201 bp, Bos taurus
ctttgtaatattcctcattggtttatcctttgtgattcttatggaagtggaggtaaagaatattgactatgaaggggtttgctgagcaattattcataacatgcaaaaaaaaagcaatcaagtttatcagattcggtcacttaattttatatcattctgcatattgtctttatttgatttttgactagctacatgcacatt

SEQ ID NO: 25575 - DNA, 201 bp, Bos taurus
cacatgtcctttactcctacattttcataggtgtaaggactgtctccttgaatttatatctcttttaattttcagttgctcagctcattaactttcccttgtccttgttgacatagattgtgattgcttcactaagcaatatataaatatgcataattcaccatgataattaatatccaatttattatggcccaagtttgt

SEQ ID NO: 25576 - DNA, 201 bp, Bos taurus
agactggccagtcctgcctttgttttaactttaatgagaatgaatttggttttatttaatgtactatttgcagttaatttatgttatccagttttaccatgatttaaatatttcctgcacttcacagttgactcagtttttatctatttgatttattatgtttttcaatatttattaatatgagcatatagtttttctcct

SEQ ID NO: 25577 - DNA, 201 bp, Bos taurus
gttcctgaccctggctgtacagcctgctgaagtcatatagctgcaaaataaaagacaagaaagaagtaaaggaaaaggataatgtgtctgtgagcatagcgatgtaatcacacagcacacctcccaaagccagaaaccaaataattggtttattctgttgcccgtccgtcatgattgaatcaccaactgactggggagaca

SEQ ID NO: 25578 - DNA, 201 bp, Bos taurus
aagagagattttgattctttgagcatttctctcgcctatgggagctaatccaaggaacagtcctactcaaacctaggaggcaataaatccccttcttgttaaggagttgcaacctgaaaatgtgtgaataacacagtccatgagcatcttgtttcacacatgatatactgtagcttcctaagaaaatgtagtagatttgct

SEQ ID NO: 25579 - DNA, 201 bp, Bos taurus
tcttggaagatatgggactgagtacagatggaactgttagaaataaagaattaaagtggtccattttcaagggtgtctggttttgagtggaaagattactaccagccaaactttcctaacagcttgttggttgtagtaactgtaaggaaagtctgggcaaacaaagggagggtgggatgcctaggatttttgtgtgggctc

SEQ ID NO: 25580 - DNA, 201 bp, Bos taurus
acactgaaactaccaagttcttagaatcagacagtctagatagtagagccaaatgatgctccctcaggcccaggaacctgatgcgaataaaacacagtaaacaaagcttagatgtgtgatgttcacagtttgactccctgctttggaagtgttcatgagataacttcatgaaggaattgggttaagtatgctggaggttgg

SEQ ID NO: 25581 - DNA, 201 bp, Bos taurus
ccaatactgttgatggagttaaaaattggaacaatataagagacaactggcaatacctataacgtctttaaaaggagctttccctgatttatcacttctacgtctaaacatactcagacttggctgcatatacacacatgctgcattttttaaattcatcctaaatttttactggcaaaatctcagtaacaacctgagtgt

SEQ ID NO: 25582 - DNA, 201 bp, Bos taurus
gtgcagagcatcaaggttctgcagggaagagcacacggtgatgagtaaatcctgcttctgagcgacagtcactctcaggagagcaagcagagagagcagacagactcagagctgagtctgggggcagatggacgggtcacatgaatgctcccagagcacacccttccctggatgcatcctgacaaggccagaacccagaca

SEQ ID NO: 25583 - DNA, 201 bp, Bos taurus
agaaagatgatgacctggtttcatctgcatcccaggtcacagccttcccttgcacagcagggggaagaaggaccagcctcaccccatgtccccagaggacgcgcaagctcactcctcataggcagaaccaagcaacagcagcacaacccatctagggagagggctcttcacacactcaatgccccaaacatctaactggca

SEQ ID NO: 25584 - DNA, 201 bp, Bos taurus
tgtgaagtgatatttcactgtagttttgatttgcgttttccggatgattaatgatgtagagcatcttttcatgtacctgctagccatctctctgttggcccttggaaaaaggtctattcagatctcctgcccattttaagatcaaattgtttgttgctattgagttgtatgggttctttatgtcttttggctattaggccc

SEQ ID NO: 25585 - DNA, 201 bp, Bos taurus
aaaacatgaccttagagtcaaattatgttattgctctgtaattttgaacaaaatcttttcaaacctcaatttcctcacctaaaatgggagcaataatatcttgttcacagaactttgagataatgaaatcaacaacaaaacccaaacatgtccagtgcctcatatgaaaaaagtgtttttcttcttttttgcagaacattg

SEQ ID NO: 25586 - DNA, 201 bp, Bos taurus
caatgacatgcaatttttaaaatattgaggatgtaaaagacagaggctaaaaggctgctccagtttaaacacttaaagggacagggcactgcacaatgaacccacattgtttcttggacattttctgggcaactgatggaatctggataagttttgtatgctaaataatagtgctgtgtttgcattaatttcctcaatttt

SEQ ID NO: 25587 - DNA, 201 bp, Bos taurus
tgtacttagcagatgctaccaaaccactttccacacatgtaagaatctgaacagacttgccacgctccctggcaaagggtctggcctgtttccagctctcgccgccctgtaccacctatagatacgcgcgcgctaaagggaagcaagatgcgccctcgtcgctgttcccagacctcagcgccttgtcaccggctcctgtct

SEQ ID NO: 25588 - DNA, 201 bp, Bos taurus
ttgctgagatatttatggccttccctgcatttctttatcagtcacttttactaaggacctcctgagtagctcttgttaccctaagttaataagacacagacgggcccgactccttgtcctgggacacttctggacggccattcacatcgtggaagctgccagtgcagtgttacaagcccgccccacagttcctgttagcta

SEQ ID NO: 25589 - DNA, 201 bp, Bos taurus
atggcacttcatccacacgacctcgcggctctcttgatgcccccatggctggccgcgctgctcccatctcacgctgaagatgggggccagagaggcaaagtgactggcttgagatagctcggcaggaggttttggtgctgaagtccaaacagaggcttgtgtcctccttccaggctgtatcgcaaaggggaggggacagga

SEQ ID NO: 25590 - DNA, 201 bp, Bos taurus
ccttctgctaacagcaccctggatctcctgtgagggccccttctctccctcttccggcttggtgtttcaggtgacatcatccctgaacccacagttgagcatgtgatccagcctggccaatcagagcttcagcttcctctgaacaattggtttagggaaagccatgtgacccagtctgaaccaatcagagctctccatcag

SEQ ID NO: 25591 - DNA, 201 bp, Bos taurus
gggagagcctgaagtagtgttcccacctaagtgaagtttcccctcctcgaccagcaggacactcaactggctctgaaggcaaggccaaccaagttcatgcagagctcccctgctgcctctctcacaacaagggcaccaagctgcctgcagcttctggccttggaattctctgggtatcctgagcaaagtgaagatgctggc

SEQ ID NO: 25592 - DNA, 201 bp, Bos taurus
gcataaacagaaaccaaaccccaggaagatggtccttggcaccgccattcacgaaatgcaaattactctagcagataacgcgtgctcctctcttgatagccggaaggtatacctgtcaggggttggcaaactcaagacacacacgctcacgtcgggggcggtggtaggggggatcacgcagcttagaggattcagttaaga

SEQ ID NO: 25593 - DNA, 201 bp, Bos taurus
gggtatacaggcatttactataaaattctctcaatcctggtatatctttgaaatttttcatagtagaatgttagcatctattaagatggcaatgtcacatatcacttaataaataaaaggctgtaacaaaagtcctatttgctaacaaaacttcattcttccaccttagagcaggttatgaaggttccatactagacctta

SEQ ID NO: 25594 - DNA, 201 bp, Bos taurus
gggcctgggagtgtccaggcgctcacctgtccatccatccccagagatcctcctctactctctgctgacagagcatggttctctcttcctgtggaacctcgtccaggcccatgccctggcctcactcacactcacaaaggggaacttaggacatttaccgcagtagtctttttttgaaaaaatttttatttggctgcacaa

SEQ ID NO: 25595 - DNA, 201 bp, Bos taurus
tcagtggaagtcctttggacaggagtctgctctcacccctagcatccaaaataaagcaaactttcctttccaccaacctggcctcttgattggctttcactcagtgaacagctggaccccaattttggttacagtgggaactcctctttctgggttgatctcagcgccggcttctcctgcctgctcattggccccttggac

SEQ ID NO: 25596 - DNA, 201 bp, Bos taurus
ttggtttgtgtcaagggtcacacagaactgtgtcacatcccacatgtgctgggtatccctggggctgggcacggctctccctgacactgactgtcaggaggaaatgggcccttgggtgtgggtgggatgggtctggttctcagctttccctgggctcagctctccccacacatgcttgttctgggtctgtgtccccatgag

SEQ ID NO: 25597 - DNA, 201 bp, Bos taurus
acctggagaactctcgtgccaccacctgggaccctgggcagctgtggctggagctacgccaccacctcatcaccttgggtatttttcaaactcattaacaggctttggacaagtaaattgtgtgttcttttgtaatgatgacaaccatgagctctttaaaccctgttatcagagtggaatcaagataatatcccatgtgaa

SEQ ID NO: 25598 - DNA, 201 bp, Bos taurus
cagagccaagggaggccccggggaccacagccagcagccccgtggccccagctgcaagtcctcccaggaacagagccacatttcctccgagtgttgcccgtacctgatgttcatgacccagggcccctccaacacccaggtctgactgacaggtgcagtttccccttcaaggatgatgcctaccagccctgcaggacggtg

SEQ ID NO: 25599 - DNA, 201 bp, Bos taurus
tgagtgatgagcgatcccagcaaagccggcttccattctcaggctggaaggatgttctgtgaattcagatgaccgcggggaggagaactgtcaggatgatcctgccctcgggccagccgcgtgcttgcactgccgagagcccggaattccgtgggtcatcagtattcacgccttgcacctgagtgggccccttgctatcct

SEQ ID NO: 25600 - DNA, 201 bp, Bos taurus
acagcaccgtccccacagaagggccaaggctcctttcaggtgacctcacctggttaacagcactcccattgaccttcaggctctattgttaactttgggcggtctggcctcacatcctgtctgaccacttccttcatgggcacttgccatggtgtaaaatcaggaatctcccaaaactcatactcttggtcacttttgtag

SEQ ID NO: 25601 - DNA, 201 bp, Bos taurus
gtacactacggcatgaaacccaaaggctcctgtggtgctaaacacagtgtgtaacaatcctgtcaggatgttttaggtatctgccaaccaaagaaaaaagtaacttctcagctagaacctcttccatggagcccttcttgtcaccactctaggcaaactcagctccctcacaggacatatatataagaccaagatgactgg

SEQ ID NO: 25602 - DNA, 201 bp, Bos taurus
gagaagtgactgttcacaatgtttttttaaagctgattaaagatatcctctttttttttttttctataaaaataatatctctgtccaggctcgaacggtagaggtcatctctaggatggcttcatcctatgcattttgtaaagggagttcgctttgtgagcagttctgatttaaaataaataccagtcctgcaaaacttcc

SEQ ID NO: 25603 - DNA, 201 bp, Bos taurus
ttttctgcagtcctattagattggaatccccaggataaaaaggacttttcctctcttgttcagagcagcatctttcatgcctggaatggggcctgccacacgcactcgggaaactgggtcttcaatgatgtcacatcagccccttgggcagaatcggatgtgatattcctgtatcatgatctcagagcatcttcatcccca

SEQ ID NO: 25604 - DNA, 201 bp, Bos taurus
ttctgttggaccaagcatctctgcgaatgtaaataagatgaggatctcaagatgagaccaccatggataaaggtgagggggaaatccaagaatgagtgtccttttagaagagagaaaagaagacatagtgtatcagttcaagtgccacggtaaaatacaagatggggtggcttacaggatggacctttattttcaaggttc

SEQ ID NO: 25605 - DNA, 201 bp, Bos taurus
ccctgtgcatggaattctccaggcaagaatactggagtggattgccattcccttctcccggaaaatccatttgtgtaccctaactcaggcacacggaggcgccaggcctaagaggagctgggggtgggcaggagaaggcactcagggtgggagcaggtccccgcagagagtgccactgggaatctggacccaggtttaagt

SEQ ID NO: 25606 - DNA, 201 bp, Bos taurus
cagtcccactctcccactttaccccaccaccacccgcgtggccacacgtccattctctacatctgtgtctctattcccgccctgaaaatagatagacattgctccaagaaagatagacagatggccgagagacacaggaaaagatgctcaataacactaattgttagagaaatgcaaatagaaactgcaatgagataacac

SEQ ID NO: 25607 - DNA, 201 bp, Bos taurus
gaaaattgtgaatctccctaaagcattccataatatcctgaccttgaattccactccctagttcactctgttcatttggtattttcatctgggtcacagcgttattatgactgaagatgttccctgagtgcaggacaaggggactttgattccttgtatctttccgtggccagcgcccttgcatccgtcccagaatcttct

SEQ ID NO: 25608 - DNA, 201 bp, Bos taurus
agcattggagtttcagcatcagtccttgactggagatcttgtctgaaaattaggtcagtgcagaagaaaatatatctaagagatgaagaaagagagagggtgggattcagagtcctaagaatattgattgaggagctggatcaaactgtacctgaaatcacatccttgacttttcactcatgagtgccagtaaattccttg

SEQ ID NO: 25609 - DNA, 201 bp, Bos taurus
ggtatcttttgcccacgtgtgggtcttctagagcttcagtaaccaggcaccacaaaccaggtaccttaacacaagaggaatttattctcgtggctctgacggccagaagtccaaagtcaaagtgtcagtggggttgtttcctgccagaggccggagaatctgttccattctgtcccccagcttctggtggtgccagcagtc

SEQ ID NO: 25610 - DNA, 201 bp, Bos taurus
gtgtggccaaaaagtttaaaaaaaaaaaaaaaaaaaggcaagtgctggttggaaaggaaagattgctttatttaggaggccagcaatgtggggagaaggcagattcacgtccaaaaaccaactctaaagattctgctcaaccatgaaagtttttaaagggagaatcttttggagaaaaggtcagggcctttatcttcttcc

SEQ ID NO: 25611 - DNA, 201 bp, Bos taurus
catctgcgtggggaccagggaggacttcagagaaagcaggacccagagagcagtgagtcgcggctgccctctgcccaccaggccccacccgccttgccccatgattcatgtgtgaggataaatactggaagtaaaaatacacatgggcgtctggagcgctccctgtctctggctgctgtacacagcatggcccacaggaca

SEQ ID NO: 25612 - DNA, 201 bp, Bos taurus
ccattttctaaaaaagttcaaaagataattagtggtgaattaagcaaacaaaccacaaaacaccaccatgtattcacaattccatcaaagcatgtaagtctggactaaattcaaacgaaataatctgtgacaagggataggtctttctttccactgcacctcaaggaatcatcgttcccttcattctagaatccacagaaa

SEQ ID NO: 25613 - DNA, 201 bp, Bos taurus
accaggcaagtgtgggattggtgggtgggggtgggtgtgggagggggaagacttcctcaggtagcaccgtcgtgaggccggggctggggggcattgaagtcgaggacaggttctcatacctgtctccattcacatttacctgggagtgggcggtggggtggggttgcgccagaccccagatcgcagctctggagccccagg

SEQ ID NO: 25614 - DNA, 201 bp, Bos taurus
ttcctttctgaatccagggcactgggaacagccaggtgccccagagcaaatatgctgagctgctggccatcatcgaagagctggggaaggagatcagacctacctacgcgggcagcaagagtgcgatggagagactaaaacgaggtaagtcatgtaccctggactcccctggtgggtgatgcccttctgctggctgacccc

SEQ ID NO: 25615 - DNA, 201 bp, Bos taurus
cagatgagaaaactgaggcccaaagcagaaagctggctaccccaagggcaccattcaagtccaggcagtctggctctgaaaaaaatccatctgtgtgtgtgtgctcagtcgcatccaactcttcttgaccccatagactgtagcctgccaggctcttctgtccacgggacttcccaggcaagaatactagagtgggttgcc

SEQ ID NO: 25616 - DNA, 201 bp, Bos taurus
tgtttaggtttgtaatccattttgagttcatttctgtgtccagttcaaggaaaggacccaacttcattcatttgcctgtttagtcatctagtagaaatggcaacccactccagtgttcttgcctggagaatcccagggacgggggagcctggtgggctgccgtctatggggttgcacagagttggacacgactgagtgacg

SEQ ID NO: 25617 - DNA, 201 bp, Bos taurus
atagaaaagaaaaaaagagtgttttaaatactgttgtcacatgacacccttaaagggcaggagtaacactgaagtatgatgggagatgcagttaggacccgcggatgaacactgggccaggcggaccttacctttctggcaggggtttgtcacagtagagctgcccagagctggactgttctctagctgaggtggcgtaaa

SEQ ID NO: 25618 - DNA, 201 bp, Bos taurus
aatatattaaaaaaaaattctgaaccctgtttgctgtctcaggcagatttctggagcagttctgctacttgagggtagcaacatgcagaaaaagtatacatgtggcaccacatgtacatacgcacatgtgcatgtactgacataagtgtgcatatccatacacatatacagacatatgtgcatgcccaggcaggcacacag

SEQ ID NO: 25619 - DNA, 201 bp, Bos taurus
ttgccctctcgcccaccctggatctttttacctctcacccagagcatttcaccaacctggccagagagagggggccttctctgtcatgtccacaagttcaatagctgtttaacctcagttttcccatcttacttacattttctaatgtgattcagtatttgctccctccataggggcatgagtttaggggagaaggggaga

SEQ ID NO: 25620 - DNA, 201 bp, Bos taurus
tcccagccaccattctggtatcagttcccccggccctcctgtcccctggtccccactgcgcagactcaacaagccagatctccaaagcaatgaatggagtatcctaacctcccacctcccaaccaaacccatctccccctctcctccccaacactcgccctgccctcaacctgctggccaccctggccttcccagccccgg

SEQ ID NO: 25621 - DNA, 201 bp, Bos taurus
gtgtgattctactgctatcttttcccaccaactgggtgaagatgacgatctgcatttctctatgcaagccacatcagggcctcactgttattaaagaaagaggaagacctttaatatagaccctaaattaaagaaaggagaaggagagcaacaggcctttggagagcagagggcacagtgacttccactacgtgggcaggg

SEQ ID NO: 25622 - DNA, 201 bp, Bos taurus
gcgggaactaattccctgaccggggatcgaacccaggcccccagctttgggagcacaagagtcttagccaccagaccaccaggggaagtccctaatctttggttatatatttatgtgttcacttggttaatgtctgcctctccatggtggggggaactagtctgttttgttcatgacctcatttgaaacgtagtggttatg

SEQ ID NO: 25623 - DNA, 201 bp, Bos taurus
tgtggcctgggttcagccgggatgggacctcaggctgtttgccacccacagtatggggacacgacacacaccctggtggagaagatgaactatactggccagttcctgcctggattcgaggcaccaccattcatggacccccaactttccaagctgtgagtgccccttggaacaggggagggtggaaagcaaggccctttc

SEQ ID NO: 25624 - DNA, 201 bp, Bos taurus
gagtcttagctactggaccaccagggaaggccttcgggggctttttttttttttttaaccttgcaagcccatcttcagaggccagagtggaaccctgttcgtctcttctggacagatgacttgcccctctaagcctgtgaatcactgtgggtaaatgggaaaggtcattgtatcacctgtggctgggaggccccctagagt

SEQ ID NO: 25625 - DNA, 201 bp, Bos taurus
cttcatcttgaagagcaaccaacacatctctgcaagccctggaggcctggcaagcccccgttctctgtcctacctaccaaaggtccccagagaaatacccgctccctgtccaggaagggccggagccagacacaggctctcagcagcaagcctggctgagcagcagcttctaatttcacagttcactgtgcccacagccca

SEQ ID NO: 25626 - DNA, 201 bp, Bos taurus
gtaaataagaacctgtgctcccaatgcagggggcacaggttcagtccctggttggggagctaagatcccgcatgctacctggtgtggccaacgaacaagcaaacacacaccctcttttccctatagacgtcctgcccagatcctcccactgtggccttatgggattggactcagtggtctgctcacccgagtgcccttgag

SEQ ID NO: 25627 - DNA, 201 bp, Bos taurus
ctatcactgcctcccattggtcgatctataaaggaagtcagctcttttggcagcctgcagaggttggcatccgagtgatacagagctaagcagaggaagggcaaggaatggatttgaaggcaaacaagcccaggcccaacactggggagctggagttatatttaatctctctaagtctcagattcaccatctagaaaatag

SEQ ID NO: 25628 - DNA, 201 bp, Bos taurus
cagaagcaggtgattagtttagagacattccccatctctacatgattactggctgatgcaaaaactcaatctcaggcaaggccctgaatggctcaatttcgcggaggtagtcacagctggcatttccctaaagggggctggtttaagaaactggttctttatgccttctgcactccactggagggaggaaccctaggcctg

SEQ ID NO: 25629 - DNA, 201 bp, Bos taurus
agaaaaaccaagcaggaatccaagctcgaagggccagtagtctctggatttaagagaaataaacactgccatgtcaagagatttttgaggtcctagttctcggcccacaccattagtggaaagtgggtagaaagcatgcatggaataagatgacacatgagcctctaaaggctccagtgactaagatgcctgtgtctacta

SEQ ID NO: 25630 - DNA, 201 bp, Bos taurus
ttcctcagagattatcagggttcatattccttcattcagctattaacatttactgagtaacagttcagagtggatctttctagaccttttgctatgtatacgtgtatatagataggttgatgcatatgattgtaagtatgtatacttgtatcctttttgtttaattctgcattttttttgtttgttcattttacataagtg

SEQ ID NO: 25631 - DNA, 201 bp, Bos taurus
aagaggtatgcttgttctcgcttgtgcagaaaacattgttccagattcaatcgactgggttcatgtcccctcacatagtttttaaggttatttatttaaatgtctaatgtattttattgtaacagacattgttttgccaacattgcctatttcagtggcacttcacaatctagtttaaaaagaaaaataaaacattttaaa

SEQ ID NO: 25632 - DNA, 201 bp, Bos taurus
cctcaccaggtacctgcaaggaaggcagtgtcggcctcatcctccctgcccatggactcacaggcagctcttgcctgaaacttgctctaggttctttcctgtcagcaagtgggctgaaggcccatcccctcagtgttttggtttttgccaccccatacccagactgacctctttcctttgcccaggaaatagcattcttac

SEQ ID NO: 25633 - DNA, 201 bp, Bos taurus
ctttctgaggttgcacgcactttcgtttgcatatcaacaggcacgctgcagacttcattaggtgttaagaggaagaatacagaaaaaagaatatagaaaatttcccatcacaagaaaaatatttttctgtaactatgtggggttgttagatgttagctagacttactatggtgatcatttcacagtatatacaaataacaa

SEQ ID NO: 25634 - DNA, 201 bp, Bos taurus
catgtgacgttactttttgggaattgcagccatgctgaaatgcgtgatgagcggcagtcaggtgaaaggtgcagaggcctttcttgccttcctgtgtaaagaagggaaagcttagggtttgtgggcgtggggacgtttccaccgtcgtctcatttcttgacctttgcctttatggctaagggacagaaggcctggtcatag

SEQ ID NO: 25635 - DNA, 201 bp, Bos taurus
gatttgtaaacaaataaggtgtcacatttttgtatctgtgaattagtctcatgtatagcctagggtgaaaagtacagtttaattttacagcttttgttgtggacataattttctaacgaaaattagaagggaaagctttgtttatacctttctagtagatgaatctaccaggaattctcacagttcacatcgtgtaggaga

SEQ ID NO: 25636 - DNA, 201 bp, Bos taurus
aggtcattagtctgctgtgatccaaactgaactaattttttttcttccctcccaaatctgcttctgcttccacactggcctaggtcacagagtcacatccgccctgccgctcaagtccagaatgaaagatcactcttggcttctctccatcaggcctgtcaatctaacctcctgaacaccattcctcctgcaccttctctt

SEQ ID NO: 25637 - DNA, 201 bp, Bos taurus
cctgtagctggacattcttaccaggcttggaccctctcactgtagggggagaaaaaccccaatttagtcaagtgaagtcaaagtaagatttcatataaaagttaaacatatatgaaaaggcacaagctttaaataaagaggagacaagaacatggtttaactactttctgactaggctttattttcaggacacataaaaat

SEQ ID NO: 25638 - DNA, 201 bp, Bos taurus
tgagctgagtgagtgagggagccaggcgcacaatgtgaggcaacggcaaggtgtgcaaggcagatcgcatggtttggccttggaatttcataccagaaacaaggggagtaataaggagttcctggcaggagacactgtgtcgaaccagcccctagggtgcccatgacaggggcaatctgactgggagcaaggccagcaaac

SEQ ID NO: 25639 - DNA, 201 bp, Bos taurus
aggaatcttattatgggatgggaagttactgcttaatgggtacagagtttttgtttgggggctgaagattgtggaaaaagatagtgatgatggttgcacagcattgtgattgtaattaatgtcactgaactgtatatttagaaatggctaaaatgacattttatgttaaatatatatattttgtaatatttattttgggct

SEQ ID NO: 25640 - DNA, 201 bp, Bos taurus
tgtgtcagggtgggactgggccaggccgtggcactgggaccacccgggagagcactgatgtgaggcaattcagaaggcccagagggaaggctctgaggctgctgtgagccatctgctgacatttctttttcattccatgttttttgaggccggtgggctttgattgctaatatagtaatgtggaaacatttgggaatggct

SEQ ID NO: 25641 - DNA, 201 bp, Bos taurus
atccattttatgtgattctcaccccattaacggtcctcggtttagccagaatatcctcttttcactttcattttaaaaaccagccagtgtaataaatcttgtcctgaaatctcggcagcacatcttggctggagtgtatgataaatctaatatactgtggcctctctgtataagagacctctgcacagatctgtatttttg

SEQ ID NO: 25642 - DNA, 201 bp, Bos taurus
tacagaaacacagcataaacagggccgccatccatcctttgttcacagcagacatcactagtcagtcacaggctatttccctctgaattagcactggtgccagaatcctcctccctctgggccctgatcagtgaggagagacaggggtggctctcccctttggggtccctcccaggtgtcaggccttcagcccacagttga

SEQ ID NO: 25643 - DNA, 201 bp, Bos taurus
atggggcctatgtaaagttctggggtatcacatctagaaatgtgagccaaagagtgtcaggatcacattttgtattctggaaaagatcattccaggagactggagatctactcatgtttgcaggccacagaagagaatgaaagagccacagaaagaagggacaatttgagagaatgtatgtcactagaatgtatgttccag

SEQ ID NO: 25644 - DNA, 201 bp, Bos taurus
gctttccagttcagcttaacaccaaggggtgttttagctggctatgggatgtgttcctatctcctctgtggagcagttagaattggggaccatgggtctgggatgtgttaacttcacttttccagtgtcagctcagagctggttcaggtgttcattcagtaaaggtttgttggatggataaagaaggaaataataatgcct

SEQ ID NO: 25645 - DNA, 201 bp, Bos taurus
caaatttgagcctaagaaagtgacccctagtggacctagactgcccggttcttcttgtgtcacccacgcactaccattatggtcactgccttgcatgctcgctccgtgaggctcaaggcaacacctggaagcctctcatgtgcccctctgtgaggggtattacagtgattcctgctcaacagatgaggaaatgaaggtgtg

SEQ ID NO: 25646 - DNA, 201 bp, Bos taurus
ccggccggggctttgagattgcccagggccgactgggtcccggcaggatccatcactgcatgcggctgattggctgctcggagagggcgctggcgctcataaaggcccgagtaagtacttctctttgcgcctgtctctggaccagaacgacccatctgtcttcctttcagacttctaatcctaactgtttcctgagagcag

SEQ ID NO: 25647 - DNA, 201 bp, Bos taurus
aggggtgttactgagaacagttttccaggacacctacaagcaaagattaggcttataaacaggctgcatttgaactaccattgggtgttctgagatgcacatagcctgctgggtatacattttaaaatgccatctctggagctatctttagtctttgccttgcagcttctgctcatgaaaataaatacgtccacaagacag

SEQ ID NO: 25648 - DNA, 201 bp, Bos taurus
ggaagcactagaagtgcaaccttaattaaacagttcgggattttctaattagcagcaatgaggtaatctgctatgaggatcctctccatttcccccacgccccccaccacagaggatgagaaggtaacccacatgatgtcctgaccaaaaagatatcctagcttgaaaatacagtgatccttaatttttttcctgctaatc

SEQ ID NO: 25649 - DNA, 201 bp, Bos taurus
cctccacagtttggtatttgtgcttgtgggcagctccgttggtactttggattttttaaaatcaggagaaaagaaatggagtttttaggtaaaagaaagtgttttcatagataatgtttttatctttatatatttatatatatatataaatttttttaatggagaaaggagtccaggactgcttaatactagagctatgaa

SEQ ID NO: 25650 - DNA, 201 bp, Bos taurus
gaattctggctttccccaccacctcaccacgcttcccctgccgtgcagtttcctcattcttagtgatcagtaaatattcaatggtgaggataatgctgactaaagtttgcactgttagcttcaagaaaattctcagaaatcattcatttcctggccaccatttggagtaaaacataactaggatttctgcagcccttcctt

SEQ ID NO: 25651 - DNA, 201 bp, Bos taurus
ccattaaagaggaaagttgggtgtgttcttatctatctttcaactgccttctccttcacaggccaacatcatcaatttgccatcttgtaggcaagacactctgaggtgcttttgacatcttagtgtctttttctcctctcttttggtcaaaagagatcatattttttcctttatgacacttcctattttgatatctcctcc

SEQ ID NO: 25652 - DNA, 201 bp, Bos taurus
atcccatagctgaggctggatgtgtatgaactggcacaaagccttggggctgtgaggcccgcatttacccacagaggctaactgaaaggagagacttgttcacaaaaggtacagacgccatgagatagtttccctgaggaagacagccctgtgacagatgcccacacttggaggaacctgcctagttcttagtccccaggg

SEQ ID NO: 25653 - DNA, 201 bp, Bos taurus
tgtctaggatttcagtccattactttactctataagtacatgacacctggtagtccaaatacatcatgagctcctcagaggtaaaaccttgggatataccttctgtgtagtgtgtggtggtgagagatggtggtgagagatcaggctctgaagttagacacacttggcttaacaccccagtgcagtgacatgctgaactct

SEQ ID NO: 25654 - DNA, 201 bp, Bos taurus
cttaattgtgagtggcttggaggaagccacacatggggtgattttacaaaaggctattatgttggcatatgggtttcacgatctgtggccatcacagcaatggctatttttagcttcccagaaaaggttgggcaggagctatttttctttttttctttcccccttcaatgctggaattggccactgtgtggtataacctgg

SEQ ID NO: 25655 - DNA, 201 bp, Bos taurus
tagctctgacaacctctacagtctgtgtaactaaggatttgtacccaaaatggaaagtgtcgtcagtagataactgatccggccactttcccactaaattttataagagaaccagaactgtctgaacataagtgtgatgaaatgagaagatgtcaatggcaaatgacggagataatgatgatgtagttctattttgctggg

SEQ ID NO: 25656 - DNA, 201 bp, Bos taurus
atgtggagtggccgcaggacttgatcctgacgagactttgcaggagctttactgacaactgttaatcctggcgaaaagccagaactcatctgccttgagcacctctcggcctccactccgattctccccagctgaagtctgtagagacagccaggcctgggcctcagaggctgaagccaaggtgaactctgtcccctgatc

SEQ ID NO: 25657 - DNA, 201 bp, Bos taurus
cattagctgcaagataagatacaaagtgaaatgttatgtccccttttatttgttttgcaactgtaaaatgtgcaacattttcatcatgatagaaaaggtagagaagggaaaactcccagcattttggcctaatgcaatggagcatgacctgtcaattgcgccatcttgcagaaaaacctactactaacactatccagggaa

SEQ ID NO: 25658 - DNA, 201 bp, Bos taurus
agagtcagacaccactgagcgactttcactttcacacctgtactgggcacaaactcagacagcatcagtgggcatgcttggacaggtggtggacataatccgtgagaccaaactgagtagagaccattctggcaacaagggctgaaagctgaccacaccctgggttgggaaaagccacgtgggggtgagatgtggcggggc

SEQ ID NO: 25659 - DNA, 201 bp, Bos taurus
gcagcccttcccaatgggtgttacaagcacaactgggctgtgagcacaagatgtcgttggcccccaggggcagaaagtggcctcaccacttcacccccccgggggagctgtggaaacaccatgttttttggtgagactggcaagtactgctcttgagttctcaatgaacagcatcctcttcatcagaccagtttaccttaa

SEQ ID NO: 25660 - DNA, 201 bp, Bos taurus
acaaactctgacagcaaaagtgtaatgttaaatatatgtactttacaaacaaatgactgaagcccaaagtatagtatgtaaaaaaaattcctttttttttcccttgatatagctattttattgaagtagagttgacttacaatttttcaggtgctcagcaaagtgattcagttatacatatacatatatattatttttcag

SEQ ID NO: 25661 - DNA, 201 bp, Bos taurus
atagatagtccagccatgaatgagtttgtctgttccaggaaaatttcatttacagaaataggcagcaagccaaatttgccctttgggccatagtgtacccgctcttgacttagagggtcatttactggtaagtagctaattagtgatggaactgcgatttgaacacgtttggggggaccctgtaaacctgtatgcctggcc

SEQ ID NO: 25662 - DNA, 201 bp, Bos taurus
gctagttagtaagcgaagaggacagggtccctctgacaggaagctgctgaggagaattggtatcaaaatgttagtattgtttttctgaggtaaggggattctgacggagaaggcaatggcaccccattccagtactgttgcctggaaaatcccatggacggaggagcctggtagggtgcagtccatggggtcgctaggggt

SEQ ID NO: 25663 - DNA, 201 bp, Bos taurus
gaactgagggttattcttaggtgtttggcctaagaactaaatgaatggcggtgccattatttgaagtgtgaagacttggggtgcatcagattgggcttgacgattcaggcctgtttagacatttaatgtttgtgaagtagacagttgggtttgtgagcctggagatttgaggaaggctggatatataaagttcacttaaca

SEQ ID NO: 25664 - DNA, 201 bp, Bos taurus
tcccagtcacctgggcagggagggcttttcaaaatcctaattcccaggctgcagcccctgtccagtgataccagagtcactggaaggtgaggcccaggcaccaatacttttcagtgctccctgggtaattacaatgtgcagccaacatcaagaaccacagatccagctggagtggccagcatattcagaagctatcctaga

SEQ ID NO: 25665 - DNA, 201 bp, Bos taurus
cagctacagtccatggggtcacaaagagtcagacacaactgagcagctaagcacagcacagggttgcctgtagttttccagtagagcatgggtttctgaagccatcgttagaagaggccccaagttgctatctgagcactgggttcagccatcacttctgctccagatctgttttttcttggccacgtcatggttcctagg

SEQ ID NO: 25666 - DNA, 201 bp, Bos taurus
ggatgttgcggagtgtttttaaagcaggagtattttgatggctgccaaggcaacaacagttcaaagaaatgtcagtttatctgccctaacttcccaacacgatcaaagagctggtggcttcagtgggtgccagcatccactcccaccacccatcccactgcccctggccagaccgggaagcactgtattaacagtgaatga

SEQ ID NO: 25667 - DNA, 201 bp, Bos taurus
gcctgggacattggaacagacacagtccccgccctcccaaggctgacattctagtaggggacacagcaataacaagtaaacaaacagccaaatatataattgctagctgggccaagactctggggaagataaccaggctgctgcctgtctgtccatctggctggccgtccatctgccagtactccagcctgtccttacgct

SEQ ID NO: 25668 - DNA, 201 bp, Bos taurus
gctttcagaggcggcaggagtttatcggctgcctcagccctggggtgaccccggaaatccgctaaaagggaaacaagggagtgttgctttgtcagtagtggtggataagagctccctccttgggtgaaggagttttgaggatgctgatggcaaggggtgccagggcagagaggaaactgaggctggagctgagggtaggaa

SEQ ID NO: 25669 - DNA, 201 bp, Bos taurus
gctttatgtaaatggagtcataaagtatgtactcttttcatacctggcttctgcttgttgttatgttttgaaaatcaccctagttaatggcctactacgcgttcatcttctgctgcatactattccattgtttgaatataccacccactctgggcttcccaggtggcactagtggtaaagaccttgcctgttggatccctg

SEQ ID NO: 25670 - DNA, 201 bp, Bos taurus
attattctaaacaaataacaggcacttttaaattttacagatgtatttaacacctgaacagtttaacatttagaatttataccagagcataaatctacatggtagctactgaagaccataaatgtttaccttctaagttactaaaaactaagtatataagtctaagttactaaaaacatttttcaaagagtattggtttac

SEQ ID NO: 25671 - DNA, 201 bp, Bos taurus
gatcatgcagaggagtgaggggcagagatttgccattcagaatttcaaagagagtccaagagccttgaagtacatgatgtggcttccactcaccgaccacgtgctgtctgtctctcattggcttaacacactatccatatcccctggaaggatgaaagggccacattgatgctgccagaaccccagacagtggttccaggg

SEQ ID NO: 25672 - DNA, 201 bp, Bos taurus
gtcttgggtaaggaaagcaactgtgtctctctgaactccagcccaggaaaggccagagggagtgaaacgctttctgctctgcagctctccgtgctgcctacgccgtgctgcctttccaagtgtggccaaaagtgcctcagacaccttcagtccagcccagagcatctcaggacttccaaagaggccccaccagtggataca

SEQ ID NO: 25673 - DNA, 201 bp, Bos taurus
ccttcttgaccttgcttatgttcaatccctggtctaggaactaagatcccacatgccctggggcaactaagcctgtatggcacacctagagaagcttgagtgctgcaactaaaacctaatgcaggcaaataaagaggaaaaaaagaggttaagtagtccaggtgggccctgctctaggtaccctcggtaaagattcagttc

SEQ ID NO: 25674 - DNA, 201 bp, Bos taurus
aacttttgatgtgtgtgtatgtgtgtgtgcatgcatgaactgtcattcatatatttttatatttattgtagaagtaacctgagatcacatgaaagggagcaaaggattattaaataccacccagagtacctcattccatgttggttgcttaaaaaagtgctggttaaacagttgatggatggttttgtaggcaggttatga

SEQ ID NO: 25675 - DNA, 201 bp, Bos taurus
tcttacggttttggtggctggaagtccaaggccttggtatcatcaggattggtttctggtggagtctctccttccagctagtattaatagatggcttcttcctcaggggcccacttagggccttttcactgtgtgtacaccctgctggggtcttcctgtttttataaggacatcagtcctctgggatcacagtccactctg

SEQ ID NO: 25676 - DNA, 201 bp, Bos taurus
cccaaccttttttttgcaagtccactctgaaccccaagagacaggtgatcttgaaactgataataagaggcattcttccctgctgacgcaaaaggctaagaaagttcaacacagattgaagtagagagacatgataaagttcagtttaaagaaaaagagggagatttagagggagggagagaaacagggagagagataaag

SEQ ID NO: 25677 - DNA, 201 bp, Bos taurus
ccaaggccccagagaaatgaatgaaactgttttggacaccccctgctctgcccctccagatcagagatcagaaccctttctctacaaaatgccagatatcaaacactgaaggctttgcaggccatccagcatctgttgttcctactctactcttacagcatgaaggcatcatagacagtatataaaagaatgggcatgata

SEQ ID NO: 25678 - DNA, 201 bp, Bos taurus
agagtcggacacaactgagcgacggagcacacgcatgcaagagctaggaagaggatggcaggcagtgagggtggcagaaggaaaagtcctgagatcagaatgagcttgggatgtccaggggacacatgggatgagggaaggggagccctgagtaattcctgagccaggggctgatagcagtgaccttgttcccatggcaac

SEQ ID NO: 25679 - DNA, 201 bp, Bos taurus
gaatgaacgggggtcccttagaagaacagaccctgctgtcccaagttgagggaagcattcagaaacccccaattctgatttcaaggaacaagccagaggacgaggaagaggggcagggaggaggcagcctgtggttgaacggctctatctgcccatcagaatgtttcctgggggtcccgccaggaattcaggcctgtgggc

SEQ ID NO: 25680 - DNA, 201 bp, Bos taurus
ttctcactttgtaaatggtgctaagttcctgaaagcagttggtgcttggtgagcaccccatgggtggcaacgaagtgaatcccaggaggaagtaaagagacggctgctcatttaggtgaaggtttgggaagacagacataaggggaggggactgtgcaacctcctgcctacacctgtgattttcagagtcagactagtgag

SEQ ID NO: 25681 - DNA, 201 bp, Bos taurus
cgaggctgaggcccagggtgcccgccaagatccacaccaacagtccgtccggctccagctgcaggggggaacaggggagagaggctgggttacagcagccaacagtcaaactgaggtttgagggcccctcgttagggaccagggagggacttttggcctccctgtgagacggctgccccaacttgaagttcaatgttttta

SEQ ID NO: 25682 - DNA, 201 bp, Bos taurus
cctagctccctgaccggggatcaaacccacattctctgcattgggaggtgaatccagagaattcttaatctctggaccaccaggaaagtccctaaagacccttttaaaatcaccactctgctcactgaaattctctctcactacttctggggactcatcatgcatttccaaggagtctgtttcatcaccctgctcaatccc

SEQ ID NO: 25683 - DNA, 201 bp, Bos taurus
ccatgcacgccgaaaacatctgctgatgggataggtccctttcacccccgctttggcatctcactgatgaccgtctgccatctttgacttcaattccggtactggccccttttcttttctcaacagccttacagatgcagtcatccacctggacaacctgatgaggttatatgccccatttctccttgtagccctggaaga

SEQ ID NO: 25684 - DNA, 201 bp, Bos taurus
gatctctgtctctcctggatcattccatgctgtgaagtcatgtaggtagcttatggaaagatccatgaggcaaggaactgaggcttctggccaaaaaccatgtgaatggaagtaaatttttcagccccgtcacatcttcagagattacagtccatgccaccctctgactgcaacctcatgaaattctcggccagaaccacc

SEQ ID NO: 25685 - DNA, 201 bp, Bos taurus
aacaacatgaacttacctattacatttctggagatcagaagtcctaaatgagtcaccttgagttaaagtcaggtgctgacagatctgcttccttttcgagcttctaggggaggatgcattcctgggcctttttcactgtttctagtgggtgcctgtattccttggcttgtggcttcttcctcaaaacttgaaagtacatca

SEQ ID NO: 25686 - DNA, 201 bp, Bos taurus
cctgaatgatgaagcatcagccttgggaaaggcatgttccagtgactgggaaaaatggttcaagtgcctgggacttaccggagtggaagaggggtacagattgagatagaaggtggagtggggattagagcaatcaggaaactgtagcctggggaaggaatgagatttctaaatttagtgggaagttactggaggatttca

SEQ ID NO: 25687 - DNA, 201 bp, Bos taurus
aatggccaatcaggtaaatgcttagactggtgcgaaggaggtgcacagagaataggagctgtgactcctgcaagtgcccgtgcagtgaatgagcccctgtgctcattttccggcccctccccaggccggaagaagaaggggaagctcaaagaagggcagcagctacacttgttgtaaaaacaaaacgaactctttcataac

SEQ ID NO: 25688 - DNA, 201 bp, Bos taurus
ggttgtagatgctgccattgtcaaacacctgctggatgaccagcccgaaggagaagggggagatgttcagcatgttcagcagcgtggcttcgctggcgcccactttgtctcctgtcttaatcagctgcacatcactctgaagaacaaggagttggcagttaacccctggatgtccggcaagtccaaggccaccgagtcccc

SEQ ID NO: 25689 - DNA, 201 bp, Bos taurus
ctaaaaaagacctgtttgatgctgatgtctagttaacttttttttttttttccacagccagagtaggaaaaaacagcagagagaaaaagaaaagactaacagtgtgattaacttagaggactttgtcattaatgcctggtgcagtggatttgtgagaaatgcaaagactagcatcatccaaggaacttctcagcccttgag

SEQ ID NO: 25690 - DNA, 201 bp, Bos taurus
gtaaggtccctggggcgccggcagccaaccaggacatatttgaactctggctatgtcctcctgcagtgggcgctggccaggccggcctcaactcgagggcgttatggcagttcaacggcatgattaagtgcaagatccccagcagtgaaccattgctggatttcaacaactatggctgctattgtggcctgggtggatcag

SEQ ID NO: 25691 - DNA, 201 bp, Bos taurus
taactgagagactgaacagtcacaactagccccgctagctcttatgttaatagctgtagtaaaaacaacagcgataataataacaggatccagaagtcttcagacactgactctgggccagcacccttgcttcatttaatctcttcacatccctgtaaataatgatgcaaacactcttattattattgtttctactttgca

SEQ ID NO: 25692 - DNA, 201 bp, Bos taurus
ttaaactttacaagcctgctgtgctgtgctttttaactagccgtgttcacatgtgagttgaagctttcattaaaaggcccaattaaagttgtggataagtaaagttttcctgctatcagttttaggaagacagatctcaataaaagcaaataaagcagacagcttttgtagatgaaatgatccagaggctaaaacaaccca

SEQ ID NO: 25693 - DNA, 201 bp, Bos taurus
agaagatgggagaggattacgaggtacaaactactatgtgtgaagtaaataagctccaaggctacacagtgcaacccggggaatacagtcaatgtacagtgattacaagtgggatgtaaccttcagaactgtgaatcactatgttgtacacctacaacttacataaatttgtatatcaactatacgaaaataaaatacata

SEQ ID NO: 25694 - DNA, 201 bp, Bos taurus
ggttgtttgcatgggaagcttgaggtgggctaattagaagcagagcatcctatatgattggtcagggagcttgtttggatttctttcatcagtcctaaatcggaagggagggaatagggaggctagtagttgttgaccaaatcctgatggtttccagttaattgatagaatggttcggcttccagactgttggctgcagag

SEQ ID NO: 25695 - DNA, 201 bp, Bos taurus
cggtggcctcacccagccttgccctgggctgcgatgagaatccccgggtggttcccgatcaggctctgagcactgccgctgcctagaacgtcctctttggcccagattttgtgctttcactgctggctccctaactgagggctggccctggagtcaggcctcagctgctaccctctacctcacttgatcccacagggcttt

SEQ ID NO: 25696 - DNA, 201 bp, Bos taurus
ccagccctaggccccctcagctcaaagtgagttcctcagtcagcagtgccagcatcgcctgggtgtcacttacacttgccaaatccaggcctggcccagctggtcctctgcaatcagaatctgatctgagtatcaccaggatccccgagggacttgtacacatgccccagtttgggaggcaccaggcctggtcgtcggaag

SEQ ID NO: 25697 - DNA, 201 bp, Bos taurus
ctttcttacagtctgcaccgcccacttcctcctcttggcctccttccgagccagggctccacgccagtgggcttcgagtgtaatggctgaaagaggtcactgctggcattagaaggtgagagcaatcccttaaatacaagagcctcttcaagaatgacgcaccccctccacaaatgcctggacgccgctgcagcactccgc

SEQ ID NO: 25698 - DNA, 201 bp, Bos taurus
aggcctgcggaactctcaaaagcagcaggagaccttcaagaaccttgctacccaaggtccaggaaccagcagcctcagcaccatctgggagcacttagaattgtaccatcttaggccccattccagacttactgaatcagcatctgtcttttgataagattcccaggttaaaatatgagtatagcagaatgcacggcagac

SEQ ID NO: 25699 - DNA, 201 bp, Bos taurus
gttgtagtcaaaagttcacggggccacaaatccaaggatctgtgctctaaacacagctgcctgtcccaaagatggacatatgtgacctttgtagtgcaccactgggacttggccctgggctcagcaggtcctaggcgtgaggcgggtcgccccagcctctggagctgtgatatagggtgacgatgcccagaggcgaggctg

SEQ ID NO: 25700 - DNA, 201 bp, Bos taurus
tgtcaaagtcacttcctcctgttcaaacagaagccctgtaagacttcagcacgttggttcccagaacatctgatcataacatcttataagtcaccattatttattttgctaatcaggaatgatcttgactgaagaggccatcagaggtcagttcactgactggtgaggaaactgaggcccaaagacttcactgatagcaga

SEQ ID NO: 25701 - DNA, 201 bp, Bos taurus
gttttcctttttactggtaagtcattcctggggatcttgggagacataatatagacttgagatgcagctccttaagggcctgaaaaggtgggacttagcatccccccagcccacccttcctggtctcctgggggtggttgacctcctggtgtgctcacctctgccgtcacaagtcagtggacttcgtgtagcggccacatc

SEQ ID NO: 25702 - DNA, 201 bp, Bos taurus
catgggatttgccaggcaagagtactggagtgggttgccatagtcacctggaaatagcagctaagttctccctggagataaatgctgggggcaagtctattcacctcctcccttcatctgtttcttccacatgtattgtgaaaccaaaagcctcaactgaaaaccacagacagtgataataataaccgcactgcagtcttt

SEQ ID NO: 25703 - DNA, 201 bp, Bos taurus
tcctagccttgtgaagtcctagctccctcatatatatcagtcaggatcaacaaggtgctgtcgctgtaacaaacagtcctaaaatctcagtgatttattacaacaaaaattacttaccatgcatgctgtgtgtccaccatgcatcagcaggggtctttactttttctacattcacgggcctggcagatggagtcaccacca

SEQ ID NO: 25704 - DNA, 201 bp, Bos taurus
tctgcaccagagattcccactcagagcctccttctttccctggggagccccgtacaagccccatcactcttagttaactcagaccttgccaggatccatgcgtggctgatgttagaacttggcgatgtttcagggcaagaaaggaaaaggaatgggaggtgtgtcccccacgggaggcctgtggcccttttgctctcataa

SEQ ID NO: 25705 - DNA, 201 bp, Bos taurus
gtacctgcctccaaggccctccggggcaggacacaggctggggttgggagcccggctccgatgcgatgctgaggaggctgtgtttctaggtgatcgtgtacgaaatggagaacttccagggcaagcggtgcgagctcacagccgagtgccccaacctgacggaaagcctgctggagaaagtgggttccatccaggtggagt

SEQ ID NO: 25706 - DNA, 201 bp, Bos taurus
aaagctaatacaattctttctcctgatttttgcaaaatattttggtgggacattgggatagtttgcctttcctggatgtcacatacactcgggaggtaattagtatccagacagtttgcagtggttcaaatgtagaaacaagggtaaacacattccacagttatctagtaagcaggtgttgggtcacagttttttattctt

SEQ ID NO: 25707 - DNA, 201 bp, Bos taurus
accccatctttggaagactggctttccccagtccagctgaagaggtgatgggcatgatgggggaggaggggtttccattaaagaaataaagttttaggcccatattttagaaagtaggcatgcaccagggtccccccattagctcttcttctgagctgagtttgatctgaaattttcccattcttttctgtctctgagacc

SEQ ID NO: 25708 - DNA, 201 bp, Bos taurus
ttttgcacctgcacctatatgacagaattttaagaagcaactcgcttgtattcattccttccaaagcactcagcctagttttcctggaaactcttggcccggtcgcatcgtacgggtgtgtgtaatagctaatagaatagtaattgcataaaagcgtgtgaggcataaacaggctgtgagcacacactgtgtggcagtacg

SEQ ID NO: 25709 - DNA, 201 bp, Bos taurus
aacccgcatcctgggctgcggcgagaagcgggaaggatgttgatggctctgccctcgcgttccttcccgcctgtcccagcctgtcccatttgtcactgccggtgttggtttaaagggccgtgtgttgtttcgtgtgaatgatttacacccttggccggtgcaccggcacgtccagatcaggatcaattaccccgccaatgg

SEQ ID NO: 25710 - DNA, 201 bp, Bos taurus
agaagggcaagaatgtcttcagtcagtctgcaaagtcgagcacatagtcaagcacctactatgtgccaggcactattttaggccctggggaccctgagcagcagaaaaattttccctcctccctggagctgaccttcagatgaaatgccttctcctgtctccctggaggtgggacctcaggcccaagctgatcaaaaccct

SEQ ID NO: 25711 - DNA, 201 bp, Bos taurus
agtccagtcccagctgccactctgtggccttgtctgtgaaagacggttagaccaggtgctctggtggctttgctttgcgaggtgagcgcactcttaactcaggactggctgacggggcccccagacccaccaggcagcgggacctcccgagagctgagtattacccaggggtaggtggtaactgaacagtcagctgctgcc

SEQ ID NO: 25712 - DNA, 201 bp, Bos taurus
gcctatctctgccctctgtagcacacagagccctggggtgccgggtgtacaggctgatcacaccccttgcgggctttttggctggagagatgaggcaaacaggccctgtgggtcttgtccagaggtcggccctgtgccctgagcgtagtccacaggggttgaagttggcacaaccactatgttcaagggacaattattcct

SEQ ID NO: 25713 - DNA, 201 bp, Bos taurus
tgtagggcctcacgcacgagtcctaagcaagccttgttacctctctgcttgggtaatgatttccccaggtctcacagtgcttattatcgaagtcacaacagacaatcatgggcctcctaattaaaaaccagtcttcgtttggtccctgcgcttgggactgcagcttggcattaccttatccaagatggaaagctagttggc

SEQ ID NO: 25714 - DNA, 201 bp, Bos taurus
ctggctgctacctggaggatgtatcagaggggattgagggcagaagcagggagattcattaggaggtcactgaagtgaccctggtgaggggccacggtggttgaccatcagcacatctgccccaagttccttctcttggggataaagaatgagaagcctttatttttggccaaggcactcagcaggcagccctcagagtgg

SEQ ID NO: 25715 - DNA, 201 bp, Bos taurus
tttgcttctctatccagcagcaaatactgcaacaataccttagggcatgggtgtgggagttttcagtctcccagatgagcacccagccctctgggccccacctggagcagcaggcacaggtctgcacaagttgttaagcctcctcctccccctcaacccacccccactcccaccgggcaggatgctcagcctggggcccag

SEQ ID NO: 25716 - DNA, 201 bp, Bos taurus
gtgggttgccatttccttctgcaggggatcttcctgacccagcgatcacactcacacctcttatgtctcctgcattggccagcagattctttttaccacttcgtcacctggggaacctcagttttcagttcagttgagttcagttgctcagtcgtgcctgactctttgggaccccatcaactgcagcacgcctggcctccc

SEQ ID NO: 25717 - DNA, 201 bp, Bos taurus
tggctgcgccgtggagagaacgaggcctgacagcaaggatttcgaaagaaccctggattaaaacaaacacaaatgaaactcaccttaaagtcctcaaaactccctggccttatttattgatttatttttaacgtacctgaatggcaaaggccaatataatggtagaacccgttttagtaaaaggtataagaaaatagctgt

SEQ ID NO: 25718 - DNA, 201 bp, Bos taurus
ttcagctcctattttcttcttacttctcacatccttttggttaccatttctgttttgtatctgaaatacttcagaccataatttggtcatggatcagaaatgatgaaaagagacatacttgaaatttaaaaattcttaaatgataagaactcttaaaaccaaactctacttgagaaataggacacagaacccaagtaaaga

SEQ ID NO: 25719 - DNA, 201 bp, Bos taurus
gaaagactttggatatgtagccccacgtgaccctgctgttgagccccagtttttagggagagagagaaaggagggatggcaaagattggacaggctgaaacggcgtcacccgttctgtacaagttttagctgcttgcctggtttgcacacatacgtgaccgtgatgggtttgagggggaggccgaaagaacaaagccagag

SEQ ID NO: 25720 - DNA, 201 bp, Bos taurus
ctgactctcaaaaacatttatgcaagcaagtggttccagttcaacacagtaaggcaaattcccagaaaattctccaatttcaaacaagagacttaactgaggttcaattctttccctctgctctgttctgttttcaataagccataaaatagcaacagaaatgaaatatcccagaatcctcaatttaagaggttcactgag

SEQ ID NO: 25721 - DNA, 201 bp, Bos taurus
ctagaccaggcttgtattgaagtcctggctcttgactaccagatgaccccacgttaaccatcccaggctttggttcccagcagagcattgctcctaacacagtaatccgaggccccaggaaggtggaggccctggctgagatgtacctcagaaaactgagatgtacctctgacgttgaccagcgccactcacagccgccag

SEQ ID NO: 25722 - DNA, 201 bp, Bos taurus
attttaaaaattaaatttaaatttgattaatccttttggttccacctgtgaaatctgaatcattttgtaatataatcctgtggaagtcatgatgtttttattgactgatttgaggctagcttagcaaataggtgggatctgaggttctgtggagcagctgagagtagttcctggggtgtaaaaatggttcaacaggtaaag

SEQ ID NO: 25723 - DNA, 201 bp, Bos taurus
tggtgatggacagggaagcctggcgtgctgcagtctatggggttgcaaagagttgaacgcggcggagcgactgaactgaggagactataggccccaccccttaccttctcctgagatggagtttatcttctttgtcttgtaaatttagggctttcagagggttgcagagtgaagaaacactcacgggtggcctgctgggct

SEQ ID NO: 25724 - DNA, 201 bp, Bos taurus
caggtgctttctccccgaggccccctttgtagccacctgaggcagttcttgggtcgaaagcaggagactgactgaggaatggaacactgtgagagcacagggggccctgaggcagctcaccggacggaaggaggtgctcagaagcctggcctggggagggcgggcctgcagcctgggctctcctggaggggttggggcggg

SEQ ID NO: 25725 - DNA, 201 bp, Bos taurus
gcggtggagagctcacggtgctggagaaggtggaagacgtggaggacagaggtggtccagtgtggggtgagggagcccccgtggccgcagggaaccctgcgtcacgttcaagaagaggtccctgagtggtagctttagcaccgagcctgcaggtcagaagcgtgcggtgtgtcccctaaaggctgatacacagcagtctat

SEQ ID NO: 25726 - DNA, 201 bp, Bos taurus
aaacctttctctctgtagctctggatctactggacaaaatgttgacgttcaaccctcacaagaggatcgaggtggagcaggctctggcccatccttacctagagcagtactacgacccgagcgatgaggtaagagtccggcaggggctgcctgcctgggcggagggggagcgcgcacggatccgtcagctcccccaggagc

SEQ ID NO: 25727 - DNA, 201 bp, Bos taurus
gtggggttacagatgaaggggccttccatgacggcccaggggttaagactccgccttccaaggcagggggtgtgggttcgaaccctggtcagggagctacgatcccacttgcctcggccaaaggacggaagcacaaaacagaagcagtgttatgataaatccagcgaagactttaaaagctagatgaggagcccgcagcct

SEQ ID NO: 25728 - DNA, 201 bp, Bos taurus
ctggggcgctaacaaccccaaggggcttgtgactccatccctgagtctgccgcgcgctcctgccttgacagacagctgtcgagactgccttctggcctctggtgtcctgtggcgcacgggctggctggggtgtggtgcccgtggaacctgcatggagccctgggctccctggccgccaccccctcgccccctctgctctgg

SEQ ID NO: 25729 - DNA, 201 bp, Bos taurus
cagctcgggcagcgggcagggccaccccccagccaccgcactgcgggacagcagccagcagacgcatggagcacctcttgccacaggggatgcagactgatggccagtgggcaggaagacggggtggcggggtcctgtgtgagtgatgaccccggcgtgcacccgtactttgccaagaaaggtctggaagcacacagccaa

SEQ ID NO: 25730 - DNA, 201 bp, Bos taurus
aacatgaagcttaaagatacatggcctgaagattaatagaagtataaaaattgccaaggggcctaaaagaggagctagctaggagaaccagggccagacactggtccatgacatcagtatttctcaaggtgtgagaagatgcaagaatctggactcaggaaaatctttacctgaaagtgtctaactttctgaaggcctgtt

SEQ ID NO: 25731 - DNA, 201 bp, Bos taurus
aataaagtggccgcattcaaaattaaactggaattatgggggcaccaagtcaacactgagattttgacatgtttcaaacatcagcagagattgaaagagatagagccggggccttctttctccaagctggtgcatgatcacctatttcagctttcaaaagtgtttgagcattacttcccaaccacgaaagacctccaaact

SEQ ID NO: 25732 - DNA, 201 bp, Bos taurus
tcttttagtcctgaataacacctgtctggctgtaggaagcatggttgtaccccctccccactcctacacacagccgaattgtggagcaggaagaaaaagatgcttcttttcagacggtttaggccgcagcaccagcatgaaggaccctgctcagtgaggccgggacccagcagccagagctgcagtgacagcctgcagaca

SEQ ID NO: 25733 - DNA, 201 bp, Bos taurus
tctcctggcttctctttctaaaagccttacaacaaccagcctcagtttacggctagatcggtcagttcccctgtggccaacaagcctggtactccaagaggactgggtatggaagcatttctgggagactcaggcatggattcagccagctgaagcagaaggaaagattaattcttctcaggccgtaccatggtgtgcctc

SEQ ID NO: 25734 - DNA, 201 bp, Bos taurus
gaatgaaaacatgaagacattttcttccctactacaaaaacaggatttgtggtatctgaataaacctgtggcatgcaaacacagtttggtaggccctttcctcaccaaaagagatgacttaaacaaacaagcaccaagcaagggaggaatgcaaaacaaaagataggaatttggccatcactctgacctgtatgaacacca

SEQ ID NO: 25735 - DNA, 201 bp, Bos taurus
cagttacggctgttagctgatgtccccttgctggggcagcaggcacagcacggggacggcagggcgacactggcagcccagagtcttccacctcctcacaacaagcagtctggaacctcggccacattttgaaatccatccctttgaaccaatgcagacagcttaatgaagcagtatttacggaaccgatgccactaggga

SEQ ID NO: 25736 - DNA, 201 bp, Bos taurus
aaccagcaaaacaccagacgtcattataaagttctcaaaaacagccgggatctacgattcgagttatggaacctcggccctgcctttccctggccttgccgtctggccctgcctttcacagagagagagagagagaggggaagagcgcgctagccaggacgcacacgtgctccttgtctcctctgctctgtttcggcagaa

SEQ ID NO: 25737 - DNA, 201 bp, Bos taurus
cgccagcccgccgcaaggggaggcccgcacatcacaacaagcgagacccgcatgcactgcaatgaaggctgcgtgaagtcaaaataaatttctttaaaaatgtatgtcaattgttcatttttaatcctactaaaccctggtccatctactgcattattttggtaaaggttttacagtatgctttgagtagactggcaacaa

SEQ ID NO: 25738 - DNA, 201 bp, Bos taurus
atcagcgctgcaagttggcctcacccacaagtaactgtcaatgagagaccattaggaaagcgattcagccaagcgtcagtggtgacatcaaatggagagtgagcttaagtgtcgggttcaggccttctcctggcggctctccagcttcctccgccttggaccaaagggtgagcgggagggcccagggaacagcctggggag

SEQ ID NO: 25739 - DNA, 201 bp, Bos taurus
aagaaatcacttcacagaatccgtcatgttcaagaagagagctctaagaacatacatacatacaccagatatttttgacttttgagactgactgatgagagagactaaggagagcctcagatttatccacactatctcttcctagggttctcagtgggtgaggagtggggagccttgtttcttgaatattttctgaagaca

SEQ ID NO: 25740 - DNA, 201 bp, Bos taurus
agaagtgaggtagcgatctccagctttttttttcttttaaatttgagggaggggcatgtcctgattctgggtgtgacctgggaacttacacagacacagttctattttgggggagagagtaaccagcagcctttcctggtcatgcagggactgcagtagcaataactatggcagagatttttcccatggaaatttgcactg

SEQ ID NO: 25741 - DNA, 201 bp, Bos taurus
catcctgcagtgacacagatgccttaatagggttaagctgttgtgtttgtgtctctgtcttgttttgggatgtgtacaagtgagtcagatcttttcctccttaggcccagggagagcatttcgggcctgtatgggctgaattgttcccctgctcccattcatatatggatgccctcaccaccaatgagactgtgttcggag

SEQ ID NO: 25742 - DNA, 201 bp, Bos taurus
ttgatgtataattaactgcccatatttaaaatcaacaatttattagatgttggtatatctacgcacccatgaaacaatcaccacagttgggataattactgtagtgctcccacccaagatttctcgtgctcttttataatcgctgacttctgatcccttaaaacccacacaaccagtcatctgtttaatgtcacgataggt

SEQ ID NO: 25743 - DNA, 201 bp, Bos taurus
agtgttcttgcctggagaaccccagggatgggggagcctggtgggctgtcatctatggggtcgcacagagtcagacacgactgaagcaatttagcagcaggagaaataattttccctataaaattttaagtgaacagagaagaggtttctcatgataatctaggagagcaggataatccaaataatctctttttatcaaat

SEQ ID NO: 25744 - DNA, 201 bp, Bos taurus
cttcctgaaagagatcatcacatgtatttatccctgggactggcactatgcagtcttcttcctagggaactgcatttgttcttggtaagactagtcctgacaaagccagtgaaggctctcagcagctacatgctgacccccaaactcccatctgctgctctctcctctgagaagaaattctccagccccagtctgaaaaag

SEQ ID NO: 25745 - DNA, 201 bp, Bos taurus
ctcacactgttttgagtcacctttcagctgaaatttcaccccaacaggtctaccttggtggccccctctaaacaccgaatactacctcatctcgcacaccgctcccttgcccagtttgatttatttcttcacagcctttattcctgcttgtcatggtgtacttttgcatttctcatcctctccacattctactgtgcacgt

SEQ ID NO: 25746 - DNA, 201 bp, Bos taurus
gtaattctcttctattctgccttggtcagaccactcctggtggtgctaagttcttgttgcaatattttggcaagagggaaaatgtcaagggaggagagatggagtggtcaggtgctaccctggccgagacctttgcagggctctcagctgtttcttagtctgtgggctggagaaaagatggttaaagagagcagagaactc

SEQ ID NO: 25747 - DNA, 201 bp, Bos taurus
gacggaccaggaataaatactgggcagcccaaagaacaggtgacctctcctgcaggcaggctgaggaatcacgcattttaacaggaaccgtctcctgccccgagtgattctctggcaagggactgaaggctctcactcgagagctgctggctgagtggggtagacagaccccagacatgatacaaagcagatgctatttgt

SEQ ID NO: 25748 - DNA, 201 bp, Bos taurus
gtgccgcatggcggcctgggtgtagatcttgctggggaaacaggtgttgaaatccttaactatcctgctgcctggtgctaggccggatgcccaggcctccgtggggtcacattcttctttcctcacacccacctttagcagggcactgctaccatgcatgcgtgagaggttagggttctgaggactcataggactggtcca

SEQ ID NO: 25749 - DNA, 201 bp, Bos taurus
actgcgcttctagtgactaaacaaggggatggagcgcttttccattctgcagctctcacctgaaggaacattgctggcccttaaaggagcaatgtctgcttgcaggtttgacttctataaccaaattgggtcagtggcgtgttctcaccctcagggcccccaggaatgacaccagcctgtacccagcttctcatccacaga

SEQ ID NO: 25750 - DNA, 201 bp, Bos taurus
caggtgtgcagaatcaaagctgagataattcattctcagttgccctagaatgagaagggctgtaactgtgactctctgctactttcctacatgcagtgatgtttaagccaagtgccaaacaggtcctaccctgatattaaaacatggtacaccagaccccacccctcgcagagatcttagccctcctggggagggactggt

SEQ ID NO: 25751 - DNA, 201 bp, Bos taurus
ccggtccccggagtgagtgcttccgaggctgagaaatcacttttgcactctccagcctttagctagacctcactaggctgatgtggccagagggaggggtgtgctggggtccctgccaaacggagggcagggcaggcgaagtgcaggatgtggaagccctctggctgatgggggaggcaggccttgaaggatgctgcggga

SEQ ID NO: 25752 - DNA, 201 bp, Bos taurus
ccgtctggcagcttgattaatttatttctccttcttggagactgctgcaaggggctttggtcaccctgtgtccccatgggcctgtaacctgagtgactgccgacacattagccttacggcaaggaagccagtccattgccctgcactaggaggctttggagtcagaaggtggtttgatatgggggcctcaactcaaaccct

SEQ ID NO: 25753 - DNA, 201 bp, Bos taurus
ggttgctcatggccacattctgggcatccaggcaagatctggctcctgggggaaaggacacttggttctttctgcctggagcctccatgggagagggccattgctgacagaagatgagacggaaaggggaaacacggagaaagaccgaggtgcctcgggcatgccagcagtattccgaatttgaccttcacgaccgtggaa

SEQ ID NO: 25754 - DNA, 201 bp, Bos taurus
cgcaaaggattcttcagctcacagcaagcagacctcacaggccaccccctgaacaccgcgccgggcgggaaagggggcctggcacccctaaggatgccccaggtgtttgggggctgggggataaaaagccgttcccttcatccttcccacagtttcaggaaggaccccgtcacagaggtgcacggcccccgcgtatctgtt

SEQ ID NO: 25755 - DNA, 201 bp, Bos taurus
tcgtgagggccacccccaagtttactgctggaatccccagaacctggaacagccccagcacactgtggctgctccaaacacatctactgtctgaactaattgataagcaggggccttgccatgccaggggcgagggcggtaaggaaatgccagtgaggatgctcagcccctgtgctaaagcactggaaggcaagactggtg

SEQ ID NO: 25756 - DNA, 201 bp, Bos taurus
gcacgcagcaatgggagatctctctcttctctatgaagcactggataccccgccccgccccccatgaatcagcaggagatgcattcaccaggccaccccagatctctgccctttgaacccttcccataagcatgtctacaagataggaagtcactgtaatgcgcaaagggccaagagaggctcccttttggatacctattt

SEQ ID NO: 25757 - DNA, 201 bp, Bos taurus
gtgtttcccgtgaacagctgaacagcgtcgccctgctttctctcaccccccgggcatccccacatgtggctctcattcatcccctccttccctcaggccatacagacgtatggagtagcacctacacactacagacgccgtgggtgccctcctgactgtaaaaccacaccacccaggggccatgggacatcactcggcggc

SEQ ID NO: 25758 - DNA, 201 bp, Bos taurus
taggagaatctggggtgcactcaccctggtcaactctcagcagacctgcgtgctctgccctgatggggtcccgggagatgtgcatgctcccaccctaatgcaggtcttagcatttcatctcacagctctcaagaccacatctcagagatgattatgggtggggctggggtggggcgaggcaggggcgggcttccaacagca

SEQ ID NO: 25759 - DNA, 201 bp, Bos taurus
gactgcctgaatcagaaattccagggatggggctactggcaattagagttttaacaagtccttcaggcaatctggtgcccactaaagtctgagactcagcgccttatggccatgtatcttggccttggctgtggctacacacacctgggtggctggggcagggggtctttaattgatctgagttgggggcttccctggtgg

SEQ ID NO: 25760 - DNA, 201 bp, Bos taurus
cccatagtaaatttttgctattgggcccccggctcttgtttctgacaggctggagtgtgactggtccagaacattccacagggccacatgaatgcagggttggaatgtcagcgtgctgttatctgatttgcgtcttttcagttcgtttcctgttggcccgaagaatgttctcaaaattacgtggactctcagatggtgttc

SEQ ID NO: 25761 - DNA, 201 bp, Bos taurus
aaacaaagcatcccctctgcatcctataatgaccatctcagattgtcctggactcaaacacacagtcaggggaggccatggaaaggagagagagaagaaactctcactgaggggatcttatgaactcctccaagaggaggtaaataagttcatcttctcttgatttttgcttttttttttttttttaagagatgggagaaa

SEQ ID NO: 25762 - DNA, 201 bp, Bos taurus
ggtgccccccacattctccaacccaggacagggcacccatctatggcgaatgagcacccagtggattcttcacttcaaacaaacacaaatggatgaggctctccaggccaaaaccggtgcacggtgctttatttatttaattggatttaatcttcattctgcttagtgaatactagaaggaaacaattaagcaaaagggag

SEQ ID NO: 25763 - DNA, 201 bp, Bos taurus
atcatcccaccagccgaacttcctgcaaggatgggaaggttctacgtcaatgctgccgacaatggtagcctctgaccacgcatgcctatgggctagaagcatggccagtctaactgagggatctgtactctcaagtttcaattttatttaatagcaaataattttaatttaaaaagcccacatgaggcaagcagctggtgt

SEQ ID NO: 25764 - DNA, 201 bp, Bos taurus
gttacgggaaccgttaaactctctgtccacaccaccctttaagccacttcaggtgtctccctcaccgactgcccaaaaggtcctgagtaaccacatgatctcgacacagaaaatgcatcctttccaggggcccagagttggacgcaaacgctgcccagcagccaagggcagaaacccctcctaccttctgcagagtcctct

SEQ ID NO: 25765 - DNA, 201 bp, Bos taurus
ggcagtgctaactctgttgtgtgtttcttttttaaacactggaagtgttggtctggccggtacaaatgtaaaagcaggcctgcctacagagaacttatactgatccttctccaactcctcctaaagactgaagaggaaggaacactcccaaagacattctatgaagccactatggccctgataccaaaaccaaagactcca

SEQ ID NO: 25766 - DNA, 201 bp, Bos taurus
tcatttctaatgcattcctatcatctttcaaatgtattttaaagagactgacctcatcagagaggtttctggtcagccacagtttgtcttgtggttaggggcccttcaatccgatttttgtttctagtgtttctgtgtatccagtaccaaacagttagaattgatgtaaataatgattcaaagaccatgaatcatcaaaga

SEQ ID NO: 25767 - DNA, 201 bp, Bos taurus
cccatgcaggaatacctaaactcaccccgataaagcttttgcgagaatcaaagtcagtagtacatgcaggcagttttgcacagtgcctgacacaattaatattagttgctagttcagtgatagtgtcatgctgcaaaagctggcccaccctttcgaaaaaggaaccaagtgatgggcccgaggaagtggtggtgctgagtt

SEQ ID NO: 25768 - DNA, 201 bp, Bos taurus
tcactgacaagaactgtccgcttgatgtgatgtcaaagaattgttttcaccttcttcacttcacaaggaaaatatacactagctttcatttcaataataagtactgtcgctacgagaaagtgaaaatcagaaacaaagagtgatgggcaccagtgttttcatttggttgatttctgctctctcctagggaactcctttgtg

SEQ ID NO: 25769 - DNA, 201 bp, Bos taurus
atgtcaccgttatcctgagtgtttcagccatggccacaccttcagccctggcaggaggccccaccagggccccgtgtcttctaataggatagaagctttacggtttatatcattgtgattaaggaaataagtcaggtttgaaagttacctgcatataggtgataattaaagctgttaaaatggatataattaataaggaag

SEQ ID NO: 25770 - DNA, 201 bp, Bos taurus
ttcccagatgtggctgcagctgcccccaccacaggcagctgattgagaagcaggaaggaaacccatctggcaaatggggtgtggtgcttggagcatagcaggaggccatggccagcagccccagcagaccaagtcagcaggcgtgattcccagctggagaggagcaggtgactggcgaggggctccaaggccagcaggatt

SEQ ID NO: 25771 - DNA, 201 bp, Bos taurus
ccatgctttacctgagtgcctcaatcttctggtgacttggaagaaatggctgagcatcaggctccagcaaatcccaagtgcccatccctggaccagcaaattgactagcatcagaagcccatgggaggtgctgaaattacagaggcttaagccccacctccagtgttgttgcctggagaatcccagggacggggagcctgg

SEQ ID NO: 25772 - DNA, 201 bp, Bos taurus
accataaagggtttgcacgttgcctccaggctctgtagctgtcgtttccaaaggctgaagaatggtcctctctgagcactggccacgctggctggaagtcgcctagtttttgctctgaacatgagcgcttggtgggtgcctccttgtctgtcatggccagggtttgtctgttgcttcaggtttccgcttaggattgggatt

SEQ ID NO: 25773 - DNA, 201 bp, Bos taurus
cggccctggattaacacgggtcccaaccgctggacacggagtagccacatgaccccacagctccaccccgggggtgtacgaggccccaaagaaccgacacggtgaagcagggtcctgtgcccacgtgttcacacttgagccagaaggcggaacacacaagtgtgcgtagtgggtgagtggactcctgagtgcggcccgtct

SEQ ID NO: 25774 - DNA, 201 bp, Bos taurus
gccctggagcagaagcacagcagctttgaagtctggggctaggggtggtggaggaccacagcagcctcccgccccacaccctgtggccggggcctccctgttcccccagcagtttcaggattcagaactccagaccattctccccagtgcgctgggaagctgggtcgacattccgggccaggcaggagcagacactgaagc

SEQ ID NO: 25775 - DNA, 201 bp, Bos taurus
ggaaggaatcactgccttggtgatctggtggggaagcttatgggggttggaagggcaggatttcctcctagaccctgtaaccatgggccatatcctttgcgccttagagagcatgcacttgcgccctctgtatttttaagggagctattttcctgtctttctggaggaggaaagtggttggcggtggctgtcagacccttg

SEQ ID NO: 25776 - DNA, 201 bp, Bos taurus
atgagcagagactgtacctaacgtggaagcccacaggtggggctggagaagacctaagactcccggatcagagacaaaggacttgacctcttactgcagcgggcctcctggcccaggtcccacgggttgacgtgagggggccccagagggtgctgtacacactgcccatcctcccctgctggggaaccctgaacttagggc

SEQ ID NO: 25777 - DNA, 201 bp, Bos taurus
ggtaagaatacggagaagttaccaatatacgaataacacgtctgaaggccagaacatcatccacgttaaaaaaaagagtccgtgaggaaataatgtaaacagtgaccactgtatacaaagggcctaagtgaccaggcagtgccacacattaacaaacttaattcttaaaaccttttagcatgactcggcgattctactccc

SEQ ID NO: 25778 - DNA, 201 bp, Bos taurus
tagaaaaataggaatctgtaatggtagagcatggggccttcagggaggagtgtgggagcagagcttgtatttgtgggttcggatccggtgccttgaacttcagggttagccctggcgaggaggcctatgtgcctcccgtcacagcctgtgagcagcgctggctctcaggttcatgcaggtctggtccaagtactaggctgt

SEQ ID NO: 25779 - DNA, 201 bp, Bos taurus
gcccttcactggcgcttggccccgagggaatgacgttccctctcaaacctcagtttcttcgtcagcacgggagggacaggagtggtcccagtcacagagatctgtgagaggttctgtcagggccgcggccctcgacccgtgggcgcctcgtcgacgccggccccacctgggggcctgtcagggatgcagattcccggtcca

SEQ ID NO: 25780 - DNA, 201 bp, Bos taurus
gggccccaccatgctgattcctggtggtgccccaccctcaaggctgaccaggacagaactgctcacgaatcagggaaacccctcaccaccctcatgtgccgtctgccaggccaagccccgacgacctgccctgggccttgagccctggtccctgtgccacagtcttcccatttgtaaagttagctatgctgtccagatata

SEQ ID NO: 25781 - DNA, 201 bp, Bos taurus
agagaagggaaattatctctaagctcaggccttccaacagcccccgtggctttcggaagcttactctgtgccattaatccctggctcacatccccagtttttggcctcgaggacagagggatgggccagctggagcccgtgcagcagacagaaacccacgtggaggaggatccgaatcgcggcaggaggaaggaaggggag

SEQ ID NO: 25782 - DNA, 201 bp, Bos taurus
aggtgcttctgtagggtttaaaatctgcccacggtgatggcaaattcagacctctgccttcattcccaggttgcctgagaagccagaaaacagacctctccgcctaacccagggcttctggaccagggtctccaaggggagcagagcagaggtggggttaacaagccggtgctgctcttgaggccaggctggggaggctcc

SEQ ID NO: 25783 - DNA, 201 bp, Bos taurus
catcatccccgccctcccacttacctttggaccaattggggcgccttctggctcagcgcttgcctctgaccccgccacaccacgaatcttcagtgaatggatcctccccaaggccggctcctgtcccattgagtgtctgctccagaatcttcattcgctcctgtatgacctatgacatctaaacttggcgtggcccatgag

SEQ ID NO: 25784 - DNA, 201 bp, Bos taurus
gagcacatggacagcatgcttttcagaccagatgccacaggtagagccgggaaatggctcatacacagaggcagcaaggtcaccatcatctaattccctgagcacagcgataggcgtttacaccggctgtagatacctggagcacccggtaagaccggccagtgtgaccctgggcagctcgcgatttctccaagaaggagc

SEQ ID NO: 25785 - DNA, 201 bp, Bos taurus
cctggaagccggcctcctgcgccgagcccgcctgtggccctgggccttcctccagggatgctgctgggagtggaagctctggcccttccgctgggtgacccaactctgactcacttccccagagaggtccccaccaagcttgacatcaggtcagctccttggagcatccagcccctgaggaccgcagggcaggtattggcc

SEQ ID NO: 25786 - DNA, 201 bp, Bos taurus
ctactagggccaagatgggggaatatttgccttccaggggaccctgagcttcattatacgttcattgtaacacatcggctaaatgacacatctacaattccgaggccagccatcaaaacccaaagagtagctggtggcctaacttctggaaatccccaccactttcaacccactccagtattcttgcctggaaaatcccat

SEQ ID NO: 25787 - DNA, 201 bp, Bos taurus
ttgggtggagtggcagagcgctgggtctggagctggggacctgggtcaatgccacagctcttgtcatttcccagctgtgtgaccctggccgagtccccgctgccccagttggaaagtgggaatcacacagcttgcctctggggttggtaggaggagtaagcagtttcaaacagtgccagagtaaccattagaggtacgaag

SEQ ID NO: 25788 - DNA, 201 bp, Bos taurus
ggtgtgtcggtgcacacagggacgagaggatttagggaggcaagcctgctgtgtgtgttgcacagccggttagcgcaggggccaggtgcctcccccatccgccccaatgccggtctccttaccctgggcagctgcggcacttcccctggctcttacagctgtttagagtctgtaaacccgctaatccctggccatgtgtca

SEQ ID NO: 25789 - DNA, 201 bp, Bos taurus
tgctgccccacatgcagccatagagtgggtctcccctcttccagggccacgtggggtttcccaccagtgtctgccttctgttttccagcgcagagtcctcaactcaatcgtgcacccagtggcccagggccttattgaagggctgggggcgggggcagtctgcatttctagcctgttcctgggggactctactgctgctgg

SEQ ID NO: 25790 - DNA, 201 bp, Bos taurus
ttgcttgctctaggccaggctttgggctacgcaccaagcctgtcaccaacaaagcctcgcttggcaagtgaagaaatgggagctcagaaagatgaaatcactggcctcatccagctggttggacacaaacactgaccccagaactggtggaatagagcaggcctcagcctgtgacaggtgagtagatggggagatgggtgc

SEQ ID NO: 25791 - DNA, 201 bp, Bos taurus
cctggactgtgggggcttcctacagcaagtcagggactgaacgaggcccatcccaccactggcagccagttcctacaagcctgcggccctgatcgagctcactgtcactctgcaggagcaaaagcagtgatggggtcaccagtggcggttccgaatgggcacgggtgggtgattgctgcacccacgggggcccaggtagag

SEQ ID NO: 25792 - DNA, 201 bp, Bos taurus
gtgctttatgtctggcaagactgccaccagctcctgcagctcctcatggcgggcccccagctgcacagcatggcacggggagtggtcacgtgacagggccggggacagggtgacaagcacatgtcatcctaaggagaccatgcctagaaagcaggtctcactaggatagctgtgtcccggcccacttacctttaaaaatac

SEQ ID NO: 25793 - DNA, 201 bp, Bos taurus
ctgttgcttccagacattttatcatgggccttttaaatagattgcagaagcacatgtggctgagacccccgtcagcccttgaggagctgtgtggtgcccccacacaacccgggccccagcacctactccgtactcagcctgctcagcttcaggcagggcgggccaggtctctccccagcaggcggcttcagcagccccctg

SEQ ID NO: 25794 - DNA, 201 bp, Bos taurus
ggggtgttggggaaagccgtgtactacagcagcattgcagtccccgtagttagggctggacagtgacacgtaaccatcgtgacacaggacacatggcctcgtgggctccaggtgaaagaccaacaccacccatccacttcggggacgttgacagattcccctatcaccccaggactgctgtgtgctggagagcaagaggtc

SEQ ID NO: 25795 - DNA, 201 bp, Bos taurus
tgccccagggtttgggcaggttgccccaggacttgagttgtgacaggccttagttgcctgccctctgctcctccagcaaacaccggaagctgtataaggacgtgtccggtcacacctggcgtggccctgtgacctcctggcactgcaagacaggctcagcccagggctggtgctgtgatgcaggttgtcatgcacctccag

SEQ ID NO: 25796 - DNA, 201 bp, Bos taurus
acaagcacaagccgggggtctccttcccaactgctccgactcaaaggcccagggcttcaggggtggctgtggactccgcaagcccacctatacctgctgtgtgcaccaagatgctcaaccatggcccagtgccagtgaggcaccaccttggggtatggtctgcctatcatgttgctggcagctaaggccctgcagacccag

SEQ ID NO: 25797 - DNA, 201 bp, Bos taurus
ggtactgtaggaaaatgacagagctgagttctcaatcctggctgcacattagaatcaaaaagggagcttttaaaaatgccagcggccaggccacaccccaaaatctctggagaaggggctcaggcatcgatattctgtgtaactgaggatgagaagcactgcccttggatgatgcttctaaaacttcagcttgttaaaaac

SEQ ID NO: 25798 - DNA, 201 bp, Bos taurus
caagtttgaagatgttgaagggagggccactggtgggaggggacaggaacgaggggaaacttcaggaagagagaggaatggtgaaagtagtggaggaatgatagggctggacagggaggcctggcgagctgcgattcacggggtcacaaagagtcggacacgactgagggactgaactgaactgaactgatgcttttacat

SEQ ID NO: 25799 - DNA, 201 bp, Bos taurus
ctgagacaatagagagtggtggtgtttgtggcccacgggagaggaggtacatggcaataatgctcccatggaagcagcaacccgctactggctaaacgaacagatctgaccaggccacagggcctctggtcggcaaacctgcaaagggctgttccaccagggaaaatattcacactatttaaccacgggaatcccggttat

SEQ ID NO: 25800 - DNA, 201 bp, Bos taurus
ttggttcagaagaggccagttctagagaggcacttaccacaggggcggtgagcttgcgtctcaggaggatgtggcaggtgaatgtcagcacaatggcaatagtcgatgcaatgggggccaatgctgagtttccactctggacaaatccagctttttccagtaacttcctttccttcttccttatacctagtaaatagaaat

SEQ ID NO: 25801 - DNA, 201 bp, Bos taurus
gtggctgccagtggaagaattcatggacagcctggcaagtctccccgggagtctggaaatgtacagaagcagagagactggaaccaacacctggccagacatgctgaaggtgagaggctgctggagcagcctgtcccagtggatacagtgaaagagggttgtagagctgtaggcactttgcaccactgagtggccaggatg

SEQ ID NO: 25802 - DNA, 201 bp, Bos taurus
cgcttcagcttcgcagcgggttggggtctgcgggttgtaggtgccagttgcgttccctgcggggtgctgctgagtggccgggctcacagacagggcttgcgtttgtctaacgcgtaaacgggggaaccaaattcatttcacagctgagggtgctcaccttggaaaaggccaaggagtttgggaaaagtgaagccccttcag

SEQ ID NO: 25803 - DNA, 201 bp, Bos taurus
gaactctgatctgaagagcctagcccacagtgacctgacggggagagaggtgggggagtggggaagataatacactaacttcttcctccttctaccccaacatctccactggcagcccctatcagccaaacaatatgaagacaagaaatgcagttcttacaggtcacatgagacatggaacagagcagggaagggagggag

SEQ ID NO: 25804 - DNA, 201 bp, Bos taurus
aatcccaatagcaacccttttggcagcctgtcattcctctgtcaggaaggttctctgggacagagactgtacatcactcctcttatatgtccaaagaaatgtcaactagaacaaaccaggtcacacaatgtatatctggaaaatcagactgtttttaaagagagaggtagatttcaactcaaactagggacaggctttcca

SEQ ID NO: 25805 - DNA, 201 bp, Bos taurus
caggttttgttttgtttttttccctttagttgccccataatattgttcctaggtggggctacctttttaaactagaggataaatagaggcctaaatcagtgtggttattcccactcattctaattaagaatctttgtttccactcaacaagatatgggaaaaaatagggcctcttcatgatatttctattgtccattaaat

SEQ ID NO: 25806 - DNA, 201 bp, Bos taurus
ctgtctccccaaaaagccactggtggggtctgctgccctctggcccagtctctccctctgctgaacccccaagtcctgtccatgtcgccacactgtggttcattcttagactgtcttgcttcctggccctgttgcccgttgacttattcctatctttccattcccatggaaaatcctgccttctccctttttgcctctgtc

SEQ ID NO: 25807 - DNA, 201 bp, Bos taurus
tggccattagatttctgctcacagagcagcacccacaggagtctgggtcaccagtcagggcagtccccacaccctgggcctggagcagatgagtgcagataacccagccccccagccccagccaggctccagcactggttggaggaggaggggccattccagacgatgtgactcagagaagacaagggctggagggggtgc

SEQ ID NO: 25808 - DNA, 201 bp, Bos taurus
gccactgctggcgccactggcagggaggtgggctttgggaaaggaccacccgccaggggtgcccctggaagacagggatgtttgtaaaggtgttcactgcgggatcagacgggggcctgggactctgggattttgctgggggtgggagtagtggggagagagtgagagagaaggagggctggagaggctgaagggggaatc

SEQ ID NO: 25809 - DNA, 201 bp, Bos taurus
ctggccgcccaggtgtcagtggccactgcccttctccctacaactctgtcactccttccacaggggcacaaccccacaagagatgacctttctaaaacctccctccaggcctcctacttgtcactccactggggctcctcaaatcccatccccaggagcccaaggactttcccaccctctgcacacctactcttccccctg

SEQ ID NO: 25810 - DNA, 201 bp, Bos taurus
ggggcctacagagcgtttcagtaaaacacaggagcctcaagcttgcaggacactgagaggacagacccactgcaatcaggatccctaatccccgagggccagcaggcacgtaaatggatgacgtgagcagaggggctgtgatgaatataccccacctgttggagcagcctccacccccacaccaccgggactgtcaccaag

SEQ ID NO: 25811 - DNA, 201 bp, Bos taurus
cagcctttgtgttccccaggacatctcattcaggcccttcacggagagagaggggctcaaggaatggtgagggggagggagagagggcaggagaagaaaggaagccctaatccgtggcccagaagaaatgaacatctctgacttccccgtatccctgatctaagtaggtcacacggaagaactcggagttcctgtcaaagt

SEQ ID NO: 25812 - DNA, 201 bp, Bos taurus
acagaagatgaatgatacacgaacaatttgtatgccaggcaactgtgtgctagataattagacattaaagtaagcataataatctcagagataaaggatggtgttagaagcatgaagcagcaacaggcattaacaaaagaaaagcaattggaaatgttagatctggaagatataatgggtaaaattaacaagcttagtaga

SEQ ID NO: 25813 - DNA, 201 bp, Bos taurus
agtctcttgcattgtaggcagattctttaccatctgaaccaccagggggaatacgttgctttaacaggtaactcagaggagaggtctgtgcaagctctggaaaaggatatacctggattggctagagggactgaaagaggctcatgggaagtagaatctcatccttttccaaatctttcatttgatgatggtgacctatgg

SEQ ID NO: 25814 - DNA, 201 bp, Bos taurus
tttttccaactatcattttactcaaatggcctcctattttatgggaaataaagttagaactaatgaaggaaaccctttctgagctcaaagagatgtgcaggctgtggccatcttcattgtaaccaaatatttaaattatttagagctcattgtgaactattattgtccattgttttgacaaaatggtatcatgagttgatg

SEQ ID NO: 25815 - DNA, 201 bp, Bos taurus
atgtgtttaggtgacgtcccttcacttggttctctgtagagtatggtttgggaaatgtgccatcagccatactttaattctttgactttacccacacacacccctggcaaattgcacagtgcacattgcacagcatatactgagtgcccatcatatatttttctaagtgagaatgatgggtttgcataggttggagacagg

SEQ ID NO: 25816 - DNA, 201 bp, Bos taurus
ctaaatcaccagcgcttatgtgcattcacgccctgagtctggatttccccagaatccccaaacccagcttgatgtgtgctcagcctctcttatttccttcggtgagtttaagccacagtgtgctctgtggtttaatttcctctttcaaaagcaggtactataacaaaatatcaagagccatggctgggccatagactagca

SEQ ID NO: 25817 - DNA, 201 bp, Bos taurus
gctccaagctggtataaaagtcttagtgccactactgggtcagggcaccctgctatggctatcctgttttgctcctgtttcagtcatgggctgtttccttcggtaggggcaccacagccagtctttgccctaccactgaggactggggcagcgtcacacccaaatggaagaaaattcagctgaccctgaagtggttgaagg

SEQ ID NO: 25818 - DNA, 201 bp, Bos taurus
taccactacagccgacttatttaatcttttcttggctacagtgacacacagaatagagcaactagaacctgctgtagacagaggccagttctcatggaagaaggcacagcgcaaatctatggggcaactggaaaccgtgctgcagttactgagcacaggacacaaaaacattagcctgtcatcaccaggccttctccctgc

SEQ ID NO: 25819 - DNA, 201 bp, Bos taurus
aaaagaaataattcaatggcacttgttaagtcacagtaaggaagacttcagtcaaagggtggggaggctatctcagtagttataaccacaggcatgggatttcgcaaagggcagagagattacactcaactctgaatatagcataggcaagaggaaatttatgggcaagttcttgcggtcagtggatggaaaattactaag

SEQ ID NO: 25820 - DNA, 201 bp, Bos taurus
cttatatgtggatcttaaagagctgaaccaatagaagcagagagtggaataatggttaccaaaactaggaggagggagacatagagaggtgatggtagtcgctgttgacactccctcaatcatgtccgactctttgcgaccccatggactatagcacaccaggcttctctgtccttcaccatctttcagagcttgctcaaa

SEQ ID NO: 25821 - DNA, 201 bp, Bos taurus
gaacttctatagcttctatctatctccatccgagacatgcctcccacagcctttagtgtcagcctgggaaagcaaacaagtccatgaggctttgttgccacacatctgtggacggattcaagttccttctccatcttccctccatctcctgcattccactaactgagtacattgagtaaatttctcagacttctgaaggag

SEQ ID NO: 25822 - DNA, 201 bp, Bos taurus
attgttaacgacacgccattgttgtaatttgaacttggtaaatgcaattttttggctgtttgctctctcttggttttctctcctgggttcctggacccctgtgttccttggcaggggtgtgtgtggggggtgtatttccttttcaacaccacaaataccatctctgctattgggacacaacagttaaataatgtgaaattg

SEQ ID NO: 25823 - DNA, 201 bp, Bos taurus
tttacaaacgttatacctacctgattcaccctctggtcttgatgttcccagagtgctggcttccctgttgctgttgttaagctcagttctgatatggtgtctcccacagttacccctggcaagttgaggagccagcgcgagacatttcttaccagcatatttcttgtttacaaaacttctcaatggcacgctatccagtgg

SEQ ID NO: 25824 - DNA, 201 bp, Bos taurus
gcccagtcccttgcatcttctgatgctcgcaatatatttaaaagattcggctctgccaaatcggggtgtactgaaagcttctggatgaaaggcaagatccttgagtccggccaggaaaatcccagaatggatctcaggccagcagccaaggcctggctgcctctccgtgcccccaagagaaagttcagcaagttcaggttc

SEQ ID NO: 25825 - DNA, 201 bp, Bos taurus
gtgtgttggcaagtttcatgcctgacacacaggaggaggtcaaagaagatttattgaaagatttattcattcaaatcttttctgcagaagaggagtacctatggttctaaaataattaaaatgcattttcaactctaaaaggtgtgtggaaatgatcattattttggtaatgcatttagtaggctttaagctgtagaattt

SEQ ID NO: 25826 - DNA, 201 bp, Bos taurus
ccttaaagcacattaacctgccaatcctcagttttactgagaagaaacttattagatctcagttgacattttattacctatttgctaccacacttattttgttatcattttaaagtagttattccatttttaaatcactaaaactcagcgcatcaacagcagtgtggatggcagatgtatctcctacagaggtttgccaga

SEQ ID NO: 25827 - DNA, 201 bp, Bos taurus
actccttgaatgttctctgttcaacctgtgctctctgcctagagaattctttcttcagatccttcttcaggcctcaaatgtcaactccctagaggccttccctaacctcctcctcttccatcactgttacagcatccaattgtattgtctttgcaggattcacgactccctgaaatcctcctttgttttcttaattgttgt

SEQ ID NO: 25828 - DNA, 201 bp, Bos taurus
aaatctaaatacagaaataacaaagtcaagaacggcagaccaaatttggctggcagtttttttttcttcccttttcctaatacagtttgaatgcgtgctccgttatttcctgtgtcttttattcacctgctttgctcattaaactgcctggcttctgatggcatttcagttcagattgtaggttctgttgatgagtgattt

SEQ ID NO: 25829 - DNA, 201 bp, Bos taurus
caagctctcaggtgacgcccatgtggctggcccacagaccatgcttccagtaataaggcaccagatacagagtacttcttaaaccccatatcctcataaacgaaaatgccttttctcataggcacacatctctgcaggtggtaatcagtgcagtaattgggtcaaaaattatcaggcacaggggacattcctggtttcctg

SEQ ID NO: 25830 - DNA, 201 bp, Bos taurus
caggtaataaagataactgttgcaaggactgtaaagattaaatgtcaggtgctcagtgccctggcacatggaaaccattcagtatgtgctggtcgctataaagacaatgatgctgaagatgactgttatcactgtgatgattcgctgccactagcttttctgctcactgtagagttatttaaagatgatctcggggccctg

SEQ ID NO: 25831 - DNA, 201 bp, Bos taurus
ccacacacacacacatgttcatccactcatacacactcatatacacacgcataaatgcatgcagtctcatacccacacatatatcatgctctggccagtccgggtttcccatctcaaacctatgccacctacatttgaaccatgtctctaacatgctccccaaagacctccctggaaggcaccccaggacacccccactcc

SEQ ID NO: 25832 - DNA, 201 bp, Bos taurus
tgtatagatattaacatcatatgaattagttttagtttccagaggcttagaagtgcaggatcttccagggcctgatatcactaaggggcccttgccattgttcatgtttgcttacttgctcctgctttattgcaaattaagcctggaaagaagaaagaatgtagctatgattattgcctcaattggcccttttcctttccc

SEQ ID NO: 25833 - DNA, 201 bp, Bos taurus
gcacaaggatattctttgcagcattggttgtaatagcaaaagttagaaacaattccagtatccatcaatatgggactggttgaataaatgtggtgcatgtgcatagcagtagcagaaaggaatgagaatatacactcattggatggagtgtctccaggccatgttgctaagtaaaataaacatgaaaggtggaggaacgtg

SEQ ID NO: 25834 - DNA, 201 bp, Bos taurus
agcagctgtgactggagccccacagcagtgctgagagacaccaaggcccttccatctccggagatgtctttcttcaaggctcctaggacacagggcagggattggaccccgtccaggaagtcaggccactgcctcgtcaccccaggatcttccctcctagcccagtgcccactgcaaacaccacctggctcctaccagtga

SEQ ID NO: 25835 - DNA, 201 bp, Bos taurus
aaggagggctgggcgggccccttactacctctaccgaacagtgaggcgctgtcattaccggtgtgcaagtaccccttcctgtgtcgtctctccccaggccctcagcatcctcatgctccctcacaacatcccacccagcctgaacctgctgaccagcatggtggatgacatgtggcattacgctggggaccagtccactga

SEQ ID NO: 25836 - DNA, 201 bp, Bos taurus
cggccgagctgacccggaatgcctgcaggacccgctctagggatcttcgtctcatctgtatctacttctctagcacccgctttttccaggtcagcccctgttggtgggccatgaagggtgggtgctggccccttcctgggggctttgcaggcatccatgtctcctcctggccttctgcaacctcagccagttagcgcccct

SEQ ID NO: 25837 - DNA, 201 bp, Bos taurus
cttacagatggaaaaatgtcagatgagttcacagcttgaggccccccggtctgcccctgtctgctgtacccggggtgatgaagtgcatgcacaccagtctacagctctcgtgctcagagtgggcctctgagtgggcttctgctcttctcaatcccaaattgctttctggggccaagcggaggggcatgattcagttctggt

SEQ ID NO: 25838 - DNA, 201 bp, Bos taurus
gcttacatttcactccggagatgagcaaggcccagagaggtgaagtgacctggccaaagtcacacagccaggaaatggccaattagaacccaaacagaccgacttgcacagtaacccactccccaccccacccccacatgctgctggagaatccagcagggatgagagggcccctgcccaccctggccttccctcctcaca

SEQ ID NO: 25839 - DNA, 201 bp, Bos taurus
gtcccaaataaatagggaaagtaggtggactttacacatcctcttgtagccttttactgagaaaacaagcaccaggccctgctgttaaaactgcctgttaatgtaaaccagggtgtcgagagaaaagcagagtactgcgcatgcccctgcattcaacaccaccagaggggcaggcgaaccacctaagccacacttctggcc

SEQ ID NO: 25840 - DNA, 201 bp, Bos taurus
tgactgagtaacgcccccaagtctggtaccatgtaacatgacccctccttggtgctctccccctggaccagtaatggccctggtcacaggcaaccactctctagagaggctggtcacctgtgaccagtgtgacctgcctgaaagagatgaattgggccgatcagatttcctcttttaaggatttaaaatgagagccataaa

SEQ ID NO: 25841 - DNA, 201 bp, Bos taurus
gacgggactacaggtcttaaaagtgtgagtgttggacttccctagtggcctggtggttaagactccaggctcccaatgcagggggcacaggctcgatctcggatggggaagatctcactggccatgaggtgtaagggcccccccttaatagagtgtgagtgttccccactgtcccaggcctgctggtgagggccttgacac

SEQ ID NO: 25842 - DNA, 201 bp, Bos taurus
agaccaggtagggacaggccgggataaggtgcggcaagggccggctgaccccgagcgggcgtggtacagaggatgacaggttgcagagccctgcagcgagcgagtagggttctgccgcggtggggcccttggggacccagattccaccctccaccaacctgtacctccttccacctacctgcggtctttctagccccggcc

SEQ ID NO: 25843 - DNA, 201 bp, Bos taurus
atcatgatcatgatgatgatgactcatgatcatccatccctcagcctcccgctgtctaagccacagggttcatctatttaaaaacagccctaccatcagtatgaaggattaatggccagggctcataagtgatcatcaaccaaaccgctctgagctcaactctttggctgctgctgtttgttgctctttccttccaggggg

SEQ ID NO: 25844 - DNA, 201 bp, Bos taurus
ttagaggttgagtcaggctggaggggttggtgccacatcactgagatggccacacccgttcccaagtgtgtacagggccaggggctccagcccaggttgtctctgccctggagctaacttcaggttgtgtgcagggacatgagagctggccatgctcgcctctgtcctggtcagaggcaagactggggtttgggtggcttt

SEQ ID NO: 25845 - DNA, 201 bp, Bos taurus
gtaccacaaactgagtgacttagaacaacagaaacctattgtttcactgtcctgaattcaagaagcctaaaaccaggatgttggctttctgaaggcaccagggaaggatttgctttaggcttcctagcttcctcaggcattcttggcttgtaaagcgccatcttctctctatctcttcacatcattcctctctctgtgtgt

SEQ ID NO: 25846 - DNA, 201 bp, Bos taurus
cctcctaacttcctaaaagaatttagacagagcatttctggaatattgttatcaccagagctatctgaaagagcatggggtaggggtggtggtggagacttttaagaagggcctagtgctcaggatccactctgtgtcccattgtctctgtagggcccagcaaacatgtatttatgcaacatttgttttttccatcttcaa

SEQ ID NO: 25847 - DNA, 201 bp, Bos taurus
taaaaggactccccagtaaatctaagatggggatatttggccatctgtgttttgaggcacagaagtgaagctgttgaggcacaatgactttattttttgtgtatgttacctgttgtatggtcaggccattccctgtggcttccgtcttgctctcggtacatcccctgctcaaccagtgcctgcttcactgacagtcctcta

SEQ ID NO: 25848 - DNA, 201 bp, Bos taurus
catttcatctggtgcataaagagttaattagtgagagattttcaagtggcagtatatttaagacagagcaaggagccatttacagtgtcctcactttttcgaaagtgctgtatgagaaggccacaagggcagatagatagagtatatgggtatatgcttgtgcaagttggggtaggagacaaaattgggggtaaattatga

SEQ ID NO: 25849 - DNA, 201 bp, Bos taurus
ccccacccagagacatttttatgatggccattctgatctataggagtgctatctcattgtggtttttatttgcatttatctaataattggtaatattgaacatttttggtgtctactggccaactgtatgtattctttggagaaatatctatttaggtcttctgcccattttttgattgtgttttttttttgttgttgttg

SEQ ID NO: 25850 - DNA, 201 bp, Bos taurus
tgccaactactgcccctgccttcttgggagcaggcatggcccaactccatcacagtcaagggtcttatgacctagtgccagctgctgctcccacctagctgggagaatgtgtggcctttctttgccaagggcccctacaaccaggagtcaacctctgcctccacctccttgggaatgcacacaggccatgtacctgcacat

SEQ ID NO: 25851 - DNA, 201 bp, Bos taurus
tatattattctttcatattatgtattaaaacttcacctgatgaagagcttatatgtgaaaaaagattacatctataaaaacatatatacagacaagtctacacatatttggggacaataatattaattgataatgctaagtcacttcagttgtgtcctattctgtgcgaccacatagacggcagcccaccaggctcccccg

SEQ ID NO: 25852 - DNA, 201 bp, Bos taurus
aaacctcattcctctagtttaatgcatatgtggccttggatagcattgttgaaccacagtgttgtctgtctctttctttctctaataaaataataataatgttattattatctcagaaggcctggtcttctgagaagcataagctaagagtggataaaatgggtaaggattatttttaaactttatttttaattttatttt

SEQ ID NO: 25853 - DNA, 201 bp, Bos taurus
acctaacaagtttgagatggtcagtgtagattagctcctattgtgttttttcttttcattgtaatatttagtgaagaaagttagggaaaatgattctcaagaatatgaacagcctcagaaagatatatgcccctcaaaaaataattttagtgcttgagactgttcacagcagccaagagcagctacaccagtatcaacttt

SEQ ID NO: 25854 - DNA, 201 bp, Bos taurus
catttatcaccagtccacgtttatgtcccagaagctaaccttgctctgtggacagaactgacatccaagtgtccctctatttgtattatgagttaaagccgtgggaagagccatctcagctcttcagctaatccagtagtaacaaactctcgcaattttatggtgcttaaacttaacattcatattacttcacactcacat

SEQ ID NO: 25855 - DNA, 201 bp, Bos taurus
tcccacctacctttttgcctaatgtcacttgtccaggcttaagccactataacaaaataccataagctgggtggcttaaaatataatcattgatttctcacagttctgcaaggtgggaggcctgaaatcaaggtgctggaagcttcagttttcgatgagagttctctttttggcttgcatatggcccctatttcactgtgt

SEQ ID NO: 25856 - DNA, 201 bp, Bos taurus
gacatgaagatgtgggatttataaaaattcattctgaggctgtaaaaaggaatatcagacaaaaacctgaagtagagagaaagcagcaggtacgaagagaagactaggagaaaagggacaagaggctagggagatggaatatatatacaggaaaaaaatgtaaggataaactgatgaactttggttactaatcagacatag

SEQ ID NO: 25857 - DNA, 201 bp, Bos taurus
tgttgattgaacaaaagttaatatagatgagatcgttcaatgggatgagatgtagatgagatcccttgttcgatgggaatgtctaaaactcctccatctctatgcaactactgtgattagacttctcaaggaattcattgaaaatattggtgataatataaattgttttaattattatccaattaaagcctgatctactgg

SEQ ID NO: 25858 - DNA, 201 bp, Bos taurus
aggatagtgaggggggaaacaattaacttgaccctgtcttaaagggactcatattctattatgggagagtagacctgagtcacagagattggaagagatatattttgaaagagcagtgcagataaattggtactgggagtcagaaaaggaacagatttcagaggtgatcaatcatcttcagcctacttaacttgaaggaaa

SEQ ID NO: 25859 - DNA, 201 bp, Bos taurus
aagcttgaaaaggaattcagatgcctcaaagggaaaggattagtagcaaagtaacatactatctggatttagggacactgttcaggatatgtatgaaagacggatcgtgctggagttgacagagcgaaaagtaaccctggaagcataaagatctgtgaggtggcaactgcagcaaaatcttggagaaagggattctggctt

SEQ ID NO: 25860 - DNA, 201 bp, Bos taurus
ctacccatggatgcctgttgcagagaactcagcgttttgagaaatgttgtcttgggttgaattttcaatgaactagcccaggcccactttcatctgcctccggtttacggaattatttcatcaagtacaagttcttattctagaattcaaaggtgcagtatggcctgaaccattaaccctgttgttaattatttgcatgtg

SEQ ID NO: 25861 - DNA, 201 bp, Bos taurus
tgttaagtgactacaagaacagatcatgcacagactttcaatgaatgcctctgaaggaagccaacattgaattccattttaaacagacaaagctgtcatatgattgaagtaattctctgaactttcctggcccagagtgctgtgccaacagccagagagcttctacaacccagaggaggaaaccttgcaggagactcatag

SEQ ID NO: 25862 - DNA, 201 bp, Bos taurus
ggccttgttcaaccatgaagccttggaacctgaaaaattacttggcattgcagcatctgagcagggaacctggtcagtgactctgcagagacaagccagtgaccccacctggccaaagagtttgatggagaggtctgcctgttctgtgactacccctacctttctgtgtagtgaaactaagctgtagccctgctcatgctg

SEQ ID NO: 25863 - DNA, 201 bp, Bos taurus
tggaatgcttttacaattacagagtaactcaattcagatggtacatttttattagaaagacccaatctatatttagatctcctttctctctggggccatatatttagtgacttctcagaactcaaaagaccagacccaccattttggctgcaaaggacagagtcaaatagcaatcgttccccctctttcctgggagcatcc

SEQ ID NO: 25864 - DNA, 201 bp, Bos taurus
cttctcaggggaggcccaaggaggtggaggccagagggctggaggcccagatcatcatacggggcacagtgtctgttcctggtccttaccctccatgagctacaccttcctccccttctggcctccctgcctccagtctggcccagacaatttcccttcctcagagaagtctttgccaagcacttccaggccccgccttga

SEQ ID NO: 25865 - DNA, 201 bp, Bos taurus
ggaatggtcaaaacttcaattgcctccttggtacctgaccccacttatcttgctgctgaacacctccaagagtaagtctcaagacccaatgagttgggagcaaaatatcctttaatatagaccaggataacatgggcttttcaccctcagtgtccttacagagagccacttccattattgctctggatttttcttaaagaa

SEQ ID NO: 25866 - DNA, 201 bp, Bos taurus
acacaactagatccgcttagctcacacagcagccaggccccacccaccctggctccgacggaggtcattcaagtccctccaaggtcaacagaccaggaagcaaccagggttctgggtgttctcaggccagctcctttttctggtctgttgggatgctgagtctcagcccctacgctgcccccagctctgatcgctggaccc

SEQ ID NO: 25867 - DNA, 201 bp, Bos taurus
ggatgtagcagaccccagaaccacagggaatcccttccaggctggtgaggtggccatgggctagtaactcggttggcctatttttaagacagtgttacagcgcaattgggaaaccctgcttgcaaggatggtttagagctcagcaaattggggaaagaatccaagaacaaggccaagtttcaaggtatcagcagggagaca

SEQ ID NO: 25868 - DNA, 201 bp, Bos taurus
agcgctggcgacaggatagaggtggagagccgggccggcgagggccggcgagggtggtgagtcacctgctgctttgtttcttaagctccggtcccgtctgcgctgtcgcagggaggccgccccggcccggcgagccgaaccaatgctggatctggaggtggtgcccgagcgctctctgggaaacgagcaatgggaattcgc

SEQ ID NO: 25869 - DNA, 201 bp, Bos taurus
gccacctcgaggccaagtagcgtggggtcgcggaggttcagcagctccttcaatgcaagcagcactggcacacactgaacgctctcctccaggccctgagtacgcaggggttggtctttctccagtcctcgacccctatcaaatcactaagactcccgcccatcctctcgcccagcgaattctcaccaaaccgaggaaaag

SEQ ID NO: 25870 - DNA, 201 bp, Bos taurus
aaggtcctttccagcccatctcctatttcctcttggccttcagtctctctggctccagtctactcttggtaagtgatcctgacaaaaggcagctgaccacgcttttcaggccctttgatggttcaccactgcacaggatggaagctgagcttcttggctggcattcaagcccttttatgtcagccccctgcctacttcttc

SEQ ID NO: 25871 - DNA, 201 bp, Bos taurus
cgctatttcccttccagcccccggccggcggctgctgcggagatggtgggggcggtgacttaaagggcttttccaccagtgcagcctcccgcgctcaggacgtcccgggccaggccgcttccagggaactcccctcaccctgtggtctcacctccgccggcactccctagcggggcctcacccagcactgacaatactcta

SEQ ID NO: 25872 - DNA, 201 bp, Bos taurus
tggctttgtaccacaggtctgagcctgggcttgaaggtgggcagtggatccaggagtctttagatccaaggagcatcatctccctggagatctgctatgaccaggccatgggcagcacctgggtcacctccagcccatatgcacagtgctgtcaaccacccattctgatgtctgtgtccattggacagatcggcagtgacc

SEQ ID NO: 25873 - DNA, 201 bp, Bos taurus
tctggattatttatttacccactcacctactgaagaacatcttggttgctcccaggttttggcaattatgcaaaaagttgttataaacatctatatgcaggtgtttgtatggacataagctttcaactcctttgggtaaataccaagtttttagttttgtaagaaattgccaaactgtcacctaatataatctgctttgta

SEQ ID NO: 25874 - DNA, 201 bp, Bos taurus
agcagaatttgaacttaccggttttcagtgaaaagtaagtacagaagactagatgtgtgaggtctttggctggttggtagtgttcatgcagtgggatctctcaggaaaattggtatcatctgggactatgaaccaggcagtcagcaacttggattgactgaggctgtcagggcatttgctctctatcccatgcatgggcta

SEQ ID NO: 25875 - DNA, 201 bp, Bos taurus
atggatcaccagagccaaagaatgaggaccaggaaggcagcaataactatgatgccaggggctgtgttgggggaagattttgagaatgaccgcatagttgacaaaataggactcccatgccttggagttctggttagtttctggtcttgagccagattctctctctgctgcagatgcgagaggacggagcggcaggagctc

SEQ ID NO: 25876 - DNA, 201 bp, Bos taurus
ggactgtgtgagcttaaaatctgcctcagttcccaaatgttctttacagtgtggacttcagcaagcaagtcagtagctcagcagcctgccatagcaggcagtttgaaccgctagtgtctggccgagctcaggtggttctctcctggtgggacattgaaatggaccctgaggggaagatcaagtgcaccatggccccctcct

SEQ ID NO: 25877 - DNA, 201 bp, Bos taurus
ggtgctggcccccgcacaggagggcaggccatggccctcatgggtccaagcccagagcctgtgctggtatgaatagtggaggctctgggcccactgccacgttcagccttcttgctgggtggctgctccactgcttgggagcatgtctgtgtctgcccagcttagatgggagcggccctagcttctcttgtgagaatccaa

SEQ ID NO: 25878 - DNA, 201 bp, Bos taurus
gtggttgatatttgaacctctttcagtgagagcagatccagctattcactacagtgcctaaagaggtccaggaggggttaaaggacacaccgtcagtgtaagaactgccactctattgcataatctacacaaccttgtagttgaatctgggtttctgggaacatcttaatcaaataactagggaatatgatataaccattg

SEQ ID NO: 25879 - DNA, 201 bp, Bos taurus
tgatatttaggcgatggatcccattactttgcataatgtgggatgctgacattttcttcaaacatgtaatccttgtcattgagtgtgggaaggagagagattgctacctgaagtaggggcagtacaggatggcactacagagaaatgacataaagccccaaataatagcaataatcattttccacttcctatcatgtcatt

SEQ ID NO: 25880 - DNA, 201 bp, Bos taurus
ctgggctcatctgtgcagctctgtgagtctcacatgtgcacacacatgtcactgtagtcagacggtgggtcaacttcaggtgatcttgatggcctcatacatgcgtctggtgttagaggcacaagactgagggtttctaaagcagcacgagtggggaaaccccaatacacaagcacttttctagcctctgatggcgtactt

SEQ ID NO: 25881 - DNA, 201 bp, Bos taurus
atatgttaaataaaccaccctctaccctccaaaataaaattccctctgtcatatgtgaaattctaatggatcctaggctcttttcctgcatttttccattcggttccactggtctctttctctgtctttctgccagtaccacttagatatgattactgtgaccttctatctggcaaagctgtcccctcctcacaatcttat

SEQ ID NO: 25882 - DNA, 201 bp, Bos taurus
gctgctgcagagcagtcaggaaaccatggctgggggcccttttgcatgtattcaaatctccagcctctgggcacgtgggaaatacagggagtacgagagtgggggcggcagcaaggacctttccctccgggacccctagtgagctgttttgaggaaggacacagctcggctgcccacgcccactcccattctccccccccc

SEQ ID NO: 25883 - DNA, 201 bp, Bos taurus
tgatcagttactattcagtgaggctactagaacaagatttgtttaccttttggaaagtgcttggctaaagttgcttctatcagaaaggagaaggtagctcattgctagaaacgatagtgttttataaatatgaagtgatagtctgcatgctgggaattgctgattatctggaaaacaaatagaatttagtaggaggtatat

SEQ ID NO: 25884 - DNA, 201 bp, Bos taurus
acctgtgcctccagttgagttacttttttctggctcctctgagattagatcgggaggagggaatagagaaggcatcaaagaaattgtcactcgtctgatcctgcttgattaggttgatacttcctcttgtggggcactttcaagagtcagaaaactcaccctcattactgggcgtctgtaccctgcatttctcttggtggg

SEQ ID NO: 25885 - DNA, 201 bp, Bos taurus
accgggactaatgaggcatcattgtgcaaacaccacttttaacctccacttagcccagttgagccggcacaaggttcaagtccagagtatgactagtgggccagcaggtgtcatggtgtgtgggaggggaggagaagtggccacttctccaactccatctgggttcaatggatccacaccatgaataaccagtggcattgt

SEQ ID NO: 25886 - DNA, 201 bp, Bos taurus
cacaggccagcaagaccatctgcacacaaatgcctcaagtttctgcttccattgtatctgttactgcctgactggtgggctttggggggacctaaggtcagggggccaggaagcgtgcctgattcacagtgagctgtggcaagaatgtggatggatgattctatcatgggacagcgaggaattgggaccaataatttaatc

SEQ ID NO: 25887 - DNA, 201 bp, Bos taurus
ctctgacagatgcaggagttgccctgcagcattgggtaagcagatagtgcagagagggggcatactgtgacacggctgcctgtgtgaacgaagatgaaaacttcacatggacattatggagcctagtgtgttactgagccattggaaacactagtgcaaaacacaatttagtggtgaaaacccgcagagcataaggagaag

SEQ ID NO: 25888 - DNA, 201 bp, Bos taurus
atctgctctgtctgggattgggagcccggagttatcccctgatgttctgagggcccctaaaatgagctgtcaggagctctggagggtgtgaggggcagtgcggcaggaaggatgctcagacctgggccagggatgaccaatacattcaccctccagacagctccccactccctgtcgcttcagggtcctgcagaaggtgga

SEQ ID NO: 25889 - DNA, 201 bp, Bos taurus
ttcctttcttcctttttctttccctttctgctttccttcttcctccctccctctctgtctgtctttcctacaattgcccatcctaatctctaagtcttttcattccaagtcaacataggactcaaaaacactaataaaattcggcatatgctgacagccgagtcagcatctgagtcatccattttactgcccaggccacag

SEQ ID NO: 25890 - DNA, 201 bp, Bos taurus
aaggatgttccagccagagaggacaacatatgcaaaagccctgaggctgaagcagcctattgaatgtgagagagagaaaaagaaagaaaaattcaggaaggcagtgggtaaagacttgattcccctgtgtaggactgatcctaccccatcacccatttggtgagcctaccttctcccacacctggggtccttgcataaacc

SEQ ID NO: 25891 - DNA, 201 bp, Bos taurus
tccacattgatgaaatggcttggcttcttctttgggccgtctttcaatgccagccttctcacacctctaattgtttctctttgtgtttccaaaatgttcatgtgggagatggtcaggccggaccctacagaagacctgagacacagtctgtcaatagctcctttaaaaagcagctagctcttcaaaagagtgtggggagaa

SEQ ID NO: 25892 - DNA, 201 bp, Bos taurus
tgaagaaactgcctccagacccttctgtgggcacatccatcaagatgacctatacttccttttccccaggactttctcagggaggcctggtagcaaatcctgaaacctccagtgtttacagccccaagtgatattctgggctggctcctcctccctccactgctattagtgtcaattaagttcagcctgacaggccacctt

SEQ ID NO: 25893 - DNA, 201 bp, Bos taurus
tggcccctcttcttcactgccctgctgtctgggtgaaggagcagccaaaggcattgttgctggagaaatgggaggtggcggcacctctggttttgtagtttgggcccttgtgagcccacaggggccctagggactcagacttggaggaggcagagtgtttgggttgggtaccgttctgctgcctctgagcagccttctgag

SEQ ID NO: 25894 - DNA, 201 bp, Bos taurus
tcttgcctggagaatcccatggacataggagcctggtgggctacagtccatggggtcacagagagtcagacacgactgagtgacttagcacagcaccacgcaaccaggtgattaaatgatgatggtgacttctggtttctactctgtctcacctcgggcagggctctcatgcagtcactcggcaccatcacctcacgtgac

SEQ ID NO: 25895 - DNA, 201 bp, Bos taurus
acccagggaggcctgtttcagatgggtggggccagaaggctagaaaaataataaacaaaaacaaaagtgaagagaagcaaagctcttgggtgccagaaagaggctggccaaggctgtggctgcctgagtaatgggttccacatttgcctggctctcagcaaccaggatccagaatgcacagtgggccctgcaggggccaga

SEQ ID NO: 25896 - DNA, 201 bp, Bos taurus
agctctcccaacctcgggggccaactaagggggccattttctgttgccattctccctaccttccaaagagagacacccatttagttcaccagtttccccattctgatctcagttctggcctagcatctagggcaatgccttcgctctatctaccacacccctttccagctccagcatctccaggcccaggtcttgccctga

SEQ ID NO: 25897 - DNA, 201 bp, Bos taurus
tctgccctggcctctcctgtggctcccaggatgggggcagaacgttgaggctgcctggtcagctgtgtcttttgctgtttgaccctggcccattttttccgttgatgtctcagtttctccatctgtaatgtgtgtggggtgggggtggtgcggaggggttggctggatcagggcctgggcctctccaacagggctgccttt

SEQ ID NO: 25898 - DNA, 201 bp, Bos taurus
tgcccccctgctggccagaggtttcatccttggtaggtccttaagctgccatcctcttgagtctgacccacagctggtaggcacctgactcagaaagagctcctctcctgggccctgcctcggttctctctcctttccttgcctgcccccaccctctgcgaggggctctgcccatggcctcaagctcctaacccccctcca

SEQ ID NO: 25899 - DNA, 201 bp, Bos taurus
ttcggttttctatgttctgaagttttcattatcaaaatttgccacactttataaaacagacaacatttttttttttttttttttggcctttgttttcatccaagatagacagaagctttgtctctggacatactggagattgctctccgcgtttggtggaaagggtcgtgctgtcttctgaagcagccaggatgcacactc

SEQ ID NO: 25900 - DNA, 201 bp, Bos taurus
tggaggagtacgctcgtctggagggcctggtggacacaccgcttcccctagcagagggaatgtgcacttaagaggagcccagcatcactgagatggtggatgatggctcgcctctgtgggcctggagctggtggggtcagctctcctggaacaagggtcactaacagcaatgagggcaagggagccccaaacaatcttggt

SEQ ID NO: 25901 - DNA, 201 bp, Bos taurus
gcccccacagcccccagtcccctataggaggcagtctcccagatgacacatgacaaaggctagactagagagggtggatatgggatgtggagaaaggtggatggacttggagctccaaagccaagatctaggaaagaatggtaatggcaacaccactgataatggtaaggaaggaaaagatgtcagtaaccctcaaaaagc

SEQ ID NO: 25902 - DNA, 201 bp, Bos taurus
atttgggatttttttttcttttacataaaagtgagcattattttttaaagcaaaacctattttgctacaatatcatgggatgtgagagcacgttgagcagagatttacagcaaacataggggacaaaagcatgatgggagcacccagtgttacactcttctgttcatactgtgaccaggctctgacttcataaaaggaaaa

SEQ ID NO: 25903 - DNA, 201 bp, Bos taurus
cagaatgtaaggatttttttttgtgctcctctaaaacttaggatgctataaaggtacgaaagagtacaggcaaagatcttatgtattaaaatccttgcatgtattaaaatgtagcttgtgtcttaaaatccttaggttggcaagcataagagactacatgacatgttgatgtatgctaaaccagcttctaaaaagttagtt

SEQ ID NO: 25904 - DNA, 201 bp, Bos taurus
gcatttcaggatccagtccacaacctactctcattgcattcattgtcctgtgtccccagtgtcctctgctctgtggattactcattctctcctggtctgttatggctttggcagtcttgaggaagactggccagggattgtcgaaggcccccaggctgagtttgtctgctgctattctcataatgtcgagtgaccttcagg

SEQ ID NO: 25905 - DNA, 201 bp, Bos taurus
caatatgtgaccttgaagacaggatcgtgtggactttagcagtgtacagttagatcagtgattagtgaattgtctcacaggcgttagtgccaggcaggcccgagcacaagccctgagcccctggtcagactctggtggctcctgtcctgctgttgtcactgtgtccttcatcttttcagtggcctttgttgggccacttcc

SEQ ID NO: 25906 - DNA, 201 bp, Bos taurus
ggtttcacctcagaaagcttcagtgcccagatggtaatgctgctggctcatacctttccctggcaccagggcatggagaggggctggatatggccagggaggaggtagcatcgggagctctgaactactgtatgaggaggagaggaaggaaaaacatgtcctttatagcagctgcctgaaaggaagacgctggggggtctt

SEQ ID NO: 25907 - DNA, 201 bp, Bos taurus
gggagggtggcaattgtcccagccacaccccttcccagctggaagccctggggggctgggcacccttcccgcaggggagggacaggcctgccaactgctcatcccaagaaactggacccagggcagggcaggctcgggcgtgctaagttaaccctggggtgcagggcagagctggccccttgccacagtgaggacagacct

SEQ ID NO: 25908 - DNA, 201 bp, Bos taurus
aggccattggggatggaatatggtctgtgctcccggctaagcactgctccgtgattgctcctgaatctcacctggagattcttctgtgctctctcttctacatcagtgcttctcaaagggggcccaaaccagcagcagcagcatctggaaacttgtttgaatattcttgggtggatatccttgggtgacaccccagactac

SEQ ID NO: 25909 - DNA, 201 bp, Bos taurus
ggtgacccactcccatcccccaccccccatccctgccctcatccttgggagagtgtggtgagtgaggtggctacgatttccacacccagagactcactgcccacatggcctcattccagcccttccttccttcctgtgagaagcacaaggctttagccaggccacctgggtttgaactggtgtccccccacccccacccca

SEQ ID NO: 25910 - DNA, 201 bp, Bos taurus
cctcctgggagctgcaaaaggggcaggctgggagtcagcaggggtgccacccaggccctcaggaggggacccatagaggcctctgctcaccccaccccccacttcggccccttcttccagatcctccagaaccttcctgggttcagctctccccctcgtcaattaaagaaggagttacagtagagctgacttgtatgtcag

SEQ ID NO: 25911 - DNA, 201 bp, Bos taurus
agcttccttccttcattcttctggtgacaacatcccactttttcttagtcaaccactccttctctactctcagtccatgtggcagaggatagggggttgggggaaaaagactggccccaacgggctgcagggaagggcatgtcacccagactcgggttcatgcccaagccagtccatccagagtcaatcatttctagattc

SEQ ID NO: 25912 - DNA, 201 bp, Bos taurus
taggggcagggacaataggttggcctttttctggggtaatccaaaaatattcatcccatatctgttaaaactgttcaaatcacctgatggattggcccttctcactggctattgagttctcattctttttactttttaagtaaaaggtataggctttggtcccttttgtaaggcttgtatttacctcaagtgtcaccccat

SEQ ID NO: 25913 - DNA, 201 bp, Bos taurus
gtggggagccttgaaagtttacataaacatgcagatgggcgttttcaacgctgctacctgcccgttagatcttcttgaaacctctttaagtgtacactgagtgcagcccattcctcacaggaggaagtagaggcttagcgcaaggtcaaagccgagtggaggctcacaccagtggtcttctgactccaccctgtgttctca

SEQ ID NO: 25914 - DNA, 201 bp, Bos taurus
ccactgccagggttgtgggcacactggagaccagcctgggcccagcagcgaggtgggagcagaacctggcagctggggtgtggaatgggggcagtgggtcgtgtccagcaaggcccaccctcctctcccagcctctacccagtctcatgtgtcccaggcaggactatggcttctgcagcagcagcaacgacagagaagggg

SEQ ID NO: 25915 - DNA, 201 bp, Bos taurus
cccgaagagagggggcgggactagagcgcctgatggaagagggtctgggggcctgggttcttgggtccagaggatgaagtggcaggggacgccgattcttcggtcccaagagaggaagggcctgagtcttgctgaaggaggagactgggacctcaatttctgggtcccaaaagagaaatgttgcaggggctggactcctgg

SEQ ID NO: 25916 - DNA, 201 bp, Bos taurus
cttggactgccatctccaccctcggccaccccgcaaactgaccgtccaccagtgacccctccaacatccaaattcaacatcccaattcctttcccagccacttccgctcccatgccgacgcaagcatgctcagaccaatgggaattctcaaaggctctaaagctccgccttccgcccaataggccctctcacagagtgtcg

SEQ ID NO: 25917 - DNA, 201 bp, Bos taurus
ccgtgttctcatctgtaaagtagggctgataacagcgccttcttccctgggttgctgtgggctctcgagtctttcacataagacacttactcttttcactaaggccttctccccttcctctgtcctctcagtttccttccatgcttagtttttctctaatgctcccatcatcacctgatatctattttacatattcattct

SEQ ID NO: 25918 - DNA, 201 bp, Bos taurus
agaggccaagccatcaaatgggtccccgggaacccaggacctccttctcacccacagggctgactttgcttgcctcggccagtcgggaccgactgatccatgtgctgaacgtggagaagaactacaatctggagcagaccttggatgaccactcctcatccatcacggccatcaagttcactggtaagtccctgtcttcta

SEQ ID NO: 25919 - DNA, 201 bp, Bos taurus
tggagtgcgagccctctgacactgcctccccgatcatgtcctgcagcgtgaatgggaaacgctactttgaatgccaggccaagtacggcgccttcgtcaagccatcggtcgtgacagtgggggacttcccggaagaggactacggtttggatgagatgtgatggccgaggaagggcagtcccctgctgcagccagctcgcc

SEQ ID NO: 25920 - DNA, 201 bp, Bos taurus
catttcacgtggaagtaaaatttgatcttttaactcaaggatatgtagtattgtgtgggaaagaatataattcttattcaaagagaagtcttgacatttgccttcgtcttctgggaggtaatctctaaatccttggaatgtcatgtcttagaggagtatttatttgcctgggaacctttggccagctagaaagtaaaaatg

SEQ ID NO: 25921 - DNA, 201 bp, Bos taurus
gctgtgtgaggccctgctcctagcgatggaactccctcggggtcaaaacagacaaaaatctcccttcgcaaaactcgctccaggtcacacaagattgtcatcttcagggtcacgcccacaggccacgcccgaggccgtgctctcacagaattgagtgtctggtttaccaagggcccggttccggttccgtcctcataatta

SEQ ID NO: 25922 - DNA, 201 bp, Bos taurus
gggcttctcagaggagatcccaggcttccatttcaactataaagccatacagaagcgtcaggctcttaactggcaaagcgcagagctatcctgtgtctcatacatgactatatgagacggtcaccgacagtctctccagattcaccaatcagaagacacaaaggtgtaacagtctcagtcacagactccccttcccttccg

SEQ ID NO: 25923 - DNA, 201 bp, Bos taurus
tatattcacacaaccatgcagaataaaaggctttagtatgaagcacagatgtactcctatacatcaagagttggcaaactttttcttaaataaggtcagactgcaaatattttaggcttcatgggtcatatgggcttccctggtggctcagatggtaaagagcctgcctgcagtgtgggagactggggtttgacccctggg

SEQ ID NO: 25924 - DNA, 201 bp, Bos taurus
ttacaagatatggccctgttacctgacctcctctatcaatcatccctttacacagacctctactataactttccccatattcctcaaatacaccagcagaattccactgtgaggcctttgctctaactttctctgtctagtatgctcttcccttagataaccagacttactccctcacaccttcaaatcttgactcagatc

SEQ ID NO: 25925 - DNA, 201 bp, Bos taurus
agtatcaaaataaatggtaatgcatcatataacacactgaataaatgaaaatctacaaatacatactgatataacaaatgaacaaataagtgagtgataaaggaatgctctccttcacagtcgaataccaactaattaatacagacaaaatcatggagattttaaaattctaccatcttgaaaacatcatagtaataaagg

SEQ ID NO: 25926 - DNA, 201 bp, Bos taurus
ccagatcttccactcatggccctcagggtcatattactgatttaattgtgcagatctctcacaagcaggcttgaaagcctgggaaaagaagagcccctaactccactcctcccagttctctgatcaggtcccattcggatacgcctcctcctggcccagggacccgttggacacgccccctgcctcacgtcccgccttccg

SEQ ID NO: 25927 - DNA, 201 bp, Bos taurus
ggggagaggaaccacctcctggaatgccagaggccctttatgggcttgagagccaccacagagcaggtggtagaacaaccgctctccaggggctagctccacggcccttagggcatctttgtaagtgacctcttggaactggggcttttctctcagtagcaggtcctgcatcagcttctggattcggggagacttgagctg

SEQ ID NO: 25928 - DNA, 201 bp, Bos taurus
gggtgcagcgtttcctttccacgttgtttaacatgccgagctctgcggactatatttagtacctcattcacgtggccccgggagtggtctggggatgtggtgtcgtctccacagtaagacacgacaaggtcagtttctgtggggatgtttagttggttggttggtggttacttcaaaactaaaggcccttcagcaaagcat

SEQ ID NO: 25929 - DNA, 201 bp, Bos taurus
agaccagcagggatacccaggagcttacaggccctgcataactgtctcattcaatggatcttcctatgaaagttctggttagtctgcaggtccattgcttactccagcctggttgtaaccacagttcagctgtgatggtggcctctcccatttgtttgctactgagactgcaactgttttaataatgcccaggggtgtggg

SEQ ID NO: 25930 - DNA, 201 bp, Bos taurus
gaggaaatggcaacccacttccgtattcttgcctgggaaatcccacagagatgcctagtgagctacaagccatggggacccaaagagtggaacatgactgagtgactgagcatgcacaaacgcaccctaagaaccagtgaagagtcatgagacaaaaggcctgtgttggaatcccagcctcctacccgtgtgagtgtggcc

SEQ ID NO: 25931 - DNA, 201 bp, Bos taurus
acattgcagcgatatgagctcaagggccggctaccccgctcaggttcacaagacagccagcaccgagaccccgcggccctcacagctggcccaggccagcaccttccagctctccacctctgtccccaagtccttcttctccaagcagcccgtgcgcagcaagcaccccacggggtggaagaggacagacgagccccctcc

SEQ ID NO: 25932 - DNA, 201 bp, Bos taurus
gcccgctgcctcacatccgccccctctgtccaccccactcccagcctccagcctgccctgtctgcccccgggtctcctcctctgcaggttcctaaattacgtgccggtgcccctgacatttctctctcacctcgcccctggcaggccccggggcaggactgtctggggacccagcggtgactggagcccgagccctgtcct

SEQ ID NO: 25933 - DNA, 201 bp, Bos taurus
gctgtatcttctccagcatttacaagagtacctggctcatagtgggtgctcaaagaaagtatggatgaatgaacaggcctgtgtctcctctccagcctcacctcccaccacagtcctcctccagcataaacctgggtttagtgggatgtggtggggagactgggttcaagtgtttaagagatcttgggcctcacattcaga

SEQ ID NO: 25934 - DNA, 201 bp, Bos taurus
acttcatccactcccagcctttctggtccatggtagatgttgctcctggattctggtattctccctgccaaaccctccaggcagcctggcactccaggccctcactgcagttgactcaagagtttgtgagcaggggaaacctacttgccacatcccagacaaattaggacccctcagtgcctccagaagagcctgtggtcc

SEQ ID NO: 25935 - DNA, 201 bp, Bos taurus
agaccagggattgaacccatgccccctgcagtggaagcatggagccttaaccactagaccaccaggaagtccctgattcacctgttcattacatctcccataaggatgtcagttccacagccagggattttgcctgctttatttgctgttttatatccacacgtagtcagtgtctagcacagagcagatgctcagtgttta

SEQ ID NO: 25936 - DNA, 201 bp, Bos taurus
agatggttggatggatggaagaatgcaagaatggatggatgaatggataggtgggtagatagaagggtggatggatggatggatggcctaggctggagtgaatcaggtaggttttgaaagctccctgagtgattccagtttctgaccagggctgctcatgcgcaaaggtgtccagacagacagaaggtgaatgcacccgtg

SEQ ID NO: 25937 - DNA, 201 bp, Bos taurus
gggttgtggggacaaggtgagactctatccacaaagggctcatgaacagtagcttgtcacttgtgtgtgtgaaggcctgcgaccgttttctcctcacagaggtccagagcagcaggaatgacagcctcccagccatacaccagcaaaggcctgctcaggtcacacagccagcaaggggctgagctgggagctggggttcca

SEQ ID NO: 25938 - DNA, 201 bp, Bos taurus
cagggttccctgagtgtccaggtcgccgcgtgggtacgaggctggaatgaccccgcagttgcctggggaacgttaagccgcgtccccgtgcccctgcaggtggtgatagcagactctgaataccaccacttccggtaccggatcccgccagggcgcgtgcgcgcgttggaggtgggcggggacctgcagctggagttggtg

SEQ ID NO: 25939 - DNA, 201 bp, Bos taurus
ccgccacggggctcttgctggaaatctcagctgccaaggtgaaagccgcatcaagcatgctctccttgtctgggaagagccggctgaggatgaaaggaatcggaaatcaggcaatctgagaagagctctcctctccctcccatggatgaagaagtgaccaatcgcagtagaaagtggaagacagcactggtgaaatggacc

SEQ ID NO: 25940 - DNA, 201 bp, Bos taurus
agggtagggttccccctccctcgccccagtgatcaagggccactcactcgaacgaagtcacgaagcaggtctgggaaggagcgcccggcatcattatgagattcttttccacggcccagccattcccgccgtgctccacctcccagcctctgaagccctctgtgggatataatagggttaaacacgggggattcgcgctcc

SEQ ID NO: 25941 - DNA, 201 bp, Bos taurus
gttaggagtccaaaatctcactgccaagggccgggtgttttggatacctggtctaggagctagtatcaccaaaacaaaacaaaaacaaaaaacactgccccggccttttccatttttgttaaacggattatattacttttatcatagggaaaaaatacggcagtcttgtttatatttgatttgtgaactgtatgtatatct

SEQ ID NO: 25942 - DNA, 201 bp, Bos taurus
tcatctctataccctctcacttgctccccccgagcaatttgaagcaaatcttagaaaccacctcagtccccagggtcgcaaagagttggacacggccaaaaaactcactctttcacactttagaagcaacacccttctgtccatcagttcagttcagtcgctcagtcgtgtccaactctttgtgaccccatggattgcagc

SEQ ID NO: 25943 - DNA, 201 bp, Bos taurus
gccaacctggccgcttttcagggtctgcgcaggcgcgctgtgctcagcgttgcgacggcagagagctttacggcttgtgggcgggactttggattggcggcaggaaggtgggccgggggagcggagaggacgggacctgggagtggaagggactgacttccctgaacggtgtcgggggccggcccgagagggcgagttgtt

SEQ ID NO: 25944 - DNA, 201 bp, Bos taurus
cttcctcctcccgtttttcctgcattccctcacttctctaattagtaactgtctgagtctgctcttcggaacttagggaaggcctaggaaagaaactaaagcccttttcaacaaataagaaacagggcttacagaggctgtgtatgtaccttggaggggtctgttgtggcctgcttggtttcaacactcccctcttttgtt

SEQ ID NO: 25945 - DNA, 201 bp, Bos taurus
gaaaattgcagaacaggaattctgggctataaggagaagttttgaaggagactacagaggaggtaagctacaattttggatcttccctgtacaacatgtccgtcccgtcttccccttcagaaaccagctgttaattgagttagactcaccctacctaaagtttgagaggcatgctgaatttgaccagaacaagagtgagca

SEQ ID NO: 25946 - DNA, 201 bp, Bos taurus
tgagtgaatcacgaagtgaatgatttacccctgacctttcatcacacaccttgattcttttctaaacctcagttggagaggttggaaacctgggctctgaccctccccatccttcagtggagaccatccatcccgggactgcctcccagaggggctccctatcttgccttgtcctcaccctttggggcctccccaccctgc

SEQ ID NO: 25947 - DNA, 201 bp, Bos taurus
caaggcctggaaccatcccctgcttctccactgtctgctcacagaagctgcagcaagagctggagttcctggaggtgcaggaggagtatatcaaggatgaacaaaagaacctgaagaaggaattcctccatgcccaggaggaggtgaaacgaatccagagcatcccattggttatcgggcagtttctggaggctgtggatc

SEQ ID NO: 25948 - DNA, 201 bp, Bos taurus
ctgtgtaggctgccaggctgcggcagaggtaggtgacgttgcccttctgggcacagaggtcatacacgcactggcggaagtactcagaggggctcagcgctgcgtggcaggctgagaaggggccgttggcatcccggagctgcccacaggcctcgaggctctcgtatggtgccgtctgctctgctgagcacacagggcagc

SEQ ID NO: 25949 - DNA, 201 bp, Bos taurus
ttcagcatctttgctcctgcctttcccttggcccaaaaggttcttttcctagaaatacacatggctcactcccttgcctcttacaaagactttgctcaaacgtcaccatctcagggaggccatccccgagcaccctattttatatggcaactcctccttagtccctgttccctttctctgctctattttttccctctagtg

SEQ ID NO: 25950 - DNA, 201 bp, Bos taurus
ctgcccagccatagttctccagccacctccagagaaggtcccaccccagcctagagagcaacggcctcagaaaactcaggagcctgaggcctggcacatgctattacactcataccttccacacacacgatcccaagcatccatccaacagttattaagtgcctactgcaggccaagcacttttctagggcactggcacta

SEQ ID NO: 25951 - DNA, 201 bp, Bos taurus
gtgccttgaaaggatgaactcattcaatcctcaccaccacccaatgaagttgaaactatctttatccccattttacagatgtggtaactgaggcccagcaatggcaagtgacttgcctaagccacactgtgaaggaaggggcaggcttattccacaatctgagctccaaaggactgtgctaacctgcctcttcctctggcc

SEQ ID NO: 25952 - DNA, 201 bp, Bos taurus
accaaagaaattaagcattgattagccatttggatatcctcttttgaaaactgcccattttactatttcattttgctcattttttgactgggctctcttattgttataaagatttgtattttggatacacgtcctttgctggagatacaaacacatacacacacacacacacacacacaaaccattctctctctctccagg

SEQ ID NO: 25953 - DNA, 201 bp, Bos taurus
accagcctttcccagccattcatttgagaggcagtagaaccttgggataagccagatgtcctgggtttaaatcctagctccaacaagctgctggctgcatgagcttgggcgggtgactcaacgtccctgggtctcagttctctcatctgtaaaatgggcataacggtagtcccaacctggtagactggctgtaggaattca

SEQ ID NO: 25954 - DNA, 201 bp, Bos taurus
tgcaggagcccccgtgacagccatccttggaccctggccaggtgaagaaccctagttcctctgcggcgtggcagctttcatcctgtgcagtccagttagccgtattgcagggcctttgtgctaaaagagagaatggttaggtggtatggctggcttctcgtgaacctgtccccacaccgtgtcagcttgtgtagttttggt

SEQ ID NO: 25955 - DNA, 201 bp, Bos taurus
gctctgtgcatggtcatgctggagccacagcagtccccaagacagcccgacgcctgagggtctcaaccagtcaaaacggtggggcctcttacttgcttctccaatgcaggtttcaaccgcagtggaggtggtggctacaaccagaaccgctggggtaacaacaaccgggacaacaacaactccaacaaccgaggcagctac

SEQ ID NO: 25956 - DNA, 201 bp, Bos taurus
gccaaggggtcaaggaaagaaggtggagcagctagactgagaggtttcggtggggaaatgaaccatgtcggggaatacctgtgtggacgccccacttgcagaacaggctactttccgagaaaccggtggcccccatgatctgtccgatcacgtgcacctcagccattgccctgaaaggggaaaatataatcacagccttat

SEQ ID NO: 25957 - DNA, 201 bp, Bos taurus
ggctctgcctgctcggggctcctgcacttgttgagcctcaaatccaagctcagggtcagaaatgaggtcaaagccataggctctggagtcagatgggcctatgtgtgaattcagcctctgctgccttccagctgtgtgaccttgggtaagcgacctcccctctcttggccttggtttcctcacctgaaacatgagaccagg

SEQ ID NO: 25958 - DNA, 201 bp, Bos taurus
ggtgtccctccagggcaggaatcccaagaagatgagtgacaaggccttcccatagaggtactccaggtggtccatgcccactatcaccaggttctccagggcaggcattattaattggccaggtgaggggatttcacatactaatttcaatagtgacctgggcatgactatagtctttcttttaaaataaatttcctcagg

SEQ ID NO: 25959 - DNA, 201 bp, Bos taurus
aaatacaatcagagaggaaaaaaaatcacaaggatatagtcggttagtcacctcacagcaaccttccacagaaagtttataccttgaaggaacaagtagagactatttcatattgagttatttcccagagcctctcccactgtaaaataatgtcgccttcatttgttcattcttctcttttctttccacaacagataaatt

SEQ ID NO: 25960 - DNA, 201 bp, Bos taurus
agggggtgctttatttagcttcccatcgaggcctcggtagtcagggttagcaagtgctcatgtctgcacccttggtgttgttccaagtagtattgttaccgagcagggttcttggcctccttaatcaaaggaaattgagcagaggccagacaagaaactcaggcgaggttttatcgggacccctgctatagcagcagggag

SEQ ID NO: 25961 - DNA, 201 bp, Bos taurus
actccaccatggaggaaggaatcttcaactgggcatagcttcctacatcaggatccccactgctccccatcaccctgcactcaggagcttcatttactctcttatgtgacctgtctggcccctgaattcattcgacagcccctaggacggtagccagtgtggtttgtaagagcatcaaggcctgtttgtaagagcacgcct

SEQ ID NO: 25962 - DNA, 201 bp, Bos taurus
tgggggccaggaaggggactaaggagtgccaggggaacacggccacagagcgaggttccacatttgtccacactgtgggaaggagtcagctgagtggtgcggcaggagagccgggccttgacacccccctcaacccaaagcaagctctcttccaccctggacaaggcgccgccccctcttctttacaccctcttccctcat

SEQ ID NO: 25963 - DNA, 201 bp, Bos taurus
gcaggtccttaggaagcctggagtgctcagggtgatgctcacgccgtgccaggcccttgtccgaactttatgaacttaacacaactccttgactcctcacggccacccctttgaggatggcctggtgttagctcagatttctgtaatggacagagtgaggcactcagataccatgtccagggcacatggctggtaacaggc

SEQ ID NO: 25964 - DNA, 201 bp, Bos taurus
ggtggggggaatggagagagaggtgggcagaagtgtcccggctggccaaagcctgggcatgggacccggtgtggggctggggacagggatcgatctgcctcggcggcagtgtgcgggccaggattgcatcttgtcacaataatttattgctctcatcccatctgatcgatggcgctgaattagcaccgtgagatgcccctg

SEQ ID NO: 25965 - DNA, 201 bp, Bos taurus
gcaggcacgggctccaacccgccttcccggcggatggacgggatgggcactcacctcgcacgcggaggtacgtcccgcaggagcgctgaatcttcttgccgtcactgacttggcacctatacatgcccctgtgagtcttgttcactggtttgatgatcagctcgcccccggcacccacgtccccgcgatacatcacagggg

SEQ ID NO: 25966 - DNA, 201 bp, Bos taurus
gatgtctaaggtaccatcagggccactccccaaccccacctgttcacccttggctttgccttttagccaccacggtggtggctatggctcttggacccctcttgggccctttttcaggctggggccccagtggccaaggcagctccattctcttaacttacttcctgagatcatactccatgtggccacgggcctggaagg

SEQ ID NO: 25967 - DNA, 201 bp, Bos taurus
ggtaacttggggagaacatgtagagagaggcccttctgaggctccctttccttctgcccctgggtggttagttaatgtcctaccagcacttcccacttgtggggggccaggaccatgttccagccccacatcactgctcagggcagagggcactttgtccagacagcttagattccagagagacctgcctctgagcttcac

SEQ ID NO: 25968 - DNA, 201 bp, Bos taurus
tggggtgaggagcatggtgatagaatctgaaggtccctaaagcgctgtggttaggaggtgagtgaatgtcgatggaagactggtgtggtgaatggataagcctgggaggtggggtctggggagctggaatcctaggtccccaagtcccttggcccctgagaagggcagagacttaaggagaggttcagaatcatcgattac

SEQ ID NO: 25969 - DNA, 201 bp, Bos taurus
cagcattggtgaggactgtgacatgtgcttgtgaagggtctcagccaagctacaagatcagcttttatcctgaaggccaggaactgaagcaggaaagagccatcatcagatttgattattcacttttttttttttttttggccatgccatgtagcacatgggatcttagttccttgaccaggcatcaaactcataccccct

SEQ ID NO: 25970 - DNA, 201 bp, Bos taurus
agaaaaaaaaaatcatttgtttcattaaaaagtcagcattttaaccatagctcaccatgtcccagtagtcagaaggccacgtaacagagatcccttataaggggtatagtaagggtttcagttcaactttgaccttattattaaatactactcagatgagaagacttagtatgattttatcaggccttgtacaaaagtatg

SEQ ID NO: 25971 - DNA, 201 bp, Bos taurus
agaccagtaaggcctcaaacctttaagcccatcaggatccacaccggggagaaaccctacaaatgtgatgtgtttgataagaacttcagctggaatttccatcttcagggccatcagagagtccacacaggagagaaaccctacaaatgtgatatgtgtggcaaggacttcagtcagatttcccatcttcaggcccatcag

SEQ ID NO: 25972 - DNA, 201 bp, Bos taurus
ataaataaacaaataaatatattttttaaaagaaacctagcccagctccctgtgaggcctagagccacttgcttcccattcctggcccagcaatgctcaatgaaagatttagacaagatgatttctcatacttgtcaaatataacatcctcagattgtattcctttgcaacttctttaataaaatcaagcaaggccaacct

SEQ ID NO: 25973 - DNA, 201 bp, Bos taurus
gtagagcccatgggatcggatatggggagagagggaagtcggagtccaaatatgacctgagcatctgcatggatggagtttccacaaaatgagatggaaaagaaatcggtagagtgggttttgaggagagtgaagggtgcagtatgggctgcattgagctggagattcccatcagaactctaagtggaggtggaggtgtca

SEQ ID NO: 25974 - DNA, 201 bp, Bos taurus
tataacttgtgatccaagatggttgctggagctccggccatcatatccacattccagtcagtagtataaaggacaaaggacttagaaaaattctttaagatcaaccccgagaaggcccacacaatgcttctactggcacctattggccaaaatgtcatcacctggccacacttagggaaacatagacaatctagtttttgc

SEQ ID NO: 25975 - DNA, 201 bp, Bos taurus
accaccctgcctgccagtgggaaggggaaatggaaatagagggcagtcttgtaagggaaccatcacattctctcatttcccattggccagggtctagtcacacggctgccctagctgcagaggaagctgggaaatgtagtctttattctgggtggccacatgcccagtcaaaatccgtattactgtgaaaaaaggaatatt

SEQ ID NO: 25976 - DNA, 201 bp, Bos taurus
tcctgtgggaaccgggcctggggaaggacacagcttcctgcccgtgacaccggcgtgtgctatctggtgtcctcggcacgacagggctggccgcgggggcaggggcaggctgactcgatgactaaggtggtcgaggtctgagctcgggtgtgaggggcagagaggggaacacatgcctggtggctgggtccagggtccgga

SEQ ID NO: 25977 - DNA, 201 bp, Bos taurus
aaggggtactgccaggcctggaataaagactgtacctaattcccccactgcactcacttactttcattcccatacttgtccatttagtcattcaacaaacgttctctgaacctttcctgcatggcccagccctgtgttgatcactgggaacacatcagagaactcttggggacacagcgcaaaatgagataaacaaaactc

SEQ ID NO: 25978 - DNA, 201 bp, Bos taurus
ggcccatataagtgtttaattgcttttctttggttggccaaaaagttcattcggggttttccgtaacatctcctggaaaaacccaaacaaactttttggccaacccaataaaatccaagaagaactgaacttctaggttaagtgaagtgttttaatattcagtatttgtctttatatcaatgcagtcatgaaaaaatactt

SEQ ID NO: 25979 - DNA, 201 bp, Bos taurus
actcttagggtagagaagcccttctcaaataaacacagaaacaaacaatcacaacaagtgcctgaaaggaaaaagtctcatagatttggttactttaaaatgaaaaaacttcagcaggacaaaacatgccagaaatgaacattaattcacagacaatgaaaagaggcatctttcaaaagcggtataaatgtccaataagcg

SEQ ID NO: 25980 - DNA, 201 bp, Bos taurus
ccttaacttctctgtgcctcacttttctcgtctctaaaatggggcctcccttgagggttaagtgcactcttatttgtagagctgggctgggatctggtgttgatagctgtgtgaagcccaggcccctcccgtttccttttttctagtctcttcccttcagtgagttgttcagtcagttcttttatgagcatctgctgatcg

SEQ ID NO: 25981 - DNA, 201 bp, Bos taurus
ggaagggatgctggaggaccaccgcccagcctggcctgcagagaccctgggctggagggcggtctgcccagacctgtgggggtttctcccaccagcattgaggaaggccttcaagggaaacactcagatccttgcaaacttctgtttcctcgtctataaagtgaagaccttgtcaggcaactcataaggaattgctccatg

SEQ ID NO: 25982 - DNA, 201 bp, Bos taurus
gacgaccaaaaatgcctccagacttggccaactgtccctgaagggacaaaaccaccccagcggaggaccatggaacgtggccccattctacagatgggaatgctgagggctggggatgagtaggacagcacccttccaaattttcctcttgcagagccagagcctccagtggaaggaaagcaggccgcccccccggaggag

SEQ ID NO: 25983 - DNA, 201 bp, Bos taurus
cccctggaatctcctggccagatagcctcaggctcactttctaggctgcttccctgtctgcctctggagtgtggaccttaccacagcgtctgaatgcctcggcctgaggattggatgttttggtggggaaggatgggcaaaaccttgtgcaaagtcaggttcaaagctccttacattgtgggtgagccagaatgagacggg

SEQ ID NO: 25984 - DNA, 201 bp, Bos taurus
aaataaaaaatttatttaataaaaatataaaatgggagtgagaatgctcacctctttgactggctgggtggggcaaagggatcaagaccatgtggggcctaaacccgtggctttgcttcaggcagcgacccaggcactggaagctttgtggacctttgagttcttcttactgggcctctgtgctctcctctgtaaagtgga

SEQ ID NO: 25985 - DNA, 201 bp, Bos taurus
cacctgaaatccctcgtttaagccactgtggctggcccagttcgatgaagaaattatcctttttctcatattcctcgtcatcaactatcttcacctgaagggttttcctgaagggagaggcagaatccccagcataaggccccctgcccatgactcaccaataactcgcccattagccaatcagtttcttgggcactcgct

SEQ ID NO: 25986 - DNA, 201 bp, Bos taurus
tccatttgggcccatgttgacccctcctctggccttggacgtttgacctctcagggctttgccagccacggctagactgggggcttctttcatacccatgtgtattcctggccacctggtcctaagagaatgcctgtagaagagtgggcagtatctcatggtttcgtagatctttctggagcacttactaagtgccaggta

SEQ ID NO: 25987 - DNA, 201 bp, Bos taurus
gggagggtgtaaactaaatcctatattgaatcctgggccacagaagatgctgtcattttattattgagacagctggccacatttgaaggcacaatgtcgactagatagtaacattgcatcaatactaaattcctcgatttctatcatttttctaagattataaaggaaatatctgtggccttagaaaatattctctgaagt

SEQ ID NO: 25988 - DNA, 201 bp, Bos taurus
tttcctctacatccggtttctcttgagtctgaaaattcaagttctctgtgacggaggaatgtatctgaaacgacatccatccacagtggccaccaggctccatttaaatgcttgagccatagtcacgccatttttatttttttttaatcattttgcttatttatttttggatgggctgggtctttgttgctgcacgcaggc

SEQ ID NO: 25989 - DNA, 201 bp, Bos taurus
tgaagcatcaccccggaagcacagacatgggccccagaatcccctccccgctgctctccagccactcagctgggattctttcggaggatctcctcagggtccccccgttactcaccaggcctcgggccgcagggtagatgggggacagggagaggtccgcgcacttcacctcccacacgtcgctggggtccagccagtggt

SEQ ID NO: 25990 - DNA, 201 bp, Bos taurus
gcagaatagtttgtggagagatctatgcttaacttatattccaaccctgattcttcagctgtgggtcagctctgcagggcctggctgaaacagcctagcttcctgcctggtagaggggacctaagctcattgccactaatctccctaccccattaagtgactttcgtgcaaaaataatgaggccagagtggctgaggccaa

SEQ ID NO: 25991 - DNA, 201 bp, Bos taurus
tacttaatatggggtcagggagctggccaggaaggatgggagtggagtgacaacggttgctatgggactcagttccgaaggcaaccttggtgctgggctctgcgtctgtggccttggtacaaagcctcacacttgtgatcttggtataggtcctcacagttctctcatgcttggcattcacgattgtaccttcaatctcac

SEQ ID NO: 25992 - DNA, 201 bp, Bos taurus
ggtacctggaccagtgcccctgaggactctgccctcgaagacaggaatgcctgtatcaggagtcacgcagcccgcaggaaggcagtcctgagttccaatctggcccgggtcacccaccagatggaacacactgggcacacaggatcctcctagggggctccgcatccgcgaaatgggtgatgccccgggactggctagact

SEQ ID NO: 25993 - DNA, 201 bp, Bos taurus
ggttcggggcgattctgatagaggcgccgaccccgagggaagggtgtgcgctgagctgctgagagagccactttacctccagccacgaccaggtgagagatggagccggggagttctctctgcccgcaggcgcgcgcgcacacacacacacacacacactcgagacttgatcccagggatccagcggcaagtggagactcg

SEQ ID NO: 25994 - DNA, 201 bp, Bos taurus
atcgaaccgtggtctcctgaattgcaggtggattctgtcccagctgagctaccagggaagccccatatataggtgtagatgccacataagcaaggatgattgggaagggcctttctgaagatgtggtatttgaactgagacagtaaataggaggcggttatagcaagcttcagaggaaaggcataggggtagaggggggat

SEQ ID NO: 25995 - DNA, 201 bp, Bos taurus
ctcagatgaggtctgctgtgcttcagggcagttggggctcagagaggggcctacccgtggtggccaggtgaccggaagttctgggcctgtgtccgtcactttctttcttgctctgtgatactgttgacaacatctactcacagaattttttttttatcctgcacaggggaccctcacaatgatcccaatgctcagggtgat

SEQ ID NO: 25996 - DNA, 201 bp, Bos taurus
gtagtttgtaattaacccatggatcaaagaaggaaaaaaaagaagctaggtaatattttgaactgagtgatggttatgtcatgacataccaacatgtttgtggggggcagctaatgctcgggcttccctggtagctcagctggtaaatgcaggagacccagattcgattcctgggtcgggaagatcccctggagaagggat

SEQ ID NO: 25997 - DNA, 201 bp, Bos taurus
ggcaagagtactggagtggggtgccattgccttctccatctgttaagtttagccttagtatttgatgggttttgatgctaatgtaaacggttttgcttttctaaattttaatttaactgctgtttgccattcagttcagttcagttcagtcgctcagtcgtgtccaactctttgcgaccgcatgaatcgcagcatgccagg

SEQ ID NO: 25998 - DNA, 201 bp, Bos taurus
cctgccccaactggggggacaaggccccgctgggcaagctgcctaaggtgctggggctctggttgctttgggatcaagacgaggaacaacttgagaccaggagtgcaggcgcagagatggaggccgagatggaattagaggcagagacggaggaggagatagatgagtctccagaataaaggaccctgggctttctctgga

SEQ ID NO: 25999 - DNA, 201 bp, Bos taurus
gaaggtggccctggtgcgcctgtcccctgggcacccctctggtccccctcgctctccctgagagaccacctagcccggcagttaagaacgcaggattggaacggagttcatccctgctcggccactccctggctgtgtggccctaggcaagtggcgtcacctctctgggcctcactggccttatctgttcaacgggatgat

SEQ ID NO: 26000 - DNA, 201 bp, Bos taurus
agggtatgacaggagccatcggagaaagctcttggctctgacgggtttgcggggtgtcacagcttcctggggccaagagcaacagaagtgcattctctcgcgctcctgaaagagagaaacatgatcgaaatcagggcgtcggcagggctgcgtgctctcaaggctctgggggaagacccctccttgcctcctgcgggtggc

SEQ ID NO: 26001 - DNA, 201 bp, Bos taurus
ggtttcctgggatgcatgatcttcgtgctaaaacagaggaagccccaggcaaaccgggttgaggtggtcaccctagtggccagtacctcgagggactccaatctggaggaggagacatacaccagcacaaagggtcacagtccagggtgagatgtgcttcagtgggggtcgtagagctgcagcgagaggccctgcagacca

SEQ ID NO: 26002 - DNA, 201 bp, Bos taurus
gcggagccacgggggagagacagatgtgactgggtgagaggaggtgatggaggaaaggggcggggccgaagggagggagaagctgaattgattggccttgaaagggatgggggcggggcttaaactgagaaaaggacccagactccaacactgtcttgccggacggggcggggccgcacatgcgacacaccgattgggtct

SEQ ID NO: 26003 - DNA, 201 bp, Bos taurus
atggcggtgagagggacctgggggcgggcctgtgtggagagacggacaaatggacgggaggtagagacgggtcgggatggggagaggggaggagaggcagaaggaagagaggttgaagagaaaggcctcatcaagagggtgtgagcaaaggaaaccagcgtgggggagattcacgcaggaaggtgtgtgtgtcagagaaac

SEQ ID NO: 26004 - DNA, 201 bp, Bos taurus
ggctagacacagcggtggcagcgctgggtcacgggccacatctgaggtcaattcttgcagtttctggagggcctgagatctgaatctctaattccttccctctgcctgttcccacccttccccttaccccagggccttctacaaatcaatttcatccctttattctcaatttctacgtgtcgtcttgctctctttacttct

SEQ ID NO: 26005 - DNA, 201 bp, Bos taurus
cttgaaacaccctttcctctccatccctgcctctctgagtcctcagcaaccttcaggctcagtcttcaacatcactgtgtgtgtgtgtgtgtatgtgtgcgcttcattgtctggttttggttggaagagcgacatacatttaattatagattattcataaagtattactgcatatctactctaagccatctagttgtaggt

SEQ ID NO: 26006 - DNA, 201 bp, Bos taurus
agggctgaggggcccttctcccctctctgtcctcccagatataggacagtggccctgagatttcatcacaggcaagggcaagtaggggtgaaggcccccccaccctggaggtcaggggcgggggcaggagaggcaactcagtgaacccaggacagggggatggatgttagaagaagatgttatctcaacctgggagataat

SEQ ID NO: 26007 - DNA, 201 bp, Bos taurus
atactggagagaaaccctttacatgcagtgagtgtggaaaaggtttcaccatgaaacgctatctcattgtacatcaacaaattcatatgggagagaagtcctatatatgcagtgaatgtggaaaaggttttgtcatggaaacagagctcattttacatcagcagattcatactggagagaaaccttatgcctgcagtgaat

SEQ ID NO: 26008 - DNA, 201 bp, Bos taurus
tgctaaataaacactggaccaccagggaattcccattggtcttgaattgagtgagtagcactggcttatctgacagttacaagaatagtagaatctccctgttgaactatttgctcctggttcttttgtttttgagggactttttagaaccttctcttttctatgaatgttggtctgcttctgcttcctatcatcctgtgc

SEQ ID NO: 26009 - DNA, 201 bp, Bos taurus
aatacaatggatactaagtggaagaacttctcagggaatcctgggagacacatacattttgctgcgtgttgctcccaagtcaacactctgatttctactgctccttccatctgagatcctgtctccattgtgaatcatgaaaaagttaagggcctctccaagcacatcaacagtctctttggagacacttataagaaaatt

SEQ ID NO: 26010 - DNA, 201 bp, Bos taurus
tgattcctaaaatgtcttgccgtatcctgtttgaccacttgcaatttaccttgatttatggacctaacattccaagttcctatgcaaaaccgcttaaagacggcagagtagaaggatgtgcactcatcttctttgagacctccaaaattataactcactgctgaacaaccatcgataggagaatgttggatcccaccaaaa

SEQ ID NO: 26011 - DNA, 201 bp, Bos taurus
gcaatctgaaaatgatgccctctagctacacttggcatttatccttccaagaaaacattacttccctctcggagcattcttcattccaaaaagaatgtcaggggacgatgacctcagagaccaccagaacctgttcttgaatcgcctcatgccagctgtgatgatctcaattcacccaggaaggggagaagaatgcaagac

SEQ ID NO: 26012 - DNA, 201 bp, Bos taurus
cctgccactcaaaagcaaataatcaggccaggttggtgggaaggaacgtttgctttatttcagatgctggcaactaggttgggggaggatggtggacatcgatccaaaggccaactccaccccaccccaaaaggggatgagagcttttatagacagggggaggggggctacaggcggaaacagcacagtcctctccaacag

SEQ ID NO: 26013 - DNA, 201 bp, Bos taurus
aaaccaaagcacagagatgagaacttgcccattctgtccttataccacctacccctcatcactccattgctccgtggaactggactcctagggccaaggaaggatggacattcttgacggctttgtatgttgtttttctcagcagatcttaacctcttcaactctgtctaggatgctgcgtcagtatgttcgccagtttcg

SEQ ID NO: 26014 - DNA, 201 bp, Bos taurus
acaacacgcatcccaattttagaaatgctgaagttgaaaaaaattatgcttgcagaaaaactttccatccagttagtgttaggaaaaatttaacgattcagagtgagtacttaagactcaggatcagtgctagccctcctgataactctgtaatgtctcacacctgaaggtactcaagagatttgatgaaacacgaggcaa

SEQ ID NO: 26015 - DNA, 201 bp, Bos taurus
gaggagtcctgctagcctcccgtgggtggagggaggccagagttacagcgaaacctccctcaatgcacaggacagctcacttccccaccccagcaagaaaccacccagtcccagggcttccctggtagctcagtggtgaagaatacgcctgccaatgcaggagacacgggttcaatccctggtccaggaagatcccacatg

SEQ ID NO: 26016 - DNA, 201 bp, Bos taurus
caccccgtttactgagcatttattttctaatctgtcaaaaaggccaccgtagcttagtgagaatctggaattactgcctggcctaaaattctaattccctcattgaccagtttttcaatgtattttttgtaaattagtcaccctcttagcacctcagtatccttccctgtttggatttttatttattttgggccacactgt

SEQ ID NO: 26017 - DNA, 201 bp, Bos taurus
agtttgggattgtctgttgcctgggttctcagccggggtgggggtggggggggggggcaggtgggcgatggtatccccagggggcctccactgagggcagcggagatggtttcagttgttacagctcggatgctactggcaggtggcgggtgagagccggggtgctgtggggccgcctccagggcagaggacggcccagtt

SEQ ID NO: 26018 - DNA, 201 bp, Bos taurus
ttggagcagaagccggcctcggttcccccaggcccaattagaggctcctggagttttcaagaggccgcagaggagacctgaagagggcaggagtggccagccttggtcactcaggagctcgagcgccaggaagacggtctgccagaggggctccctgggttcccagaggccctgagatccggaccccaggagagcccttgc

SEQ ID NO: 26019 - DNA, 201 bp, Bos taurus
aggggccatgtgtgtagaaggagaggtgcaagaggatgaaaggacaggcacgaacaggagtctctgggagctgtgatgtagggagacatgagggggcttccggaggatcctatgaggagttactgtgcgttgagattcatgtcagggcttctactgatacagttccatcggactcacggagcagtcgcataggagggccag

SEQ ID NO: 26020 - DNA, 201 bp, Bos taurus
ctcatcaaccttacaagcgtttgcacagcaagggaatttagaaagaaaaagacagccctcagaatggggaaaatatttgcaaatgaagaggcccataagcgattcatctccagaacatacaaacagcttgtacagctcaatatttttttaaaaatgcagtagaaaaatgggccagagctctaaatggatacttcatcagag

SEQ ID NO: 26021 - DNA, 201 bp, Bos taurus
tccaggctcttgacaggtagttaatcataatggggagaaccttagtattctattacaggttaatcactaaagggccattgcttgtaagcttaagttacacacagtggcccatctccgggaactctgtctgccaggtaatgagcatggaggtaaaatacctttgtttaggtctctggaatcatcctgaccagggccacctgt

SEQ ID NO: 26022 - DNA, 201 bp, Bos taurus
taagaagtaacggatacatattatcctaaagtggccactaaaagagtaataaagagcctgtctgtgagaatagagaaaaaataaaacacatactgttttagaagaggcttcccaggtggccaatataggagacacgagttcagtccctgggtcgggaagatcccctggagaaggaaaaggcaacccactccagtgttcttg

SEQ ID NO: 26023 - DNA, 201 bp, Bos taurus
aataaataacaaaaagtcttgagggtctgcatggccttgcattcattaattctactttgggaacttatcctggagaagaaagggaaagatatgggtgaaattgacctattacagggccttctctggtgttccagtggataagactcaatgttcccgatgtaggcggcgtgggttcaaaccctggtcaggcaactagatccc

SEQ ID NO: 26024 - DNA, 201 bp, Bos taurus
gcccctgtggtccatgtggggcatttgggtcgctctttgaacatcttaaagtcttttacttctacttcataaaaatgcatagaaaacgaaagcaaggccttacagttaatgtaccttaaaccaagctggaactcatcaggtgttcctgccgcaagtcaggggtgggggtggaggtctttggcctcaatcaaagatcagtgg

SEQ ID NO: 26025 - DNA, 201 bp, Bos taurus
gttccttagtaagatcacactcaatctcccctggtgtttgtattttaggaagatggtttcagatgcccgcacagccccacacatcagacgatgacgaagcgccactaactgggggccacaaactcattaatgacaacctagtctccatgtatcatttctcccaagtctctgggatgtgaaggaagaaacgcctctcgtgtg

SEQ ID NO: 26026 - DNA, 201 bp, Bos taurus
ttgaagtcttccctgtttgcagtactctttagtgtgaacttcttggtgtcgaaggaggtgggagttttggctaaagcctctcccacagctgacgcattcataaggcctttccccagtgtgaactcgccgatgtttaatgaggctggagttgtacctgaagaccttcccacattctctgcactcataaggcttttctccagt

SEQ ID NO: 26027 - DNA, 201 bp, Bos taurus
gaaaataagaaataagaaaacttataaaatattatttatacatgtcctgatgttgttttaaagcagatctccagaaacaaaagatgtcatgaactaaatcctggcagctgaatctataagaaacattgccaagaatggatttaggtttcagagcatcatttcagcatgaaccatccaatgaggacccaaagtcagcaaata

SEQ ID NO: 26028 - DNA, 201 bp, Bos taurus
ttaaagattttgatttcaccatcaaatctgaatgaagtccttgttgagtagcataatcttggttgtgggtgcttctttttcatcactttagatatatcctgtcactctcttctggcctacagagtttctgttggaaaatcagctattagcataatgtagattcctttgtatgttagtttttactttgctcttgcatctttt

SEQ ID NO: 26029 - DNA, 201 bp, Bos taurus
agaagaagaaagaaaaaagataaattatcagactttttaagtatgtaagagaattaccaggacagtgaaatgtatagaagttttagaaaacatttctggaacctagagaacagtaaagttgcaggttaatgtcaaaatgatagaaaataaatctcaggactggcagatgaatttaataaagtgacagaagatgaatcaaca

SEQ ID NO: 26030 - DNA, 201 bp, Bos taurus
tttgctgaaggtttgaagtgaggcatttggcactggggcttgctggactttggatggggcttggtcttagtgttgagatggaggcacttgggagagcacttgctgattaacatttcatgaggttgggatttctctgatggtacaatgtcctggcctcatgtttcccacctcagggtttcagacctgacccctttctatagc

SEQ ID NO: 26031 - DNA, 201 bp, Bos taurus
cttctggcaaatctgggccatctgggatcccaagaagatgtgggtagagactggtgggtgggtcacagctttgcaacagatgtggtctctagaactgagattgcagtgggcccttgccttctgcctctcactatcacatgcctgcctctctgcctccatggctgtagatgggagccagcttgccacccttcagtattttct

SEQ ID NO: 26032 - DNA, 201 bp, Bos taurus
aatagaggcagaagtatataacagaaataaaagtgttataaaaaatatttcaaaaccttaaatagatttaatagtactaatacagtcaatagttacagaagaataaaaaagaaaggaaaaaaaaaattccagaagcaactacagaacaagtcaaaatataagaatgataaatgtttggattgagtctttactgtcagtgtt

SEQ ID NO: 26033 - DNA, 201 bp, Bos taurus
ggcaagagtactggagtgggggtgctattgccttctctgtctagctgtacagttagaatcaaatgtcttaacatctccatacttaggatatctcaactatcagctaagtgtagatcatatgaatagtatctcctagtagagttgtttcatactattcatggggttttcaagacaagaatactaaagtggtttgccatgccc

SEQ ID NO: 26034 - DNA, 201 bp, Bos taurus
aggatgactgtgcctcagatcatcaggtccttatttcaaaattcaggttcacattaaagaaagcagggaaaacgactaggccactgatgtatgaccccccccacacacacacacaaacacacaaaaaaaattcccttatgattatacagtggaggtgatgaatagatttaatgacctagatcaggtacacagagttcctga

SEQ ID NO: 26035 - DNA, 201 bp, Bos taurus
gaaataatgagagttcaggatgcagtgagtggtctgctaattttctgcttctaaggccatctcccataagctctgttataactgcagcatgtgggacaaactcctcatagcaatggcccctaagacctgacttgatccatatctccctgaactgtaggatctcacttcctggtacgtaactctttattcattgtattagtt

SEQ ID NO: 26036 - DNA, 201 bp, Bos taurus
caactcagcaaattctaatatattttcatcaagtatttgacactttgtctgccaattaatagttggacattggtaacaagaaatgtacttaacaaaaataggctgtaagagccaagtcaaggaaaagaatgcttttgtctcaagtaaattgccctgagaatagattaactatacataaaaagaaattgacattagttgtaa

SEQ ID NO: 26037 - DNA, 201 bp, Bos taurus
ggttctttgggacactaatccatcatctatttctgctggccttctgaatagtctctattctttgctccatcacttcatctctctgtatattggcctgcatacagtgagcaatgcaagcttgggcttggtaacacatatattaacctttagactgcatgccaacaagcagattatggtttaagtcaaggggccaaataactt

SEQ ID NO: 26038 - DNA, 201 bp, Bos taurus
tttggatttgtatcatgcaaatgtttcttctcaaagtgaaattaattaaaaatttctatccaagatgctccacataagatatttatcttggtatcattcaccactaaaaactttcccttctttttagtcttgtttaagaaacaaaattctgtcaactcttagaaccgtctttttttttttttttttgctttctgaaaggtt

SEQ ID NO: 26039 - DNA, 201 bp, Bos taurus
aaggaaaacgagtagcttgtgtccaaaacactcaaactctgaaggatttcagagagagtttttaaaggcaaatttgtagggagtgctacagagtgtgtcaatctcttctagtttgtcggtgccggggtaacagggtggtgctccaggaatctcagtcatctgcctctggttccaaccagtctcagggactacacgctcaag

SEQ ID NO: 26040 - DNA, 201 bp, Bos taurus
agatcctacataagttacaacttagaatcaagctgtgtcctaaaataagaatgcaatataacctagagagtttcatcctgatttaactaaggagatcatacgattcattgtccaaacatagcatttttgaaagtaaaagagggttatattaataatgactttctcatatgcaacattcaatttttatagactgcaaggaga

SEQ ID NO: 26041 - DNA, 201 bp, Bos taurus
tttatgccaaagaatgcattgcctatgtttttctgtaagagctttatcgtttctgactttacgtttcagtctttaaaccattttgagtttatttttgtgtatggtgtagaattgctctagtttagttgtctagtttccttgcaccacttttggaagaggttgtcttctccactgtatattcttacctcccttgtcaaagtt

SEQ ID NO: 26042 - DNA, 201 bp, Bos taurus
tctcccagcctcttgccagttttacaacccatgaatgtctttctccaggagccatccttctaaactgtaatcatcaagaaagatagcacccctatctctctgtctctgtgggagggtagcaacctaactttgacaagcaccaattagcaaatacagattgcaacagtatggagtaaagccttccttgcctgtttaactcag

SEQ ID NO: 26043 - DNA, 201 bp, Bos taurus
gctttctctaggcataaataggcaagagggaactttttccagaaccagtgggaagagttgcacacggcaggcagccgtgagggcagtggtgtctgtggccaaaggagcaacgatgacaaggagcctgaccacatccccctgcactctcccgcctcctccccgtgggtcccatccactgagccagtcagaagcgagatggca

SEQ ID NO: 26044 - DNA, 201 bp, Bos taurus
tagtgttttctttctgtgtcattaatgctgtgaagttggggtgctggggtggagatgtaacattacacaaacccctatcaattgaaggtctgcttgcttgcataaaggacagaacaagaggcaagcaaaacagagggaaagaaaaggcattttaggatttttaagaatatgacaatggataccttttcatgtggaggcaaa

SEQ ID NO: 26045 - DNA, 201 bp, Bos taurus
tgacaaaattcaacattcattcatgataaaaaacccttaccaaactgggtgtagaagaaacatatctcaatgtaataaaagctgtgacaaacccacagccaatagaatattcagtggtaaaaagctgaagaccttatcactaaaatctaggacaaggatggcaattctcaccacttcttttctacatagtattagaagtcc

SEQ ID NO: 26046 - DNA, 201 bp, Bos taurus
tcattaattactttcttagatgcccccactgctatacacaaccacactgggggttggggcttcaacatacgaattttgcaggaacacacacgctcagtccataacaacagcaaaactgttaagcaggcagtagttaataattgagaattaatatactgtttacatttgaaagagaagtctgagtacattttttgctctgca

SEQ ID NO: 26047 - DNA, 201 bp, Bos taurus
tctgccaaccaattaacctccctgagggccaattgccatgaacattaaatgacaaatgggtatactttcatgtgagtcctccccacacaaaaagttctccgttcattcctctggccccacttcaaagctgcatcttcattttcacaagtgacaaagagcaagacaagattctccatatccaaaatagaaacggttcattcc

SEQ ID NO: 26048 - DNA, 201 bp, Bos taurus
cgctgggtccgtctccgtgccacctgcgccactcttccgcctcttggctcccgtctgtccttctgaatcagcgtgaatagcatttcctcgggtattctgttaggccctcccagagtaggctgcactttccccaaagccttataaaacttgatgaccacttcttattttatatgaatggtatttttctgcttgattctaagt

SEQ ID NO: 26049 - DNA, 201 bp, Bos taurus
agagagactggcctatcaattgcctgatgcactgaattacagaataggacccagccaaggtgcccttttagtgcctgatgcacagatctacagagtaagatgccagccaggggggcccctctatgtgcctgatatgtggaacaacagaaaaggaccccaggcaagggaactctctaagtgcctgaatgggtggggctatgg

SEQ ID NO: 26050 - DNA, 201 bp, Bos taurus
gttagtgaaaagtctgcttccaactttctcagcagggtacagtggtgaggtgttgggtcccaggtgcttctggataagaggtggagaggactctgtccccccattagctctgttctctggctttctaaggacatttgttctagagatgccctcaactcctccctcagatgtgtcacagctgtaattctagaagtgagactg

SEQ ID NO: 26051 - DNA, 201 bp, Bos taurus
cagtctaaatctagctccactgactggaggcaatttgttggtacagccttttccaaaatgaagatggagacaggtacagccgcaggaacattgggcatgatctgatatctagtacctctggagttatcccttgtttcccaccttgatgcatatgtttcaagctaactccttctccatccccagctctcctaacgatactgt

SEQ ID NO: 26052 - DNA, 201 bp, Bos taurus
gaacaggggacacagaaagatttggtaaccaggaagggctcatatagtcctgctccgttttagtctcttacacaaataacagtaaaaagcaatctgagtatgtcaccttaacttattccattttccaggaacacaatgcacccaactactagtgacgtttgtgttactgtatccacttcataaatagattgtttaagtgaa

SEQ ID NO: 26053 - DNA, 201 bp, Bos taurus
tttttcaactcctgcactggtgccctccgcccacagtggattcacaataaccacagggactcctctaagtaacctcaggcagttaggggcccattaagacgttttagaactaacacacaaaaaagatgtccttttcattataggggagtggaatgcaacagtaggaagtcaagaaacacctggactaacaggaaaatttgg

SEQ ID NO: 26054 - DNA, 201 bp, Bos taurus
agtgcctagcaaagagccttacatgaggacatgctcagtgaatactggtccttctctccctcctctctccatcaccaagcaccaggcctgtgtctctttcatattgagatctggtcttacattattctggtaaacattaataatgttattcttctttacaagccctgtatctggccaatgctgagactatagacaactctt

SEQ ID NO: 26055 - DNA, 201 bp, Bos taurus
tctcctttgttaacagttgaactatgcaccctcctcctcttcacctgcaggtcaaatcctgcaggtgaagtgagctcaagtcccacctaagggctgaaaatcatgatgaaactaagccagaaatagtgatgcagccctcttgtctgcagatggcttggatgtgggcatagagcacaatcctcgccaatcatgactaacagg

SEQ ID NO: 26056 - DNA, 201 bp, Bos taurus
acgtctatggtgaattaatgaaggccaagaataaaatttggatccactgacactcggtttgaactctttccttcaagccatgctgcaggcaacaaaatactggccccagtagattcctgggggaaggaaaggggaaagaagtgccagcctaaagtgccattcctcacctgctacaaggacgcttctagcaggggtatgtcc

SEQ ID NO: 26057 - DNA, 201 bp, Bos taurus
atcactcagcagctgggttcctgctgccccagctgtcaagtttccagctcatgcattcagttatccatcaatggagatctcaggggcagttgagcgggagcggacaaaccagcctttctttatgccaacagggaatgcttgaaataaccagacacacaactctgattgatgcggccacagtttacacaccacactacggac

SEQ ID NO: 26058 - DNA, 201 bp, Bos taurus
ataaacaatttagaaaagcccaaatctcataactaaatgggcacatgggaacagtcttctcttgtctccaaacaccttgaaatgagaaaaattgtgaaacgatgacatttaccctgaaaaatggtcaacatgaagtttgaagatgaaagatccacttagcatgcattgctttaaacctttgaaatgagcagtgcctgactg

SEQ ID NO: 26059 - DNA, 201 bp, Bos taurus
aaaggatggcctggaaggaagggacagctgggatggtatgagaaggaactcaaagaaagggaagaagccagtctcttctgagtgaagggaacagatgggaaatgagcaaagacaaaagaggccacgtgggtaggtgtcatcagttagaggccaagccactagaatttgatcaatcgacaagaatgtatttactggactcct

SEQ ID NO: 26060 - DNA, 201 bp, Bos taurus
gttagaaactgcacaactagatggatcaagggaagatttcataatgctctggtgctgggctgggcagtctagccaaattccattcattagctaaggcaccaggtgagtgtggccagtaaaaatgttgttttggttccatagaagcgctgatagggaataggaaataaactttaattttgggggtcctcagaggcagtatag

SEQ ID NO: 26061 - DNA, 201 bp, Bos taurus
acgggggaaagttggctcctagcaaaggcagcacaaggcagggggtggaatgcctggtccatggctaggtattttctctcccactccttttctgtgggtatagtggtcacagacagcagcaatttttttttttccccgatactgctatttctcctagtgatgcatgggtgaggcaacaaaggggaggggaggcgttgtttc

SEQ ID NO: 26062 - DNA, 201 bp, Bos taurus
tggtccgcccctgatgaggtcaccttgttatgttaaatatttctacctcctggtggaggaaccgaagctgattgctctcaaggccacctctgcccagaacagagaacacagcacccaaggcaggatatacactttccaaaggcttaggtaggctcctctgtgaactagaaagattcctttcaggccccaggaccagagcat

SEQ ID NO: 26063 - DNA, 201 bp, Bos taurus
cagaggagacttctgtgtcttttagtgaacagtggcctctgctctgctctgcatctctgagagtcctaatgcccaggtcacatcacccagaggaggtgcggaaggcaaacagcagcgcctcgggccctgcagggagagtggagcccccaccgcagggccaccaaacactctgcatcagacaaggaggacgggcggcagtac

SEQ ID NO: 26064 - DNA, 201 bp, Bos taurus
tgggccactctccactccccacgctcaccctgcacgtttcgactcccatgactccactcacgtgaccttctcaatcccacatactctccccacttcccgaccctttgatgtctccctcggcctccagggctccgctcagaagtgaacccccgtgagaagtctgccctaaccccctgctcagatttcagcacctcttcactc

SEQ ID NO: 26065 - DNA, 201 bp, Bos taurus
gaagcaccccgacccgcgtggccttggtggagggcagggttttctccacattgttgtgccaggcggagatcttggtgttgaaccactccacacaccaggacgcgttgttgcggccaagccggctttcggggccctgccgctccatgctgccgtagcagatacccaccccgcagaagttgttcttctgcagctccacctccc

SEQ ID NO: 26066 - DNA, 201 bp, Bos taurus
ggactgagtgcttcctgccctgggacttctgtgtttgctgcattgtatcctggggatcatcctgatcaaactgccccttggtctgggtcccttgtaaatcatcagggtcacaaggccagtcccagtggcagccctaattacatgtcccctccacgggccctactgctcatcttcaacgggagagtgtttggatgagatgtc

SEQ ID NO: 26067 - DNA, 201 bp, Bos taurus
taggcagtctgcaaggacttcctgtgtgcaagtcttgtctgttttttgttctttaataggtggtgcacataacacaatacatgattccaaagaaaaacgaggagaagagggcaccgccacctccttttctgtcccccagacacacgtctcctctttgggagactgttatgaggttcccctgttcctgctcagcacatgtga

SEQ ID NO: 26068 - DNA, 201 bp, Bos taurus
ctctgctgtttagtttaatgagagggtggagtgaatcttcggtgctgtgatttttcatcctgttaactcttttcaaaagggccccttatcttgtgagcagggaggagtgatgtcctatacgtgggatcactgtgtatcttctctgtgaaacttcaatcagtcaggagtggaccttcagtccctgcctgttcgctgtaagaa

SEQ ID NO: 26069 - DNA, 201 bp, Bos taurus
aagccgtgaacccttgttctgaagtgagggtagaaaagatgcaagatggggtttctgtccacgaggtgctcctggttggggagagaggtttctattcagactccctttcccctcgaccatgactctgacctctgcattcccccagggtttgtttcgaggccaggttgttgcctgctgggtcctgctgcttcctgggcgttt

SEQ ID NO: 26070 - DNA, 201 bp, Bos taurus
gaagctgcggatgacctctgtcgtggtcgctctgcaccctagggagtgtgcccgctcggggcctccttttacttggcccctagtggctccgtgctgcccacctgcccatctgccctccctccgtctcctgactccttgtggtttcccagtacgccgtgcagggcctgctctgcgtcctgcagctcaggttgcccgctctgc

SEQ ID NO: 26071 - DNA, 201 bp, Bos taurus
aaaggaaaagctctttccagtggtatagcctccaccccaaatatattccaccgcttaaaacggggatataatgacactacacacattgagttagcagtcatttatctccattaccgaaaaaatgatccatttgcaaaaaaataaaaaattaaaaaatggtgcttgttaatgcctgtccagatgctcttgtgaacactgggg

SEQ ID NO: 26072 - DNA, 201 bp, Bos taurus
tagcttatacctgcttataggtcctctccatcacatgacttttccccagatgaaaccacttatttgaattttgtgtttatcattccattacttataaaagtaatctcatcacatttttacataatcagcatattgttttattttgctattttgagcttcatacaaatattacattgtatataatattcctggatttgcttt

SEQ ID NO: 26073 - DNA, 201 bp, Bos taurus
tctagaaaggagtgacagcgggtgggtcactttggctttcttttccattaataaggtagagagagagttgctgtatgcctcttcatagctttggaaatgttgtgaagttcatcttagaactttataattttgaaactaagcaactcagatttttaggaaaaaggataatatccttattatttttgtgtgaaggttgatttg

SEQ ID NO: 26074 - DNA, 201 bp, Bos taurus
ccattcatcattccctgcctatgcagtcacctgtacatggctcaaacaggagcctctcccgaaaaagctgaacttgtctttctgctttcacaatcagctagctcagtctctctggattcaaattccaaagtcttttgttgaggttggaccatgtatcccaagtggctgaggaatgtaggggtcatgtgacataagcccacc

SEQ ID NO: 26075 - DNA, 201 bp, Bos taurus
ttatgatacttctattcaatggaaggcagtaacaaatacgaaaacgtagatgttaaaattctagtcttaatatgtacagacaatttctggatagcataatctgtaaggaaacagtggaaaaggtgaaaataagaggtcaggagttttgaaatgatagtttgtgaaatgacaggtaaaactaattattttaaaattgttttg

SEQ ID NO: 26076 - DNA, 201 bp, Bos taurus
tcaccctgctccaagatacctgtggctaggctaaattcaggtatatgtggccaagaggcagggattcccttcttccatccagacccaaggctctacctttgatgcagcatgtgaagaaactggggcccagatcacccttgccacaagtcactcataaagcagaagttccaggcctcagaagaccaactgaaaagagttgag

SEQ ID NO: 26077 - DNA, 201 bp, Bos taurus
atgggaggaatgcagtcattttgttttaaccaggattagcctctctgagcatggccaagcacaaaagaaggactgacactgaaggtgccaggccctgggggctgcaagtgggtcgatctggtttctttgaaacgtggagcagaggcaaggtcaacggaccctttccttcttggcctgaaccaagtctgacactgcgttttc

SEQ ID NO: 26078 - DNA, 201 bp, Bos taurus
tagcagaagcagcttggccatagtcacagcagcagtgttctagacacaaaattcttgctttttaatcttatggtgtggtaaatatttattggactttgtttgccattcagttctatcatgctgttttgtaaccttagaaatacattataaatttatttattatgctaattgtaatttttgtaattatccaaaaagtcagaa

SEQ ID NO: 26079 - DNA, 201 bp, Bos taurus
taaatgctcctagagtaaaacaacaggctgctgttcatatcacaaatcatcaattttggcaacaaattaataaacagatactttcttttccatttcaccagaagtcttttgtactgcgttttaaaactagctttgtattgcttttggataaatgatccatgttcatcattattaaaaaaattcacaccattcagaaaagta

SEQ ID NO: 26080 - DNA, 201 bp, Bos taurus
ctgaacccttgactcagtagccacattctgcctgcagtatcaatctaagtataatcaatatctctatttatgctggaaagatcatatcccaaggccaatcgtttaggaaagattatttatcttggttgcttattaaagatgatgtttgaattttatagattcataactttatacacagggcataggccctctaaacagctt

SEQ ID NO: 26081 - DNA, 201 bp, Bos taurus
atgtttcaaaatattcatcaaattttccatccacaccctggcttctccatacctcatcctccttgttaccattacaggccttgttactgttaaaagcatcccctcaatttgtattctagtccctgtttgctgtcctctcaagagctctgctccaccaattatcctttcttgctcttactaaggtaggagataggtgggccc

SEQ ID NO: 26082 - DNA, 201 bp, Bos taurus
ttttctttctctgacttaattcatttagcgtgataccctttagatttatgtgttgttgcaagatttctccttttcaaaaaaattgtgattgggtagtactctatgtgtgtataaatgtatctcataccatttttatccattcatctattgatggatatttaggttgcttccatatcttggctgttataaataatgctgcag

SEQ ID NO: 26083 - DNA, 201 bp, Bos taurus
aggtatgttaatagttacactttttctttcaacctaaattgacttgctgacctataatttgtttatggtgtataaactactctcaaaaaataactttttcggagccccttctcatatatggcacaccattattttactaaataataacagaagtaaaacttaacttctttaggaattaaagaagtaaaacttcttaagact

SEQ ID NO: 26084 - DNA, 201 bp, Bos taurus
ttgaatgcatatttttggctactgagggaaataggaatataagaatatcttggcacaaagacatctcagttcttaaaactggcattttagagcccacatattcttaaatgtagctacaagggagcagttgcatatgacagcgccttgcagttctcttagtttggctattgacttccctccaggtttatttttaccagtaac

SEQ ID NO: 26085 - DNA, 201 bp, Bos taurus
aggtgtcactcactggaaagtaaagttctttcttgttttttgtcttttattgtgggtccagagcataaatccttcttacaggttctccttttgcttttttttaattatagcagaatataacggttaatctttgtttttgcttgtctgtcctattgttaggttggtgcaaatgtaactgcggtttcagaccatgaattttaa

SEQ ID NO: 26086 - DNA, 201 bp, Bos taurus
ttcctggagtgtgaattacctttcagttgggtctggaaaatgggtaggaatttccggccagaaaaagaggacagcggggcgcgccaggcagggaggccccgaagagcacgcagggctggaatagcacagaacttagtgcaggagtgacagtgagactgaaaaggcagctcctgcctggatcccagggtgggggtggggatg

SEQ ID NO: 26087 - DNA, 201 bp, Bos taurus
ctggtgggatccataagttacagtgtatcaaacttgtttaagccttctcttctgaaactctctccactcctttagctctaaatcccaattcaatgacactgacctccccatcatcaccccacaagctaatcaatttctcataccctctcatatcagtgtagcccaactctaggaaaaccttgaaatctttctaaaagcaac

SEQ ID NO: 26088 - DNA, 201 bp, Bos taurus
agcagtgggccgtgaatggaagtgggttggcagggcaccattcagattaggaactggcttcattttcctctcttgcttttctcttttcagaagctcaggcagaagccaaaaggcccatgttcattcaaaaccagactgtggctatcttgcagtgtcttggttctgggagcaaagtgaaagttaaccttgtacattcagaaa

SEQ ID NO: 26089 - DNA, 201 bp, Bos taurus
actagagagtagcccctgctctccgcaactagagaaagcctattcaacaacgaaggctcagtgcagccaaaataaatgaataaaagggcttccctgatagctcaattggtaaagaatccgcctgtaatgcaagagaccctggttcgattcctgggttgggaagatctgctggagaagggataggctaaccacttcagtatt

SEQ ID NO: 26090 - DNA, 201 bp, Bos taurus
cccatagggatgaagatgcagagaccacaggtggtcaaaaccatccctactcattctctgtactatacgtctgccctctccacagcttcctcaccagaaggggcctatctgtctgtgtcaatcctgctgatagctgggtccaggaatacatcagggacctggagaagagcccctgagtggtccagaaggaacctattgaaa

SEQ ID NO: 26091 - DNA, 201 bp, Bos taurus
actgtcccaccacccactgtacagtcactgatgcaggacaagggatattctatcctctccatgccaaccgcttcacatattcatagcccagactcttctgtttggccccaaaactaaaggcttactgctctttagttataatgtaaactgccctcattccagtctgcccagcactggccttcatgacctgaatacaagtta

SEQ ID NO: 26092 - DNA, 201 bp, Bos taurus
agaattctatggacaatacagtccagggggtcgcaaagagttggacacgactgagcgactttcactttcaaaagtagaggagggcattcgagtctcagggaacacctacacaaaggcacagaggccccaagtcacatggagagtggtaattactctggtgcacatggagtggttgacattttattgacacctagtctggcc

SEQ ID NO: 26093 - DNA, 201 bp, Bos taurus
atgggaacctgcacttctgggaaagtaagagtaccataaggttccagtgtcattgagtgcaatcccagctccagctccagctcctgcttctatggccctgaagccactctgccttggaacatcggtgaatggatgcttctccatttcactactgctagctctcctgcccagaacccttacatttcctaaacacactgaggc

SEQ ID NO: 26094 - DNA, 201 bp, Bos taurus
gataaagtaggtttgtggtctggttgtcatctggccctccttacagtggagtccacagatcagacagtgcgttacctgtctgggagcttgatggaattgcagaaccctgggccccccagcccagagcttggggatcagaacccgccatttaaggacacctttcaggtctgagaagcagtggtgtgacgaggcacagcgccc

SEQ ID NO: 26095 - DNA, 201 bp, Bos taurus
agtctggtgggctaccatctatggggtcgcacagagtcggacatgactgaagcgacttagcagcagcagcagcagcagcaggtatttacactaagacaagaatgtattgtcactggtttttggaaatgtgcacctgtgttcacgataaccttctgggtggctttgtctcaagtgcttctttccctcagtaccaccttcctt

SEQ ID NO: 26096 - DNA, 201 bp, Bos taurus
ctggccgcccgcacaggaggaggcaacagggatttggaaagagagatgaggaaggaggactgtgcttactgcctagaccacaggggataagactcttcacatggccagtgggataggaattctaaagtttccatccattgtcttcccaacagccctctctctcccttgcttctttcttgctatcagaattcagatactagc

SEQ ID NO: 26097 - DNA, 201 bp, Bos taurus
agggatggagagtgaggctgagaagattcaaagggagggagcagggctggggtggagactgaggagcctagaaacctgagaggcctggggtggtaggaagtttgaggtttgaggtccctgcctctgatcctgaggtcactgcctgagctcctgatgagtctcatttatcagcaagcttaggatattgtttgcaatcctgac

SEQ ID NO: 26098 - DNA, 201 bp, Bos taurus
tgccccagtgcaagggcatctcagtgggtggtggggtgggtgttcctgagagtcctggaccctttgcctccactggggtgggttcccttaagggtcatttcgtgtggggccttcagggtgggaccctctgcttctcctgcagagacaaagcctagagtgaaagaacctgctgcccaaggtcacctgggagtggaggggagc

SEQ ID NO: 26099 - DNA, 201 bp, Bos taurus
atgtcccttaccagactctgcctacttcctacctgtggtacagtatcatctgcactgaatggagagggaagcggaggcccagaaagagaagctgatgtgcataagtgcacaggcagtcaatgctgctcttgtgatcagcaccaccacctcctgcctcccaggcctggacatttgcagctccgcgtgctcccgagtagactg

SEQ ID NO: 26100 - DNA, 201 bp, Bos taurus
aaagttgctattccttgcctcaagactttgcctcccaattattggcctgtcctgcagcgggcagaccaataacaaatagataaaggggccacacagcaccccatgtctcactgcattttatctttaagctcttggagagcaaagtgaaagtgaaagtcgctcagtcgtgtcagactctttgccaccccatggactatacag

SEQ ID NO: 26101 - DNA, 201 bp, Bos taurus
aagggagtggcagaggatgagatggttagatagcatcaccgactcaatggacacgcatttgagcagagaaacaagagacagactggagctgcattccacttcagcctgaggagtccttacaccctgcttctcagggtaccccaggctctccatctgaggaactccaggttctttgctgtccctaataagttgtgattttat

SEQ ID NO: 26102 - DNA, 201 bp, Bos taurus
tggggtggggaggcaggatgactcagatgcctaaactctcattactacatgaccaggaggcatttctaagaaggaaggaagtggtcagtggccacttcctgttgcccttatgaaaagccctggttttaaaaggcatgacctgcacccaacctcccacaacaaacacatcctttgctttcttacttccctgttgctatgctc

SEQ ID NO: 26103 - DNA, 201 bp, Bos taurus
cagtggtccttccagatgtacattatcttcggggctcagaggggcagcaagtggggtgtgcaggataaacaccttcctggatgcctgcccctgaagagacggcagctcaccctctgcagagccaggcggtgtctgtatccatatgtaaataccgagcactcagccagggccgggaaacacacagaagaataacaaacagat

SEQ ID NO: 26104 - DNA, 201 bp, Bos taurus
ggtcctgccagcagctaattgtccacctggcagctaataggccttctgatccacctcaccactcagcccttagacagtgcttctcagccaagggtggttttactcccacaacagacacctggccatgtcatggctgtagcagcttgggaagatggagatgctactggtgcttggggcttacctggtggctcagcaataaag

SEQ ID NO: 26105 - DNA, 201 bp, Bos taurus
ctcttcccacctattgtttcattttgccctcagggaagccctgctcctcacagaacattagctctgttttgcagagaaggcccagagtagctaggtgacttttccgagggcacagagcaggtccctgagggtgccatgctcttcccgctgggccccagctgtgtgggcttggggacgaggaagggaacaggtctcagggat

SEQ ID NO: 26106 - DNA, 201 bp, Bos taurus
ttcacagatggcaaaatgaatgaatgagcagaaagagaggatgaaagagaaccttggaaatgggatttcatcagattatcctgtacgtgtggagatcgcaggggccaaggagacctgcacatgcagaaagcaactgcagcgtcgctttgcaaacatccccgtgacctgcttcttcaggaaggtgaccatcgcatccaccgc

SEQ ID NO: 26107 - DNA, 201 bp, Bos taurus
tgaatatctgtgtgtgtgtgagtgtcttttttccttagtatagattcctagaagtaaaataagaggtcaaagtgtatgtaccgcaggcatttttatatttgttgctagattgctttataattaaagtgttaattcaacagagcatgagagtgtcttcaaaatggatatggccatcttcatttggagcaaaataaaagctgt

SEQ ID NO: 26108 - DNA, 201 bp, Bos taurus
cggctggtgcagggcagagcagggtccagtgtggctggagtgagccagggagaggacagtgggaggggctgcgtggagattgtaccagactatgtgggtcctgtgggccacaggagggactttggctttcactccaggcaagacagagatggagcacagtggcagagtcttaggcagagaagagacaggatctgactttgg

SEQ ID NO: 26109 - DNA, 201 bp, Bos taurus
caaacagattcaagcaaccaccgtacaccctgcttcaatctaccactttttaccgaatgagttttaactttggtagcatctccttctccggaattgcaaacgataattctttgaaaagaactggaagaggctcagtgattccaaagaggcactcttcagtacagctcagggtctagtctgaactcgtagaggacatggaca

SEQ ID NO: 26110 - DNA, 201 bp, Bos taurus
ctgtctgcttatttttaaaatctctcccttttcttttcttatcccactctaactattcctgaaggctcctccagagtctccaatcaagaactaggtcttagtgttttgagcctactttgatagtcttaaatcacagatccagttactgagccaagaagctacttagctgtttttggttttaaaaatccccaaagccatgtt

SEQ ID NO: 26111 - DNA, 201 bp, Bos taurus
cttgttgctcatctacatgggaacaggggaggggagggggtcagaaccggggtctcaggggagccccatcccatttcccagccagccagttccttagaccgcccaggcctgaggccaccttcctctttcttctgtaatagtttgcaaggagttaaatgtaagttgacaagcaatattcaccaagctcttctgtgtcagggg

SEQ ID NO: 26112 - DNA, 201 bp, Bos taurus
gccttagattgcaggctattaagcagaggaaagaaaagctcaatagtacatactctcttcaaaagcagtgaagttaagagactgtgggaagagtagcttctgcccagtgacttttatcagtcctcccatacaacttctcagaaataaatttgaatttcctattttttattcttctatctcaccacttcacccttcccaaac

SEQ ID NO: 26113 - DNA, 201 bp, Bos taurus
gtttccaaagtggttgccaaagccacaacatggtgaagggggaggggcccttagcatctcccaaggacaggctggagcaacgcggtgggggtgcggagtgagcacgccttgcagagaccgtctttctgaaaatgtccccaaggtgtaacagggagtttctgtctgaactgatgagtccggatcctccgacggcagtcttgt

SEQ ID NO: 26114 - DNA, 201 bp, Bos taurus
cttcaagtgactttaaaacctgtaacttgatctgaggttggcaaatcttaagttgatgatccttgaaatcacctgcctgcttgcgattgaggtcaagttggatttaactggtttgtactgcctttagggcagcaagaccaaaaaaggccgaactgcaaatgtagcatgcttctgggctgaggcagcgtctgatgggtgcag

SEQ ID NO: 26115 - DNA, 201 bp, Bos taurus
aggatctaagtagcttgctcaaggattccaggctaatccagtgtccttcctacccttctcttaaccttcatgacaatttgtgctggcccttcccctcccacacagattctctgtcaagctacaagattatggatatctccccaaacacaacctgattataggaaggaaaggcctgagaagaggtgagagggaaaagaaagg

SEQ ID NO: 26116 - DNA, 201 bp, Bos taurus
tgagttctgtgagcacagtgctctttatctgtagtaatcctaccaagtattgtacagttagagctcaacttgagagagtgtttagtccagcctcctcattttagggaactgagattcagacatgttgatctagttagcgaagtagaactcccatctccttttatctgctgttaactcgtgatcctaaagaaaacatctgta

SEQ ID NO: 26117 - DNA, 201 bp, Bos taurus
aaagaaaatgaaacatttttgctgtatttggaattttatattattattagttctcaggcacatgtaggtcttgtctagtttctttataatctgtatacatatatatcttaaagaatgcattgagaaccagtgtaacagacagcctttaatgtatagtcatttagctaccacacaatttgtgggaattgctagactatattc

SEQ ID NO: 26118 - DNA, 201 bp, Bos taurus
cctggggcctggagtttgcaacctttgtcctagatgttgtgttgtgaaagcttttcccagctgccgccctgaaactccttcccggcaagagtaggtggatatattgatacatctctggatggggccagggggacccggggatgtgcggatgcatttagcttctggaagcatgggaagccaggggaatcaggctgggatggg

SEQ ID NO: 26119 - DNA, 201 bp, Bos taurus
tcctttctttccttccccgtcacatccactctctcaccaagtccccttaagtctgctctcctaaagatgccccaggtgtggccacttttttccatttccacgactctagcttctcccactctggtgtcagccccacctggcagcagcctcttcagaatctaaaactggatccttccactggcctgtttagaacccccagtg

SEQ ID NO: 26120 - DNA, 201 bp, Bos taurus
cagcctgacctcccccccagggccccacctatcttcccccatacttctagatttagagacccaagcgtctacacattcagcagtgaagctcaggtgcaagtagggccttgaatctgaggtcagacccaataggtgacggactatagatccctggagggagataagggtgggaagcctgagtagtggggggcctgcccaggg

SEQ ID NO: 26121 - DNA, 201 bp, Bos taurus
tggttcctggctctgaaagaagaacccccatgggtttagctcctgctgaactgggcagagacctgggatgagagagaaactctctggggccaaacacagtggctacatctgctatggaaactgggctgcctgacaagagaagccctgaagaatgagggcaaaggaggccaagggagcagagaacagggcagggccaactgg

SEQ ID NO: 26122 - DNA, 201 bp, Bos taurus
tactccttgactgcatggtctgatgctcaaggccaaaaacgatccttggctccatctgtgtgggattctgagataaaagaaggaacaccgaagtactgcttcagtggtctgcttccaggttaggcccctagaaaagagagttgactctcagttctaaaaggctcaaacttgccttataccaaaatgcaagtcagtggcaaa

SEQ ID NO: 26123 - DNA, 201 bp, Bos taurus
tttgtgcagtttgattcctttcctccccctccatggaggaggaaacaggcagagtcttaaagggggcagagcttggattcctgctctgactctctctgccctgatgtgtggctgggttggatcttgggtccaaccaaagtgatcatcaggttcacctgatgaagcacagatcattattagtaccctaattaagttttggat

SEQ ID NO: 26124 - DNA, 201 bp, Bos taurus
aggggtcgcaaaagagttggacacagctgagtgactaaacaacatctgtatttggtttcccagggagcagtcacaatgagccatcactctaaatagcacagtgataaaggccacttgaagagtacctgtgaagtgcttttcatgcattctcctttaactgattataacatccgttaacttattaaaactaacgtagttata

SEQ ID NO: 26125 - DNA, 201 bp, Bos taurus
ggagggtgagatccatggagccttaggtgggggagggttctgtcctgtcaggcgtcagataagctgaaaggtctcttggctgttgtcgtcactaattagagtagaaattcctgctcctttatgagaatgggaaggtctgggctgcagcctgggttccccatgccatctgtattttaatagaacgtttattttaataagata

SEQ ID NO: 26126 - DNA, 201 bp, Bos taurus
tgcagctcatcacttggaggtcagccctcttacctggagggggctggatgggaccagaggttaccttcctgtcacagcctcctagggtgagcaactgggttaccagaagtgtgggcctcaagcgctttgcatactgcgtcttcagctggcagggtttgcactcaggttctgtcactctgggaaagaactcaagccaggttc

SEQ ID NO: 26127 - DNA, 201 bp, Bos taurus
taccttcataggcctcctccgtgtactcggcattgatgaacctgtctaggatgtcattttcctcagcaaaggcgagaaggatccgcacgatctccttggtgttggggttgatgtttaacaaggccttcatcaggcaggtcttccctgtgtccaaggctgtcagcttgtgcatgaggaagtctgcaggcaggagggcaggat

SEQ ID NO: 26128 - DNA, 201 bp, Bos taurus
aaaaagcaccctgccctctggacccagggtttctgtgcaatgggggtaggacagaacagtgtctggagttcacaggctctgtgacaggaacttgctcatgcggcccagccaggagcaaaatcaggacaaagtgcaggagccccaggtctgcccttgactcccaggctgcaggcagaggaaaaattcaagtctcagtctgtg

SEQ ID NO: 26129 - DNA, 201 bp, Bos taurus
gagtaatccgagatgccagaagataatggagtaatgtctactgggtattaaggggaaggtaacatagctcaaaaattctataaccagccaaaatataactccatttgtgaaagccaccaacatttttaaacatacaagaatcctgagaatagagcatttaaacaaccattcctcaaacagaaaaggctatttgataaacat

SEQ ID NO: 26130 - DNA, 201 bp, Bos taurus
tggacccacagaattagcatcacttggaagctgtcagaaatatgaacttcagacttattgaatcagaatcagtagggctcagaatctgtgttttaactagccctttgggagattctggtgcttgctaaatttgagagccatttatgattatgatattaagttggttgaaggaacccacagatccattttcctgcactctac

SEQ ID NO: 26131 - DNA, 201 bp, Bos taurus
tcacggatgctttcttccctccctatccaccctgacagctatgaactcacaatttcctccactgatttcatcatgagatgggagacaagctgcatcccaaggctttattgctctgcggcaacctctccttgaacaaaccatcatcttgcctcctcccagccttttccctcttcttactgtgtcctgagtgtccctgaaaaa

SEQ ID NO: 26132 - DNA, 201 bp, Bos taurus
acggagggaagatgatgcataaaaaggacccagcataggagctcgcctactcctagctcttaagacctttcatcatagaggtaggccgcagaccaccctccggacactcagagcatgtgagagtctggttcctaaaactcccactttggctccccctccaaggcctcaaaagctcaggatcaagcacaggttggaagcccc

SEQ ID NO: 26133 - DNA, 201 bp, Bos taurus
gatgataaaattattctcctaaattttcttttagttctattatgatttgggtcttctttctaatttagattagttttagtccattaggagttcacttttacataaggtgtgagataagaaactaaaatatattttgctccaagctgataacaaattgcccaacaccggtttattgaatagatcatcctttttgcccttgat

SEQ ID NO: 26134 - DNA, 201 bp, Bos taurus
tcctttcttaagggtttcagatataggcacgccctttccccacacctcaccataaagtcttgtcaaagtcaccaaaggacagggggtgcctttggccccctgcagtagctgggtttttccccttcccagctccaatccgatctgacagccacgccactcctcaggggtgatggatgctgttctcaggtaccaggtaccaac

SEQ ID NO: 26135 - DNA, 201 bp, Bos taurus
gcctggcaggctatagtccatggggttgcaaagggtcagatatgactgagcaactaaacacacacattcttaaatacatatgtgctattagggttcaacacgcacattttcagtagcccctggtcactataccatcaacaactagaggaaaattacttctgatctggaggaaaggggaaggagaatttttaacaggttcac

SEQ ID NO: 26136 - DNA, 201 bp, Bos taurus
atgatacagcaatcctacaaatgaaaacatatttccacacaaagatttgcacacaagtgctcaccaaagctttgataatacttacaaaactactttggcttatgataaccaaaaactggaaataaaccaaaatgcccactataaatggacaaataatagtgtatctatacaatgaaatattagacagcaacaaaaaggaat

SEQ ID NO: 26137 - DNA, 201 bp, Bos taurus
caacaagagggcatacttggaagagtggagctgtgccacatcatacccacaggaagcttctgtcactacagaaaatgagcacaaggccattctgggtcacaggagaagccatcctgaactgccatcagctaccacactgggctctgtgggggcagccatcttggatgacttggggaatatagcctcagctgccttggcgtg

SEQ ID NO: 26138 - DNA, 201 bp, Bos taurus
ggctgagccactctgggcatgcccccttttctctctccaggtctcagggtgaatgtggtgagtggtttttgaggtcttctcaggccatatctttgactgtatgccttcccagtggagatgatatcatctccaaggaggcagaaactcctcctttgaggggtaaaaacatgttaaatattccactggttgtggtactccgaa

SEQ ID NO: 26139 - DNA, 201 bp, Bos taurus
gctgtaattagggttaacattcttgggaaactggtattatcatgtcaatatactcttatcgataagtttcgtattacatttctgaaaaggattgtatgaggcatttcacatgatttgctagattcccaaatgacgggtggctacacaaggaagcagactgcccggttggtcctgatggtgcacagatgcagcatttcagca

SEQ ID NO: 26140 - DNA, 201 bp, Bos taurus
agaaaataaggcaggataaaaggatggagagtgagaggccaggagagcagctatttagggaagagccctacagaacaacaggtaacataatgctctgaggacaaaggacacacacccacctgacacaggaattctctcgaaacacatcctgagcttctgtttgttattcaacaggggtgagggctttgaaaggctcacagt

SEQ ID NO: 26141 - DNA, 201 bp, Bos taurus
cggcgacgcggcgcggcccccaggagcgcagggcttgaagaaccacggcaacacctgtttcatgaatgccgtggtgcagtgtctgagcaacaccgacctgttggccgagttcctggcgctgaggcgctaccgggcggagcccggccgcgccgaggtcaccgagcagctggcggcgctggtgcgcgcgctctggactcgcga

SEQ ID NO: 26142 - DNA, 201 bp, Bos taurus
ctatttacagcacaccaggctccttgacggagccaaagcaccaaagcaaaactgaaatggcagcttggggctcaagttaccctggactggggcccccttgcgtcctctgggcttccattctggggctctaggtcatttcaggtgaccatccagactcctaacagttgctcccatgcaggtcccaaaggccccaggggggag

SEQ ID NO: 26143 - DNA, 201 bp, Bos taurus
ccactccttctccagaggagggtgtggagatggtcaaggtcattgggctgttgctgatggggcctgtgctagagcctgagtccacgaggtggagccatttcttgtcttgtcccctaagtactcccaggcaagacctcttcctgtacatctgtgctgagcacagagccctgcacagaatacctagtgctcacccaagattta

SEQ ID NO: 26144 - DNA, 201 bp, Bos taurus
agaggaaggccttcatcattctctctgagattccagagagtaactgtgtgtggaaagaggagggtgtgaaaccagacgtggggagggaattcaaatgcccagatcttggtgactgggcctcaaggaaatttttgaaaattttcaagtcatcaaattgcatttgaagcgtttcagtgcatttataggcatgttattacattg

SEQ ID NO: 26145 - DNA, 201 bp, Bos taurus
actgtagcttccatggtggtttctgtaatttccatattccttccacagagtatatgacttttctttctcagtttctttttatcttacttggtgcctagattgtctgcaggtttacatgtagacaacacacacgtgcacagatatctcgggatatcctccaccccagctctgtgtttgggcagacattgtatccccctgctt

SEQ ID NO: 26146 - DNA, 201 bp, Bos taurus
tttagctgaaacacaaaaccaaggaccttaatatccttgaattattttgtagctactaaaacacacaccaggtagaagaagttaactgcatgctgaccactggcatgttgaccccaggatggttggaaccaggttggtcatgttgactcctgaaatacaccgtggtgacctcaccaccagtcagttaggagaatgtccaga

SEQ ID NO: 26147 - DNA, 201 bp, Bos taurus
gtctggacttctgcctctgcccaggatcttaggacagggccttggcaaagaggtgctggtggtcgcatggaataaacaaccaagagaacattcacaaggcgccttacaatttatagaggccgtttgccatactatatatattgtatatgaatacataattcacataattatgtccgtgtcacttggtcctcaaagcagccc

SEQ ID NO: 26148 - DNA, 201 bp, Bos taurus
actgtttgctgtcccagggagtttggggtacagattgtcttgtttggcaggggagaaagagataaatattcacactgtaatgagtcctccctggagaaagcgagggagaaggaatgtgtactcctcaaaggtccacggaggaggtgggacgtgggctctgttccgtactccttgaaatagttcaggaaaggcatttccttt

SEQ ID NO: 26149 - DNA, 201 bp, Bos taurus
agaaactgacgagtttaacacagttcctgggttggtttccctgtgtctgtttttttcatttctggttcaatgagctctggccaggaaagtggaaaaagtcatgtgatacaaaataccccgaacaaacaaaaacaaggcttccaggtccaccctctttatcagaaaattagtgtgggtcttacgaagggatgcatggctggg

SEQ ID NO: 26150 - DNA, 201 bp, Bos taurus
agggcatacagggcaggctggagaaaggaggccatcgtctaccgcagactcattagccaaagttgagctgaccaagtgagggcctggctttgccttcctctctcccctcttcttcttcctcctcctccgtcttctctttcatttttacaagctttaccagacggtatactagagactggccagggaaaagtttgcagggaa

SEQ ID NO: 26151 - DNA, 201 bp, Bos taurus
aaaatatgaattccttgtggaacatcgtaattcctgccgaccaccctgaggcctcacagcctgcagtccagccacactggcctcctctgtattcctcgatccctttaagttcatttcaaggtacaaccttgaatatgtgtggtcccttctgtctggactgctcttccccatgctttctgctccgctgtcatcctctcatcc

SEQ ID NO: 26152 - DNA, 201 bp, Bos taurus
tggagcggctcctggcgcggcggcggcctgtcatgctggtgggaactgcgggcactggcaagtcggtgctggtgggggcgaagctggccagcctggaccccgaggcgtacctggtgaaaaacgtgcccttcaactactacaccacatcagccatgctgcagggtgagtgtcaacacctcaataaccaagtgaatcggcctg

SEQ ID NO: 26153 - DNA, 201 bp, Bos taurus
ttcttcttctcccatgagcagttggaactggatttcctgatggaccatctgtgttttatacaaatcgtatttgacccaatttccctggaaggaacaaagacaaagtatagggcaaaagagaagctgtcaaacatgcaccaggtcttctaaacatcctttctgctctcagtggatctatttataaggtacatccaccccata

SEQ ID NO: 26154 - DNA, 201 bp, Bos taurus
tggatgatgccgacgtggccacctggcagaatgagggcctccctgcagaccgcatgtccacggagaatgccgccatcctcctcagctgcgagcgctggccgctcatggtggaccctcagctacaaggcatcaaatggatcaagaacaagtatggtgaggacctccgggtcacccagatcggccagaaggggtaggtgtctg

SEQ ID NO: 26155 - DNA, 201 bp, Bos taurus
agaagaagctggaggagcatagtgagaacagccacgcagagttcagggtcttcatgagcgcggagcccgcaccctcccctgggagccacatcatcccccagggcctcctggaaaatgccatcaagatcaccagcgagccacccacgggcatgcacgccaacctgcacaaggccctggacaacttcactcaggtagggccct

SEQ ID NO: 26156 - DNA, 201 bp, Bos taurus
tttattatgataattgggttaaaccacctagaacacaaagcaccctaaaagtgtaggcacctaatatcaagtctaaagggagaactcctcaatcatcattggagattttaacactgttctctcagtaactgatagaaaaatagacaaaacaaaacaaacaaacaaacaaacaaaaatatatatatatgagtaaggaaatag

SEQ ID NO: 26157 - DNA, 201 bp, Bos taurus
cagagtcggacgtgactgagcatgtgtacacacgggattggagtgggtgagagggtttgcctgcaggggcggcctggccgctgggctctggggttttctgcgccctcctgaggcggctgtgtttggcactgaccatcgacggaacttattttcagcaggtttaactgtggcgggcctgtcctgttcttcagtagcaatgaa

SEQ ID NO: 26158 - DNA, 201 bp, Bos taurus
gatcatgtctgcttcatctttataacccctagagttctagaacacattctgtgctttatacacatttctggtattgaaactgataggaaattgagaaattgataggcagaggctgaattccttaaatgggtgattggtagtccagattcacccctcccttctggaatctagatagagacccttggaggtcagagcacagat

SEQ ID NO: 26159 - DNA, 201 bp, Bos taurus
ttgggtgcagttcaagtacgagctcaacacctcgagggccctccactaggtttaccaagaaaccgaatacctttattgggtgggaaatggagccccaactagcatctggccagtcgggagtggggacctccccgggggacactgaacacccttgtaagcacactgccctaattacggtgggcatttgagggcaggggggtg

SEQ ID NO: 26160 - DNA, 201 bp, Bos taurus
cttaaagaggctggatgaatgtggcaccaagaccctggcggcagcagcaataaccatgctgcataggcagatggtctgcagagagcatggccagagtacctacaacttgcactctaacaacataatgcagatcacatttccataactgtatcatacacaggcccagcactgtcacattgcttgtctaaatgtgatacaaat

SEQ ID NO: 26161 - DNA, 201 bp, Bos taurus
taacagtggatttaaaaatggcccctaaagacttagcgttcatcatccgaaggctgcagttattcctgaggataaaataaccctgacctgaaacaccaggctaacgggccagagactgggatgctcctgggatgagaggaagctgagactcatctctcataagggtcctttgtttacccagggccctgtgggggctgtccc

SEQ ID NO: 26162 - DNA, 201 bp, Bos taurus
tagccttttaacatgtttgtaacagcttttttcattttcattaaaactattgctcaaagcagaaaacttggaaattacacaggaaggcacaaagacaagacgttatccacaatcccaccatccatccccagattattttataacatttctgggtttgtctcttccatttttctacctatcgaagtataaaattttacttga

SEQ ID NO: 26163 - DNA, 201 bp, Bos taurus
tgtaactcgtcctttggtgaatttaaacaccctcctgtttcagctttaggttcaatataagcaaaccccgagacaaggtagtttgtatgggaggtggcccgggaagcaagaataataggggaagaaaagtgactcggggaagaagaaaaaaagaaaaaacactatagggccagcaaaggcagactaattcctcaggggctt

SEQ ID NO: 26164 - DNA, 201 bp, Bos taurus
gacatcctgttacatgtggcacgtaaaaagaaattatacaaatgaacctatttatgaagcatatacagactcggagaacaaacttatgatttccagggtgggtaaatgggaataaaggatagttagggagtttgggcggagaaggcaatggcaccccactccagcactcttgcctggaaaatcccatggacggaggagcct

SEQ ID NO: 26165 - DNA, 201 bp, Bos taurus
tcaaggctatctggagaggcccccttccctgatccatggcagacgtcagcagtggatcaggaagaccaggatgaactgctttcaaatcctccagaaaccactgggcctctctaaccttgtcttcttatcttcagaatgactgggggagattaaaggagccactcttacaggccctccctctttctgtggtcctagagcagc

SEQ ID NO: 26166 - DNA, 201 bp, Bos taurus
ctgcacgcccaccatacacagggatgccgctgctactcgatgcggccccgggcggcctcccatctgctcttagagggtggagtggccttttcttccctccgaacgatgataaattcagacaccccttcatctctccttccaggactgttttgactcttcttttgggaggccgatcagcacccccagcggccttatacctgc

SEQ ID NO: 26167 - DNA, 201 bp, Bos taurus
ggctttatggcctgaaactctttcatcttggcctccctatattctttctgctccttcacagtcagcagcatgaactctgtgttcactcgtaaggggtcaagggcagagtagtagcggggccgttctttcttggcagcctgggctgccgtgcctgcgggcggagccagcatgcggtttggcttgatgacctgcgtgctggtt

SEQ ID NO: 26168 - DNA, 201 bp, Bos taurus
cctgacattcctatgccagcctgacctgggaagatcatttgtcctctctcagcctcagtctcctaatctatgaagtgggcaggctggcaaagccaaggccggtaaacacattcccggtttggctctaggggcaactgtactgctgtacctgagatctgcccgaccttgtgggaaaaagccctgtggtctagtcaggacgtc

SEQ ID NO: 26169 - DNA, 201 bp, Bos taurus
taccatttactcactgtgactgtcagtgagttattcaacttctctgggcctcagtgtcttcatgtatatagggcagagatagtaataatacctagcttacaagttttttttaaattatttatttggcatcattgcgtcatgcaggaactttctgtgtggcgccagagcttagttgcttggcagcatatgggatcttagttc

SEQ ID NO: 26170 - DNA, 201 bp, Bos taurus
ggtgtggctggttgagggggatggaaagaggggaccaggcagccaagagagtaggattacggaggagcaggggcaggtgagctgacatttaaagaaaaacactgttgaccttgagttaataattagtgaggctgaatgatgggaacatgagtttcattatactctttgctctacttttgcatgcttgaaattctccacagg

SEQ ID NO: 26171 - DNA, 201 bp, Bos taurus
caggtgtatcggaggagagcgctgcccaggtggtcttgagggtggtcttatctatctcagctcctcagagtagctcactccctgtgagaaagcagcacagcgtcacaggaaacactagcttctcccatttttgccatagatgattgtgatatagagaaattttaaaatttctctgtgctttcagattccttatctgtaaaa

SEQ ID NO: 26172 - DNA, 201 bp, Bos taurus
tccttttccacctagaaagaaatcaaggtgccatggtcacctgaacaggaaagagctccccccatgtccacgctgggcccactgatacaacagcaaaggaaaccttgggcacgtgtgtgcccagcaccatctctatgttctgggcttcaaaaacagccaaggcagagaagtgtgatggatgtcagtggccgaatggatgga

SEQ ID NO: 26173 - DNA, 201 bp, Bos taurus
gagatgaattctctggcagataaaacaaaggggattttcaagggctctggaggtggctggcactggtttcttgctgaatggagtttcaggtcaaaacttacaactttactttccaggttgatcgtaacccctaatcttaacgctcatctgtaattaggtttaatttggaacaagcagctggagatgagggaggacaaagag

SEQ ID NO: 26174 - DNA, 201 bp, Bos taurus
ggagagataaaattagcctacttactagatattctaaccaaaatctttctgacgattgacaaacccgaattaactttttggccaagccagtagaatgctgttttttttttttgtttgtttgttttttatttatttatttttttttaattattaatttctgaaccctcctccctctgccctccccataccatccccctgggc

SEQ ID NO: 26175 - DNA, 201 bp, Bos taurus
taggtggcccctactgtccgtctccttccttccttcctgccctccatacactggtgtccaagctggaggcctcgccacccactgcaggtcatgtctggttaacagaagtgttgaggagtctctgagttatttcagtgctcaatttcactgtgtgagccaagaccggaggttctgcagccttgattttaaagatacttgatt

SEQ ID NO: 26176 - DNA, 201 bp, Bos taurus
ggttctgaggaccatgaacccttcttaaggggcctgcggcatggcacagagcagtcctgggtgagcccacttgctagtgaccaaggatgacccacacaacgccctgaaggactctgcgagagcaggaacaagtctcagagccaagactcatgccttccagcatccacagcatccccaaaccagggaagtctgaggccctgc

SEQ ID NO: 26177 - DNA, 201 bp, Bos taurus
cattcccccacccctccttgtcatgctgaacacctctgcatgaggggcctctgccaggaggtgacatctgagcagggcttagagccaagggtggggccatcgtggcagagcccagagaagattgcaggcacagggagtaggtaatggacttggcagcacagccagcgggggctggacacagggcctgggtgagaccagccg

SEQ ID NO: 26178 - DNA, 201 bp, Bos taurus
ctggcaatggtaggtactcgataaacgcccacagaacagacaagcgagtgatcagaaagagcagggcaggtgcgcggggcctggcgtggccctgcttcccccttccacagcttctgttttgaatcttctctccttccatcccactcagtttttgtcactgaactgtatctctcccttttcccaaacccagtgaactcctat

SEQ ID NO: 26179 - DNA, 201 bp, Bos taurus
gtgagggtcccagacaggctggggcctaaccatctgtgctctcagcttcaagctgggcaaagaatcaccctctcttggcccctttaagaaataccatctggagaggtgaccctgtgaaccatgaccccagacctttgtcccatgcacccagagtcggggagtgcatgggaccccgacctcctggccagccacagtctcccc

SEQ ID NO: 26180 - DNA, 201 bp, Bos taurus
ttgctctcttttggatatcttttatttcttgcgtttttgctctgggtaaaagttgttctttaagcttatttttcttagtctctatttgtgtttatgttctgtgtcttgattatgcaaagaaccaggccagcagaatctcatatattctggttcttaatttttaaaagtgtcatgactcctttaatttcacagaacattgga

SEQ ID NO: 26181 - DNA, 201 bp, Bos taurus
gggcaggccttccctttacagaggaacttgctgctctcgagagactgagagttcgcttccctcctgggtttccgtcccgtcttctatcagggtaccgaaacgcgtggtttcaaggcctcccctcgggctgtggagggtagagcctggcgacagtgtggacgtgtgaagacagaagggcagccccgcgccgccagaggacgg

SEQ ID NO: 26182 - DNA, 201 bp, Bos taurus
gacaagttggtctccatgtgctctgccttctctgtgtccagggcctcaaacttctctattacctgggacctcctgcaagagagggcacgaggccactgagcggggagacagggttccctggagcctaaagggacgtggtccggagtctgaggggctcctgcagccagcaccccaagccagctcaccccagctcctgggcca

SEQ ID NO: 26183 - DNA, 201 bp, Bos taurus
ccagcagcagggcctgagatcctctggggtcagctcatcaccctgctccagcaggcagcaggtcttcccatcccagtaacatcatcactctgctagcccacgagccctgctctctgtggccccttagatgtctggtctccctgccgctgctcctctcgtgccaggaccacgggggcctggttaggaggaagcccacggccc

SEQ ID NO: 26184 - DNA, 201 bp, Bos taurus
ggactgggattactctggaattgcttttggggaagtggactaggattttttttcactgggatgccctttgaggccagaccggcaggtcctgtgtgtgtccgtcccccagtaacatcactgatctctgtctcccagagtcactcagttgccgccaagagcaaggcaggtattatgacctgctcctgagggactgcgtcagct

SEQ ID NO: 26185 - DNA, 201 bp, Bos taurus
actggatgggccagggatcgggagacttctgaaaagggccagacggtgaataactccagcaccgaagtcaggcaggctccaggcagccggggtgcaccagggaaatgagaggatgcaatcaaaggcctagggccatcacctgaagacacctgggtccttgcaggaccctgtcctgcattcgggccctgagcctggagggtc

SEQ ID NO: 26186 - DNA, 201 bp, Bos taurus
cccagacatcgtgtaatttcatccacaagagtttcaaaatgtatttctgaaggttatgacttaaaagacaattacagcgtcattgtttagatcttcatgcgtcacagccattccttaatatcagcaaatatccagtctcagtctacagttgtctcctcaatgtcagaatgaacaaaatatggtttgaatcagcatctgaat

SEQ ID NO: 26187 - DNA, 201 bp, Bos taurus
gagctgcttggggcggagcagtgctgtgctgcccatcgacccatcccccatccacttcactttggatcaaagttaaatgaattcacgtggcctgagtagaagtcctcggcagggactggggctggcggagcaaagaaggtacctcaggggaggggtgtctggccctggccccacataaggctgtggtggcgcccgtgcctc

SEQ ID NO: 26188 - DNA, 201 bp, Bos taurus
tattgtttgactatatcaaaatatacgtatctgttcgactactgatgtgaactttctaattctctgattcttttagctttttcctactggcacatcttctcatggacataagccataatccctgtcaggctgtgtcatacggggtgtgtgtgtatgctcagctgtatagatattgccaagcagttttctttccaaagttgt

SEQ ID NO: 26189 - DNA, 201 bp, Bos taurus
taggcgaagagaaaacaaaagttcacgtcgacctaggaaaatggccgattgagtacatctggctggaccccaactccttagtagcctcccctggcccaccgacattaagccctgggcttcaagggactatacgatcaactcatttccctaaaagatgaactaaaagtgcctactattgaaaataatctctttatccattta

SEQ ID NO: 26190 - DNA, 201 bp, Bos taurus
agtcctgtacacattctagggctctgaaaaatttagttagaaaactaaaagctagaaagaatacggaatctagcatcacagttcaccggcctttagtagccgctgactttgggtaagctaatcctctgaggactatcacttggctcaaaattttttgtaaaattctttatctttgtaaactatacactattaaagctgatg

SEQ ID NO: 26191 - DNA, 201 bp, Bos taurus
tgtcttagccacaactccaagcgtacaactcagtagccccgttctcttacggttcaaatatactgctgaccttgggttcgttcttgttttgtttttttttcctgttaggattatttgggggtttttggtggtttaaactctttaactttttccttgctgtgtatgaggaaagctaaagctgttatcaacttcttcttctat

SEQ ID NO: 26192 - DNA, 201 bp, Bos taurus
tccagtggttaggactccatgctttcgatcagtccctggtcagggaactgaagaccccgtaagccacactgcgaggccaaaaaaaaaaatcattatttcctcagaaaagggatcccagtggaaggggcagctccaacctgaagattcagaacagatccttttattaggccctttcagtggtactcaatgagtctcaagtcc

SEQ ID NO: 26193 - DNA, 201 bp, Bos taurus
cttggtttagggcttctggcctccagaaaataaatttgggttttcttgagccaccaagtttgtggtcatttattatggcagccctaggaaacttacacacttgcctcaaactcttcaatggcccctcctggtcagggttaaatggcccagggagcctgctgagggctgattctgccacctctccagcctcgttgctcaccc

SEQ ID NO: 26194 - DNA, 201 bp, Bos taurus
ggggttagtcctcttccagccatccagatcaattagagattctcagaagcagtggaggtccctggctgggcggtggcctacagaggagtagctccagggcgtttcctgggcttagaaacggaggctgaggaagtcacagtgagcgatgggccctgcactgcatctttcttatagagtcctctgtggtcagctgactctgag

SEQ ID NO: 26195 - DNA, 201 bp, Bos taurus
tacacaaaccaactctgtggccagacaggcatgctggtcagctgtctgataacacctctgagttgagctcggtcactcttgggtatctggattaacccttccacaactgctgcccctgggccctctgggcaaggccccagttaaatcttatttctttgtccacagtgggggaccttagtaaagcctgggacactaagtgct

SEQ ID NO: 26196 - DNA, 201 bp, Bos taurus
gtccccagaagtctaagtatcataagcttaggcctgcttatgcccatttgccagacctgggtgacaggtgctgggctcccatccaggcccagagaagtatatgacagctctcagaccctgttctcatccgagagggcttgctccagatccaggctttccagaccaccaccccagggtggtgtgggccctgggggcccttcc

SEQ ID NO: 26197 - DNA, 201 bp, Bos taurus
tttgcgtgaactctgggagttggtgatggacagggaggcctggcgtgctgcgattcatggggtcgcaaagagtcggacacgactgagcgactgaactgaattgaaaggtcttctggcccccagtctgttcgcctcctgacagtactagcgacgactgcctgggagcccaccctccgggcaccagggaacgtggctacttca

SEQ ID NO: 26198 - DNA, 201 bp, Bos taurus
gagatgaggactctcctggggtcatcgggcaggagtattcagtgtggcaccctgatcctgagcctcttgtcccttcctttcagggtgaagctggtcctagcggcccagccggtcccactggagctcgtggtgcccccgtaagtacagaagacctggttaagggcccgcacctggcccttctctccatgctgcccccagccc

SEQ ID NO: 26199 - DNA, 201 bp, Bos taurus
tgtgaacacctcacatcagccaaatggaccacactcacattttgccccttctgttcccaccactgtgtacactcagcctggcctttgatgcccaatggtacgtccactgttccaggaggtctactgagctcacccctgggggctccctctgcactgctgtgagctccccagacctgggcccgagtctgtctcctttttggg

SEQ ID NO: 26200 - DNA, 201 bp, Bos taurus
tcatctttgggtgctttttcctaggaatcctgttcaccggggagctctgggagttcttgagctttgccgaaaggtaccctaccatcgtctataacatccttctctttggcctgactagtgccctgggccaggtgagtgccttgatgggtgatggcttggcttccccaagagagactggcctggctgggagaagagggtggc

SEQ ID NO: 26201 - DNA, 201 bp, Bos taurus
tacgggacacgtccagcacacccaccacagtgtggcctcgccagccccgagcgggccacgagggaggcagcatctttatccaggcgggccctgggctgataggcgaggctggctgtggaagggtcacttgctggataaggtcactcccagaggagccagcaggggcaggacgggggaggaacacgtggctcacgggtggct

SEQ ID NO: 26202 - DNA, 201 bp, Bos taurus
tccatcatcatcagctgtgagtgaaattgcagcttgtcctctgaatcctattgctgatgatctttcagctctagcatgtcccccatcctctccttcctccagtaggtaactcttcttgcctggttactcaatgctagcccctgtatgccagctattgtactgaaccactgtacttttcaaggtactgtactataagattaa

SEQ ID NO: 26203 - DNA, 201 bp, Bos taurus
tctatggagaaatacctcttctaatcatttgcccaatcttaaatgggttatttgtcttttcattgttacattgtaagagctcttcatatattctggatacaagacccttatcagagctatgattagcaagtattttttcccatgctgtggcttgtcttttaactttcttgatagtgcctcaatccacacaagttttaaatt

SEQ ID NO: 26204 - DNA, 201 bp, Bos taurus
tggacaattagaggtgggctctagaggcctggcgggaggagggggtgtgagaagagctgaggattcagtcagggacacagaggcaggtggagagaaggggacggaggccaaaagagagaggcttctgactccccagtgaacttgggaagggggaggcaggagaactagagaatggagcagaggcctcatggggagcccagc

SEQ ID NO: 26205 - DNA, 201 bp, Bos taurus
agactgctgccaaaggaatgtaaacctaaaggagcctcagaccctcccagagtcaatcctctctctcaggctcccaatcccttactggtctaaagacatctgagtctcatgcatcctctgttcataggagtgctgggcaagcctagggagaagctggcctggcccagcagactcgcagccttcaagctcttcctggggcca

SEQ ID NO: 26206 - DNA, 201 bp, Bos taurus
gtcagtgccccctgagagtcctggcacctgccacgtttcaatgcaacaccatctccctgccccaagaaagaaatggggacctctttgtccacccaagtctcctccaactagcccagacctacatttgcccgctgctgatgcccaacaaacagggctgatggcatccctgtactaagctgacagatgttatctgctgatttg

SEQ ID NO: 26207 - DNA, 201 bp, Bos taurus
accatctgagccaccagggaagccctatgtgtatatgttaatcccaacctcctcctattttatcccttcccttactttcttttcttgatcatgaccggcaatttgaataacattatcatgaagggttgatgtaataaaatacagagcagtatgcccagtatattgtaattgttgaataattgttactagtctcttccaggc

SEQ ID NO: 26208 - DNA, 201 bp, Bos taurus
ttcccaaataccctacccccatcatggaggctttggtccagagaactagtcgtacacagttacaccaaactatttttcctcattcttcaagtcaacagacgaggtagatactccttaacaaacacaagtatgtatacatatatgtagaaggacaagtggaatctttcctttaagcctatgatatcagaagtgtgaagtaca

SEQ ID NO: 26209 - DNA, 201 bp, Bos taurus
gcctgggccttccctacctctccagagcctctttcaccaccttcccaggaactctctttgttctagctgttctgggtttcttttggttctttcaataggtcaggttctctccagccacaggcctggcatcgcatgtgctgtttcttccatctagaacactcttccctgtcctctttgcctggctagcatcttttgagtctc

SEQ ID NO: 26210 - DNA, 201 bp, Bos taurus
gcagaacatagaggccaacagagaaagcagagtaataaagcttgcaataatttcactaggctgaggagataaaacttggaattcaggactaccaaagcagccagtcttcatatggccagaaaaatggaataatagataaagtctaacattcttcattcaacttcccctcaagatatttactgcctcctatattacagtagt

SEQ ID NO: 26211 - DNA, 201 bp, Bos taurus
aatttgagcccaagtggcccacaccagaaaagctctgggactgggacatgtttatgcggatgccagaacaacgctgaggccgagagtgcattatccctgacgtgtcctgatcctaccgctttggcatcattggcctcaacatgaatggctacttccatgaggcctacttcaagaagcacaagttcagcatggttccaggtg

SEQ ID NO: 26212 - DNA, 201 bp, Bos taurus
ataaagggccaagctgcagctccccgcaatctgctctagctgcctgtgccccccctcaccctgacaccgtgctgctaaactggaatttgagactagggatagcgaggggtgggccagagagctcaatagaaccataattggtgtgtgtacagactgtgggagtgtacaaaatctttttcatgtgtgttatctcaatgaatc

SEQ ID NO: 26213 - DNA, 201 bp, Bos taurus
aggccactttctccagcctcctccagcctgtgtacccctaggcaggtgacttcttcccctttgactccctctgttccccttgaattagcatcaaactgtctctatctgcaggccacacttcatctgctgacaaaggctggtgggagctaactaagaaaaaagaagtgtggggagtgtggtctgccttctaatatagacagg

SEQ ID NO: 26214 - DNA, 201 bp, Bos taurus
gcccactctctgaggccagggttaaggcttccccacaggggagaggacagaaccccagtcagattcccagaactcccaagtgagagctctttggtggtttccttgagtggcccaggggcagctggtgcccttctgggggaattgtttttaaagtaaaggtccctggcatcattcccactcctggcaaggggctccatcttg

SEQ ID NO: 26215 - DNA, 201 bp, Bos taurus
attccaaaatcaacctatgtaacgcatcatattaacaaaataaagtagaaaaactacctgaccattttcaatagactcagaaaagcacttgacaaaattttatacccattcatgaactttaaaactcttagataactgaaataaaaggaaatttcctcaatttgataaccattgtcccagaaaaacccctatagttgatat

SEQ ID NO: 26216 - DNA, 201 bp, Bos taurus
gacttttcaataaatcttcataaacacaggaaaggggatattcctttgtagccttttggtgtttaactctgatcccctagggccatgaacccttccatgcctcccactctgcttgggtgtttctaccgcaaaaagcgattttacccagaaattgagaatcagattacaaagacccggcctggaaggagtttgttccagaaa

SEQ ID NO: 26217 - DNA, 201 bp, Bos taurus
tcgtgtttccatatatggcagggtcatccctctggggatgtccggttttctaatgtctggattttggtgtccaaggggagggtgccatgtgggtgtgtgtccattgagacctgggtttttcagggaagatcttctgagctctccactagaaaacctggcagacttgtcctgccaggggaaacagtacaataatggacaaaa

SEQ ID NO: 26218 - DNA, 201 bp, Bos taurus
cgctcaatcacgtgccagagtttcgtctctttccttgtggttgaggggcccgcccgttggtgtccccaccaatgctcacttctgggaacaggccctgcatctcagctaaatatggcagaattggtgggtcaccccacgcttgaggggaggggctgtagggacagagctgtaaacagggtggctatctgcctagtccccctg

SEQ ID NO: 26219 - DNA, 201 bp, Bos taurus
cctgtgccccaggtacccagtggttgccccctgaaacagccagcctggcctagcccactgcgccacccttcctcagactgtcctgggacccagtccttttctcccactgactctgcccctggcccacaagttcccctgtgtctcctgtcaatgtggggagggggcgtgtggacccaggaggggactgtggacaggatccag

SEQ ID NO: 26220 - DNA, 201 bp, Bos taurus
agatcccctggagaaggcataggctacccacttcagtattctggcctggaaaattccgtggtctgtacagtccatggggtcacaaagagtcggacacgaccgagcgactttcgctttcactgggcctggactgtgctagactcagagacccagagcttccgagtccacagaggtgggagagagacagaccagagaacagtg

SEQ ID NO: 26221 - DNA, 201 bp, Bos taurus
tgtcaactgtgtttccattttttcccttaaaagacattctgacggctaccttgtgggtcatcactcataacttaaggtttggtgcaagcccacattcgtaacagcactagtcacaacagccaagaagtggaagaaacccacgtgtccatcagctgagcaacagatgagcaaaatacaacatatacatacaatggaatgtca

SEQ ID NO: 26222 - DNA, 201 bp, Bos taurus
gaaagactggtgttagctgaaagcaatatcagtgtttttgaaatctggttcctggaccgcctatagtacttgttaagtgcaggtccccaggcctcatcccggccctactctaccagaacattttgtggtggctgccaggcatctgccttgcaacaggctccccagttgcttccgctgcccccgaaaggttgagaaccattg

SEQ ID NO: 26223 - DNA, 201 bp, Bos taurus
tttgtgcttccagtgaagagagcacagtgtcagtccctggtcagggagtgacgattctacatgctgtgcagtgtggccaaaaaatattttttcttgttaaaatcttaaattcctatccatatgactgagtcttgtaaggtgaaactaaggcccttgagtctttcctgagggagatagcctacttaaaaaatattcagggtc

SEQ ID NO: 26224 - DNA, 201 bp, Bos taurus
atccactttggttttggccttcctggaaatgttttgttgccctcttaattctctgtgtggaggcaggatgctgtagatctgcactgtctaatacagtagttgctggccatgtatggctgttttaaattgaaattaattaaaattaaattcagtttctcagttgcacttggcatgtttcaagtgcccactggtcaccagtgt

SEQ ID NO: 26225 - DNA, 201 bp, Bos taurus
atgataacaaaaggcagtatagataagtgtatatgtgccatgttcactttaatgactattcataagccagtaactaactatggagactatttctggatcagtacaatccaagtgtggttgtaggtacactcaacacattaacacaactcttggtatctgacactgatgaaaaataaaaaagggtaggtgaacaaacacata

SEQ ID NO: 26226 - DNA, 201 bp, Bos taurus
ggagttccctcttctgacagctgtaccgacaagatcctatcattgtgcaacacgtgtttcctcttggtcaatcccgaagcgcccccgggccttcacacacgggctgttgtttagagtcgcatcgatataccaggttgcttctcccttccagtggtaacctggaggtgtggcccaccgccttaggtgggtgttagtctcagg

SEQ ID NO: 26227 - DNA, 201 bp, Bos taurus
aacattttattggagagcagcaagaaagctttacagactcctagaatatcacaaataagcaagcaggagaggaaatgacagaatagagatacttcgtgcacgcttagaggacaattttagaatacaaaagccttcttaacttgaatttcaagtttggatgtccctgattgaagcaccgtcttctttcaaggattctgctgg

SEQ ID NO: 26228 - DNA, 201 bp, Bos taurus
tagctcctctaggccctcctgcacctgcgcagccactgctccttggacgtggggtagctcctcccagtcgctgcccctggcctcgggccggggttgcgggggtcgtgtatctcctcccagatgccacccctgacctcagacatggggtagctcctctcagctgccacccctgaccttggacatggggtagctcctctcggc

SEQ ID NO: 26229 - DNA, 201 bp, Bos taurus
atgaattctcaatcgggaaacagattcaatccttatttaccaaagattcataacccttagggaacaacttccgcctctaaaattccatcagtgactgtgacaacaatgtaaagaacagtaaggaaaatcctgtttattggttcacgtattgagagcccagtgtataaaagtactggaattgaagaagtgatcagaatctga

SEQ ID NO: 26230 - DNA, 201 bp, Bos taurus
tatataatagatagatcacctaaacaaaatattaataaggaaatattggcattgaatgatatattagattatatagacttgatagatgtatacaggccaccccaaaacatcagattcatattcttttcacatcaacatggagcattttccaaaatagattatatgttaggccacaaaaccagtctcaataaattaaagaaa

SEQ ID NO: 26231 - DNA, 201 bp, Bos taurus
cctttgagctttcacatttgcctaaccatcacaaaggagacactccatgaatgtgtgctctttgatgaactgaaaacatggccaacatgggcatgcccagggtcttgtagacccaccacacattttcccaggatcccttctctccctactcacttggagtcctcgctgtccagcagcccacggtacgtgttgatctcacac

SEQ ID NO: 26232 - DNA, 201 bp, Bos taurus
cacgctgtgcacccatgaaatcattgtcctgcggtagaccttcaaagaagccacatggtctagcccgaggatctgcccttgttaattgggagttagtccgtccaatgacattcttttgtgttacgtgacctggtaaaaccatgatcaaattcacctcctggcccacctggcatttccagggagggactaggattgaatcaa

SEQ ID NO: 26233 - DNA, 201 bp, Bos taurus
cgaagacatttggccatgtcctcaaatgcccttttccctccttcctgctactgctgcccatccttcaaggttccttatcaattctgaatctcttctaaagccttccctggactccccagctcttaatgacctctctgctcctaagaacctgaaaaccagcccctcagccacacctgccatctctgaagctgtgtggcagtg

SEQ ID NO: 26234 - DNA, 201 bp, Bos taurus
gcaggggaaggaaagcagactgaccctcacccccgtcgggtttccagaccccactccccaccattctcccacactttgagaggttccaggccacatttcttcttgggctccacccctgctcctgaggaactggtggggtggggctggcatggtgccatggcccagcctcctcccacagggtggccttgtgcctggtactgc

SEQ ID NO: 26235 - DNA, 201 bp, Bos taurus
gacttgaggagttgggatggctcagccagccgctgcaggttggtggtctgcccctccacctgggtggtgagcagcagcgagctgtcctctcctgtcacactgggacacatggcctcccgcacccgcttggctctggcggttgtggacatctggtactccaggtcacctgggggccagcaaagagggactgagttgcaggaa

SEQ ID NO: 26236 - DNA, 201 bp, Bos taurus
tgatgtggatgttggggtggaacaccttcctctgccggatcatttcttccaggacatccccaatgcccgcagaaaagatgaaaaggggaatgttgttctgtgaaagggtgttgaagaatgtcttgtatccatccctgaaaccagatgaatggttctgaaactgcatcgcctctgctactgccctttattttctatttgggt

SEQ ID NO: 26237 - DNA, 201 bp, Bos taurus
atgctctttctggctccttccattataccatacagttcccctcctcttttttctttctagctcctttttcatgacctcgttccctgttttttcagatatgcagctctgttgaagctcagattcccttggcttatgctgccttcccctgggttacaagtgccttagttttcaagtctgggtaagagatgaaaaaatttgagg

SEQ ID NO: 26238 - DNA, 201 bp, Bos taurus
atccccgcccttgggcccactcacctccaattgtgctctcctggtactcgtggaactgacccttgacgaagcggaggacgaggctggatttgcccactgcagactcccccagcaggaccagcttaaactgacagatcttgttcccagcagctggtccgttgggtcgcgctgcgcctccccgacccgccatggcccgtcccg

SEQ ID NO: 26239 - DNA, 201 bp, Bos taurus
aagccaggaccgcctggcatcccgggactgcggccgccacaggagcatggccagtggcagcagcagcaacagggtcagcagcagcagcagcatctccaagcagctcctggaaggaggaaggcctccaagtactggtactgcatggaggaggggaaacccatttcctcccctcactctgccgagcacaggaaaatcaagttt

SEQ ID NO: 26240 - DNA, 201 bp, Bos taurus
aatgcagatgggaagaagacatgccagagttatcctccgtcattcactcaacaccagctctgacttgggctgtgctggcctcagagttccttgaactacagggagatccaaccagtcaatcctaaaggaaatcaatcctgaatattcattgcaaggactgatgctgaagctgaagctccaacactctggccatctgatgcg

SEQ ID NO: 26241 - DNA, 201 bp, Bos taurus
tgcagaactcacctccaggtcaatcttgaggccttggtgatacacctcagtctcaaaggtgatcaggtgcagctcctcggtcacaatcagggaggcctacaagaatgagaaggatgctcttcctcagagaggatggcactgagtcctgacagccatcactacaccatcctgaagcgcaacgcaccaggtggccatggatac

SEQ ID NO: 26242 - DNA, 201 bp, Bos taurus
aactttatctctaactgattgaatcgctcccccctttccttgagatctgggtccaacagctactactgttgcttggaatacttttccttgtgatttttccagaagcataatgcctctcaggtggcactagttgtaaagaacccacctgccaacacaggaaacacaagagatgcaggtttaatccctgggttgggaagagct

SEQ ID NO: 26243 - DNA, 201 bp, Bos taurus
tccccatccggattcacagtggaggactaaggagattcagagcaggatccgcaggtacaaaacacaccttccaaagattttgctctccttccttttctccctcctgccaactcccaaggcctgaagctacacacactcatgcaaacgccaaaatcccactcctttcccacacctcctgttttcttccacatcagagctcac

SEQ ID NO: 26244 - DNA, 201 bp, Bos taurus
aaaaaaaaaaaaaaaaccaaagacctaatttccactaatttgctaaattgctggctaagacactgtgaaaaaaatacccacccgccatccctccttccttgcctaattctgtgttggtaattgataatcaaaaccactgagagcaccatgcttggtggtaattactgtaaatgtcaagagacgggaagataattcattcag

SEQ ID NO: 26245 - DNA, 201 bp, Bos taurus
aggctgtttccagctcccttagtagttttgtttgtctttactactggattatttcttttatccagtgacaaggcactgctctcaacacctaacagaacttggaaacgattcagggttgctggagtccccaggggaagactctcagctctgggaattttttaaattcaagattccacccaagtgtgcttttcctaaaagaag

SEQ ID NO: 26246 - DNA, 201 bp, Bos taurus
cagcactcaagtggttagtctgatttcctcccccaacccagcacacaccttgggggatgtggtgagaatggaaagtaatttcctcctggcctgaagccagctccatgtgcccgatcctgctgactgcagctcactggcagcaatggcagtgactgatgctggggaggcctgggctggattgagccagcctggcacctgtga

SEQ ID NO: 26247 - DNA, 201 bp, Bos taurus
agtcacttttatactacatttggttcagtgtctttcatgggaagagggaggaagattccacatgcatgtgtgtttgggctatcaatttatcagtagctatacacttaatgttctcctctggcttcaaaaagcatcccttggtattatagggtatatgtgtattgcacaaaaaactttgacttctgaaaatttgtacttaat

SEQ ID NO: 26248 - DNA, 201 bp, Bos taurus
tgcatctgggctgcagtgaggaaatgctgaccattgtgtccatgctgtctgtgcagaacgtcttctacaggcccaaagtaaggagtgcaggcctgtgttcgtgtaggggtcaggcgaagttgggtaaaatcagcctgttgccacccgagtgcttaatgtgcacacaatcaagtgtgggccatggagggtgtcccggcactg

SEQ ID NO: 26249 - DNA, 201 bp, Bos taurus
gggttttctggtaagattttgtttgaaaaaatggtgctgaggctgaaaatgtttgaaaacctctcaggactcttctgactgcaatagtgtgcaatctgcatggtaatgtccgactccagcaaccgtctgggagtgagttcctctgtcctgctctagtgtgtgaggatccctccccatggcctctctcatcgttttattttc

SEQ ID NO: 26250 - DNA, 201 bp, Bos taurus
cacatgggcttagttgccctgcagcgtgtggaatcttccctgaccagggatcaaacccatgccccctgcattagctggcagattcttaaccactggcctaccagggaagtcctgggtggcttcaggattggatgcagctcgagacatgagcagttcaggctggaaagttgtgaccacaaccacagcagctgcagtcacacc

SEQ ID NO: 26251 - DNA, 201 bp, Bos taurus
tgccaaatgtcaccccatttcatcctttcaatagcactaggtaactactcttacatagaatttgcaaaagagaaaaggggtgggacttccctggaggtctcgtggttaagagtcagtactttcagatgtggatgaacctagagtctgtcacacagagtgaagtaagtcagaaagagaaaaacaaatatcgcatattaatgc

SEQ ID NO: 26252 - DNA, 201 bp, Bos taurus
ggtcctcatgtgagcacctgtccatctccaagggtctcatagggacagtttcagtgtgacacaaagggatgaaaaatagtcctatgaccaaaaccagagaggagacagagaaggccagccccccacgcccctaccttggagaacaagcgcggcagcggggggtgtgggggttgccttcctcccctggctggccttttggtt

SEQ ID NO: 26253 - DNA, 201 bp, Bos taurus
ctcattccattcatctgttttcccctctagccagaaaatccatagttctatgtctttatctggataacacctatacattatttatacaagagagtggtccgttctccaggaagtttccatgaacttttaaggttatatcaggtattctttcaaatgatttggagattttcctattgtctttctgggactgaatttgagtcc

SEQ ID NO: 26254 - DNA, 201 bp, Bos taurus
catagtgttagatgtttggatgaatgagagtttagagctggagagctgaggagagggctgagctccaggacagaaaaggtgactcaggtcagtgttggccaagatgatccgaagcccagcagggtcacccacctaggacttggtccggatgctccagccagggcagctacagatgaaacaggaagatgagcttgatgccag

SEQ ID NO: 26255 - DNA, 201 bp, Bos taurus
aggtcacacagccagtcaatgaatcggacttcaaacgctgtttattttcttcttcatctcatgtggattagttcacaggcctcccaactggcagctgtcctcactgataaccgtttgcctaaatttctgaatgtcatctgcctttgattcctcatcgtggccctgcctgttgttggaacacctgctactgggtccacgtca

SEQ ID NO: 26256 - DNA, 201 bp, Bos taurus
agttcctccttcaggcaggcagccaagacccaccacccttcataaggctctgtggatcatacagcaggggctccaaagtggctgagcaggccagaaaatcttccaggatgagcagagtggtctgaaatcctgaaggcagaaacatcagcttcactgccacccaccctccccaggccagaggcccagaagccagcagcaggg

SEQ ID NO: 26257 - DNA, 201 bp, Bos taurus
attcaccttcatgatgacatacttcatgtgggaagaaagttaatggagaggcagagacagcgcagctactagacagctgggggcccagggtcaccaactggccacctgagccagggcaaagtatttcattctctggccttccattttctctcttatgacatgagggatgttcttctgcctcaaacattcttcccttccctg

SEQ ID NO: 26258 - DNA, 201 bp, Bos taurus
gaaacagcagtctggaggcacctgtgagatcggaggatagcacctgcttgccttccagccccagcctcatcagtgtgcggctcaaattcctcaatgacacggaggagctcgctgtggccaggccagaggatactgtgggtgctctgaagaggtacgtgggcttggaagtgtcaagtgcagcccctatggggccttagaaac

SEQ ID NO: 26259 - DNA, 201 bp, Bos taurus
aacagcaacgccttatttccagcactttacacggctaccgctgccccaggtccccgtgtccagcagagggcgctagggcctcaaaatgcaaccagcagacacttccgtttccttggaagcctgcagccagggagggagagtacctgacgggggtaggcctgactccagtcagaccctttgtcccaactagtccctttcacc

SEQ ID NO: 26260 - DNA, 201 bp, Bos taurus
tgtagggatcctgggccctggttttgattatctagcactgctataggatacagtaccccaaagacctggcacagtgttccatctccactgcttagctgtgaggccttggatgcatttcttacctctctcagccttcctttctttacgctcaagttgggatagggtctgtcctaaaaaccttgttattattgttgcttagtc

SEQ ID NO: 26261 - DNA, 201 bp, Bos taurus
gacaagattcagggaggggcctcagggcagggagtgggatatggtcaagggaaggtcaagatgtccagctaggcttgttcagagctgggaacccagggaggtaaggggctattggaggccaacagtccatacacttgagcaccagtggagctggtccagaaagctaccagagacgtgtcactcagggtcagcaagttctcc

SEQ ID NO: 26262 - DNA, 201 bp, Bos taurus
aacaaacttcctcacatctgtacagcttggtggtgggcccctcatctggggatctggattttacccttcttgaatggacgggcatgagaagaaggctccaaccttgcttaggcccttctcctgcttccagatctcttgtaagacctaaggcttgcggtggacatgggagctgagaaggccgactcccactcagcccagact

SEQ ID NO: 26263 - DNA, 201 bp, Bos taurus
aggtggccctctgtgagcagggctggtcagccctcaggcaaagctggcatcacaattgttggagtcattatgaggattagttgctgcctctagaagtgcggctggggccactctaggagccaataagtccccgggtgggagagggccccgaagacccctattaggaagcagcgatcccctctaaggctaagctgctgagcc

SEQ ID NO: 26264 - DNA, 201 bp, Bos taurus
gatctgctctcattgcccctgccaaggcccagctccctggaccctcacattccatggtctcagacctagccttcggcaaacttgattaagcaaagccccttgggagtcagagcagatggggtggcccctgccctggaggtccgggccttaccaagccactggcagctgagtttttcgaatctttgaagaaagtcaggattc

SEQ ID NO: 26265 - DNA, 201 bp, Bos taurus
ctgaaaggcccaggctgaaggaaatgggtgtctgcactgaggagaagacctagaaatgggatgtgagcaagggagtatcatgcagccttgaaagcacgggagtggagaggccctgtgggtgcctggctaacagcacaggttctggggccactaagtcctcttccggctccaccattgctcgctgtgtgaacctgggacagg

SEQ ID NO: 26266 - DNA, 201 bp, Bos taurus
tgtccgtggtgaagagcagagcctgtggtcgggagagaactactttctccatggcgtgggtgtgctggtgataggagacacccgtgggaggtgatgggccaagagcccagctcccatccactactcaaccccacagaacattagctccatcaccacgatgttgtgttaataccgaaccatgcaaggcgaggggggctcgga

SEQ ID NO: 26267 - DNA, 201 bp, Bos taurus
tttaggccaccatcaaagtactctttatagaactcaagcttggtcgtgtctctcttctctgcttaaaacattatagtctgtgctctgtttggtcaggtccccgtgcctttgccaggcccttcaggactggttccctgctcacctgcacagcctcatctgctgccctttccccgctgagctccacgcttgggaacaccagac

SEQ ID NO: 26268 - DNA, 201 bp, Bos taurus
ccattgagtgagataggaatccatgagttcataacagtaatagatagacaaataggttcataatggggatcaaggggcgggggctctttctgacaagaaaatgctgactgataaatgcggaggtaggcataaagttgaaaaatcaccatcctgaaaccatcatagattgatctgagcaagaaagaatcaacagtgggtgct

SEQ ID NO: 26269 - DNA, 201 bp, Bos taurus
aggtggaaaatgggatggcaaaggagagagccatccaacccaaacgagggctcaggaaatactctggcttaatcccttctcaccataattcagtgtaacagaactgctatccataggggctggtagacaagtccaaatgcagcagagccttcttggctctagagatagagccaatttgtctcttttctttgttcccaaaag

SEQ ID NO: 26270 - DNA, 201 bp, Bos taurus
taaggactggtatcatttaggggctgtgagtctttaaacgttttctgacgaccttagctcagtgatggatccttctaagttgcttaaggagatcctgttgataatgctcatttaccttccatctcatggtgccccatgttagaccttttttcgaacaccctggctctccaactaaacagtaatacgcctatgtgcaggggt

SEQ ID NO: 26271 - DNA, 201 bp, Bos taurus
aaacagagctcacctttcatccccccagaaccgatccatgagatgtttctcccagttcaagttatctgctgtttcctggaccctggtggccctcggtgtgagtggaacatatacatcaatctggcaaccaggatgcagcccctttctggaatatgctggccttataaccacgggaaaagatcaaaggtggaagcagtgctg

SEQ ID NO: 26272 - DNA, 201 bp, Bos taurus
ggctcttgtgaactgcagtcagatctcaaacatctttttctaccattctgcggtttccaccattaacgcagtactttttttttttcctttctgtagtgaacgttgtaaataggttatgtgtagggggcaagacttctccagcttagatggcttcctgaagaaagtggtgtctttaaagggaccattctgcccctcccagcc

SEQ ID NO: 26273 - DNA, 201 bp, Bos taurus
cttcccactgtgaggagggcctgcataacgacaggagcaagtcaggggaaaaaagccaacctaagcaaaggagaaccaaacaagtttaaacttttatccacaaagtactgaggcctcaaccagctgctcattaacatttcccgacacaatttcacggcagacatgttttctcttattagcaactaaacagactgattagca

SEQ ID NO: 26274 - DNA, 201 bp, Bos taurus
cgaagttaatatatgaggtgttgcaacagggcctggggtttaccacgtgcctataggtgtgatctgggaccactgtgtgtgcctggggtcctccgggccctaacatctcatctcccatttgaaaatcaatctccctgtctctctttctctgttacttttcttggcatagttttcattaaatgaatatgttatgaagggcct

SEQ ID NO: 26275 - DNA, 201 bp, Bos taurus
ctccatttcagactgtttcccaggtaacctaacgtaagacaatacagttcaaaacaaaattaaggatcagtagatttgatgagcaccagggccatccatacattcattcagcaaaccagtgtctggcacccaggataactttagtcctagaagtcttcctgaatgaggaagggttccaagtgggcctgaagggcagacaga

SEQ ID NO: 26276 - DNA, 201 bp, Bos taurus
gcaatgatgggatgttggaacatcccagatacagaaaaaaagatgggaggaaaattggatgttgagagcatctgtattcacctcccagaaaaataccccccgctccctcactgccccacttacttcctctcctctgtaatttagaccatgaaggggctctgatttctaccatgttccctgagcctagtgcagtgcctggca

SEQ ID NO: 26277 - DNA, 201 bp, Bos taurus
cccgaaaatcgttggccttacatgcaacattcttcttttaaaaaaaattttatttggctgtaccgagtcttagttgcggcctgagggttcttttttgttggctgcaccccatggcacgcagcactttcctgaccagggatcaaacctgtagcccctgcagtggaagcacagagtcttaatcactggaccaccttttagttg

SEQ ID NO: 26278 - DNA, 201 bp, Bos taurus
tgctaagtttatctaaagatgttgtagactcaatccagtcatttttctatgcatcacctaagcagcccttgcatagcagattactctaaaaagaaggaataatttctgctaaagagtttttagttttacatacaaggaagaataaggtgttacttctaaagtactagattacagctcagttggtatgagttctggatagaa

SEQ ID NO: 26279 - DNA, 201 bp, Bos taurus
aaatttgttaccagtttcctggcccaacagctagctgtgctttgtttttgtattttcacatttcataatcacttactcttgagccagccttttgggactcttgggaggcctaagagagtaaagcttttctatacataaaaggcaggtggaagatatgtaggtggtggtctgtcctgggaaggcagaaggcctgatagggtc

SEQ ID NO: 26280 - DNA, 201 bp, Bos taurus
gaaatctcatgccctttagctgtcaccctacaagccctatgtaattactaatctatattctgtctctgtagatttgccttaccatttcaaataaatggtataatctgtgggttttgtgactagcttatttcacttagtatgtacaggtttatctgtattgtagtatgtatcagttaattcattcttactttttgccttttt

SEQ ID NO: 26281 - DNA, 201 bp, Bos taurus
ggccctctacgtgacctttcagtatgcaatggctgctgcttcacttttgcttccgaaatatcatgcaagtttctccatggccacctctacctcaaaaccatacaggactggcaaaaccaaatactggcaaggatgtggagaagcaggaattctcaaacactgctggtagaaatgcaaaatggtacggccactttggaagac

SEQ ID NO: 26282 - DNA, 201 bp, Bos taurus
caaattagacatccatgagtttaattcaatctgtagtcaagttttataagatctgaattccctcacaatagctggcatgttttctttttggacaaggcatgtgctgtccactttactatatccagtttcactcattttttctatctccaggctcctgcaagcttttgagttaataactgctagtttacatagtcaaaatct

SEQ ID NO: 26283 - DNA, 201 bp, Bos taurus
ctcatggatgcatcaaatagccaaagtgtttggacctcacttttatttctttggaaaacaggaagcctaaagccctctcaggttgtactggaccattatggaatgggttacatcatactacagtacttcctgcctctcttgctgctccaacagggaacgctcttccaatccccaggcccagctcacaccccatctgcacct

SEQ ID NO: 26284 - DNA, 201 bp, Bos taurus
aataatggattttaaagtaaagcagaaatgtttgggttgagaattattaccaaactcttatttgagagtggctaacttggttttcaagggattaaattatcctatttctggcccttcatgtttccctccacctagttctaaatttagaaattgatgctgctctaaatcagattttaaattgagtccttgcttagagtgact

SEQ ID NO: 26285 - DNA, 201 bp, Bos taurus
cagagccctaaccaccagaccaccaggtaattccccaaagatgatttttagatctcattttaagttccccacttaccctcagctggataagcatcccctcgcagcacacccggccagaacaccacaggttgtaaatgtgctcattctcctggttcagctttcctgtgctggtggcttccttgttggttccatcatcccctg

SEQ ID NO: 26286 - DNA, 201 bp, Bos taurus
cagggcctacagagaaggaagagattactgtaactgaaatacagacatggctgtgaacagaatcactgggttcagccatctgtccacccaatcatttgtttagtgcccgccacaggccaattcctgtgccgtggacaggggatacaacgataagcaaacctatctgtcctcgtggagcttagtctatagaaaacctgctgg

SEQ ID NO: 26287 - DNA, 201 bp, Bos taurus
ttcttttcacagagcattttactgtgcagcctgccctgctgatctgaatcagggatgcttcctgggtaatcagtactgtgcagtcccgaggctggtggccgacagcactgagcagaggtggggattcatggtctgtctgcaggggatgaaaccaggaaacattccctgaaatcctctgtggccaggaaatgcttccatgga

SEQ ID NO: 26288 - DNA, 201 bp, Bos taurus
tgaggagggtgagagcagcgcgggaggcaggacacccgcctgctcctttaaactgacggcaggctggcaggacaggcctgattagaaagaagggacgaagccatgaagacgagcatgggcatggtgtgtcctgccacatgggtctattctccatgtccaggacggagggtgggtgttgggggcgagggccggcatgagtga

SEQ ID NO: 26289 - DNA, 201 bp, Bos taurus
actcaaggtcacagatgtactgagtggcccggctgggatctgactgggcccagcctgcagcctgaaacaaccacagaggactgctggcttgctctgcacttaatttctccccatgagcaccacggccctgcctgagcacatccattcagaccggtgggagcagaagaaccagctctcactgcccagcccggattccagcac

SEQ ID NO: 26290 - DNA, 201 bp, Bos taurus
agtcaacacaatgcctgtgatataagggggccctgcataaatttctgctaaatgagtgaatgagctgggagcacagctgaatgcaaacagtcatcacgtatggtggccgtgcacaggccatggtgtcaaattagccccagatggccggcctccacactgagctaggctcctgaggggcagagaaggccaatgtcattccct

SEQ ID NO: 26291 - DNA, 201 bp, Bos taurus
ttatgtacaagtgggaataggatgcacaaatcaaattttgaaaatatgtttcataatacatggtaatactgcttgaaagttagtcagtaccacacacaacctcctgtctatttagggggcaaaggagttaaagttgtgctctattattttaggagagaggtgtctttgatgataaaacttgaaaataatttacaagaagtc

SEQ ID NO: 26292 - DNA, 201 bp, Bos taurus
agtgggactgtcacagatttcaaagaaccacaggtataacaagcaagcaaaggaaaagcacagaaggggaggcaggggcctgcctcctgacccctggggatggattagtagctagagctgaatctccatcgtcactgcaaagcaaggcaggcccagagagagagcacatggaatcaaaacgaaaaaaaacgggaagagact

SEQ ID NO: 26293 - DNA, 201 bp, Bos taurus
cttcctcggaggcagagtggaaggcgtggtttgggaagggggctcaggtgttcactgaggaaatagcgtgagtcagctcatgtcccagaaaggccatgtccgcctgcccgcggtctggctaaaagtgtgtctctcagcgtgggctgggctgtgctagcctgaccctccacccccagcagctgttcatgacacagcagtgtg

SEQ ID NO: 26294 - DNA, 201 bp, Bos taurus
acgggcgagagtcaggcaccaggcgccgccgggctggccgctgcccacctggtaccctaccaatgaacaccccaaagacggcctgaggaacccacctctccaattagggggcagccaaaaatctagtttctcgtccaaactatgcacccgagcaaacctgctctccagaaaccgtccccatgacagaaggcagcaggccac

SEQ ID NO: 26295 - DNA, 201 bp, Bos taurus
tctgtctgcagccaagatctgcatgtggtgttcaaagacagaaaaaagccagcctctgattctcctgcacttaggcacagccctttctctctcgaggtcctcctcacatgaggtcccacaggtgctccagggaccccaccccacatcgcaagctcgtctgctcttcccctcgttcactacccagggacccccttcgacccc

SEQ ID NO: 26296 - DNA, 201 bp, Bos taurus
tgaaccctccaggagctgtactcggccagtctgactgcccgccctgcactgagggaagaggtcacacccctcggtagtgtagggacagctggaggagcccggctggaatctgagcctggtggcccttgtcatcagtgccagtctctgatgggccctggacttgcaacaggtgccaagcttggggctcagcaccctctagcc

SEQ ID NO: 26297 - DNA, 201 bp, Bos taurus
cccagcatgtggttttgagagctgaatctaaggtggcctttcatgcagagatgctggtgtgagttattgttataggaaggactcaagaggtgctggctgttcccatggccctgcccctgtgtcctttaccacgaaatgtatgtctgtgtcctaatcccaagactttgaatggggacttgtttggaaacagggtctttgcca

SEQ ID NO: 26298 - DNA, 201 bp, Bos taurus
acagccatggcagtctccagacccgtcctggtctccctagcccttgaggggctttgatactcaccagcccaggagccagccaggccaggttcagatccacacccagagactggtctgaagggcattcagcccaagtagcccaaagccagcctggcagctgatcaccaggctccaccccgattgtggccaaagcacccagca

SEQ ID NO: 26299 - DNA, 201 bp, Bos taurus
tgctagtttgcagaattcattcttcggctccatgaacagaacttgggtttcacgtttcactttcacgtccttatctgggtggcctctcactccccctcagattcagtcatcctgggcacctccaggaagctgcaccacagcctcttctggctccaagccctgctcaagttcgcgaggaacttgcacccgcagcaccagagg

SEQ ID NO: 26300 - DNA, 201 bp, Bos taurus
atacaaatgttagttttatccttaggtcatagaacatggattgcatttatacattaagaggataaaccagttgcatctaaactctttgggtacttgtgatggctttaattagtttacaactttctggtttatttcctctaatttttctatctccctaatctgtacacatgcatatattggggagagaatattttgagatgc

SEQ ID NO: 26301 - DNA, 201 bp, Bos taurus
aaaattcctaagcagcctggcaggctggaaactcaggcaggatttatgctgccgtgttgaggaagaacttcttcttctcctgaaaaccccagtgagtgctttgaaggccttcagcaggttggatgaggcccacccaccctcgttattgaagatctcctgttcatgaagtcaattggtcatggatgggagctgtaactgcac

SEQ ID NO: 26302 - DNA, 201 bp, Bos taurus
tactcagtgtctgcatttccaggccacggacaagcttgctgaactctcaatagtcatttctctgcctatgctgtgaactgcagtgtcacttcctatttccgatgaggtagcaggcattgtaggccaggaattgaggcttcatgtgatctgtttgcagaagtctttccttttctgactttgtagaagagacacaattagaag

SEQ ID NO: 26303 - DNA, 201 bp, Bos taurus
ggtactatgcttcctgggtctgtctgatggagaagtaccctgctgtctccctcaggggtgctggagattagcatagcccagcatcctcaaatctccaagttgttgcccagtagctgctgtccatccaggcagcggccgtgggttcagtggggagctctggagagtaagtttgcacggctcagggtgagaaggttggcatcc

SEQ ID NO: 26304 - DNA, 201 bp, Bos taurus
ggaaagatatttactgctaacagttctgggagccggagtccaagatcagggtgccagcaaggtcgggtcctggtcagggccctcttttggggtgcagatcgctgttttctattttctcattgtgtcctcacatggaaagcagaagcaggaagtaatcaggatactaatcccaccacaggggccccaccatcatgacctcat

SEQ ID NO: 26305 - DNA, 201 bp, Bos taurus
cgtggttggaatacagcaccccagggtgctgccctgactcaggcagggtgcgagcagatggcgccatcagcatcgatgcaccatggggggccaagcagagggttcccggagcatggcgtcattcacagcgtccaaagaggacacagctccacctgaggttctgaagaaggcttcatgagtggatggctcgaggcctcatgg

SEQ ID NO: 26306 - DNA, 201 bp, Bos taurus
cagcgccccccaggtaagcggccaggatgtgggaccctggtggggcggagcgataactctgcggcttaggggtggtccccgccccctcccaaccccatccggttcccttgaggccaccagctagaccccctccaagttcctttgggactctgagaccactaggcactgagttccctcccgcggttcttctgtatctccctg

SEQ ID NO: 26307 - DNA, 201 bp, Bos taurus
gagggctcagtgtggcccctcagtgtgtgccgagacccctgggacctcctggctcagagcaaagctgtgtatgctaacacccagggctgacgctgaaacacgggcagcagagcctgggcctggacaatccccgagagtctaggtaccccagcccccctcagccatctgggagtccttctgaagaagctgcaggacaatatg

SEQ ID NO: 26308 - DNA, 201 bp, Bos taurus
caactaagtaccgtgactctgtcctcttatcaagaaaaattaattcatgagtccttggcagaaaacttcatgtccaagtagattaaggggaagaacatgaggagaaattttgcagggttagcacaagaagagatgccgtttataacttgaccactaaggaagacaaaggatccggcctggatcctttggggaaaatcacaa

SEQ ID NO: 26309 - DNA, 201 bp, Bos taurus
tgaggagcgtctgtgtccctcttacttgggatggaagccccgatgggtgctttgtataggccatttatcagatgcctttggaatggagacagaggatggccgagctctggcatccacagcaagacactctggttcctttgggtagctcagctgagtccccactaggagcctgagtctgaaactgccattcctggtggtcac

SEQ ID NO: 26310 - DNA, 201 bp, Bos taurus
agctccctggcttatggatggttcaatctcccatggccagtgcctcccctcaatccagatcagtccagccccaacctggtcgcctttccaggccagcctcgcaggaggaccctgtgctgggttagatgctctactgtcaccaacttgaaacgcttcatattttttgaatgaggagccctgcagttttattttgcaaagggg

SEQ ID NO: 26311 - DNA, 201 bp, Bos taurus
gtgggcagggacgaaggaccacagagcttggagataagacacgtgagcccacggccagtctcccctgtgctgtggccgcagcctgggccaaaggggcagaaagcatgtgtctcaaagagacaggggtcatatccagagaccccaaactgccccaccagtggagcaacacaggccgccccttgtgatgccggggagctcctg

SEQ ID NO: 26312 - DNA, 201 bp, Bos taurus
cccctgtggtcagagctgagcctcgccaagtcatttttaccagcactggcaatggagagaaccctccgtctaggaccttgacgtctccaggctgagcaccatcctgtggttgcattcatgagggtctggcttagttggcctgggggtgaagtctcacctgcccatccttcaggcagagctcccatctagaaacctacaacg

SEQ ID NO: 26313 - DNA, 201 bp, Bos taurus
gaaccctcccctaggtggtatttaggttggccctgtgatttgctttcaccaacatgggaaggggtcacgcaaatgctgagacatggagagaggtgagatccagcttgcattagacccctttagacgtgcaaatgaaactaccttggaagttttagccctataacttaaagaaccttagcactataacttaaagaaccacaa

SEQ ID NO: 26314 - DNA, 201 bp, Bos taurus
cccctcaccgaggtccctgacgcttagccgtgcgacatggcgacatgtcccgcctgcggccgccttcgttccctcctgaggccaggctcccgcaagtgaggaagccgaccaccgtgttagacccatgatacgaagatgaattcgagccggtccctgcacccgagtgactctccaagcccgccctggactcccaggccacgg

SEQ ID NO: 26315 - DNA, 201 bp, Bos taurus
catgtggagccaccgcctatttatatcttcccatttatgtcttccagctaactggacaggaacatacaccttggtatatctgaccccagatacttcaattgcccctaacaatcagaccctccatatcccgctaactcataactgaccccagacgggcaattcatttccctgttgatcagtttaggaacagcagctggggtt

SEQ ID NO: 26316 - DNA, 201 bp, Bos taurus
cctggcagtcttttgacgcataaaactgttttcattttcctgaagcccgaactgtctgttttgtttgcttctgttgcctgtgcctttggtgccaggcccccactcgtctgtcttcagatctttgttggaaacgccccttgcttgccctgcatgtcctcgctcctgcactggttccggctctgactgccccagcccggactg

SEQ ID NO: 26317 - DNA, 201 bp, Bos taurus
tttattaaaaatgtaaatgcttttaataccaaaggtgcatgtcctctgctaacccagactgttaaatggtttcttaaagaacgagagggagatgacttccctgtcagtccagtggttaagactctgagcttctacctcagggagcagggggttcctcccctggtgaggaactgagatcccacagcctcgaggtacagccaa

SEQ ID NO: 26318 - DNA, 201 bp, Bos taurus
tgggggagcaagtcggcacatgctggaccctctttggctggggggccgtgtgggacaggctgggagagatggctcaaaggttctcagaccagaggttggacgactttccccaaccccagggggttagggcttcctcctctccactgaaaggagtttcttgctgcactggagggaatgaatagatggagccagtttgtgggc

SEQ ID NO: 26319 - DNA, 201 bp, Bos taurus
tgttgggggtcttcccagggcggtagctggccaggacctcaggtgcgtagagaggcagggcccggcgggggttcagagcgagcaggaggggccccccgaaggtctaggaagacagtgaaagctctcatcagaatgtgaagggagcagggttcagcacccagcctagggaggatggagggggacactctggggggtgtgtgc

SEQ ID NO: 26320 - DNA, 201 bp, Bos taurus
ccccttggaatgtgtgagggactggcccagagtaagtcagcgggccagggctagaaccataaccaagggctggagccccaggcagaccccacacagagtactgggggaagacacaggggcctccctgcgcatctttgtccaggcctctgggtctcatcagtggtacctttgaacagaggttccctgacaccagggctcctg

SEQ ID NO: 26321 - DNA, 201 bp, Bos taurus
gcgtttctctgaattcagcaaaaccataattattgtgttttcttctcagaactctgttttacataaatatcttgggcaaagtcttactcttactgtagtcattttgtttcattgtgttaaattacactgatattttgcacaattaaatatccttaccctaaaagctctacagtgtttcattagtgaacataacttgccaga

SEQ ID NO: 26322 - DNA, 201 bp, Bos taurus
gagagaaaaggtaggaattctgtcctgacacattctgaatgagaaggggaagcccgctgagtttagaattttattgcaactaatacaggacatggataacaaaggtgtgataacacgtgatcgcctctaaagacctcggcgaccagggcctacaaccctcgctcccgatggaccttcttgcgacggttccgacgtagagac

SEQ ID NO: 26323 - DNA, 201 bp, Bos taurus
cgatctgcatccctcttttctgctctgggtccattcttcctctgtcaggactctctgcccactccactccgaccctgccttctgtccaaattctgctcatttcttaaggcccaggccaaactttcatgaagccttccttggccacttgggtccacatttccttctttgagctcctacctccctttagggccaatgtattac

SEQ ID NO: 26324 - DNA, 201 bp, Bos taurus
ccatgtcaggtggcttgtgggatctcagtttactgacaaggtactgaacctgggccactgcagtgaaagcccagaatcgtaaccactgggccaccagggaactacccacccccactggacacacacactttcattttgcatttctacctggttccctcaaactttactacgccttaactttaataaatatttattgagagc

SEQ ID NO: 26325 - DNA, 201 bp, Bos taurus
aagagcctgggctggtctgggctggcaaagaaaaccactgaagggggttaggagtgatgagcaaggcagggctcctgaataaaccatggccaagtgactccgtttctgtctttcagagcgccagcacccagataaagctgcagggagattgatgggcttccctggtggcactagaggtaaagaatccacctgccagtgcag

SEQ ID NO: 26326 - DNA, 201 bp, Bos taurus
tgaaacacttcaagaggtatggaggaacagcaagtggccattcggttatctcaagagttggggtggtcagcagagccccaagaagaacaaatctctttgacgctcaaagaacattcccttcaaggccttgtcacttctggctcctcctgtctccagccttcaaaattgtccaagggctgcctgctccccagagcatgtgct

SEQ ID NO: 26327 - DNA, 201 bp, Bos taurus
ccatggtcaaaaccagtgtccaccacccaccaccaccccgccctcagcatctttccttctgctcataaatggatgtgccgtcatcagaggaccccttcagcagagggctgggtttgagccaaggccccacagacactgagggttcagaggaatgccaaacgagccttaggctggagggcagggcagccggattctagtctc

SEQ ID NO: 26328 - DNA, 201 bp, Bos taurus
gctcattgtcctggccaaggagaacgggcaacctacaccacgggtggggatcagccccgtctctgcagagaatctcagcttctgtgactccaaccattccagccacatcctttagaaagagtggaatttccaaaccgcaagagccatgatgggcatggcaaggtggtcatctccccaaaacatatttcattgagtggtgct

SEQ ID NO: 26329 - DNA, 201 bp, Bos taurus
tgcactgctcttccctggctgctcttcacttgtctctgcgtccacgcccttccctgaccacccgcctctggaattttctctgtgggacccagggaagctcgtggagtgtggagtctgttccctacaaacagggaacaggggacgtggaaaggctgccgcgccccggagccccatggtgccctgctcagtttcaccaccacc

SEQ ID NO: 26330 - DNA, 201 bp, Bos taurus
agactggggtgggtggtggcgtttcaacaggtgtttggagactgactgtgccaagaaccaccggacaggcttcagtggcgacgggcctgttgcaaccctccggaagctcatggtctggtggggagaggacagtccagccacagctgtagaacgacacagccagtgcctgctggggccagggccatccgcagtgtgggggct

SEQ ID NO: 26331 - DNA, 201 bp, Bos taurus
cctcatgacattgttgataatagtcttaagcccacttcctggcatttgagaagggttttacttgcttcatttatgtccttacgtccccctggaggccgtccgctcccagcggtgagatggctgactgatggtcatcaggagtccgccgtaacccggggctcatccagggaccaaacgtggccttattagccccgtgtttat

SEQ ID NO: 26332 - DNA, 201 bp, Bos taurus
tggttcccccaggctccgggaactctgccgtctgcccaggacccagggccgcctgcccctctgtgccttgggctggcccaggcctcctacagcagcgaccccaagctcgaagtgtccagggctcactgctgctagacttgtgacacatggtggacgcagagcacaggccacctcctgttcttcttcttatgcctgacaagg

SEQ ID NO: 26333 - DNA, 201 bp, Bos taurus
aaccactgggccacctgggaaacctcgcccttgtggggtgagtgttacattaccctccctggtctctcgtccaggtcctagggtagttcatggaaggacatgctaagtcatctccggcccctcggtaccaccatcacacctaagtttgcaccccatcttccaccacaagaccctgtggcctctgttgccaagaggagctcc

SEQ ID NO: 26334 - DNA, 201 bp, Bos taurus
gccagcgggatgaccctagagattcttttgaaacgtcagttccctgcacctgagagccgtgactgtcatctcatacagaaggtccagggctgcagaggggtgggaagagggcccctgcggtcagtgtccagaccctgagatgaaagtttctgtttaactggacacactcaagagctgcagagggtgctcagagcatgcaag

SEQ ID NO: 26335 - DNA, 201 bp, Bos taurus
catcagttagatctcggaggaggggaaccctgctgtggaatctatcctggatttgctttgtatacatttttgcacaggctggtgtgtttatgccaatgcgctgtgcatgctgaaacattcttgtgtcacactgcaaccatgctgagtttcttttatgctttgctttctcccttccctcacctccaaatgtggggtgcactc

SEQ ID NO: 26336 - DNA, 201 bp, Bos taurus
tgaagaggaagctggaaatgtagatacttgattagctcaggcacgaggcagcggctgctttaattagagggaccacggtggagccggtgggaaggagagcccagccgtgttttgaaggtctagttcacctgacaagtgcatgtggggggtggcagaaatcgaagcatcaggaatgactcccaggtctctgtcttgagcaac

SEQ ID NO: 26337 - DNA, 201 bp, Bos taurus
gctgtggagcatctgaaggcctcgcgcggtaggcagttggtaagagggtggcccgctgtggagcatctgaaggcctcgcgcggtaggcagttggtaagaggaataatggagtcatttaagcatttcattgctttgcttgctttaatattccatcacaggttaagtcatgctgtatgagaaattaatactaaaaatgctttg

SEQ ID NO: 26338 - DNA, 201 bp, Bos taurus
cctgagtcaagccctaagtctgcttctcttcccaactagcttttgaaccctgaatttgtatcagggtgttagctgttgattctcctgctggcccttccgtgaacggaaggctgaccatctcttgacaagccgtgtcctcctcaggctgcccttctgcctggtcaggccaagaccctgttcagtccatacccaaaccactga

SEQ ID NO: 26339 - DNA, 201 bp, Bos taurus
cttgttggagccctttggtgcagccgttttgtgcaggagcgaggccctctcgggaaggccatcaacgttcatttgaagtttgctcagagcccctgagtgtgcgcccaagatcagtttcacagatcccagccatcaatccagccagttgctcagttaatctgaacacggttcaggagtcgagtcagtaataaaactgtggtt

SEQ ID NO: 26340 - DNA, 201 bp, Bos taurus
ctggaagccagctccccacaaaggaggaaggatggggccaagtcagcctgggcctcgagggaatatgagagagcgacctgtggctgattcacagggggccagactgacaaagtgtgagagggagttggggatgtgtcaatcatttctccttgacaagaatttatttggggcatcagccttcaaaaaggcaacagataacct

SEQ ID NO: 26341 - DNA, 201 bp, Bos taurus
agtccaactgagagagacagagagtaatctacatcccaccaaagagctctcaatatcccactgtgaaatgcaaagaaatgaaaataaaactccatgatccatgtaaaagtatggctcagaatttaacagaatcagtggtgcatatttctcagattcaagaatcagaagttcaaagatgtaactgaaaatctaaaattaggc

SEQ ID NO: 26342 - DNA, 201 bp, Bos taurus
gactgtcaaggagagagaaaagatgcaaatcatgaaataaaactctcaggagccaaaagagagacttctgaagtcattctagagattggccagaaaatcaatgtattcaggaagtgatcagcatagacatgatcattttcttggggaaagctgtacatttggccagtcagagctctataaatcaataatgtaaccagagtc

SEQ ID NO: 26343 - DNA, 201 bp, Bos taurus
ataaagagaaaaagttgctgtacttccaaagacagtacttgttggggagaggcgggagattttattgtttccattagttatttagttaaggattctttccaccccttttttcccttcctacacaataatggagcaagagctgtgactctcacacattagaccagaaagaacttggcagacgaaagtagccgaggataaggg

SEQ ID NO: 26344 - DNA, 201 bp, Bos taurus
acctcggtgagaccacgcggagtgagccgcgctgtctgtgccctgagtctaagtggggagggcgtgaaggtggggggtcctgtgcagacccagtgagacccggaggcctctgattcaggctgtacagaccaccgcacgcctctgttctaacagcgtgacggagaggccaacgtgaaggaagtggcccagccacccaggctg

SEQ ID NO: 26345 - DNA, 201 bp, Bos taurus
ataatattagttgatcttaaaaaggagtgataatcttagattacagtaagtcccccagatacgaatgagttctattccaagagcaagttcctaagtccagttcgctcataagtccagcagagttagcctaggtactcaactaatacctttggctctatagtactgcattgtaataggtttataatagttttcacacaaata

SEQ ID NO: 26346 - DNA, 201 bp, Bos taurus
tcacttgccatgagtaataataaaccctttcctctcccagtctttggcttggttgagtccgttggtttggcacataccaagaggcaaacccagttttggggtaacacttgctcagttatgtaactatttagcctattagttattaatagctatggtcctctttgaaaaggtgacatttgagcaaaaccaaatgaaggtcag

SEQ ID NO: 26347 - DNA, 201 bp, Bos taurus
gtgggaggattattccaactgttttgggaaatgggtagacattcccaggagttgggctactgtccactttttgatttttatggttggcctcagaactgccgcgatgcctgtgggtgtgttgtttaaccgacgtgttacaatgagcatacactgaggctcaaggcccagtggaattcacccaccgtcttggacctatttggt

SEQ ID NO: 26348 - DNA, 201 bp, Bos taurus
aagaagtcagttttttaatcctttgtagctactgtaccagtcgcactatatttcgatatcaaacaatctgaaccgaatgttaggaaattgcatggaacatttggggcatcagctccctgggccacaacggaggcttcaaacgaaagcgagaactgtcctattccctgtcttccttatttcccactctgtcaaatcatccat

SEQ ID NO: 26349 - DNA, 201 bp, Bos taurus
ctgctcctcctatcttggtatcgctttttgattccatgccagggtatccactgctttaaaatatacgtatgtaactaggctatatacatcccatgcatgtatgctaagcaggcgtggtaagctgcttcagttatgtccgactctgtgctacctgatggaccgtagcctgccagggtcctctgtccatgggattctctgggc

SEQ ID NO: 26350 - DNA, 201 bp, Bos taurus
tctgtatccagtagttgagtgattcgtaaaacaaattggccactcaaagtgtttgaaatcaaacatccacaggaaaaatcatctcatcatcaagtctgaaaatttcatgaatggccaaaacgacaaacccgggttagaataccagaaacgagccctgtgaaacgagcctgtgaagcgtggtgcggatgccatcctcccccc

SEQ ID NO: 26351 - DNA, 201 bp, Bos taurus
gttaacgacttccaattaaagccaaagaggaatgtaatatggaccaggagtcatcacatgattgaggaaagtcacaaagggcaaggtcaccaagctttttttgaaaagggccagagagtcaatattctgggctctgcaggacatgcagtctccatcacagtgattcgactacacaattgcggggagaaagcagccctcaac

SEQ ID NO: 26352 - DNA, 201 bp, Bos taurus
cgaagtcgactgatgtgctgggtaaagcttggactaaatgttctcaaagatcctttccagttcctaaattccatgagaataaaactgtcaaatggtccgattgtagaagtcaggaagtttctatgccttcagggctgccagaaaggtcatggaactggaatcgcgaagctgtttctagaagaggaacagaacgcccctctc

SEQ ID NO: 26353 - DNA, 201 bp, Bos taurus
tgaagtcatttccccagttaatggtaaatacaaagtcaacaaatgcacacgagcctcacaaaggcagacctgtgggccttgggtcagagggcttagaagcgaattgagaaagatgaaagggtcacgtagggtcagtcggggtcagaggccatcaagagtggaggttctagggcaggacgagagcgaagatcatccccgtct

SEQ ID NO: 26354 - DNA, 201 bp, Bos taurus
ggacactttgaagatgaaaagtgccaggtgggtatcatcacatccgcttcttaagatggtatgcggaataataacacagctctcccccaccgggcctttcatccgtggatttcaaagcccttagccttaattaagtcgcccagcacctctcagaagtaggcactaacagcctcttgcctgagatggagacgcagaggagag

SEQ ID NO: 26355 - DNA, 201 bp, Bos taurus
gacccggcctggcgggccgcccccggtgtccgctgggccctcattggctgtttcgtctccatccgccaacccacctgtctgttctgcgtgcgctgtgcccggggttcctggccccataaaatttcacctcctggtgtagaagttgtctcacctataaacatgctctttgaggtgggcctccccaggggcgcccaaggcagg

SEQ ID NO: 26356 - DNA, 201 bp, Bos taurus
ggcagctgcaggtggcgtttctctgtccagatggcctcagtgatttctgacttgtgacttctgtatctcaatcccaccaccaatttgacactctcgtaatcgttttttcttgtctgtttatcttgatggtgcgcctaaggcacacagagtttaagtggtgagcctgaaagccatttcaaccagtgctagacattgaatttg

SEQ ID NO: 26357 - DNA, 201 bp, Bos taurus
tgtctggggaaaccctacagacatatatgaaataccttaacaacatttggccaaaataatcttttttttttttaatgaatacagagacctgaggggacacagaacagtggaaactcaaaatggggccacaagtcacacagaggctgacgccgggtcatattcttcaggctgtaacaaacagggtggaaggggattccaggc

SEQ ID NO: 26358 - DNA, 201 bp, Bos taurus
tcttgagggggtcaccaggagggcttgtcgactcagtctagtggctgaagctgcctctgctcaaacacctctgggaacctctgggactccactctcagaatgacacacatggccagtagctcatcactccccgcctgacccctgtcagcctttgagagtgtggtgtgattgtttaggggctgcagcaaaaagacacagatg

SEQ ID NO: 26359 - DNA, 201 bp, Bos taurus
tgggcagcagcaggccagagatctcaggctgacccgggccacatgaagtgtttaaggacagcagtagacgctgcttactcaccccaccttacaccttagggttcacttgggcctgatccagcgtgagtgaagtggtgagaaagacctgaatcacacttgtattcctttaaccttcaaggtgcccagcttaaccatgtgaat

SEQ ID NO: 26360 - DNA, 201 bp, Bos taurus
gaaggctggattccattgcctcaccatcctctcttagggcccttggcatcgtctgcatagaaggaggtgggttggcctgaacccacctttcctctctgcatgcttctgctttctctcccagaaatggagctgtgccagagcaaccaggccaagagcatcctcccaggacaaccgagaagtgtgagcaggtgctggggctcc

SEQ ID NO: 26361 - DNA, 201 bp, Bos taurus
agcttcaaagaaatcctttggctgtcttatctcaagcccatagatggcactctgacactgtctaccggaggcatggatacagcagagaaagtcaccccggaggcctgctgcccagagccagtctgcctgtcaagcttgtcaccacacccacagacccccgtggggacagaagaccagggctgccagctccctcccactcag

SEQ ID NO: 26362 - DNA, 201 bp, Bos taurus
tcttctcttttaaaatttttcctttagaattaaccctctgccatcctgaaactctttatctactaagtgcaataagggccactctcttgtcttagaataagcatgctctcatccctcccatatgaaatatgagggatttattttgacctttggtaacctcctgaggcttcccaggtggctcagtgggtaaagaacctgtct

SEQ ID NO: 26363 - DNA, 201 bp, Bos taurus
acaaatcctttcagcaagagcgaaaggagaccaagcagtcccactgtatatcatagaaaatcattaataataaataaaatagtctcccacccttgtgaaaaagtcccagttgtctccccaggggagtaaactaaacgcctttgattgaaggggaccgttgacagaggagatgaattttacccaagtgtgctgctagcaaat

SEQ ID NO: 26364 - DNA, 201 bp, Bos taurus
aaatgggactttcctttggagaacaggattcaggagaggcagcaggggatgggggagcagaaaaaactaagggggcagagaaggagagagtgggtacatacaattacatttcttttacagtgcattcattctccactttattttttcattagcaaaaatgagaaaattctgacttgcttaaagagtcccacccagatcaca

SEQ ID NO: 26365 - DNA, 201 bp, Bos taurus
cccgaccccagggttaacctggacacggctgggctggccccagggaggtgggctgagctgttcctttcggttccccagcctgttgctgagagaagcattcagtctcacccatggcctgtgattgctctgtcaaatcaattcgagagactataaagatataagagctgaacagcaccagcaggagactccattttttttcct

SEQ ID NO: 26366 - DNA, 201 bp, Bos taurus
catccacgagcctccattaatccagttaatccttatcttctaatcaaaaacaaacatctttgagtgtacttgggatccttttaacactttctgcacacctagatggtgtcctcagccttataatccagagctttttgaagccacttcagctcctggaaaggagggaacaaccaccattgtggcggggtcctgccagcccct

SEQ ID NO: 26367 - DNA, 201 bp, Bos taurus
ctttggtaggtggggtagtccagacccaggccgaaagcacctccatcaaggatacagcaaagaccactccctagacagtgagactgggtgaccaagggatgacggtcttggcccagtgtccttggaggaataagcatctgaacccgtgtctaaccaaagatgggaatgagccctgctgctgctgctgctaagtcgcttcag

SEQ ID NO: 26368 - DNA, 201 bp, Bos taurus
acagtgaaggcttaggtgcataagtttcattctgattgattttgactagaatcttctgctttctgactgttgatctgaaataagtgattggccttcatgacaccacatagagtggttgtgaggattacctgagataatccatataaaatgatcagttgttagcttttaacacagaaaccaactggagactctgatatcata

SEQ ID NO: 26369 - DNA, 201 bp, Bos taurus
tccacccgcctcccctcagccgaaggagaggaatctcgatggatttctggaccctttggtgctggatgactgtcatagactgatctggtatctgctgacagagaggaagatctgggtgatctaagtcaacgttggctgatcacctatgtgcctcccccccttccttcctcgaccatgcaggcatcgtaaactgatcgtggc

SEQ ID NO: 26370 - DNA, 201 bp, Bos taurus
gctacgatagcagactgtctttgcatgaagagcattgatagtcctgctccccaagtcccggatctaagccccctactgtgaaacgtggaaggagtcagcggtacaggaaaccttagttcagctagttaccagtaaacatatacaaggtgctgcttcttagagagctgaaaattataaactcagttaagaagagtcctggtc

SEQ ID NO: 26371 - DNA, 201 bp, Bos taurus
ctccaccatgacctgtctgtcttgggtggccctatatggcagacctccccacaaccgaccccaaatacacagggttttgtagaaccgtgaactctttgacgctattggggacagtctgtggccctcccagacctggctttcagaagcctcaagctgtcttttccactctggagggcagtccagatccctgtaggggttgtt

SEQ ID NO: 26372 - DNA, 201 bp, Bos taurus
ggggactctgcaccccagcccccatctattccacagaagcagcttccctccgggcccacacctatccaccacgcaccacctccgcctttgctcccgggccgtaggaacttgtagacaaggcaggcatccactcctctgtcccatgggctgtgccatctagggcaggtgaaggactctcccaaagggccacagtgtaacttg

SEQ ID NO: 26373 - DNA, 201 bp, Bos taurus
ctccaaatgctggctctttcgtggggctccttggtgaagggctttcccccagtctgttgttggtagatgcccttgtcagctgaatttctgtagccatcctcgtgcccccagctcctggccccctgcccccaaccaggcacagcctctctctgcctgggtgctctcttccagccagaagccctcctggcaggggcgagggtg

SEQ ID NO: 26374 - DNA, 201 bp, Bos taurus
acagacccagtgatttatccacaaaactttctcacatcttgcaatgcacgtggcagcccaagacaaaggcttccacgttcaccagcgaaggctccacatctcacaccaagcagttacttcttgctcttctcttgtgggtcaaagcctggctccttctctaaacctctctattatcttcctcatatacattctaaatatcga

SEQ ID NO: 26375 - DNA, 201 bp, Bos taurus
gaagcccctctctctcctatataacacccagcaaggcccagcagccctatgccttctcccagcttctccatcaggacaaggagagaatgcactgcaaccgagaagtctttctggcctcaggagtccaggtcaccagctcccagttcttagagattctgtgtgtgtgtgtgtgtgtgtgtgtgtgtgtgtgtctgtctgtcc

SEQ ID NO: 26376 - DNA, 201 bp, Bos taurus
cacggtcactctgtttttattaacttaacctgagactcccaacccacaggtcaggggcaggtcccccagaagcgcccccagctctcgtcaagagccccctagggaggcgtcactggggccaagggttcagggttgagggcggcctgaactggggcagcactctctgcccacaaacatcccagacggatgttttggtctcat

SEQ ID NO: 26377 - DNA, 201 bp, Bos taurus
aggagatgaaaagggtagaagcagctgcagaatagaagcccaggagtgacggggagcgtgcatcagaaagcaacgccaagcctccttcctacccaccagcaggggtcaacgtgaggcttccagtccactcctctctccaagactgctgcatcttatattttatattcccctaaatgtgtaagattcaggccccaccacaac

SEQ ID NO: 26378 - DNA, 201 bp, Bos taurus
caaaaaggctgcaaaacgtttcctaaattcagccttggttgggggtgaggttcttggggcggccaatcaggtgaccaaaggtgagttcgcgaacatctcacgatctgtgggagcgggccggggaagggtcaggcctccctgagagaaagaggccacacagccagcagccaggacactgtgacacgcggggtccagagcgca

SEQ ID NO: 26379 - DNA, 201 bp, Bos taurus
taattgtagatgccaaagaaaaaaaaacctttctagaagtcagggaaccttccatggaaggcagggaaaggaagcaggcaattttaaaaatccctgtaaatcttctaaatagtaatttaagaaagagcattaaatcctccttgttacaagataaacatatattgtttctgaacaagctttcactgaaaatatctgaataac

SEQ ID NO: 26380 - DNA, 201 bp, Bos taurus
gcgggggggtggggggcaccggggccttccaggaagaggaaaaaacaggatgtcttagtcagcttcaaggtcagggcagttttctaaggagcatctggaggtggcagaggagccagagacatccaaagattaaacctggaagggccgggatatagagaactctgtaacaggactgggaagggagccactgttgattcactg

SEQ ID NO: 26381 - DNA, 201 bp, Bos taurus
aggttggtacaggctggattatatagggccttctgcaccttggggaagagtttgttgtctttaaatgcaatgggaagccattggagggattcacattggcggtgggttaggggaaacctggggccaggcttcagtaccttaggggtcaggctccctctgccctcgacttcgtccactgtctccaggaggccaccagggccc

SEQ ID NO: 26382 - DNA, 201 bp, Bos taurus
aagaaaaatacatgctttaatttaatgagcatgaaggagtctctgctctgtttatatacagcacattataaataaaagggaaaaagaaaatgaaatctgtggggaactggttcacttcagcatgtacatggctgggctcttgtcacggttggctcatgcagtttttatttatgaaaatggtatttccaagtggcatagagt

SEQ ID NO: 26383 - DNA, 201 bp, Bos taurus
taattcaaatggcagtctgcttgcagcattcaagaggccatgcatactctcctgtaagcgaccaggccaagtcacaggcagtatttggatggttttctatataggagggagaccgtgggcttaggatttgaaaaccagaaagaattaaagccaaaacctagtagatgtagtagccaaaagctagtctcaggattaggtaaa

SEQ ID NO: 26384 - DNA, 201 bp, Bos taurus
ataccatagagcccaccctaatgaccccatatatcaggaatgaccctatttccaaataaggtcacatgctgagaccctcaacatatctgtatagggacacagttcagcccattatagcgtgggcaacctttgaattaaggatatgatcccaggatgttgataagacttctgagccagaatggccatcattaagaagtctac

SEQ ID NO: 26385 - DNA, 201 bp, Bos taurus
attgggtggcagcagctggtggggtgttgggataatcttgctgatgactgggtagatatgaacctcttgtgttagtagattccagaaagcaacatgctccttgatgaaaaggccatggtcattgtcttgcgggattggcctggcctggctctgacagttctcagctgctccataaatctcgcatcagttccatctggccaa

SEQ ID NO: 26386 - DNA, 201 bp, Bos taurus
ctccagggcccacgagtgtgaaaatcgggatcacttcgggaggcctgcctggccttgccccatctgtccatgccccagcacccttccctcccacctcctgtatcagccgctgcgcaggagggggccagcttcattttaacttcagccgaatcaaagtctcggagagggagtgggtatcactgtgggtgaggtgaggctcct

SEQ ID NO: 26387 - DNA, 201 bp, Bos taurus
ggaaaccttcagtgaatccagaggctgggtcatgcaccccaaacctctgagcacagagtgcagaacatccgagctgacacccaagtggcagttcctgtcctgtaatcctgttttcagctcactgccttcagctctctgacccaccattctctcctccacccagctgggctccaccatccacagcctgccccttcttgcttc

SEQ ID NO: 26388 - DNA, 201 bp, Bos taurus
ccacccaagatcatatctggtgctgaaacctgggtatttggaaagtctaggcaaataccactgtgggcctcgcccagcagtggcttgaggcccctgacttttgctcttgcctcatcactttggggaaacccgctcacctgcctgggtgactagggtctacgaatttatgggagctaatgctgcttgtccccttcccctctt

SEQ ID NO: 26389 - DNA, 201 bp, Bos taurus
gcactgagggccccgaggaggggctgagtgctgccttttcctggtgcagcattcgaattctctgcagggcgaccattaatcctacaggctagatggtcagcgagggcccccctgccctcatagacctcagagtctggtggcagaacatcatagggtggctgagcagagctgagcaggccccgagtccagcagcctggatct

SEQ ID NO: 26390 - DNA, 201 bp, Bos taurus
tctgctcagagatcccgtgggttcttcctctgggactttgtctttgtcctcacacccggcccggggagcagagcacacaggcctctttaggcagggcagctactttctcattctcgccctcccagtccttttctgcacagcccaggggacatttttctggccagcagggaagagtggagcactttgctctgtgcatatctt

SEQ ID NO: 26391 - DNA, 201 bp, Bos taurus
ctggaccatatacttgcctggacttgtcttctcattacagctccccacccaggacgacaccaaggacaccgtgtccttcagttccattacagaactgggctaccaaaactaaaaagatcaactgctttacatatttccgcatgtgatgagcacatgttcatgtaatatatggtagtatctgttggccttgtgtatgtgtca

SEQ ID NO: 26392 - DNA, 201 bp, Bos taurus
gctgtagaaacctatgagctgagttttgaaagcaggtagatatttgcctcactggtgtgtgtgtgtgtgtgagagagagagagcatgcctagggcaaggtatggttttctggtatttgtttactctgttgctaacccttctggggctcacctttcaagttggaaagggaaggagatctaggcaccattagatagtttaccc

SEQ ID NO: 26393 - DNA, 201 bp, Bos taurus
gaacaggatgatggaaaattttccatctaaggccacactgaaacatacttcgctgacctgggaacgtttgtacttggagggtagattcagcttctaggagcgactaaaatgtgagaatggtgaacccttgaccaagtcagctggctgaaggggtcagcctacacacccacagctgtagactgacgagggctggaaagagtt

SEQ ID NO: 26394 - DNA, 201 bp, Bos taurus
agcacacaacacagtctctttagaaaaacaacacgcctgaaccactgagggaaaagggttggtttccatggcaacatcaaggccatgagaagcagtctggcatggcggggtgttcatctgactctgctcttttgtcagaaatgatgtgtttcagagaacccagccccagagatcacgagtccaagttgcctggagagatgg

SEQ ID NO: 26395 - DNA, 201 bp, Bos taurus
gtgactgccagctgctctgccttcctcggcatgtgcggtggccagcgctggtgcttagcagcttctggctctccttcccttccagagcacagagcgctgcatttctcagccccttgcccttggccacggccccgtgagcagtcctagaaatgaaatgtgaatggaagtgattgtgacttctggaccaggatactgaaaacc

SEQ ID NO: 26396 - DNA, 201 bp, Bos taurus
ggaagggtggcatttggggagtttgctagtgctaaattgctccatctgttgcattaataaccaatcagtccggggggctgggaaaatgggtaattggagcgtacggtacctattagggccgatctgcacatatgtaactgctcatttcatctgtacgagggactgcttacttatgcaaatagcaggtctgatgcccacgtt

SEQ ID NO: 26397 - DNA, 201 bp, Bos taurus
gacccggtgggcacagggggccgtgagggcgccgggatgagggggctggtgtgcccttcaaggtggtcacgacaataataaagggggaagtaaagaacgcattgtcaagagctttgttttactcctttcctccctccagccaatgaaccagcgatgaaaagaatacagctggtgatacagagaagagaacaacaaagcacg

SEQ ID NO: 26398 - DNA, 201 bp, Bos taurus
tcttcttttgcattcatgtcatgtgtatcagtctgggctttctgatgaaaactaagggcaaaaagaatgtcatatgtcaggcccagggttggtgaatccagccctaaatccaccctctcatttcatcctcaccacagtcctgattttacagaagaataatctgaggcccagagagaggtgaagtaacctgctcgggaccac

SEQ ID NO: 26399 - DNA, 201 bp, Bos taurus
gagaatttaaaataaaaaattattcattgctggctctaaaagtttcaaattccactggggatcttagaaattaaatataagtcacccttcaaagacactctaatcagcaatgatattagacataacagaaaaaaccatgttagaatttacattgatagtttaagtcaagtgcttctgtaggctcatggaatttgtgacgtg

SEQ ID NO: 26400 - DNA, 201 bp, Bos taurus
gttagaacttttgatggcaagtgtcagaaactcaacaattaaatagaaagaggacttactggcgcatgaatccaaggaagggccgaagaaccaagcctccagaagggcagctgctctactagaccaggaacaattagaaccagggcatggaatgttccagaacattctttctgcctcatttcttggccttttctccacagg

SEQ ID NO: 26401 - DNA, 201 bp, Bos taurus
gaactacaggtgcttatgtattatgtaaggcatcctctactattttagttattttaattgagacaaaggactcagtgtggcctactggttttctccagctttttgcttcctgataggtgtgggagtaactaaagaacctgagaagtattgtcaaatatgtgggggaaaagtgagcagatggcatcctgctgtccacatgtt

SEQ ID NO: 26402 - DNA, 201 bp, Bos taurus
ttctctaaagtcaaagctcaattaaaaaaaagtccccattgctatttaaaaaaaatgctttactttattgtacccatacccgtgtttgtgtttgaatgatcaacacaaaaaatagtgatttaagaaaataaaattataggtccttaataaatttatattggaggagaaggaaatggcattataagaaagagtttttataat

SEQ ID NO: 26403 - DNA, 201 bp, Bos taurus
gcccagcggtgggtaatcaagaggtggacaagccacagggcaggcccttgacctacaaggactccactcagcatcgcctttccttcttgtttcaggcaccgtccatccagtgcagagaggcctcctagaagctgggggagtgctcagggggctaactttcagtctgactgtggcctggcgggctcaggggttgtcttctcc

SEQ ID NO: 26404 - DNA, 201 bp, Bos taurus
ctggctctataagcaaagaagagctgaccaaatattgtcctgcattagagggagcacagagaaggaaagagaaaagatctgtgtgtcccagaagttggattttcaaaaaccaaatgcctccttgaaagtgttgcaacttactttaatatactgcagagtagacagtttgaatcaagtgtgtgatttgctggttttaatcaa

SEQ ID NO: 26405 - DNA, 201 bp, Bos taurus
gaggacgtgcacacactcacaagttccacgtatgtaagtacatacatacaaactctattcaggagataatgcctgttgatggttggaaactggcacagaggagaagtgtaggacaaggttatagttctatttttgacaaagaaattgcacctgaagattgagtaaaagctttccttcttcctgttttatccctggtgtttt

SEQ ID NO: 26406 - DNA, 201 bp, Bos taurus
gtagtagcaactttgatttgtgaccatgaaattgggtcttcaataacagcatctcatacaacaacacagaaacagtactgaacttccccactggcctttaaaagtccagattctacttacatttctacctatgtgggtgtaaatatttgtctcccatgagggggtagcagaagtcctaggtgagcttccaggcctccttgt

SEQ ID NO: 26407 - DNA, 201 bp, Bos taurus
ctccctcttccgttcaaaattccatcagggagaaactctttccaaccaatatttaaaggcccctctcatgggcagggcttcaaaatgtcaccagggcagacgctgctgatttttgtaaaataaccatgagcctggagttagagaaagagagcccctatatccctgagtgacagtcagtattttgtagaacatattagaaaa

SEQ ID NO: 26408 - DNA, 201 bp, Bos taurus
acggactccaggtacataaaccaccatcaccgagtatttgtgttcttctaagtgacctgccctgagacacagttccgacaccaccttggaatttccagttcaaccactttcctcatgccactcatgaacctacaaagactctttattgctcgctaggtctctcaaattctgtttgatttctgactctccttaacgtggccc

SEQ ID NO: 26409 - DNA, 201 bp, Bos taurus
ctgccctgcccctattatgccactcttgacactactacacacacatttaccttcagccaagtaaaccttcttgctattccttaaataggccaaatatgcaaacaggagtctctgcatgtactgctccctcttgtaacatttgcacgactccctacctcacttcagatttctgctcttatgtcaccaaacctgagtggcctt

SEQ ID NO: 26410 - DNA, 201 bp, Bos taurus
ggacgtgcagcggggcagagaagttgagggcagcctagtggaaaagcaccctgtagcatttggcaggctccagattttccccccgcccccatccaagggaattttcacacggcctctgtataggttactctttcccttacttttaaaatatgaattttccaagtcaagattctgggaatgggagtctcaggtgcccttttg

SEQ ID NO: 26411 - DNA, 201 bp, Bos taurus
ggagtcccggagcctcggtgttaggaggcacggattcgaggccgcagctctaggcgccgcaaagacaccgaagggtcgctaagccgcagcccaacgacccgtgttgagcacgcctggcctgtgcggctgggatgttaactgtgaggtgtgtgttttgggaagaaagcaggacagacgtttctcacagagcggcaggtttct

SEQ ID NO: 26412 - DNA, 201 bp, Bos taurus
cgggtttggtcggcccccatttgccagggtgatttacagaagcctttgaacaccgacgcttgtggccctgcgaaggccagtgactaactgacctgtctgtgtatggtccacttcggaaacagaaacttccccggtggcatgggaaagaaaacaccaacctaatcctgaaagggtaactttaaaccaaagcccaaccgagaa

SEQ ID NO: 26413 - DNA, 201 bp, Bos taurus
tcagtttggtcagcaaaatgtgggtcgaaaatggtagcacctcttggagcagaagcttcaaaagccaaagtgtggttctggcctctctctgccttctgccgtgtgagcagcatgtctcagctagaaactgctcctttaatatggacttaagtggggaagaacaggggtctagctgcagcagagcctgaagcagacaacttc

SEQ ID NO: 26414 - DNA, 201 bp, Bos taurus
cgaagaggctgcccagccatggcaccccagcaaagacggagggtggaggagagggcgtttcccggtgctctggacttcaccagcaaggtcagtagcacaccgtatacacctctgggtcttgctctaaccagcaagtgttcagaatcagatcgcatcgccctcctcattaaaactcttcaacgacttcctagtagttctgca

SEQ ID NO: 26415 - DNA, 201 bp, Bos taurus
atggatgaatgaatgaacaaacaaaagcaaggggcccttcttgcctttccccctcccctggctacagcgcagacatggcagcaagagctggggcagctgtcgcagactgtgtgatgaagctgagtatcaaggatggcaatgggaccacacggagtgactcgaattcctggtctcaggtccctggacagcctcttggggcag

SEQ ID NO: 26416 - DNA, 201 bp, Bos taurus
gttgcctctgtagttccctctgttgtcctcttggcagtgtttcccagattgagatgatttgggccaggacgaaatgggactcaggaattttaacatgttcaacaattatcttggttcttatcatcatggatccttgcagatccaaccagactaccatatctcttttaatttgcaatgttgtgttaattactgctgtatagc

SEQ ID NO: 26417 - DNA, 201 bp, Bos taurus
ctgaaggcttgctattccctcacaatcccattaacatgtgaaagcaaagatctcagacatctcagatcaaattctactagacatacagatgcttattaaacgtgttaacatgcacaaagcagtgtatatggctgcccatcccatgagcatgaagacgctgacctgacaggaggtggccctgacccattctggagccagaat

SEQ ID NO: 26418 - DNA, 201 bp, Bos taurus
tgaatcaactcttcacatgacgtgcccaaagtaactatttagtccttgatgtcatcagggaacttcaggttccaaagaattctctaggccctttctaacttaaagatccctaaacaagctgcaagtcatcactagggaatctgtgaaaaatgcacaacctgaggccttgtcggaacctactcaatcagggtcttcatttta

SEQ ID NO: 26419 - DNA, 201 bp, Bos taurus
tacctcaagtaaagggaagagatctttatcttcatcctttaacatgttccatttctggatcagtggaggcattagcatctggatatattcctaaattacaatgatgaaaaacacagaaagctccactatcatatgtaaacaagtccataccgagtctatgaaaactaaaatccatttagagtaattgtataaaatttttac

SEQ ID NO: 26420 - DNA, 201 bp, Bos taurus
catttcatggttttataattcataggtcttctgggagacagttacacaccaacctctcttgctacttaagtttgtcatttgtctgcttttaaaaatacttctgatgtatcctcatatcccaagaaagttttaagaaagagtataacattataaaaatcttaacatttggaatttaagatgaggacaggacagagaatagat

SEQ ID NO: 26421 - DNA, 201 bp, Bos taurus
acaataaaatattttggacacattttaatagtaatatttcttagggggtgggggagggagtaccaataaatgaaggaaataaattatatattgctgaacccaaagtatcctttcatagtttactgtgcatctctttataattaaaattttgagttttctttgttttcaaaaactaattgacaatggaaatttcttttaaac

SEQ ID NO: 26422 - DNA, 201 bp, Bos taurus
caattcatcactttgagcatgctgccaaacaattttgtttcttcttctagaaagtagttgtaatgaagctggtctccagcctgtgtcagatgagggaatagatgaggtaaaacttatcaataattctggacttgcagacacaatggctgtgcatttgcattgttgaagggcagttttcccttccaacctgtagcaagccca

SEQ ID NO: 26423 - DNA, 201 bp, Bos taurus
agaggtgagatggaatttcaacaaggtggtcaaggaaggcctccccaaggagatgacatgtgatcagacagctgaatgcagtgaaagagcaaacgagaggagacagccagtgccaaggccccgaggcaggaccatgcccggggtcttctgagaatgggaagagggcatatgtggcaagaataatgcaagttagggaagagt

SEQ ID NO: 26424 - DNA, 201 bp, Bos taurus
tgaagtgatgacgatgaaatgatatattcactgagattaaagaaagcatgaaatctgttgtctcccttcgctttttaaacctctttcaaaaaaacaagaagacatggtaggcttctatatatcacacagtaaacattggagctttttagaacagcaggtccactctcttagatacatgggctttccttgcattttctctgg

SEQ ID NO: 26425 - DNA, 201 bp, Bos taurus
caggccatgggacacaagggcttgtttactggcaaatatttattgagcacatctatttatcaggtgaaaataaattgggatatgaaagcaaagaagagaagtgtaaatacaggccctaagctcatggcaccccattccagtactcttgcctggaaaatcccatggacggaggagcctggtaggctgcagtccatggggtcg

SEQ ID NO: 26426 - DNA, 201 bp, Bos taurus
ttttgtccctaggggcatggtttcatggattaattggcagccatgggctctcatgcagcaggatgaagatgaattcaggctctaaccagccaacctggaacggcaaatagcaacctctcctaccctggtccaccaacagccttccagtcttattcccaaattctcggcctccaggccaactagccctctcttttctgcctg

SEQ ID NO: 26427 - DNA, 201 bp, Bos taurus
ggggagccccacagctatgcccctactcatccccatcccccactcctggtgccttggctacttctctgcccaggtaccaacatgtccaccatatccccttggcttggtcctcacttcaagttgtttctaattcaagttcctccctaactactcactttatatggatctggtcctcaagctaatacctccccccaggccccc

SEQ ID NO: 26428 - DNA, 201 bp, Bos taurus
agtgccatattctgtttaagctttccaaaatttacattaaggcgattcttgaaagttataagaaattgctctaccaccttcaagccattgcaaatatatgcacattgcatcaaatgtgcatataaaccaataaatatctttgttgctctctaattaatcacaaacaattacacataattatttcattaagtggaaatttta

SEQ ID NO: 26429 - DNA, 201 bp, Bos taurus
tgcgtgagagagcggcctgcgccgattcggagccgaagctttccctgccaactcctcggcttcgggatacacttcggcccagatccttgctgtcccaactcgcctgaaacctccgggattctccggtaagcctaggcacgtgtcggcgaacgcggcccctgattggtcgatgttgagcaccacgcccccctaactcagcca

SEQ ID NO: 26430 - DNA, 201 bp, Bos taurus
gctcatttagagtaaaactcaaaatcctgacagtggccccacataacctgtgcttctcccgctcagtctttacctttcatgtaactgctcctcttttctcgtcccgtttcactttggccccctttgctggccctcaaacatgtcagacatgattttgcctgaagtacttctcaactgctgttccctctttccccacaaatc

SEQ ID NO: 26431 - DNA, 201 bp, Bos taurus
cctttatctattaatacaaaacacatattattataaaaatgatagcaaaaacatttcaaaaagcacaaaggaattcacatacaaccctataaagtaaggactatgaaactggcccaaagtgcaatttcttgatagttgagctcttctccttcatatgtaatatctttaaccgtaagccacaaaagagcataatattatgat

SEQ ID NO: 26432 - DNA, 201 bp, Bos taurus
caatatgactagggtccttataaaaagggagaaacttggagacaaacaggcatacagaaagaatgccatgtgaacatgaagacagccatctacatactataaaggcctggaacagatccttcataatcctcagaaggagtcaatcctgctcacgaccttgatttggccttcttgcctctagacaataaatttctgtcatat

SEQ ID NO: 26433 - DNA, 201 bp, Bos taurus
tctcttactgtccttggaccccagccaccattttctgaggaagatagcccacatggagaggccatctcggtgtattccaactgacaacgataaggaggccccctgctgacagccagcatcactgccagacatgtggttgaaggagccttcagatgattccagccctcagtacatcttccagctgaggccccagatctggtg

SEQ ID NO: 26434 - DNA, 201 bp, Bos taurus
tcaaggggtcacaaaaagttggacaggactgagtgactgaactgaactgaggtaaagcagtgttcaggaatctagtgctcagcgtgaagttaccatcttctacctgggcaggggccctagttcctgcagaaaactgaaagataattattatgtagattcctcaaagaggaaccgggatcctgttcaatcatcgcactattg

SEQ ID NO: 26435 - DNA, 201 bp, Bos taurus
ccctcttaccagggaaggaaacatattccgcagtcttgggaattagggagtcattgtctcttggggccattattcaacatattaacaactacgcagtgaagttcatcccctttgctaaaggctacttccccccgtccccccgtgataaaactataactctctacaaatacaaaataaaatcaacacatcaaagattgtatt

SEQ ID NO: 26436 - DNA, 201 bp, Bos taurus
tgcacgcaaaccagatagctgaatggcacattgtcctgagaggaactgggtgccagatcttcaaataggtttgtgaccctcttttcctccccaaagtgaaacatgacagctttatttctaggaacatacaagaaaagtggggaaagcatgttgttatctaagggggaacttctcacacagattctacttgtgggcagagtt

SEQ ID NO: 26437 - DNA, 201 bp, Bos taurus
ttggggtacaatgaggaaggctgtaaggaagggtggggtcataggatttctgagattccttttacatttaaaaccccaagcttttctgttgttactatatagagtggttttatcagcacaatcatccttccagctcacaaaaggtaaaaatttggcagccacaaagtcccttcttcatttgcattgtagtatccttagctt

SEQ ID NO: 26438 - DNA, 201 bp, Bos taurus
aattccttggaactgaaaccgattctttaaggtaaagagcaagaaagtagtactgatacacaaacctgacacacagagttttaaaacttactaatccaaagggatctaggctagaggtggaaataatctcaaaaaaggtacagtgagtgcacaaatagtagctccatcaagaaagacgaaaatgaagaagacacatttcta

SEQ ID NO: 26439 - DNA, 201 bp, Bos taurus
ccaacagacccttctgatctcacagtttctgtgggccaggaatctgtgtgtagtttctatgtgcacgtcctacggcccagcgtctcccaggttgcagtcatggtactggctagggctacagcgtctcaagccttgaatggggatggtctgctccaagcttactgcaggggctgtaggcagacctcgggtcctctctggcgg

SEQ ID NO: 26440 - DNA, 201 bp, Bos taurus
aacacatgaaagtggaaacgaggcacttgggtgtggtcttcatgtagttcttctaggacacaggaaaagaagtcacgcagaattaagccaatactgtacactgtggggaagtaaagtctgttacaggaactggtattatctaagtgatggaaatgccctagatttctcctcttcatctaggagatgaaggccttcatcaac

SEQ ID NO: 26441 - DNA, 201 bp, Bos taurus
atatcaaaaccctgagggccctgaggagagtgtaaatgcaaaccccacctttgtgtgtggagcagacccaaattataaaccatctgggaactcaggcaaagacagatgaacctttctgtggccttcctgtgtcactgcacacagcacttcagtcctgtactttactccagaagagacttttaaagcttccagttctctcct

SEQ ID NO: 26442 - DNA, 201 bp, Bos taurus
aggcgaggccatgcatatcttgtccctggggtgacagtgccagctggcaagcatgtccctgtgtttccattcaccccagaagcatgaagccccactgtgcaccctgaaggccacagctgcagtgctatattgtttaaccatctctgctttggctaagaagcaagtcatctcaagaaggaatttcctggtttctgaagtgtc

SEQ ID NO: 26443 - DNA, 201 bp, Bos taurus
actccttgtttcctaggatgttttgaaatttaatgaccaaatgcttgttaaagctctccctggagccttttgatgaaacaaactctaactacaaagtgtggtttaaaatggaggtccagcctggaggcatggcaggctccagacaggcctagctgcttttttatgcaaattaaacatcttaatccacctggcaaattactg

SEQ ID NO: 26444 - DNA, 201 bp, Bos taurus
ctttcagttctatcatccttctggtaatctaccttcgtgttctacctcagggacccatgtggctgcctgatttctggccaacaaaaatgcattacatatagaaagacaaaaacagaggaaaagaaaaagaatcctcaccagctgtctattctccaagaaacttctgcttagatctcactggccagaacacaataccgtaac

SEQ ID NO: 26445 - DNA, 201 bp, Bos taurus
tctggaggccacctgctttccttggctcaggacccttcctcacacggctccaactgtcatcacatttccgactgctgtggttaaatctcctacttcccctcgtataaggacacatgatattgggcccacctggatagtcaggataatgtgtttggcttcttcgttttctggttaacaactccactgcgtccccaacacccc

SEQ ID NO: 26446 - DNA, 201 bp, Bos taurus
ttggagttggaaaatacatacacacttaattttgttgactactttcaggtggctctctaggatggctgtgtcaatttacactcctaccagcagtgcttgggggtttccacttctccactttctttttatcatctgacgtttgatcttttgccaatttgatggacattgaacattatatcatacttctttttatttgtattt

SEQ ID NO: 26447 - DNA, 201 bp, Bos taurus
tcaccttttcattgtttctaaaggggaagaaagccatttatatagagtaaattagagaaatttacatctgccacatatgaagacaaagaagctctttttactgtgattcttgaattaaagagctgctcataagaagctcataagaaaatattcctaagaatattttcagttctgtgtatcgtcattttaaaataagaatgt

SEQ ID NO: 26448 - DNA, 201 bp, Bos taurus
aagtctatgtaaaatcaatgtaaaatggaagttttgattctgttttcaaatttaaagtagtttaagtccagttatcatgacctaaattctttactgttcattctagtagataacatgacctagttgattccatcatcatatccagctgttccacattcttaatggatggaggaacatgaaactccttgaaggcaggccttt

SEQ ID NO: 26449 - DNA, 201 bp, Bos taurus
gcttggggccattgtattcattgaatcttaatgtagttctcagtcattcactattttgagaatccaattgattatctctttatttccagtgctataggatggaatatctatggcttatttagtggagcttgggctataattctctaaaattatttcttgtctcaatagaagatgttgtatgttaagctttgcatgtaactt

SEQ ID NO: 26450 - DNA, 201 bp, Bos taurus
ggcactatatattaataactaaccatttgtgatgcctcctgttgcctgtcctcatttactgttctagacatgactgcctatatgctgtttaacaagagtgcatcattcttacatcaggattaaggacatatacagactgttttcagagaacaaattagacatttaaaagtaccttaaaaatgagatgatgcaatcaaatgt

SEQ ID NO: 26451 - DNA, 201 bp, Bos taurus
gcagcagtcactacctaaatgataaagcacctgtattgaatgtctgctcaaggttggtttgaaaataggaggtctatggatacatacgccaatgagagcatgtttactgctgatgggattcctctttaatgtgcaaccaaactatagacgcaagcacttataaaggaatgatgccatggagaaaaatacagtctgtcagcc

SEQ ID NO: 26452 - DNA, 201 bp, Bos taurus
catttctgggccctggttatatttgactgtttatcctttcctctactcccagtagcataaaacaccctctctaagtagaaattaatgattgctttaaagtgtcaagcagcaatatttaaacacaaagaatattttgacaatcacatgtatgactttaacatatctgtgaatttatgtgatggaaaatgtttcagataccta

SEQ ID NO: 26453 - DNA, 201 bp, Bos taurus
cagtgaagactcctggaggtttaaagtccaaatactttccagtgttttcagtcaaaacgatctagtgagttctaagagcaagaaacttcgagaaaaacaatgatgaaggagcattttcaaaaaactcaagaagtgaattatgatccaaagattttatattctgccaagatgtccttcaaatatcaagactgaaaaattcca

SEQ ID NO: 26454 - DNA, 201 bp, Bos taurus
gagctgtgcctgagacagactttttgctttcctagtcaagaggtcctccaagttggcaaataccttaatgaatctgactaaatgttgatgatattcattcatttataggcacacatacatacttgatgttgataacatcttttgacctgttgctacatcatatacaaaggctaaggacattttttgatccttctaaattag

SEQ ID NO: 26455 - DNA, 201 bp, Bos taurus
caagaattcattctttttacggcttagtaatattctattatgtgtgtatacacacacacatgtatatgtatgtgtgtgtattttacattttctttatccattcatctaatgatgaacacaggtttttccgtaacttggctgttgtaaacaatgctgtaatgaacatagggctgcatatatttttttcaattagtgcttttg

SEQ ID NO: 26456 - DNA, 201 bp, Bos taurus
acttagaaataagagaaggccacttggaattacacaatatgtgaccttattcaaactttccacagtacctgcttcccacattataacttgatggaaataagaatgtggtgaaaatttaaagtgaaagtctgttcaaggttatgagaaagctaaagaattctggactatataatgattgctttttattctccactgtctttt

SEQ ID NO: 26457 - DNA, 201 bp, Bos taurus
aataaaactgaaaaaataataagtctagcaaattggtagcaaaacacagccaattcctcttagctcttttctttcccacaacctcagatatagcacagtagtaccggtaagggaattaggattataactacctagaatgtagtttgagtcctggctctataacttacagatattatactgctgggcatatatttaacattt

SEQ ID NO: 26458 - DNA, 201 bp, Bos taurus
gggctgtactgccaagaagatagccaaactgagagtaaaattaaagatgaacactgtgtataaaaaaagaaacagctatgggcttgtttttcaaaggataatgccagacataacacaatgtcagggggattcaatataggtgagcagggactaccactctgttcatgatgatagacacaactttacaactatacgtgacta

SEQ ID NO: 26459 - DNA, 201 bp, Bos taurus
gatagaggagtctggcgggctatggttcaggggatcacaaagaatcggacacaactgagcaactaacactgtcaactttctctgtaaaataaagaggctgaaccagttgaccacaacactttttatgattattatccaattgtgtacctgctccttttatgttagttctattttaaaagctttttttccttctcactctcc

SEQ ID NO: 26460 - DNA, 201 bp, Bos taurus
gaaggcctgggtgttttacatcatttgtattagttattttcctttccacttaagacattccattgcattcgtttaccttacctgactggctcctccttgattagcagtctatggccaaagttggccttccgacttgagaatctttgatagtgtagagcaataggtcagtaggtctgccagtaggtcagaacgttttgagct

SEQ ID NO: 26461 - DNA, 201 bp, Bos taurus
aatggaacagacagtaatggccccagtacttggaccctcaggtaaacagagatgcaaaacgtgaaatagaagttttagttgaagcaccagaactaaagaaagccgcattctaaagtggacgtgaggccatcgtgcgtgggatttacattcaaggttaccagagtgcattcttgtgactggccccgaactcttctcatatct

SEQ ID NO: 26462 - DNA, 201 bp, Bos taurus
agagagaaagccagctacaggagaccctccagacgttttctgccccatgatcttcaccatggcctgttcatcctcaccagtggagtggtcttgttgctgttccctgaccacaccacaagttctcccgactccacatgccggctcctcttcctccacctcctcttccacctactgtgcccagagtccaccacctggctcaaa

SEQ ID NO: 26463 - DNA, 201 bp, Bos taurus
aggaggaataaggaaggaagactcatcacatcagttttggtaccctgggggactgctgctagcccctcacgggcacccctgcaccgaggaacccaagatgagtaagtgctgaacagcctgtcacagccacgtcacggcagagggggggtctgtgggctgttagttcctctcggtgttcacagggctcctggcctccaggag

SEQ ID NO: 26464 - DNA, 201 bp, Bos taurus
tgattttgcttatttttcagttataagattcaagtcttattcctttctacatgagacactattagctaagtcatactatgatttttttttaattttaggcgattttaacaccttctagtcttcattagaaaatgagtaaggtaagataagtgtataacaaacacaaggttttatacttgcctgttgtgaatgacttgcaat

SEQ ID NO: 26465 - DNA, 201 bp, Bos taurus
ctgttctacatttcatcactaagataatattttgcatcattaaaataatttcctatcaccttggagccatctatgccacttctctcaacagtaaaaatatctaatttaagcattctgttttactggccaagaaactgcattcaaaaggtaaaagagataaattgtgaatccagtatggccacaggcaaattagtgacatgt

SEQ ID NO: 26466 - DNA, 201 bp, Bos taurus
ccgttgtttctggtggtgtccagtaatggtgccccgtgtatttggtgttggcattgtaaaccaaggaaagtgtctagctgctgaggcccttctaaataaacccaccaagagttggttaatgtgtattgcaatgaaaaactccaatgtatacacatgtttcctgaattttttaggtcatctccctcaaagcctcatcgtttg

SEQ ID NO: 26467 - DNA, 201 bp, Bos taurus
cttttctcttttgtattttttccttgtttttttaaatttatttatttaattagaacataattactttacatgaatcagccacacgtgcacatgtccccctcgtcctgaaccccccacctatctccctccccaccccatccctccgggttgtcccagagcaccagctttgccctgcttcatgcatcgaacttgcagtggcca

SEQ ID NO: 26468 - DNA, 201 bp, Bos taurus
agtcaataaggttaaatgcttttctgatttcttaagtgtgattttcagaaacatcctcagttttattcccctacggcaatgtatctgtcatacccaactttggataagtgtatccactctatgagatgagaaattgagtactgactggaaacagatgttgctgcttttagaaatgaaatggcagatagacatttggaaggg

SEQ ID NO: 26469 - DNA, 201 bp, Bos taurus
ccaagttcatacactgaaaccctaactcacaatgtgatggcatcaggaggtgggggccttggaaagtaattaggttcagatgaggtcttgaggcctccattatggaattggtgctcttctaagaagaggaagagagcaccctccctctgtacattatgcactgaggaaaggccaggtgaacacacagcaagaaggtggctt

SEQ ID NO: 26470 - DNA, 201 bp, Bos taurus
ctcccaatggatctttgcaacccagggatcgatctcacgtctcctgtatctctcgcattggcaggtggattctttactgctgagccatctgggaggcctccgtgtgtcctttatacatgccctaatacagtctcagtaagattttctgttagttgcctcttaggctagcaccttactggatataagaacccaagccaaggg

SEQ ID NO: 26471 - DNA, 201 bp, Bos taurus
tctttactttattgaataatttatacagaaataaattctgagaacactttaatatcagattactaatgtagtccatggcctattgtgtcttacttataaaactttgcttaaaaggtcaagtgaataaaatgtcttaacttataaattagaagttttaaatcttcatctctccagatacaaaaaaaaaagaatatttttaac

SEQ ID NO: 26472 - DNA, 201 bp, Bos taurus
ggataaacctggctactgttttcaagctcatggaggattttacagatgggatcaaacagttattccctgtgacttctgaaggcctaattcaaagaggaaactgaattaaagcagaaaacactctggctacatttaagggagaatttgcctgaggaatgataaaaccctgacaaagactaaaaggccactaaaggatgagag

SEQ ID NO: 26473 - DNA, 201 bp, Bos taurus
gaccattttcttatactttgtatatcagtctcacaacattttgggaaatccatgaagtactacatgttctggaatacactcacacctgtaaatccatagcagtaaaccaaggttgaaaagcaaaagtactgtataatataactgaattatgtatcattgtcaaaaggagaataaaagtaggaagaaaagaagcatgaataa

SEQ ID NO: 26474 - DNA, 201 bp, Bos taurus
aggtgtgagaatacacgcaactatggcaggtcctagtacctaacttcagcggatctgtgccatcagagctgtgctggtggctgtgtgagccaactgcctgcattccagtgggtgaggaggggcccgggtcagtgcccacaagagtgcacgttgtaaatgcacacatcaggcggctggcaacaccacagagtgcatgtcttg

SEQ ID NO: 26475 - DNA, 201 bp, Bos taurus
ctgccatttataacacaattactattgaaaaatgtgttcaatttaagcaagctgcttatgtggaccttttggaattcaagtaggttgggaacttgctttagaacaaaaatataaaagcattaagacctcactgtggtttccaaggcaaatgcaggaatagaattctgatacaaaactatattgtatataccttcctccttt

SEQ ID NO: 26476 - DNA, 201 bp, Bos taurus
catgagaattaggacagagagcaaggcctgtggaagccttggctgcccatcttgcctggcacgtctgtggaataaccctgctatgccagggctctgggaacgttcctttgatttcagaggtgtcctcagggcgagtcacatgaccaggttgtcctgatagatagtaaactccaagggaccttagcaccagggctggcagat

SEQ ID NO: 26477 - DNA, 201 bp, Bos taurus
tttgctctcaaggaggggcctgtccttggtcttggtggtcggtgctgggaagggcacacagatggagagacgcctcctgggaagcacagcagtgagagagcatggggtccctgaggccctgtgagcggtgagatgtgtctggtgggggtttgtgtgggcggggaaggagatgaagggtgagaccactgatgaatgaggaat

SEQ ID NO: 26478 - DNA, 201 bp, Bos taurus
gcagctttataattcagcaatcaaaacatatttactatcatgcagaagaaaaaaaatgttaattccaagggaggtaaatgaagaatgtaaaaaattcctccgaaacatataaaatacttttaatagcctctctaatatttgcgaatagttagaacccctttccactcatatttggaatgcattggcacatttgttgtttaa

SEQ ID NO: 26479 - DNA, 201 bp, Bos taurus
taaacctcactacaatcctttatttccaatcaggaatattgtcattagagataaatttagaagaagatagatttaacagtacctgtatccattttcaaggggtagtgctgaattcttcccatatcttttcactggctagggttgagttttgagctgtcttatttgtgattgcttttttaggggctatctgttagcaactga

SEQ ID NO: 26480 - DNA, 201 bp, Bos taurus
taagtcagtgaaatgtggacatataggaatgattacatcagacgtcagaggatggaatttagttgtatcaaaagagggcaaagaatactatcctttcatcattcttgtttttgaaatgtctatccctttcttattattttattgtctgtgatcattgcagaagcatcagtaattacagagaagctgaatagtttctctgga

SEQ ID NO: 26481 - DNA, 201 bp, Bos taurus
taacacttcagattaagggctcaggattgtaacgtgtttccttcttaattgtttgttgcaatgaagaataaaaatataattattcattcatataaaatttcgaaataggatattaaacaagaacagtgttgtgatcatctgcaacctttccacaatgtctagaagaaatcccttcacttattcatagtacatattaaaatt

SEQ ID NO: 26482 - DNA, 201 bp, Bos taurus
gtcagtggaagttatttctataatctgtactaactcaattgtctgagtataaaaatattccctattgacaacatggccttctttttctcctaactttgttacctagctgctagtagatgttaactctattgttctcagatgtgtccactcccaagatccaactcactcagcaagctttcattcattattaatggatggaat

SEQ ID NO: 26483 - DNA, 201 bp, Bos taurus
atgatttggggtaagaaatgtggaaatctgtggatagtaaaaaaaaaaattgaatttaaaattttactgcatcttcaatgatgtaccatcttaacacaccaatctcttctaccatatatacaaagcagaagaaaataatttcatattcaattttaaggacataaaggctgtctaactatttcaaatgaagtacttattctc

SEQ ID NO: 26484 - DNA, 201 bp, Bos taurus
tgaccaaattaactgggtctgccctgatacagaattctgtccatggcagaaatatttggtgattagggaaatggagtgactactgcagacagccagaatcccattaagcatggcacattaattacaataaatgaaaattggtgcttaaaagaataacttttgtgaagtatccatatttaatatcagggagtggcctgagcc

SEQ ID NO: 26485 - DNA, 201 bp, Bos taurus
cctgttggcagatgaggaaagtaaggcccgcagaggggaaagaacttgctccaagtcacatgtctattgcttagggaagctgacccactgaaaaacagttccggcctcatttgaaaacccagtgtcttttgattgaccatattgttctgtggcagacgcctgtctgtggaccttttggaaaatagcttagcgatatcacca

SEQ ID NO: 26486 - DNA, 201 bp, Bos taurus
atatatgattgaatgaagtaaatgctcatttttgtgtttaataaaaactctgattcttctattcaggctgatttttatctgtatcttcaatttccacttacctatggtttggggaaatagagataacttggatacctaaattctgtctacaagtatttcttgagaatctcttggtcattaactctctagaatgaaactggc

SEQ ID NO: 26487 - DNA, 201 bp, Bos taurus
gccctaatcaaccacagaggattacatgcttctacttgtgtctggtaggaggaaatgttagccaacagatttactgaccactacaatttctatcttcaaaattaattaaaagtaaaatgatttacttctagctaaaaaatgaattatatgttccatattcataaatgtgatatacaaatattcatgtgtataatatacaaa

SEQ ID NO: 26488 - DNA, 201 bp, Bos taurus
caatttactttccttttttaatctgcttttttggcagtgaaacttcttccataattatatctctccacattcttccaaacccactccaagatccacatcttcttgctgtatatccttatatgttgtgttaccttaatattctgaaatgtatctttagttcatattgacctctgaaaatcatcccaattcaaataatatgtg

SEQ ID NO: 26489 - DNA, 201 bp, Bos taurus
ctcaaaacatcctattaaccatttttctaatagggatgtcattttttttttaatgatcccttttcactctttaaggttcaagttaaacctgaccctgcctgggatcctaaaataatggctctctcatctcaactgatatgaggcatttaacctcattccttacatggagttaagtcatcaacaactattttcagattggga

SEQ ID NO: 26490 - DNA, 201 bp, Bos taurus
agaggagagtggtcccagggtcctgggaagatgagtctgggcctgcaggacgggagcttgaagctgtgttgagctgtaagttacaaaggcaccctgtggttggtagtgtagagttcctgtatctcttcatctcttttaccagtggaaagtgcctaatatgtcctcatacactcttcccattgtccctgctctgagataatt

SEQ ID NO: 26491 - DNA, 201 bp, Bos taurus
aataggttgggaataggagaatattatttttccagctaattactactcagcttgtttttaaaggctttctcctaaacccgtatctctcctacttgttctgttgggggagtgtgtaatttcctcggttctgtcttgtcacaacaaaaatttgaagcgacggaccagtattacagctccgtgttacagctcagttttatttgg

SEQ ID NO: 26492 - DNA, 201 bp, Bos taurus
cccctcatttacctgctactgacagaaataagcacaatcactctttagattcacccagcactgtctacaactcctttgaatgggccagtttatcctcctaatccacaggaaggctagctttttgcattaggactgaactaaaaatgctgtctgccatatcagttaaaagaaggatgctgcggccctcaagtcacacagtca

SEQ ID NO: 26493 - DNA, 201 bp, Bos taurus
gtaaagtgaaagaaggtttgttcagggaggaagcacactctgcagacaggatgtgggtcatctcaggagtcaggagaggcatgagaggccccagggtaatagggttgtcagtttttataagggtgggtatacttataggctaatgagtgggaggagtcagccagctattttttggggaagagatcggaatttccaggaatt

SEQ ID NO: 26494 - DNA, 201 bp, Bos taurus
atggggttaccatgagccagacacgactgaagcgacttagtgcatagacagtgaatgagaggggattgatgtgtgatatttccaggtctgtgctctaaaaatttcccctttattggccatgagctgccaactggacacggacttctcccacttctcctttcttgacgtgaggggaaacagcaatgtaactatgctaagcca

SEQ ID NO: 26495 - DNA, 201 bp, Bos taurus
cttcacagtcctcctggggatattgtgttacctctgcaccatctctcaatcttttttctttctgaatcattttaattcaatttatgaaagtcacatacacatgtggtctgaagcaatgggtagcttttcactgttgaagcctttccttggcaggggagagacagcctctgataatggcttcccagatagctattcaggagc

SEQ ID NO: 26496 - DNA, 201 bp, Bos taurus
aggagcccttatttttgctgtttgggcagagccccttggagctgatctgacacttcaaagcagtcccaagggtcttgcagtcagagaagctgaaactaggaatgaacctgatgagattctgaaacagaggtggtccctgagaatgttcctttctgcagtggcttatttgatgattttattccttcatgaatgatgtcttga

SEQ ID NO: 26497 - DNA, 201 bp, Bos taurus
ctcgacttggctgcaaagcacagctttctgattgggacctaaccaatgaaacagacagtgatagggtaccgagggcctccaattcaattctgcagggtgtccgatcttttgaacatttatattagcaatatgttatctacaaaatctatgacacggaaggccaaacttctcttttgatttatagctctcgccgtctggttc

SEQ ID NO: 26498 - DNA, 201 bp, Bos taurus
tacccacttcagtattttggcctggagaattccatggacggtacagtccatggggtgcaaagagttggacatgactgagcaactttcacatcaagtgttcagctatattttggccccaggctattttctaaattagataattgtgatcaatagtcagcttcatcactgttgtccttgttgtcaccatcatcatcactggac

SEQ ID NO: 26499 - DNA, 201 bp, Bos taurus
caatattgtaaagtatttagcctctaattaaaataaataaatttatattttaaaaaatcagacaaaaaataaaagccaaagcattgcttaattatagccatcaacaatttgaaaatagttgtacacagaatattacttgcagcactgtttgttaaagaaaaatattggcagcaacatgcccaaatgaacaaggttagttga

SEQ ID NO: 26500 - DNA, 201 bp, Bos taurus
aaaaattgattgtaggaaggaaagagaaatgaatagcaagagtccactgtatcattgtgttgatgttctcctaatcccaggagggtgcttaggccattctaaaaccaaccaagaaggaagcttggaggacaggacacttgactcagacctgagggtctcagtgttgtggtgagctgcttttctgacaacagagttaagcaa

SEQ ID NO: 26501 - DNA, 201 bp, Bos taurus
agggatgcacaaaataaatggagaaaaagcaaggatgctcacagacacagttcaaagctagggcggcttgatgctgagatatgaatgtaagctcctgggaatgagtttggcggtgtcactctagctgctgagggcgccctgcttgccacaaagcaaacgctgaatgctatttttgcctttttttttttttttcacgtaaaa

SEQ ID NO: 26502 - DNA, 201 bp, Bos taurus
tgacagactgcattttcagaaatacacgcttggtgtgtcttaagaacttaacagttcttggctctctataacatctcaatctatttaaccaaactaaccaaactggttatttcgaaggattctatcgctaacagtgtagaactcctttacataccaaacatacctaaaccaacccacaggccagagcaaatgaagcaagga

SEQ ID NO: 26503 - DNA, 201 bp, Bos taurus
gctactaacttacacctggattcatttctggaagcttttagttcaaataaaccaacatcagtatcttgttcaaaggtctttggattgagtatcagattccctggttgtttcttggcgtgtggggccctttcctacatggtacggaaagatgccttgggacaacatgtgttggaatgtgagggaaataatgtgcactgacgc

SEQ ID NO: 26504 - DNA, 201 bp, Bos taurus
tataagtaagacctctgacctccactcctgtcagaggtgttaggtcctttcttaaattcccagagttccaaccatccagtccttggttcattgtttatgctgtttggacaccttttccactgctgcatggaataagtatctgagtattttactgttcggctttgtataagcttatatttgaaatcctccactggattagac

SEQ ID NO: 26505 - DNA, 201 bp, Bos taurus
tccttgcattgaatgtaaacaataaaacctctttatgaaggctttcctactttactcagaagtaggctaattcatttcacatatacctgtaatcaaacattaggcttaataaaagtgtacgtttattaaagagatgattatgtaggttaagtttcccatagtccacctgcccctcaactatcaaccttcagaagaaaacta

SEQ ID NO: 26506 - DNA, 201 bp, Bos taurus
ggtaccgggcagagagaccttggccataggaagagaaaaccaagagaatatgccttgcagttctgtccctcagctacaggggcagaaatgatcatttattagctccagaaacttaaatggccgttagtgcaagggacccagggaacagatcattgcacagatctttgctttttacaaagtggctttcagtgtgctccatgt

SEQ ID NO: 26507 - DNA, 201 bp, Bos taurus
gtgagaagaacctggccttgaaagaggagtggggtgggttcttggaagagggaagagcatggcaaagatgctgaggtaggaaaagcgtggcagggtggaggtgaaggcagatggccagggtaacaggatcctggagaatgaggaagaagggggcatgagataaaaaggaagggtaggcaggggctagatgtagacctggga

SEQ ID NO: 26508 - DNA, 201 bp, Bos taurus
cagagttcctattctttcaagtctaggagatttaagatatttttctaaaatgaagattaatgctgacaccagacaatggaaattaaggccccttgaccctcaggagttccccaagcagtggtttagctgtatttttcaagtatacctgggttgaagatcagcctactgccccatcaccaagaatcagaggattaagggctg

SEQ ID NO: 26509 - DNA, 201 bp, Bos taurus
atggccgcattccacaatcatagcctcaggccctttcttccatcaggttatctgtcatatttatggttgacctaaaatcccatctctttgaatagccagaatggccatggaaattttagtgcttcttccctctccttcctatattttagtttttctgtcttcactttcttaacttttagatgtttgaaactcttgtttttc

SEQ ID NO: 26510 - DNA, 201 bp, Bos taurus
acagtccatggggttgcaaagagtcggacacgattggactaattgagcacattattaaaacgaagttccttttatgaaaatgctttctagatattcatcactactgaagttcaacacagacatgcttcttagaacagcaaattccatttcccagcactactgcccaccccatgtccaatagagatgctaactgtggaatgg

SEQ ID NO: 26511 - DNA, 201 bp, Bos taurus
gctccagagaggcagaagcaaagagttaaattgctcctctcccccgaaaaagggcacacaatttagctgacagaaggcccaagaggctatgtaattgagataacgagtcatgaaagtggaaagtggcatggagtgtatatcaagaatccagttgggccaaagacatctccatagatgcttaatgtgggggtgatgacacct

SEQ ID NO: 26512 - DNA, 201 bp, Bos taurus
ctcaggcaaggccacaggtgagcaagaagcaaggctcgggctcgaagcaggtcctctgcaatgatcctgctccaaacactcagctctagcctcagtactgggggtgtcccctcacaggcccaggccgccaggggaacattaaaatgacatcatctttgaccaacacacatggcatagaacctgggcgcgtgctaagtcact

SEQ ID NO: 26513 - DNA, 201 bp, Bos taurus
aaaataaaaacagtgttaagccataaaacacatgcaagggagtctaatgatattctattttacttttcatgctttttaaaatacataatattcttcttctatttttaatttctcaaaattttccttctgctttgctagtattctcagcacatgcttggtctcttgctggttctcctcacaatcagaaagctctcttcacag

SEQ ID NO: 26514 - DNA, 201 bp, Bos taurus
gttccaggagagttgcagtgttttgttctccatgccagttcattagcagcagaacggctgccgggctgtaatccaacctggctgacatcagctccccagtgaaagaaggacagagctggagctgcgtctgtgcagccaacagggatcaggagggctcggctgtactgacacgttggcaaaaaagaaaagaaaaaaaaagat

SEQ ID NO: 26515 - DNA, 201 bp, Bos taurus
acatccgtacatctgtatttgtttgagtacctgttttcatttcttttgagtatatacctaggagtggaatgctggtcatatggtgattctcggtttagctttttgaggaactgccaaacttttcccacagcagctgtactgtttcgcaatcccataaggaatgtacaaagattctaatttctctacatactcaccaacggt

SEQ ID NO: 26516 - DNA, 201 bp, Bos taurus
aaagtggaatcgtaaatacaaggagtggtgggactctcctgacaaactgacaatgtattctgttctttaccctgtttttaaactcagaaaatctgcttggtagtgctagtgattcttaccttacaaaattttaggtcaccaaaaagtgcaaatatgatacatccctgtaatgcacagtcttcttttttaagataatggctt

SEQ ID NO: 26517 - DNA, 201 bp, Bos taurus
tccaactcttacatccacatgtgactactggaaaatagtctgcttcattttatattatgtcctccagtggactgagaaaatgtgatcttgttcttcctttaaacttcagagactgattcagtgttgaacatgtggtaagaattcaataaattctcatcgatctagcaaataaatagatgaggatacgtgcaatgtcatagt

SEQ ID NO: 26518 - DNA, 201 bp, Bos taurus
atggtgcctatcatatttagtttctatttttcatttggacatagatttattacatagagagacatggaaccttgcacagatcatggttgccttacaataagtcttagctaaagcctgaatatcatccagagaaacccatatgttttgtagcaagcttattcctagacatgccattttctctaaatgtggccaaatttggtt

SEQ ID NO: 26519 - DNA, 201 bp, Bos taurus
atttagatttaggaagtctaaagtggaggcagtatgctggaatttttatacaaagctgccagatgattctactgttcatctaaggattagaaccccattgttaaaggactacctcctttgtatgttctcttgctgtttgcactcaggaaacattctttggatcaataaatatgaaagggtcctttcactgttgccagggca

SEQ ID NO: 26520 - DNA, 201 bp, Bos taurus
aagttaaacctggctcttttacaaagagtgtagaggcgggtgttgaccttgagagttttgtcaaactggtttggaatataagcttgcacagacctagagtcaagtaactgagcagtgaaggatattcatagcaaactgtgtgacctcagtccccttggggtttggttatgctatggagggaatcatgtctcaccaatggac

SEQ ID NO: 26521 - DNA, 201 bp, Bos taurus
ggggacgacacagtggtgaagagcccactctggatgtcatggcttctcccaccagagtcacttggtcaccagatgccaccagagccagccctggggcccctacccagaccagggagagcagtcaccctctgatggtcatcatgccactgtcagtggtgctcttcctgctaatagtaaccgtggtggcctcatgtgtctggc

SEQ ID NO: 26522 - DNA, 201 bp, Bos taurus
ggctgggccaccgtggtgggcacggagagggtcttctgtgcccagagcgcctgtggcttggtggtctagcctacttctgtgccacccttaggagcgttcagtccccctcggccccaaggtcccctgctctggaggtggggacaggcccagactgtggcgttgaggcaggtggtgggcacacctggggcccggtcgccagat

SEQ ID NO: 26523 - DNA, 201 bp, Bos taurus
attaattaaaattcatagcaactcaccacccacagcaattggtcagcaatagtcaaagggcagaacaaaccccagtggtttctttacctctctgtgtgtctgcaggaatgctcacagtggacgctgttctgaagacgtcttttctaagccccagagcaagatgcactatctcatggccagttcatgggcttcaaagcttga

SEQ ID NO: 26524 - DNA, 201 bp, Bos taurus
cagcctttctgtctggattctgcactctgcctcttctacctgctcgttttggctcctggaccctaaagtctgttcacatctgggcctcacttctgcgtataagctaactgctctggatgaccgagcactgcctggctcatccttactagtggacatcccagatctcctggaggctttagctccagcggaggccctgctgtt

SEQ ID NO: 26525 - DNA, 201 bp, Bos taurus
tgttatggagtggcaagacacactagtgggtggggggaaggtaaaagcagaaaaggagacctggttgtgccacagtcaattcatgtggaaggaacataaatgggtgctcactgactccatcagcctgccaaagagaatcctgaactttcaaatccaataccttattccttcctctccaaaaattcttttttgctgtttaga

SEQ ID NO: 26526 - DNA, 201 bp, Bos taurus
tttagatgtgtgatttggaggtaccatgttggaagtacattcttagagcctaaaggcagtgtcggaattggagatttgtgaaggagacagaggcctctgtgtctcttggttcactgcactatctatccctgttgctcagaatactgcctgacccagagtaagcttttagaaattgtcagatgaatgaatgtatggatggat

SEQ ID NO: 26527 - DNA, 201 bp, Bos taurus
tttctgttgaccactgccagctgcaggccctgcagttttcggtgcatctcgtcaatttgctgaacttctctgatatattggttttgccagggattcagaaagctgtagtgggccacacgggcagcagaccaccagtgaccattacttttttttggtgcaggtttggctttaggaagtgcttttggagcttcttctcgatcc

SEQ ID NO: 26528 - DNA, 201 bp, Bos taurus
acagtgtcctttggtgactctttttgtagccaaatatgccaggccctttgaattcaaaaatgcaaatacttaagttctgtggaacttccttgaatgttttcttttcttttcttttctttgttggccctcttagagtgatcttctaatttttgtcacttttatcttgtagttttcatcactttgccctttggtgctcttttc

SEQ ID NO: 26529 - DNA, 201 bp, Bos taurus
ttcgcagaggtgagacctgcagttccgggtgagaaatgtcaggcagggatcaggaaggtgtcttcagagcccactgaggcctcctcctaactgtgctgtccagtctagacaagcttcttcagcaactgggtggactcatctccagctccaggcctcctttgtctatgtctcaactgcttagaacttggcatggaaaagaag

SEQ ID NO: 26530 - DNA, 201 bp, Bos taurus
cagctctgagacactgcagacatcacagtcagtgggccaacacaccagctcaaggactactggggttctggaggcagaggtcccacaatttacctctgccaagcaatgaaccatcactaggcccagaaccccttggccctacccaccagtggttagacaccagctctagaacccctgggccctgaagcaagaggccatgag

SEQ ID NO: 26531 - DNA, 201 bp, Bos taurus
actaacaaagtataattaaccacctttgaaatctatttactctggcaatcactaagatcaataactacattttgaatacttttaaccaaatccatatactgcaagaaaaaaaaaaaaaagaggcaatgaaaagggtactcaggaaaacctgaaatattagaagtattagaaaacgtagctatattacaaggaaatgaaagt

SEQ ID NO: 26532 - DNA, 201 bp, Bos taurus
atatatatgtataactgattcactttactatacacctgaaactaacacattgcaagtcaactatatgccaataaaatttttttaattaaaaataaattgttaatttcaatatttgttatgatattttctttcagatggcagtgaagtgtcttgtcctaacaaaaattagaatagtgtgatagtttaaaatatcttgaggaa

SEQ ID NO: 26533 - DNA, 201 bp, Bos taurus
tgaaggccatgagaatactagaacctcattaaaagtttccatggggtgcatgcttagctctgttactttatgatggatgtgagacagcaatgagctgttctgtaagtgtcctcccagtggccaggcatgccaggagaacaattcttacagttattacctactgagattttaactgatttccgtttgtgcaaatattgctgt

SEQ ID NO: 26534 - DNA, 201 bp, Bos taurus
agatactttgaaagctttttaggaaaatgaggaagaaggagatttcttttccttctaataatgcaacagtttaaggatgtaggctgtattccttaggccagtgatcaggtatgcttaagtggagggagatagtgatattgttgacccatggtctgttgcttatctcaggcctggggaaataaacccagggctaagggcctg

SEQ ID NO: 26535 - DNA, 201 bp, Bos taurus
ccctataagttgttgtatctgagattccagctgcaacacacttatttctggaatattgctgtgttcaactctggatacggtaactggtattaatgtcctttgtggcatccatgacatatgcaggtatgggaatggtggacaacctcaaggagacatggtaggaggtttagtctcatatatatgctcaatcccttcaagact

SEQ ID NO: 26536 - DNA, 201 bp, Bos taurus
tagcagagatgatcagagggcccttttgttagtgtgacacacagctgctcgtgctcctgagtataacacgaaggtcgcatcctcctgctttttctaaggcgaattgcttgtgccctttggccagaaactctgccctgtggaggtggaacatgtccccataaagctgaccctagattctgcattgtcctcatcagctcctta

SEQ ID NO: 26537 - DNA, 201 bp, Bos taurus
gtatatatggatacagatacagatgtatagatttattgcggggttggtggttcacaccattatggaggctgagaagagcagaccagacccaggagagccaatggtgccattccagtcccagtccaaagggctgagaagcagaagagctgatggtataatttccagtccaggggcaggagaagactgaggtctcagctgaaa

SEQ ID NO: 26538 - DNA, 201 bp, Bos taurus
cagaactttctcacagtcaaggtcaagtccaaggtatgggcagattcagctcctggtgagaggctgcttcctgactgacagagggccattgttgtgatttcacatgacacagagagagagaaggagaaaatgtcaattatatcgaatcccatcatgagagctctggccttacagctgggttatctcccaaaggctccatct

SEQ ID NO: 26539 - DNA, 201 bp, Bos taurus
atgagacaagacttaccccctgctggcccaaatatgcagagtttgcaatggaaatggagagggattctgtcctataactcttagatgctttacaaagtcagaaaacttttaaaggagggccagagaattctgtaaaaagggagaatcttggccagagtagtcatgctcttatgaagctcttgaaccatgctagggaaaaag

SEQ ID NO: 26540 - DNA, 201 bp, Bos taurus
tttataagtttatcagtgattagactgcattgttgagagtactttctaatatggctaaaacagaattttgctgaaacaaaccatactaaaattcagaaattatttactatacaaaagtaggacatgttttaagaggaatttctcatactgaccttagcatagctggaaaataaactagaccttagaactggttctgagttt

SEQ ID NO: 26541 - DNA, 201 bp, Bos taurus
ttcaacttttagatacaattcaaatcaaattagtttacacgagcagagtactttctgttgactaaattgtattttcagtttattcacatattgcatgtagattttaccaagctcaggggatgtgattacttagttatttctctaatctatttcctccatgctactcccctccactactttatgtgagggacttgcagtttc

SEQ ID NO: 26542 - DNA, 201 bp, Bos taurus
tatcataggtaatatgcataatacatggtaacaagatactataggtcataggttgaacttctcctttgtgaacacagaaatacatcgaaacacaaatgttctttttacatgaacaaagttcccagagtgggagaggaagtgctccttggaccctttggatgacattgttaactctttgctagtatctcttcagtataatag

SEQ ID NO: 26543 - DNA, 201 bp, Bos taurus
tgatggatatgtaaagatatctgggaagtcactcgtttgttagggtcctggctggccttcttaaatgtcatgaaatttaagtgtgaaaatggccataaattggacacatgaatccacatctatcagtgagatagatgccttactccactagtatccttgatctgatcgtaccccatctccaccctgtcaccgtggttctca

SEQ ID NO: 26544 - DNA, 201 bp, Bos taurus
taatacaagccttaggcctcttttgttgtatttattccaagggagtgtacaggttttgttgctattctgaataggaagtcatttttcactacatttttctattggttatttatgttatattagaacataacatttcttatataatataagaatatttggggttctgctacctatagtaaccttgtcttattagcttatata

SEQ ID NO: 26545 - DNA, 201 bp, Bos taurus
atcctttctttatcacgtaattccatttgaccttgtttgcatatggggatcttcagaacctccacttcatttgttgtaggtagagccactaggccttcgctgctgcccacatgtgtgctcctgtagttcagtaccgcctcttgacagtgacaggggtaagagtgaacatatatataatttgttgccatttacatggtgctc

SEQ ID NO: 26546 - DNA, 201 bp, Bos taurus
ctctccacggaatactctaggcaagaatactgaagggcagccgttgcctccttccagggatcaaacctgggtttcctgcattgcaggcagattctttaccgtctgaaacaccaacgaagtcttcaggggcttactaaaatgtcatggtctcagttaattttactctgatacctatctaatatactccccaacatttcatat

SEQ ID NO: 26547 - DNA, 201 bp, Bos taurus
aaggcttaatgaaaatgggtaaagtctatgggccaaattgcaaatggtgtgacataagcattttccaaagtagacattcccctaaagatacacaagtagggggagtcaagttgagaaacaggcctaaggtttcagagacagttctgaaggaagtgaaagtgtagtagtcactcagtcatgtttgattctttgcaaccccat

SEQ ID NO: 26548 - DNA, 201 bp, Bos taurus
ggagaattatcaggctatccaaaatgacaaggaccttgtggcacctcaagtctcagaggttagaagtgagccagactctccagctgaggttgaatggcactagattctgtactgaatgcacacaagatgacttctaacacaggaaaagatttcagcaagggcaagacaaacacaatgttaaattcagctcaaaaacaatag

SEQ ID NO: 26549 - DNA, 201 bp, Bos taurus
aaaataatgataaaaactatagccagtgcaataaggtaagaaaaataataaaaatgtttacagatggaaagaaagaagtaaatggtttatatttactgttacaattattatgtaaaatattacaagaggcttcccaggtggtgctagtagtaaagaacacacctgccaatgaaggagatataagagatgtgagtttgatcc

SEQ ID NO: 26550 - DNA, 201 bp, Bos taurus
gccagtgacatctactactatagcaatgactctacgatttcatcatgttctttgttagatatagagattccaatctgaagcggggaacggtctcagtcttcttcatggcctgcgtcttttctgtcctcatctgtgctttatttggctgtttactctaaatctttcctttgtctttttcctttctctaatacccctttcccc

SEQ ID NO: 26551 - DNA, 201 bp, Bos taurus
tttccacaggcatcaaaatagaaaatgttccaagctgcctgaatgttctcaattggtttttagggcaaaatggaattcccacttgtctcaagaacagaactcaatgtctcaatgtacagaaataaattatttactttgtgtggctttccaaggatgcaaactggaataagaaaaacagtcaaataagtttaaaaaaatctg

SEQ ID NO: 26552 - DNA, 201 bp, Bos taurus
actggaacaaaaccagggtttccctagcctactttagccctttcagctcaaggtccctatgcaaattaggtaggattggtcttcatccagtttcagattcggtgtggtagagtcttacatgagctgtgctgtaattgttggagcaagacattctggacaaggttcaaaatctttaggagaatagcttggagtagaagtata

SEQ ID NO: 26553 - DNA, 201 bp, Bos taurus
atttaggtatgaaattcatggcctctgccacagatactagagtaaaaatgaggagtcagaaaaatgcttgggattttctaggaagcatacattttgtatgggttatgaagtacttgaaaaatagtagtagatccaaggcttaaagccatttgtactgatttgataagtaatggagagccattgagattttgagtatgtcct

SEQ ID NO: 26554 - DNA, 201 bp, Bos taurus
caaaaccagctgaaaagtctagtggagacacagattaaaagctctctttagacacaaaaattctgaaaagtatctcatgggagctttcttgtgtatagctagggaggaaatgattgattctataaaagtaaaagtgaagagtaggttcagatgttgaggtcaaagacaaggccaaccctgacctaaacaattatattttat

SEQ ID NO: 26555 - DNA, 201 bp, Bos taurus
ttccagagaatagcaaggagagataaaaaggccttcttaatgaacaatgaaaataaatagaggaaaataatacaatgaaaaagactcttaatctctgcaaaaaattggagaaatgcaagaatgggcccaataaaggatagaaagagtaaggacctatcagaagcagagagattaagaagaggtggcaagaatacatagaag

SEQ ID NO: 26556 - DNA, 201 bp, Bos taurus
gagattattgtacctttctttgagctttttttcactttagacagatttatttttagcagacctggacatttttgacatttcctattattaacagtattggttcctttgatgaaggaagccttttaaaaatgagaagcttatacttgttaagcttcatttatcattctttgaaagaaaatctaattgtaagtcatttggaga

SEQ ID NO: 26557 - DNA, 201 bp, Bos taurus
gatctgaagacacatgtaattgagactgggaaagtatttagttcccttttgaccaaagactgtgagatgatcatgggccatagcagcagatgctacagacggaatagtacatcactaggcaagactagaaagaactgagagggtagctcatgaaacagaggcccctctcatcccactcttataattttttccttttaattc

SEQ ID NO: 26558 - DNA, 201 bp, Bos taurus
cctaatttcatgtgttaatctttaatcagcatatttgaagaaaagattttcagtaatgtggatgtggactgcttatgcaaaccacaatagaaagagttttgagactcacttcaggagtttatactttcagagtcaggccatgaaatgtttatcacaacacagttgagctgttcatcacagtcttaaaatgcattcttcctt

SEQ ID NO: 26559 - DNA, 201 bp, Bos taurus
tccttacaagaaaagaaagaaaagcaaaagtctgaaaaaaaaatcttctaagagccatttggttaaaaaatcatatgcatgtatatattacttctgagcacggccttgtctgccagaacaagaatcagattccccaacagtcagtctctcctattaggaagtttgcataagcctcttatcctcatccatcagaggtagaga

SEQ ID NO: 26560 - DNA, 201 bp, Bos taurus
aaaagccaaaccactatgtgcagctttctttggcctcaatgcaaataaacaagaatttgtctgcgccccgttggtatctgatgggccactttggaacgctctcaaaaagtgtgcagcacagagtcctacagctgctgccggttagattggttggttggagcacagtactatgaggccaagattgtgggtttgggtggtttg

SEQ ID NO: 26561 - DNA, 201 bp, Bos taurus
agttaaatggaaactaatgtcatcaaatttttttgcccatgctgcaagttatacagtttactcttttctactctttttcattcagacaaaaaaacaacctcttaatttattaagattaaaaaaaaaacaaaacaaaaaactggccttgatccattaaattgattacacagccctctaatggattgtgatagtttagtttga

SEQ ID NO: 26562 - DNA, 201 bp, Bos taurus
cacttaaaaggtgctgcgttgcagattgactgatgtacagaaaaaagtactgatagagtgcccaggtgaggcacatggtttccttagtacctaaaaatccagtgaggtactgggcctcatgtctgggggaagagggaggaggtggagaagctgttgttgttgtttttaactgctggagggaattgcatgttgtgaatctgc

SEQ ID NO: 26563 - DNA, 201 bp, Bos taurus
catagcttcagagctgttgtcagttatttctcttagcccttgattccaggaacaaaccattttgtctttatttccaacattatttcttggggtgggggatactgtttaagaaaccagagttagagatgaggacttgggcacaagtaggagaaggcaatggcaccccactccggtactcttgcctggaaaatcccatggacg

SEQ ID NO: 26564 - DNA, 201 bp, Bos taurus
ggcctccttaggaagtagttctaccaaggtcaagtccaagatccaattagggcagaaagactgaagtaacagtgcctcagacgtcttcagctgcccagtgcgcggcaccttgaatataggcgaggccccatatacatatccatacagatatagaatgttcaccaaatcagttgaacgcatttgtttatgcaaaaatagtta

SEQ ID NO: 26565 - DNA, 201 bp, Bos taurus
ctttggggaccctgctgtctaattcttgacagtttctcttaattagagttcccgaacccatcagagatttgaattacgttgaacttcaaggaaaaagcaatccaatgtctctatagctttccttctgtggccttttgactctcatttaaatttatcaaccttcctgagtttttcccaaaattattttgagcttagcatatt

SEQ ID NO: 26566 - DNA, 201 bp, Bos taurus
attaaattctctaagcatttaaatagttaaattatttttgtattcagttattatacttccctgtacactttcaatcttttatatggaaggcaactgggccgacctggtaacaatgagggtaatatcttaactcactggttataggttttattttcagtggttttgacatgtggccttcgattaagtagtatgatgaaggaa

SEQ ID NO: 26567 - DNA, 201 bp, Bos taurus
atttaatagtgaggaataatgagtaatatcttttgggaaattataccaacaattgccatgtgtgaagaatttaagttttgtaactacacagagtatatgataatgctgggttataatttccttgctataaattcttttaagtagaaagtaacttacttccctattgctagcccatgcacactgggacattctttcttaaca

SEQ ID NO: 26568 - DNA, 201 bp, Bos taurus
tcatcaaatttttccaaattaagaaattgttgacattatatataatggtaaatatttttacaaactaggtctttctttaacttttgccaagactagtgtgaacaaaggataaaccagagcagaaactctggaaatagccaggccttgcaatgtgcgcatttgtgcccattggtggcgtaccagtctctgttattcctcttc

SEQ ID NO: 26569 - DNA, 201 bp, Bos taurus
aaatagacatgctataaatctcaaatgtcctagaagcagagttctaagactagattttttctagtcctctggtgtggtaacattcaagcttaaccaaatatttcctctttttggtaatcttcagtaaagctcagtaaattttagactacattgttactctttctacaaaggcctacaactcccacaaccaacattccttag

SEQ ID NO: 26570 - DNA, 201 bp, Bos taurus
aaatttctgagctttctgtaatccctttggaaagtgtatgggatcttggagaagcatcctagaccttgagcagtttcgatcagaggccccataactccaggctaatgatgcagtcagactaatatgtataaaatacagaacaaacaagaaccctccctggccttctcccactagcattccctgtgtattattcctgtggtc

SEQ ID NO: 26571 - DNA, 201 bp, Bos taurus
ttctttcctcctcctcctacagccatgctggttttcttttcttgcctcaaaaaaaaaaaaaaaatagggtgtttaagcctcgcttggccttttcctttgtctggaatgaacctctccagattttccattggctggccgctttctgtcactcagctctcagctcagatgccttcccagagagacttttcctcacccctgtca

SEQ ID NO: 26572 - DNA, 201 bp, Bos taurus
aagcttgagaggatgaaggtggggagaagggagcagatgttagagacctcacttagaataggatggttctacaaccaacatgacaaagatctactgagaacgaatgaatgctccttgcccagtctgcttcaactccaatcttctgaagttgatcctagcaaggcccactgcattagtcatagtgggcactgtccacagaaa

SEQ ID NO: 26573 - DNA, 201 bp, Bos taurus
gattaatgttttctataggtaaatagcctggagaaatagtctaatcaatattaaatgtaattgattccaagctttaatggatgccttcaagcagctctgacagcggccttgcatcacctctgccaccatgccgtgtttgaccagtactccagctggttgttaaagaatatctatcacttcatttcactgtttttcattttc

SEQ ID NO: 26574 - DNA, 201 bp, Bos taurus
cagatttattccattcagctcatgtattaaaatgccactcccttctggttggccaaatttctccataaaaattggctaatggcctaatgagagttcccttgatatgattttttttttgtttttcttttgctgcctttagaattctctcttgaactttggccattttaattatgatacatcttgctgtgggtctctttgttt

SEQ ID NO: 26575 - DNA, 201 bp, Bos taurus
cattattttcacaaatggggaaacatatccagaaacatgacagatacaaaattctactggtagtaagagggctataggctataggacccttggagcccaggcctctgcttttcctacttccttcctgtttttgccctttatttgattcaagaagctgtttcttgcagctctgatgaaacattgccagctatgttgctttga

SEQ ID NO: 26576 - DNA, 201 bp, Bos taurus
gtgcttctgattacctggtccatctctgtagctcagaaccctcctcttagatccatcatctgatgcacacagatgtcttcccttgtatgtggtatgcacatccatattaaatcccaatgtgctcctcctctgagtttttctattttagtaaatggtagaatataaatgcccacttgcccaaaacaacaacctgaaagctgt

SEQ ID NO: 26577 - DNA, 201 bp, Bos taurus
taagaaacttttgagaatgagtatatgctctgatgaaaaaagaatgatgggttaggatgtgtccggggaagggtgactactttaagatgggtgatataaccgtctctcatctgattccattcagattaatttctcccctctggtctactttgctcagtacccgggtagaactgaccttgcaggttacattctataggcccc

SEQ ID NO: 26578 - DNA, 201 bp, Bos taurus
tcattctttaattaagaggtaatattgaacctgaacattagatgagaatagcaaatagtattcccctttggttcacaagtggttgctccagtttagaactgaggttactaagccaacccaggaaccccagcacaacatgtggccagagttggagcagagtggaaatttttttgtattgaattgtctacagatctccaaagt

SEQ ID NO: 26579 - DNA, 201 bp, Bos taurus
attcctcctagctccctgcaaaatcagactatctgacatatgtgtgctgtgatcatggggactttataatggaactaggtaaaagattctgttagaatacttagaaacaagccaggaagcctggatatcatacatttgaagtgtctatttagttaacctgaagaatcatctatagataacaggaaaccccacatcccctgg

SEQ ID NO: 26580 - DNA, 201 bp, Bos taurus
gacggactggtttgatcttgcagtccaagagacttgcctgtgagtgtcctggagtctctggtggaagcatgggttgacagtggcctgctgcagggtcaggaacacatactataacagtcctggagcctgctggcataagtccttttgaaggaggtcaccattacccctaccatagtttggcctcagaccaaacaataggga

SEQ ID NO: 26581 - DNA, 201 bp, Bos taurus
taggaggctgtatgtgacacatgtgtgaaagtcacaacatttgccctccctgtctatctctagaagctggtaattgccccctcttggtttccttgcatctactcaaacttttgcaaacagtcccttcactaagctcacttcaaattacccaattacatagcctctgttgggcttcccaggtggctcagtggtaaagaatct

SEQ ID NO: 26582 - DNA, 201 bp, Bos taurus
acttggagcaatttttcaaaatgaaaaggtttttatacaagtaatgtaacttttacaaagatcttctttggatcatggcttgctgcctgggccagatttagctaacggatcaaaggcagaacactctaagctctgcacaggactgctgaaattcagctctcgagtgtgtgtgcttgaactgcagtggttcttaccctctgg

SEQ ID NO: 26583 - DNA, 201 bp, Bos taurus
caaagcctgggttttcaaaatgagagaaagaagtcacagacaaggcccccagctagttgggcagagaatgggtgaaagccaggccttgtgaatccccagctgcaaactctctctgctcactaaaaaggactaaattacataaaaactaaacggttctgagacggtattaattgtgcaccaatattcttgcctggagaattc

SEQ ID NO: 26584 - DNA, 201 bp, Bos taurus
gccgcggtggcagctcgcgggggtggaggcccgcgctgccccgcacggtccggtagggaatctcagaggggtccctggggatgcctcatgagaggtggtcgtgggccaactcctgtgtgtgacattggtggggggtaagttgagcgccggggaatggacgtgatttcttaggctcgtctgtggtgcaaaccaccgaacaac

SEQ ID NO: 26585 - DNA, 201 bp, Bos taurus
atactaagatggaactatgactattttggaatactcagataattgttgcttctttgggtcttttcattagattttaagatgtttctgtaatttttattttattctagctgcaacagatcaatttcatgagcctaatgcaaatagtaggatcatcctttgctaacctcccagatatgcatcaacttctacaacagtcccagt

SEQ ID NO: 26586 - DNA, 201 bp, Bos taurus
agcacgcaatatggaaagagcatctcaagtaaagtcatttccttggcaacagctctcactcatgttcatctcacatacacatgcattgcctttggcctgagcattcattttgattcagtaaccattagctatggtatctttttttttctttcaccgttccatgcggcttgcggaattttagttccccaatcagggatgaac

SEQ ID NO: 26587 - DNA, 201 bp, Bos taurus
tcttctactggccatttacctctgagagtcactatggaaggagaataataaagtcatgtgatatggcagtattagtaacacacagctgtattgggttactgtctttttactgatcattttaggccagttcttgctccctgggtaactctgggaattctctgcaggcgtgcagaagacgtgaatctagctctttgtgtctgt

SEQ ID NO: 26588 - DNA, 201 bp, Bos taurus
aattcattgtattatcaaagtatggtttgtaagtgagtgcatatgctgccattatgtaggtatatcataatttacttaactgtttccctattttggacatctgtgttgggtaaaatttttgctctttgtgatgaaaggtacttgaaggtaaaaatttgtccacctttcacatagaggtgaattcctggaaggggaaggaat

SEQ ID NO: 26589 - DNA, 201 bp, Bos taurus
gccacgaccgagagatggcgatccaggccaagaagaagctcaccgtggccactgaccccatcgagaggcttcgcctgcagtgcctggccaggggctcagcaggcatcaaagggcttggcaggtaggacctgggctgtgggctgcagggagatgaaggagaaaggcagagtgtggccaagtgaggctgagaccagccatggg

SEQ ID NO: 26590 - DNA, 201 bp, Bos taurus
ctaaatgaatcagtcactcccattgtgttttcaggcaacttcatggactaaggctagttcctgggtaatatgagaagacagcatctgtctcctgtgcttgtcctcattccagcttgtctctcctttttggccccctatatcctcatttccagctttccccatctctgccctgtctttcctctgcagctcctatggctgctg

SEQ ID NO: 26591 - DNA, 201 bp, Bos taurus
aaggtcacaacttatcttatttacggagccacaggcttagagattctagctcaactcatccattcattcatgtgttcaaaggccattaataaatccaagctacaatgaagactcttgtggaggttttaagcagaaacttaaaaatgcaaaatgatcgctcaagagttttaatctaaccagaaattctatttatagttatgg

SEQ ID NO: 26592 - DNA, 201 bp, Bos taurus
tgattaggcttgaattagatgatctgcactgttccatttttggtttatgctctgagtctttcaaaatgtacaaattagtaaggatggttcacaacccctttaaaggcagtcaaagccttaaatttgcaaattttttactatgctccttaaacacacacacacacacattttaaagggctctagagaagacatttgcagaca

SEQ ID NO: 26593 - DNA, 201 bp, Bos taurus
actggaccaagaggaaagtctctttatacaattattaaaggttactttccatttacagtcattacaaaatattagccatatacccccatgttgtataatatgtctttgagcctaccttcacccaatagtttaaactcctcattcccccacaatggtgctctccactccccccagctggtacccattagtttgttgtctctc

SEQ ID NO: 26594 - DNA, 201 bp, Bos taurus
tatttggttttgcattatttgtaacagtgaactattagaagcagcacaagtgtccaaaaaggggaaattgccagtatgagtgtcactcatcaaatactggatggggagagctttaaacttccccttgcccatccctgcattctgataaaaattgaggacatatttctggaccaagtaagagggaacaaaacttggaacaaa

SEQ ID NO: 26595 - DNA, 201 bp, Bos taurus
tccagagttgatgttattgtgaattcagcagcacttagggctcagctataacatgttctgtaatcagtgtatccataaataacttgtgcttatatataacctcagaatgacttcttgtttcagagtgtggaggacattcttcatttggggaggtcaatacaatgaaactgagaacctctcaatcttatgtggcagccaaaa

SEQ ID NO: 26596 - DNA, 201 bp, Bos taurus
aggagagatgggagctggatcgggcctctgtacccaaccctgtattaattctcagagacagagttttggatgaagtagaggataacagctttattgcttcgctaggaaaagagggccaccataggctaatgcctcaagaccgtgtcctgattggaggaggtagtgagaagttttatagtaatgcttaaaaaaggggagggt

SEQ ID NO: 26597 - DNA, 201 bp, Bos taurus
cagtcccaaatgctcctacccaaccttccttccttccctcactcctcctgaaaatagagaaaccctctgtctgacttccagggcaaaccgcatggaagcatacaccagaaaagattctgtggcagaaaatagaaatggctgctggataatactggagctgagcctgagagaatcccctgagtggctgccctgggcccagag

SEQ ID NO: 26598 - DNA, 201 bp, Bos taurus
ctttcaaacaggaagactcaggacctacatgttcccaggggtctgagaaccactgaaaagcagggcttgtgatccaatggttcccaagatcaggcaaggaaaccaggcttggttgggtcccttttattcctagaggtgtggcctgacaagtgggagccctgggttaaacaaatgaagatgttctggtcagggaagaacctg

SEQ ID NO: 26599 - DNA, 201 bp, Bos taurus
aactggtgtggtctttttctccgtagtttggcatggggaaggggcgctgccaaatggaactccaggcctgagcctgatactaggtcttagacaaaggcctgtctagggaacagagcaggagaaattgtaggtgtagtacttcagatccagtactccagatggatacctgtaccccaattcccaaacctcatccaacacaag

SEQ ID NO: 26600 - DNA, 201 bp, Bos taurus
cttccagagcctgtctgatgtctttgtgttccttggctgtaaaatgaggataagaataacacatgattctggaatttgttgggagaatacaatgaaactagatgtatgaaactagatgcactttgcaaactctgaagggctgtaagttagtcatgtttgggaaatgaatgttctggctaattaccgtctcaggcttcatct

SEQ ID NO: 26601 - DNA, 201 bp, Bos taurus
tggcactcaaagcagccacttaaagggaggaggcagaagggccactgccaccctccaggccattagcagagacatggagtgagacacggaaggcccacagcagaatcctgggagttcaggggtatgagctcataagctcacaaatccccagcaaagttttgacagatagcacattccacagctgagttcagtgtcctcaga

SEQ ID NO: 26602 - DNA, 201 bp, Bos taurus
aagattattactattaatgatcgcactttgtgatagactcgtcttttgtactgtcaataattaccctacagaatgagttaaactcaaatctttgaataaactatgtttctgctactcttcctttagactttcagatcttggcattaaagacatttcttaactctagggtacatacatattttcaagactattttttctttc

SEQ ID NO: 26603 - DNA, 201 bp, Bos taurus
acacacacacacacacacacacacacacacacacacacgagaggccatgtaaggacacaagaagaaggaagccatctataaagcaggaggacagcccttagcaggaaccaaacgggccagaacaatgagacatacgtttctgtcgtgtaagccccagtgcatagtattctgttacagcagcctgaatggactgagacaacc

SEQ ID NO: 26604 - DNA, 201 bp, Bos taurus
ttttttccagctctgatagttgttctacagcctctaggggtgggacagcagctgactccagcctggtttctactgcatgttttatgttgtcctggagccggtgagcccagaggaggcgggtggagaaggacagggaggtcaaggctccgccgccttctctgtcatttcccttcatcaggtgccccagctccccagcagagg

SEQ ID NO: 26605 - DNA, 201 bp, Bos taurus
gcaagtaacctaaggaaaggagatacaggtcagtcttttggaaataaggtttagaggtacaacccagatacaggcacaattctgttgttaggatgcttttctctgtgtctctatgtgtatgtctgggtctgccttacactgtatgttctctcatgtctgcatgtctctcttctgttcctttctgtttatcatcattctctg

SEQ ID NO: 26606 - DNA, 201 bp, Bos taurus
agtcattatgagaaacagaagagaagaaaatccttgtggtatttctcttggaacaacatgaaaactgaggaagaacatacatatagtatcaaaatgtacccctggcatgagatgttgggataagtggtataaaaatacattaaacgtaaaatggaatcttgaccaaaaggaaaatatagtatgatgttacaactaagaaca

SEQ ID NO: 26607 - DNA, 201 bp, Bos taurus
atttattacgtctagttggccactttcaacctgcactcacgtgaccggcctcaatgcatctggttttgcacccacctgggttgcaggcacctcttgaactgatttgtagattttttacaaagggaattggtccatgttggtgagtggatgtctccctagggcaaggagagtctgagacttcctattctgccatcttgctga

SEQ ID NO: 26608 - DNA, 201 bp, Bos taurus
gctgccttcgtgaagatcgattctgatgggaatagaagagcaagcggggccagggagggaggtgtgttcagagactcctcaggtgtgaaagctctgcagtcagagggtcagaggaaacttggtgggaggagagctgagttcaaaaccaggaaaggctggactgcctctgggcagagagggcaggcaagggcagagaggtag

SEQ ID NO: 26609 - DNA, 201 bp, Bos taurus
tgacctttactatagtaccgcctctccctcaagaccgctcactgctactaaacaactaaatgaactatttaaaggtcagttaggtaaaattcaggagcaggggaagttattaagaagctggaagcgcgtcgagtttgtcactgccgcctgagggtggtggttgaaaacataagccattgcttgcctagatgtccctgtcag

SEQ ID NO: 26610 - DNA, 201 bp, Bos taurus
tttcatttctgctgaaatatgtgtccaactaaagaaaaagctttaaatgaagtttaaagacaaaaacacaaaaagcccagcttaatatttgtatgctgaatattagcccatcaccactggaaactctcagataaaacaactcaatgaaaatgcagcaagacccttaaatgtagcaattctaatgctcacctctattattat

SEQ ID NO: 26611 - DNA, 201 bp, Bos taurus
agttgtcaaagaagttcaatttccaatttaacgactgcaccatcgcagtgtacatgtgtaattataaacagtggggcaccgggacacagtgaaggccagcagaaagctaattctcggtggaagttgttgttcaaaataattgtgcattgttacttgatgttctgcagtcatcaagtcaagcacttttcaatttctttcatc

SEQ ID NO: 26612 - DNA, 201 bp, Bos taurus
tctttatttacattttagagcactattctccaaaaatttcattgcagagagtaagaactgaaacaaggatgcccaagtgtgaaatctgcaaaacaggtgcgctgggtgtcctgagctgttttctaatcctcacccccttgctctgtgagctgtcttctgtgaactacctttcagatgcccattgtttatccaaagaattaa

SEQ ID NO: 26613 - DNA, 201 bp, Bos taurus
tcgttgaaatgatctgcattggtctgttgttagcttgtgtaccactgcattacgcatcattctggctgctccttatttgaaaaagctgtacagtgttccattggtgattgtccatttgtactcagtcttcaatctgccaacagtatttattcaagtatcatttttcctatattattaatacccaactttcatgacatcaga

SEQ ID NO: 26614 - DNA, 201 bp, Bos taurus
ttaaatgccttggtttctcttttaaactcaatgacattcatatcccatgctgatcatcaataaaatagtcagaacctttcatcaggagatagaacacaaactgcagtgcaattttccattcctttttctacaattacctaaagatcactttgaatttagtgtgtttaacaagggctttttaaaaagaaatgtgcttttctt

SEQ ID NO: 26615 - DNA, 201 bp, Bos taurus
aggaataactcctgaaactatagagaactggcactcaattaaaaaaaaaaagcataaatgacaatggagttaataagaaattatatcactagctcaagatatataaataaaaactgtatttatttataaattggacatttatcaaatggaatttttttgaaacaactaaaattgaacatgatgcaactggcaagggctaaa

SEQ ID NO: 26616 - DNA, 201 bp, Bos taurus
gcaaataatttttttgagatatagttttcctttgaggctgtttcttgaagtattctttgttctctgaaagaagacaaattcttgcttatagctctttgacgttcatgatatatcccattggggccctaaactatgagactgttttgataagaatgtattacaccatactagaaaggctgcatcaaattaagaatgtcttac

SEQ ID NO: 26617 - DNA, 201 bp, Bos taurus
ctgcttgcctcctttgcactaactctttatctcttctacttaggtcatttttgaagggagctctctagcctaacaaaatatattagtcccacaccaataattgggaaatgccaccacttcagaaagtaattgtatgaataggggtaataattactatgtatcaagggtcttctgtgttcacaaactgtgtagtgatcttaa

SEQ ID NO: 26618 - DNA, 201 bp, Bos taurus
gtatgtgtataactgagtcactttgctatccaaccaaaattaacacaacattgttaagcaactacacctcaatttaaaaaaaaggtgcaatggctcaacattgtagctgacatcatagctgatgatgatgatgaagatcagtgaccagtgatgatcatgaagactggaaggggaagaagaaatatcaagggtttacagaag

SEQ ID NO: 26619 - DNA, 201 bp, Bos taurus
gcagataaaataaatacaaactgttacagccacagaactaatctaaaaaagtttgattctgcaaatttattaatctcagtgtcagttcagtttaataagtgtctgttgcaatcagtaatgttctactactcacagttatcccttactgtgttaactgatcaccaatgccctccaagccaatacaagcaaacaggaaatcac

SEQ ID NO: 26620 - DNA, 201 bp, Bos taurus
ttcttgagtgttttgcatatctcctgaaaaggagaattacagtatttttgctctgggtaatcttttcaaggatgtttgtacagtaagcaaccttgaaagatagagaatgcctccctctgagcaaatataactctctaggataataagataataactctcatagggataaagattggcaggttttccagcagctccttagaa

SEQ ID NO: 26621 - DNA, 201 bp, Bos taurus
tcatggggtcacagagtcaaactcaactaggtgactttcatactttacattgtttactggtagggcatagagaggaaacatttcatttcacaatggtgatgtgaaaatgtctttagcttcaaagtcaggagtactcaaagtttggtggagggaatgaatttgtatcaactatgtgatatcctttcaatcaatttgccacct

SEQ ID NO: 26622 - DNA, 201 bp, Bos taurus
ttatctatcatttatgtaacacatgaaatgaataagtaaaggagaccacatttatacagtaggccgttctgttctgagtcccctcgtctccatgtttctccacatgtattttccttccccctcttttggtctcctcatctctactctccaactctgctgtcagaataatctctgcaggaggagtgccttgaaattacactt

SEQ ID NO: 26623 - DNA, 201 bp, Bos taurus
ttgaaaactacagaattttttgctggcaaacaacagaacttgctcattttggcagaaaaagaacctacttgcctgcactgcctttttaagcttttgaaagctgaaacatgtagactgtattaaaaagtataaagaagtaacattttaaatacttgctaactaactttcattgtgtcctcatgtgtgtccataggaggcaaa

SEQ ID NO: 26624 - DNA, 201 bp, Bos taurus
aatatatgtgtacagagaaaattcttctataatttttctaatatttgaagacgttcaaacattctgaaatttacagtgaaagaaatttacaatgaacacccgccacctaccattaatattatactataatatcttagattgattcaacaatcaatttaacatatatctgctgattaatccagctcttttccatctatgctt

SEQ ID NO: 26625 - DNA, 201 bp, Bos taurus
cctggtcttctggaaaatagcttttctaatgccttatttgtgttaaaaaaaaaaaaaaagactttttcatcatcctgacaatgttctagggctattatttcaatcctactgagactctgcaaacaagatcccaacatacccacataatatttgaaacaatggggctggtgcttatcaagtcaccatatatgttgttaccac

SEQ ID NO: 26626 - DNA, 201 bp, Bos taurus
taaaatctggctagcctggacaaagatccctgtactgagtagaaactgctgaaaatagaattgaaattatgccaggatggaaatagtggaggaagagaaatatacgcagctaaaagtgggagaaaagacagaggtagctgatctaagataaaatgccatattttgtaaaaacttcacagacaaaacagaagagggagctct

SEQ ID NO: 26627 - DNA, 201 bp, Bos taurus
tattttctattccttttgcctgttagaaattgcagattatgttttatctaatgtctttaaggaattcattttaatatgttgcttcagatttcaatatgcaacaggaaatcgtccttcaaattgtcagtttatgtttctacttagcctatgtgcttatacataattgttggtaactttccttctatatttggttatacttgg

SEQ ID NO: 26628 - DNA, 201 bp, Bos taurus
ggcctcagcctgcaatagcttggagcagtgcttgggtttccagccagagactgggctgagccatggtggtgaaagcaccagatctagccattagaccagttgtcagtcaagggcaatggccttttggctttgcagaaaataattcccacaaagacagaaagtagtgaaccaagtaaagtatttataaggagggaaaaactg

SEQ ID NO: 26629 - DNA, 201 bp, Bos taurus
tcattcatctcattcatgagggttccattctcattacctaattactttccaaagttcccacctccagagactagactggggttaggatttcaacataagagtctttgaggggcatcaacaagcagtacataacaataagcaagactaaagatatggaaaataatgcaggaagtatattagacaagcagcatgatggaactg

SEQ ID NO: 26630 - DNA, 201 bp, Bos taurus
gcatacatcaattacagtacagaatttatttccagtgggaatggatgctagaacataaaaaggttagggttatcaaggtgttgagggatagcgacactgcatattgctcagagatcctagataaatctcaacactaggcttttagatcttcttaccagtaaaatgagagtgttacagggactagtacagggatagtaaggc

SEQ ID NO: 26631 - DNA, 201 bp, Bos taurus
taatcccaaagacaagatgaaatgtgtgtactcaggaaatctgcaggtgaagtatgccaacgaggggggaccaaataactttcctgaatcgaaggacagccgcaacttaacttttttctcttttgaaaacaaaaatgaaaataccctgtggcctgaccagactgtcctgcagtggggatacaggtctacacagacgacaat

SEQ ID NO: 26632 - DNA, 201 bp, Bos taurus
atgtatattcacatactcttcttaacagaaagatacttagacactcaccaagaaagaagttacaatttgtgttaaataactgcattgaacttgtgggccaaattctttagactactactacgcttttccttctccattgatcctgatgtggattctcatgaatatcacaaataaaatctttgaaaatatgttgcttatttc

SEQ ID NO: 26633 - DNA, 201 bp, Bos taurus
ttgttttatgaaactaattttttttggcctgtccaattcatttatttctgaaagatcacatattttaaaagacttcttgcagttctagataaatggagcatctggccacctatgactgtccccatcgttctcaacttatatgaataattagaaagcagttgtactctttgaatcttacaataattaataatttgcctgaat

SEQ ID NO: 26634 - DNA, 201 bp, Bos taurus
ctacaaataagacttgaagctacctaaggaaactttctctaactttatactgcctttgtccattatagattccaagcaaacaaagtcatggtacacacattatgttcctttacttgtttaattattgaattgtatttctttttcaaagtaaatgtttccacttgagcaatggatcgatactcctctcttctcaagaaacag

SEQ ID NO: 26635 - DNA, 201 bp, Bos taurus
gcacacaaagtttaggcacagtgcaagaagtttctgaaggatgccctgggtagtgacagaagcttccttgagtcccaaggcatgtccacagtgaccactgcaggcacatctctaactgaggctgctatggatctctgtattgttgatcagaactcttagacctggtacccaagactctggaaacactctgataaaggtctg

SEQ ID NO: 26636 - DNA, 201 bp, Bos taurus
tgaaacattgagttcataattaataaggatgttctgtgagcagacaacttcaaaatctttacagtctcttttgatatgtcagatttaaaatagttgtcaactatccacctagatagaaacacaggtatcagtaaataccagaaatcagaaataattgacagtagctacaagagaaaatgttaataatgcactcatctctca

SEQ ID NO: 26637 - DNA, 201 bp, Bos taurus
aagagcagagagttttctctggttgggagcagagggagaatcagagagatctgaggtgtggtagaggctccacatgaaggaggttctttattgctgagatatatgggatggacgtgagtctgagtgaactccaggagttggtgatggacagggaggcctggcgtgctgcgattcatggggtcgcaaagagtccgacacgac

SEQ ID NO: 26638 - DNA, 201 bp, Bos taurus
agaccaagaacattcaaaagcagcaagacctggataggtttttgtttaaaagtcactaaatgtattttctattgtccaaataaatgcaagcaacagtttttctaaatttctgccactgcataacaatgatccttcttcctctagttcccagtaaaaagttcttactttcttgcgagccctcatttacagcttcctcactta

SEQ ID NO: 26639 - DNA, 201 bp, Bos taurus
aaatggaagtgctgtctcctggtgttcgtaaattatgttagcgttgagctaaccatcaggtgttctcaattaactaataactagctccttaaagcttgaacgcaaagaactctccatgtttcatttaaagaaataaatatttaataatctgaatttacattaaactaaattatagcagaaaaaagaaaggaaagcaggtcc

SEQ ID NO: 26640 - DNA, 201 bp, Bos taurus
tgattgcttcttctagctaaaatagcttttttatttcattttttattggttgagttcaattatattcaatttgggggccaaatcaactcaagattatgaaatttctattctctttatcaagggttatggatggtgactttggataaatatatatttatgcttctactaggggaaaggagagggctgccaaacttgaaaccc

SEQ ID NO: 26641 - DNA, 201 bp, Bos taurus
cacagacaggacttagaaacagacctcagcaacacacatagaccttttacagcaaaaacacttagatattcaaaagtatttaatagaaaagggtattatcgtaaaaataataaaaatcatccaacaacaaaatacattttgctacgccaaattctcagctgaaatgggggggaaaaaaaaaaggcattaatttcaattttg

SEQ ID NO: 26642 - DNA, 201 bp, Bos taurus
aatattaatttaaaggtaaatttaaatagtgacttcaacaatatctgtaaatgtgaagagcaaagagcaaactttattccagtctcatctctaatatgtacttacttttgtcttaattgattgatggcagagcaaatcatcccttcttatagatttagaataaaatggtatacgtttattttgctaattcacctgttagat

SEQ ID NO: 26643 - DNA, 201 bp, Bos taurus
atacaaggtgaaataaattttgatcaaattaatccaaaaatattactaaacactaaatttagaaatataattaaggtttataattcactctttctccctcctttccttcctctttgcttcctatttgtatgaatttatcaaacaaagttgacctaagtaagaaagaatgattcaatattaaaatattttaagtgattttgt

SEQ ID NO: 26644 - DNA, 201 bp, Bos taurus
ttataatgtatatcaaatgaatgattctgattagataaatacaaaataatcatagttactaatatttgaatctattcacaaaaatagagcaagccctcaacaatagcacgatctaaatgacaaacttttcaacaaaactaggtaggatggtatcctcacaaactccaaaagagatgttggtgggaacaaactttcaacaac

SEQ ID NO: 26645 - DNA, 201 bp, Bos taurus
ttttttatcatttttcattccaatatgctatcatattttttaatttttaatgtttttgtagaatttattatcattatgaatttttagcacattttttttaggacactgttttgtgcactttgcagtccacctgaaatatcacaacattgttaatgagttataatccaatatagaataaaaagcttaaaaaaatagttctgt

SEQ ID NO: 26646 - DNA, 201 bp, Bos taurus
caactgtactcaatactctgtaatgacctgtatagaaatagaatctaaaaaagactggatgtatctatatgtgtaacagattcaactttatgtacagcaggaactaacacatcattgtaaatcaactatactccagtaaaaattaacttgaaaaataaaaggacatatttacttgctgagtaaactaaaattaatgaacca

SEQ ID NO: 26647 - DNA, 201 bp, Bos taurus
atgcctggctgcaccaatggaagaatattttgctgtggatttgttaaaagagaaaaaggtaggcgagatttatttgaataacagatgcttctgggagaaatatgaggatttgacttcatgcttctatgataaaaaacaccaaaatatcaaatctgtaagtggatgttaggaaaaaaggtgcctcaatcagataaaaaaaga

SEQ ID NO: 26648 - DNA, 201 bp, Bos taurus
gctgtaacactttgcaaataccaccaaaatgtgatgataatgtcaccatatttatgtgactacatatctacctcccactgtaagtagattttctaagactaactggtatggctaagttccactgtattttctcctaatcatcaccagctgacaaattgggcacacttataatttgttttgctgagctgaactgaagggatc

SEQ ID NO: 26649 - DNA, 201 bp, Bos taurus
attcattttgatatttggcaaaactaatacaattatgtaaagtttaaaaataaaataaaatttaaaaaaaaaagaaagaaaaaaaaattgcagctataacgtaaactacatgtgtgaaaaaattaggcacttttgagcaaaattatgccccgaccagtaatactgaagaagctagggttgaacagttctatgaagacctac

SEQ ID NO: 26650 - DNA, 201 bp, Bos taurus
tgaatcacaagcttcctctacagaccagctgcaggccattatatgtgttcccaggaggtcaaggtaatttagaggcgagatatgtgctcaattccccaggagcccctggcccattcactcctataattatggttagagtccaggaatcttggtacactgaagtttagagttgtttccttgaaacacagtatttgttaggag

SEQ ID NO: 26651 - DNA, 201 bp, Bos taurus
agaaagtgattttacatgaggtgatatgttctcaatacaaatgataggattacccaggcatccactaaatctcagagtaaataccatttcagtggacacacgggccaaatttgggagatggtgagggatagggaggcctggtgtgctacagcccatgaagtcacacagttggatgcaacttgacagctgaacaaaaacaac

SEQ ID NO: 26652 - DNA, 201 bp, Bos taurus
tattgattgttttccatttaccccccctcacaccctacccaactgcacttaccatagagacaaaaatcaaagagtcaagcatttccatattttgactatactctaatgctccaattctgctttggtggcaagacataaagccatgtcagtatgacatgaagcaatatactgattttccatgctattttcaagtctgcaaaa

SEQ ID NO: 26653 - DNA, 201 bp, Bos taurus
gagtactggagtgggtagcctttcctttttacagggagtatttaaataggcagccacctagtttaggtttagcatgtgggttttggattaattttatggaatatggttcaaatggccgtaaatgttctgtgtctttgtgatattattttggtctgcttagctcatctgaagtccctgggtccccagaattcccaaatagtc

SEQ ID NO: 26654 - DNA, 201 bp, Bos taurus
actgatttaatatctgaagggtacaatattgtgtctaacatatatgatatggtgaaaaaatgctagcttatttcaatacagcttgtgatggcatcatgctttttcatgaacacataatagatgagactcattttaaacatatatttaaataagcattcttaatattttttcacatatattggggctgattttaaaatatgc

SEQ ID NO: 26655 - DNA, 201 bp, Bos taurus
caggtgatgtctttattattaggtttatttgaaagaaaaaaataagttaaaatacaattactggatccatggatacgtgatagaaaagccaaacaaaaaaccaaaatatcagttattatttggcctatacaaatatattttatcctagtcttgtataggagtttaggcttcatagtttcgaaaaatgtttattataattga

SEQ ID NO: 26656 - DNA, 201 bp, Bos taurus
ttgtggctgtttggatttgatgaagaataagtttactttgcattgattttaagatgtgatattttcaaatttgactaggagctgtgaagaaaatatcttttggggcattttctttcagatttcacagtccactggtagtgaaatgcagttatttaccttgatacatattggaaaccataagagattttatgtttatttcac

SEQ ID NO: 26657 - DNA, 201 bp, Bos taurus
tcactcattgccctgaggatgaagctgtattgaatatactagagtggcttattccttggatggaaacttttaggttagaattttcctcttggtaccctccgaatgaggtgatattttaatattaagtgatatttctgatactgaatgagtatccagaaagaacaatacaagtacataatactccataactttcccaggtag

SEQ ID NO: 26658 - DNA, 201 bp, Bos taurus
aaaagaatgaaacttcttttctcctttccactgtccacatatttattcatatatatgttagatgatttgattctttctttccactttcttagtcagcacaacttatctcctgtccattacatcaaatactcagctctacgatgtcactgttaaacttattttggaaaaatgcctaaaccctttagttgaaatattccacat

SEQ ID NO: 26659 - DNA, 201 bp, Bos taurus
taagtccccatctcagaaactgcttccagagcatctgacttaacacaaatgcacttagcaaagattgtgattgcaatccactagttcaatacatagacagatgttctaattgtttgcttgggtgattagctgaaatctctacttaactgtggcctcctacatatgaagttgaaagatagaaactacttgctgagaggagaa

SEQ ID NO: 26660 - DNA, 201 bp, Bos taurus
ttaatattccatagaaaatatgggtcaggcgtaagaaaggatatgttatatttatagttcttgccagctatcatcaggaaaatggcaagaatattacatacatagagatatatttatagatagtctgagtctttattttccatgtcatttaatgtttacttctttctagcaaggtctaaatcatatttcagaggaagatac

SEQ ID NO: 26661 - DNA, 201 bp, Bos taurus
gtaagtaaataataaatctgaaaagtttttggaaaacagcaaaaaccaaaggtgatgtagaacctactgaacacatgtatgaagcgagggttaaatagcactctattctaagagtacattcataagttcaatttgttcataggtccccaaaagttagcctaggtatccaactaactcaatcagctacatagtagtgtattg

SEQ ID NO: 26662 - DNA, 201 bp, Bos taurus
ccagtgcttggaagattttacaaaaagaaaattttatttttgtcttggaggatataaattaccacagcacatttagaaaataatttgataaggaacatatccactcttaggctcctaattacattcagaagactcttacagaaataaaagtaaaattcatgtgtgttaattaaagtactactgtaattacaataaaaagga

SEQ ID NO: 26663 - DNA, 201 bp, Bos taurus
tcactcttagacaatagatgcaattcatcaaatgctgtgcttcaaagtttgaaaggtccttaaaagccatctattttaccagcctttgaaatcctgaatcgtatttcttcatgtatatgtgtgtgtgtgtgtgtgtgtgtgtgcaagatatgtatacacatactttttcacacacatgtatatgtatttaaatttgcattt

SEQ ID NO: 26664 - DNA, 201 bp, Bos taurus
ttgagttgcccatttcatttattggtctcaaagttctttatcagtttgaaggatattattcaacagcactgcttcccaatatagcatcactggggtcttttccacagtgttaaatcttgtactgcaagattactccaatgtctataaactatctctaatctaacttaatattctgcatccctttgaaaacacctcaggatt

SEQ ID NO: 26665 - DNA, 201 bp, Bos taurus
attatctccttcactcagtcattccagaagcattcagatgagagtcttctctttgtcagccactagcttaagggctggtaagaagagggcagaaaaagatacaaaaattatccactgctttgaggctatcacatgggaaggcaaaccattacaacatagtaagaaaagcgtttaccgagttaagtacaaaatgcaaaggga

SEQ ID NO: 26666 - DNA, 201 bp, Bos taurus
taccatcattcttcagtgtaataataaatatcctgaaaagttcaggtcccacttagctactaaagtccagaagatgaccagtcctctagggattgtcatggggtggattgtgtccccactatttcaccccaccccccaaattcatatgtacttattcccagtactgcagaataagacagtttgggacataaagtcatgaaa

SEQ ID NO: 26667 - DNA, 201 bp, Bos taurus
ccagcctagtggtctaaatcctttaacagttgcacagggcccggaagggccgatggttcccaaggatgccgcttcctcgtgttggaaaggaaccttgcaggcggaggaggggcacagaccttcctaaacaggttgctggccgcacgcactctagggaaagcccgacgcaggctgtccactgcctcgtttgttgggagaaat

SEQ ID NO: 26668 - DNA, 201 bp, Bos taurus
ggcttttttcgaagagtagactggttccaggacagaatgaggggagaggaattaacttaacagtagagaagtctggcaaatgctgcctaagccttgtggccaagtttaacattatcagtgataagccatgttgctaatatgtgcccttgatatgatgtgatgagactaccttccttacctttgtagtcttccttctaaaat

SEQ ID NO: 26669 - DNA, 201 bp, Bos taurus
tcagagacttttctgacacctcagtctggaattacacaggggctgacagcaagagcattaaattctggttctctggttcttgcctctcctttctagggaggaaccctgaacagcttcagaccatttccaaatacacctgggcttacccaggggccattgcagtgggcttgaatacaccttggcagttagtagttgttccgc

SEQ ID NO: 26670 - DNA, 201 bp, Bos taurus
agagtctggctccttgtggctgccttgatcttgtgagggctggccagatgatctttgcctttctctaacctcaaaataattgtaaaacctttagaaatatcgcccacagtttcttagatccttgactatacacatggctcttgaaagagcctgagtagaaaatttggccttttgtgtttgaagtacacactgtatgtcact

SEQ ID NO: 26671 - DNA, 201 bp, Bos taurus
ccactttcccatgtgacatggcatactctgaggtcctggggcttagaaggtcacatcttggggagactattagtttgcccactacgtagggaatgttagcgggacatttcaggccactgggtggtagtgaacatgtagtgtggcatgtagggagagcagagtggtgggaaggagccggtagcatagagatgctttaaagac

SEQ ID NO: 26672 - DNA, 201 bp, Bos taurus
tcatgatctgttttcaaggagagtggggttaactggtaggactttttcttctgggaaaagccaaaaaaaaaaagaaaacaaaacaatgaaacgaaaacaattgaaaccttaaaattgccctgtcagggataaaagtgcttgggaatgtgtattcctctgaatttcctgccctatcacaacgttctcagtttgcatctatac

SEQ ID NO: 26673 - DNA, 201 bp, Bos taurus
caggcacaaagattggaggaaagttggccttaaaagcacaaggggagggggaacagagagaggggacctgccctaggaggggccatgatgggctccagggtgagcctcccctcaccaccctactctcctgaggggcagagttactaccacagtgatcaaatatggttccagggccagcacaggaggaacaggcgtaactta

SEQ ID NO: 26674 - DNA, 201 bp, Bos taurus
gcccaaaagctagcctttgttaacttttctttgcttgacattcttcaacgatattttagtttcccaaactctctaagatccttctcacagcagggccttccggcagtttcccactatttttctctggctgagtcttgcccttcaagtgtcactcacatggtcctctctatggccctaagactaagttagggtcttctgtaa

SEQ ID NO: 26675 - DNA, 201 bp, Bos taurus
gtctcccaacaattgccaggatctgtcttccacatcactcaagaacaaagaacggaagagcaatctttgtccttttccacatgctcaaacctcacacaatgtctcgctaaagctggcttctctgaaggaataaaagttagcaagagtaatgaccaagcagacatttaactataaagttatcaataaagggagacaataaat

SEQ ID NO: 26676 - DNA, 201 bp, Bos taurus
tgaactgcagtgcactgcatattgaatggaattcagtagagtgtaaacataaccattatatgcgctaggaaagcaaagcatcggtgtgactttctttaccacagtgtttgctgccttgtgatggtctgaaaccaaacccacaatatctccaaagatatacctatttttaggaaaaaatttgcaaaaaatatgtataattat

SEQ ID NO: 26677 - DNA, 201 bp, Bos taurus
tgaattagatgctcttatcaagccagcttttcttcacttaactagcccttaagctcagttcaatgtcgtgtgacagcacagttagtatgtggtggaaatggccttgacttcagattttattcccagcttttcctactataccatagttcctctttagaaatggatccactgtttaattcctttagttattactttcagtaa

SEQ ID NO: 26678 - DNA, 201 bp, Bos taurus
aagcatcctgacagagaagatgggctgagttggctctcagctggaagttcaagaaagtttcatggacagcacttagactgggaggatggataggatgtccgtgtggacaaaagtctgagggtgaaatgaacagaggtaggaatgaacaggggtaggaatgtccaaggaaggggatggaggcagtcagggacaaaaagtatt

SEQ ID NO: 26679 - DNA, 201 bp, Bos taurus
ccaatccattttctgaatgccctaaagaaatcttcatagtacagtcaacaagttgtgtgctgtttgttcctggcccattgacaccacgtcaaggcttgagcaaaaaagaattaaactcttcaacccaaatctcctcttcattctgtcagggccacccaaagcaccgcactagcccagaaatggaaatgagcatcttgatca

SEQ ID NO: 26680 - DNA, 201 bp, Bos taurus
taatccttctgccaaaactaccatccttgaacttacaggaggccttagacaccatcgtgatatccacacagcattgcttctgatccaggaactcacttcgaagcaaatgaagcatggccatgggcccgtgctcgtggaagtcactcaacttaccatgttctgcatcatcctgaagaggctagattgatagaatggtagaat

SEQ ID NO: 26681 - DNA, 201 bp, Bos taurus
ctaacaagctctcagtctttccagttgccaatcacatccctgacctcacccgacctctcatccctccatcccccaggcccagcctcttctctgtgagccctgagcagactctgctccatcactccaaagccccacccagagccctccccgcttctccttgccaccgtagaacccttcccgtcttctccagcacacatgggc

SEQ ID NO: 26682 - DNA, 201 bp, Bos taurus
gtaaactattaagctcagtattgttcagatggccagtagtatgacttacacttctaacaaggaaaattaacctctgggtcctaagagtaaacattccacaagttattcaacaatggaaaatcttttagttgtaccaatggtctgaaactcaaactatctaataccccactggtcgaatcaacttattttttacccctccac

SEQ ID NO: 26683 - DNA, 201 bp, Bos taurus
cacctcatgttttactatcaggatgtggaggtagtggaaacaggtatttaaagttgatgtcgcataacccagaaatgtgttgttagatttacccaaggacagcatgaagcagaggccactgcgaggactttatcctgggggatgggacaggtgaggagtgggggatgaggcccagtgaaacaggtcctgtttgtacctcaa

SEQ ID NO: 26684 - DNA, 201 bp, Bos taurus
gaaattccaagctggcgtttgttctgatagtcttgtgttttaccccttacttacttattctatatttaatttgctggcatcctattattcagacactctcgtcttcaatattttaggtaagagttcctataattatgtaatctgccgactccatgcagccaattttcgttatggaacatgtacccatagattgtaatcagc

SEQ ID NO: 26685 - DNA, 201 bp, Bos taurus
tttgatccctgggttggggatggccttgacacctacaagctatgggatcctgggcatgttacttaaacttcttgggccttagtttcctcatctgtagaaggataataaccatccctatctcatagaatttttttgacattaaatgaggtcacacatgaaagaattttatcaaggcctggtacattacaagtgcaatataat

SEQ ID NO: 26686 - DNA, 201 bp, Bos taurus
cgtctcaataaaatcaatatgcttataaagtcatataagcatatatatggcatatttttttttcaaagaaggctgttttaattatgtatgtacactggccctttttcaaaaatattacttgatttattaatatagtatgcaggatttcctccttctgagtcagacaccactgcttcggaaactgcttgcaactaacgatgg

SEQ ID NO: 26687 - DNA, 201 bp, Bos taurus
aaatgacttcacttacgtcttgttccacttaccttggaagtcgactaagatggctttggcaaaagacagcaatttcatggggtcgatggtacctgaatgaagcagagattgcctcaataaatatcttgagtattattatttgtttatgacctgctctgttcaaaaacagattgtagccaaatgggttggttatatcctttt

SEQ ID NO: 26688 - DNA, 201 bp, Bos taurus
tcttagatggcaccactgaaagcaattcagtcagccacttggtgctgtgtccttgtctctaagttagagataaaggcactgtcttcaaacaggttaagagtgatgatgatgaagtgtttcattcttggtaggagtttgagcaatgccgtcttcttttgaaacttcctacttaattccaaactacttcataaaataatagtc

SEQ ID NO: 26689 - DNA, 201 bp, Bos taurus
ctgctattaaatgtacagtgcacaacaaggagtacatttctgcaatgtgttctccaaaaagtagctttgaacatgccacatcaaaagcaaaatgagtttggcggtcttaacacaacatctgctcagggatttccccctacacgaggaggggaaaaaaagagaaataaatgtatactacatggcatattgaaaaaaaaatca

SEQ ID NO: 26690 - DNA, 201 bp, Bos taurus
gctcaaataaaattttccaatttttttcttagatccattggcgttgacattttcctgaatcaagcttcgaatcctgaaagctattcttgtctcatgtacttattgatctagatatgaaacttttaaaaataaagatgacatttattgtgatttccttggagctctcaacacgtctggtaagtaagatggtgctacttctca

SEQ ID NO: 26691 - DNA, 201 bp, Bos taurus
tggtcctattacaaactgtgaaacccaaattctgtagatctttctctaaggtggttttcagaagtcaaacaaatgacctacttttccctatgattgtacacgtaagaaaaatcttatgagaaaaagaaaaataataaaggtagtattaatcatatattttcatatagaatttagtggaaatttgaagatatttaaaaatta

SEQ ID NO: 26692 - DNA, 201 bp, Bos taurus
aactaaaaaaaatgtgtttgtagtattttaatttcacacgtgagaaattgttctgtagctagtaggttatatatgtagtatggccaacatatttgtcttggaagcaacagttataacgggacatggaacaaaagttcagttcacttcagttgctcagtcgtgtccaactctgtgactccatgaaccgcagcacaccaggcc

SEQ ID NO: 26693 - DNA, 201 bp, Bos taurus
ccttctgcctctcatcctcttactatgttttcccatttttcatttgttttattaaggctttaagttttaaagtatgtttttccctagtttataacagtgtcttttgtgggaattaaatccatgtccagtgtatctaaacacatttgttttaaatgtttaaatgcttaaggattgctcctgcatagtccagtgttaatgaat

SEQ ID NO: 26694 - DNA, 201 bp, Bos taurus
cccacagattgaacccaggtctcctaagtctcctgtattggcaagtgaatacttaacccctagggccacctgagaggcccaggatgcacacacttggaccgaagtcactaggctgtgaagaagcgcaagcagccaagaagatgctcacgtggagagatccacaaggaaagacactgcacccttcagtctccagccatgact

SEQ ID NO: 26695 - DNA, 201 bp, Bos taurus
tgccgggtcttcattgctgctcaggcctttctctagctgtggtgagtggggtcttttctctagttggggtgtgtgggtttcccactgcaggtgccccattgttgtggagcaggggcctgagggtgagcaggttttagtagttgcaactcccaggctcagtagttgtggggcctgggggtccaaccactgagtggtatgtgg

SEQ ID NO: 26696 - DNA, 201 bp, Bos taurus
gtgttaaacaatatggataaactctaaaggataacatgcaatttcgttggaactgtaaaataaagtagttttagattcctaaaattgaatatgaaaaacattgcagtagggtgaggaaagaaaatattagaacatctgtttgtgaaatttctcattctgtattttataaaaaaaacaaaatgtgtgaatgcatgttattta

SEQ ID NO: 26697 - DNA, 201 bp, Bos taurus
gtcacttataattttatttaaatattttgcttcatatggcctaacttgtctaatatttcaaatgtgtgctgtgctaagtcgcttcatgtcctactcttggtgacccagtggaccataggccacaagactgctctgtccacgagattctctacgaagaatactggagtgagttgtcacgcccttctccaggagatcttccca

SEQ ID NO: 26698 - DNA, 201 bp, Bos taurus
cagcattctctgagatctgcagctgggctcaaagcattcaagtctcagcacaatcttctcggtaattgtagcccttgtctggaaaactgccttagtctgtcgccctagacgctccgcctcttgtcataacgctgctttccctgggcatacagagaagccttgccctgcctgctctgtggcaccggggcttgccacacttct

SEQ ID NO: 26699 - DNA, 201 bp, Bos taurus
aaaaaagagtgaacgtgagaaaccctggcccttgccctgccaatgaagcacaaccccaggtggtcatctctctctctccccacctgcaccccgccccccaccatgtgggcccaggcacaccctgtgcccaacaggtcctggaagtaataaaacttgctttttcaaagtttcctgacagtggttgctgaggtatgtcttgca

SEQ ID NO: 26700 - DNA, 201 bp, Bos taurus
ctgaggcctccctcctttgtggtatgatgttgctgctcttccctaaatcaagagaggagacctctttctccacccctttggctctgactctgactctgatgtcctggtttactctggccagtagaatacagcagaagtgactttgtgcagtgttggagctaggccttcagaggtgttgtaaattttgtgttcagtgtggtg

SEQ ID NO: 26701 - DNA, 201 bp, Bos taurus
cagtgagaggagggagggggctgccaggggctgccaggtcagcccttggggtccttaggttcctgggaaattcttttaggctgtctgggctcattatgccgtctcctgttagaacgtattttacttctccactcactagccggtgtcccggtaggggcttggtggctggacagagccagcatggcagggtttcctgtggcc

SEQ ID NO: 26702 - DNA, 201 bp, Bos taurus
ctatgatgtcgatagtgtggggcaatcagtacaaggctgagaacttaacttatatgttaaataaacatacctaataataaacatattccatagatttaatgagcaatgcattattgcacctgctttgagcccttcacatgctttcaaattaaagattgcattcctgggaagtgaagtgagaaacgtacagcttgggattat

SEQ ID NO: 26703 - DNA, 201 bp, Bos taurus
gaaaatatacttaatctcactaatgatttttaaaatgtatattataatgagatgcagttttgcctttcaaaatggcatcatttaaaaacatttaaaaagaataacagcatcaagtgttagaccaaaggtaggaaagagatttcttcatgcatctgtagtgggagtacaaattagcatagtctttgaaaatataattcatat

SEQ ID NO: 26704 - DNA, 201 bp, Bos taurus
gggaatttaggcaaacaatgtagtgttcttatttctgattctcggctctcttacccttttacctttctcaaaagaaaattcatttcattatgcttgacatatatacttaccatgtataaagcagacagctagtgggaaactgctgtatatagtgcagggagctcagcttggtgttctgtgaagacctaggcgggtgggatg

SEQ ID NO: 26705 - DNA, 201 bp, Bos taurus
agatggtgcaatgatcacatttcaagcttaggggcggggacgctcttgaggttgcctcctgagtttttctgagacaactcgagtggcctttgatggcttcgttattctctgggataacaaggtgcctttcactcctcttatccatttccttccattgacctgagaagcagtcatttttatgtgattggagcataggagtgg

SEQ ID NO: 26706 - DNA, 201 bp, Bos taurus
cacaaagagttgggcacaactgagcgactttccctccctccctcacagagggggacagtggctcatttggggagcatgtcattaaactgcctgaagcgtgtaaaggccattgccgagagatgatgtcatagctgaaattcttgtttatcttgaacttaaaaactcaacaagaataatctcctgttatttgcctatcatatg

SEQ ID NO: 26707 - DNA, 201 bp, Bos taurus
ggcaaggatacaatgagcagcagtctctaaaccacagagttaatccttagggcaaagggactctcaccctcagccaaggggaagaggttcctggctggggtagcaggtgcaaatatgaccccaaccggtgttgcagggtcctgcacctctcattccaccccaactgactttggaaatagtgttcctgtgaacttggctgaa

SEQ ID NO: 26708 - DNA, 201 bp, Bos taurus
atgggtgtcattgttattttcctgttttaatcacgaacttcacaaattgagtgtgttctagtaacagctgtattttaagatcaagaccataaaggggctgggaaacacagaatttatttgtcaatttctggctataggcatttgctaagggagaaggggtcttacatatttgcatatgtgtcaaatcaccttgcttttaat

SEQ ID NO: 26709 - DNA, 201 bp, Bos taurus
gggcacttgcctgacccagcgagtctgcctgcaggtgctgcctttggcttgagtggagtggggaggctggcctgttcccaggttcactgagcctcttcccactccagaatccggtgtctcctgctagcgtttatcaggtcgggtgatgatgcttcatgagacatctgctcattgactccctggcagatgcggagccccggt

SEQ ID NO: 26710 - DNA, 201 bp, Bos taurus
aatagtgattcttttagcatccattcagtatcaagaaaggacgtacatcctgggaagttagaagtcagttgacacgatggagagacccttggtgtgcctggtcaggtgtgtgtaggtgcaggacgaaagcaatatctccagtcctgtcactgactggctgtaatgaatgggaagtcatctcagtcttctaatccattcagt

SEQ ID NO: 26711 - DNA, 201 bp, Bos taurus
gctcacggaaggaaaatgataaaaagaggtggccagcactgcatcatctctgagattattttgcaatgatcattatgcatatctcatcaatctaacttctcttcctatggggcctttaatacaagtataaatgcaatagatatttaataatgggactcaatacatattcattagtacagaggccgaagagcaaaaattacc

SEQ ID NO: 26712 - DNA, 201 bp, Bos taurus
agtcaacacacatacggtcctgggtagagacaagagtatcacaaatactaaagagacagcaggacttgttgtttgcttgtttggtataaactggaggtgagagacatgctcttcctattgcgaggagatttgtttcccctttttgaaagcagttttccaagtctgagtcctaagtgggctctcatttcctctgagaatcct

SEQ ID NO: 26713 - DNA, 201 bp, Bos taurus
ctaagtagaaaaaccacagaacaggctcacttttagtgaattttgctctgagcattcaacctttgggaaatttccataataagtatataacagtgaaatatacaaaataaccatcaccaatgaaaaaaataccctcacctttttcccccattttcacctatattttaacacagcaaaattttaattagtatcattctttca

SEQ ID NO: 26714 - DNA, 201 bp, Bos taurus
ttgtaggaagagggcatgtgtccagtactcggagcagccatgacacatgtgcattgctaagtcgctccgtcatggccgattgtttgtgacctatggattatagcccgccaggctcctctatccatgggattctcgcatatctaactgatacacaggccatttcttgtgttgtcctgccccaaaccatgccttttccacctc

SEQ ID NO: 26715 - DNA, 201 bp, Bos taurus
gagaacccttgtttgggctgctactggactgccatggtgattggacatccaagggaaggctcagaagcagcagttcaacagctaaggtattgggtttccaggtaaacgaatactagaggagttacttatctattcattcattcaataaacagtttttagcatcttcactgtgctcatcactgaagaacaagaaaattaacg

SEQ ID NO: 26716 - DNA, 201 bp, Bos taurus
agtctggggcaggcccaagggctcagaggggatgtttctccttaaggataaaacgacagaagacccggtagaacaaaggcattaagctgttctgactgacagacagctgcaagggaacacggtgtcattgcgcactgagatggattactttttaaaataacctcttcccacccacccccaattctctttcaagttctttgc

SEQ ID NO: 26717 - DNA, 201 bp, Bos taurus
tgtcccctgggaccccctttgccctggtaaagcaataaagctgtattttctatttcacccaaatctctgtctccaagatttatttccgtgtcggggtgcagaggtgagatttgacctcaacatccctgtggagttatgtggtcttcccttcctacccaaacatccacatgcagctggatgttcaaaatgctggaataggct

SEQ ID NO: 26718 - DNA, 201 bp, Bos taurus
tcttctccaacaccacagttcaaaagcatcagttcatctaacaagggcaggatctaaatgctattgtcccaatacagctgctgggtacaggcagaagagggctcagggtgagaactgccatcaattctgctcatgctgcaacaggacagaattgttttatacatctccatgccttttattatttattgtttcctgtaagtg

SEQ ID NO: 26719 - DNA, 201 bp, Bos taurus
tccggcccgagctggagtgctgctttcaggacgcagcctgttctgtctctttccttcttcagcgggagtcgtgtactcaacacttccgagcgtgtgcaggagtgaatgagaggccagcaatggaagagatgcagggcggcggtctggtaggtaggcagttgggtggttccccgccccttcctgcctctgcgttgctgctga

SEQ ID NO: 26720 - DNA, 201 bp, Bos taurus
tatttaaacctctgcccatggaaatgggcatataatgttttcccccaggggaatttgtcttaggaggagattactatggtgaattaattttagctgctgtcctgtctggctcctaatttcagataatatgctcttttgatttatttaataggaccttaaaatgcaacaccccagagtttaagagaatatgatgataaattg

SEQ ID NO: 26721 - DNA, 201 bp, Bos taurus
gcccttgcagggctgtatgtggcacttcattcagggaagatctcactccagtagacaggagggcccacgccaaggccagtgtccgctttagctttaggagctctttgtagaccagaaactaggctaccaccaccttcagcttctgggacagaccaggaaaggcctcaggccctgggcgtcgctggtgaccactgcctggcc

SEQ ID NO: 26722 - DNA, 201 bp, Bos taurus
tttcctttagcagacatcatcctgaaacagtgaagacagtgctttcttattggttgaggtttgccctttctctgccagggttcttgctggggtgggccctcttttttctttttggtccaaagtgtagtttgctccatatactttaaagaatgaattaaaattatcttctctttggcctacttgtgggccatgaatattatt

SEQ ID NO: 26723 - DNA, 201 bp, Bos taurus
gtctgatatgtcatttcatgacttttgtaggattatatcgtgaagccaactaggtgatcctgtcaataacctggccaactagaatgtgaattagaatatgttatgaggggaaactgtcaaacaaaccatcactccaaaggttcatatttagccctgtggccatagggtttatggggttcctataggaacatcccaggatcc

SEQ ID NO: 26724 - DNA, 201 bp, Bos taurus
cggaagaccacagaacagccctgcaggacatgaagctggacaggaatatctgtgtaatctttgttggaaatacagttacgggccctcagtaaccgctgatccagtttggagcgatggggaaggaagggagaaaatgctagctgctgaattttacaacaggccagacatatcggaaggaggccatggtcctgaagccatgcg

SEQ ID NO: 26725 - DNA, 201 bp, Bos taurus
gaagcagccaacccaccctggaggttgtggggaggccctgtataaatttcctgctttgtctgcctgtaccccttttggggggcacaagtctccataccagggcctagcatcctcttctccagcacccctacagtctcctccatggatctagaggccaaaatgatcacacaaccgagactgggttttctgtcccttatttgt

SEQ ID NO: 26726 - DNA, 201 bp, Bos taurus
agcatctcgccctcacagtaagcaggcctggctccctggaccccctcttagaacccttgccaactcattcatcactgcttgtgttctggtgcagaaaaccgagctccagccttcgggagaggccgtgtcccgtgcagagaggacattgcgcttatgtgattcaacctgcctttctctgcaagccgacacctgaacttgtta

SEQ ID NO: 26727 - DNA, 201 bp, Bos taurus
tgacactgcccgccccatgcccacccaccagggccagctttggagcacagactgttttcccacctggatgaactgtcccagggcctccaaaggggtttccaatccctttactaagtacagataaaagttaaaccaagtcagaggttgttctttaatcattcatcccacttaaaacccaaagtgctttgctgagaccttcac

SEQ ID NO: 26728 - DNA, 201 bp, Bos taurus
aaaatctagggtctcatgatggcttgaatcctaaaatatttccattctaatatttgaaagtgtcaagaaaaaaataaccagtgtgcttcagtgaaatgaacgtcagtgtagatcttttccccatggtcttacagtacaattcagtggtgaatccacatgtgaagcctctttcccaccctgactccagggccagcagatcac

SEQ ID NO: 26729 - DNA, 201 bp, Bos taurus
gggcagcgacactcacacctctgtgcccggggcctcaaggtcacctccctcctccacgagcacctcctccaccggcagctggccccaggaggttaacacccacttccgtccatgctggtcacagaagagtgttgacatggcagcacccacttccctgggagaagcttggagccttccaaaaagtgtggcccagactgtacc

SEQ ID NO: 26730 - DNA, 201 bp, Bos taurus
ccatctgtgggtcttaacttcagaccttgtctgttggacaaagatgggtcccgaatctcactggcctctttgagagcctttgtttcctatctttaaatatcaatacttgataataatctacaagttcatttattgttatgggaattaaatgagatgatgtatgtaaaaaacagcatttaagaaatgacagttatggataat

SEQ ID NO: 26731 - DNA, 201 bp, Bos taurus
ctttaccagctgagccaccagagaagcccccctttcaccatttgatgcctcaaattactttaatcctctgagataggtgaactcttgttcccatttcctggaaatgaatactcaagcaagaggctcacccacgttaccaaccaggctgatggacacccagctgcccacggcctgccaggtctccacaagtgtgcaggtgca

SEQ ID NO: 26732 - DNA, 201 bp, Bos taurus
agcgcctgccccaccgcggccttcccttggacacccagggtcctcgccggatgtgggcgaggaagagatggcccgcacagaaggggagctgctggccagcggtcctctgggggcgcttgtcttctttttccttcctgtgtgtccgtctcacgtgtcaaagcaatggactctgtgatagaaaccggagggcaccatttctgg

SEQ ID NO: 26733 - DNA, 201 bp, Bos taurus
ccaaatgatctatttttaatttaactcttttggctccgataacagttaccgaactcgaggttctgctgttcctgatttaatgcgtttggatgatccttcaaagcatgctggcctgacaagctctgccaagcattccaaggagaggcccccttttggggttcgcttagtttgggctgcagtgtccacaggcctggcccaggt

SEQ ID NO: 26734 - DNA, 201 bp, Bos taurus
agcagagaaggctagcgggacagccacgccggccacaaacgcggcattcagcagcgcagggtcccgccgccgattataattaccgccgacaacagtcaacgtcagggctgcctctacttattggccgcaatcaatgatcatctgtgggcgacacattgaaaattcatcttacaaaccagcaccctgattgggttatttgct

SEQ ID NO: 26735 - DNA, 201 bp, Bos taurus
tcagggactcttccccttgccctggaacacacctcgtcaccagtttgaggaatggttcttcctataatgaatatgtttatcaacccaggcctcagagtgcggggcggtgattgagtgcagaccggagcgtgacacgctatgagagcaggaataaccttcacgacacgagtaccacaggctcacaaagccccggtgctgcct

SEQ ID NO: 26736 - DNA, 201 bp, Bos taurus
caatctcactcttttattttatagcatttacaaagtagttaacctctctctgtttacattttctcactttataaaacaagaaccttttataaaataagacacatgggccaccccacatcccaaggtcactgtggtctggggctctctcataaaacactgtgaaaagaggaaaacaccgaatactgtagagtattgatgctt

SEQ ID NO: 26737 - DNA, 201 bp, Bos taurus
cactcttcagtgatatcatagcagtagcaatttcacttacactctcttatttgcagtattataataagtaaaatcaacatgataatagttatcttactaaattgatcttaatagttctagcttacatttctcaaatcctgcagcattctggattcatactgttacacctgggggttacctcccatttcttggtcagttctg

SEQ ID NO: 26738 - DNA, 201 bp, Bos taurus
ccggccgcctgccggcccgagaggtcgtgggagtatcggcacttctccccctccttgcacagcccatgaagataatacctgcagacgacttgctttgtcccgctgccagtgctccggctctgcagccagctgggcccggcccctccccatgaggcttgggcaggcctcagacgtgacgggcggaacggggaggggcctgga

SEQ ID NO: 26739 - DNA, 201 bp, Bos taurus
ttcttttcttttttttttcctaatcagctttaagtttagtggcttcaataaacaacattggtttcgttcaaaatctacacttaggaaaaggtggccaggactgctgtcgctttgcagttcacacagcatcattttcatcttctgttcaataggagcaagtcacttatacttggcctatattctaccattttttacagaata

SEQ ID NO: 26740 - DNA, 201 bp, Bos taurus
aggccaccaaatccagaaggcaggtgtggttgcggggtctctgggtatgtccctccctcttgaaagtcctgtttgtcctccttcaggataacttgtcctctgagaggggccgaagttcaggctcccagagccacaagtcccgtcccccacctgagaacagtcccggcaggaccgtggcctctgcagattggacactgttgc

SEQ ID NO: 26741 - DNA, 201 bp, Bos taurus
acagcggattctgcctccaagtggctctgcagccaacaggcatactcttccttactcagaacctgggtgagacccgctgatgagtgcatgggccgtgccctgctgctggctctgcccctccgtggagctgcctactcaccctcttggcaatgcacaaggtgcgcaggccctccaccgcatacaagttgaggtaattctggg

SEQ ID NO: 26742 - DNA, 201 bp, Bos taurus
gcttggtagcaaaagggctgcctcggtctctggagggggaaagtccctgcagagggcggcagggtcccgcaggctcaggctgactctgggaagatgcacatgacaacatgagcccagcacactgccctcagcagctcttttttatgggctgacgtgtgttctcccccagaattcgtttgttcatgtcctaaccccagtatc

SEQ ID NO: 26743 - DNA, 201 bp, Bos taurus
attagcttctcagtctttcttcctcctcaggaccctttgtcggcttcccacagaagccacagaggcatctcaagggcctgtgtcctttcctggagaaagtgtccagaagttatgtccctgtgcagtccctgaggcaacagtacactctcagagagctgtgcggcccagagtgacagcggctgctgggagactgggtccctg

SEQ ID NO: 26744 - DNA, 201 bp, Bos taurus
ccatccatgtctgcatcagacagacgcccctaccctggctgggaggtgagctttcaggaggtaacagaaggcaggcaaaggaaaagcgctcaggagtttcaaagaagggccacctcgtgtgtgagaccaggaaaacacccattacttgtctcttcacacggtggaatcgtcacatatttcaggaagaatcgccccaaatgc

SEQ ID NO: 26745 - DNA, 201 bp, Bos taurus
ccactccatgtccaccaaagcaatgacatgacacaggacagatcccagctgtgcaccgcatcggatcactgtccctgtgggtaccaaagaccctgaacaaactccggcctgacggtggggaggacggggaggctcagacatacaatgactcacagcccaggactgaaaacagccatcccagacttttgggcctgaaggagt

SEQ ID NO: 26746 - DNA, 201 bp, Bos taurus
cagtctgccatagcaaagtgccacagactgggtggctcaagcagcagacatttctgatttttatggaggtctgatttggcaggagggctcctctgaggcccctctccctcctcgtagattgctgtcttcctgtgtcctcacgtggtttctccgtgccttgtctgtgtcctgatctcttctgtggctgccagtcagatcaca

SEQ ID NO: 26747 - DNA, 201 bp, Bos taurus
attcatcatctccaaaaacactgcagtattcaagattagtgcaaaaggggcaataaactgttgctggatttaattaaaaacaacaaatcatttggtcagtggtaatggatgctacaaacaacccatcaggtgcatggctatttaaggagccaatattttaatctcaaaacatccaattagatgagatcatgaagctgatga

SEQ ID NO: 26748 - DNA, 201 bp, Bos taurus
tacacaaaggtagactgattattttatgtaggttgggttttacagggaagttttgctaatacagctcaggcagattggcccatgggcacagaagatcgtcctgcagcagccttcagcaagctccatccagaacacatcctttcaggcaggtgcctcagaggggcctgggattgtacgtgagaactgtccgcaagtcccagg

SEQ ID NO: 26749 - DNA, 201 bp, Bos taurus
tctcctgcattgcaggcagattcttaaccatcttagccaccagagggttatcctagtgctggggtcccagggctgagggcaggtgctggccccagctagcgtgtgtctgcctgtctgcctgtgagactggagaggctctgtcccagctggagtcctgacattggctccagtgacgttggccactataagatcttctgtccc

SEQ ID NO: 26750 - DNA, 201 bp, Bos taurus
ctcggccattccagcgttttcaagtgtcaggatacaggtaatgttccacactactgaacagaaaccgtaagtttatgttggttctaattagggtcagacactcccaggccttgcaacttggaaaacatatttctagtgaagtaaaagaacatttgttttaaagtgatcacagcatgtggagaaatatctaccatcaaaatt

SEQ ID NO: 26751 - DNA, 201 bp, Bos taurus
ctcatcccccggctggaaaatggacagttgtacaggcatctggaggtcattctcctcctcctcccctactctctgttttcctggtgtgagactgagcttgcggaaggacgctacagaggctgtcagtgccagagtcagagcagcgtgtgagcttgtgtgggtgtgtgggaggcggtgaggggatgagccttagtcttccag

SEQ ID NO: 26752 - DNA, 201 bp, Bos taurus
gtcgttgtttacaagacgtaaggtatgaggccgtgagagagtggggcaggaagcctgactgaggcagtgttgttagttaatttctccacgtgtagaatacaaattgcctccctgtccataatctgtcagtctgtgcaaaatgggaaaaatagaattgcctttggaaggtgaatgaacacgatgaagacatgcacaatgcat

SEQ ID NO: 26753 - DNA, 201 bp, Bos taurus
ttatgtgtggaagttttcagtatatgtgcaggtgtggcactgaaatccttcttacttgatttccttgttaccttattttcacaagatcctggagcatgcaagtacagttttctgctcttcccttccattttctgagatgtcattctgcctcgacatgcctgcttttgtcagctgctactaaccaatagccactatgtaagg

SEQ ID NO: 26754 - DNA, 201 bp, Bos taurus
ccactggagtggctgatggcttgttccttgtagaactggaaattttggcaaaaacctctgtttattggaatagcgggcaacagtccctgttcgtactttcataactgcttccaaactggccatttatcctctgaggtaattcatttcttgtgttaacttaccaagcatagtcaatagcagttatggcttgtatttttcacc

SEQ ID NO: 26755 - DNA, 201 bp, Bos taurus
ccttatcagtcatctgagaaacacaagttttgaacactgaactctagtgttttgtttttccattagatttgcagagattgaactctccacagcagggatgagggagcaggcatggggcacagcattattgtggacaggcataatctatgctaattgcttgattcatctcgagctgtccttgatgcatttcatgatgacttt

SEQ ID NO: 26756 - DNA, 201 bp, Bos taurus
gcaagtgtttagctggttgaaagctgcagagcatgtgctgtttgtcaccttaaaaactagggcctgatggcaaaagcagtattttcttcctgtgaaagctgggtatgtgaagtttcaaagctgcctgaaaaaccctgtttgcatgttttctattcactgcagcaatatcactctatgacaagtgagaaagaaacatactgc

SEQ ID NO: 26757 - DNA, 201 bp, Bos taurus
ccccaggagagtgtaggacagaggttccccagtcccgttgtgtgattattcagccaaggagaagcactgtcttgctctgcagtgggtgtggtgaaatctttctcacaggtgtgttgctgtaagtacctgcaagcacccagtaatggccactcttactgcttggtttttgtaaatcagattttcagaagtgtgctcccagac

SEQ ID NO: 26758 - DNA, 201 bp, Bos taurus
atgaggacatggtgacaaggtggcgtctacaaccaggaggtgggtccttgctgagaacagaacctgccagcacctcatcctggacttcctggcccgtggagtgagaaagaaatgtctgctgtttaaggcacccagcctttggcaacttgatagcagcctgagccacctaaagtagtagtagcgttagccactcagcagtgt

SEQ ID NO: 26759 - DNA, 201 bp, Bos taurus
aaggctgctgcatagcccttggcatcagagttcccttcatcatcattccacaaatactctttaccttcctcttcattggatctcatttcctggagtacacattgttctatttttgctttactctctctttttttatgaaacacatcctcccatagcttcctgaaataaaaaggaaatggaatttttctgttagatcgtctg

SEQ ID NO: 26760 - DNA, 201 bp, Bos taurus
aaagctgctaactctcacagtaacccaccattgagaaaccgaggcgctgggaacccagccagcatcagccagctggaaggtgttgggccagagtagggacatggacctgccttaggattccctgggcaaaagtggacacttcttcagtgaggaaggggcagaagaaaagaagatgcacttctgaggccatttttttcctat

SEQ ID NO: 26761 - DNA, 201 bp, Bos taurus
gagggtcagctcgcaggcctgtctgccttctctccgtctctgcccccagctcattgctgggaacgcccccttggcaggcctcctcgctttctgccccttctggaaggtagtgaggtccacgcagaaaggtcagccttgtgtgtccagcacttctccgcctggaggcagagggctcaggagcaatctcttttcacccctgca

SEQ ID NO: 26762 - DNA, 201 bp, Bos taurus
aattaataaagacaagaggtgggctatgagtttgatatgatatttagtgagcttctcagagtgttcaagagtgagtgagtcatgggtagggtcccagaataagattcattgttacaaatgcttaggacttttttttaagcagtaacttgtctggttttaaaaacagggatctttccatctcattttgtttccatctaagga

SEQ ID NO: 26763 - DNA, 201 bp, Bos taurus
agccaggtgtctccctaaagaccatgaggccgccacctccacggctctcccgagcgtgcatttccacacaggcgaggaagacaggcagcctttgctacacatctctgaggcctggtgctttgtgttctggggtgctgtcgggttttcagctggccagcctggcttggccccggccccggcgggagaacgcgtgtctgcccg

SEQ ID NO: 26764 - DNA, 201 bp, Bos taurus
tgtggaactgttggcccttctcaagttagtagacttggaatcgatgggacttgactgtgatgtccaggcgtgtgatgtcatctcctgtcccacatgggctgcatgcagccgaggcccttcagcggaagtggtttctttctgtcaccgagagcaaagtcttagggaggccacttttcatccgcattcctcaccgaggtgttt

SEQ ID NO: 26765 - DNA, 201 bp, Bos taurus
agttgggttgcaatggtgccttggttccctgcaagactataaaataggcttcatggttgcctaaattctctagtcaggcttactagacagttgatagaggggcctatgaattagcttacttatttggagagtagctccaaataaccttgcaggtgttcctggccaggctttctgcaggaaggggccaggagctgtactcag

SEQ ID NO: 26766 - DNA, 201 bp, Bos taurus
ctacaggtcttcctcctgccaggcctttagtgcagagtctgagttaatttaattaagaactaggctgagtttgtgtttcgttgctggtattgttaccctcgatatagttaccacaggcctcaaatgcctctggaggcagtgggagacaggtttgctagaggtttttttgcttgttttttccccaaagaaaactgctacatt

SEQ ID NO: 26767 - DNA, 201 bp, Bos taurus
atccttttgctgagaaaaccacttgttcctgctttacccagctcactcttactcatattttcccagggctctgctcaaatatgggctcttctctgaggctttcccaggcccccagcacccgtgattgcaggatcttgatgcaccctggaaacccgactaccatcggtctcctgcttggatggtgaagatccgggaaaacag

SEQ ID NO: 26768 - DNA, 201 bp, Bos taurus
tgactccagaccctggggaaccttccctgtagaaagtcctcccaaccagaggggacagaaacatgcggactatatgagaaccaggctgcagccagttgctatcctgcaccatccagcgtggggcagacccagtgtcccccgagcagagaggcacagagaacgggagacagagccaggggttggcgggggcggggggcacat

SEQ ID NO: 26769 - DNA, 201 bp, Bos taurus
caatattcctttattactggtgcctatatttgtaatccattccatgacaagtacaattatgtccccgtcatacactaactgaccacggctgaaggtgggcgggaggggagctctttacaaggtatatctatccttttcagggaaaaccaccaggaagcattcagagcaaaggaagtcctgctaaccattctctctctacgg

SEQ ID NO: 26770 - DNA, 201 bp, Bos taurus
tatccctacaataaaatataaatcagctctatgaaaagaaatgaactaccaagcatgcaactacatgaattaacctcaaaaacattaaactaagtgaaagtacccagacacaaaattctatattgtatgattccattcatatgaaattgctataaaaagcaaaacaagagaggcagaaagaaggtcagaaactgtgtcaga

SEQ ID NO: 26771 - DNA, 201 bp, Bos taurus
tttccatgtcttcctctatattggttgctatagggcacatatcattttcataggtaatataggaagttattcttttatatataaaaaaagtttattctttctcactgtccttccattttaaaatgggcattccccaagttctgagcatttgacacacaatcatcctacaaatacaaaccacagtgcgatacagagcaactt

SEQ ID NO: 26772 - DNA, 201 bp, Bos taurus
agaagtcacaattcggaagagaaactggtattttcataccagtatactaatattctccaagaaaaatcagttatgaaaggaaagactggaggtatacaactagattgtcacccattcttgtggtttaaagaatatttaactcctagatacacatacttatttagatcttttaaagttactttccataatgcagaatatagt

SEQ ID NO: 26773 - DNA, 201 bp, Bos taurus
tccttgcatctactttcctgcagggattcccagctccatgtcttttttttagccaaagccctccagcggcctccatacataccctgtggtgtgtgtggccgtggaagacctccctactgggcagagacgggagaggaaaggaagtggcacccttggactgcgacatgaccctgtcttgcacaaggatacggatgaagcagg

SEQ ID NO: 26774 - DNA, 201 bp, Bos taurus
cccgcatcctttattctctaccatatctcttacgagcagtcaggccgtgtttgttcacacgttttaaaatacctggctcccgcacaacactggaaacccccctccgccgctccaaccccgaggtggacgcagggttggcgtctggcgagtgctcagcaaacacccgcgagaatgtgtagctgcggccggaagacgcaggtc

SEQ ID NO: 26775 - DNA, 201 bp, Bos taurus
tttttttttaatcacttaaggaatatgtgattagcacacacaattttctgttcacacttcctaataataatgaaagcttgtaaagcatttctacaccttagacatcagtcagcataagtaagtaaacacactgacactggcgaagtaagatgctattcaaaataagccaagactagaaagcaaggattttactatatttaa

SEQ ID NO: 26776 - DNA, 201 bp, Bos taurus
aaacctcttgtcagcatcttctcatctctgaagccaggctggagaggcaggtggtgggtggtcaaaagacaggaaggagtagggggcccccctgcctcatgagctgatggaatttgcatggagactgtgaacacataagcatccctgtttaccgcaaaaaacattggccagacgccgctgctgctgcttagctgagcagcc

SEQ ID NO: 26777 - DNA, 201 bp, Bos taurus
gtgctgctctagcatcacctgcaccatgagaggagaagcttgtgcatctcttagtttgtagaaagggctatttccagacatgtttgtcttctccttttggattccttatcttgtcgtcttcaagtcacaaggtctgctgatcaaatacactcccatgttttacaagaacttactttctgattgttctgttttactttaaat

SEQ ID NO: 26778 - DNA, 201 bp, Bos taurus
gtgcgtgcacagaccgtgtcggcccttgtgtgtcgccggggcggcagggggcctggggggcggcgtgcagaagtgcacttgattcctgatcacggcctgcatttgaatttcgcacttgccccagatggagacattccttggagctgctcagtggggtttgtttgaaatgggccatagctcagtgtcacatgaccctggagc

SEQ ID NO: 26779 - DNA, 201 bp, Bos taurus
tggctcagtttgacctttgaccttccacgaggccaggacgctgactctccaaggcatgtcctgggctagagtcagccttaggcagcactgggattcaggcattggccaatggtccttcagggtgctgggaggcttatggacctcctgttgtaaacttggattagcctttcccaagagcaactgagattgcactccaccagc

SEQ ID NO: 26780 - DNA, 201 bp, Bos taurus
gtttgtcctccagcaaatggtcccctttctctctctctctccccatcacaccctgtttttattcccccaaagtatttgatatgtgtttgtgcacagtggcatgatgtaccgtggaagatctatggtcgcaatttgtgatccctttaagaggaattgttctgtctaggaacaggattttacctaatttaagctttaccgaaa

SEQ ID NO: 26781 - DNA, 201 bp, Bos taurus
aatgctgaccacgttgggtggaagggctcaagttcaggggcaaggcgggcctgagcttcctgcagctatatcaggtgaggccccctcttctgttatcatttgtgagacatttgagatgctatttcctcctgtctgcccccgtagggctccacatttgtcccccaaagtgacacctctttgaatgcaaagggaacagtctgt

SEQ ID NO: 26782 - DNA, 201 bp, Bos taurus
taggttgggacacacagctttttgagagcaggcatccaccgtgtccacctttgcctggcaaagaataaatctgtccttttctacttcacacaaaactctgtcttcgagatttgactcagcactggtgcacagaggctgaagttttggcattattactccattttaactctgggagatcccttattatacctgttttttaaa

SEQ ID NO: 26783 - DNA, 201 bp, Bos taurus
caacgctggagtttctgctgccaaaaccattgtatggaactgtgccaatcactaacggcaactcaagcatcaactttttagcaccaggaatgtgaatgtacacctaatacgccaaagaccaaaacaacaacaagagagagagaggcacaaatgtaagttaaaccttatagtgagtaacccaattattttttcataaaaaaa

SEQ ID NO: 26784 - DNA, 201 bp, Bos taurus
cacagcgggctcataagcttctgccctctctcttttgggaagcttcaagtcctgagaacaagtgcccgccaacatggtggggcatgagaggctgtgtgccatgcagaggggccatcccacatcctagccactgtgtccattaattccactgtgcctcagatagctccccagcctcagcagttcaaggcggcagtccacgat

SEQ ID NO: 26785 - DNA, 201 bp, Bos taurus
atgttgtgtttcatcttttaaaactgatgctaaacaatgctatagtgaacatccttttgcatacattttgcacaggcctctcatcactgttagcaatacaattgcttaatcaaaggatatgtatttttctaagactgggacctaatgacaagctggtccttagaaaacttgaaccggctttgtgacaggccacaaaactga

SEQ ID NO: 26786 - DNA, 201 bp, Bos taurus
tggacagtgataggaatatggaaaaaaaaaatctgcctttggccatcagccccatttactcctaggatatcagaggggcctggggctgttcctataaggcgagggcatccaagggcattcgggaacctccatctcagcttccgtgctcgtctggccaaggctgccttcccagatcaatgcctggctgagaaatagctcttg

SEQ ID NO: 26787 - DNA, 201 bp, Bos taurus
ttatgagggtcagagtgcctatgccaaaagcgagcttggagagagggaaggctgatgaataagaaagagaattccagagaacaggatagatggggtagagagggaatgtagcatcatagcaaagaaattggaagctcccagagaaatctatagctatataatctgcacccaaggggggtgggggggtctatggaacactcc

SEQ ID NO: 26788 - DNA, 201 bp, Bos taurus
aaatttcatcttttaaaaaggatcacctgaaggaacacagtgatgtcaatggatattcaaaatgattggccatggaagtggtggtggtacatctagctacctagataacattcagatacactagtactaacccaaagctagaggatttggttttaaaaacatagtacaaatgataacataattaaggcaatcccactctcc

SEQ ID NO: 26789 - DNA, 201 bp, Bos taurus
gagttggaattctgatgtgctgtgtccataaagctttgataggcactgccttgtatatccagagagcagggtccttctggatggagataagtggatacaaggatgctaggcaaagagaacttaaaacagtacaggcactacaaccaagagtttgacaatctcagctatgaccaacggttcttttttttttccttcttcatc

SEQ ID NO: 26790 - DNA, 201 bp, Bos taurus
ttttggaaatcagatctagatcaaacccctattctaccttttgatgcttgaagatgttgacaatgtctgttgacctttggcacttcattatccataatgcagagagagtggtacctttctggttgaaaaatatgaatgcatctgaaaatattagaaatgttcaacttaattcctacgctttcctctctttactctattgta

SEQ ID NO: 26791 - DNA, 201 bp, Bos taurus
ctctttcttttcagcagggtgtacgggaaagtttgagatgtgcagtttttctttatagtctcaacaattcgctgttttcagaaagggggtaggggacagaacatacagaaaagatgagaatgtgtaaaaatccatgaagttttaagcatatttgagtttgattctgaaagatgaattggtatataaccccattccagaaag

SEQ ID NO: 26792 - DNA, 201 bp, Bos taurus
gactgagcagacacacacacacacacacacatctcttaaattcccttcttagaagcagaacagcctcatcaaggaggcactatgttagatttctttatcttattgtaagctgcagctaaaagaagcctagggtatgcaaaaaaatagagttgaaaatgattgtctagcaaccagaagctgttcagacaaatattacatcac

SEQ ID NO: 26793 - DNA, 201 bp, Bos taurus
atcaagaactgattttccaccttttgcagttgaccataaattaaacagatattctggaaaccagaaatcaaatataaaatcttcttggaaatttgacatactcttccaacagaaatagtttaaaatataattttatcccaatgacagatttaatagcaaacaaatcaggagcaggtctcactagttcttacagttcccagg

SEQ ID NO: 26794 - DNA, 201 bp, Bos taurus
acagaaggattttgatttgaagacagcttaccaccctccctgtgaatgtttgttctggtgttaatggatcttaaaacaatttgtttacaatcataaaccacctaaaagaatgtaaggagtcaagctttccaatatgtgttgcaatatttgttaaacagattaatacacagagaaactacagaaagaatacagtataaagca

SEQ ID NO: 26795 - DNA, 201 bp, Bos taurus
gtaaacaatccgtgtcaacatggaatgtccgcattttaaggctgtgtgaggataaattttactttcttcacaagggccttctgggaagaactttggcacatgcggacggggagaatgtgacctagaggagaagggtttggagccctagctcattctgtaaccccactcctgtccacttagttgaggcccagttagggccca

SEQ ID NO: 26796 - DNA, 201 bp, Bos taurus
gagaagttttaaaagagcaaacaatgggggaataaaccccaaacaagacaaaacagttggatgctggggcacattaccactgattgaggtagctgctcctgaagacctcatatttttattttctgaagctctcagcagagatttctgccagcttcttatcaatggccccatttgatatcaaatatccttcaaaggactcct

SEQ ID NO: 26797 - DNA, 201 bp, Bos taurus
attctagactacttttaatctcaatgtagataagtgtataaatttacaggacctttggaataaatagctgactgtgattaacaactgatgtttctgattgttggaaatgtatttggtgaaggactcagctctttgcagattctcacagtaaatctggtcaaacaactttcttaagatctttttaaaaattttaaaattaaa

SEQ ID NO: 26798 - DNA, 201 bp, Bos taurus
acctaatgtctttctagtgatgatttacataatcaatcagcactcatgatgaccttcagtggaagttatgataacacaggtgagtgtttcacatggagcacgtgtcacatggaagaaatactttttttcttccttctgtaaactggctgagaattatttttaagccattgacaaaatggaacaaatgtctaaaagttgttg

SEQ ID NO: 26799 - DNA, 201 bp, Bos taurus
tggcctcaagaaacaaaagtccttcttgtaggtactagcatcattcccctgtgctttgagatataattgttctaactggtcttccccaggaaccattatctaggccacttctttgctcccacttctctagggagacaattcttatcagaaggcaaaaaaaaaaaaaaaaaggtgagggggaagttatttagaatttaggga

SEQ ID NO: 26800 - DNA, 201 bp, Bos taurus
tatggtatcttcataccacagatatatttgacatatcttttgtttaatatattgatagaatccttttttgcacagcttatgctttttgaaagtatcttcaaccaagaatggtagactgaaatttgcgcaattaatttctattggaaaacagaaatttggaatgatctagtttatatattcaatctagtttctattttcagc

SEQ ID NO: 26801 - DNA, 201 bp, Bos taurus
gtcaaaattctagaaactacaatgagagggaaagaagaagacaacaacgcagtggtaagacgccacttcgcagcacagacataaatactgctctccaggaccctctgttcctttcagagttttgatatctttatccttgccggcaacattttttctcccctcttcattccttgggccattcttcctaacctctcctgtcct

SEQ ID NO: 26802 - DNA, 201 bp, Bos taurus
gcacaagccactttaacatgaaccagatgttgagtgcacggctgggggctttgagcggagattgcacattctggaggtttgcttaatggggtgtcccaccgttttagaaagggcagctaatttccttggggcactatgcaatacaccacggaatgctggggttctgggtggtttttctttctcggccatcctatgtccaca

SEQ ID NO: 26803 - DNA, 201 bp, Bos taurus
tgactttcaacataaatttcccacccctgttaacctcctaaagtcaccaactcagataatgattctcttcccttgattttcgccagatgggaaacaagagatttccaagaaggtagaatattttcttcccaactccattgtcttttggatgtagaacaggtctgctcatgttccgagtctcaaagggaccctcaggaaaag

SEQ ID NO: 26804 - DNA, 201 bp, Bos taurus
accccaatttaagcaagacccgatggaacatccctgttccatatttcctggttttagtcttctgagcttgaagaagttcagtatggccaacaaattttggttttggtgctttctttcacctgtatactacgaacttttgttcccttctcataatattcattgtcaaataattctgtttggtaatctagtcttaatgacatt

SEQ ID NO: 26805 - DNA, 201 bp, Bos taurus
gttcacacctgactctgacctccagccagagatgctatggaaaggatacacatccggtccagcaccaggaggaagatctcgcgagagcaggcaggccacatggggctcctacgggaagaaggcggtgtcctcctccccttgttcctgatcagaaaccaggctagggaactgcagggatggggcagagtcatgactggccaa

SEQ ID NO: 26806 - DNA, 201 bp, Bos taurus
tttttttttttaagagttcataaagcacttcagtattctgtggttcatagtgtcattacagagaacagtagctatggccattcaagaaatttggaaacgcctgtaagtggagttttagctagtagaggacaggctttgattctgttagtgttcctgtttttcactgtttggaaggtctgtaattagctcagctttgggcca

SEQ ID NO: 26807 - DNA, 201 bp, Bos taurus
ttgatccctggttgcgatcccccatgcaactaaagatccccaggacacagctaaaaaatcccacggctggggatcccacacgctgcaatgaagatcgagggtcctgaatgcaacagctggggcccaggacagccaaatatataaataaataagtgcttgtttttagaaaaagtcaagtcatcttgacttgagaggcacatg

SEQ ID NO: 26808 - DNA, 201 bp, Bos taurus
aataacatttgagttgagcctcaaaagatgtgcaaaatttatccatgccaagttgggaacagttccagaaatagaggcaacatataaaaaccatggcaactgtctgcctttctccacatttacatgcatacctgaggatgtaaatgagataacaatttatacattcatgtgcatgaaggtgtcttaaggatagataacttc

SEQ ID NO: 26809 - DNA, 201 bp, Bos taurus
gctaccctgagttcaaaccctggcacttggcagagcagccctgaggctgcctttgttatcacaccctcaccagcagttcaaacctaatgaatcttctacaaatgcttttcggaattctgctggggtcgtgggtaatgcaattaggagataaagaagttgactggaatgagacgaactcaaagatcacgtttcagacaaatc

SEQ ID NO: 26810 - DNA, 201 bp, Bos taurus
ggtaatttctccatgtgaagcttctctttacttcccccctgactgcccagttagagtctgaaggctgttgtttctgttgatgctttctgtggccggaagataccaagcagccagggtgggctgagctatagcaggtggcacacagggtgcagactagttctggccagaagacgtgggcttggtaacttttgctccggggat

SEQ ID NO: 26811 - DNA, 201 bp, Bos taurus
catcagtccttccaatgaatattcaggactgatttcctttagggttgactggttggatctccttgcagttcacaaaagcatacaaataggaaaatatcccatccatttggagtaggatatttaagcacaagccctgttatcagccagcagccttatggcccctctgccatgggcatcccatttagtcctgatcaacaagtt

SEQ ID NO: 26812 - DNA, 201 bp, Bos taurus
ttctaaaaataattattaaacactggttgggaccaaacttttaaaaaactcttgaatatccttgagttagtttccaggcccatgtgaagtattccttgggggaaaaggaaatttgtccagtgggtctgtagctggtaccacattccatgtttctgtacatgccttgatgtttctttctgctgccactggcctgtctcccca

SEQ ID NO: 26813 - DNA, 201 bp, Bos taurus
cttttaaccagaagaccagggtgaagtgaagaattcccccttttccacccatctccctcgtgacgccagcttaggggccgagtagtgaatccgccactgacggcgttggcaaggcagtacaagcagatacaaacatctcgcaccagtctccttatttcaccaaccgaggcacagagaagtacgcttcaggtcacaggccag

SEQ ID NO: 26814 - DNA, 201 bp, Bos taurus
cagtgaagtattcactttagatttgtggatctgaagcatgaaatcgccagcatgtagtttttttttttaaaggcagaccactggcctaaagagcaagagtttggggagaggggaaaacccagttgagcagcctccttcaaggcactgattggggtaaatttcgcactgaagggctaaatcccatcaactcagagcctgcct

SEQ ID NO: 26815 - DNA, 201 bp, Bos taurus
ccttgaaatatatctcacaattaatgttcattcacagatattctcccatcattgtcattcatgtcagttgactactagattgacagatggcaagttgtgcgatttttttctgtgaatttgcattttctgttcaaaatgtcacctttttcttattccagatgaaagctgatactccagatttaaacaacaacaaaaacaatc

SEQ ID NO: 26816 - DNA, 201 bp, Bos taurus
cagattaaaattatttccataaataaggataaagcaaacccacttccttgagtccattatttcaggtgattgtgatttccgtgaacattagtgttcctgagtattatttgaatatttgcttatgtacttgtgggaagcctccctggtggttcagatggtaaagaatttgcctgcaatgcaggagactcaggtttaatccct

SEQ ID NO: 26817 - DNA, 201 bp, Bos taurus
gggccccatctctcctttgatcagtcacggctggatgggagatttttgaatcattttattgtctgactgcagctttatagattctctttcaggaagcagctcacttttcctctttcttcctctggcctctaattctttctttgcttcaggggtcctggtagttcagggtctatgtgtcaaggcctttggttagatcattta

SEQ ID NO: 26818 - DNA, 201 bp, Bos taurus
atattggggggccccctggggagaggaagttagcccagagttgggtgtttcggtgattttcgtctgaggtatataatgaaatctatgagctgtaaagctgtatagaaatttccatcctgagcatactgcaaatgacttttgtactttgagaagccgaatcccagttgagtcctgaggttattattctaaggtcatctttcc

SEQ ID NO: 26819 - DNA, 201 bp, Bos taurus
tgtggtatctgggtctgtatacatacctgcatacccaggtatctgtggccaggggaagcaatgatctggttcagacctcttcttcattcattaattaatcgtgaggctaatatatattgaaggccaacataagcaagaaaccatgctacgacaaagtgcagttgctcagttgtgtctgacactatgcaattccatagaccg

SEQ ID NO: 26820 - DNA, 201 bp, Bos taurus
ttctgtccagtctgatttacagttgagctaaatacatcattgaaaaaccactgtttatattttctgtagcttggaagatactagacaaagattaaaaataaataaacagctcatcaaggcttggaaaagtttcagttatgcaggatgaataatttcttgaaatctgttgtacggcatagggcttacagttaacaatattat

SEQ ID NO: 26821 - DNA, 201 bp, Bos taurus
aaaatgaattttatgtctggaaggagcaccaggcaaatagacccctgaggctgaagttttctattaactcacaggatagtgacttaactgaagaaaagcagcacgtgaacctcctctctgaatcctcccagcatccctcaaactgacttcaagagcctagttgctcggcacacctcaccccctgcacaacagagctcagca

SEQ ID NO: 26822 - DNA, 201 bp, Bos taurus
aggaaaatattaaattggtttctactcacccttggagttcagagacaagtttcattctgtgacatcacctggtttggtttgtatctgagtttctatccaatagaactactaaagagtaggacctgtgagtcattagtagatatgagtgggtgatacaaattcatggtctggaaacacaccatggtgatgggaaacagatat

SEQ ID NO: 26823 - DNA, 201 bp, Bos taurus
gggctcattattttgtttttctatccagagaggaaagaactttgaaatggcagcttctgacaagaataaaagaatagcaataatcatggtagctctgtccaagtcaattttctccatgtggcaaaatatgataggaactcacaaaatgaaaggataccaggctacccagagcatagctaccaccagggaactcatcatgaa

SEQ ID NO: 26824 - DNA, 201 bp, Bos taurus
gcagctggaggaagacagagctctggctccatctcagtccccaagctgtatccctctggccatggtagcacttccccaaacaccacagaaaggagagagctggatccttccagccctcagaaggactcagcctcttctgggctgccttcccaacaccccaaacaccagccacttcctttcaaacatatttccaagtgaatg

SEQ ID NO: 26825 - DNA, 201 bp, Bos taurus
atagttaccatgattatatatgatatcagtcaatgtcatgggaaaatattaattgaaatgaactaatccactcagtactgagtgcagaacaaacttgggcatcaagctggagaaggaagttccactccctgtttgcctctcagatccaggtaaccaagtcttctagaagcctggtgaagggctacttcttcccaactaacg

SEQ ID NO: 26826 - DNA, 201 bp, Bos taurus
acggcataatgtccaacacacatgctaaaggaatttgtagatgtgatagccatctgtgggacagagtgggggccacgacacgtggagaaggcaggcatcagttgaatcctaatttttccaaagcagcaaaacatagattctggaaacttctagctcataaacttggaaatctcagcagccaggaattagagtgagttgaga

SEQ ID NO: 26827 - DNA, 201 bp, Bos taurus
tcacctgttgtcacaagctctgcagggccctggagcccccagggaggcaggaggaggcagaggtcactgtggctgctatctgccagcctcctctctgcctgtttggagtcggttctggccattcatggcatcgctggctgtatccctgagggctgagcgctgggagagcaagatcagggttgagctgtaatcttggctctg

SEQ ID NO: 26828 - DNA, 201 bp, Bos taurus
cagcttcgctgctggttcagtgcactctgcgagagttttgtgatagagaagaataaacctgactccatactgaatctgtttattttactttaaccatcttatctattgctttcgctgaaagttaagaatgttgcctgtaccctgaaatacaagagagcccattccctaggctctgacctttgagggtataacacttctccg

SEQ ID NO: 26829 - DNA, 201 bp, Bos taurus
agcctggcacttaaatacctgttgaatgaataaaaggaggaagaaaaatggaaggaaggtaagtagaaagaaaggaagaagcttttatccttggagagaaggtggttagctatttccaacattttctcaaagcccatcttgggaccagctttcttttttcatagagtcaacaaaatccttaataagcacctcttccatgtc

SEQ ID NO: 26830 - DNA, 201 bp, Bos taurus
tggcgtgactctctgcatggaacatttcatattcccatgcaatgaagaagccttcgaagtgctagtgggaagctgctgtataacacagggagctcagctcagtgtcttgtaatggcctagaggggtgaagaatcagcctgcaatgtgggagacccagattcgatccctgggtggggaagatcccctgaaggaagaaatggc

SEQ ID NO: 26831 - DNA, 201 bp, Bos taurus
cctcgggggcccttttcaaactctgcactggctcggctccctttacccctttgtttctcctatgaaggcacaacctcccccacagggctccttggctcacaagggccaaacaagcaggtatgtttaaagcatcagcagccagaggcaccaaaaaatgaggacaattcagcttttctgcactcaagaagtctaagactctat

SEQ ID NO: 26832 - DNA, 201 bp, Bos taurus
tgtccgtggatcctgcagcaccactggcatcttcataagagaaaggacagagagtttacacacacagggttgagagaagatgagcatgtggagggggaggcggagatgcccccaaagcaaaggggcctccagaagctaaaggagccaaggatggaccctcccctggaagatcagagacagcaaagctctgctggccttgat

SEQ ID NO: 26833 - DNA, 201 bp, Bos taurus
agagaccttggcagctgcaaagggcaacctctctcccattctctgccatagcctggagttccacagtcgagccacacggtcgggttgaagaaggaattcacagggcctggactccatcttaggcctgttcatgctgatcatgctcagccacctttccaatggactctgaactctgtgtttagtgcccatgaaaacaacaac

SEQ ID NO: 26834 - DNA, 201 bp, Bos taurus
ggttccctgggctgtttccagggcaggacggagagttacaggctgaggaagtatggccattggctttcccactgatagaaatccatcgtctcctacaagggccgatgagtgtgtcaggcaagtgtctactcctcagttctgtctcgtcacaacaaagatgtggagtgacggacattaaagccctcggcgtgtcacagctct

SEQ ID NO: 26835 - DNA, 201 bp, Bos taurus
gggtcacaaagagttggacatgacttagcgactgaacaacttttctctaagttgtcaccaaaaggtggacagattagaatgacctgaccaccatgtgatacggcccttgccttctcctatactactcacagggccttctggaggaagcaagcctgccccaggcttactgtgctggcgtggggttttatttcaaggcgttga

SEQ ID NO: 26836 - DNA, 201 bp, Bos taurus
ctactaaggctgtgactatccgtttcacgcctcttgcctagcttctcgtcgattgctgacaatctttgagattcctggccttgcatcacccacccgtggtctctgccttcatcttcacatagcgttcttgctttgtatgtgtttctgtcccaagtttcccattcttctaaggacattagtcatattggattagggcctacc

SEQ ID NO: 26837 - DNA, 201 bp, Bos taurus
cacaggctaggtcactgcccttgtcatgagggggaaggctgggagacaagaaggaccctgtgtttcattccccatctcctaacacaggcaaatacctgtcgtgatgattcgtggggaggaaggcccccctgaagtcacagaaagcccggattatggcatatttttaaaaggtgagttctgtgacattctactactttcagc

SEQ ID NO: 26838 - DNA, 201 bp, Bos taurus
gataaatagcatgtatgatctgtaggcagaggccaggagatgaaaaactatgtaaggtagctttaagaaactatcagaaaaggggaaaatagaaattacatattagaggaaacagatgacacacctcagtttggacttcactctgaagacaaataacaattgttggttttgggggcaagagagatagggagacgtttgtgt

SEQ ID NO: 26839 - DNA, 201 bp, Bos taurus
gcacttcctataatatgagagagacaggagggaccaaccagtctttctgaaagagggaattcacatgagaactagaaagttaagagatggttgtgctaattcatcgatataattatgcttgttttatttgaaccatcatcccctagtatattcttctatctctgtcgccagacttctgctctacttttttcccccaaatcc

SEQ ID NO: 26840 - DNA, 201 bp, Bos taurus
ccagtttctctctttgtaaaatggagtttattttgaggactaaaggagaaaaaaaacaatctcttataaattcaaaagctcttggccgagcactggagaattcagaggactcagtattattagctggatcctaggaaaagcaaagcctgccttacatctgaagcccattacaggggaaaaagcctccctgggtagcgggtg

SEQ ID NO: 26841 - DNA, 201 bp, Bos taurus
atttatttatgtaggccgtgcccggtcttagttatgacatgtgggccctagttccttgatcaggaactgaacctggggcccttgcattgggagaaaggagctttagtcactggaccacgagggcaagcccttgggttaccgaaaggtgtggggtctggctgctcgctgccccaaagccggtaaacaggccaggttggtgga

SEQ ID NO: 26842 - DNA, 201 bp, Bos taurus
cctgtctgacttgtgtggctaggaatggttgtgtttggcctgcgggcctagggaccatcatgcccagggccagcaggcctggctctccctcccaggggcctgcagtgactgctgtgtgttcatgcagcagtctgcaggcacagtgctttctcgtggtcattgtcagagatgtagggtggtcttgttttgcgggtaaggaag

SEQ ID NO: 26843 - DNA, 201 bp, Bos taurus
aaattcagaaaatcatccatgttattatattcactgtgctgtagctataagtaggtaaaagctactagtctgcatgacaaggcttggaagtatagaaaacaaaaagtctgatttgttgtgatagcagaaggaacacaaggtagaagcacaaacactggagtcagacagacttggcctgtgtctcagccctgccactgactg

SEQ ID NO: 26844 - DNA, 201 bp, Bos taurus
aggaaaaaacaccttcatatcacaatcacacactttagaactggaaaagactttaagtccaacctactaagaccaatttatagttctgtcatccccaagactgcttctctctccttcttgtgtgatttatttaacaatatcaactggcttctagggtaattagaaatactcagatagctagcaaacttgcaacaaacactg

SEQ ID NO: 26845 - DNA, 201 bp, Bos taurus
tgatgctataaaagatccatttgaagtgcaaagtaagtcagtgggtcttaatgtaacagaggacaaagagttcattgatatggtttcagcatttacattgcaactcatctttaagaaactaacatttgccaagttttggtgtaatatcaaagaaagtttttcaaaactatccaaaaagactttttaaatatccctttattc

SEQ ID NO: 26846 - DNA, 201 bp, Bos taurus
gtgtgcttgatataatactgaggccaagcttgcaaaaggactggaaattcaggctctaatcaccttgaggcaatatgtaagatggatattctgtaattaaattccacagcaaagagattaacatgttactgagtgtcctcagtttttaatgatgtagccttttggagggtggcacttaatacagatcttaaaaagaatgat

SEQ ID NO: 26847 - DNA, 201 bp, Bos taurus
gattttgtatattgaaaaccctgaagatttcacttaaaaactatagagacaataaatacagtaaagctgcagggtataatatcaatataaaaaagtctgttgcagacgtagagaatgaactgaccattgttggcaggaaggatgggggaaagggatagttttattcaattcacataaaatttaaaaacagaaaaaactaac

SEQ ID NO: 26848 - DNA, 201 bp, Bos taurus
aggaatcacctaataagcaccccaaccttgaggaaaaagagggaaagaactggggactgaaaatgtgggcaaagtgcctggcgaactcatttgcctgcactgctagaatatcagcttcctgagggtggggatttttttgtctgcttggctcacccactgtgtttccagcaactaaaatagtgcctaacacacagaagacac

SEQ ID NO: 26849 - DNA, 201 bp, Bos taurus
aaacccattatatgttaacagaaatcacattttcataaaaaataacattttgggaaatctttataaggactagtttggtagaagatagctggagcctcatatgagcttctgcattcagcctgtgatttcttgttttggctgagggaaaaaaaaattaacctaaaattgtatagccagccaaactgaaattagaatatagga

SEQ ID NO: 26850 - DNA, 201 bp, Bos taurus
tttttaaaaaataactagatatttcaaggagaagtggcatagttcaagagagctttgtcttctgtcaatataggaaaatgtgactttaaccaactgtattcatatggggagagggatagatggggctgattggaattattccttcttcattcctttagaatcttttatatggaccatttttaaagttttagttgaatttgt

SEQ ID NO: 26851 - DNA, 201 bp, Bos taurus
tgggctggggtttgcttatgtgccctgcagtgttccactcctatgccatctcatctgcaccagactcttgccctaaaattttccattttagtctcaatctatattcatgctttgctccgaatacaaactgaattctaggcctttcttttaaaagccctggagtagtatgtattctctataactggacaattttttgcagct

SEQ ID NO: 26852 - DNA, 201 bp, Bos taurus
ggtatgagggctcagtgccaggcaccactggcatctccccagatcctctgactccaggttccaaacctcagcattttctgccagatggggcgcagttctaattcaagtaagctgtgcccccatgaaggtatgagccagcggaagacaggaagaactgagagataagactttaaaagctttgagcttgaggtaggaaaggag

SEQ ID NO: 26853 - DNA, 201 bp, Bos taurus
cccttgaatatttagatatagaattggaattctgtgccggtgttactcagacgaaaggtgccactgagaagagaggcgtctgtctccatccccacgtcccgcactggcctcatcttgtgatgtccctgagtgagtcctttcatgtccccaagaaaagggatggcagaactggtgggctgtgctaaagagtggttttccttt

SEQ ID NO: 26854 - DNA, 201 bp, Bos taurus
agtcagacgcgacagcaaccttcactcacctcaagacaatcctgtaggatgcacactgaactgagctgtggatgaagcccagagaaggtgaataattgactcaaggtcacaggcttgacagggtgacactgaagtacaaactttcttgtccggctctgctcctatctccccacctaccccttccccggcacctgctggcac

SEQ ID NO: 26855 - DNA, 201 bp, Bos taurus
ctgccccgcctccaggtcatcacagagcaccagctgagctccctgtgctgtacagcaacttcccactagctattttacacgtgatagtgtatatacgtcaacgccactttctcgattcgtcccaccattcccttccacacccccactgtgttcacaagtccactttctatgtctgcatctctattcctgtcctgcaaattg

SEQ ID NO: 26856 - DNA, 201 bp, Bos taurus
ctctgaccccagcctgggccctggctttcccgggataaatgatgccgtggtcctggctgagcagttggagagggaagccaaggagggcgcagccccagggactgtgagcagagaggtaggtgggcccgggagagaaaatgtcccttgagcagcagttctgaccaggaggtggttcacagagtcaggaggctggcttctctg

SEQ ID NO: 26857 - DNA, 201 bp, Bos taurus
ctccaggaggtgccagctccctggtcacccatgcagacagcgccatggaggaaaggaccctcttgaccaccagggctgctattggacttctcattaaagctgcttgatgttggccccccagtcccaatcagagggctccttgctttctcacagctggaggctaccgttttgacacagtctcacttcctgtttacaccacag

SEQ ID NO: 26858 - DNA, 201 bp, Bos taurus
tctccagaggccggaacagggcaggatgagcagctggcaagagccagagggtgagcgccacccgcccaccagagctgctcagctggcctgtttggcagtctgctggaggcttgttcagagccaacagggcagaaggaatgacagacatctgtagatcccattgatcagaccccacccaggaggttgtcaggcctccaagtc

SEQ ID NO: 26859 - DNA, 201 bp, Bos taurus
gtatatgatagggataaagatttctttgtatatgtgcatggagggaaaaaagaaagacaagaaggaaggaggaaggcaggaaataatccttgtgaatcacctagtaaagatttctgtcagtatgttagagatacaaatttcagtgcacatgtggaaggaaagagaactcttgtggattatgtattacagataaagatttct

SEQ ID NO: 26860 - DNA, 201 bp, Bos taurus
tgctttgcatgaaaatcagagtctacagaaggggaatgatggtgcccctagagccagccagtgccctgcggagcctggtgggacctgagttattggaaaaactgacaaaattgtccagtctctgaccaggtctttgttttgttttatttttccttaagatgtgtgtttgtgtgtggaccatttttaaagtctttactgaat

SEQ ID NO: 26861 - DNA, 201 bp, Bos taurus
ggttctctgagccatatggcctgatttgcagttgaaaaagacccctgtggtccctgggagggctagctgggggggccagggcagaaggggagcccagtcatttagaaggcaggagcagggtggtgagtggtggtctaacccagaagatacagtgagagcagagctgaggggctgtgtgaagggccaggcctggggatgaca

SEQ ID NO: 26862 - DNA, 201 bp, Bos taurus
gatccaaattgcaggggtgggcagcagacacttcgtaaggtgagtgtttctggcattacactttgaggagcccccctcccatgcccattcccactctgagccctggactcagtggagaagcaggactatattaatacaccagttggagggtacctcaggacagacatgcgctcctgctggtgccaaaactatgtctttgga

SEQ ID NO: 26863 - DNA, 201 bp, Bos taurus
cagcatgtgcactccggactgggacagacccatcttacccaaccaaatactgggaggacacggcctggccagcctggcctgcagcagatctctggtgcagcggttgaccagagagctgtctttgagtgggtggaggcgggggtgtgtctggtggagggagtgttgactgggaggacagaggctggccaagcatttcccatc

SEQ ID NO: 26864 - DNA, 201 bp, Bos taurus
actggaaaccttctggaaaagtttagtctttatcagaattaaaatatagtgttgtaattgcaagcatactagttatttgaaaacctaaaatattcttaaaggcttggcaccccgattttgcagtttctgttgtttctttggtttagaatttctaggtagaagcaagccattgtttcaaactactttcttctgttatttgtt

SEQ ID NO: 26865 - DNA, 201 bp, Bos taurus
gcctgtggcaggaggaccagagttccctggaggtggaggacagtggacatcccagcagcagtgactgacatccttgaggggcagagctgtgactttcggtcctggacagtaaggccaggcaccgcctgcttgcagcaggaatgaaaacgaagcctcttcagacaaagaaagagagggaatggtgaggggatgcctggggcg

SEQ ID NO: 26866 - DNA, 201 bp, Bos taurus
gggcacatttgtgtaatcaacacatactcgtcaagtgccggattggtggccagcgctgttccagaccatcagtggacaaaaccactggcaatctcacctgtggggctgacatgctggacgggaggcctgctggggttgccagggtgcaccatatgcattgaaatacaagatgacagcgaaatactgcaggaagcaggggca

SEQ ID NO: 26867 - DNA, 201 bp, Bos taurus
ctgcatgcacttctgtgtctgaaggtgtattcctgatgtatccgtggagagagatgtattccacgtccacttactcttccaacatcttctgaaattttctagataatttttgcttccttgttcttgccataaattaacttttaaaaaaatagctaaaatctaaagaattttcaatactctgcagccactagaatgtaagtg

SEQ ID NO: 26868 - DNA, 201 bp, Bos taurus
gttgtcaaaaccccgagaggtaaggacaggggaaggagggagagctggtctgtgctacggttgcagtgccagctcccagcttgcctgaacttggaacttatgtgagtggacgtcattacaatgggatttgagcctggtggtctggagccccaggacggtggagggaggagccaggggctgcaggtgctggccctggaaggg

SEQ ID NO: 26869 - DNA, 201 bp, Bos taurus
ttggccaaaatgattggctcaagattgagagagtggccaatcagaactcagggctgagcttccggtgaagagaagctctatttccgttgggagcagttgcaaagtgaggttggcctgcgcgggtggaagcaaacgtgacgtcagcttgtggcctttgctgctaagtcacttcagtcatgtccgactctgtgtgaccccata

SEQ ID NO: 26870 - DNA, 201 bp, Bos taurus
tcagtgtgtttgaaagcaataagaagattgcttatcttcactttacagataagtagtcagaacctcagaaaatttgtaagattttcctttccaaaggccacagtgctacctttaggtctcagatcagtccagcttaaacccacacctacccaaagtctaccctacatacctgggccatagttattagcctttctagaggaa

SEQ ID NO: 26871 - DNA, 201 bp, Bos taurus
aggaagatcccctggaggaggaaatggcaacccactccagtattcttgattggaaaatcccacggactggggagcctggccagctacagtcaatggtgtcgaaaagagacatgcctgaagtgactaatactagtaagtgttagtgtcatgggaaggttttagaaaaacgactggccagaacattttaggaggaaaacagaa

SEQ ID NO: 26872 - DNA, 201 bp, Bos taurus
gctcttcacaggcaggcagatgttgttcccctattaaaaatatgcacgtcaacacagaaaagataagtacctcacccagggccaatacacccatacaccaaatgtgtatgttcataactcacacaatgacactcaaggatacagagtcattgtttaaaggcccaaatatataattaatgtgtgtatatatatatatatata

SEQ ID NO: 26873 - DNA, 201 bp, Bos taurus
agatggaagcaactcaggggagcatgtgtttagtagaagtctctccttagcctaacagatggtcatgggatctacccacagggaacccacaagactgcaggtggagtatttcaaagtgggaggagcccaaaagccctctgcctggagccccaccagttgctgtggctagcccaggatactgtggctccaagaaccacccta

SEQ ID NO: 26874 - DNA, 201 bp, Bos taurus
agctcacagggaatataggagaaaagaaagaaggcctggggccagcccacctgttcgtgttgtggttggtgcccagttccacgagatttgccctgatgctcctccagtggctttggccatggcagtggctggcctgcattgtggtgatgatggttcaggcagttacccccacagggctagctggggggaggaaaagcacag

SEQ ID NO: 26875 - DNA, 201 bp, Bos taurus
gtgggtggggggatgggggcacattctcagccatccactactccctgcagggagcctcagctcagattgctcaggaaaagccatagctgtggcagggcacaggctcatgacatatagcccacctcacaggctctagggccgttggtccccaatctttttggcaccagggaagggtttcgtggaagacagtttttccacaga

SEQ ID NO: 26876 - DNA, 201 bp, Bos taurus
cctgcctgccccagctcctgttccaggagagcaaccccggggtgcgctacgagtacatcatccacagggaggcggacggccacgaccacatccagccgcctgagttctcctggcgctatggaccctggtccaaatgcactgtcacctgtggcacaggtgaggagagggctgggcacggccgctgcccagcggggcctttgt

SEQ ID NO: 26877 - DNA, 201 bp, Bos taurus
tgccccagaagcagctgaccccacagcaggtgctcgccgagtacccgctgactgtcatcctttccacagggcagggcgctgggtgctatggcctgaagccactcatacactccaaatgccccatgaaaacagctgctgcagagtcggtggagcagtcagccttgctaatctgtatggaagtacagagggtgcggctataca

SEQ ID NO: 26878 - DNA, 201 bp, Bos taurus
ccacccccagatggaggacaatgatctctatgacgctatcactgtgggcctccaccaaactgatcctagcctggaatacccaccagaggaggccagcagcacccctgcctctccaaagcaccaggtctcctccctccacaaaaggaggagcctggatgcaagtccccggaatctctccgaggaagaaagcatggaggtgag

SEQ ID NO: 26879 - DNA, 201 bp, Bos taurus
gataaatagaagcaagcaacctgaggagaatactccattaaatcctttgtgatcactattgccattgccctaaaagaggccctctcttttgaactattacggcaatgatgtgaggcggggcatggcatataatttcctagttacagatgggaaacccaaggctcagtaaggcaaagtgactggcccaatgccactcagctg

SEQ ID NO: 26880 - DNA, 201 bp, Bos taurus
ggagtgcagacccaccctggcccaggagcagcagcctgccaggggccgcaaggccaggagagatgggcaagcctgagatggagccctgtgctcctggggctggtctggagggacgaggagcattacggccatggtaatggcttctgactttagaacatgttaaacaagggttcaaagctctttcctcgtagctattctgca

SEQ ID NO: 26881 - DNA, 201 bp, Bos taurus
agtctggggaggaccagcagagaataaccgcttggtgagagacaggcaggatatgttgctgagcccctaggaaatctgatttacttcatgcaatacaacccactcttgtgtccctgggcctttgcatatgctgatatctcagtctgggacaccctctccactttgtctgtctggcgaatttctactctgcctttaaaattt

SEQ ID NO: 26882 - DNA, 201 bp, Bos taurus
gttgaccggcgtggagatgagaaagttgtgttctcgcgcgaatcagaagcccggcgggtctcctctctgtgccctcctggctctttgctcagggccacacttacctttcagctgcctgttgcagtaccctcataactggttattctgccccagtcttcaccagccagagcgatctttctaaaatgccagtcagcttctgtg

SEQ ID NO: 26883 - DNA, 201 bp, Bos taurus
tccgtgttacagctctattttatttagataataacaggaaaatccatcctcaaggcatgagggcatgtcaacacaaagacgcaaagagaagcgcgtcccagcgcgtgggagagagagcgagaaagtgcgcaagcgggagagagagagacccccagccctttggctcctctttttatacgtttttcctccccctgggcctgc

SEQ ID NO: 26884 - DNA, 201 bp, Bos taurus
tgtggaggtgaggaaaggaggagcccccatggcctctcaacacagtttcctgtgagctgacccctgccaggcttcgcgactttgttcccgggaacccacacacccacctccctgagggtctgcactgtgtagggggcaccacggtgcacggcttgaacccccttcaggctgaagcactcctcggtgtcgctgggagtgttg

SEQ ID NO: 26885 - DNA, 201 bp, Bos taurus
cctccccaacccccatctccccaggacagcttggacccagggagagcctgcccctggccaggagaaaccctgccacaggcctcccatccacagcccacagccggctcccaagggcagcaaacaacttttcagctcctgaactgtgtaattgttgggaatagcaggccccacccctcccgtcctggctgccttgcgcttgga

SEQ ID NO: 26886 - DNA, 201 bp, Bos taurus
aagacagttttgtcctggtggccaacgcctcagagatggaccgccagagccaccccgtggtcctcaccatcaccatcctgcctgtcaacgaccagccccccatcctcaccacaaacacaggcctgcaggtgagagcattgtaggaccacctcccgctgtccccgtccccaccagagaggcccagcaccgagctccccttct

SEQ ID NO: 26887 - DNA, 201 bp, Bos taurus
caagtgtgcagtggaaaataactcgttgccaagtagaggcccatagagtgtatttctcactatggaggctctgaaatgaacctgttggttttgatgctgagaggactggagctggcctggggcggagctgagcactagtggtgccctctggtttgtaccagaacttgaagggttgggccagcccagctgtgtgagtccagt

SEQ ID NO: 26888 - DNA, 201 bp, Bos taurus
ataataggtaatattcattgataatacaaacttgataccttgtggaaaatacagactaggtaataaaaccagtcacaagattgccgggtagtgagcagtatgcagaaaatcctttgtaaaacagaaaaaaatacataagtaataacgcttatattgattttatttaacaaacacgtatagtctgtataactcttattatgt

SEQ ID NO: 26889 - DNA, 201 bp, Bos taurus
gtgggcccagccctctggtcacccccgtgggtaaccccaggggaagtagtcacatgatgtggcacttctcagctgattgcttgaggtcccccaatgtgctgtgggccttgtccttgagtgagccgaggtccaagccagggaggctggccagctgcccaaggaccgaggccctctcctcctcctcctctgtgtcctcctcaa

SEQ ID NO: 26890 - DNA, 201 bp, Bos taurus
caaggcctccttctaaccctttcctcctccgctgggagatccgctcgccgcccgattactctgccctgccaaagcgctaatagccccaggaacctcgagggcccgagggttctgggtcgaagtacccttggttttctgagtgatcctaggggcggctcaacgcgtccagctagtgcgctctcagcaatgctgcacattctc

SEQ ID NO: 26891 - DNA, 201 bp, Bos taurus
ttagcgtgctaagtgcaggacagagttcccctgtacaatatgtgtgtgacaagctccaataaataagtagcactgagtgttacacaacaataggtttgttataagttctcatggccaaagaacctctgtgccaaaggctggcagcaaaatggcacaggaaggcggccagcctctagtcttaacacacacttggccctggta

SEQ ID NO: 26892 - DNA, 201 bp, Bos taurus
gccttgaatggcttttagactcaatttaaagaccagtttgctagagtgttgctaagagaaaatgcgtctaatttgccaaaaccaaattaactcctaatacacaaggggaaatgtttaagcagcaaacagttgataaaaatataaacactttcattctccttattccatgtggacttgaacttaattattgaacttacactc

SEQ ID NO: 26893 - DNA, 201 bp, Bos taurus
tctaatggggccaggaggaaggaggacacaaaagagtaagttctgtaagggagaaagtgccagaaagtatcaggagagcaaagtagactcttgcgggggaggggtatagaatttgcaggtaaaggccacaaaccagaggggggatatacagctagatttgcaggaatggaggggcagcttcatataacttcattctcacta

SEQ ID NO: 26894 - DNA, 201 bp, Bos taurus
tttgctggcttttaaatgagcaacagacatatttgttgtggtgtgtagccatggaaatggacaggatgtctgcaagatcggtgactggttgcatccagacgcctccttaccacccaggaggcacatccacccaaggagccccagcgggcctggaaggagaatcataatgtccaaagctgacatctccctcttttgccatca

SEQ ID NO: 26895 - DNA, 201 bp, Bos taurus
gagagggcctgtgtttgaattttagctctgccacttgaggacaaaggctatatgaccgttggcaagttatttactgatccctctgatcctatttccttctcagtaaaatggagataataagttgcatttccaaaggctgctgtaaaaactaaatgagataacatgtacagaatggaggtggaggacagcacaccgacactt

SEQ ID NO: 26896 - DNA, 201 bp, Bos taurus
tgaccaatgaacatgtactttagatggagaagatgattctgaccattaatgaatttaaatgaaagaatgacctgtccagtttaatgatggacttatttataacacagattcgagctattttgagttcagtatcctgatctttaatttctctcttagcttaaaaagtacaccttcttttcacttacattttaatatgaaata

SEQ ID NO: 26897 - DNA, 201 bp, Bos taurus
ttctgaaagaaaatctgacagtctgtacatctgcaattcatactgccttcgcaacccagaaagccccagggtccttccaaaaatacttgtaggatgcccctaggaaattctctagattgataaggccatggttagggaccacactttgccatcaccattctgccttctctgcatctggaagttaggcttcttgggtagtct

SEQ ID NO: 26898 - DNA, 201 bp, Bos taurus
aaatcattttggaagctatttatttttcagtctatgttgcctttgggtcaggcttaagctgtcctcaaactggacagctgcccatcatcatcagtaagctgcttactgagtcagagattgagtgcagctcaggggagcctgtgaagtgatggtcctcccagtaaggggctgtagacagaatcatagaacagaagaatctct

SEQ ID NO: 26899 - DNA, 201 bp, Bos taurus
cattgtttaaataactcactcaagcctagatggaaaggcccttactatgtactcttaactagtcctgtgcagcaaaactaagaggaattgactcttggatttatatttgccacttaaaaagggcccccataccagaccagtctacagagtggactgctgacctcaaagtcaccttaaactacacccacatcaagatgagat

SEQ ID NO: 26900 - DNA, 201 bp, Bos taurus
cttagtccctacttgtaggttccgtgagactttaccaggaggggtggggtggggagcacagagatcgagaagctgcagggagcatgtactaattactcaacagctgaaccaactcacgtatctggggttgattctgttattctaaaagtaatcacagaaaaaatcatatgattttaaagctgagtccaaatattttatttc

SEQ ID NO: 26901 - DNA, 201 bp, Bos taurus
ttaaaaagcttataaacccacaacaaatactttaattacattggatgaatgtaaatcatgaatgccgagcagctggatgctatgaaaatgtaaatgcaaactaatcagtggaagtcgaataaagctggaagcggtataaatcaaaatatccactggggaaagcagaggggctgccatcaggcatttttatataaccacgta

SEQ ID NO: 26902 - DNA, 201 bp, Bos taurus
tgactctgcagatgagtagagctgctggctgggatctctgctcaggcaccactgcaagcagagatacagtcagcaaagacccaagctctgacaatggtaagctctgcctctgttctaagtctgtatgggatccccaatggccaaactctgtaggttccttctttcagtggttcccaggtgagaaacaaatgagcctcctgg

SEQ ID NO: 26903 - DNA, 201 bp, Bos taurus
tggcatttgagcagaaacaattctaaaagaacaggaagaccatacattttgggatggagctgcttctacagctaggaaatactttggtccactgataaaggaggttcggttcattcatgtccaagtcgatactcccactttcttgaagtccatcctgtcacttccttcaagcccaatctcagtcccaagttttcatcagct

SEQ ID NO: 26904 - DNA, 201 bp, Bos taurus
actggcaggtacattcctcaaatccccagtgaagttgtcatttatactcaagacaatatacattgaaaatctaaaagcagaccccattttaagaccactttgaatgggcccactactgtgatagagcaatgttgcctcttcttttctgtgtaaccagagtcttgatacgtacccagttgtaatgccttatagagacctttc

SEQ ID NO: 26905 - DNA, 201 bp, Bos taurus
aagtgctctgtagtttggggaggtttttagtgcaatcttggattatcttcactcaataactttattcactaattctccactatgctctactgtcttgattcgtaatggtattaaaaaaacatagggccttataaaacagattgcatttaaggtattttgtgaatacgtactccttaagggggaaggatcttcaaaagttca

SEQ ID NO: 26906 - DNA, 201 bp, Bos taurus
ggatggccaactcattctcagccacagcaggtttcttaaaagctattaaggtttgtactgaccaagggatcacttaaatttccaagaaagagctctttaagtgtgccacttctctagttatgtgtaacaccatttcaactccaactcaattattcagcactttttttcactatcaaattggaaagctctgacttttctatt

SEQ ID NO: 26907 - DNA, 201 bp, Bos taurus
attcaatttaattcatcttttttggtaatgatccaatgtgtcttcctgttatggtttggatttccttataatagatatgtgttaggattgatcatttatatttttgacaaatgttttccatgttgcattatctttgtaaatgattaaattgcattctgcttttatattgactttctgagtgggtgtatccaaggcaggaga

SEQ ID NO: 26908 - DNA, 201 bp, Bos taurus
atattatgcaacagtagcaagttggtccagctgcagttttcacaaaaacactcttcatcactgcagtcccaggcaaacctgtacaactagagcttaagcagagttaaatgatatgtgtaaagcatttttttccccttttcctgcgttagaggtggggtggaggggacaaatttacttccttggttgcttatttattatcta

SEQ ID NO: 26909 - DNA, 201 bp, Bos taurus
cccagttttggtttcatctgcatggctgtaacatagcaaagcctgaaggactgtccctgttcctgctctaccctggctaatcctcttacgttaccctttgggcactgaataaattacagctaatctacaaacaacaggaggatctgtgcgatttcagcttttgagaacatttttctagggagatgacaagtaaggaataat

SEQ ID NO: 26910 - DNA, 201 bp, Bos taurus
agcagataagtaacttttaaacgtgttaaaaataaaatattatttgtctttcagtagcatttccaaagaaatttctaaataggagggaaaaaacataaaaagttttagatctcaacaagaaaatccatcattgcagtggcttgccttgctatcattctagagtccaaacctgtcataataaatgcaaccataaatccatgg

SEQ ID NO: 26911 - DNA, 201 bp, Bos taurus
gttaaaagcatacttctatacttttctattaaaatagaaatagtcatacaaacacatgattctatgagatagaattgctgaagttgtcccagagggcccttaaaccatacgaatttaattttttttctttttgctattccagctgggtgatttccaccactctgtgcttcggatctctggtctgttctgtattatctaatc

SEQ ID NO: 26912 - DNA, 201 bp, Bos taurus
ggatgtattagttgtctgataatattctgtagcctacagatgcttggggtggaatgtagatttcttaaaaaagaaaggcccaatggcattacttctgtaaggctccaggttgtttcttgtaagtggcattaaaagaaaatttcccttttaaatatgacttggcatcagtgtaatatttccaaagcaataaatttagcataa

SEQ ID NO: 26913 - DNA, 201 bp, Bos taurus
aagtgctttgggtctgtcactagtcatatatagtatttgctacatgtggtgtgtgcctgtgagctgagcacagaacactattggccccatggctggtagaggtttagcaaatctgagttagtacaaggtgtttcacatctactactgagggagagcattgacagcccccagagagggggcatgctttccatttgaatcatt

SEQ ID NO: 26914 - DNA, 201 bp, Bos taurus
ctgcagagcacaagaggcttgagggacatttttttttttagtggcaatttattcctgattcttttttcagaagtaagataaaattgtgaaaataaacaccggaagtctgctagttgaaacttacccattgacaaataacatacgtgcctccattgtcaaaatgtgttcaaaaaggaagagcttaacagtgtctcatcttag

SEQ ID NO: 26915 - DNA, 201 bp, Bos taurus
catgggtgtgcatcagatacacagacacagggaaagactagaagggaagcagtttttatattagcatagcaggataacagatgatcatctgcaaagaacactggtttaaacaaaagtttttttttttcttacacacttaaaagacatctagaggctggcagccctgagttggtatgaagatttcatgaagctatcaacgac

SEQ ID NO: 26916 - DNA, 201 bp, Bos taurus
ctctaagatttttttaatcttaggaaataaatgacttacttaatattcaaaagtcattttatgaaagaaagagctctaagaaatattaaagcatgtgttatagttgatagaatatatgagcaaacccacatttccaataattcaggtttcaataagttgatttccattggctatgataaagtctcttatgactgccccctg

SEQ ID NO: 26917 - DNA, 201 bp, Bos taurus
tgacaccagattctgtattttcccattacctaactgaggcccactgttggcatatactgaacttggcaaattagtaatctagagtcaggaaatccattcccgggtgggccaagggaaatttgaaggtctgtaaaccctggctgactttggggatgtggtgataagacagagatagcagattttaaactgtggacactttgc

SEQ ID NO: 26918 - DNA, 201 bp, Bos taurus
tcttacgatttactctcttaacttttctaaataccatatagcagtgttagttatagatgtcatgttactatgacattcctagcacttaatttgtgttataactggatgtttgtaccttcctccaattctctctcctcttaccacccccccgccccaacaaacttttaaacacttcccctatcttacaatcaagtattttct

SEQ ID NO: 26919 - DNA, 201 bp, Bos taurus
ataataatgaaatggagatgctagtaaagagtgctattaatagagattttggcctggggatctcaagatacagggaatcttgccctctgacggcctcttctctcttccaggttcccaagggaaatacacgctcaggtcaatggtgggcaaaaaagcaaggcagatttataaccaattagggcattggcccggaaaatccca

SEQ ID NO: 26920 - DNA, 201 bp, Bos taurus
caaggaatgctccttctaaaatacagatctgacctaagctttgctgcagtgcttacaatctagtgatagctctctataacccataaaataaaattgtaacgttatacctatcccctcacacccctccaccgccctgcagcaaataatgaaggcaggcgctgtgtgctgtgggattctcacagacctctgccctcaaataag

SEQ ID NO: 26921 - DNA, 201 bp, Bos taurus
caagggcctccatagagctgttattagacgcaaacctctctaaagtcttctattagaattagggctggctgactgattccaggaaataatttcaacctggcccactgaaaggaaacaaaaagaaggagggaataataaaaggaaggaaattttgtgcttgtttttgccttttgtttttttttaagtgaaaggatctattta

SEQ ID NO: 26922 - DNA, 201 bp, Bos taurus
taactatacaaatcctttcatatatgccaagtttcagtctggagctcatttctgtgttataaatcttggcatactgaattttgctaccttcattacaatggaattatcctttcaatattcacaggtgcctccctgtgagaggcctccttgagattaatttagccttgagtactttttattaattaaataacattttaaata

SEQ ID NO: 26923 - DNA, 201 bp, Bos taurus
gataaaaaattataatttataggcttgactcattatttacttctcagaatgctttcttgtcattagccatctaattgccttcatatgtgacttctctaactgaaatgcctatggtggttatattagaatatataagatactaatttggtttcttttaaagattatgtctgagtatctcagctctctattgcgcagatacaa

SEQ ID NO: 26924 - DNA, 201 bp, Bos taurus
acaggatatccgtgttgtttggacagtgccagtcttctcacacgattgacaagtctacagtcccattggcagcaactgagagctgttctacagagctgctcgcttggtcttttctgtgctttacattttaatattccagagaatatgtagtaacatcatgctgttttaatttatattttcctgatcaccactgtgataaat

SEQ ID NO: 26925 - DNA, 201 bp, Bos taurus
tgatagtcctaaagctgttttacagaaacttcagttctttggacaagtcctttcaattttctcctgtgacctctctcatggtactgacctatggccccaacaacagtcttcagacaggaaccctgcccctgacatttaactctccagtctagacagccaaccttagaagcacacagttcccttcctgtgacctggttgact

SEQ ID NO: 26926 - DNA, 201 bp, Bos taurus
ccatttgtattatatatactgtacccttactgtagcctcagggaacctatagctgtttcaggtatgaatttcagcacaggggcatcttctgcaggagaggcgagacaatcaaggggtgtcagcctcgctgctgcacgactgtgaggcaggggcattgggcctgaggcgttttagctgactttattcttctgtgactcattg

SEQ ID NO: 26927 - DNA, 201 bp, Bos taurus
gagcacgcacgcatcctccactgagtggacttgagactggaaaagtccagttctcagctaaggaaagattgtttggcttgggaagccagagattctggcagcttgtgggtgacaaaggctctgcatccagctactaagactatgactgcagaccctcaatgagaacaaaagcaagtggaatttctgtaaggtcccgtaggc

SEQ ID NO: 26928 - DNA, 201 bp, Bos taurus
tttcatccgaatgaaatctactctgaccaaacgcggcgtgcacatcaaatcatcaggatataaggtaagctgggttccagcaggggtgagactcctgtcttgggtccatcctaggtcatttgcattgcgtgtcccagctgctttgggtccacatgatcaatacatgtgactgtgagcagcacacagggttcttagttatct

SEQ ID NO: 26929 - DNA, 201 bp, Bos taurus
atttaagtctgtatataaacacattgatgatacaactgagacaatgaagatgtgctgagtccagcatgtcactggaggggcagcacgagatggagaatgacagaggaaggaagcttgagcgctaagcttgatgtggctcaagcctgatgcaatttcctaatccatcaacatgaagacagggtgaatttagctcttcacctt

SEQ ID NO: 26930 - DNA, 201 bp, Bos taurus
gcctggacaatgaaggggcctgtctaagaggtggagctgaatccagctcttcttagtccatgtaaagtatctgtccacgtcacatcacaggcagtgatggcgtcccatcaaattaggttattttatttattaggttatttcattttctaaattaaaaatgtgaacttaacaaagaatagttgagccttttctgaacaggaa

SEQ ID NO: 26931 - DNA, 201 bp, Bos taurus
cagatccctactaacccagttggctggcctcagctccaagccctctcttgcagttgccttcagctccctcactcaagtgtgtgttccctccctcggcatccggcctccagtgacaggaatatgctcacgtatgaagccccagcccccagcaccaactcagcacagctctgcagggccatcccagtttcagagctcccatgg

SEQ ID NO: 26932 - DNA, 201 bp, Bos taurus
gggtgaccaacccaaatgcctgtggtttctacatgggagacaacttagagtggaaaaatccaaccactcgagctaattttaaaccaggaataacataatgttcattcacattagaaaggtcaatcatatttgtaaagtagctactgacattaccttaactttgtaccctaacttttattccaaatattccaacttttcccc

SEQ ID NO: 26933 - DNA, 201 bp, Bos taurus
tgcatgtagaggagaaatggccctagcaaaactaggttcataggcttcatggaacttttaacttctaaagacgaaaactcctcaatagctccaataaaaactctgtcaatgtccatcatggcctaggttagtccacgtgtccatccctggaccaagagaatataatattctgattggccacttgaaccacatgggaagaat

SEQ ID NO: 26934 - DNA, 201 bp, Bos taurus
aacatgcttaaaagtgaaagatcatggacagcatttccaatgtcgctggtactctgaattatttccagggtctaaagggaccagaaagtgtgctttgggatccagaatttgtgcatgtttagtattataactttagtagatttcatttttactcaagatataggataaaaaatatattgttttgaaattttgcaaaaaaca

SEQ ID NO: 26935 - DNA, 201 bp, Bos taurus
agtgaaaaaactcagaaggatgctagtgagattacacatctctgagtgtattctacaaccttattctacaaccatgtgtccaacagtatctttcagcattggttaaaagcattttcctaggagacaaagttttaggtcaaatgctttttaaaaattgtaacattattctctgtctttcctacctttatcaagatgtctgca

SEQ ID NO: 26936 - DNA, 201 bp, Bos taurus
gctctgcgggaaagctgtggcctcttgtccgtagccttcccttttggttggtcttgggggcttttccgaattccatgttgaagggtttggagaaggtctcctgcagatatttgtttgggtgggcctgtggaaaatctctagtaagctaccaaagtttacactgtgtgaatggggaaactgtcctctgccctagcaaagaag

SEQ ID NO: 26937 - DNA, 201 bp, Bos taurus
caactagatgtctagaccaggcttaaaggcatctctttaattacagccacagagatgttcctcttccctttcatctcatttctggggctctgctctggcctttgccatcatcttctgaaaggttagatgtgccatgtcaccattcagtttgtgcatccaaacagaagccttgcagcatttttctcttgcttaggttggcac

SEQ ID NO: 26938 - DNA, 201 bp, Bos taurus
ctgagattgcaaaagttgttctcgccagtttctcaggccccagggagcatcccaactgttcctgtctctccagcacactcttcaagattagtgggtggatccccttcacacttcattccatgtgcttttcaacctggtgtttttgtgtggaatgagactgtgttcaagccttttaagagcaggttttccattttctgcagt

SEQ ID NO: 26939 - DNA, 201 bp, Bos taurus
ttcttgattcctgtaatctggaaattctttccttctcttttctcttaaccatattttcacttctgatctactttgcatctttctgtataatgtttgtcttgtctctctgctttcccttactccctgaatttttaatgcttttttgtctcttttgcttctatccaaaactaggaaaaaataaaaaggattcaaggtaaaatg

SEQ ID NO: 26940 - DNA, 201 bp, Bos taurus
cctgctgcatggtagccagtttggtaaaggaaccctgatttctgtggtgagggaaagagagcagaggaaaggaaagctaaatgtcttgatttggggagagtggcaccttcttaatctcagagctacattgtaatttgccattgctttccacatacctgccaggaaatagctgaagatcatccagctatctaggagcttgga

SEQ ID NO: 26941 - DNA, 201 bp, Bos taurus
ctgttgcctctttttaaagtatggttacaccaattttgtctgcatgactgaaaatatgaacacttggtagagcttagaagccttatggtgagccacttccaatctctttgggcttgtctcaaaacagcacatcctcgctctctgtgtcagctacactgatctgccagtcccccaaatgtgtgtgctccttctgcctcaggg

SEQ ID NO: 26942 - DNA, 201 bp, Bos taurus
agaattaacatttttaaggatttttgttcctgtaacagctattaataattaattaactaataaattaactatatgattataattttatttcccatgtaattctgactctggagaaagataggctggtcttgcatatgtaaatgttctgggttgacgtcattatcttgcaagcttggttaactgtcagttcacctctgagta

SEQ ID NO: 26943 - DNA, 201 bp, Bos taurus
tcctgcgcctgcgcagccaccgctccttggatatggggttggtcctcccggttgccgcccctgacctcggaggcagggtagctcctctgggctgctgcccctgaccttggacaaagacttcaggccatagatataaataggaacacatcaaatatcaagactcccacaaggaagagtatatccaactcaaacaacctagtc

SEQ ID NO: 26944 - DNA, 201 bp, Bos taurus
aaagcatatttcctttaccaagtaaagaaaattcttccaaataaccataacctatatatgaattatggatttaaataggaccttgtgtatggctcataaaccattaatatccttagggatgtttgctattatgttcttttctgctttcttttcttcaagagttacatcttccatgagtctcaatttcctttatgaagaaac

SEQ ID NO: 26945 - DNA, 201 bp, Bos taurus
tttgaaacattttttctttaatgataaaaatataaatgataatgatgaactcttaaagcttctgtattagtagtactttattggataaggtgctttacaatttgagtctacagtattaaattccacactcaggtacatttgtttttttcttacatgtgatgtttttattgatatttgcaggttgctttatgggaaacagta

SEQ ID NO: 26946 - DNA, 201 bp, Bos taurus
ttgtcaaattagatttttcttctcattacaaaatgaaaacatcttccaattgcttgagaaaaagaaagcctgtacgattcctttaggcacatgtaagtctaaagttggaagcctaaggagtttcatcttactgtgctcatttaaaaataagtaaaagcttagtaaagttatatctgactacatattaacattctaggtctt

SEQ ID NO: 26947 - DNA, 201 bp, Bos taurus
ttagatctcatcatttaaggtatttcatttgtaagggcatttgtgcagaagttttttctttatcagtagtgaatatagggaaagtcattcttccattatttaaaacataatgaaatcatctattacttctttgctattaactctaatttgaaatattccattccagtgtgtctaaattcatttgtggtgaggatggaaata

SEQ ID NO: 26948 - DNA, 201 bp, Bos taurus
gaactttgaatatcttcaacatatttatttattaaagttcagaaggacatttgatgagatcgaatagcttaaaaggatagtcgtgaaaagtataataaaggttattgtagagaaatgtgattgacaatttctgctttaaaagtgcacttggagggagtaaatataagacagggtaatagaaaagcccattttgtgaaatag

SEQ ID NO: 26949 - DNA, 201 bp, Bos taurus
atcagtgtaaagggactggattatgaaaccagttataaatctattaaataatgagagaaaactaggaaagtcgtatgtgcccagcatgaagcagagacaactgtcaatgatttatacctactagtacataatttagctacaatatacccagcaatttaatactgacatgtatgttataatgtgccagaattgtacaagtag

SEQ ID NO: 26950 - DNA, 201 bp, Bos taurus
ggagaaggtgaaccaccacacagatcctacaaatcctaggccaacctgggtggaggggggagctatggatctactgctgactcctcagagtgtcccacattgagtgaagtgtgcaggcctttacacacctgtcttgcttagtcactgtatgccagctgttcaggcccagatatgaactcaagggaaagactctgcagctga

SEQ ID NO: 26951 - DNA, 201 bp, Bos taurus
aaaaccccaaggtctgtagtttgtaaaccaaaaaagccaatggtgtaatgcaatctcagtcccaaaatccaggaaccagaggagccaatggtgatagtaccaatctgagtagaaaggcctgagaattgagggtcattggtattaaggtcctatccaaagacataatacccagtggtgttgatgttggagggcaggagaaga

SEQ ID NO: 26952 - DNA, 201 bp, Bos taurus
tttcatgtttctacatgaagaaatgatctagaaaatccaaattataacctcaaaaatataccctaaacaataatatcctagaaaacaacttctgggccatgaggatttagccttaacttttcagatgaatcttgttaagctttttctaaaatagcattgtgatttttgaaaattctaacaagtaatcgtttggcctatgtc

SEQ ID NO: 26953 - DNA, 201 bp, Bos taurus
cctatttagagagtattcaaagaaaagcttttaaactgtgagttttcttaggtgctgaaataaaaataatatatattaattatagtttgtgatcacaacacatttcaatgactttgttgctgtgctgtctccactttatgtaaataaaattttcatttaaaatacattcttaaaacctagaagttagttgacaaaacaaca

SEQ ID NO: 26954 - DNA, 201 bp, Bos taurus
tgtgttagtttgtaaattgagttagctatgatggtggattggcagtatccctctgcctccataagtgaatcctaaagataaagatatttctccataaagaaatccataaaagaaaactctggtacaaagaggaacacaggcaggatggaacaaaactaatatttctatttaaaaaccattaaacagaaccacagcataatt

SEQ ID NO: 26955 - DNA, 201 bp, Bos taurus
aggaaagtttctacaaacttgcttttatgtacagtaggcggaggtgaaatgaacaattttgatagatggaaacagttgtacttttatgtctgtctggaaggaaacaattgttacttaaaagaagaaaaaaagatacctaatataaatgagatgtccaatgctatgctatgtccaatgcattagattttaaagcaatttcta

SEQ ID NO: 26956 - DNA, 201 bp, Bos taurus
ttggctgacttcctcaggagctttctttagatactgtatgttcacacagtttgttcgggagattattgaggcggaagctagggaagagatctgatcattttttagttacttgactcattctactttgaatcacagaaagaacccacaagttaggcaggtattgtgagatcaaaagatttgaaaggtatgcttggccagaga

SEQ ID NO: 26957 - DNA, 201 bp, Bos taurus
ctttggcgatatccttttgaatacaagatggcctgagctcactgggtgtcagttcaaaccaatttgaatcttttgaagatcgagatattgtagcaacattctgtgaattaggatcaagttccccaattctaacatttaatcttgcactctgttccagtgcacaactggacagattccaatagcaaagaatatcattttcag

SEQ ID NO: 26958 - DNA, 201 bp, Bos taurus
gtaaagtttccattttgtggcttaggaattgtccaactgagggaaacaacaagaccaggaaagaattcttgcttctgttgaaacctttccaaggggtaggaggttctttggaagggcttgttagccatttctcatggactgtgtaggcagttaggaagaagggaagcaaaacagaatggactcttagtttagaggatggtg

SEQ ID NO: 26959 - DNA, 201 bp, Bos taurus
atctatcagatctaggcccttaaatctatttctcacttcaaaggcttactacttcttctccctggtgaagagctgtttccattctggttaccagaaaacagtggtgtatttttcactgattggcctgcatttttaaagctgacaattttgcttaatatcatgtgagccatttagcattctaacacttgagatgataataaa

SEQ ID NO: 26960 - DNA, 201 bp, Bos taurus
gcaaaacaaaaatatggccatcaggccatcataaaattttaaaaaaattttaaatttctaaatgaactaattcttcacccaccagatctttttagttgaaccagaaggccgacagaaaaatactaggaatgtgtttcctaggatatctgttaagtttatactgacaattaagtccagagagaaggacatgtctccaaaaga

SEQ ID NO: 26961 - DNA, 201 bp, Bos taurus
taaggagaatagcaaccagaagaaaagcatgatgtaagtcttccatgatgttggcaaggttgttttttgatctgaatactggatccaaggaagtacctaggaggttaaaattaattgaaacatagatgtacattaaagaataaaaaagttgaatatagtggaaaacataaaaagtattacattgatgaaacaatgtataaa

SEQ ID NO: 26962 - DNA, 201 bp, Bos taurus
ggccttcttggttttgtggttaagcaaacctgctttcttgagtgatcattaacttacagaggtcttccatacctttttctttacttacaaacttctagtggggttaaataactactttctttgacccttaactctacctatcagtatgactttgcctagctagtatttatattgtaagcgctaaaattgttgataaccagt

SEQ ID NO: 26963 - DNA, 201 bp, Bos taurus
gtatccagtctagcagatagagggagctccaaggaacatacagatttttgtaggcagaagagagcaggaaccaaagtaatataatgttaagtagaggattggttattataagtttacttttcttttggggatagcattgatctatcagacagattatgtaatgtgtgctcactagatgattcctgattgacttgtagaaga

SEQ ID NO: 26964 - DNA, 201 bp, Bos taurus
ctctggaaaatgattttgtgacacatagttaatgccatttcccttacattttaatttgttggaggaaatatctttcttaacatattcaaatcaacatttattcaagtaatattcatttcagtggcctcatctctgcctaaaacttcgtgaagctaagaattgcatttttttttcaaacaatgtctatgtgtatatactctt

SEQ ID NO: 26965 - DNA, 201 bp, Bos taurus
agatagaattaaacatttaaataaggaagtcagaaatggctgcataataatgataatattgcaagctgttgaggaaatgagccatgtatatacctgtggggacagatttccagccagaagaatggtaggaacaaatattctgaagctagaatgtgccaaccatatttaagtgacagccaagaggtaagtagagcagggaga

SEQ ID NO: 26966 - DNA, 201 bp, Bos taurus
gatctcacatatctttctggttgttcccgagtatcctaccccactactggggagagaccttctgggttcccttcgggccatattatggttaggagtgtaccctaaaagcaacgaaccctgccttttaggacagaggagtccctgggtaggccataaatgcccaatctgtaaaaatgacctttaatccagaagctgcctacc

SEQ ID NO: 26967 - DNA, 201 bp, Bos taurus
ttcacaagtgtggcctaaacatgtcatccttcacatcatcccagtgttggtaggattcatctatatagaaattagacattttatttttcaggagtaaactgatgttgcttcaaagacactaaagagtgatctaaaaggacaacagatagttttactacctggttggatggtaactacatttcgtagaacagtgtgataata

SEQ ID NO: 26968 - DNA, 201 bp, Bos taurus
tattacagtcatggattatgtcaggaaagaaaaaaatgtatgataactatacgtgctggcagcaaatgcatgaaaaaattgcttgctaaattgttgatacttttgtacaaatgaaataatacaaacacagtgttgtagtttgtatataggttaggtacatatagtatacaaatacaagcaaaatgctgagctttaaaataa

SEQ ID NO: 26969 - DNA, 201 bp, Bos taurus
tataataattttcttctaaattttgagaaacacaatggactgtaaatctgggttacacctaaagagcagggtaagcaggagtgaatatccagctaaattaatctataatagcagaacagcctggagtgttaagagactgcatacaaatggatggtgggtcagaatatatgccaaagagcagataatgaaccaaaaagtgat

SEQ ID NO: 26970 - DNA, 201 bp, Bos taurus
agacaaactgctaggtaattagcctataggagtgagaaggatatcagcactgtgagggaatgatgagccagaaggtttgggctaagagaaaacacaggttggtgctaaaaagtattggtaagccatgttaaagattgggaattttatcttaaatgaaagaaaattctttgaagtattttaagacttgaaatcccagaacta

SEQ ID NO: 26971 - DNA, 201 bp, Bos taurus
tgtggcagatctctcccggaacacagatgtgctccaagctgttcccttgaagaagcaaactgctgtgtactcctccccagggtctgtctgcctgagacatgagtttctgtggtatctcccagtgtgaacacgcactagtgagctgggatgcccccgtcatgtgatctttgagaattagctctggccagcctctgttatgag

SEQ ID NO: 26972 - DNA, 201 bp, Bos taurus
gcctgaacagaatgaaaaggcaaaggaagggtgaattctctctctcccttaacctggagtgtctatttcctagtgcctttgagtgtatgagcttcttgttgtctggcctttctgtttctgggacttataacatacccctggttctcaggcctttgtcctcaaactgcaggttacaccatcagcttctctgattttcaggtc

SEQ ID NO: 26973 - DNA, 201 bp, Bos taurus
cttaatccatagatcttgggtttggttactatgagcaatccctgaactaagtgcgtcctgttcaaagcatcccatagatgagcactctcactacagaagtgcacttttttaacctctacaaaagagaaagtgtacacaaaacagggtccttcttccttaaaagataatgtaggtgttttagacgttttttgaatgtttatt

SEQ ID NO: 26974 - DNA, 201 bp, Bos taurus
atatcactgacatagcatcacaagttcttactatcttgtaaaggatctgggaatccagcaggctagccaaaattgccctggcagcactcttttgcagcatacattttactttcaaaatgtcaacatagcgtcactctgagatttgttcatctcacaaatggcagagtcagctccttaaattaatcaacctaacttggaaga

SEQ ID NO: 26975 - DNA, 201 bp, Bos taurus
gtattcttaccaaggaccaaggcccacaggggttggggggggggggtcctctttgatcctccccaagtctggtaacactagtaaacgggaaaactcttcccattctcctaggcctgcttctctagtagaaaaataggacagggtcacatacacattttgtttgcatatgagttgagtgaggtagacaggaatcgacagtat

SEQ ID NO: 26976 - DNA, 201 bp, Bos taurus
tggaaaggtcaacatttatgaaatctatcactctcccaatcctcttctttgctgaaaagctctcatacaatcgcccataaacattagctctatacagatctgctccctgtagattaagtttctggaggattttaatgactttcaaccaaatatcacaacatttagacagtgagaggtatgagttaacattcaacaaataat

SEQ ID NO: 26977 - DNA, 201 bp, Bos taurus
actgtaacccagggtggacttattgctgtcaagggggaagtttaggttgatgattcttctgagctgcccagctcagtggtttttctgttgacaatgtcagttctttcttgcagacttagtgttgtaacagagacttcagctatagaaggataatggggatctatttaatagattctctgttgggaaaaaaccctcaatctc

SEQ ID NO: 26978 - DNA, 201 bp, Bos taurus
ctttgataagcaccattagcaaacacagatggcctaacacactgaacaacctcctctgaagtcctccaatacttttccatcagctcagcaaagcgcttaacaatcctctggcctctatttcccaggtttgggttaactctttctaccctgttgcaacagccttgaataacacctttctttcctgtttaactctgtccagca

SEQ ID NO: 26979 - DNA, 201 bp, Bos taurus
aaattgaaatcttcttttctagaatttttggggccatgggatgtttcttatgataaaggtgagtacagaagacttcattgtagcagaacaggtcagagagactaggactggaaattaagctggcctccagaagtgagcacaatattctgaggactgacagcgtcagggaaacgtagaagggagaaaggtcattccagaagg

SEQ ID NO: 26980 - DNA, 201 bp, Bos taurus
taagtatgaatggtattaaaagactttgtagacattgtttgatttggaaatcgtggccacttgatcactatacaatctgtcagtttccccaaagggttatattaacagttttttccttcttttgttcatcagtgattgcagccatgaaattaaaagatgcttgctccttggaaggaaagttatgaccaacctagacagcat

SEQ ID NO: 26981 - DNA, 201 bp, Bos taurus
gtcataatatttctcaactgtaaaatggagataataactttatctaccccacatggttgttctgagaattaaattaggataaacaacaaggtcatgaccacatccacacacagaagttgatgccacacaaatgtttcactgttgcactgacgatgcttaagtcacggtctttgagaaaacttcaaaggcaaatgcattata

SEQ ID NO: 26982 - DNA, 201 bp, Bos taurus
aaaattacaaaaagaattaagccataaagaggaaaagaaaaaaatgataaacattggatttggacccacaaaggaaccatgtagggatttttaaatgccagatataaataatcatatgaaatgtttgaatacataaaagatgaaaccatgaaaattagcaatcaacatgagatgtcaaaatgatcatgtagacttatagaa

SEQ ID NO: 26983 - DNA, 201 bp, Bos taurus
atatgaaatatatgatataagattgatgaacttcaaaaacatagcgctaaggaaagaagccagactcaagagaccatattttagattatttaatttatatgcaccaaccaggataagcaaatctttggtgacaggaagtagatttgtgattgccttgggctggaggttggaatagcgagtcactgaaaatggacagaaggt

SEQ ID NO: 26984 - DNA, 201 bp, Bos taurus
gtcttactataagcaacaagaaaaaaacagacagcaccttcaatactttgcttggaaatttcctaagctagatcacccagttgacaaagtacactttctacatttcacattactacaagaaatgatgtttctaagctttctgccactaaataacaaagattccccttttcttcaattttaccaccattcatcctcagtctt

SEQ ID NO: 26985 - DNA, 201 bp, Bos taurus
atttatagatccctacaagtgaaaaacaagtgtttgtaatcctgttttatgtgttaattaaattcgtactttctaccaatagttgtcatgggcctctcatgtactcagtactgggatgtgccagcaaaggctgtgcatcagagtagcacatttatttagtgccttctatatggcatggtctgttctaggccccatggctac

SEQ ID NO: 26986 - DNA, 201 bp, Bos taurus
aattatttctgagcactgtacttaaattgttctatgctttgtacattcagggctctttctcccagatcgtctctagttaaagggtgctagattatgaggtggaactctgaggggaaagcaaagctgcagaacaatcctgttttccacgaggctctatgatggggactgcagtagctttgatgtatgcggctcccagagcat

SEQ ID NO: 26987 - DNA, 201 bp, Bos taurus
gtccacagggtcacaagagtagggcatgacttaagtgactaaaccaccaccatccaaggggagaaaaggactagctgttctcacctggccaggaactacaggcttaatgacaaattctaaggtgtcaatctcctctgcaactgtgctatctggaggacactggggaggcagtctgggccataagacttacttgagcccaga

SEQ ID NO: 26988 - DNA, 201 bp, Bos taurus
tgctccccaaaatcaaaggcacagtgggtgcatggtgttctgtaaatgggaacgtgtggctgggacagatggaccaggccattccagggaagagccctccgcgtaccaggaacattgctgcacattcattctctctctcaccagcacccattttccagatgaaaaaactgaggctgctcaagattctaaatccgtggggcc

SEQ ID NO: 26989 - DNA, 201 bp, Bos taurus
aagtgtttgataggcaaataaatgaagagggggaggggccatgttttataattctttggcaccacccaaccacaagaccaagcatctagcaagtatgctataaaaattggcccatttgctttgttttctgagagcaggcaacatacatattgcctaagacacagtacctgctcaataaatatttccaagacaaatattttg

SEQ ID NO: 26990 - DNA, 201 bp, Bos taurus
aggcagcagcagaaggccctcctccaccgcctgtctcccaccccaggcactggaatcacacccgcgccccactgcagtctcaggatggagaagcaggaccccgcacagggaggtggggcctggcacacgctctgggcttatctcgccaggggcagcagtggctctggggtcccccagccaggcccaccaccagcctgtcac

SEQ ID NO: 26991 - DNA, 201 bp, Bos taurus
gatcccctggaggagggcatggcaacccactccagtattcttggagaattccatggacagaggagtctggctggctacagtccatagggttgcaaagtgtcggccacgactgaagcaacttccactttatgttacgtaatctaaccttcaacaccaatcaatgctcaagctttaatggtatacactctgtgaggttcagaa

SEQ ID NO: 26992 - DNA, 201 bp, Bos taurus
gcaccaacgaggtgctctataaacagggattgactacatgttggctgactttcaggaaaaataactcaagagaatgcttcaggccaatgccattcatcttccaaaaggatccatatgtgttcctctctgcctgctcaggcgctttgatcaatgagaaaaccctgggccagaaggaagaataaagatattgcttgtaacttc

SEQ ID NO: 26993 - DNA, 201 bp, Bos taurus
atctttagtgtggatctaatcctggggacacaaatccttgtgtgggtcagtctgcaggaaactgatgtggagacctcaaagatggcaatgagaaggaaagttgacctaactctagaacaaaggagatgaagatggtgtgtctaccagatgccatggttggatcctgaatgggaaaaagtatatatttacaaaacatgtttc

SEQ ID NO: 26994 - DNA, 201 bp, Bos taurus
attcagaccctagtgactcttcatcggaaatgtttttgacagaatctaaggatgagaggaagcatagaacttagaattaggcagacttttttgatcttctcagatcttaggaaagagacattgtgtgtctaaattacagctgtctttcagggactgtttagttaagcatctacgatgtgcagcaccctgggaatccatcag

SEQ ID NO: 26995 - DNA, 201 bp, Bos taurus
agaggccttctaaggaccatagccaggcaccttcaagttggcattcagggggacccagaatttccatggttttcccaagcacccaaagcccccagccccaaattccagatcagaggatgggcctctgtgtccagaacatggtctcaccaagcagagtgggcttagatagttctagccctgtccgagggcttggcagaaaaa

SEQ ID NO: 26996 - DNA, 201 bp, Bos taurus
ctctcttggcgctgtcttgggtaatccttgcagtcccattttaaagatagaaaatcaagtcttagcacggccaggaaacttgtccaagatgctccaggcagcgaggagcacggctgggaagtacaccgagagctttctgactcccagcacagctctccgctgccccttggctgtacctcgtgagcgtctcagttgtttgtg

SEQ ID NO: 26997 - DNA, 201 bp, Bos taurus
gatgggtctggcacagtgactcaccctcccccagctgcagggcgggatccatgagctccatcatgtattccacgttgagaagcatctctgtgaggttgctgcgggccaggacgtacatgagcaccggcaggaagtcgtctgccccgtagggcttccctgggagaggaaggaggcggaaggtggtgagtgcgaggctctcct

SEQ ID NO: 26998 - DNA, 201 bp, Bos taurus
gagaacagagatgggtgagggttgtgatgaatcgcagtgtactctggtcttgctctatacaggggagagagccaggagcccacaggccaagggagagacacggtccacctccacggtagccattacttcaaaagtaaatgtgaggacaaaccaagaagcccgtgaagaggcccatctgtggccttcccccagctcttgctt

SEQ ID NO: 26999 - DNA, 201 bp, Bos taurus
tctgtgccctgccctggggaccctccccagatgtgtgagtctcaggtccttcccagggctacagaggcactgccaccccaaagggccacagttgccagttcagaacagcagagtgctgtccagaagtgacgagacagtgccatgggcgaaacctctgggggaccaccttagcccaccctcatggccccgactcatcattcg

SEQ ID NO: 27000 - DNA, 201 bp, Bos taurus
aagtgcctcaccttccagattatgagatgatttggcttcagaccagcctcttctcccctcgccctcccaccgggcacctacacctcccaggcctttctccttgtgccttgagtccctcatgaaaacccctgctgcgtcctcattggagcctgggctcccctcccaggggccgggctgcagttaggcccgagccagctggtc

SEQ ID NO: 27001 - DNA, 201 bp, Bos taurus
ccggtccttgtgggaaaactggagcagcctcctaatcaggcttgtgtgtctgtttctgcctttttaaatactccctacctcttcagtgaataggaaagagagttatggattggaaggcaggccatcagcagaattttgtctttttattttatgtttatttttaatcagtctttattggagtgcagttgttttataatgttg

SEQ ID NO: 27002 - DNA, 201 bp, Bos taurus
gtttcctgctcttctccatcattttatcttctctatttctccatttctcatctgcctatatctggctatatctggccaccccttcctttcttttcaccccaccaggaaagagaaagtaataagataccattttctagttgaagaaacaagcctctaaaagctttcccaaggccactaaggcaggcagtgggagaactgaac

SEQ ID NO: 27003 - DNA, 201 bp, Bos taurus
tgaccgttagttttccttgcaattgggggactgccatttcccacagtagggcgcagagcccgagctgccagaatggctttgttatttgcccttgtgggcccctttgcctggaatattcttcccctgagtgtcctccatggttctgcattgcactgagatcttgtcttaaatgggccttcacagagagtgcttttttggcca

SEQ ID NO: 27004 - DNA, 201 bp, Bos taurus
ctacagtcggtgaaattctccaggccagaatactggagtgggtagctgttcccttccccaggggatctccccaacccagtgatcgaacccaggtctcctacattgcaggagggttcggtaggcccagatggtcacgagaccagccattctctcatccatctctctcctactctgtgtctccctgtgtatctgcttccttta

SEQ ID NO: 27005 - DNA, 201 bp, Bos taurus
catggccaagagtatcttttaagacatcatcattatgccattattatttttttttccttttgtgtgtttcataaatatttatgggatctcctggacacaggggaggggatatttaaaaaggattcctggctcaggaggtaaacatgttccaataattctgtagcctcagtggcctatagagagatgtcctggagggtattg

SEQ ID NO: 27006 - DNA, 201 bp, Bos taurus
cgcccgagggtccctgagagtgtcaaaagcacaagtgtctgagacctctgatatctggtgccatctgtctttgggggcctgctgtgctttggtttgtcccattgccgttcactattggttcacttcaagagccggctgtccctcattcttgcccctggggtctcctaggacactctctgaactaatctcaggcctttcttg

SEQ ID NO: 27007 - DNA, 201 bp, Bos taurus
gggccagcagagggcccagatgtttccgttacagaactttttagagttcacaggctggagaatctgggcttcccaactattactgccaagctcagcctaggtggaggcaaaagccagagccttggccccgggtcctggggcccaggtaggggtccatgttcaggcttccctggaaagcagagtgtgtcaaagtctcagagg

SEQ ID NO: 27008 - DNA, 201 bp, Bos taurus
ggatggtctgctggagagtagaggaccaaggatgggtatgatagagagtaggggacgaaggacggtatgctaagacagtggaggactaatgatgagtaacgtagagagtggaggaccaaggatgggaatgctggggagtggaggatgaaggatggaaacgctggagagtgggggatgaaggatgggaatgttggagagtcg

SEQ ID NO: 27009 - DNA, 201 bp, Bos taurus
tggccctcggcctccactccatccttcccatgttctggagagccatacagaaggcaggctctcatcttcatccctagcgcctccctggtaccagcaagcttctctaggccttcccaagctgctgaccagcgccggctccagccgctcgcgggcttttccatttctggccccatcgggagtagacccaagacagccggcaga

SEQ ID NO: 27010 - DNA, 201 bp, Bos taurus
ggaaacaccttggtttcagacttgcagcctccaccactgtgagactgtacattcctgctgttttcagcctccgttagtggtgctttgttaaggcagccccagaaacaaccacaggcctctggctgtacagacctctgtgtgggcttgctcctaaagtcctcagcagacgaaggtgaatttctggaggacggctgtagagta

SEQ ID NO: 27011 - DNA, 201 bp, Bos taurus
ggagaacctaccagactcagggatcagctcagaaactgtcccgtcagccagagagcaaatggagacaagctgactgcctggtgtggggtgtgggatggggatacggcccaggcttctgtcattctgggactccgtctttgcctttgcaaacttctcgtctgtgttttctccgaggcccggctcagtggccggggaatacaa

SEQ ID NO: 27012 - DNA, 201 bp, Bos taurus
cagaaggtttggggcaatcagtccagataccaggctggcaagggccaagatgagagtttgtcccaaacctgctggttctcaaaacagttctccttccattgcttgaacaaatgataggccatctaaatgttaatataagacaccaaattggaaaagaatcagatgtcataatgttgtcatggtagttattatataaatggt

SEQ ID NO: 27013 - DNA, 201 bp, Bos taurus
caccactgtccaccccaggtaacaccaccagcgttggcaccctgctctgtgcccacagccagcttcccattctgggccacatcataacttttgtggaccccttcatccctcccccaaatattaactttatattttacacctgcattagtataaagatgacctgggccaggtgtattattatctgtgtagtgtctgatgcac

SEQ ID NO: 27014 - DNA, 201 bp, Bos taurus
acaatataaaatattttctggtaaaagctttgctatactcactgcatatcattaacattaattaaaactaattttacctgtttccctttccttttttattatggcttccaaaagttataaaactcatacatacttttcattatctttctactgggctgtgctgttcttttgctaattgtgttttataagaatcagttctag

SEQ ID NO: 27015 - DNA, 201 bp, Bos taurus
cacagtgaaatgaagggacaactgtcatttgtgacagtactctgagcactcgtaatccaggccaggctaaaaacaatgagtatcacacaaaactccagacgccatgaacatccggacaaagaaactctgattcaaagacattttcagctgaacatgacttgaaaaaatcaaaatgcctttctactttagagaagcacccat

SEQ ID NO: 27016 - DNA, 201 bp, Bos taurus
cagaagcctgagcaccgcaactagagaaagcctgcgtgcagcaatgaggactcagtgcagtcaactaaataaatgaataaaaaataaaacaaaacaaaacaccaatggtgccgaagctgttaacactgcacggtgaatcgaggcgagaggactgacttgcacacatcagacaaggcaacgtggagcgctttggcaaagatc

SEQ ID NO: 27017 - DNA, 201 bp, Bos taurus
ttcctgccatcacttctgagaagcacagaaatctggctttggccaaggacaggtctggcctttgccctcggcttctgggaggtgacctgtgccattcagccggaatgtctttgtttaggctggggctgaccacgccagagagaccactagtgtgacctgggatgggggctgtgggtcagacagtaccagtgggcctggaga

SEQ ID NO: 27018 - DNA, 201 bp, Bos taurus
ctacaccagcagagttcagaagctgcaacagagatcacaggccttgcagaccctaaaatgtatgctaaatgtctgctccgttgaataagtcagaccatggatgtggggcttttcgcaggtgcctggcctctggtcagtgtcctagagatatcgctttgtcactatcatcattctcagatgcttagcaaataattgttacct

SEQ ID NO: 27019 - DNA, 201 bp, Bos taurus
agtttcggatgacaaggcacagggaagctctaagcaccacagggcactgtggttttggagactgcttcttccagttggaaatgcctggggcctgggaggcgtggtggtttggagacctggaaacacgtcgcatagtacactaggggtccagcagggtcgggcagggagcagaggggccccagacccacgaatcagtctcag

SEQ ID NO: 27020 - DNA, 201 bp, Bos taurus
cactcattaccagtgggttggccaaagggctatatccaccaggtccgctgttcggaatctgaagattcttaagaggaatctgcaaccatctggggctcctccaggccctacaggagatttctggtctcactctccccgcctttagagatactgggatgaggctcagagaggcggagaggcttgcccagggctgcacagccc

SEQ ID NO: 27021 - DNA, 201 bp, Bos taurus
cccagggcacgggcctttgtgagccctgggccttcccttcattttcctcagtcccgacgagttctgggctgaaccagctcagctgtcccatctgaggggcagaatagggccagagccacagtctatagacataggagatggatttttgctcggttaagagaatcattcaagataaaaaccagtgactcagtgtcttgcttc

SEQ ID NO: 27022 - DNA, 201 bp, Bos taurus
ggtggggtagcctcgaatgactgctccttgctttctgccagctttccagggagaccctttgtctctgcagtgattatcagccgaaaatcaccccctttgcgccctttcaatacttccatggttaaccccacggctggagggctgcctaacgacatttttatagcctgctgcctctccgcttcattaagtccctgctgtggc

SEQ ID NO: 27023 - DNA, 201 bp, Bos taurus
gatgtgacccatcatttacttaagatcaacagtgtgaaatgtgttacaagggatgtgggaagtgaaatatggcagcagccttcaagtcgatttctgaattcgaggcaaaagcgagtcttgggaccatggctcataaatcattccactgatggctggagaggtggctcctgtgaggtcacctgtgcaagaaggttggaggtg

SEQ ID NO: 27024 - DNA, 201 bp, Bos taurus
ctgaagcaggtgtgaggccatcagcaataagagttcagttttcctgacatttaccaggcaccaaatacatgccaggcctactgcccaaaccaggatgtagtgcatagcttagcttatccctccatcactgagactgttttcaggcagtggggcccaaggcaaagccctgggccagaggtgaaggatgaatatgtgtgtgtg

SEQ ID NO: 27025 - DNA, 201 bp, Bos taurus
ggttgaaatgacctggagacaggtgtgggtctagaggaaggttggggctgaattcataggttggaaagtcatcatcagaggtcattgccggccagaggaggagagagaactatctggggcagaggtcagcaaactccctgcaaagggacatacagtaaatagttttgattctacaggccatgtggtcagctcctcagctct

SEQ ID NO: 27026 - DNA, 201 bp, Bos taurus
tccagaaaaaagtaagatgcatttctcatcctaccaagtgtaggaagaggctgagggtggtcagagcatcggtgagatgcagcatgccttgtgcagtaccggggagagtagttggcccagcttctcagcaaaggaggaagagttatttctgctggcagatgctggtggcttcaacaggtgcctggctttctgatcccaatc

SEQ ID NO: 27027 - DNA, 201 bp, Bos taurus
tctttccaatcgcaggttagtctggtgaggaagataaagacgtttgccaccaagatggtaatcacgagtggaaatgatgaagacagaggaggccaggaaaaagagagtaaagaagagagtgtcttggcgatgctggggattattgggaccattctgaacctgatcgtcatcatatttgtatacatctacaccactctgtga

SEQ ID NO: 27028 - DNA, 201 bp, Bos taurus
atgccaggcctccctgtccgtcaccaactcccggggcttgctcaaactcatgtccattgagttgatgatgccagccaaccatctcatcctctgtcattgacgcccaagaattggccctttcgaccagaaccctgagtgaccctaatgcaagttctccaaagattcagcttgccgattccccagttacaaaccccagtccct

SEQ ID NO: 27029 - DNA, 201 bp, Bos taurus
gaaggggtccttccttccaggaagtcttctacacccttcccagagggctaggtctctcctcggtgccccagcaatggcctttggccccttagtgacagcaccagtcatgctgtgttggagccgtctgtgtgtctgtctctcatgcagtccatgagcctctcaaaggcagggcctcgcctcagccatctgtctatctccagc

SEQ ID NO: 27030 - DNA, 201 bp, Bos taurus
gcagtcaccatctgcagtgattttggagaccctaaaaataaagtcagccactgtttccactgtttccccatctatttgccatttccaggttctcaggccccaaatctaggcatcatgcaatccctcctttctcatgacacatacacaattggaaaatcatggtggtcctacccttggaatatttctcaagcctggcctcag

SEQ ID NO: 27031 - DNA, 201 bp, Bos taurus
ctctctgtgttcagcatcttttacttctgtagccccctttgcttgccatgttcctgtttctggatgatggttccaagactcttggccctgggtgagtgacgtcattctctaaatcagaacatcttccacaggaatactgtgcagagcacatccccccacgagctggggtctctgcccctagcactaagggggcctgacctt

SEQ ID NO: 27032 - DNA, 201 bp, Bos taurus
gtttctagggattgtgttcttgcttggacttcactgttctcaatgggatattgttctgcaactggaccctttaggctttgtgtctgacacacaatgaatatccttcaaatactcttttttaaaaaaaaaaaaaaacaaaaaacctctctaatcaagaaataaaactttctagatgtttccctttcaccaaattcctgactg

SEQ ID NO: 27033 - DNA, 201 bp, Bos taurus
ggatcatcttcctaaagcatgatctctaacttcataacacttccttttgtcctgtaaggcaccattcacaggtcccaggaattaggacctgatctctttgagggcctctattcagatggccacagtggcttataaaaaatttgctgttttatcgaatgttaaatcttgttagccagtcttagaagcgcctttgtcaaatgc

SEQ ID NO: 27034 - DNA, 201 bp, Bos taurus
agggagggctggggagacgcccaaagggcaggctgaagacagagcaggctttcatcaagtgaaagggaagaaacggcaatgcccaggtgaagggactggagtgtggaaaagctaaaagggaacgggagagcatgaagatggctcttgtgatgagtggtgaaactgaatttctaattttttaatattgttttgaagaagaat

SEQ ID NO: 27035 - DNA, 201 bp, Bos taurus
atgagctgatcacactcttttaactaatactatacagctcctcactaacccctctagggtaggacacacagctttggcccactatagcctgctttgcctggcaaagcaataaagctattcttttctacttcaccgcaaactctgtatacagagctcatttggagtcgggttactgaggccagattcagcatcaatatggct

SEQ ID NO: 27036 - DNA, 201 bp, Bos taurus
acttgtgctatatttgaggaaaccaagtctcagaggccttgtctctagcccatgtcatgacttggcattgggcagggcttggaattcaattgaactaaagttcttctccaatgcctcagcaagtaaagaatctgcagcagactagggtttgatccctgggtcaggaagatcctctggagaaagaaatggcaaactactcta

SEQ ID NO: 27037 - DNA, 201 bp, Bos taurus
ctgtttctatcttgactgattaaggctgatgctgtataaggatgactcagtgaattttccttggcttttcccaagggttcctattcatccccttggtctgcctttttcaaaattaggaaaggggactattgaccaaaaaaatatatttgagaatttggtcaactcactctctcattcctgtagtagttgggagtatggcct

SEQ ID NO: 27038 - DNA, 201 bp, Bos taurus
gactttccaaactccagagctcagctggccctcctccgcctagaacttcagcgccctccttttcctgaaacctctgcgtaaagtccgaactccctggaccgcgtccaaagtcttgccactctggccccgcctcggtccagccccagcctccaccagccccaccctccccgcctgcaggacaaccaggctctgtgctgcttg

SEQ ID NO: 27039 - DNA, 201 bp, Bos taurus
caaagagatgagaaagctgggtgaccactgctaaaccttccaggcagagagcagcaggttctaaggccccaaggcaggagggacagtcctggcccctcctcgtctctccacgctcatctcccaggaaccccacactccatcaccttgggtgcaccccatgcttgcctgccttcccatctgccttactcctcctttccctgg

SEQ ID NO: 27040 - DNA, 201 bp, Bos taurus
tcaagcttgcaaactgagagatatggtgtctttgacatgagcatattttagctcatgaataaaaggttttactgaatttaaatgtgcttaacattgggcttccctggtggcgcaatggtgaagaatccgcttgctgatgcaggagacacaggtttgatccctagtctgggaagatcccgcatgccatgaggcaactaagcc

SEQ ID NO: 27041 - DNA, 201 bp, Bos taurus
cagctatggccatgggctgccaccgacttccttctgggatgggtgcagcacagaatatcaggtttagtgatgaagggtctcaattctcacatttttaagtagggaaactgcagtgattctgggccactagcaggcaagtttactgggatatcagctcctggagcacagcactggaaggtctagggggagggtgggctcact

SEQ ID NO: 27042 - DNA, 201 bp, Bos taurus
ccatttttatagatgagtaagtctcaggagaaaaaaaagtttaactttggaacagtgtcttcctcgaccaggccttcttaatcatttaatgaagcaagcacgtcttctcagaagcatctggcccgtttcagtcctcccgaatccccgtctcccagagtgccctgttacacaggccaccgatgtggcagagacctgctctca

SEQ ID NO: 27043 - DNA, 201 bp, Bos taurus
catctctgtactccagggtctcagtgtttgggctgtggggtgagggcagaagcggagccaccgcggtaatgtcgggctaactctgtgaccttggtagtaccgctgccactctgagtgccacgggctctgtacacacacgggttcactgcaccctgaaagcggtgccgtggaaaagcagcagccccatgacccccaggagga

SEQ ID NO: 27044 - DNA, 201 bp, Bos taurus
acagccagtccctgtcctggtggcccctcccgagtctgagatgctcagcgctctcctattgggtggattttacagagttcatgtctctcagttgagtttcgtcagccccaaaggggccaccacgccgtgtgggtttctggcaccttcgttcagtgggatacagtcaccgtggtccccggggcggagtccccagggcgggtg

SEQ ID NO: 27045 - DNA, 201 bp, Bos taurus
ctactacggtttgactttggcaccagcctggagatgccacttctgggcagtgggcaatagcagtgggcagcagagctggcttctgctgtgggtgggcctgtgagcctccagggggagatgagagctgttccttgttgggtgtctgtgagttgagcagattgaaactttctccttgtctctcaggagggatttgggggtatc

SEQ ID NO: 27046 - DNA, 201 bp, Bos taurus
cctgtgtccatctatggccccacaccgccagagtgggagctccccaggacagggctttctgtccacctcattccccgctgtgtcctcggaccctgaagcagagcctggcaaccagaagggccctgtaagcattcactgaatgaatggaaaacagagtgaatgtgttttacagatgagcctgtggaggggccgagggagaca

SEQ ID NO: 27047 - DNA, 201 bp, Bos taurus
gaaagccagggtggctagagcacaggaatgtgggggttggggcagagcctcagaggcggcaaggaccagtctaagtggggccttggaggccttctcgggtgtttggtctcctctctaacttcacttgaaaagcactgggattctgcaggggttgggcaagggaaaagaggcccaggcatcttccccaaagaccctctcctc

SEQ ID NO: 27048 - DNA, 201 bp, Bos taurus
gattaaagtttgtgacaatcctgcattgtcagataatggttagcatatctaaaaaagcaataaagaaatttaaaaatacagcacttacattgttttttagatacaatgtattgcacacccttagattatagtgtgtgtaaatgacttttacatgcactgggaaaccaaaaaataaagtgcgactcattttattgcaatatt

SEQ ID NO: 27049 - DNA, 201 bp, Bos taurus
agcgagtggacttgactctgaagtctaaactcagagcccaaactctcatccactggcaagactactggtctacccaagagctgggcccaaacactagcaatgggcactgtgattataggatctcagccctttcatttgggcttccctgggggctcagtggtaaagaacctgcctgcaatgcaggagacacaggcgagatgg

SEQ ID NO: 27050 - DNA, 201 bp, Bos taurus
gtcccgttggcctccatggtggtctttggggtttaattaaatatgtcagattaggtcagatagtgaatctgccttcagaaatggggcaactcaattccacgagccaaggagtagaatgggccccatattctccttgggcttccctcatggttcaccccaggggtagccaggtctcagaagtcatcatggccattcgggaag

SEQ ID NO: 27051 - DNA, 201 bp, Bos taurus
aattcggctgtgggatgcggaacagatactgcctgatgtcttccttgagcccctggcacaggtgggcctggaggacttcgtccggccagcccaaggtgggcaccaggctctggaactcgttgatgtattcgatggcggcgcggtccccctgcctgaggttgaacatggcatcttctgctacccgcagggcctggcggtact

SEQ ID NO: 27052 - DNA, 201 bp, Bos taurus
gggtcatcttgcttttatttcatcagcattgatgacatgatgatttatatgatccaaatgaatgaatgaaagacctacagctgggccttagggacccagcgatgaacttgggtagaggacgaggggtgggcaagtaacccagagtgtctggaagcctgagggccatgacagcacctcccctgtagtctacttttctctctt

SEQ ID NO: 27053 - DNA, 201 bp, Bos taurus
atcctaaacatgtcccatgccattaagtaatttcctatcttatgattttttttttacctagtatcctggcaaatgactatatcataattgatttaattgatgcacgcttgtcagatatttacatgatttttaaaagttggatgatagaagttggagtgagcagctttgtttttccatcttcacgtatgtctcttatttgta

SEQ ID NO: 27054 - DNA, 201 bp, Bos taurus
tttctgcttctgtggaggaagaagaaagctgtaaagaatgttgtttccaccctaataatgagaaaaacccagaaaagactccaaagactcacccccatggaccacaaacccaccggtcatgtcacctgaatgacaaagaaggacgatcccctccggaccggctcacgtgggcctcacgtggcaggaagtagcggctaggta

SEQ ID NO: 27055 - DNA, 201 bp, Bos taurus
cccccaaaggccagagctggcagattggaaggcgtggaattactggagatggtgaataggggatggagcagtctagaccggcagctgagacgaagcgttgaagatggggccgctccaaccacagacacgtgcgtgcgtgtgtgctgagttgcttcagtcgtgtccaactctttgcagccctacagactgtagcccatcagg

SEQ ID NO: 27056 - DNA, 201 bp, Bos taurus
ggactcttgctttaaatttttattggagtccagttgctttgcgatcctgtgtcagggtctactgtacggcaaaatgaatcagctacacatataaatacatacacatatccctccctcttggacttccttctcctccaggtcaccgtagtgcagtaggtcatgttcccggtgccatacaggaggttctcactagttgcctat

SEQ ID NO: 27057 - DNA, 201 bp, Bos taurus
ggaggttgggggactgcttagggacaaaggaagaccgcttaggaggcggggttcacggcgccccgggcagagggaaggggccggggctcctgcgacccggggttcgagtggtggagtccggagaagaaaaatgaagggagagcctgggaaccccgaaagaggggtctcccagacagagctgccgactgcggggccggaagg

SEQ ID NO: 27058 - DNA, 201 bp, Bos taurus
accttttaagtcttctctggaaaggccctggagtgtttccttctcttcagggatgtgccctattaaccagggcgggtaggtttggggcctggcgagggcagggtggggctgcaagctgcacctatgatgaccctcatctactcaatgattgctgtgcccactccccctggggaggcagggacagaaatctgctcctggagc

SEQ ID NO: 27059 - DNA, 201 bp, Bos taurus
tcgctgtttccatatcgccgtggctggcgggtcatgtccgagagccactgctggattttatcagatgccgtatggtttctctccttaagatgtgactttaataactgccgtgttgatgaatactgggaggaacctcggcgccgtcgcagtgtggcttcgctgcgtgctgtgttggatttagttttcgttactctctgcctc

SEQ ID NO: 27060 - DNA, 201 bp, Bos taurus
ggaaaatcacttccttaaatacagctcactcgggagcatgtgatgattaaaaaagaagcctcagaggaaggttagaaggtctggcagggccttctgttcttcttccctttcttcccagttccctggagaagccttttcctttaggggtctgttcgcagcacactcacggcgaggggcggaggcgcctctgtctctagtctc

SEQ ID NO: 27061 - DNA, 201 bp, Bos taurus
gtttcctaaaatgaggtttctacaggcctgagcctttctcactaacagtggactgacttctgtcatcttagcaactaacccttttctcccgtcccggcgcaccctggccagtgggcccagcgggcgtgtcttctggaagaagtgtcttctgaagcagtgtcccctgtagaggtgagccagctgacacccccccagacagcc

SEQ ID NO: 27062 - DNA, 201 bp, Bos taurus
tggtagggccataaagcacaggtctggatcggcccctgatgtctgtgcctttttgtaagcactcgactccctctgcaaaatccctctctacttaaaatacatggagtgggttgtttcctggcctgaacactgaatgagtccacaatggcttttaaatgaagcctggagcctttagtttggggaagatgccaatcaaatgcc

SEQ ID NO: 27063 - DNA, 201 bp, Bos taurus
agttcttcattcagcccgcagatgaatacccggccactgggttggcagtggacaagccggacacacacttaaccttcacggccaacaggccctggagaggtgggaagatggaccgcacactttccgctgcaggacggttgtgagaaatgcgtcaaagaaagggggaggatgcagggtaaactgaggccagacagggggcga

SEQ ID NO: 27064 - DNA, 201 bp, Bos taurus
gttcctttttcagaaacatagataccatccaaaaatttcctgatatccttgtggcttgctgaatctgacacaagttccgtgtggtttccttcaagactcaactcatcttcctgagcttgagggactgaataagccatgtctaggctcatctgacccctgtggatgtattttccatccccgaaattttcagatttcagcaag

SEQ ID NO: 27065 - DNA, 201 bp, Bos taurus
ctctgccacaaagtgggcctttgtgttggcgtccactgcccccagcaaggaaggtgggttggggtgccactgaacggttaaatccatggtctgatgtggttgagttggggtgggagcctggccgtggtggtgtcacgggcgagggcccccgaagctggacaggagagaagagcctggtgtggggtgctgagggagtcgagt

SEQ ID NO: 27066 - DNA, 201 bp, Bos taurus
ggaaaacggggattcccgtgttccctctaaacagagactggctttaccaggaaggactggggcagagggagacactttagctgaaattgactcaaaatgtgaaatgagaaactgatgccccaaccctctggtttgtttatctagagaggaaagagcagaccaactggaaggggtgcctggaggggcggcctggtgtcgcag

SEQ ID NO: 27067 - DNA, 201 bp, Bos taurus
taatcgggatcctagcgaagagaaaagtcgattggccaaaaatgaaagactctgacaacagcgtgctgggtagcactgatgccacggccctggggctgctcgtttgtccggggcaccaagagctttcaattgcaacagccacgagagatgggagagcaggccgggacctgggcgaggttagcactgagactccaagaccag

SEQ ID NO: 27068 - DNA, 201 bp, Bos taurus
ttcccctgagacccccaagcccatgccccagccaccctgcccaaggctggatcctgacctaccagcgtccctggagacggccctggagccctcaccccctcggtcaccttgtgaaagtcgtgaggaagccccagtagcaagggcagcagctcctgagctcaggctcctcgggctggccctgtgtgctgagcaacaggaaga

SEQ ID NO: 27069 - DNA, 201 bp, Bos taurus
tatgatcccatgggcaaaaacatgggccctgttcattaatgctgtgtcttaaggctagctcccaggttgcaggaggagagatggctacgtggagacatagactctaaggccatagggcagactcgcaggaacaggcctgcagcccgcgaagcccgcactttgcagctgtgtccaggcacacaccccatctcctgcagcctc

SEQ ID NO: 27070 - DNA, 201 bp, Bos taurus
cagtcgcggggcccacagcacctccaccccctcagcccaggccagcgtgtcagccttttctggtgttgtccccagggccattttagacatttcttcccccaactgatccccgtgaaatgctcagagcaaggaccgtgtgtgagtggaagccgcctggatgccctgcactttggctcttcagttcgctctggggcccctctg

SEQ ID NO: 27071 - DNA, 201 bp, Bos taurus
agcggggcgctctctcacacacagctctagacaccagtgcagatcccaacccaacaggaagaggcgtactgtgtgtccccagaggaagaaacaccactcacggccaactggcagaagaagaaccacctcctccttgcctggcaacaatgcagctaaggaaaggccaccaaacttcaaactcccagtttcctccaaaagact

SEQ ID NO: 27072 - DNA, 201 bp, Bos taurus
actactgattcagaatgacttatgatgcaataagtaaaccactgtgtttcatttcttccaaaggaaatttctctccgtgtcctctgcccttatagtaacacacaaggccctgtaagatccttacccatccacttgccaccaacaccttcctgcttcctctcctccagtctgcccctcacatgctcagctccagctacagac

SEQ ID NO: 27073 - DNA, 201 bp, Bos taurus
accttggccaagtctgaaagatgtcacttcagaggtttccctttctgtgaagcacagacagctctacctgccccgctgggctctcaatggaatttcaggaagaaacataaaggaccctggcctgcctgtgcagtcgctcagtcatgttcgactctttgcgaccccatggaccgtagcctgccaggctcctctgtccatggg

SEQ ID NO: 27074 - DNA, 201 bp, Bos taurus
ttgtttttgcttctcaagtccaaggcagcatgttcgtgttgaggagctgctctcaacactgagtttggtgagagaacgagagttaggttgctaaggtgtccggccagagaagcagtagtggggtctctcgccctgcggagaagggggctccctctttgaaactcaggagcttgtctctgcattggcagagacatggcccag

SEQ ID NO: 27075 - DNA, 201 bp, Bos taurus
ccttggggcagaccggcccttacaggggaacttgtctgtggggccgctgcccgtgaccagctccccgcctgtacagcagggagacgagacccggtgcagctgcttctgcttgcggagggcctgaagcttgggggcccttgttaagaaaaagaatctgaatcagaattagatgtgaaagcaggtgtttgcttactagttgtt

SEQ ID NO: 27076 - DNA, 201 bp, Bos taurus
tcactgagggccggggggaggcttccgcctgctgggaggctgcccaccgctctgcactcccggtcctgtgggacgagggggttgccctgagggtcacctgtctgggggcactggcccaccttccctatttacagcaagaaagcaaggcccaggcctgtgctcagggtcccaggctggcacgtggcagagctgggctatgag

SEQ ID NO: 27077 - DNA, 201 bp, Bos taurus
acccccagagccctcagaaacgaggcgcagccttggagggccctgttgctgctgtgggttgagggaatgattgattaacgggtgagtgaagctcacttgggcagggagggtcccaagaggcgggggcccaggttttctagtctctacgtttcgcctggggctgaccttgagctcgtgggcaaggagaaccctggactctga

SEQ ID NO: 27078 - DNA, 201 bp, Bos taurus
ggctgtagggcggacctgcagatggctccgctctctgtctccacttgtccacgtgcctgcgttattaagggggccaggccaggaagcatgaaattagttacggtcctgtgcggacgtgtccacactgcctgtgtgtctcctgtgtgctgggcaccaggccaagagaggtgcatgagacacagtcccgagtccctgggaact

SEQ ID NO: 27079 - DNA, 201 bp, Bos taurus
gagaagggggtgtggggggtctcaggggcctgtcccccatctttctggcattggaggcagggctcggcgagattgggggttggggacacaagggaggaggcttggcggatggtgggccacacgcccttaacaggtgggattgctaagcagggtctggggtccttggggtcaggcccacatgactctggagacgccccaacc

SEQ ID NO: 27080 - DNA, 201 bp, Bos taurus
aagccctgccgagcggactgcgcgtgcgtgtcttaggactccaaggaaggatgctgacgttgaccgatgcgataaagagacgcagtcagcacggctgggctgactgtgcccaggtgagtgtccagaccagtgtcctgcaaatccgagcctcagcaggcttttttaggaaactcctcctaaatctgcccgcagagactgaag

SEQ ID NO: 27081 - DNA, 201 bp, Bos taurus
tcaggaggtcgaggagaggcccagggcgccgggcgggggtgccagccagccttccaggcagcagcacgtctgcagagctaggatttgcgcattccaagaacggctgtcccagcacgggcggccgccacacacacaggtcactggctttacggtgtccaggagccagtgcaccctccttggtggctcacctggcacgcccgg

SEQ ID NO: 27082 - DNA, 201 bp, Bos taurus
ggaaagaaagaacactgacgacaggtaccatgactccttacgcggatcctgcctttccagctcaaccgtccatgggcctgtggatagccttccgtgcaccgttcgtaaagcttgccgcatgctgtctcctgggctgcctgagcgtaggtgaccttccccgacagatggcacagttttgggtctggttactggccactactg

SEQ ID NO: 27083 - DNA, 201 bp, Bos taurus
ttgtgtccagcagcagtgaatgggggctgggtgcagaagcgcaggctgtgtgggtcggtcctaaggaaaaggactgaggttgaatgccatgaagacatgccgaggaggctaatgtgacacagcatagccaggacagagaaaaccctggaaccaccagaaaaataaaagatcattcccacaggaaggctctaatgccgcact

SEQ ID NO: 27084 - DNA, 201 bp, Bos taurus
atatccagtagtgtgttttggggtgtctatgggttcagtatggctttgagcagcctgtctactaatgggcaggattgtgtttctattttgctaatggtttggtgtgaggcatctgttactggaggtttctagcctttggctgggacttggtcttagtgttgagatgaaggcctttaagagagttctcattaattaatgttc

SEQ ID NO: 27085 - DNA, 201 bp, Bos taurus
ggagtcactgtggatggtgctctgtgtagtatcagcaaatgatgctattcgtgcagtgcccatccaaccctggcctagtccctggctggcctgcccccagcgtttccttttgtcttcctcgctgtgcttagcctcctctccacactgcagctggagggctcgcagccctggggccagcgatcctctcctaacactgaggcc

SEQ ID NO: 27086 - DNA, 201 bp, Bos taurus
aggaaggcattgctataggacctgtctagtcttgctttctgcttggtctctggtaactggattgcctgaaatcaagcactgtgttttgtgctttggttttttgaagacagtcatgaggccacgccttaaggcagaaatcagcctgaagttactgttatctgggaacacagtccaatgctggaagatatttactccagatat

SEQ ID NO: 27087 - DNA, 201 bp, Bos taurus
ccacaaaggtactgaatcaaagcctccaaggactagagctagcaagctgcattctaccaagctcctcaggtaacctactcgaggccctaaggcaagtcagcttgggtcctgacccagtccagctaatcagggtggaccactgtgccaccagagggaagcaaagggcagcagaacagaggcaggcctgatgggagagcagaa

SEQ ID NO: 27088 - DNA, 201 bp, Bos taurus
tcaaactgaggagactgaaattttagaggttgtttattgatcatctgtagaaacagtgttacaggtgacacctatttttttttaaaagatcttataaacattgtattgagcaaaaagggaaatcaccaaaccaaatctgtagcacaccatttatgtagattataaaccatgcacacaaacagcacaatctgttttctaagg

SEQ ID NO: 27089 - DNA, 201 bp, Bos taurus
tatcaagtttaaccaagatgagcacaaacatatggattttagagcctgaactatttagagcctgaaatattttccctccccaatgaaccatttatacattaaattcatcaagaactacaaaactagtatcttaaatggaagggagtgtaacgacttaacaatgtcacattcgataaagtatgataactggtcattttaaag

SEQ ID NO: 27090 - DNA, 201 bp, Bos taurus
gcctttgctattagttacactcttttttttttgtctgcatgggtctttgttgcagcatgcaggctttctctagctgtggtgcctgggctctctagatgccatgcgtgggccctctaagttggcctgagtagttacagcacctgggtttctctagttgcagtgtggaggcttagttgctctgaaccatgcaggatcttagtt

SEQ ID NO: 27091 - DNA, 201 bp, Bos taurus
agggtcatatgaaagagtttacgagtaaaccctctgctgccctgatacaaagagcctgatttcatcatgggactaggttgaagaaaactcagtgtaatacgtacatgatgtctggcatggcctactcctctatttccaggaagcattaaaaagaattaaagacagacaaagtttttcagctgcagtggagccagctctcta

SEQ ID NO: 27092 - DNA, 201 bp, Bos taurus
tttgcttgcatctacaaaatcttccatgcaactttccacttgccactctaatgggaagccctatctatacctagactccttttgaaaaatcagctttatagagttatcatttacatacaatgaaattcactcgtttaaaaatgtatagtcttatctgtgtgtttaatgtacacagttgtataactcccaccacaatcaaga

SEQ ID NO: 27093 - DNA, 201 bp, Bos taurus
ggagagggggagcggagcatgggacggtgacagcctgggcagcttttccttccaaccccagttttaggagtgattgtttatgaagcccgatcagatctgccgtgtaccaagtgcactccatacccgttggttcatatgcatattgtgtttgtggggacaagtgtctgatggcagcttgtcccctttgaccccacctgttaa

SEQ ID NO: 27094 - DNA, 201 bp, Bos taurus
ccttgaccacaagaatgaggaaaatgtggtgtccttagcttttacacaagcagggctctgctcctactgtatctttatcttaagagttaacaggaccctatggctgctccacctgggagccggtatctccagcctcacaactcctctccagccccactttctgtattttaggatggacatcgccttctgtaatgttgtgtc

SEQ ID NO: 27095 - DNA, 201 bp, Bos taurus
catttctctcaagccacagttcatgggctagctcttcaggaaatcttaatgacactcgagtctttgtatatgttcacatagaaccatgttcagcctcatagacactatattcacaatttataatttaaatcttatataggagataattggatacagtccttctgccccccagactataaaaatcatgggggaaaagaccat

SEQ ID NO: 27096 - DNA, 201 bp, Bos taurus
tagttaaatatgcatatcttattgacatttttcttaaaacaaaaaaattaggatatatgcactgaattgtaggcattataccatcactaaataacagaattgctgtgttcctttttttttttttttactagtgaagtgtagttgatctacagtgttgtgttagtttctggtgtacagttaaattattcaatcatacatata

SEQ ID NO: 27097 - DNA, 201 bp, Bos taurus
aatccaaatcctggatttggaacagaagcataatgtgagggatggctataatagcaaaggccaccactacctaagctgagccttcgccatgttgcagaaacggccaggggcccccacacttgagttcacacaacttcgcccacatgctctcaggtcagtactgccatggctccattttccagatgaggcttggaaagtggg

SEQ ID NO: 27098 - DNA, 201 bp, Bos taurus
gctcagatctcacatgccttgtggccaacaaagcagaaggggataaaaagcccttattctccattatgtgtgggtgctatagctaagtgagcactgacctgtggccaacatggggttttccttgtgattctcagatcatcttacaagaaataacctctggtgccacaggcaactgactgcatggtggtggctttgttgaaa

SEQ ID NO: 27099 - DNA, 201 bp, Bos taurus
agtggatgaggcctgggcttacctatttcttccttgcacgtctggtgcctaagccaagatgatgcgggtggctggggctcactggagctcctgggagtaacatcaaggcctcctcaagtgtcttctccagaatgcctcattatcatagccaccttagggtggtcagatttcctactcagcagtgcggaattccaacagcaa

SEQ ID NO: 27100 - DNA, 201 bp, Bos taurus
ctggaaagaggggcttaaggggtgacagggtcggctctggtctgtatccagtctggctcctgggagccacattatgattcttcaccgaggttctccaggcgcagggcctggaaaggcagcagtggcatcacctgagaacgtgaagaagtgtgggttccaggccccagcctggccgtggaaccggaaactctgggtgcatgt

SEQ ID NO: 27101 - DNA, 201 bp, Bos taurus
ggtcctcgaaatgcctgcacaaaggaaacactctttaaaaggtgaggaagtgaaatcaaactcaaggccatttccctgagaaacagaagaaccctgttcaatctgaccccggcctgagctcttcaccactgggtcttctaatgaaagcaaagtacactctagactatgggcttccctggtgactcaggctgtaaagaatct

SEQ ID NO: 27102 - DNA, 201 bp, Bos taurus
aagtagctatcttcctggttaactatagtgaacgattaagtgtgatagacggggagaaatgtagcaaagcccatttgatcaaagttctctctgtgtcaccatctttggatggcccagcaaacagctgtctgccaaatattaacattttttaccttcctgtgaattatcttactttcctttggagtctgagacccttatttc

SEQ ID NO: 27103 - DNA, 201 bp, Bos taurus
aagcgtctacgatgtccacctagtatggtttaataagctttgtccaaaagttccacgccaattccacctcctggggagcactggggtggtgatggctctattcactgagacaatttgagtcagtctttttacggcttttcagctgctctcagttaaaaactgtgtttggcaacaaatgatggaaaactttacgtacaatag

SEQ ID NO: 27104 - DNA, 201 bp, Bos taurus
caggtttgggaaggtgacatacttttaaataaatccaccagcttacaaagacaaaaattaagctatggggcaaggctctctgcattaatctctggattatgagcaaaaaacgatgactcctgggaaacccagaagccacccaggaaggctctctgagaatgaacacaagtcatccagccctcctgcctcccgccactgcct

SEQ ID NO: 27105 - DNA, 201 bp, Bos taurus
tctttggtgtgccaatatggtgtattatatcaatcgatttttgaatattgaatcagccttgctattctcaggataaaccccacttggttgtgatgtattattcctttatcatattgcagaattcaagttgctaatattttgctgaagatttttgcatctgtatcatgaaggttcagttcagttcagtcgctcagtcttgtc

SEQ ID NO: 27106 - DNA, 201 bp, Bos taurus
aaagtgaatcagctacacatatacatatacccttccgttttggattccttccccattgaggtcaccacagagcttgagtagagtgccctgtgctatccgtgggctctcattagttatctattttatacacagcatcaatagtgtatacatgtcaatctcaacctcccagttcttcccagcctctttcccccttggtcttca

SEQ ID NO: 27107 - DNA, 201 bp, Bos taurus
agcttttcctccagcctgaaatgtgggtcaaaagggaggagaaaatggaatcattctccttttactctttcattactctttgagtatatttgctgatactttgaaaatggggtgattaaaactaggtaaactggatcactttcccccgacccctggaatgtagaatgaacttcatacctggaagagaacatagcaattatt

SEQ ID NO: 27108 - DNA, 201 bp, Bos taurus
cactgacaccaaggccaaactgctccattcattttccaaatactttcactctcctacattaacacacgaaagatctattccttacatgtaagatctattacttacaaaaccctcttccctcctgggcctaagatcaccctccttggtaacactaacacttcccttttgggcaaggcaggcagcttaattttaaaattatgc

SEQ ID NO: 27109 - DNA, 201 bp, Bos taurus
cacccagtcatctctttagctagtatctttcaacccacctctcagcctagagctcacatggtcctgctcaggaagggagaaatacagacggcctctcacatgcacacatgctcacacaggtagatgtggggggtcagcttggtcttgacttcaaatatctgtctaactgtgggtcacggccaaaacgtgtgagtgctgcta

SEQ ID NO: 27110 - DNA, 201 bp, Bos taurus
aaatttacttgaggaggaaaaagtctatgtgctttgaggctctggccttctgatttcaaggcccagcagtttccttagagatggatgtttgaggagatctatgataacaatgtctaatactctactagcctgtacttttggaagtcatggctcctttaactgtgacatgaatcttgagtggtttttcttttcactcacatg

SEQ ID NO: 27111 - DNA, 201 bp, Bos taurus
cctgtcctttccctctaccttctgtttcagggtccagtcagagtcgcacgttgcatttgggggccttgcatttggtggccttgtctctttgatcgtctttaatctgggagtgtcctcagcctttccttgtcgtaggacactgacatttaggagtctaggccattttctggaatgctccacagcctggtgtgtctgcttcct

SEQ ID NO: 27112 - DNA, 201 bp, Bos taurus
ccggagttgttttgtaagcagaggccaagagggtggggaactttctgaaggaaagtctttgttttcacctggcacacgggtgatttgaaagtgagtcagggagagtgaggcatgggagaaaggcctgctttggggagtgatgtcactgaagctgggggcgcggaccacagttaactgtgcctttgaaccaaggatgtggtg

SEQ ID NO: 27113 - DNA, 201 bp, Bos taurus
ccagtggttggagctcggagcatctgactcttccaaggaaagaaaatagcctggagggagtggtgaacggccagggacaaccccccagggcccctgcaagaagtgggtgggcgtaaagccaccaagattctcaaacgagcaagtcgtttgaacaagaagtgagtcaccttccaaataaaattcctgggtaagcaggccact

SEQ ID NO: 27114 - DNA, 201 bp, Bos taurus
ttgtcttattttgtcattcccgcctcttcacaggaaggtcagtctcactgactgagagtgagaggcagggaagccttcccgtggccatgcacacaagtccgtattagagagcagattggtcgctgtctcacacggtgagggcgctgcccgtcttcctgacgtcggtggcaggcggtgcctctcgcgctcgttatgctagag

SEQ ID NO: 27115 - DNA, 201 bp, Bos taurus
gtgaagggaatagcagaaagtatttacagtttcatgaggttctaaataactatataatcatgccccatttgggcatggagtgaaaaatattacagaacagcatcctatggcatctaagcacattcacgtacccctcactgtagaatgagttagcaaggagttcctgtacctgttttcttcctttacacaaacagcacgccg

SEQ ID NO: 27116 - DNA, 201 bp, Bos taurus
ccacttctcctgcagaagagcaagtgttggggaatgaggaagaagggtctgtcttatatatatcagatgagatctgaggcctccagtggtcagtccaccccggtggttggatgtggtgttccccgtcctcaaaaatgatgagctggaaatcggggtgttacatctgtggggatgagctcccctcaaagtgtaagcagaggg

SEQ ID NO: 27117 - DNA, 201 bp, Bos taurus
gatggggagcggctacaaatacagatgaagcttcactcacctcctgttgtggcccggttcctaacagaccacagaccaatatcagtttgttgcctggcctttggggacccctgttctagtccagagaccttaatctgaatctaatcatgaagaaacagcagagaaacctcaatggaggactttttataaaataactggcct

SEQ ID NO: 27118 - DNA, 201 bp, Bos taurus
gccgtctatggggtcgcacagagtcggccacgactgaggcgacttagcggcagcaggagcagcagtattccattgtgtatgtgtaccacatcttttaaaaattgttttggccacatcttacggcatgggagacttcccccaccaggaatcaaacccatgccctcagcagtggaagctcagagtcttaaccactggaccacc

SEQ ID NO: 27119 - DNA, 201 bp, Bos taurus
acagctgacatttattgtgtacattttatgcgtgagacatttttataagcaccccatgtgtcttaagtaaccatcacaacaaccttacgcggaaaataccatttccacattttagagatgaggaaatgaggcacagagaggtagagtaactcacccagtcagatttcaaaaccaggcatcttgtctcagagccggcttatg

SEQ ID NO: 27120 - DNA, 201 bp, Bos taurus
aacatgatcatgacccgacagttcaccgtgagatgacccaggccaatctttaacttacaaaaggaagcaatggaagtcagacctgcccaaaggcaagcagattgtcagcagagctgggattaggcctctgtattctgtaacctgctacatacagtccagcaacaacaactctgccacagaagccagttttaatacaaaagc

SEQ ID NO: 27121 - DNA, 201 bp, Bos taurus
acacactgaggaagtggcggcaagcatcccaaccaaactgcacgccaaaaacagagaaattaaagtgacacaagctacacagagacacgccacacataaacagccctccaaggccacagtagataactttctcctaaactcacagagcaagagaatgtaagtaaaacgaagacgcatagagagtcccaaataaggtgaatc

SEQ ID NO: 27122 - DNA, 201 bp, Bos taurus
cgctgcaagtaagcacagcaaaataaataaataaaactaagttaaaaaaaaaagttgctgagagagtaaatatcaaaagttcttatcacaagaaaaaaaacgttctgcaattatgtatggtaaaagatgttaactcgacttattatgctggtcattttgcaatatatacaaatcttgaattattatgtggtagaactaaaa

SEQ ID NO: 27123 - DNA, 201 bp, Bos taurus
gaaaaggaagctgacaatgtgtcctcacaattagctcatagaagggacactacagaagggtgtccaggttctttgttactcaatctttctaacttaagaactatcctttaagtcccatctatccttaatactagccaaacagctaactaacttaagtgacgttgtgaataaaacatgttcttaaaaactaaatgtggtgga

SEQ ID NO: 27124 - DNA, 201 bp, Bos taurus
atccttggacttccctggtgggccagtggttaagactccacacttcaaatgcaggtttgatccacagtcgaggaactaagactccaaataccatatggtgcggccaaaataagaaaaaaaacaaaagcaatattctcaaaccttcatgtgaatgggttcaaatgcagactgaaaagtaaatactgtctaatactattgaat

SEQ ID NO: 27125 - DNA, 201 bp, Bos taurus
aggggtgcgggaggacaggccgcccctgagaatagaggctactggggccgggggtggcacccaagaggctagacttccgctggcctggttttctagtgcacaggtgtttgcaattctaaataaatgtgcagtgtcagggctcagcagtttctcagctgagacttgtaatgagggctgagcagggaaataaggtgggccctc

SEQ ID NO: 27126 - DNA, 201 bp, Bos taurus
ctcagtcttttggtgatggggcagatggcctggctgggcgatagatctgttttgtccaggggacacagtcatgtgtcaggaagagtgtctgtaaacatgaatctcctctggggccttgggatactgtggtccagaggttaatcaatacactgaaatgtgtatgcgccagagaaaggggaaaatgtatgaatctgttgttgt

SEQ ID NO: 27127 - DNA, 201 bp, Bos taurus
gctttcttcttggggttcagaagtgtatcctccattccttagtctcattttgaactttgttacagatatcaataagctcaaggaaattagagtggatgaaggcattggaagtggggatggagagctgggtggatctgagagaatgaaaatggactttgttgtattggatgtggcagagagtgaactttctgggctggtgcc

SEQ ID NO: 27128 - DNA, 201 bp, Bos taurus
attttatttgcccaagtcaaggccagtgttggtcttaatcagtggatctgagtttctcttgatgtttgctgcttcagtggttacccagagctaactgtctcgggccagttctgaattagtcctggagccagggctgggcttagcccgcctaaaccacataaccttttatagtggctaaaactgatgctgggagaggctatt

SEQ ID NO: 27129 - DNA, 201 bp, Bos taurus
tttaacgtgtgaaacacattttaaaatatattatttaattaaaaatgatatttgtcagcttactgctttgccaactcccttcccagagttgtgttgttgccggggcttcagtacaagagcagagtcgactttctagggagcagaggttgggtggcagggtggcagtgcaaggcagagctgcaaagcttttcagagccagca

SEQ ID NO: 27130 - DNA, 201 bp, Bos taurus
tcagttctttcatctgtaaattaaatatactaccctgagtgacaagcacatttctaagcttcatatttctccctttcacatctaaaattctctttatgaatttctcaaatagttttttggtgtgtgtgctcaattatcatgatgcaaatttccttccaagtaaacgcaacctatatttttctgacttctttctcgagacaa

SEQ ID NO: 27131 - DNA, 201 bp, Bos taurus
agagagatggatagacatgtgaagaaaggtaaagtcctttgacaaggcttttggatatgtaagtgtctcactagagaatcaatatctggtgtattaaagcaaagtgaaatgaagtgaaagtcgcttagtcatgtccgactctttgcgaccccttggactctatagtccatggaattctccaggccagaatactggagtggg

SEQ ID NO: 27132 - DNA, 201 bp, Bos taurus
gtagggtatctggccccttggatcaacacaaacactgcaggtattttttcctcctttgcttatatttagagagtaatttaaaaatagattacagaaagatggaacactctagagtggctggctttcctagctgagctcttaaaagcactccagattgttaacaattataattataccttcactcctggataccagaaataa

SEQ ID NO: 27133 - DNA, 201 bp, Bos taurus
taccgtgaaaaatgtttatagctactgtgaattctggagcttgatgactgcttgggaagactggatgggagggttaggggcaagtggctggacgatgatgcagccttcttgctgggcattaaggtatgggtagaatttaacttctcactgttaatagggaaggctattcttggtacaagaagcaatttacagaaagatgtg

SEQ ID NO: 27134 - DNA, 201 bp, Bos taurus
cagcctccgcctggtcagttgataatgaagtccaccttcaccatcatcccctggaaaacacatggtgagtttccaaatagtttaatgtatgttgctaagaaccaaagatggccatgtatttgggaagacatttaatatggacagaaataaaattcaaaaaacagagaaaagaatgtagaagaaaaaaagaccacacttaga

SEQ ID NO: 27135 - DNA, 201 bp, Bos taurus
ttgtggaaattgataaccttggaagagggactctgttatactggcccctgacctgtcccacttggatactgtcatccacaagtttgcagggtcatgagacacaaaatgttgatgggcctctaggctgaaagaatgcaaactgactaaaagaactgctcaatctaggttccgtcttggttttgtcatggcctagctgcatga

SEQ ID NO: 27136 - DNA, 201 bp, Bos taurus
acaagggcccagtgtccgccaacatgaaaatccaaaagtggatcccccgctgctacgtggaggacacggaggccgagaagggcggggcccgcgccgagcctgagtacttccccccagccagcgcggtggagacagaatataacatcatgaagttccacagcttcagcaccaacatggcctccaacatcctcaatgacacca

SEQ ID NO: 27137 - DNA, 201 bp, Bos taurus
atattgtcctgctgctgctgccacacacatgctcttctttctgctttctctgtcctcctctctctgctgttctatttagatggctctggcttttttcagacatttactcttggaattcagtgtcactttatgaattgccatcagaaactcagacctctttgggcaggatctagcctctgagaactcgttggaaaccagcag

SEQ ID NO: 27138 - DNA, 201 bp, Bos taurus
gcagggctgagccctaagtggttgtgttctgtgctctgacctggcacccgcatatttcagtggctctcatgcagtgtggtgaggctgagagtgagcagggggcttgtcctgcccccagacaggcagtacagccagatcctgagaaatggcaccaaggtcatgcaagccagtggcagaaatggggttgacaccaggcagctt

SEQ ID NO: 27139 - DNA, 201 bp, Bos taurus
caaagaatgtgagtttttgatccaataatgtaaaaacgtaccaagaaccactgtgataggagtagcccaacactggggattgaggagagctccagattccactctctggccaggagcaagtcttgttccctcttttcttaaaaaaattatttatttttaattggaggataattgctttacttgttccctcttggggcatca

SEQ ID NO: 27140 - DNA, 201 bp, Bos taurus
tccattaagatccaatctgaaattaaaactcaggatttcaaccaataagctataaagctgttgaactctccctgggatgtagttaccttttcttaaacttcctaagttgtctcttcttagccccagagtggattccttatgaagcctttggaaggatctctgatgttttatggccattgcccatcagagtggggacagtta

SEQ ID NO: 27141 - DNA, 201 bp, Bos taurus
ttttatatacttcaggagtaatgggcatagaaggaggatcgctggaccagaaattaggatggctgcctggctctggcactgtctgctgtgcggctgcaggcaagtggttaattctggcctttatctgcaaaatgataacgcaaatgagttcccattcagctgtcgaattccatttctgattttatgatgtctgctcatttt

SEQ ID NO: 27142 - DNA, 201 bp, Bos taurus
cataaaccataaagcttatcgtgcaaatgagcatccagaggtcataaactgcagaagactgtagcatttaagtttggaatgctggctagcgccaaatgtcactttcttttcccatagtatgaattcagcgtgatctttgatacaagccacctgtctggggaagaggaagttcttagcttcatcgttacagctcagaggtaa

SEQ ID NO: 27143 - DNA, 201 bp, Bos taurus
ctgggcccgactgcccatgtgaggcaagccataggcagtcactcctgcaagaaggttcctgtggagacggaggacacagctgctctcacacagctagatgggacctggcctggagaatgtaacagcctctccttgttgtgggcctcctgcaaggatgagccttttagcagagcccctgagtacaggcctaagacaaggcca

SEQ ID NO: 27144 - DNA, 201 bp, Bos taurus
gctctgttataatgtcttttccagatgtttatgtcatggtttaatgagtctcataaagtgaatcgggacatgccatcatttttgttctctgaaataacttatgtaagacttgtattatttctgtgttgagtttgtttaagattggttatttgttctttaaacatgtggatattttcctttagtactttgacaatattccag

SEQ ID NO: 27145 - DNA, 201 bp, Bos taurus
aataattaagaaaatgcaaattaaaactaaaatgagatgatcatttcactctcaccagacaggtaaaattttaaagccaaatttgaatttgagggtgacacaaacattcagtctataacttacatgcatcttccagaccttattccatatatttatatacatgtaaattacagactgaatgtttgtctgccccaaattcat

SEQ ID NO: 27146 - DNA, 201 bp, Bos taurus
acaaatgtaaattttttagattctattgacacattattgcatgagaaaaacatgttgtagatttgaatggatagtacaatatcatttatgttggaagaaaagctcagatatgtcgcaggaacatattctattaactagactgataatggttggaaactttgtagagaatattagacctgagaacagtggtcaaaagggatt

SEQ ID NO: 27147 - DNA, 201 bp, Bos taurus
cactactctactgttttaattagtatatttcatgactagtgctaatgcttggtagggcaagaccctgttctcattcaaaattgtctgggctcataagaatcataaaatcatcttactaattccatgaaaatctgctttttattggaattgcattaagtttatacatgtattaggagatcttcagcatacttatttctattg

SEQ ID NO: 27148 - DNA, 201 bp, Bos taurus
atgtgacttgatagctatttctacacagagatgaagctgatttctccactgctctaaatctggactagacttgagacttattttgacaactagaatgcagtggggagcctgaggccatcccagttgacaatctagtcttcaagaggccctgcatggtactggtcacttttctggaaccatacctctgccgtgtgaataagc

SEQ ID NO: 27149 - DNA, 201 bp, Bos taurus
cactgtgtgagctagagtgaggactgagagccagtctctcagacagcttccctagctgagttgtaccctctgcagggtgagaggagtcttgcataattctcctgtcctctctggcacctggtatagcaggttgtaacttcttgttacagcttcttgtagtagcttcttgagtccaagtgtgggattgccataaatagaaac

SEQ ID NO: 27150 - DNA, 201 bp, Bos taurus
agaggagtgagttttgtgaaaatcacacttttcttttttgacagaataaacacaaaggggaaacttttaaatagaggtagaagttctgaacatacacagccaccctagcaggactaactggccttagatgcagccactcagagtgtttgctttctcttagagacatctttctgccatgaaagtggtttccaaagtcttgca

SEQ ID NO: 27151 - DNA, 201 bp, Bos taurus
caaaccatctgtagttccaaggactaaatgtcatcaattccgactattctgtgattggtgaatttcaaaggcttggctgttgacttctttaaagctttagtgttgagagaaattatcagggttagattgtgaaactgcgcaggactaagaacctttgtatgggcatccttagggacaaattgggatcattttaaaaataag

SEQ ID NO: 27152 - DNA, 201 bp, Bos taurus
cagatgaactcaaagatgcagatgattctttgtggctgaagcacgtccactccatcaaagaccttggcccagatctggactgattataactttgagtcacgaatacaaaaactggaagtgaattgtgtcggtcagaaatgtgttcaaccataaataatggaaaatctggcccacaagggttccaacaggcagggaattctt

SEQ ID NO: 27153 - DNA, 201 bp, Bos taurus
ttgaatccatccccagggctaaggttgtaaatatgttgtgggggaggtaagagtcttgtgtgtagagtggagagtttggatatataggtttaagtagaaaaggggggacccatgtcaagaaattcccccagaacatgaaaatagagataatttgaggtattatataaataaaagttgtgtgcagagatatagaaaacaact

SEQ ID NO: 27154 - DNA, 201 bp, Bos taurus
ctccaggatccctgagcgcacacgagaaagatctcagtagccagactcggaaaaggagaggaagagagggcacagcaggcacactagactctgcgttcagtggcagaggctgggctgctcctcttcctatcacattattctgcagatattccatggagtgtttgttctaaacgtcctctgatttggcagaggcaccttggc

SEQ ID NO: 27155 - DNA, 201 bp, Bos taurus
tcttagtcaccctgccgcatcccgcatataataggtgctgcaataagctctggtaagtcatcagatgaacctttgtggaatgtcttttgccttgcctttgattgatttaccatgttctttacaacaaatatcctgccttaaagattccatgctcattctgtttgactctgtacctacccccaaacccaggtctgttacaga

SEQ ID NO: 27156 - DNA, 201 bp, Bos taurus
tttaggggaccaaccacgcagtgtgaagacagcagaggactgctgatggttcgtgagagagcagaaagggccatgggtcgtgaaggatggatgagaccgggccagtgaaaagaacaacgggggaacactgtgagcaaaagcaaaggtgtgagggacttccctggtggtccagtggctaaaactctgtgttcccaaagcaag

SEQ ID NO: 27157 - DNA, 201 bp, Bos taurus
taaaaagtgaaaaaaaaaatttttttttaaagtgccctctgctgagtcatctcagtgtctgttctggaaaatctgtttgtcctatatcagggcctgtcacaagtgaacacatcttcacttcacagcaaacagtaacacttgcctcatttaagagagaaaagaaggaaataaatttacacttatgcagaggccctagaagca

SEQ ID NO: 27158 - DNA, 201 bp, Bos taurus
gacacacagcacttgcgacttaactgggactccaaatacaacaatgaattcctattggccgtgtcctaacatgtggcctaagtatcagctgactcagctgtttagagaaagcatgaaaggagacaggcatgtggtgagagctaacacttggccaagaaagtacctgatgaactcatacacccttcctgtctcagaccacaa

SEQ ID NO: 27159 - DNA, 201 bp, Bos taurus
aaatgtgatagagaacagcaccctggaagctgggggttgatagagagtatgaagattgcatggagctgggagaacatgaattctgacaattcagagaagataggccttgtcaaacagactgagtgaatattcaactgagacctcagaaaagccacaccttactgataacttctggtaacaaaaatttaaaacaagccttga

SEQ ID NO: 27160 - DNA, 201 bp, Bos taurus
gaatggaagctgcgctcacgggagaaggagaagcctgcactgccctcccacaaagacacccaagacgatcctacggcacttgaggattatgatgaaaatcgtcaacccctcagtccagaacccagtaaggagagctgacctaatttgtgtgcccaacaccatggtgtacggacatttaatcaacagggcacttgagagttc

SEQ ID NO: 27161 - DNA, 201 bp, Bos taurus
ctgaataatggactgctcctcctctgacttggtattccggggagcagccccagggctcgggcctctgtagaccagggaggatgaggcttacctctgaacaatacggatgtggctgattctcagggaattattcaggcagaaagtcttaaatcattatactagactttggaaaatcatgatgcaaaaggcgactttatttgg

SEQ ID NO: 27162 - DNA, 201 bp, Bos taurus
aggcaaatttcatagcacagtttcccccatggctttctaccgggcataaagccttccttgatatgctacctaaataaaataagctctccctccattccccacgtcaactgaggtgaaaaaagcataaactaaaacttgagacaccttttatttggcagacttgctgggggcttaaacctgagaggcaacctctcagatagc

SEQ ID NO: 27163 - DNA, 201 bp, Bos taurus
acttcagtcaacgcttcctctccctggactagtgtttcatcagtgcggccaacactaaatcaagaaagatggacgcacagctaaggccaagtaacagatgcggtaagaaaagtaacagaaaaactctggaactggttgcaactcaaactaggaaaatggcccaaacagagccaagagacctcttccactgtgtgtgtaaac

SEQ ID NO: 27164 - DNA, 201 bp, Bos taurus
attattaatatttaggatggcaaatatatacacgtcatttcttcacaaccattgcttcataaataaagacgtgacaccaagaccatcacctgcccctggatgcatcgggtgtttctggaggtgtggccattttctcaggcttctatagaaccattacatttggttgatcgttaaacatagtttaacataattctccatata

SEQ ID NO: 27165 - DNA, 201 bp, Bos taurus
attcaaacataggcaatctaactccggggccagaaacagaattctcagggttctaaaatgctgagatatgccccagaaggcagtctgtctgcggttgtgatgctcttggtgctggccttgtgatgtgcctggacttggtggtttctgtatcccccagctgtgttcccaccctgctctggacaaccttctcccgctgacagc

SEQ ID NO: 27166 - DNA, 201 bp, Bos taurus
ttatctagctccacagccaaagctgtcctcgaccacagtgggacacttgtgcaaggagagctaccatggccagtggtggaagcgggggcaaggcccagtgagtcaggagtagtgcatgaactgagtcccgaacaaacgctggacaaggattgcaaattctgtcaaaagtgggtttgaattagctcctctatttacaagtct

SEQ ID NO: 27167 - DNA, 201 bp, Bos taurus
cgacttagcagtagcagcatgtgtgtcttataggtcttagtagttaatacacttgggcttctgggccaagtctaaattattttgaaaatagataataaagagcaacagccaagggaagggcatggctgaatctccaagaagtggctgtgacttgaggaaagtataaaagtgaaaattagaacgagtgggcattatggatgt

SEQ ID NO: 27168 - DNA, 201 bp, Bos taurus
gtccggagcagtgaaagccagactgacgtgtctgtctccaacctcaacctcgtggacaaagtcaggaggtttggcgtggccaaagtggtgaactcagggcaagcccatgtccccaccttgactgaggaccagggacctctcctctgtgggcccccaggccctgcgcaggcccttgtccccagaggcctggtacccgaaggc

SEQ ID NO: 27169 - DNA, 201 bp, Bos taurus
ctgatataaattattggaagacccattgtaaaggtgaattaaatgtttccccagagggtatgcaatgggttcctggctttgtttggaacaagagctagagtaatcacaaccattgttattggccatcagaaggcaatgtggagcctgggtatctgttaaacttagtaagaatagttctaggtgaactggatttttaggtaa

SEQ ID NO: 27170 - DNA, 201 bp, Bos taurus
tgctcatctcccccgagtttaggtcaggcgttttttcctcctgtgttttcctgtatgtgtaacctattgaattcagatgacagctctggggggaaaggccggttgctatctctaggtaatacttcagtaaagtgaaacctgacatagttctcttacttatattttgtttatggaggccccacttcctttggtcgaaaggct

SEQ ID NO: 27171 - DNA, 201 bp, Bos taurus
gtatggttcttagcttctgaaatttatttaaaacctcctggtgtctgagtgggtgccttggactttgggattttatcataaagagtctctgtagtagagggcaaccattggcacgtgataagaaggccatggtgtttctgtctgcagttgactggtgtcccataaatgtggtaaaatcccaaagttaattctctttgcaca

SEQ ID NO: 27172 - DNA, 201 bp, Bos taurus
ctccttcagagttatctggtcctaagggaagtttaactgtcctttgccatgggcaaaaaaagaggcagggctggggccacctgccacctgattttatagattttggggtcaaagagacagggctctgtccttcccactgcaaggaaccagggctgctgtggttgaacctgcgttggcccaatatattttacagtctgcata

SEQ ID NO: 27173 - DNA, 201 bp, Bos taurus
ttctcacgtctgcttatacacacacatactcacaatgtgtatatgtatttaaaatttggaatcaccatggagtcaacttcttggatttgactccatttgtaatctctataggcttcatctgtaaaattggcatacggatgctatagacctcctaagactattaaactacatagttctgttgttatgtattattattgtata

SEQ ID NO: 27174 - DNA, 201 bp, Bos taurus
gggcaggcccttcgagggggtgtaaggggtactcgctttaaacctttcagcaggaggagcctaggctgtgagtccacttgagaatgtgcagggcccttgagcagagagcagtgggctggaaccacagcatgaatgtgactggctgtgcaccttttgacaagtctggcctctggacagtgactttcttgtttgcaaaaagta

SEQ ID NO: 27175 - DNA, 201 bp, Bos taurus
catggctagtactctttacacagaccattcccatcccacctctcatccggtccgcagcagtgctgaggggtgggtgggagggatgctctcggccatcactcgccagttttgcaggtgatactgaggtgaggaaagctctcagggagcaggagagcccaggactgagctccagctttctgccttctgggccagtttcctgtc

SEQ ID NO: 27176 - DNA, 201 bp, Bos taurus
tttagtctttaaaagctcaagcatttctctggtttttattctggttgggaagggtgataaagagcaagattcaggccatttccaaaatgtaatctgtcccgatcacttggtaatttaaggaaaagtcggaagggtgagtgggaggaaagtcatccaatctcagaaatgcgacttgctcaggcaggccagacacagggcaga

SEQ ID NO: 27177 - DNA, 201 bp, Bos taurus
ttacttacatcttgttttactccgacccagctttcagagcagtaaccatggtggagtcttgagcctgtcccctagtcaagctaagtggccacctctccccgtaatgtgcccttcacctgccttggctcctgtaatctgcccaaatatcttgacccagctctatatgtcactcaagcactggcccagttatcttctgggagg

SEQ ID NO: 27178 - DNA, 201 bp, Bos taurus
agttgcagttgaagcttgaagaccactggttgacagaatttcctcttagaagtcagtctttttcttaaagccttcagctgagtgtgtaaggcccatccacgttagagagagaagtgtaacttgctcaagttcactgattgaaatgttaatcccatccaaaaaatactttcacagaaatgtctagaatagtgtttgaccaaa

SEQ ID NO: 27179 - DNA, 201 bp, Bos taurus
ctcaagagagaaggctgaggtgaggccaactgcctactggaagtttccaggcaaaagcagaggagataaaacccaaggaggcccagggtgcaggaatttttgggggcatcccattcagtctttgactgagtcctggtttttgtgtgatgagaggaaatgacccaaggccagggggcgagccgctggtgagcgggaggctag

SEQ ID NO: 27180 - DNA, 201 bp, Bos taurus
gaggggcaaagagcaaggacacatgaagaggcatattcagccacatttgcttattttccttagagataatctaatccacactaccagctattgcacagaagtcagacagcaattttagtacctattattttctctctacttcttccacttttaaggcatttcagtttcacatctttgaaaatattatcttccaaatcacaa

SEQ ID NO: 27181 - DNA, 201 bp, Bos taurus
tttacaaaacatagttctgtgtgtgctaaacaattcacaatacatctggaaaaaacagggaaatgtctaggagaacagtggttgggaaaatgtgttagacccaaatgcattacacttacctatcaagaagtagtcttcttcttttatttagaaactgagattcttaagggattgatttttattattcctattggttcttac

SEQ ID NO: 27182 - DNA, 201 bp, Bos taurus
tcttactctatgaaaccttccctcacagccctctggatgcgtgaaaaaatgccctaagccttcctcctctgcttcccagtagcactggtacccacacttcaaaccgggccaagcctcagctatcagtgcttctctggtttatcacctcttctgtcacctctaaaaagcaccacagatgtatctctatctttgaacttagaa

SEQ ID NO: 27183 - DNA, 201 bp, Bos taurus
agatggtgtttaaatatgacacctgtaaccatacggtgccccacactgtcatgggagagcaagcctgaatccaccattaattgggtggagagctaccagtctataatatagaggaaaaagtatctggaaaactctctattctatttttatagagaggcctgtgatggattcccttagaaattccttcctttaaaagtttct

SEQ ID NO: 27184 - DNA, 201 bp, Bos taurus
gacttcgctggtggcaccgtagataagaatcggcctgccaatgcaggggacacaagttcaatccctggtccgggaagattccacaagccataagggcaactaagcccatgggccataactagcagaacccgggagccacaaccagagaaaccactgcaatgagaaacccacacagcacagctacagaggagcccccactag

SEQ ID NO: 27185 - DNA, 201 bp, Bos taurus
ctagcccatctcctccaaccacactgaatttccctgttgcgtaattaggctaaattctcataacatactcttctgatctttgctatcgcttaataaaatcataacaaaatatttgtgtacttcctcattgaatattcacctgccacattaaactgagagccttgtgaggaccacttctattttgttcgctgctatatgcct

SEQ ID NO: 27186 - DNA, 201 bp, Bos taurus
tcagtggctttttgctagacacgtggtcagacaatactgacagccttgttcaataaaacaatacaacacagcttatgtctctaaggacagcatcagatcattaggtagaaattaactgcttttcttgtctggtacctcattaaagctcaaaaataatagttgttctgactagttagcactattgcacatctctgaggatca

SEQ ID NO: 27187 - DNA, 201 bp, Bos taurus
attgtgagtgagtcagtgcctgggagaaagaggccaaggtaaagagggtaggaacagaacaaaggtcatcaagagtggctctgacccgtatgtgaaggacagttaaatcatggcgtggcagacaaactggagtggtattagtcagggctgagctgtaaaaaaacaaaataaagtttttattcatccagttttgtttccctt

SEQ ID NO: 27188 - DNA, 201 bp, Bos taurus
atagagcccaatcttctggtcttactcatttacctccaactttaccatgtattcccagcaaagttaagagctgggccattcaaaccaaatcaagctgggcatagaccaggatgcccgctgatgcctgggatcaggtcacatcctgaaacataataaaatccagtggctgcttcctcactgctggacagaggcctctggttc

SEQ ID NO: 27189 - DNA, 201 bp, Bos taurus
acaccatcttctcttgggcatttcgcaacctgcttcgggaggcatcctgatcagggtccacctggggaagaaaagtcatcaggtcaaggattctgcacgccacgcccttgcctcactacaatcactgctctgtccacaggaatggggaagaagcagtcgtgaacatcagcagttgtcaggagaagtaccacagcttcagag

SEQ ID NO: 27190 - DNA, 201 bp, Bos taurus
tttcattctctgaggattttttttaggtcattctaatattaacaccagaagtatttgtggctgaaaagcatgagtagtcatattatttcagtttctttagcatttttctcttgcttaattatctaatgttgctcttcatatccttggggaacgcagcatacttcattaatatggacagtttaacgagagagaaaactggat

SEQ ID NO: 27191 - DNA, 201 bp, Bos taurus
gtgaaaaggcaaagcatatatttaagtgctagtcatctttgaggagaactcccacttgatcctttgtcagatcaggtgttttctctaaggccttcctaacgccacttacagagctgccacctttcctctgtgtcctcacaatattgtgctgaattatagcactggccacattgttgtaattatctctttccatggaaactg

SEQ ID NO: 27192 - DNA, 201 bp, Bos taurus
atcattcatttttgctaattttactaggtaatatgtaaaatattttgccctctcaactgatacctatttgatctaattcagagaagtctattacgttagcattcctgctttgtgaataagagtaaatctgaaaatggtatagtggtttaacacagtgaaaatttactgttcccccaatgttagcagggtgaagggggaggg

SEQ ID NO: 27193 - DNA, 201 bp, Bos taurus
tggaggccgaatgtcactgggggcaggagggcactccagggttctcctccccaaaggccagctattcggagctcagggccaggctggccagcttcagagatgtgttcatgacgtgtggtgtcaagggcttcgaaagggaccttgctcccaaattctcccacgtcggcctctgttatttcaaggaccgtgaacatagcatac

SEQ ID NO: 27194 - DNA, 201 bp, Bos taurus
ataactcctcttacatagagctgcttctagcattgctgagctaatacacatggtaatttttagaggtatggagggttaaataatttacgataatactatccataatttgttttacttaaaaatttaaaacgtctattctaggatataattatgtctcatgtgggcaggacagttgaattacaacatatttattattctggg

SEQ ID NO: 27195 - DNA, 201 bp, Bos taurus
actgcagccctccaggctcctccgtccatgggattttccaggcaagagtactggagtggggtgccataggagatgtgctggccaatgttaaatggtctggttgcttatttaatagttacctaggacttcaatgccttagagaagattatttctctatggatttggagtgtgcctggcctgtaaaacactgattggtcttaa

SEQ ID NO: 27196 - DNA, 201 bp, Bos taurus
ctaggcttacctttctgaatgacaggccctgaggcttttatctgctgaatctcatgccccatggtttgtggaccacactgaagaagggagttactttctcaaagctcctcttgcttgtgactttagaggaagactcaaggcagaaaaatacagagtgggaacagtctatctcttgatgtagcacccccttttcaaaagcag

SEQ ID NO: 27197 - DNA, 201 bp, Bos taurus
cagtaaagttattggatctacaaggaaaaattttagaataactccaagttccctcctagctttaagctgcaagtgatgagtgattggtggcaatatatagcatgccaaagtagcatttcttgatgcaaacttcttccattaactcttatcagcttatcagaaggaaaaaaaatccacattattttatctcaaagattctac

SEQ ID NO: 27198 - DNA, 201 bp, Bos taurus
tatataactaactatccttcggggattcaattagattaagagatccagaatgactgtaactatctctattaataactcaggctaaaatctgacagtttggaaaatggacgtgttattttcatcactttcaaagattgtagtaacaccccttcctcctctgacataccaacacttagtgatccttagaaacagaaagaagag

SEQ ID NO: 27199 - DNA, 201 bp, Bos taurus
aaagtaattagcctccagttacaataaataaattaattttttttaaaaagatcattgggcagtgagaatgacatggctttgctgtactcagtttctatgctccctcatatacacattgtatttggaagatactgacatttaaattataaatttttacactatcataaatattgcatgtaatataaatatgtggatacttct

SEQ ID NO: 27200 - DNA, 201 bp, Bos taurus
aagaacctaggttagttttctcccaaagcagtctttcattgaactgtaatggtaggagcatcagccagggtctgtactcaaaatgggaagaatatgtccacggcatactcaaaatcagataatttgaggagcgcttataagaggatatccataaaggcatggggaagttcagttactttatcagctatctattgctataac

SEQ ID NO: 27201 - DNA, 201 bp, Bos taurus
agctaatgattggcttaatttggccatattctattttaccctaatccattgtggctagacagtgggaaagacatatgacactcaacacagatagagccagtaggaaccatgaagagggaaagtgattacaaactgggtgatcatcccaaaaggtgtctaccctgaatccgaactgtggttttagttccctgagattaatgt

SEQ ID NO: 27202 - DNA, 201 bp, Bos taurus
ccaccatggctggcatgtttgtgattattttcacttgttgtgaagtcacaggatggctgcatcacactttccatcacattcaaagatgcaggtgggagacggtacagggaagcatttcttcttgtttcttcctttatgaataagtgaaggaatttttcccagaatactttcagtgtatttccctttgtatatcactggaca

SEQ ID NO: 27203 - DNA, 201 bp, Bos taurus
gaaattctttattttgaggtatattttaatatttccataataaagacatttttaatgtttattcaatcaatggaaatcagagattatcctgaagtattccaatagcagtaaggagattccttaaggcaaaacaaagtcttgagaactttcactagcttacttgtagaacaaaagaaaacaggaagaaaggtttctttaagg

SEQ ID NO: 27204 - DNA, 201 bp, Bos taurus
ctccctgccatttaataggaggaaatattcagtggagtagccagctactattatttttgcattaatatcaacaatgagcactgtgctatcactgttggcaattttctccttctaataaataatttatagttatttgtatacaagcaattataaataacttcttacacttaaaaagttaacgaattattttagttcattttg

SEQ ID NO: 27205 - DNA, 201 bp, Bos taurus
taaggagagttacagaaccacattctcaaactaattggaaataacagaattttatgagccaagtggtcatctaagctttcacttcaagttctaaatcatttacttctccacatctgctataattctctttgttttttccccagcagagggtgcaaaatattaaaccttggaactactgcataaatgtgaataaaattatac

SEQ ID NO: 27206 - DNA, 201 bp, Bos taurus
gttaaacatctcagagaggttacagccacgaaactctggtccaagtttaagcttttactttaatagagacccaatctccccagaaacaaatgtctttgggaatgagacttgatttcaagactaagttttggactaagaactggtagaaagacttcctgcaaattttatatgcctgaaggcagtcacatgggaagaggactc

SEQ ID NO: 27207 - DNA, 201 bp, Bos taurus
gctggaaaccactgtttcttgtccctgtggatttttgtcttcagattcaacacttgtgtagtatggattgatttaaagatgctggtggacaagacagacaattatttagacaacagcatcatttcattagagagaaagtgaaaggtgtgaataagacatgctagctctccaggagatgttgacctgagaacaaaacaacaa

SEQ ID NO: 27208 - DNA, 201 bp, Bos taurus
aggtgaagttgacccacaaccggttttttgtaaataaagttttattggaacacatccattcctatgaatttacatattgcctttggccgctttcatgctataatgacagagttgagtagttgctgcaaagactatctgaccctcaaagttgaagatatcatctggccctttacagggaaaaaaaagattgctgactctcgg

SEQ ID NO: 27209 - DNA, 201 bp, Bos taurus
tcactttaagctgttgaaaccctctaaatcttcaaaatatgtgtatctaagccaattgttagttttttggatttattggcacttccacagttaacataaaattaataggaagccagatgtacataaaatatatatttggcttttaaaaaatcatctaaatatgtcttggaatttgacaagaaaatatcattttccatttaa

SEQ ID NO: 27210 - DNA, 201 bp, Bos taurus
gtgcacaggcctcagagaatgttcaggaatttgataaaagtttggtcaaagaatctttgtcaaaagcagaagtagtaaccctagctcatgataagtgctgatttggccttataacaaactctgtaatacaagggacctttaaaaaactttttaattgcttttcagtaataccaatatttgtaggttatagagataatgtaa

SEQ ID NO: 27211 - DNA, 201 bp, Bos taurus
gggccagtggagagcacttctcatgtttcaaatctcccagcctcttcttgtgtcatttcttctctttgactaattttcaacctcactccttcacttgaaaggaccctcgtgattattttgggcctgtttgtatcatctaggattatctctttttttaagagcagctgattagcaattttaattcttctgcaaatttaattc

SEQ ID NO: 27212 - DNA, 201 bp, Bos taurus
tattgctgttacagtcatccctgtttatcaacagtttcacttcctacagtttcatttacccacattcaactgtggtctgaaaatattagatggaaaattccagaaataaacaactgatacattttaaatgtcatcatgctttctgagtagggcttaaataacctattctaaataagaaaaaaaatcttactaacctcgact

SEQ ID NO: 27213 - DNA, 201 bp, Bos taurus
cttattgaaaaatagaaaccactcatggctgtaaaaccagtgaacctctttcctttatttaaccttttgcccttgaaaatgtacttttttatggtccgcacgtgatccaaccaagcttgctctcagtgagcctttcacatgagttatacagagaagcacttcaaagagaaaagagaaacgctacataaatgcaaggtagta

SEQ ID NO: 27214 - DNA, 201 bp, Bos taurus
aacagaacagtgggtgactgcctatgagcggaagctcctgctcgactgcccaagctgggacatcagtcttgtcctgctctcaggctacaactgaaacactagctctccctgggtctcaggccagctggctttgagactggagctataccatcagctctccagcatctccagtttggtgacccagatcttgggacttcccct

SEQ ID NO: 27215 - DNA, 201 bp, Bos taurus
taggaccagaagtgtgtgcaggcagtcttggggccttagaaagcaacatggaaggcctgcaggttgaattcatccagctgatgcacctaaagtgtatcgcatttctgagagaagcagctgtttagacccgtacctaaccctgtcagtttgtggtgatctctaaggaaccctgccagccccggatggagacaagccagctgt

SEQ ID NO: 27216 - DNA, 201 bp, Bos taurus
agtacagatgaacttacttgcaaaggagaaatagagacacaggtaggacagatgggataccaaggtgggcaggagatgcgcgatgaactgggagattgggactgatgcctacacactgctgtgtataaaatagatagctaatgagaacctactgaatagcacagggaactccactcagtgctctgtgttggcctaattggg

SEQ ID NO: 27217 - DNA, 201 bp, Bos taurus
ctcaactgaacactgtcttacagtctttggaaaaccaagggagcatcccccagccacctcgacctctcagtcctaccgtggatgctgagtgccaggtgtccacagaaatgtcaggcctacagagtcagtctcctccagggcctcctgagggccttccaaggacagcactttcaacttcttcccattcttggagacccagca

SEQ ID NO: 27218 - DNA, 201 bp, Bos taurus
tgtttttacaaatggcccccttacagggaacacagacttgactagttgtggttccaccatttcccacaagacaaacatggtgtggatgtagtcatcgcagcgctgatggactcatctgagagccttgtttatacagcaagcccacggcttttcttggggctcaaggtgccttcattcacagtacacatagtcgttagaaaa

SEQ ID NO: 27219 - DNA, 201 bp, Bos taurus
gtcttttccaatgagtcagctgttcacatcaggtggccaaagtattggagcttcggcatcaatccttccagagcattcaggcatctagggagcatgttagaagcccaaagggccagtcccattcccagggatttgactcagttggggtgggtgaggctccattgcctatcctttcgacaagcacccctgggtaattttgat

SEQ ID NO: 27220 - DNA, 201 bp, Bos taurus
agaagggcttttgttggggcttttcttttctgtacctattgtcatttccaggttgccagcttttccaactctaaatctgggaaatatatatggcaaaaaaacccaaaaatcccagggacctcaccattgtgttattccttgggttcctatctttacaccttctgtttatttcatatataatgtttaggatttttcactgca

SEQ ID NO: 27221 - DNA, 201 bp, Bos taurus
ctgtgcttttgtctctcatctatcagatgggtgtgattaaagtgtttgccatcttcacagagtggttggaaggctacaaaaggataatacatgaaagtagatgctgttgtttgaggaatagttaatatttaataaacactaacttctattcaaagaaattccttaagaatagttttttcctttttaacatttcctgctcta

SEQ ID NO: 27222 - DNA, 201 bp, Bos taurus
gagatgctaccacagaagagactctttatcagtttttttaaaaatttgtgatctgttttaactggcctactttgcatgtagaatagattaagcctaatgacagagaaatgatctgagatcagaatttcatgatcttaaatctggaatgacttgtgtcgagaaatccctggtttaagggatttaagggattaatttccacaa

SEQ ID NO: 27223 - DNA, 201 bp, Bos taurus
gggaagggcgaacatgggccggagggctatgtctggttcacagctgtctttgtaaagaaagtttcattggaacatggccatatttccttgcttactgatgtctttggctgctttcacctacaaaggcagggttgattatttgtgaccaacaccaaaaagacagcggagcctaaaatattgactatctggccttttacaaaa

SEQ ID NO: 27224 - DNA, 201 bp, Bos taurus
ggaagaaaataaataacttcgtattttaccccaattttgttatactaaaaagttagtaaaattgtatagatctcatgggcattactttgagtagttttctgtgtattaaatgaaaatgctgatcccctatttttggtatgtgcgtgaacaagaagaggtactgataaaaacatctcagttcactgcaaatataaacagtaa

SEQ ID NO: 27225 - DNA, 201 bp, Bos taurus
taaagttttacatccacatgtctaatttaaattgtgcattttgtaactgaagctatcaaagatacacaagttctgaaagaaagtggtcagtggaagaaagcacatccttcaactcaattacgctggtggaaaccagcatgtgatatgtcaagattatgtagaatttaaattccacagatggcagaaagtcatttacttctt

SEQ ID NO: 27226 - DNA, 201 bp, Bos taurus
actcaagtctcatatcagatggtgtgggggtcagccctctgtatctgcagattcagaacccatggatagggagggatgactgtagagatctgaaagttctccaaaaccttctttatgaataacaaattaattgcttctcctatcacagtgtctcttgcctccctctgcaactccagctgaataccgtccatggttaaaata

SEQ ID NO: 27227 - DNA, 201 bp, Bos taurus
aaatgaaaacgtcagacccttcttcagctaagcaacaataccccagcatttccctacctgtttgactgcacagtagtttcaagtagacacttttgtggaagaagcattctaagatcaaggggtataacattacatcttcttggagactcatagggaatactaaagactctgagaagtcctgcagcaaaaaataccctacac

SEQ ID NO: 27228 - DNA, 201 bp, Bos taurus
agtaatcccaaaacataaaaaaaaaaaaaactgagggttcaaaacattttcttttcctttatgccagcattataaagcatcacctttgggcaagtacacaaatctacacatgtgataaaatttcatagaattatacaaaatagttgttcatattgaaaaactgacagaatcacataaggaactatagcccagttgactatt

SEQ ID NO: 27229 - DNA, 201 bp, Bos taurus
gtgaaactctatttcagtagaactggtttcctttgtattgcaattagaaacattaatgtgaggtgtcctcatcatactgccaagggatctgaaatacaaaaaaggttaagaacctctgagtaacacaccaaagtgtaaaaatgagtactctgtatatacacttctcaggaaccaactattcctgagagattatatgtgatg

SEQ ID NO: 27230 - DNA, 201 bp, Bos taurus
catgcttacacacagggaaaatttgtaccctccacaggctctcaaatgttcatcatgaaaccaatggcatcaattccagccattccaacagggacaccgcatggtgccaaattcttccctggcaggttctgccaatgacatcgcctgatattttgtcctggacaatccaccaacccaaggaggctatccattgaccgttta

SEQ ID NO: 27231 - DNA, 201 bp, Bos taurus
cgcctagccacatgtgattgtctagtaagttaataaaattaaataaatgtaaaaacctcttatgtcacagttgacacatttaaagtgctcaatagccatatggagcaagtggctaccgtattggacaactcagatacagaacattttcacactacagaaagttctactagacatcatgaaaggtcagacccgtgcactaat

SEQ ID NO: 27232 - DNA, 201 bp, Bos taurus
tctgtgtggggaagatctttaagtgatagctcatcccaagttggttttgtttattcagaaggaagcatttctttcatggatgagagatagagtacacagacctacagtcatgagaatcttgctgcccttgtatcctggtccaattctataggcacaatgcccagaaactcactgacatatcttgtattttggggaggaaaa

SEQ ID NO: 27233 - DNA, 201 bp, Bos taurus
acataatggctacctttgaaatgaaatgacttttcaaagccctttattggatctcagaatcttgtcagtaaaaagaaagaaacagatggaaattggacacaaagaaaaacgaccttcactcaaaaactatttattaaaatgatagtagaatgcactttgtctgtgaggtgtagagtcacaaataagaaatatgggaaactg

SEQ ID NO: 27234 - DNA, 201 bp, Bos taurus
cttcttactgagcatgtattttaaaatctttcctagctgtgtaatttttccagatctcaggagccagctgtagatgccatgggtatctcacccatattcacttgcttgtacaacttgcgtgcttacctccaggtcttcccactctttgcacctacttttcttcccctgtgggaattccctgcccaccacacagcaggctgg

SEQ ID NO: 27235 - DNA, 201 bp, Bos taurus
atttcatagagaaaggaaaggaaggttgagagctgcaaccattttgatcatttaagccaaaggtctaaaaactatggcccatgggcagtctccaccttgcgatcaaattttataaatagagctttattggaacatggagacagctattttttcttataacgacagagttgagtagtctagggagagagattgtctggcctg

SEQ ID NO: 27236 - DNA, 201 bp, Bos taurus
tttcctttctttaaaaaaaattatttgtttatttggctgtacatgtgttaccggcagcatgcgggatctttagttacagcattcaaactttcagttgcagtctgtggcatttagttccctgactaagggtcgaacccaggccccctgcacagggagcatgcagtcttagcctctggactaccagagaagtcccaacactca

SEQ ID NO: 27237 - DNA, 201 bp, Bos taurus
agacccatagtgggttttgaaagtttctgacatattcctaggaatctaaaagaccaaagaaattttatgcagaaaatcttcaggaacccgcctccccccgccacacaaatgattagagctaataaatgagttcaacaagttgcaggacataagatcagcattcactatcaattgtatttgccagttttatcagtgaataaa

SEQ ID NO: 27238 - DNA, 201 bp, Bos taurus
gtttcctccctccttactcctcccccctccctttcctccctctctcttgccctccttgtctttctcctcattctcactctgatattcttcctccctttctcccttcacttccccgtctcctccccctaatatttcattggagtttatgtaactgaattaattagacctatttctcaaggagttggttttccataaaattca

SEQ ID NO: 27239 - DNA, 201 bp, Bos taurus
caagagtcctccttgcctagaccatctattcatgtgagttatttcatgactacgaggggttctgaaggccataggcccagtgctttggtggtttcttttttgacttgctggctttggtttcattacattgtttgactagttaccgcctcagtccacagcagtggccttggagactgcagtcttggagaccataagctccaa

SEQ ID NO: 27240 - DNA, 201 bp, Bos taurus
atgcaggacggtgtccaccgccccagctgctgaaatgcgcttggtgtggcctccttagccaggagcatcttccgagtcatcagagagtctggcagagaggcgcccgtgtgaccttcatctggccttcaactcggccttttcttaaaagacaccgtgaagccggacacttgcttttaggcaaacccaccaaaccgaccgcac

SEQ ID NO: 27241 - DNA, 201 bp, Bos taurus
tcaagcagaggagtccttcttgttttttttttttaaaaaacaaaacttccatgcaggaatccccttagggaacactgtcctctgaggccagaaaggagcagcaagtccaaggtgcaagagaatgacggcaccatctgctgcagagtgccgcaccaagttgggaagccacatctttactgctgtttcccactagttttgtgg

SEQ ID NO: 27242 - DNA, 201 bp, Bos taurus
attggcccccttgcgaggcatatgggatcttagttccccaaccaggaatcaaacccatgccccctgcaatggtagcatggaatcttaaccactggactgctgggaagtccctgcatattattacacttaacaactgttttatatttagccagtctcttcctggtgaatgtttaggtttgccgtcttcctactacaagcagc

SEQ ID NO: 27243 - DNA, 201 bp, Bos taurus
aaaaaatagcaccaagatcagagaggaacgagtattgatcaggaactatctttctgaataaatagggttggctttttaagaagtacaattactgttagctcagtatttgaaggttttcttaggtatgaaccaccctgttgagattctgctcacactgtggattgaccttaatcagctgactcatcgttaagggtgaggccc

SEQ ID NO: 27244 - DNA, 201 bp, Bos taurus
gctttatgggccaacagggaaaaccaaagatattttgtaggtactgtacacatacaatgtttaaaatgtaatcactaaaaaatataaaaaccattcttagctcatgaactaagtaaaagcaggttgtaggctggctggatttggctcaaaggcctaactctgccacccacgctctagtcttaggggttgtggtgaattcct

SEQ ID NO: 27245 - DNA, 201 bp, Bos taurus
tggagccagagaatcactaggaatatatgaagggatgaggactctgtgggctagggtattaagacattttgccccggttcacacatgggatgtttgccacgattgtgggaccacaacactgctctatctcctcacacgtggtgctgctggccttgtattcccagtgatacatgtcctcagaaagcaatcaccgtattctct

SEQ ID NO: 27246 - DNA, 201 bp, Bos taurus
atgacaattattattactgcctaggaatgtcctttaggtattctgccttcaccatggagagtgtacattttatgcttcaggagaacaagcacaataaaaatgaagacagttgaaaagaaaagcttcccacctttccccggatcaactgaatgaatctgcctttctcaagtcgaaagagttgacgtcaagcctgtgactaaa

SEQ ID NO: 27247 - DNA, 201 bp, Bos taurus
tataccacctctgtgcctttaggactttagtttattccactgcccataatccagtcagtcaaaatcgtatgcatagaccagtagtatgaatagataggttgtacacatcagcatatttgctctgtgtgtgtgtgtgtgtgtgtgtgtgtgtatcacctggcacgtggtagacactcactcaatagtggcaatttttctctt

SEQ ID NO: 27248 - DNA, 201 bp, Bos taurus
aacaaagcagactcattacagtttgaagggtaatgctaagcttgcttagaaatgaagacagaacttttaattcctagagcagggatcagtaactatggcccaccacctgttgttcataaaactttattagaacacagcaccgctcatttattcagatattgtctgtgtctgttttcatgcttcgttggaggaattgaatca

SEQ ID NO: 27249 - DNA, 201 bp, Bos taurus
aaatcttttgtgcaaccaaattggccacggggatttgaaaggggaggatactaatattgtcacttggctgagaatcagcataacccttttttttccagattatcccagtaattgtagagaaattgctctagacataaccactggaatggcagaatctattaaaaatcgaaaagctaaataggcttttataagcaaagatcc

SEQ ID NO: 27250 - DNA, 201 bp, Bos taurus
tacctccgattcagaaataggaacgtgtacattagaattccatttcctgaaaggagagcgtcctcgttttttttttgtattcctctccccctcccaagtctgggaagacgcagccaggggaggggggcgaggaagcgaggaggaatttaaatgttagctcgttctggctgcatttcgctgaggggagattgggacccagag

SEQ ID NO: 27251 - DNA, 201 bp, Bos taurus
ggggcgctgcagaaggccttgcctagcacgctgcagcgtggtagggtctttaacccgcaactcagtataactgtgtagcccttattctcacctgccaccgtggccagaatgcttcctgtgcatcaggtacccagagatagtggtggaaaaagccagaatcagtcggcctggtgataccggaccttacatctctacgactgc

SEQ ID NO: 27252 - DNA, 201 bp, Bos taurus
actgaaagagatcagctggaaaggcccagacagttaacacgcttcttccactgaggactcaggatagtacatgatccactgtactagcgtaatgttccaatattgccttaaaaaacatttttctggccttgctgggtcttagttgcagcacacaggcccttggggcatgctggcttctctagtcgcagctcatgggcttag

SEQ ID NO: 27253 - DNA, 201 bp, Bos taurus
ccacttctctatattgagcactcattacctctaaccttaaacgtcatcaaaaatattttcaaggtgttgtttcaaacgagaaaagtaatgttgcttctataaagttgtattaagcacatccctatcttttcagttcaagccgcaactctatcaagctcagtttacattttgggccaaagttcttggagctggtccacccta

SEQ ID NO: 27254 - DNA, 201 bp, Bos taurus
tacactgttctgtaaatctacagttatttcaaaactgaatgcttttgtgtttagcgtgtgaacacttttgacagattatttaacgatggccacactttttgctttttaaccaacccattttgataactccacatggaagtaaggaaatcatatcaggcaaaatgtatgttggggaccaatgagaccatgagagttttcatt

SEQ ID NO: 27255 - DNA, 201 bp, Bos taurus
ttttgttgcacatagtcatggggggggtcactttttatatagttatcaccctgtgctgggctggcaagtcaactgtggtttgtctggaaatccccactgcaatacaccagaacaaatgtatttattgctattttttgctggtagaatatttataagggaaagtcaactcccaggttaggaaagagcatccgtgtcccttat

SEQ ID NO: 27256 - DNA, 201 bp, Bos taurus
actgaacaatttcattttgacctctctgaaagggtgggtatggagggtcagaagtatcattaatagaaatgttaatgagcatttaaaaaaatgagttaatatggatttgccaaaaatgaagtgaccagagtaaccttccttttttgaccatgttactagagtggaagataaagtcaagtttgagaaatagtgtatttcagc

SEQ ID NO: 27257 - DNA, 201 bp, Bos taurus
cactagtatcttgccagccttcccacaaccagcctatttaaaaatacattctgggaaatgtacctagctaggtattaaaatatgtacttggtatacattttggggatattatatgaaacagccaggaggcagcaatcttgagaaaattagagaagatgcaattgcactaggaaactttttgttcagttttcatctttattt

SEQ ID NO: 27258 - DNA, 201 bp, Bos taurus
ttgttttatctccttcatgtatatattgtatgggcttgtatcatattggaacttcaagacggggtctggataaagcaaaaggaatgaatctttgaagttacatttataacataaaggttgattacaagttttaaagagtgaagttccatttaaacttccttagaagattcaggagttaccctctaatatgaacacttgatg

SEQ ID NO: 27259 - DNA, 201 bp, Bos taurus
tatcaagatgagatgagcactgttcccagcctcaagaagctcacagaaaaccggagaaaccagaacataagaatggggaacagtgtgaaaatggccataataagacataaatgaggcaagaaggaggagggaggtctgagaaggctgggttctggtttttcttaccctggctggtgggaggaatgacacaatgagcaaggg

SEQ ID NO: 27260 - DNA, 201 bp, Bos taurus
gtcaccatgacctgggttttccctgtctctgctctgctgtggagagtttgctccatcttgcactggttcctcagaacaatgggtgcctgctcagggcaatcgaggccacatgttgccttgtgcacgtccagagataagagctgctgttaacacattctgttctagccttcctcctttatagtaaaattaaggcattataat

SEQ ID NO: 27261 - DNA, 201 bp, Bos taurus
gtacctgggttgttagaaataaaatattggcagtcctgagttctgtgcataatgcaaaatgcatacttaatgtatattagaaaaatgtatgcatcaagctattcttttgttattttctatatgtgattctcatccccccatgagatgttggtgcttttgacctagcaaacacacatgtgaataattgcttgaagttggatt

SEQ ID NO: 27262 - DNA, 201 bp, Bos taurus
ggattaatgagaaaagtaaggccttccaaagagagtagtaaaccaagccccagagaggcagagtctgttgcccactgtattcagactctctgatttcctcctgagtagaggccctgttgtctttatggtggcactgccctttctgtgcccagcatgggtggcatgccgtgggttcctggtgagtgttgctgcacctacatg

SEQ ID NO: 27263 - DNA, 201 bp, Bos taurus
atatctcacagacttctttggagagtacacaatatatgtaaagaacttagtgcttggtacagagtgagttctgtataagtatttattgttgatgctatcagtcttgatatttataagcaataatgtctattccaagtaattatggtgattattattaaacttagataatacaatagttgttatcttatttccaataagcaa

SEQ ID NO: 27264 - DNA, 201 bp, Bos taurus
acccctcttcatgcaaaaatcccactcttcatgatcaagcgcaaaattgtaagtgtcacatgaatattgcttaaaatattaaattcatttcagtaaatattaattctgggcctatgctgtatatgaagcatttgttaggttacatgattgtattaaaaatgaatagatgttttctcttccctccagttaaagagcttaaga

SEQ ID NO: 27265 - DNA, 201 bp, Bos taurus
tctaatatgtaggaagaactgagaggccagagcagaagatgggaggtgttaaggctgaactgaaactggaacatgcaagttattgcaggcaatgttaaggacttccttcttaatcctaagattggcagggaagccattgaaaagttttaagtgacaaagaggaataattcaatcagatgtttatataagaccattttggct

SEQ ID NO: 27266 - DNA, 201 bp, Bos taurus
gaaatttgtctgaatagcagaactgtgatacttagagagttatttaaattcttcaaaaagtaaataggtggagatccattcagtagaggcctgagtacagttgaaattctggatgaatactaatgaatatattactgggagtatttctacaccactgtgagttggtctagagaacctgttaggccctttgcttactaattc

SEQ ID NO: 27267 - DNA, 201 bp, Bos taurus
aaaagaaactctttgaaaagctgattaaaacataattttaaatttcttttcacacactcccatgactatatctcctaaaatgagaagaggctatgtgttctctctgagctctaagccaggcctcccctctgtggtagagcatcttttgatttttccattgtaactattctttgtcaggtggtatcagtgaattgtcagacc

SEQ ID NO: 27268 - DNA, 201 bp, Bos taurus
gacgggggcagtcacacatgggacgcaaaacttcaatcagacataaacaagggcttggtgaaggggggctaatgcccctaaaacagccactaactacgcccgggagaatgtcggaagcaacagaaacacctggaatctcagtctgtgaggaacatcttaaaggagatgtcctcagtggtccaatgtggccgctctgcagca

SEQ ID NO: 27269 - DNA, 201 bp, Bos taurus
acagatcccttcagtctgtctgggccaagaccagcatactcctgacaagaactgagaatgctgcctgccccccaacctcccacatcccctggtctcagcagccacagtctgcagtgccaggtgccttccttcaccccattcgggcaatcttgatgctgtctatacaggctgttgtcagcccagcagtccagttcccaagaa

SEQ ID NO: 27270 - DNA, 201 bp, Bos taurus
gaaaccacagcctccagagctccacttcaaatcctacctagtccttagggccagggttacatccaccccctctctctggacactgacagcacctggatgctgggacagtcagtatttgccaggccaccgtctcaagggctgctggttttcgagggattatatgttgggtctccacctcccctgcagtccccataaaagcac

SEQ ID NO: 27271 - DNA, 201 bp, Bos taurus
tgtaagacacaaagcagagagttaaatggaaagaagaattggaaaaaagaaaggcaagaacaagaggaagggacattctggacacccagaatctggacagcgttatcagtgtcagtgaaaggaaaagcagagtgctgctttaaaacaagttttctccacagattattggttgcctgaggtggggcggaacgaaataggtaa

SEQ ID NO: 27272 - DNA, 201 bp, Bos taurus
tgatgacggggagaggtgcgtgctgctgctccagtttttctggtccatgttgcatcctgagcctttcatccatcaccatccatcccagtgagctgcctctatttctctgccatctccaaggttcctgagcccctgaccagaactcagtgtgctcccgagtcaagagtcattggagggagcctgaggcaaagaggcatcaaa

SEQ ID NO: 27273 - DNA, 201 bp, Bos taurus
agggacccgcacaccatccctcaacatggcttacacggccagctcttactgtgttgaaactgacagctgtttctttggttacaaaggaagtagctgctcaatgttctggccgtgttgtagaaagagaatgtgtcttttaacgctagagccacacctggagtggtgaggggtgcagctcctgagactggagagggaacctct

SEQ ID NO: 27274 - DNA, 201 bp, Bos taurus
ctgaggagtcttgagggatctctttccactgtggaaggccaggctcctcccccttcaattctgctctgagagccaaactaatccaaaatattatccttacttccatgggccctttgagtttcagaatctatgaaagtctacagcaagaatccttctaatccaactcaatggacatgagtttgagaaaactctgggaaatag

SEQ ID NO: 27275 - DNA, 201 bp, Bos taurus
atgtttatcacctgtatggagcttactgtcaagtgggagacgcggttgttcaaaaataataaagtgtatgatttggtgaattattctagttccatttgttctttgtagagcattgtttaaaagttgctgcaagatatctttagttgcaattgttttttataaatgtgtgacattagtgtaaatattttgcatcagaagttt

SEQ ID NO: 27276 - DNA, 201 bp, Bos taurus
actgatccctattgtcaggtattttaggctctttgcacatcttttgcttttatagtgttttctcctcctaaaagttaccttagtggaggtcccatgtagaggtatttagtccaaatagtttagacatgtgtctgctgtttgctgataaatgaagtcatataaacaagtattaatggcagcagagcagtcagtggtgtaata

SEQ ID NO: 27277 - DNA, 201 bp, Bos taurus
ttgaatccagagcctgttctcaatccatcagctgtggccaaaggagtcacgggatctgtgttccccttcccttgccccacccctagaagaactatggagaatctctttgagaaaggccataatgggtagattctctatcggggaacctgtgggtcaagttgtaaggaggaaaaacagctattcctgggaaatatgtttgtg

SEQ ID NO: 27278 - DNA, 201 bp, Bos taurus
tccacactaatcaagtccccttagtaatacagaaaaagataaatatatggatcaaatctctttacaacaagagccagagaatctttttattacaaagtctatttcctaatccactcatcatctcactttttaaaagtaaagtctatttaagcagaaatctcaagcaataaatagagtttaaattgcccctttgaaggtgtt

SEQ ID NO: 27279 - DNA, 201 bp, Bos taurus
tctctgtgcccctcccctgatgacagattgccagttcctcctgtttccaaccacattaggttcaattacctccgcctaatcctcatattcctcccaaatgtgtcccccgggcagtttctataaattttccaccgctccaagataatgagatattttttcctcttctaaaaatatatagcattcattcttctttccatgtct

SEQ ID NO: 27280 - DNA, 201 bp, Bos taurus
atctaccctattgactatcatgtaaaacaaaagaacatattctggacgcaataatacccccaggactaaaaataaaatattgccagaaagtacagagtctgctcttgcagcacagtgaaacactatatttttgtaataggtgttctctttccctgcacagaggtgtctgctgcactgcctatcacactatgtcacgtcatc

SEQ ID NO: 27281 - DNA, 201 bp, Bos taurus
gttacatagtgagaaggggtgcacagtgacattctagaactgatttgatcatatcccaatgttccagaatgtctttttgttcacttgtgttttttggtttaacaagaacagtgggataaccttactatttctactgggtatttcagaaagcagtcaaaaaacatttggcaagtgaagatcagtctcagctcattgaactga

SEQ ID NO: 27282 - DNA, 201 bp, Bos taurus
tggcacagggacaggcgtggggacagaacagatgacccagcccgagccggagtgatgtgggagctgctggggccaggcaccttgctgggccctcctcaccgaagaccttgtctcatcctcacactgaccccatgtgtgatcgtgcaggtgtgacaccagagggctgagtgtgtgtcatagagcaagggaaagaaccagtgc

SEQ ID NO: 27283 - DNA, 201 bp, Bos taurus
cacccccactcccacctcccagggacagacatctattaccaatctttgattttaatccccaccgagaagatagggacactggtcagatgtgcccacaccattccaatcaagaaaaaataaggtgtgagaccagttaaatatgtatcacaccagctctctgtctgaaatactgttaacaaccagttaagtgctccacttcac

SEQ ID NO: 27284 - DNA, 201 bp, Bos taurus
cccactctggcttcatccaggtcactgcctgctgaggaaagggcaccatagctactctttgctaaggtgcaggaggatccacctaggtgctgccctccaggaacgatgcagacaggccttgctcctctgggttacagcagccccagtcatggctgccaaccttgttgcctgcattgagattgtccaggagagcctcaactt

SEQ ID NO: 27285 - DNA, 201 bp, Bos taurus
ttatccaatttccgctgtctttttttatgcctgcctgatttttatagcaagatcagagttggatctgagcgtcctcacttcaacactaagaccactcttggtatcttcatttcttgcacaagtaatgaaagggcaggaaaagattattaattcaagtaatcagagctcttagaagctaacattacctatagtgttgagttg

SEQ ID NO: 27286 - DNA, 201 bp, Bos taurus
aaaaaagtgcaactcttcctttcccttgaatgcttagaggccagtgtagggttattaattgacctactttcattattcttgtgtatgagaaaatagggagagtgaggagaaaggaaaaagatgggggaatagctggttggtggagcagtcagaacacacacaacatttattaagttcactgtcttacatgggcatggatca

SEQ ID NO: 27287 - DNA, 201 bp, Bos taurus
caccaccgggtaagaacttcatcctcattcactcattaatctcatcgtcatactctctttttctccctcagccatttgttccaggaggtacctgctgcccgtgtgggcaggccttccctcactgagaaccccagggatgtcagccgcaggacctgtcctgtgtgttgagtaggtggctcagcacctttgtccttgagcact

SEQ ID NO: 27288 - DNA, 201 bp, Bos taurus
tactgtaaaagctggtcacaccctacacaacacaaagagtaaagaaactcccacatttaccacacagtcccctatctggatgacctttctccttggccctaaaagaggaagatgcggacacaaaaactcccctagtaatagctcagacaaatctgagggtctggaggagccgaagggcctcttcactcttgtgagggtccc

SEQ ID NO: 27289 - DNA, 201 bp, Bos taurus
taagactccattcttccagtacctggggcatgggtttgatgcgcagtcagcaaactaagatcctacatgcccatgggtgtggccaaaaaaaaagaaccactaaagggtttattataaatatgggctccctgctccacctggcgctatggctggtctgggaactggcatttaaaccagctgcaccctagattctggaaaacc

SEQ ID NO: 27290 - DNA, 201 bp, Bos taurus
catgccaggccaaggcttcccccaggacccacactgccgccctgatggttcttacggaatgagggagggagcggggaggaagaggaggactggaactgccttcattaggtgctctgctcccagaccgtcagcctgtgccctggcctgggcttggggtgggcagcatgtggcgtgcagaagaggtcaggccgggaggcgggg

SEQ ID NO: 27291 - DNA, 201 bp, Bos taurus
cccattcaaatctggtccccatgactgtggagaatctcttttctaattatcttgtgacccacttccagttttagccaggcttgcttgcccacagccttccgaggccctgctcacctctgcctctccacctatgctctggcgaccagccttcctgcccagggatgcatgtgactcctcagtggagctgcgaagccctttctg

SEQ ID NO: 27292 - DNA, 201 bp, Bos taurus
tgggccagtaactgtttgaaaacctgagcatacacaagtgatcaagaaaggtaagatctctgctttagtggagcttaaatttcatccatccccccacccctggccagctatccattcaatgtagttttactgagtcccattcctcaagaaagatttgaaaggctcttgggaccacagtcttcttcctcagttgttgaacta

SEQ ID NO: 27293 - DNA, 201 bp, Bos taurus
ccacaagcgcacgaagacctgccctcagtagggccatcctaattgaggctctctgaagtctatggtgctcccagcacagagggaggggtgctcttctaacactgtttaagtggccagtgtctgtgagtcatggacaaaaatcgtaagacactgacaatggcatggaaactttggttattctgggaagtaagacaaaattca

SEQ ID NO: 27294 - DNA, 201 bp, Bos taurus
tgtggggtggggaaaaggcctgatgagatcctttgtggaggccccttgacccctgagctccaccccatcccccaacaccaccagcaagggtaactgacccggtggttctgagccctcaaaatggattaagagaccctgaagaacaaatctcagatgggaggccaagctgtctgtgcacatggcaggcagccatctcttaaa

SEQ ID NO: 27295 - DNA, 201 bp, Bos taurus
ctcttttcaagggcagtggggtaggtacttaagctgaaccttggccgggccttgtgaattcaccttgagaaaagcacttgttctcagcactgcaaggccccattagctgacttcccccacatggcttgcctgctcccctcccacagaccaagcagatgaggagggaggaaagggcactctatccaaaaccagggttgctgt

SEQ ID NO: 27296 - DNA, 201 bp, Bos taurus
ccttaagctttcctgtgtaatgaggtttcctgtgtaatcctttcctcctaaaggatttttaaggtctgtccttagagtatgttgaattgctttaggactcgggcctggcctgagtggcacttctctgcctccccattttacatttctaagcctgatttacagggttttctgcttccctgtcataggctacacctctttctc

SEQ ID NO: 27297 - DNA, 201 bp, Bos taurus
attctttccatcctcttggtcacattaatccctgggcaacacgtgtaaatgactattcccagagtttctgtttccataggtctgggctggggcctgagaatgtgcatttctgtcaagtgctcaggtattgctgatgccactggttgggcactgcattctgaggatcagtgacgtagaacagtacagggcagacatttatgg

SEQ ID NO: 27298 - DNA, 201 bp, Bos taurus
ctagacaaagctggagtggtgggtggaaatatgggtcactgggggatgttttgccaaggagaggactctctcctggggctaaactgaatgtagggccattcgagatccaggacataaattcctcactgggaccctgatcttgttggcagggatgcaggggtcagggacctgggctggcccatgttcctgtgccctctggtg

SEQ ID NO: 27299 - DNA, 201 bp, Bos taurus
cttcataattatatattgacaagagttacatggccttctaaaaaaagaaagtatttaaaataaacagctaataataatctaacctcgggtaaccagttccctctcattcgttccctctgtttgaaagtccactacttcactttttttttctttaatttttattggattatagttgatttacagtgctgtgtactacctcac

SEQ ID NO: 27300 - DNA, 201 bp, Bos taurus
agggcaggggttcatcggtcccccctcaccgtgctgactgtccccttcccccaggacactttggcagtggggagtgagctgcagggcctgaaggtaaagcgactccatgtgggaggcttgccccatggtgctgaagaggaggctcctcagggtctggttggctgtatccaggtgagggtcagcgtgcaaatacgaggtggg

SEQ ID NO: 27301 - DNA, 201 bp, Bos taurus
aaggaacagaggttttggaggttggggtggggcaggtctgggtggaatgggagcagggggtttcttaggggtccaggtgggacattgggggtcagagtcaggatagtcctagggctacactcatcctcactcctaggcccagagaaatcccagttggtttctggggaggccacggtggccgagctggatggactggagcca

SEQ ID NO: 27302 - DNA, 201 bp, Bos taurus
gcccccatggagacaccagcagatggtggtcactgtggagcaccacgcttgtctcagcctcctggctccttgggctagtggccttgagtacgtttacagagaatttacaggaacttgtgagaaaagctgacctgcgtattttcagatttccttccgcacatgccctgtgttctgtctccttgctcaacatcgaggtcctga

SEQ ID NO: 27303 - DNA, 201 bp, Bos taurus
gccacactggcctctccccactcctggaaacttctccctgtgattcattacctgtgcttcctgagtcattttcccttcaacccttgcctcctgtaatggtttgtgagctcccagaggccatgagttggtctgtcgcgcccacgtctgagttttggattcaagccacccaaggcctggctggtggtggatacggggtgtgca

SEQ ID NO: 27304 - DNA, 201 bp, Bos taurus
gatacacccacagtggaagcagatgaccaaaagggtagaaatgtggaggctaattcttttgaatttggggctcttggcggaaataaaacaaacacaggcaaggattctcctattactgaaatggctaccaagatgacagacgtgagttgccaagaccaaatcccgggggcaggatttgttccttcagtcctggctgaggag

SEQ ID NO: 27305 - DNA, 201 bp, Bos taurus
taaccataaaagcaggaaaaagggaaggtggccctggcaccaatggttgacctcataaagggacatcaccatctgtgtcaaacccctctacccccacccatggcctgtcgttatgatccatctaggaacggcaagacccttggagcagaaaatgatgctaccagagctttgaacgtggccaagcggcactttaatttgcca

SEQ ID NO: 27306 - DNA, 201 bp, Bos taurus
actgattcattggctgtgtccagtgtagtgttcaacatgtccagtgagcttttactttcatttggtatattttctcattggctctttttccaacctatcatttctcatagttttccaatttctagatgaaactttcaaacttatattttacttcttaaaaataagcatacggaatcttaaactaataaaatttatatgtta

SEQ ID NO: 27307 - DNA, 201 bp, Bos taurus
gacttacggaggagtgaacctctgtgttatgttctgcatggtatagcagtgtagtgccttgttcagtaagacacatttgtatttagtgaatcttgctggagtggaggttttggtttctattgagtaggttcttgtggggattaagtgagactttaaagaccttgtataggtcttcctgccctgaagtagataacagatggt

SEQ ID NO: 27308 - DNA, 201 bp, Bos taurus
ggccaaagtatcctacaattgaattcaaatctgacaccatgtagagttcgtgtggacccctaacagttccaccagattgctcctgcttcagatgccaactacaagtctgggccacttgtacttctgaccaatcagttacaaggtcagaagagcggtggggttccccacaattcccctcttcaggtttgagaatttgctaga

SEQ ID NO: 27309 - DNA, 201 bp, Bos taurus
atgccaaagtcaagatggaacagaaggtaacttgggggatctgggtctccaggaaggcaaggcctcagggacctcagtactgggacacccaggatggccccccccactttagaggcagagggggaaaacaccagcccaaggaaatccagtcacccagagtcagtgggtatcttctgccaactccagagtggcacacagtag

SEQ ID NO: 27310 - DNA, 201 bp, Bos taurus
tacttagagactgagaaaaggggaaagtattcttccaaattagaaagagaatccaaaaggacttcagaaaatgaagcaatgaaaagatgctgttctccccacaatgaactcggattccgacgggggtcatcatattccaagcatgataacaatgcttcccgttacaaatctgccccttcaaaacctgtatccaagtctgat

SEQ ID NO: 27311 - DNA, 201 bp, Bos taurus
cctgctctgagctgggaactactctgaactgggactcacccagcttccccatcaagcctggcctgtgtttcaagagccccgggggttgcattcctttcgcatcttcagaggtccccctctcagcctgggctggaggcagacaaggccagagaaggcagggcccgtgcaaatccaagacaggtgggagctgcagcccatcta

SEQ ID NO: 27312 - DNA, 201 bp, Bos taurus
gcatcttcattgctgcacatgggctttctccagttgtgccgagtgggcttctcagtgcagtggcttcttgtggagcacggggtttaggcctcattatttttgggtttgctgaatttcaacatcaactgaattaagagattcatcagcactcttatgaaaaagttaggccatagatttgggaatgagaccctgaaaatttac

SEQ ID NO: 27313 - DNA, 201 bp, Bos taurus
gaacaatttaaatctggggggatggtgagggaggagatttcccttagaagagatggcataaacaaaagtaatgagagagaaagagggacaaagatgtggtaaagacatgttactggagataaggccaaaatgttaggttgactcacggaagtcatggaaaacctttaatgataagttcaggccttatatgacttggtgctc

SEQ ID NO: 27314 - DNA, 201 bp, Bos taurus
aatgtgttaagagtttaaaaactgtgcaactcttcaaagctcacaaatattgttagaacagtcaccctgtagttagattggatgccactaaaagggtgcaacaagcacaaatggacacaagtgacgaaatatgtagaacatagagtgcacacagctgcttaaagcggggagccccaccaagcttccccagcccccagtgtt

SEQ ID NO: 27315 - DNA, 201 bp, Bos taurus
caaatcaactcagcccggcaacagtgaccaaggacctgctttgtttaaacccagcactctgagccccaggagacacgggtgcagaagggccgtctgccctccctgagctattagcacagtgcagtggacaggtgcatagacgttagcccagccccagcgggcagggggacctgcctccgagcccacggggccaggacagca

SEQ ID NO: 27316 - DNA, 201 bp, Bos taurus
gggtcatcctgttctgctacgtggagatcctcaggaccctgttccgctcacggtccaaacggcgccaccgcacggtgaggctcatcttcaccatcgtggcggcatacttcctcagctgggctccctacaacctgatcctgttcctgcagacactgttgaaactgggggtcattcagagctgcgaggtcagccagcagctgg

SEQ ID NO: 27317 - DNA, 201 bp, Bos taurus
tgctaagctcagaggccaagctaaatctcttagcttgacaggactgtattaccagtgaagcccaaagcttaatttagtttgagagaaagagaagtggcttatttttacccacttgggtgaatggggccgaaggagtcccagaacaaggaccccacttttctgatccctttcccatcctctcagacctccagtgaagaatgc

SEQ ID NO: 27318 - DNA, 201 bp, Bos taurus
ggtcctggagaagcttctactggctcaagagccctcagggcacatctcttcccgacgttattcagtggtgtcatgtcaacagcttgaaatgggccaaggtgggagtgattacaccatagcagtcagcaaatgctacaacccagggctcctattctgctcagagctggtgaccagttaaatatgcaacagtctacccctgcc

SEQ ID NO: 27319 - DNA, 201 bp, Bos taurus
cctatagtctgctcaatttggcatggtctcatcttcagcaagctggctgtcttttcctgtgggctgacagttctctagctaattgtgtcaaatttgaagatgctgtactccgcgtcctctccacactcattttagctgtcagcttcagcaagctgacatatgatcctcatcattcgtgcagccctagaaagagatgttcct

SEQ ID NO: 27320 - DNA, 201 bp, Bos taurus
gaaaggaggggggaagtgagtgaagccagcctctggcctgccctcctccagggagccccaggatggctggaagtggacgaagggcagcaggcaggggcagtggtgaactgctggccccttctttaccctgcaggtgctcgaggcagccaaggtcaggtcctctgggagcagctcatgaggtggccaaagtactggagtttc

SEQ ID NO: 27321 - DNA, 201 bp, Bos taurus
cgaacttgctgaatatgaagacggcctgagatgggttaggaatttgtgggagtaagagagagaggagccgtggaggttggcctcagatcctagagctgaacgctaactctgttcctgatcgctgatgggaggacacccccaccccagtcgctgccaggctgatggaaatctcaagaggaggaatggcttccctggctccct

SEQ ID NO: 27322 - DNA, 201 bp, Bos taurus
acaggagagaaactggggcttcaagcacagaaaggatcgtctcaagtgagaatgttctgggtggattgtgcccccgcccaagtcataaggcctggaaactcagggtgggaccatatagagccaccacagaggggagcagttgctcacttaggatgaggtcttgcgggtgggccctgttcgaggatgacctgtgtccttatg

SEQ ID NO: 27323 - DNA, 201 bp, Bos taurus
taggaagattgaaatcccaggacaaaagggcctccttttctctcagctttatggaaagctccccaccattgtccaatttgcctcagatcagagaacctcgctgaggaccagcactggcctcaggtggttgccaggaaaccaccgagacgatgtgcttggccccggagggagcccagtggatattagtattccgtcttattt

SEQ ID NO: 27324 - DNA, 201 bp, Bos taurus
gcggaggaaatagcaccctaggagtagaacacagctagcaacgtaggcgatacccacggaaagacaaagggtaggtggccagtcctgagggagacggttattagacctacagcaaggattaagcttaagagtgctgttagagagacagggagaggccagtcagggcggagggaaaggccccaagttggtggtggtttgaat

SEQ ID NO: 27325 - DNA, 201 bp, Bos taurus
ttaaccttaaaatctcatttcagacttttttatcttttcagactcactttttaaacatttttatacatttttgaaaggttgtactctatttgcaattattacaaaatgttggctgtatctctcatgttgtacaatatgtccttgtaaccggtcttgtactgaatcgtttgtacgtctcactcttgcacccataaatcatcc

SEQ ID NO: 27326 - DNA, 201 bp, Bos taurus
actttgttgtcccgtgaagggagtgggaggagaccgagacagagagagggagggagaggcaacgtgaccgatcgcagcttagtttactaacacactcctcatgttccttagaatagagcgattctggacacagactaccctgtccctccagtgaaaaggcaagcaccgaatggacagtcggcctgaatccagcatgcacgc

SEQ ID NO: 27327 - DNA, 201 bp, Bos taurus
tacatagagaccacgcagtataaaccgtcacggaataaacattcagatacgccgagatcaaacagacacggccagaaacaagccctggtaaggctggtgttatatcctgtgtacatggagaggtgctaaacctggatctgatttcttcaggacacaacccacttttctacaacaccctcacaataaaaagccgaactgagg

SEQ ID NO: 27328 - DNA, 201 bp, Bos taurus
aattctatctgtattaaaaaaaaaaaagtcctgaggtcctacattagtgtctgtttgcacggaagtcctcaaaaggaagcaggggtttaatgcaaggtgttgttgctctgtcactaagtcgtgtccaactcttggcgaccccatggactgcagcatgccaggcttccctgtccttcagtatttccctgggtttgctccaac

SEQ ID NO: 27329 - DNA, 201 bp, Bos taurus
taaatgagcagggacaatgatccctggcttcgtaaagcatagagtactgggagtgagactagacaagcagcaaatgtacaaaatatgccgagtagcaggtggtggcaagagaaagtctgggggagggcttcactgaggaggagacattgagcaaagacccagagaggctgagtgaatgaactgagtggataatccagagaa

SEQ ID NO: 27330 - DNA, 201 bp, Bos taurus
atgagatgtaattttctcttctgctcttggcagtgtttacctttcagaattgtatatatactggaaataatttattctaagtttaaagcctggtgcaaagcgcatagatggcataaaattaatgctaattattattagtagcaactattctgacaacattgcttaaattggagggtttattatttatatgtatgcagtaag

SEQ ID NO: 27331 - DNA, 201 bp, Bos taurus
agggtcttttccaacaagtcagctcttcacatcaggtggccagagtattggagcttcagcttcagcatcagtctctccaatgaatattcagtttgatttcgttgacattggccctctagctattcctggaacgtaccaagcactctgctccctcagtacctttgcactgtactctgctgtctccgggttcttctttctcca

SEQ ID NO: 27332 - DNA, 201 bp, Bos taurus
ggcccgtggccagggcctgcttcagcaggtggttgagccggagggcgtccaccgtcgggtacttctgcaggatgtagaccttgatggctgccaccgaggtgccccggcgccgctccccggcctgcagtgcttccagcaccatgcgcagcaccggagggtggcggcgcggcgcccggacggcgccccgggccaggcctgcgg

SEQ ID NO: 27333 - DNA, 201 bp, Bos taurus
ctgttccctgactctgtctcagggcagtcgcagatacaggcaggcctccggtccgtgagaagcagacttttcccaaagaatcatcttcacgttaacccacatacggagagccctcacgggccccactgagacttgttactcattcactgctcacagtaatctcataagaaaggtataacttgcccatcttcccagcgtgga

SEQ ID NO: 27334 - DNA, 201 bp, Bos taurus
accaagcaaagacgggacggcgggaagagcaaacatgcaaacaacctaatttgactgaaacgtggccagtgcagggcgacagggagcaagggataaggccagagaaaagagactgcagccatatgacaaagattctcaaatgcctccaggcagcgactttattagttccagtgaccctaggaagactgtgtcagacagcac

SEQ ID NO: 27335 - DNA, 201 bp, Bos taurus
gggaaaggtgtccaggccctctggactgtccctactacctcaccagactttagtacattcagtactggagaagcggcatggaaaagaacatcagtcttcagattttgcacaatagcctactgtccttgatcagcaccacaactttagaggtgaatgacagatacatggataatcccagaagaagggatgagtactgggtcc

SEQ ID NO: 27336 - DNA, 201 bp, Bos taurus
gccctggagctggggtggagaggagagaggaacatttccctccggcagggaataaagcaggagccgcttgggcgggtactctggttccacaggcctgagaaaacgggcactgttgctgagataggtgttgggcagaggcagaattttgacaagagggtgccctttaccaaacgtcagaaaaaggcacggaggcctgggctt

SEQ ID NO: 27337 - DNA, 201 bp, Bos taurus
tggtctaaccagatgaggctcccccagggcggccacatacggttgtgcaggttgtggactgcacaaaggcacctggccacttgtacactgaaactcggccggagtcccgcccaccctgggcagaactgcatctgcaagaagaagggtcaccttttcttaatttgtacgaaagtgtcatatggcataagggtgccctggccc

SEQ ID NO: 27338 - DNA, 201 bp, Bos taurus
ttaaactgaaaaacgacataaagagcaataacagtagaaacttttgctcattggattttcctctgtaaaataaccagggaaaaaaattgtagaagaaaaacgaagaagtttgtggaaagtgagcaatgcagacttgggctgactcacaatcaaatgagtttcttggtcacttgctgtaaagtgatttcctaacaagtaaac

SEQ ID NO: 27339 - DNA, 201 bp, Bos taurus
gccccactactaggagagcaaaagggccactctcgccagggtcacggtctttcaacgacagcgttgcctacagccgttctaccaagaggatttcaggcagcagaaggccgggagaccctctgaaatgtctttggtgccactgccccagagggtgtccattctatccacaatcccggtatcgtacagatcacagcaagaacg

SEQ ID NO: 27340 - DNA, 201 bp, Bos taurus
cctagacttgatgcagagcggcagctactggagaaacctgagtggagagtgccatgatgaaagtcggcttttaggaaaaaaggcctggcagcatttgcaacctaaaatggcaggggagagactaaaggcaaggacactaactaaaaggctgtggccctaatccagcacgtgttcatcttcactggttactaaaatcgtgac

SEQ ID NO: 27341 - DNA, 201 bp, Bos taurus
ctccagtattctggcctggagaattccatggacagtatagcccatggggtcgcaaagagtcggacacgactgagcgactttcacccatctccctaatgacatgattagaaagtggcccctgtttgtgagttcattgtccatgtgggctagaggaaagagtagggaggatcaatcaccacaataagatgtgagaaacactgt

SEQ ID NO: 27342 - DNA, 201 bp, Bos taurus
gagcaaacagcaccgacggcgtgggaatgctggccagtgcgcgtgagtcggggtcgtgagcaaacagcaccgacggcgtgggaatgctggccagtgtgcatgagtcggggtgtatgttgcttcaaccacattataaatctactcggcagcttctaatgaagttaaatctacactcaccccatggcccgacaattcccccgc

SEQ ID NO: 27343 - DNA, 201 bp, Bos taurus
cccacacccaccggggttgggtcttgtcaaaccccactgataagtactaatgcagtgaccttgtctgcttttctgctcccgccctcttcaaagtgcacacgtgcccccattctccaaattaaactggatccctctaggggcactgatgcccacctctgctccaaaccaggtcacagaaagaaccaattcatagccttaccc

SEQ ID NO: 27344 - DNA, 201 bp, Bos taurus
agccaccttcacagccctctctatagcagacacccctggtttcccgggtcccacgcaggcgggcacgccttgtgcatggtattcaaaaggaagtgacgccaggccccacagcctcttgggctgcttgccccacaacctcgtggcctcgacagcatcagcttcagggcttatctccccctggaaagtaactgagttgccttc

SEQ ID NO: 27345 - DNA, 201 bp, Bos taurus
ctctctctctctctgctccctcttcttcctctcaccctgttttccacctgggccagaacctgggcccttccccacccagcaaaggccactcagccccacaataagcaaagcttagtcccacctgagacctccccagggttcacgtgtcatcggctcagccccttggagaccttcgcttccctgggaggctcctgggctgac

SEQ ID NO: 27346 - DNA, 201 bp, Bos taurus
tctccccgcaggggtggggggcaggctcccataagtgaaccccaaggaggcttctcctgctcagattatcgggtgctggggccacttccttggcaaagggctctggtctccagggggtgctctgacatatatgcagggagaattcctaccagctctgggggtgcctccaattgcaaacatcccctcccgcctccagctggg

SEQ ID NO: 27347 - DNA, 201 bp, Bos taurus
cttttggcctctcaagtccacgttctcaaccgctcagctgtttcggatccctcgctctagattggtcacaagggaaatcaggtctggtgcttttatggtcggcttcaagctactgggccaggctgacagattagggaagtaggtgaagacaaacggggaagtgagggccacagggcagagactgaaggggctgggcctggg

SEQ ID NO: 27348 - DNA, 201 bp, Bos taurus
cccagtgccttcagaatgacccactgagaggcgattcaaggcccaccccccgccactgccacctccgggacgatcgggtcacacagcctgggtctgatctcgctgctgccattcttggggccaacaatgctcgtttaataggtgggctgagactcctgcccaaatctccagatatgaatcatgtcatagctggaagaagct

SEQ ID NO: 27349 - DNA, 201 bp, Bos taurus
gatcagggcccaggcagggtcagcttcttctgaggcccgccccgtgcttggtgtgtagatggtctccatcttcctgtgtgctcacttggtctgcaggtgctctgatgtctctgccctaatctcttctaaggacaccagtcaggttggaagatggcttagcctagtggcctcattgtaacttaaccccctctttacaggctg

SEQ ID NO: 27350 - DNA, 201 bp, Bos taurus
agactcgcctccccatctcctgagagggcatgtaaccctggctggcccatttaacgccccctccagctctttagaaattcgagtcctccaaggcagaagcagtgagagatgtttctgaaggcccagtgctgagaaactgcctgttttggggcttggcgatgcaatgtcagccccgggcacccaactagagaaagccgcccc

SEQ ID NO: 27351 - DNA, 201 bp, Bos taurus
gcgagcagccatgtggaggtgggacgcagcctggcgtggttaagaaatggtcagggcctggcatcagcagggaggtcgggcgatgcggctagaaaggcaggcaggctgggccacgatctgagactcatggcatgcctactgcacgggaggcatagttctaagcccagcaaccccgagaaggggaggatgccattgtcccat

SEQ ID NO: 27352 - DNA, 201 bp, Bos taurus
ggcatcagggcgcgcccaggagctgcagcggattccagaaacacaggtggggccacgggcaccacagaaccaagctgccagaagccaggccaccgcaggaaatgcccacagtgtggggcgatcctgacctcagcccatcctctggtgaacagaggacctaaggggaccttccagccctgaacttggcgatgtgctgaccgc

SEQ ID NO: 27353 - DNA, 201 bp, Bos taurus
agcaccgtgccttcttagagaaggcgaggaagcaggccaatgtctggttggagggcctgggaggtccgttccaaaaggcctgggcaggaatcaggcctgagggctgcttccatttttcctgcaggatatctgaactgcccaggaggctgcccagagccgcaggacaaggtgctgggtggacaggcctcctcagccgggctg

SEQ ID NO: 27354 - DNA, 201 bp, Bos taurus
acatgtggaaggacaggcgtgatgagtgacggccagagacgagacgggggcggtgggggcgggggagctggcaggaggaggaggaacaccatcaagcaagccaacgctttccaagcgcgagctcatgcctgctgagcagtttggccctttctgattaataaacaagctttaccatcctccgggccagttattcttcataaa

SEQ ID NO: 27355 - DNA, 201 bp, Bos taurus
agccgctccctgctcccgcgtgtccgcacacgctgctgtccgggaagcccttccctcctccactgggtgacgccggagtggccgctggtctttaagggacggtcctcaagcccccggggtccctcccaggacagacctgagcttcagagcagggtcaggtcatgctcgggtccgggtgcggctaaggccacaccccctccg

SEQ ID NO: 27356 - DNA, 201 bp, Bos taurus
tctgtaatgcaggcacattctttatcctctgacccaggaagtccatgcttaaatataagcctcaaagaattaaaaacagacgttcaaacaaaaacttgcaaaggagtgttcatagcaccacgttcaccatagtcaaaaagtggcggtagccccgcgagtaaggaggagatcaataagaacacgaacaggaagctccctggc

SEQ ID NO: 27357 - DNA, 201 bp, Bos taurus
agtaggcctgccctggttcctgaatacatagcaaaacgagccctccacagaatgactttctgaggatgaccttggagaccatctgggcccaccgttacccagacccgcaggctggtgtggaggggaccggagccaggacgtgctgtcggcaggctgggggcagggccccccgtccccgacccgggatcctccgtgggtgtc

SEQ ID NO: 27358 - DNA, 201 bp, Bos taurus
ccacctgggggtgcccaatccccagaggccgccatgaactggctgtcacagaccacactgccccacccacgtgggtgcagacagggcagctgggggcctccgcactttatccactgcacacctgcccaaccaggctccgcaaactcagttcccacctgagggtgggtgtccacgtcccaggctgcccccagcctcctattc

SEQ ID NO: 27359 - DNA, 201 bp, Bos taurus
tcagacaactcagttgtccgctccatatacgagttctctagaatttgtgttccgtgattatgctatttttttcattacagtgtaacacacatactttacatgcccacatcttaggtgcacagcttggtggatttctcaaggtgaacatgtccctgccaacaggacgcagggcaacacagaacaccaccaggtctcgttgag

SEQ ID NO: 27360 - DNA, 201 bp, Bos taurus
cgggccagcatttgcttgtgccccctgttctttcttctttaactttccattttatcttggagaccacctcattggtccttagcagcgttgtgagggtttcaggtatatgatgaagggtccggccgtgcacacacgcgcgcgtcccttctcccccagcccccaggcggccccatgaccctgagcggagccccgtgtgctgtg

SEQ ID NO: 27361 - DNA, 201 bp, Bos taurus
atctctgggcctggaaatcccctggagaagggaatggcaacccactgcagtattcttgcctggaaaattccatggacagaggagactggcaagctactgtcgatggggccccaaagagttgaacacaactgagtaattaatagatgcaatctcaaaaacgacagaatgagctctgctcttttcaaaggcaaaccattaaat

SEQ ID NO: 27362 - DNA, 201 bp, Bos taurus
ggtatgggcaaggccaaggaagggtcagccacatccttgatgcgtgctgcccaaattcaagcagccaaacatgagacaaacaggaagaatctgagggcaccgagcaaaatcatctgaggcctgaaaggtatcctgagggactacctggaagttagctttcagcattcattagaaaagtgaactcggcacagatctcatctc

SEQ ID NO: 27363 - DNA, 201 bp, Bos taurus
tgctctgcctgttcacctgcttcagctggagaaggacccttgtcactctccgtgaaatcatggtggtggtgagcgtctcattttctgagaagatattgttcctttctgtaataatataataaaaagaactatacaataaatgacaaaagtcaacataaatattaataaatgatagtaagtgcctcatttggttattaatgt

SEQ ID NO: 27364 - DNA, 201 bp, Bos taurus
tatctgaatacctaactaaagcagttccacagtgccattggcggagatcacacccaagtataacatggagactttcagtgctatcttctggaagaacagtcactcttcaaagcatgggatttcaaaagggccgtttacacgggcaaattgttaggacttccctggtggtccagtggttgggaacccacagtgtagtgctgg

SEQ ID NO: 27365 - DNA, 201 bp, Bos taurus
caggactagtaagagcaaagtcacagatgaactgttctgtagtttgagtgtgtccctgggatcctagagcgtggagggcctggatggtgcggtgggtacttatgcccaaactcaacccctgtgcatccattctggatcgggtctgggagacagagttttgggtgaagagaaaagaatagttttatatctttgcctgcaaag

SEQ ID NO: 27366 - DNA, 201 bp, Bos taurus
gcagggcaggatctctgacacatggctctgggttcttggtttagtcccgtgcttccgaaagcctgcagtgtattttcgccgtgcgtgtcgtgctggccctgctgacgagcgctgtgcttctctggaggacaggacccccgccccacacatgctgtgctcctgggggaccctctcgccctggccgccctgctccttcagctg

SEQ ID NO: 27367 - DNA, 201 bp, Bos taurus
cttgtttttggccacagtatgacgtttacccttctgaatgctttactgctgagaagatgggaacctaaggaacttagaaattcccgctctcctggcagagcggaaagatggcccagaggctcaggagcacagggctttggggccagctctttgtctgtgccacgcatcctgggctcggtgcttccccacctgcagcctgtc

SEQ ID NO: 27368 - DNA, 201 bp, Bos taurus
taattaaagtataattgatttacagtgttgtattaattttataaataaatatgtacattgtatactttacatatacacacacacacacatacatacagtcttttttacattcttttgcttatgggtcatccccagatactgaatataattccctgtactacatgatgggaccttgctgttttttgtcctatgtataaaagc

SEQ ID NO: 27369 - DNA, 201 bp, Bos taurus
tggaggtagggcctctaaggagagaggattcaggttaattaggcacataagggtgagattacaggatcagtgttcttatgagaagagacaccacccaacgtacacagccagcaagatggtggcccaccaatagggggcctcaccagagcccaccaagccagcacctcaccttggaccactagcctccacagctgtgaggaa

SEQ ID NO: 27370 - DNA, 201 bp, Bos taurus
cagtaagctggttcttatatagtgggaagcattgattattcctgtgctgctgtttttctaaagacaaagcaaacaggcccctggaaacacaggacttggttacatgttgagcattggatctgtacatgtgctgaggagagcttgaggcatgacctgatgccccaggctctgacggtggccattaaggctaaagaataaggt

SEQ ID NO: 27371 - DNA, 201 bp, Bos taurus
atgactgaaggcagacaattccacctgcttcttggagtagtaatggcccaaggcagccgttcatagcaacatctctgtacccattgctgagcttttattttcttcttaaaatgtgagcagttgaggccctgtgtagtgaaagaatcaacttgtttccctctagtttgttcaaagacacaatttgctaccctacagatgtgt

SEQ ID NO: 27372 - DNA, 201 bp, Bos taurus
attcccaaccaggttcagtttgagtatctgcattgctatggccttcaaaagcattgcctccaaaataaccaagacctgaagatttttaaggctgctgggagcttcttgagaagccagaggaggggccagctgggtccggcttcccctgggtccttcaattcacaacagggccaggaggcagagactaaccatgtgtgtttt

SEQ ID NO: 27373 - DNA, 201 bp, Bos taurus
ttattttttcatatcacccacagtcagatgctttgttttctcatgggaaaattactccaaaaacatctctagcctgggaatggctttggcattcacacacaaaggttaacacagagtgtcttagacgatgttagagttgtttttaacacaggacagaagtcatgctgtgggaattctgaaatgtgagagtcattttctctg

SEQ ID NO: 27374 - DNA, 201 bp, Bos taurus
tatttctttaaagtctatgccggtggttctcaaatgtcagtatttgtaagaatcaccgggagggctcctgacacctcagattacagtcctccccaacctctgcagagtttttagtccaataggtccgtggtggaggagaagaattagcatttctaacaagttccaggtgatactaatgttgcctagtgtggggatcacatc

SEQ ID NO: 27375 - DNA, 201 bp, Bos taurus
ccatgagtgtgtgacaggtttttaaattctgagtggaatcacatgataccgtctacagttcctgttgcaggcagaaatcatttcaggaggaggtaaattaaaataattgtctttttctttgctacctctcttcccccctggcagagttcctgtgactcccagatgtgtaatttcatgggggaacaggtgtgtctgctattt

SEQ ID NO: 27376 - DNA, 201 bp, Bos taurus
taaaactatattcatgaagcatttatgagcaccagtaagaagacttcaactataggacattcaaaagtcaattgaaattgttctttgcaacagaccattctgggggacagttttccctttttcaagtcacacatggctacggtattaagaggctcttagggtttctggaatctggagtttaccacactctctgggatggtt

SEQ ID NO: 27377 - DNA, 201 bp, Bos taurus
ctcctttcttccccagtgcttttctgcccctgcagcatgaggtggacactggggtccgcttaacatttatgaattcattgtttaccatttccagggaatccagatttacagggccacccctgagaagtgggagacagaattcaaaggataaatatctttcattttcttctgctgtgaagacagcacagtaagtcctctatg

SEQ ID NO: 27378 - DNA, 201 bp, Bos taurus
attggagcaaagagacaggaaatgtcaagcttgataggtcatgctgagaggaaaaatgtactctaaaaacatgtgctaccatttgacttactggtgttaatttgatcttatattcaacacaaatacagtatgtctaactgcgatcatatctaaattgttattctaccaaacttaaacatccgttgctcaatggagcgccac

SEQ ID NO: 27379 - DNA, 201 bp, Bos taurus
attaactagacatcatgaaaaacattttgcaacatatgcaaacattgaatcattattttgaacacccaaaactaatataatgttatttgtcagttatatcaaaatttagaaaaatacaatactgaacatttgataagggagtgttctctagaatttgtaccaggcaaccatttcaaggcactcctgtaacgattttctaag

SEQ ID NO: 27380 - DNA, 201 bp, Bos taurus
aagaaatctaacctatactagtagttcaggaatacttttccggataaagatatgcttgtgttgaaactactgcagaaaaaatagtggccaatttgagttccaagagatgatgagatgatacgtttaatattttatacatatggataaaacagtatctacaaaagccagtgaccagctcaagacacttaaaggaagcttgtg

SEQ ID NO: 27381 - DNA, 201 bp, Bos taurus
cagtggtaaagaattggcctgcaatgcgggagactcagagacactggttggattcctgggtccggaactgaatgcacctgatcatgtctgatcttggaagttaagaagggttgggcctggataggaagttagtgcttggatgggagacacctgggaatactgggtactataggcttttggggcttcccaggtggttcagtg

SEQ ID NO: 27382 - DNA, 201 bp, Bos taurus
cacatcctggggtctttgacctgtgggcttcggcacaagcaggccccattgtgtaatacatgtggcacagcgcttctcaggccacattcacagaggctaacgggtctacaaaggtcatcctttactgataattggaacattttgagtggcatccgtcttgtccagaggccttcaaaatcaactaaacactcactcacctaa

SEQ ID NO: 27383 - DNA, 201 bp, Bos taurus
acacaagcttgaataaaatcttttctgaaaaaagatttatcaagtatgaaattagcatgggaacctaaccaacaaaaattcattcactgtgccaagcaccatagcaagcaccacgggaatatgactgtcaaaacaggttccagtggtggtgggaatgtgatttggcatgcaatagacctcactttaagtcttccattgatc

SEQ ID NO: 27384 - DNA, 201 bp, Bos taurus
cattgcttatcaatttaggtaaattcagagtggccgttgagatatgtgtgtttgacctcatccttagagacagaaaggttaaaaggaaaacaaaagaaacgtttgtgctaatggccctgccaagtacttattgttgcagcaccatagagtcttaatataaatgggttctgaagatgtccctttatagcaaaatgctctaga

SEQ ID NO: 27385 - DNA, 201 bp, Bos taurus
agaaaatgtcttggcttccttctatacaaaaatttcatatcaaagtttttaaaagtgttttcctactttcatgtgtcatgcattaaaatatattagcacaatggattagtgtatcagtgactggttccttaagaaataagtatacacacacagagagagaaatagatatgcataattatatgaattaccaccaaaaatggt

SEQ ID NO: 27386 - DNA, 201 bp, Bos taurus
tcagtaaccctctacccttttctcactgtgataaactcactcaaaccacacactaaagtgatggaaaatcaatagaaatgtaaattgtaccaatcctctccacactccaagtcttccaattattgagaaattctttataattctttactattattataaatttggttctagtacattgcagacaaattctattatgatgtc

SEQ ID NO: 27387 - DNA, 201 bp, Bos taurus
actacttttccccctcagcaagggccagatttcctcagtttttgttcattttttagtgctaacaaacaaggctacactcagcagcaagaaataaaatgactaaatgcccagatatgatttcaaggggcaggaaatttctccgtccctggctcactggcagcaaagtaccgtttccaaagttgttctcccatgatcataact

SEQ ID NO: 27388 - DNA, 201 bp, Bos taurus
agataaaataataaaatgtttttaaatgtcttttaaaaattatcaaggactgcaccaatgtcactttcctgatcttaatattgtaccacagtcatgcgacaacgtaaccgctggggtaaacgaggtacacaagacatttctgtgcacaagcaacacttatttcaaaattaaaaaattttcacaatgaacaagtaactcagt

SEQ ID NO: 27389 - DNA, 201 bp, Bos taurus
tccgaaatcaccagggtgtctgagacccaacacacattaactccaccagcaacttcacctttatttctcccacccacacacaagctactctggccttcctcccacccacaaacaccccgaactcaaccagaacctttgcaaggacctcctcactgcgcacacagctgcctcacactccagggcaaaggtcagctcctggga

SEQ ID NO: 27390 - DNA, 201 bp, Bos taurus
taataaatgacaaatctatgcaagtagcagatagagaaaccaggaatatattttataatcttgggataaggacgtctttcttaaacaagaagtaaaactcggaagtcatgaaaatgaatagatctcactgtatagaaagggaacttgtctgtgtaccactgtcaaacaggctgaaaatacttataatgcatagtagacaaa

SEQ ID NO: 27391 - DNA, 201 bp, Bos taurus
ctaacccttccttcaggatggaactggaggaacccccgctcgttctggctgctgccaatgtggtgagaaacatcacctataaatatcgagaggacttgtccgcacatctcatggtagctggctgggaccaacgcgaagggggccaggtgagtctctcccagcgtccccccttccttggagttaccctctcccccagagagg

SEQ ID NO: 27392 - DNA, 201 bp, Bos taurus
cactttgcttcagaattccctgggaggctttccaaattgtcccatgcctgggcccatcttagacccgggacaccagaacctgggatacagaggcacaagcactttggggaaagccattctggttcttctgacagttcaacccctggctgaacttggatctgtctcctgagatgccctgaatcgaaggaaaacatttttact

SEQ ID NO: 27393 - DNA, 201 bp, Bos taurus
agttgccgtatctgccaggcaggaggggtcattcctacaggaagaggctgttgaaggaatctgaggagatctagaacctcctgggaaagaaaagggttgagtacaagtctcagattttgagagtggggccagggagccaacagaggcctgaggggtggggcagaggcttctctggacctcctctgcttgctgggggcctgg

SEQ ID NO: 27394 - DNA, 201 bp, Bos taurus
tggccaacggtgtcaaatgttgctgagactgcaaagagtccatttaatttagcaacacaaagatgttgaactgtttcattgtttagggttaaggattaaatggcaaatatgaaagagagatggttgcccacaactttttcaggaaacttggctctgtcaagaaatagaaaatggggcaggagtacagacagatgaagggct

SEQ ID NO: 27395 - DNA, 201 bp, Bos taurus
gctgagggcagcgccggttccccgtggtcaagatgctgcaaaacgtgactccccacaacaagtacgtccctgcgagccgcgtgtgggaagggggcgttggagggccgcggcgcgcgcgggtgaggtgccgagttcggagggagtgcggaaccgactcgggcgcgttgctgtttcgtggcgcaactgttggctgtcgaggct

SEQ ID NO: 27396 - DNA, 201 bp, Bos taurus
catcgaatcaggtttgaaatttgccctcttgggggtagaaaattatcacaaggaaacatagaagataaattattaaatgcttcttttcctttcccttttttattgggcaactataggaaattaaacctgtggatgagggaaggaaagattgggaatttgggatttgcagatgtaaagtattacatacaggatggataaaaa

SEQ ID NO: 27397 - DNA, 201 bp, Bos taurus
aatttcaagatcaccaagaggaatcaggaggtgatccatcagcattaagcaatcacgagggattctgtcggtgacagggttaagatgactataacataaacgggttacatgagatcaggtaacagaaggacttcataggaggtgaggtgtctggccgagaaaagttcagtgtaatgagaattcaggagggtttctattgca

SEQ ID NO: 27398 - DNA, 201 bp, Bos taurus
ctgctggtagaggtgcccgttcctctccagctctgttcctccacctgctttggcagccttcctccggggctccccttgagagctgccagcagggtgtgacagggaagaaaggccaaagggaaggttagcggtttgggcgattggaggatatggggagattctgtgggtgatggcaagattagagaggttggagaggtggga

SEQ ID NO: 27399 - DNA, 201 bp, Bos taurus
gtgacaaatcctaatcacgggacacagggaccagtggccagtgacaaggccgtgacccatcaactgtgtagaaaggaattttcacagaggtgggaagtccaggtagacagacacacaggtcggccaagagagaaagagacacgccctcgtggttgtttgactcacttctgtggggcattgcttccaggttcctctcggcca

SEQ ID NO: 27400 - DNA, 201 bp, Bos taurus
agattttaggatggaacatcaggaagcttcctgggtgtcaatcaggctttaacattgacctcaggcagctgacttggtcacttggcccagacatcctcacatgtgtagtgggattatcaagttacccatcaaagggctgatgggaggattacccaatcccttatctgcatcttgaggccagatgtacttggaggttcagat

SEQ ID NO: 27401 - DNA, 201 bp, Bos taurus
taccctccaggatgccccccaggaccttggtgcctccctgtcccgctcaggccccaggccctaggccaggctaggctgccggcctcgctgggtctctctagagtccagaataagtcacacagcatagcgggggcaaccctgcctgggatcagaaggctgggggttaggctgttcctgtggcctcatcgggggtgagaacca

SEQ ID NO: 27402 - DNA, 201 bp, Bos taurus
taatttataaatgaagaaaatgaggcatggacaagctcacacaaccaagaagtagtggtaccaggcagaactggctatgccacttgtgggacccagcacacaaagaaaagcaaggcctcttgtccaaaaatttaataatttcaaggcggtaacagcagagctttgaagcaggtatggggtccctgcatgactacatgggtt

SEQ ID NO: 27403 - DNA, 201 bp, Bos taurus
tgaggcctggcaggtggatgagtcctccatcctggacccctggggtggggggaccaggcaggcgtgtgggaaagatactcgtcctggatcctggtggtggcggcggtggtggtgggggccaagggcaccctagtctttgacgagtttgtagacgtggtgctgggctccgtgctcgctggtggagacttcaaagacgaaagc

SEQ ID NO: 27404 - DNA, 201 bp, Bos taurus
tctctttctggatccatggggctttggcagtgtcaggggaccccccacacacacacatggccagagagctggtgacttaggggttgtccccacaggcaaacggggctaggtgctcccaccactctgagtgtttcagtgactgctgtctcatcaacttggactctggtggcgccttctgtgcccctcgggccagaataacca

SEQ ID NO: 27405 - DNA, 201 bp, Bos taurus
ggttcttgcctccaacacagggctcagtacgcagaaggctcttagtaattgtgccctgaatgatatagggaggagaaaccagtgacccggaagactttgccggcctccgagggattggaggttccaggaggacatatagggaaccagggaagtatgggctgggctggggactgcgctccagaagtggtttggcggcaggac

SEQ ID NO: 27406 - DNA, 201 bp, Bos taurus
aaaaggaatcactgaaaccttctaataatgtatctcagaggggaataatatgctagggacattcacatatctgggaatttgggaaggtttcaggtgcttcctatttttcatgtaaaggactcactggtgtcatttaaaagcagctttttattcatgaactcactataacctttgggcggtctgactgaatttatgatctgg

SEQ ID NO: 27407 - DNA, 201 bp, Bos taurus
aaaagccttggctcggtggggtgggaaactcttgcctcctcttagatggcctcctctggccacagcatgaaggttgggggtgcgggttctctagcaatgaagaggttgcagagactggcggttctggaggcaggtggagccccttctctgctccctggaggtgtgctggcgaggcagtagggtgttacaaactgacctaag

SEQ ID NO: 27408 - DNA, 201 bp, Bos taurus
aacttcttcaaacctcctgagtaccttttagagcagctgaatagtagagaattctgtgtgaactcttttctgtagcatttgaacctattccttgaaattttttgtagctaactcccaggatgtgccgggagttgctgggcatggcacagatggttgtttcaatggtgttaagagttttctgatttttagtccttgagaaac

SEQ ID NO: 27409 - DNA, 201 bp, Bos taurus
aacagaacccctgagcgtctggtgcttgtggccatttctgggccagatgcagcctttggttacaccctcctggtgctcagcagacagggagtgggattgtcctgcgggagtcctgggcctgtgtgtcctccccgggtgttaccttcacctgatcagccggctccactagcgggctgccaaccacacggccgtctgtttccg

SEQ ID NO: 27410 - DNA, 201 bp, Bos taurus
tctgatatgaggctagtgatacttcctttgcagggctttaaggattggaagcagcctatataaagcacttggcatatagcggtagatggtagcagttattattgtcatctgttgagctatatcaggcgcagccaaacagcactgtgcactaaaaatgaaagatcctgccatagggaaatagatctggataccaggctcacg

SEQ ID NO: 27411 - DNA, 201 bp, Bos taurus
tcagaaaccagagccaacttggcagccctgtcactgtgggaaaggaataccctttcctggagggaggccagcgtttactccctttacagctgcagcgtgcagggagggaggtgccatcccatacccatccgtggaggttttgcaacccgatgagtgaaccctttgggactcagggctgagcagcacctcttcctgggcccg

SEQ ID NO: 27412 - DNA, 201 bp, Bos taurus
ggcctgtcctgaagaataagttcaccacaaacctcagccacccctgcggggcctgccactgggccttgtccttcttggcgtcctgcagaggcctctgctcgctgagaaggtccttggtctcctctgggctgggggcagcagctgtagtgtcctgagcctccacagactgaactggactcttgagacatctggccccatcac

SEQ ID NO: 27413 - DNA, 201 bp, Bos taurus
ttccccgcccagggactgaacccaagtgagagtgagtccaaccattggactgccaggatccaccctttcctgactaggccacacagtcccagacccgccccgggcttatcagcccagagctgacccgcttcccaggatcagtcagaaaaggcctgaccccatgtgttccccaccccccagcgggaactgcagccactgccc

SEQ ID NO: 27414 - DNA, 201 bp, Bos taurus
tatctcttccaccctcatccaactgccttctcatttccatgtctttcccactgtcccaggagagcacagggggacagcatatactatgtgataactgccagtaataaaggctggtcagaaaagaatttacttgcagctgcagttcttcagggaagccttagtataatcagctggccctgccacctggtcatttttatctta

SEQ ID NO: 27415 - DNA, 201 bp, Bos taurus
tctatgtgctgctcctgctccttgaagccctcttgcctcagagaccagtatgcccctctctctcctttgctcagggttcatctaactgtcatctcctcggggaggccccctccccgaccacctcatttaaaatgtcaccttgtccctctctatcctcttattctcctttgtgacacttaccaccactggaaatcgttattt

SEQ ID NO: 27416 - DNA, 201 bp, Bos taurus
ttaattctcatctccagggtaaaaacgtcactccagtctcagtcccaaggtggcaacgccaaaacccatcacacccagatctcagccccaaacttcagacggctcctgcaccccctgcagacgtcacagatacgtccctctcactccccagcagagcacattgccagacaatccctcaccagtgacctaaccttggtcacc

SEQ ID NO: 27417 - DNA, 201 bp, Bos taurus
cagaacttgggtgtctcagggaggagaggatctgttctggcctgtctccttggcttgtagatggttatctctccctgtgccacttcacatcctcccaggttcactgtgttagggcctacctttatgacctcattttaactccattgcctctgtgaaggccctatacccaaataagatcacattctgagatattggaggtta

SEQ ID NO: 27418 - DNA, 201 bp, Bos taurus
ccacattgttaattggctgtactccaatacaaaataaaaggtttaaaaaaatagcttttgaaaagatttcaggtaatttaattggtatttctatttacttcctcagtttggtcttaaatactttatattggtgtttaaagttctccattattaggaagaaaatcaggctagtataaaggccagttgtagaaatcactaatt

SEQ ID NO: 27419 - DNA, 201 bp, Bos taurus
cttcctgtttcaccctttcttacacttctcttctttccttagctatttgtaaacagacccttgatcaatcttctttgcccaaaagccacccagtacattataatgggatgcaccagccttctcaagttacttaattagggggaaaaaaaagtttgtatttctacttccaggggttggtggtggtgttcagtcaccaagtca

SEQ ID NO: 27420 - DNA, 201 bp, Bos taurus
tttgtaaatgttttaatttggaaatttcatctggagaagtgggagggctattatctggcttgaggattttctgtaaacttagattcccacttgttatatctttatgtatccttgtttgtaattgatggtgcttttcaaactcaattatgtggacagattaggtgtgtcctttctgattaaaacagttcgagaattgctggt

SEQ ID NO: 27421 - DNA, 201 bp, Bos taurus
catggggttcctttcttcaagtttctcagaaaagaggagggagagaaaaagagggatggggagaggaggggagggcggaaacaatgagatattcagtaggacagaactatcgtcaatactatgactactgcttacaatcagacctattacaatgaaaatcatcatgtactagaggatctccaaaccttgttgctccaacca

SEQ ID NO: 27422 - DNA, 201 bp, Bos taurus
tgctatattgcctactgttctgtaataaaattcatagactgagaacctactacttataaaaaatacattagctataagggagagatttttaaataatttacaataaaataatatgcatttcaaccaaattagaaaaccaaactgtccctataaattttcataatgccttctgagaagagagtccataaccgtagcctctgc

SEQ ID NO: 27423 - DNA, 201 bp, Bos taurus
aaacaccaattgtgtactcttacgtatgctctgaccactcctcttattccatcccctgttaaatttcattttcttgcctttttcattggctgggactgtcatacatccttaagtagatcttgtgatagttggcatcttattctgatcttcttttggaagaaaatccttctaacatttccccatttggtttgatgctttagt

SEQ ID NO: 27424 - DNA, 201 bp, Bos taurus
ccagagcctcccagctgcccccggtcctgagaagattctgaacagcggtccgtagccgtcctcagcttgctccctggagctgtagtgtccccatctctgctgctttgtttcggccaggcccccctgctgaaatgcccaccctctgcccttgctgggtccaatctctccccacagattccctgcttaacccccgctcacagc

SEQ ID NO: 27425 - DNA, 201 bp, Bos taurus
tactacagtataagaactttcctaatctcctgtctcgtccaaacatcagcaagggggttggtgggaactcaacaggactttgtcttccagcggcctccgtttgggtcctgaataaagactaagtctccctgggaggagttttgagagagggcacaagttgtggggccagccaggaaccccaatgcccaaagggatcttgtt

SEQ ID NO: 27426 - DNA, 201 bp, Bos taurus
gtggcctcagagaagacatttccttcccggacctcaattttcagatctctaccctgaagctagatgctttccagctcagggcttatggttttagtcttggatgttcagaaggggccccaagaaaaggaggaagggacagacttaagagttcctggggaggaggacaccctcaggaacataaacactcaggagcggtggagc

SEQ ID NO: 27427 - DNA, 201 bp, Bos taurus
cgccggagaggtgaggcctctcctccgtgtccttgctgtgctctgactttctggccctgggaagagggcgtgagtgctgcctggggaagtggcagagggttggtgtggctgccagtgccgtcatcgtgtcttcagattgtctgtatcatgtcttgccccctgcactggacgccaagaaagaggggctcctggggagctccc

SEQ ID NO: 27428 - DNA, 201 bp, Bos taurus
ggacgtccaggcagggccagctcttctccaaggaggcagcatcctctgcttaggtccagccctgcagtgattgaattatccgccctttcacttaatgagcatctctctggactggccatgagacctgtgttcaggagagcagacatttcattagcagaattcagtggtgccgtgttgatcctggtttcctgacagttaaga

SEQ ID NO: 27429 - DNA, 201 bp, Bos taurus
gcctgctgccctcaaaattggactgcagaatttttagtgttaaagcacctcccattgaaactcaatgctgtgagaggccaaccagtccctacccagccatgccctgctccaccctgcggagtgacagagcagggcatgtatgccaggaatcaaagtcacagacacagtcagccccacagcccaccagggtctctcattctg

SEQ ID NO: 27430 - DNA, 201 bp, Bos taurus
cagggacaaaaaggtgggacttggccacagtcaagtcgccaactagagagtgtaccggtcaggcggagtgtactgccaaggcgcgggcaggggtgacaggaaaggcggccccttaaggaaggctcacccacatcttttttggggggttggggggactaggggaagaagtagagaggcctcccattctctgtctcctaccct

SEQ ID NO: 27431 - DNA, 201 bp, Bos taurus
agttggaacatgacatggacagactggcccacatcttcagttattacattagtgacatcgtggagcgtgagtgactattgtgggggaggaaagaggtgtggtgctgggcccctgagggtttgtaacagaaggggacctggggtactttaaaatgcacactaaaagtgacatccttttagtgtcattcatccttaatatctt

SEQ ID NO: 27432 - DNA, 201 bp, Bos taurus
gaggggtctgctccagacagactcgaggccaccttctgccctcacaactcccagccccggggcaggaagccccgaagcctgaagaaggagcccggccacatagcacagctgtgtccaggctgatgcagagtgagaagcccatttgcagccacgggggactgtgaaccccaggctcgcctgctggccccgcagcaagaacac

SEQ ID NO: 27433 - DNA, 201 bp, Bos taurus
agagacttgacaaaagacccttggctgttcctagttagataagtttccagatgttgcaagggatttgagtctcttagcaatttttactccagtaattttacctttctaatgccacctgttgtctgattgcagacacatggaacccctgtgctgtactcgaccccttcaaaaacagcctccagtctgtgaccatcacaagac

SEQ ID NO: 27434 - DNA, 201 bp, Bos taurus
agcatggagatgcaggcaaggctcatggcttggcttgaaaaagctaggtgagaagtggcagaaggggacagatataaagagaggagggggagaggccagatgaaggacttcgcaaagggaaaagagatcaagagatccagccagggcagggatgggagccagtggtatccaaagagaccatgtgtcctggttttctaggga

SEQ ID NO: 27435 - DNA, 201 bp, Bos taurus
ccatcagtaggaattgttatagacatcataaaatattttaattatagaattaacacatatgagtgtggaaaatgaattattatttggggactctctgctcagaaaaatgatcacttacccgatggcatcccactccagtattcttgcctggaaaatcccatggacagaggagcccggtaggctgcagcccatggggtcgct

SEQ ID NO: 27436 - DNA, 201 bp, Bos taurus
acatagacaaaactagagatctcatagcttcactttaaaacttagttatgaatcagttacaatataagcttactagttcataagtaagttggaataaattaaatttgcttgctaagatgacaaaggctttattgcttgtggaaaagacttttaagatttgtatttgatcttgataaacccttaaggaggctatgaattaga

SEQ ID NO: 27437 - DNA, 201 bp, Bos taurus
cacccgggtccggggtgtggaggtcctcggccccaagcccactttctggccgctgttccgagagcagctgtgtcgccgtacgtgtctcttctacaccattcgggcccaagcctggagccgggacattgcggaggaccgcaagcgcctcctccagctctgtcccaggtaggtgggcagggtgcagccaaggagatacggtta

SEQ ID NO: 27438 - DNA, 201 bp, Bos taurus
aggaacctgcgcctcgcctgctttctttcctcctcctcctttctaacccaccacttctggggtcgcaggactgcgcagaggccaggggctagtcttttgctgaatcagagatggggtggtggatgggggatggcaaatttcagatcagtggatccagccccactcctacgttagccagcagctaagacaggccaaagtagg

SEQ ID NO: 27439 - DNA, 201 bp, Bos taurus
caaaaataaacacatgttttatgagtaccttgaagttacagaatttgctgggtcaagcgattggaaagaccaagaggctacccttaaagtgaggtggcctgtgtcctctgaccagataggaatggaagaaggaggagttggcagagaaagtctagactctggtctaccatggagcctaggcccaggccgccagaatcccac

SEQ ID NO: 27440 - DNA, 201 bp, Bos taurus
atgaaagcccccctccctaaccccggcagtccctggtcctcattaaagactctaatcctccagccctgctgcagattcagaggcctccatccccaggtctgaagggaaggggacaagcagtgatttctcttcccttcacccacccccaccaaccaggctgggcttgggcacctgacccagcggtcaatgggcatctgaggg

SEQ ID NO: 27441 - DNA, 201 bp, Bos taurus
agtttcccttgggccagaggagggctggaggaccgacctgtggccagtgggatagaagccgcgtgtgtgatttccagtgagtttcccttaaagggaaggtgaagggaaggggcaggcccttcttcactcttcttcctccttccctctggctggagctccagtgactggagtgaccttggaaatggaaatgacacccagcag

SEQ ID NO: 27442 - DNA, 201 bp, Bos taurus
actgcatatcactcttcaacgcgcttttccccactcaacgatatgtcctggggagctgcgcctgcttacagccttgccatctttccttagaactgccatgtgctattccagagcaggtagactgcttccagaaccgccctctacgtgttgttaacagttctcatgattaaatggaagactgaggggcttccctcgtggtcc

SEQ ID NO: 27443 - DNA, 201 bp, Bos taurus
tggatccaagcattaagaaaacagaatggtccagagaagaagaggaaaaactcttgcacttggccaagttgatgccaactcagtggaggaccatcgctccaatcattggcagaacagccgcccagtgtttggaacactatgaatttcttctgtaagtgaacctccaaaaatggtactaaaatgtgtatatcttctgaatga

SEQ ID NO: 27444 - DNA, 201 bp, Bos taurus
tggttgtgatcacaaagcataacgatgatgaacagtatgcttgggagtcttctgctggaggttccttcactgtccgtgctgaccatggtaagttggctttcctgttaaggtgtctggattagaattctggggaaacagtaatgaagatcttgagtattgtatgtgtaaagcagttatagttctgtgtttatttagtttttt

SEQ ID NO: 27445 - DNA, 201 bp, Bos taurus
ccagtggctgctgaaccgccatccccacccctgtccgagttccttcttcctatgtcttcctgtgtctcaccattgtgactgcagagcttgatttggagagcggactgggaaagatgactgaggcctcggacagcaaaggtgccccttactgtgcaaagaggccttgggaaagagattgatatggatttaatggcaaatatt

SEQ ID NO: 27446 - DNA, 201 bp, Bos taurus
gagatctcttaattaagcggccttcccctaggagaaaggaaatgggcttccatattctcagctccgacatcagatcgcatgatttactacccgaggcctgtgtttctccccaaaccagctcctctatagcacaaacatctatcactttgaaggcggttcaaacgccactttccccttctcctccccctttcgcagtgccct

SEQ ID NO: 27447 - DNA, 201 bp, Bos taurus
cctattttctactttctggttataatttgaacttagtggctgtcggttcagtagcaatgttgtgaccagcagggaaaggccaaggaaattgctgagacctcggccttggaatccttaacccctgaactaatactaggaaattttttttctggacttcttgtttagagaggaaaaaaaattctccttagtttatgttagtca

SEQ ID NO: 27448 - DNA, 201 bp, Bos taurus
tggccaaagtactggtgcttcagcttcagcatcagtcctttcagtgaatattcagggtgagtctctcccaaacccacccgagtctgtgactactgccaccgtatgccaccttcatcagaggagaagcctgctttccagtttgggatgtgatattttggaaaggatggcagaatggaaagtgcttggaggatcactcagaat

SEQ ID NO: 27449 - DNA, 201 bp, Bos taurus
tagggctgagagagtcacagagcagtctacgttgaggtcagcttcacttgacttgactgagcaaacactggagaaactgcatccttcctgtgctgtgtggcgtggtacttggtgcattgagggctcaaggaatagaacagaaaaggtgtttcagaggggtttggatgatctgcagaagatggagtgatggccatgcttgca

SEQ ID NO: 27450 - DNA, 201 bp, Bos taurus
aaatcaaaacagatcacccacctgagattgtgagggcaatctggagcttggtaagagctgtcagtttggtacagctcccactgaggatgctaatgacacacaactttcatatgtcctcacttcctcacccccgatgtaaggggtgtgtggtgtgcttagttgctcagttatgtctgactctttgctacctcatggactgta

SEQ ID NO: 27451 - DNA, 201 bp, Bos taurus
tccctgtggttgttcggttgccaagccctgtcctattctccttaagtaggtctttatcatagaatcttaggatggtgaccttgaaagagagattggccagcctgcagcctgttctttgagagacagaaagcaaagagagagcttctcgcttgtttagggatagtgagaagttctttttgctaacactgggaatcttcagaa

SEQ ID NO: 27452 - DNA, 201 bp, Bos taurus
ctgcaacctcgcccattagatgaagggataactggacaatgtctagtcctgaattctttgtttctctccatgctcacttgttcagcagtattaattgggcgccaattataaattataattgacccttgcttgtgaagagctgtaatgcaaattctccactacgtgcctagcagaaaatgttgatagtggccatgaaaaaga

SEQ ID NO: 27453 - DNA, 201 bp, Bos taurus
tgatggaagagaaaattgcattcagggtttcagaggatgtgaggcaagcctcttcccctgtcttgggctattcaagtcatcagccatccttccacaggatgtaggctgcttgtaagttccatccctcactctgaccctgacttggaggtccctgactcagggccttggttggtcctccatctttgcacaccccatgggaga

SEQ ID NO: 27454 - DNA, 201 bp, Bos taurus
cagcctgacagttcatgggatcacaaagagtcggacacaagttttagtcacagtggttttcttaaatagcagtgagagatctcactgctgtatttaaaatggataatcaacaaggtcctactgtgcagcacagggaactctgctccatgttatgtgacagcctggatgagaggggtgtgatggcaatgagatctctcatag

SEQ ID NO: 27455 - DNA, 201 bp, Bos taurus
catatggcaataatagggggcagggtggcctttcagaagtatccctacttcaggaccttgtgtttcttggagcagtcattggatgagagccatccctagtggagggcccttggtgaggtgactcctattgtgcgtgtttgtgtgtgtgtgtgtgtgtgtgtgtgtgtatgtgtgtgtttgcatgctcactcagttgtgtct

SEQ ID NO: 27456 - DNA, 201 bp, Bos taurus
tggggaacttgacagctgatgtggaggatacatttgtattatttccaaccaacaagaaacttttttttagcaaatacttttaagtcaggccatccaggcattttagttatttgtttgtttttggctgcatgtgggatcttagttcccaacccgggatggaacccacgctgccacagtggaagcatgaagccctaaccacga

SEQ ID NO: 27457 - DNA, 201 bp, Bos taurus
tgagaatttgcagaactggtgggccagctagcttaaccttgcaccaagtgctttcttcctgaagtttctccaagtgtttaactctgcaaaagtcaagaacgtcctcatcctcttgtagggagctgaagaattttctggccgcactccagatgccgtgacgtggaaccattggtcagaggcaggcggaaacaggcctgggaa

SEQ ID NO: 27458 - DNA, 201 bp, Bos taurus
tgcactgcctaccttcaaagttatattccaaaggtgcaaccatttacatagcccataccctagaacctggcagagtaatctgcacatagtaggtgctctacacaatgaggctgatgaaggcccactttgggaatggtgtacctccccaaaaaagtctatgactattgagctggtcaatgcatgttttattctcagatttcc

SEQ ID NO: 27459 - DNA, 201 bp, Bos taurus
tgctgtgaaaagtgtggcctgctctttgtctttctcatttatgttatgatattttcagtaattcaaaaatttaattattttttctcttttcaattgtccaggaaactctaaaggagctcatatggccctcctatagggatacagctgcttaaaatggaaaggagcttctccagacagaagtttatgaagtggagtttctct

SEQ ID NO: 27460 - DNA, 201 bp, Bos taurus
gatggagttgaaactgtcattctggaatcaaggacagaagtgaaggcagttgtcatgtgaattctgaagcttcagtgtccagagataagtctcttgggccaggaaaggacatttagagaaagaggggattaagacttcaggaagtatatgggaaagagaagcagtgtcttgttctgcaacctactcacataacctttccca

SEQ ID NO: 27461 - DNA, 201 bp, Bos taurus
aagccagcaataatcatcttaaccaactttaaatgtctgttaagtagtgtactcagggcatcttcttggatgcccccaaggccaaatgatggcatcaaatggattacatcattctttggcagtagaagctgaaggacattgagatcatcgcagcaatacccactgccaagatgggaccagcggctctctggcctctttcaa

SEQ ID NO: 27462 - DNA, 201 bp, Bos taurus
gaggagccaggcaagctacagtccatggggtcaagacacatccatggggtcaagacacatggagtcagacacatctgagcaactgacaatctcatttttacttcatggagcaaaataacaggagaactgtagaaactagttaaggagctatagcaaccagggaagtgcataaacaagagaagggatggttcaggtgaggcc

SEQ ID NO: 27463 - DNA, 201 bp, Bos taurus
gaaattcacattaaatgatagacttatgtactgtaatagtccaggaaacatattcagaagatacaaggaaatttttagtatattttaaactgtgtataaataatcaattgttaaatgtgtaaaatagaaacttttccttttataaagcaacctaggtaccccatgatttgtggtaaatgttaatcaatcaaaagacttaat

SEQ ID NO: 27464 - DNA, 201 bp, Bos taurus
tcaccagggaaacccccataaaactgagattaaagatacaatcttttaattgtgttgactgaaagggcaacaagtgaccatactcaatgataatccctgattgtcagatctttgtaaatatctttcagggagactagagctcttagagaaaaaggctgaagaacaggaaaaagggaaggagaaaaagaaagaataccttga

SEQ ID NO: 27465 - DNA, 201 bp, Bos taurus
agcgacaaactgctgggggtggtgctgtggtgggctgggctagacccctctggggtaggagctgctttgaggaggattctggttcagtctgaggccatcctctgagtgtggaaaaccagtcccagccaaggttgcccactgggtgtggcagggtgaaagctgctgtggaagagggctggccagggagggtgggttgagagg

SEQ ID NO: 27466 - DNA, 201 bp, Bos taurus
ttagaaagaaaaaaaattgatttcttttcctagagtaattagaagacaaaagccgggttggactgagagaaataaagagaatcgataccaatcactttctcagttttttcattctccaaccacgaagattgcagtgaggttacttgtattctttaatgcaacacttctttttttcaaagagtagcttaaatcaacatgcat

SEQ ID NO: 27467 - DNA, 201 bp, Bos taurus
ttgttccctccaccacacccaccgccagccccatcacatccccgagtatctctctctgtagcatgctgggctgggtgtcaggtgaacacatatgaatgtgactggtatttactcacaatgaatcatcctcatgttggatggaccaatcacaaaaggtaggcataataagacctcactagactttgtaaatacagtttaaaa

SEQ ID NO: 27468 - DNA, 201 bp, Bos taurus
cctttcccttctccaggggattttcccaacccagggatcgaaagcaggtctcctgcattgcaggcagattctttaccagctgagccccaagggaaaccctgggccctaatccaatatggctgctgtccctgtaagaagaggaaattaagacccagaaaacacaggggaagacaacatgaagacacccagaaaaagatggcc

SEQ ID NO: 27469 - DNA, 201 bp, Bos taurus
gagaatggcgtgtttctgaggctagttgtagggaatcaccttctcccagctttcctggacctagactacgtgagggcctgttggaccctcacgagggacacaggagaagtgggtctccacagagcctccgacaaagggctgtctcctggccaatcaaggccaggattggagccttcaagattggagccttgaagagggtgt

SEQ ID NO: 27470 - DNA, 201 bp, Bos taurus
ttttgctatgacattaatttttgctgtgacaatgagcttttcactttgtttatctccatctcattttttctcatttttaaaacggaaagcctgtgctccacgactaaaccaccttacagaaaccacctgctctttctgtggggagggaccattgacctaaagcacgtaaaaggccgaaatgctcagttgtatgtcaaaaat

SEQ ID NO: 27471 - DNA, 201 bp, Bos taurus
ttgaaatgtaagtgtcaaggtaaagttcctatattccagtttccatgggggaataagatgctaactgccacggttaccttactccgagttgtaaaataatctactgtattaagatgtgagaaagttttcttttgcttcagtaaagccaatcagcaaacacagatgtcctccatgtccctgtaccacagctctctctctctc

SEQ ID NO: 27472 - DNA, 201 bp, Bos taurus
catgttgaacaataatcctgactatcatgacaactgatcgcgaaggtgagaattttaaaataaagaacagcgtggagaggcaagcctgccatttgtgacgacatggatgaaccttgagggcattatgcaaaggaaggcagtatgctatgtcagacaaagacaagtacgtaaatatggaatctaaaggagccaaagctgtaa

SEQ ID NO: 27473 - DNA, 201 bp, Bos taurus
cactctgctttaatactcagaagggtgggtgaaacatgggagaatacaagctgtaagtctggagatgtaacatttgccttttgtgggcactcatctctatcgtgtaaccttaaacaaggaactttacctcctaggatctatacccgaaaaggagattaatttcaatagctccaagctttaaattggtatagttttcctact

SEQ ID NO: 27474 - DNA, 201 bp, Bos taurus
tccgtgtgtataggccaggcacggcaagagggatgtaaatgctaaggcggaaattaatgattctgtgctattggttacaatcaggtcttattgaacatttttttgcatagcaaagaaggccatcaaaggttgacagccaaaagaaacagtttaaacaaaatgcaaagcatcatcttccctttgcctaactgtatgaggagg

SEQ ID NO: 27475 - DNA, 201 bp, Bos taurus
ttatctctgggggacttagcccatcctgagaaaatgtcaactgctcagtcaatgggtccagtgtcttcatggagcagactaaggggagtcaaaccaggccgagggaacaatggtcggcattgttcttcccaatctttctctggtccctcccccagcatggaaacctttacaggccgctttccagtttgggaccaagccctc

SEQ ID NO: 27476 - DNA, 201 bp, Bos taurus
tcaatccttgattttctgcattaccacaaagccataatttctactgttaattagctaaacctttccattaattttccatgcaaccaccatttctgccccatccactccccccacccaaagcacacaactgacccaaatttttcaggtgttgcagaaaactttgacctatgattattgatcaatccacgttgtaaaatatct

SEQ ID NO: 27477 - DNA, 201 bp, Bos taurus
atgaaatcatctcatttgcagcaacatagatgaacctagagattatcatactaagccaagtaagtcagagagaaagacaaacaccatacggtctcacttatatgtggaatctcaaatacaacaccagtgagtatatctttgaaagagaaacagattcacagacatagagaacagacttctggttgccaagggggtagaggg

SEQ ID NO: 27478 - DNA, 201 bp, Bos taurus
aaaaatagggccagatttagcccacaggccattgtcttctgactttggattaaagacactaatgtgaaaaaaataaaaacgtaccaggaaacaaacagatgaacttttatatagtctttggataggtgagaattttctaaccaggaaatcaaaggcagaaaccacaaaagaaggtatctgtaattttgccattatagaaat

SEQ ID NO: 27479 - DNA, 201 bp, Bos taurus
cctcctctccttcctccttctggtctaagacaatccagtgtaaactgccatcacaatagtattatacatcatggaatttttgtccaagttcagatgaagcgatgcttttatcactataagtcttttacccacagtcaagttgcaaacacataaattaggaatgtaacttcaagcattacacagaaaacatgagggtaaatg

SEQ ID NO: 27480 - DNA, 201 bp, Bos taurus
cctcagagtccactgtgatctgagagtaagttcatggtgtctttaatgcagcaatatagtaatctagtagacttgggccttcagaatggctcagccacgtgttttagagtttgaagtaacaactgcgtgttttcagaattacacagccaattccagaagcatctcacgtatcaaggcccacgtgtcatagaccaaaggcac

SEQ ID NO: 27481 - DNA, 201 bp, Bos taurus
ggtgaggatgaagaggcgggtgactccaaatacggccgcccaggcgttgaacctgcccgcagggaggtgcagaaggtgtgtcagcctttgaggcccaaacaggaagagggttcaagggtggtcggggagggtgattgagaactgaggtgtccagaataagatgctccaggaaaaaaataaccccagggctccacctaaccc

SEQ ID NO: 27482 - DNA, 201 bp, Bos taurus
aagttagcttcttggccacatttaaaaaaaaaaaacaaacaaaaaccaaccagcaaagcctgcgaccagccctggagtccatgcctttcacattctcagatccacaggcctctccaatgaagggtttcacctggagctgagttagcaacgttggtttttcttccgtattttctttaatggcatccctcccaatacctgtac

SEQ ID NO: 27483 - DNA, 201 bp, Bos taurus
tgcctcagcaaaaaaaaaaaaaaaagataaaacaactgttttccaccaaattaagagtttaaaatgccagttgccaggccttccctggtggcacagtagacgggaatccgcctgtcgatggaggggacatgggatcaatccctggtctgggacgattccacaggccgcagaacaactaagcccgtgtgctgcaactacaga

SEQ ID NO: 27484 - DNA, 201 bp, Bos taurus
ccatgagatttagcagataataggcagggtattctggacttgacagagaaaagaatgttccaaaagggtggaactcgtacataccccagtgttttagcagtggcttatccaggccccagtgctccactttgcagtcataaacatcatcatcagaaggaaggaaggtgaggtaactgatcttggagaaggaatgatcatcct

SEQ ID NO: 27485 - DNA, 201 bp, Bos taurus
gccgtgtccctggcaccgtcagctcccgctgcagcaggggacgtagctgcggctccagggtgcttggagatgggactccgaagcggagcaggaaggagtcaaaggcctcgggtggggcctcccagttgagcctcagtgaactcgtggtcacatcagtcaccgacaggtgagacagcctgggccctggctctccgggcgtct

SEQ ID NO: 27486 - DNA, 201 bp, Bos taurus
ctgggagcgcgggaaggaacccacgtgcccaccatcttccccgccctggcctcgccctggttttctgggagccagattggaaggctgtccctgtcaccccatctctgaacatgcaaagtgatctcagcccaggtgggatcccacaacctcgcaggctgggcgtgtcccccagccgcacccctttctcctccccacccccaa

SEQ ID NO: 27487 - DNA, 201 bp, Bos taurus
tccttgtcaggaaaatcctgtggacaaggctacagtccatgagatcacaaagagttggacaggactgagtgagtaacacttatactttctgggaaggtcccgcatgcagtgggctaacagcccatggacacaactacagagcctgtgttctggagcccatgccccgaaacaagagaagcctgtgtactgcaattagagagt

SEQ ID NO: 27488 - DNA, 201 bp, Bos taurus
gtagcacagggagaaagatgagacagagctcagctgtgggcagcctaggggatggagagagatgaggccacagtgagagaactctgagagcaggggataaactaggctgtggtagaggggaactggggatcagagagaggaaagggagaatgaagacagagggtgcatagcagaagatgggaagaccaagaccggaatttg

SEQ ID NO: 27489 - DNA, 201 bp, Bos taurus
ccgctaaccctacccgcaaggagttcacagaaagctctacttccaccttccccatgcaagtgtggtcacaaactgtcatcccagtcatcgcaatctgcaatttctctagggcccctctccccctgacggtttgcggctgcgcacataagttctttatctcctctcccttctttagaaaggtttagaggccagtttgaagtt

SEQ ID NO: 27490 - DNA, 201 bp, Bos taurus
tgctctccataggtaactccactaccctttattctttatcttctttgcatgttgagatgtgagatttcctcaggagcaactgccttctgctctccaaggtcctgaaaagatacccctgggcttcctgaaaattcctgtttcccggaatgcagatttgagttctgattggttcttcttcttcttcttctttttttttttaag

SEQ ID NO: 27491 - DNA, 201 bp, Bos taurus
taatattaagctaagtatctatttgtaccatctcaaaacacagctgacataaaatttacttcagaaccaaatgatttccaaaaactcacatacacctgaacctcacgtggcttcctctggccccttcctattgcaaaaattattggaacacagcagataaaggaattctcacaccagatacctcaaatctcatagcatatc

SEQ ID NO: 27492 - DNA, 201 bp, Bos taurus
aaggtctcaataccagagaactcaggggcccaacaaccacgttctcttcacagaagcttactccacattgtgtaggtatccatgcctgtctcctccactttcagatgtcttcccggccgccccatctccccagcactgtccgtcatgcaccccaagagctccgtcatgtctcggaggtcctctctctttcccctccacagt

SEQ ID NO: 27493 - DNA, 201 bp, Bos taurus
aacttgataaatctgtgcgggccaaacaaattaattacttatgcaggttgtatcctacagttcttctttgcctttgacttcggtgcaacagaaaaccttttattggttgtcatggcctatgatcactatgcagcagtctgccaacccctgcactacctggttatcatgcaccctcagttctgtaagacggcagcagcatca

SEQ ID NO: 27494 - DNA, 201 bp, Bos taurus
atctggaaaggcctggttggaagaatttatgaatgcactgaggaatgtatgttggagtgagacagacctggtgagaagtgtaataaggaaagtttgggtggagggaggccagggtcaagattgaacctgcaacccctttcctccaacaggccctctcctggagggaagacagagattcatgaaggagtgagaaatgcaagc

SEQ ID NO: 27495 - DNA, 201 bp, Bos taurus
cctttattttacacaagaaaattgaagcatagagagggtagtgatttatccaaggtgtacagttatgaagcaacagggccaggattcagactgaggtgaagtacatgtccacgtacatcatatcctgcctcacaatatctatggattatgcttttctgcatggaaaggtagagactgaggccttgggatgccagtctgttg

SEQ ID NO: 27496 - DNA, 201 bp, Bos taurus
cccgtctcttctatccacggagtgaatagtagctctaattaacacagcttttcacctaattgagtagcatttgatcagaaaggaagtttgagctttccaatagctggctctgtggcttagttggctaaagcgcctgtctcgtaaacaggagatcctgggttcgaatcccagcggggcctgctggtttttcatctcaaaatt

SEQ ID NO: 27497 - DNA, 201 bp, Bos taurus
tactctgtgtgagcaagataaagatagcaagcagaacatttcaaaagtgagagtcagtgagaaagtgaaaatgaagggtggggggaggaggtatcagagaaagtaaaagcacatgttggggaggcagagtagaaacacgagaaacctgatcgggtgtaaaggcctttggcaagaggatgaatagcccccacggggagggag

SEQ ID NO: 27498 - DNA, 201 bp, Bos taurus
cttcctctccagattttccagcatagcaactgtctcctccccactctctggacttctgtatccagtcctgcagttcctcaggcagtatggttgagctgtgccagcaccaccaagtccaacgtctgctccttggtgggtatctcaggccttaaccactcatagcagaatacccagagctggcacaagaccgcaaagggccaa

SEQ ID NO: 27499 - DNA, 201 bp, Bos taurus
ggacatttcagtctagaccccgaaatgaaagctcacgcagcagggaaacggttcaaacggttcaaactttggatttacaggaaaccttttttccgaatccttgttttatccccccgggtgcaacgcagatacatcaagtctataagaactagaatatgacagtaacttaacttatacaacaactctttctcttgtttcctt

SEQ ID NO: 27500 - DNA, 201 bp, Bos taurus
ctaaaagataaataaataaaatgaaattttagcattagagtcccaagagagtggtagtattctaataaataaaagggaatgctgaagcttgccccaaggacagacatcacaatgatttccttgcctaactgcattctgccaaaagaaacacatatttagtacacatcttctttatccattcatcacttgatgaacacttag

SEQ ID NO: 27501 - DNA, 201 bp, Bos taurus
gctggtaaatttgcacagcaccaggaaggtaattagttatggtggctgtgtggcccagctgttcatatttctggctttgggggccactgaatgtgttctgctgcccgtcatgtgctttgataggtttgtagctatttgtcggcctctccattactcagtcatcatgcaccaaaggctctgcctccagttggcagctgcatc

SEQ ID NO: 27502 - DNA, 201 bp, Bos taurus
ttttggccactgacctggaggatctttttccctgaccagggagccaatctggttgcacatggatggaagtgcagagtcccactggatgaccagggaattcccagcctgagcacttttatgtaatctggctccctaactgtgtggtggcttcagaatgatcagacatctcatacattccaaagaggagtgccccagaacacc

SEQ ID NO: 27503 - DNA, 201 bp, Bos taurus
aatgtaattaaaggcaagggacaaaatccctgtggactaagaaatttaacttgggggggggggaataaaaggaatttaagcttttttatttattcagccagagctattgtatcttcttggggatcaccagaaggtaagattggaaaaagtttagattacaaaatttctaacacctttttgatttcagtgaggtagaaatgg

SEQ ID NO: 27504 - DNA, 201 bp, Bos taurus
gctgccctggaatttgggagctaaagcccaaaagctcttaccgggtttctctgttcctggaatcagaactgcccagattggataataattgaaatttccactctgtgcctaactagagagtatttctccacgtgcagggttttcaactctggtgtgctacaccacgttaaatattgatatttggggacacttttataaaat

SEQ ID NO: 27505 - DNA, 201 bp, Bos taurus
gataacattttactttgcagaagagcagggtaaaaatgtggctcgatgattatgtggtattttcttcaagagttcagataaaagatcctaagtcatgggccagtggtccacagggccctcgccaacctgcctcattctcagaatcacccaaagactcaaagctggatactgggaaactgttcctctgtgtgagattctgtt

SEQ ID NO: 27506 - DNA, 201 bp, Bos taurus
tgctgatgagagtctagaagggataaggagtgtcgacgcacctgatgaggagcaccggtgcaagtttctgtggcgtgggagatggtctaggaaaaagaagcatctgcacctctgttaccgcgagaccgtaacctcctgtccccctcccccaggatggtggggagcgcataaagagcctcagtctaggagaaggtagctgct

SEQ ID NO: 27507 - DNA, 201 bp, Bos taurus
cataattagggagactatttaaagctccaagatgtacactcaaggtttcaccttctgaaacattttcccttaatgtaggaatagtatctccaggaataccagtgtctggtgttatttataatatgaggaccctgagacagtgtgtccatttccagaaattcagaaaagatggtttactctaggaatcagtacctaagtaaa

SEQ ID NO: 27508 - DNA, 201 bp, Bos taurus
tatggccaatcttttcttctacccacttcccatcccaaaccacattttcattgcttcagagaaagaaaggtattagtggcagacagtttgcaccagcaggtggtcttcctctgggtttttaggcctgaagcttatgggactctgaatgttcacattctctgcttcaccttatggaagcttgtgttctgatggcctctgcta

SEQ ID NO: 27509 - DNA, 201 bp, Bos taurus
gttccaactacagttatccccaagttttatcccacaaaatacagcatgaaaaaaaaccacagcataaatattattcaagtaaaatgctatctatcatagctgcatacgaataattaaagctctgggcttcaacctgcagagaaggcagtcatgtggaacagttaaagttaatgatctaagtttacaataaaacagatttat

SEQ ID NO: 27510 - DNA, 201 bp, Bos taurus
gagaaaggaaatctccctgcctcaacatcccccacagtctctccccctctgacaccccccacccccaattctctacttctgcctatgtcagttaatggatatatctccctattcaggccccaaacctggagggtggttctgggcttgtctcttcccttgcccaaagcccccgattttttcccccagttctcttcactcccc

SEQ ID NO: 27511 - DNA, 201 bp, Bos taurus
tcctgcttcatggcagaagagagaacattttgaaggaaatcaaaaggttcgagtttttattccttggatgttatctgttagtgtgtgaccttgaaaaagcaccttccatgctgagtctcagtttccatgtctgcaacatagccatatctaaattaattactatttaatagtaataattaacgcaggcctggctgctatact

SEQ ID NO: 27512 - DNA, 201 bp, Bos taurus
catgtcccctgcattggcaggtggagtcctaaacactgaaccaccagagcagtccctgctatttattctttatgtggccatcagagccaaaataaatacatgacttggtcattccagccccaaatgagacatttgaacaattgactcagtttgtccctctctttaaccagcaggtcatagactcttatttagaaacatcca

SEQ ID NO: 27513 - DNA, 201 bp, Bos taurus
aggctgaagattctcaagcctgtgagttcccactccacagtgttggggtttgagggtggaaagcttgtgtgaagaaggaaaggaaaggaagggtatctgcatcttggccaactggacctatcttaaattccagggaagctcagccaaaagcttgacagcagtgagtccaaccaggcaatttatgcaatgttgaattccaag

SEQ ID NO: 27514 - DNA, 201 bp, Bos taurus
ataacaccagaaatatatgttctttgaaaatttaaaaattatcagctttgaggtcatctagaccttgtgctattcttgaacatagctctttagaatatttttgtgtgtgtgtgtgtgcatgtttgttttaaagcaaattttatcatttataacttccttagatatatcctatttatccaaattttcaaaaagaagtgcatc

SEQ ID NO: 27515 - DNA, 201 bp, Bos taurus
gtttggctgaattttaaaatgataaaaacatgcctgatatctagcctgtatgaacattgcttcatttagaaatctgtcatcttttaaagtatttataatattcattaaggtgaaagggaagggaagagagagaaaagtttttaagcatccaagagttcaaacaattattttaggattaattagtaggcttatgagattcct

SEQ ID NO: 27516 - DNA, 201 bp, Bos taurus
aaaaatttcttcttcagttttggagctgtattattttgaattggcattattgagatatgattcatatataataaaatgcaaaatttttaagagtataatagcatgtttggacaaatacatataaccaagtaaccaatatcagaataatgaatgatatggaacatttccatcaacccaaaaggtatcctgtgcccctttgga

SEQ ID NO: 27517 - DNA, 201 bp, Bos taurus
gcctcattccttgcatgtggtcaaggtctatttcatttcctgtatctctcacatcctttgctacttttcacttggcagagccctctttgatttttagtgtaataatattctttctggtctctttctctttctctaccagccccaacagccacaactcctcaatccacattgaagtttctcttttctaattctggacattct

SEQ ID NO: 27518 - DNA, 201 bp, Bos taurus
aatggcatctcacttctcagataaatgtgtttttgaatccagctttctgatctactcagtgtctacgtgaccagttggacaattgtccagaatccccaggtgggggacagatacacaccagtatttctgccattcaattgatcagagtgtttatgatacatggggttcctgtgggtcagttagtaggcagctgactgtggg

SEQ ID NO: 27519 - DNA, 201 bp, Bos taurus
cacaatcctaacattatttaaaatattttcacatacatcttctcttaaatacaatctgttctcttactaaaactttgttaataatatcaacattctttccgtctgctcagcatcttaataatggagatgataaaatgaaggaagaaggtcaaggagaaggaggatgtttttaatgaatttaaaataaatttaaaatttact

SEQ ID NO: 27520 - DNA, 201 bp, Bos taurus
cattctctttactcaaaaatagtgaagtaaacaaaatataggcacaaaggagaaaatattcacatatctcattaacccacttgcacaaatataagtggaaacctggggaaaccctcaagagttcaccttgtcttgcctcttgccctctgtgaaggcactatactgagtcaattgtcagtaactgcaattaatgggaaaata

SEQ ID NO: 27521 - DNA, 201 bp, Bos taurus
aagtatatactatgataccaggtactgcatggcaactataaatgtaggccaaaaaaataactgtgtgtagatcacagctatttagctgaaaaaataattttgtaaaagtcaactaaaagtaaggcctctgatagtgttgtgaaaggatttgatttctcccttttcaatttttaaaatcctttagaccaattttcttcaaca

SEQ ID NO: 27522 - DNA, 201 bp, Bos taurus
aaacgtatgtcaagtaagtaccaatataatcgctaaatcatttgcatgcatagacacacacagactttttctaatgttatcataaagcatgttgaacatgcaaagaaaaaaaaaagcagtcctatccttaaactgttgtgtaatctaaagatacaattatattgtacctagaagaatgacaaacacccataaaatgggtac

SEQ ID NO: 27523 - DNA, 201 bp, Bos taurus
cagttgtgtctgactcttcgcaaccccatggactgtagcccactgggctcctctgtttatggggttttccaggcaagaatatgagattatgtagctattcccttctccagggactcttccagacccagggatcgaacccgggtctcctgcattgcaggtggattttttgccatctgagctagaccgtaaaacaagagatgt

SEQ ID NO: 27524 - DNA, 201 bp, Bos taurus
cccacctcttggcccccatgatcagaatccaggctcttacagacagataatctagcaagatggctcgaggtcaactaccagtctcggtgttcaccttgaagaattctcgtatcctctgcaagtttaacaggaaataacataagctgctccaggggcaacccctctccctccttgcctctcgggttctcccctttccaaccc

SEQ ID NO: 27525 - DNA, 201 bp, Bos taurus
taaattaattctcttctgcaaatcttagaaagccactgccaccaaatgtctggtgtcaaaaaatcaagcctgtgttatgagacacagtactcaactgtgacggaagagcggctgaaactaagcaatatcccttgcacactttagaaatatagcttttccacgctatattttcattgcaggttccaagtcgcatatggaatt

SEQ ID NO: 27526 - DNA, 201 bp, Bos taurus
tcctataaaccaagaaaaattggtatttggaaatgtctttagtttgctgttatttgtgaaggatacttttgctaaatatagaaatcttggttgacagtttcgttctctgagtaccgaatgcatcactccactgtctttgacctctgttgcttctgatgagaagtcaaccattaatctttttgttctctcacacatagtatt

SEQ ID NO: 27527 - DNA, 201 bp, Bos taurus
ttaataaagctaggtccttcaggaggtagagagagtaagatccaaaacaccagtagagacacaagcccagaatgggagaggggccaagtcatcctgttcttaaatagggggttaggagggaagcatgaaaacagatgctattattcttgtagaagccagagaatactaagcaagattcccatctgttggcctcaatttcct

SEQ ID NO: 27528 - DNA, 201 bp, Bos taurus
cagctggcctgagagagaaaccctcccttaaagggcgagggagctctgtcccaggctgcagagccgtcatgggcagagatttcttctctattttcacccatgcagtcacctcctcttggccgatttctagaactcagctcggcttcccagcaggagccccaccagagcgcttgctccctgagggtagaccctgatctttca

SEQ ID NO: 27529 - DNA, 201 bp, Bos taurus
aataaacttaaaaatccaggaagtgtgttcaggaacttggaagggagtggactggaagtttggtgacaaacaggtctggatcagaggcctatggttgggcatgtgaaaatgctatacccatcagaaagtatgggtcatgggagatgcatctagccagttgacatgagcaaggcccctgtcattggccattcaggaactggg

SEQ ID NO: 27530 - DNA, 201 bp, Bos taurus
ggcctgccactgaacatcgcccctgttggtggtgcctccaggctgtacccttgggtttctgatttgaaccatctgctctccaccctagggcttgaccccagctcaggatgcatttggcaggccagaaaacgtcggtcctgcagagagccactttcatttatttctttggcctcactggttcctgcaaggccagatctcctc

SEQ ID NO: 27531 - DNA, 201 bp, Bos taurus
ggaataggaggggaagatggtggtacttgctgccatgtggacctaacccactgcagagctgcctgttattcaggatttatctagagagttcatgaagtaccgatgctgtttacttcccaggccactctgttgggcaaaaatcacaggtgttcacttactttatatgaacccactggaacagaatacagtacctcctgggat

SEQ ID NO: 27532 - DNA, 201 bp, Bos taurus
taggtaaatccaatttgggcaggaaggagctctggttctgggatagctgagaaagagatcagcagcctgtgaagctggctcaagatctggcaggaaaaggggatagggccccattctcagaagatctgactcttccctgtaccatcacacacagtcctcagatcacacacctgggtatcacctggggaagagaagtgggca

SEQ ID NO: 27533 - DNA, 201 bp, Bos taurus
atactgagactgtccagtctcctccttttgcaacgaagtattgaaattcacacttcggtcccagtagtcctgcttgggccccatcctgcagaaaagtctgttaattaaagacgttcctgtgttagatttctaatgggaaagctgtccttcagtggctcaaaacaaaactgcacagtgaacttttatagggccttgtgtgta

SEQ ID NO: 27534 - DNA, 201 bp, Bos taurus
caaacaactgtggattcatgatgaataattatcctctttctgattgatcctcaataattcaggtgtgccaacgttagccttcttatgtctctgcacgcttcgagtagctaatgaatacagttctggacagagatggcgataagaaatgtttctcccaagtcatcctgggttttctccctggaccaaaggaaagaaatactt

SEQ ID NO: 27535 - DNA, 201 bp, Bos taurus
tttgtttatccaacccagtatcaacatatcaacagagagccaaatgagcatactttagcattttgcttttgtgtaagaatttgtactccctccatcgttccgtttagttaagaatctattcatgtgccacctctgtgctgttgagagtgcagtgaatagatacgggtctctaccttcaagtggctttcagtctatggggga

SEQ ID NO: 27536 - DNA, 201 bp, Bos taurus
catccttccacttcaattcaaactcagaatttccattctcagtatttcagatgagggctcactttgaaacatatattgaatggccactgtatgctacatttttattggacagggggacaataaaagtgaatttagcatgattattcctttaaggaattcacagtgcagcaggcaaaatggccataaaaataatatgaaaat

SEQ ID NO: 27537 - DNA, 201 bp, Bos taurus
aacgccagatttggtttccaatgagcagaaaggaaaaatatcttactaactgaaataaagttggcaagaaaattttgaagactcctgtaatatccctcgtatctctgtctaaatcatttttaataggaaattttttatccccagcgtatgacaagggctcccaagaatggtgatttgtctctcagactaagagtgtgaatc

SEQ ID NO: 27538 - DNA, 201 bp, Bos taurus
aagaatggatagacagctagaaaggttagcagatcatgcagaatcttctaggccatgcttgaaagtcgaactttattccacaaacaatagcgaggcattgaaaagataatgacaagattagatttttgcttaagaaagactacttcctgcaggcaggaaaaaaaataaagaggacaagaaagataggaatgagagaaaaca

SEQ ID NO: 27539 - DNA, 201 bp, Bos taurus
atctttcccccacttttgtatctgttccctggacttcgtcagcggatgacctcagtgccaatgagcagctcgtgggcccccacgcatcaggcgtgaactctatcctccccaaggagcacggcagccagtttttctacctgcccatcataaagcacagtgacgaggaggtaatgggccttaaagagtctcttaaagggcttc

SEQ ID NO: 27540 - DNA, 201 bp, Bos taurus
gcagtgccgtgatagcaatgggatgacagatcttctctgggagactgatttctttcggatgagtcatccccaccctccactgccagattactatgcccacagcaggacctctcttagccaggtgtgcctggctaagttacgttttatcccatccttccctggttcactgcttccttgtacagttaggaccagagggaatga

SEQ ID NO: 27541 - DNA, 201 bp, Bos taurus
gtgaacaggtggtagtgttttatacgcctttgtatggccaggttactttgagatcctggccttgagttctggtgacagtggcctttgggaagttcaagagtagaacaagagaagtcaaacccatgtcaacagaaaggaaattaaactttcagttaggcttggaaactcatgtgggccctttacaatctatttagaccttac

SEQ ID NO: 27542 - DNA, 201 bp, Bos taurus
ccctatggggcctgactgcactgatatttttttaaagagcaactgccacccatgggatttcgtttctgctttactagtgcagtagtgatgtctccagggcatcgtggtgggcaggcggcccttgctggcatcgctccgcactggttggggggcggcgctgggcagcaggggtgggggaaagtgaacaccccctccagtctc

SEQ ID NO: 27543 - DNA, 201 bp, Bos taurus
gccccctggatgtttcaccatcacgtgtcaggattcagggaagcacgtgtagtcgcataccaccaccaaaccacagtgctccactgtggaaaggctccagtggccagccccggcgcctgtgtgcgcatcagaatcacgcacgatgattcccaaaatacacatgctcaatccgccccaacctcctaaatcagaacctttgtg

SEQ ID NO: 27544 - DNA, 201 bp, Bos taurus
aagaaacaaatgcataaacacattactgctacattaaggcaatatggaaagtatactcagaaatctcagtaaagtgacagtgtaggtttctagctttaacgtagctagtattgcacccagtaaggtcatctaggtttcccaacatcctagaaaacccacaagctgaccagcgtccaaaattcccaagtgggagtggaaaaa

SEQ ID NO: 27545 - DNA, 201 bp, Bos taurus
ctctcacggaactcctagtttggccttaaagagccatcaacttgacccatgctaaaacacaggcttttgaccctcgcaggatggccagtgaagccaagaagtaggagccatgtgtatagatatacagattgtacacctatgggcttctctaagaagcagccagccctgaacagtgagaagcagaacagagtgtctctgagt

SEQ ID NO: 27546 - DNA, 201 bp, Bos taurus
tttgtacacctctcttttatgctttatttttttagggcccactccaagatgttcagccctttcggtaacattccttctgccttctcttggtggcaaaacagcaagagagacaagggctacaccagatgagctgcagagaggttttttttcagcaactgaaagtttctgggggacatatattcaactgtaagtaatcatgtg

SEQ ID NO: 27547 - DNA, 201 bp, Bos taurus
ctgggcctctgacatgttacacctacagcaaagagcatggccttggagactgattccgtgagcaattctctgtttataaggaaggcaaatccactcaatcaagggagaatgaaggggacttgtgggaaggatacagagaccctccctgaacccaagggcaggaagcagagccgagcctccggaaaacggacatcacagggc

SEQ ID NO: 27548 - DNA, 201 bp, Bos taurus
atcattaggatatcaacatcagattaatcaagacactctgtttccctatactggttaatgaagtgtaaagtattttgtgaagttgtgttttaaaaatgtttgagatataaaaatatactcaagataatttgaaatatattttaatgttggtacattttgcttcaagaaagtttaataaaatttttaaataaatgcaaaata

SEQ ID NO: 27549 - DNA, 201 bp, Bos taurus
aggttcatgtgtcagtatgtacttgttcatataataagtgtatgcacatatgtgtacatacacaatatacacgcacatgtacagacagacacatgagagatgggagagaggccctcatgcagggtggtccagcaggaggagtcaggcactttacaagcaatggccatcattaccacagggacagagtttagactggtgagg

SEQ ID NO: 27550 - DNA, 201 bp, Bos taurus
atgaaaagcaatgcaaaagccacacaatgatcatgtctccccggaggaagaccgcaggtcctctgccagccaaaggcagggtttgcctttcacacctctgaagcgacagcccaggactgagtaagagaactcagcaacttacaggaagctaacaagcctcgaaccactctccctccccagaagaacttctcagccgcctta

SEQ ID NO: 27551 - DNA, 201 bp, Bos taurus
ttagtgtaatcggagaatgtctctttgtcccattttcactgacctcctcccaatatacacacatcgtgaggactgaaacacttctgaaaaatgctcaccaaccacataaataatcagggaaggtaaaatggaatctgcaggcttaaaaggttaaactacttacaagaatgcttcgttgcttaataaccatttctctcatga

SEQ ID NO: 27552 - DNA, 201 bp, Bos taurus
tatctctgggggtgcctcacctgttatctctggtggtgtctgctttctgagcatcactacctccagggttgctgtcttgctgtgactgccagggtcaggtcgggccacctcgggctggtcccctggaacctcagcaatctcttgctgctgctgctctcctgcgccactgtgtcataccatcgcctagaatcttcggggctt

SEQ ID NO: 27553 - DNA, 201 bp, Bos taurus
ggtcgtcaacttttccagatactattgcagaagtgtcacgggccttgctccttgtctctactatcgttgtcaaagcctcggctcagattgtcctcaaatcctagtagggctgcttcagagtctgttagctggtacgctcgacactcatctctctcgacttcagtctaccgctgacacactgctcctgagagcagggctggt

SEQ ID NO: 27554 - DNA, 201 bp, Bos taurus
ttaggggccaaattaaaaaaaacagcacgcttattcaaaatcagatgaatgtcagtgggatgtttgtcaaacaaacttgtcagtatttgtcacagtttgaggaagtatcgaccaggggccacacttgagcctggaacggagttatgtatagctgcccagttatgattttaactaatgcagggccaggggtctgagggtata

SEQ ID NO: 27555 - DNA, 201 bp, Bos taurus
atctttctatcatggaataatgatagatacgaaataacatctatcgtgtgtcgagtgtttcactgttttcagaatcacctcttattcattatctcagtggatcagcacaattgctccaggcggtagcaagttcatgtttcaatagccccatttttatggctcagaaagtaaacgacgggcccaaatcacatattaagtgag

SEQ ID NO: 27556 - DNA, 201 bp, Bos taurus
acagaagaacaggagaattcggaaggcaatcttccaagattatggaagtcctgatcactagcgtgtgggctgactcgtaaccagacggctctgagcctggcggtctgtttattacttccatttagtcatcttgatagttgtctcatcagcctgattaggctccaggcttacttctgttttctcatcacccctactcttgct

SEQ ID NO: 27557 - DNA, 201 bp, Bos taurus
ccaggccatctccttcttggctcagcaggtaccgtgacacgtgaccacagccttagattcacagaggaaaacgtcccgctgcttttttctgagtccacaatccacgtgctctgtagcatggcctggttccaacttcactccatgcacactcctctcctccctccactccctgcaaattggaaatagtgatacacagccacc

SEQ ID NO: 27558 - DNA, 201 bp, Bos taurus
tgacataggtcacaatatgctatgaagaaataattcttgctttattcttgaagaaatcattctggctttaggttttgttcctttttattaaaataagggggaaaaaacgaagtaccattacaattgacgcctttatttctacacttgatatcagttaattaaaaagcaaagtttgctgcattccttgacataaagaagcca

SEQ ID NO: 27559 - DNA, 201 bp, Bos taurus
gttacctgatagaggtttacaggaacatcgagacctgacctgcatggacaactgcaggaacaaaggatcctacaccaagaagttttccacaacgagccgcgtccctccctcaccttccctctaaaagcgctttttaaggtatgagccacctgtctctttgcatggccctgcaataaacctttctctgcttcaaacactacg

SEQ ID NO: 27560 - DNA, 201 bp, Bos taurus
cttaatttcaaatacattttaacaacccagcggttttactcccctctcccacatttgctgttttttgcatcatattttacaacttttgtgtccccttaacgacttattgcaaatatagatgattttactcctaaccctaacacttcttttaatcttcctgctagttttatatgtggttgattcactgactttactataagt

SEQ ID NO: 27561 - DNA, 201 bp, Bos taurus
cttattgtcttattgaggatttagtcacttctcaactattaaaaaatggtatgaaaacatctcttctaaaggtccctggattggtacccaggttcccgaggagagactgagggggcggagggagacctccgaaggacacccacccatctctctcggctcccagcgaggaacgaaggaatggttcagttcccaaacgtccct

SEQ ID NO: 27562 - DNA, 201 bp, Bos taurus
aaattaagtatcaaaactacttttttaggtcctttttttctccttccaagatctgggagccactgtcctcgggcagcttgctaagttctttatctttaggtcactctttcaatgttcatcccatgagttgtttcttgagaggcctaaccgtcacacttctggcttctaaaggagtctgttcattaaacaagtgaaacaaac

SEQ ID NO: 27563 - DNA, 201 bp, Bos taurus
aggcctggatctctgggggtcttccctgcgcatctatcaaagatcccctcctaatagaccaggtgggctgggctccctttcagggcataactgggatggactggctttatcagacagcggggcctgtctgggaggaggtggcttttcattctctttagcaaagcaggagacaaaacactgatggatgcatgattttaacac

SEQ ID NO: 27564 - DNA, 201 bp, Bos taurus
tggccaaaaaataaacaaataaataaaattattctttaaaaaagaactttcgctcttcatcgaaaagaagaacaatagatctcttagacgtgccaataaccggccagcttcatgatcgatgcattgaggactctgatgtttttgtctcacaccctgcagcttgggatgaggaagtaatttcttagtgtgattcttcatata

SEQ ID NO: 27565 - DNA, 201 bp, Bos taurus
atatttactcagagccggattcataccctacttaactccataggaattcgcaacagttggtcttgacaactccagcagttctgagcttcattaacctatttgcaggtgctctgctttccaagctgcctgtgctcagagaaaaaaaaaacaaaaaacaacactttcaaaattctctgacacagcctgccgcctcagttcagg

SEQ ID NO: 27566 - DNA, 201 bp, Bos taurus
tctctttaacaccatcaaagacccaaaaactttgtaaaagctgttctgtgttattacaacagttgcgagtcaataggcctgccgtgaaacaatcactgtttccgagaacagaaaaaaagtcacctcctcagcacttcaagtagctcattggcgaagagggctcgtggtttgaggtcagccttgaagacaagtggctaggct

SEQ ID NO: 27567 - DNA, 201 bp, Bos taurus
ctgaatgataaaacatactggagacagacgagggtagggggtggagaacagctcatggttctcaggcctggcttggttctcaggcccggcaacctctgggttggctactgccaagaaatactgagagaagatgctccggattacaacgtgggctggggccagggtggcttttgtgggggaggggaggctgcttatagaccc

SEQ ID NO: 27568 - DNA, 201 bp, Bos taurus
acaaaacttcaccttgtcaagaaaccacatccttgactgagttaaattaggcaccaattaagcaacagggctatctttccataccccagcacaaggccaagcgtccttttgatgatctgttaataaggaagactggaaaacaaagagccctgtgtgactgatccattcattccccaggccccacggctgtgggagtcagcc

SEQ ID NO: 27569 - DNA, 201 bp, Bos taurus
aaagatcttttagggtgtttaggacagacagaagggaactttgagggaggcaaggaaaagcaccatctgaacttggagaaggatgtttatgctgtttatcaaaggacttttccctttgaaactgacatggagaagggaagagctgatatggtcaaaggatgcctgataattaagaaccaggctcccgcactctatcctaaa

SEQ ID NO: 27570 - DNA, 201 bp, Bos taurus
tcactccctccatggtcagttgaatgggctccagaaaagaatgtgttttctggaatattagggaatatggtagtgaagagttctaaccttgaggctatttctccaagttaaaatggtcttgaagattcccattaagctcgaaggttgggaactgggtgggtttctcctcttacattatgagacataagcgggtggctcctg

SEQ ID NO: 27571 - DNA, 201 bp, Bos taurus
tgctgtggcaatatcccggtcaatagtcttatcatcttgctttctaaatacagcaagttctttatgtatgtaccttcaagttgagaagcttcaaagctgcaaacgtgtgtttgcatgactgatcacgtaagttagttcacatttctggtgtatatcatcgcgtgtgtgtatctctccaggtggctgtgcttttgtgtactt

SEQ ID NO: 27572 - DNA, 201 bp, Bos taurus
cttagctcaggaaggaatcacggcgattagaggctgtgggcgctggggagccggtgtgcgcctgttggacggctgggatgctgactcacgtgtgaaagaaccaggactgactccaagcccgcggcgtggcagcctcggtcccgcaggggttcggctccccctggccaacggcacggcctgcagtcaacagcaggccccttt

SEQ ID NO: 27573 - DNA, 201 bp, Bos taurus
cacttacaaaagattatagagaatagacagaaaaataacgttctattcttctttgtcctgacatgccctggactttgcttttttttttttttaataagctaatgagctgtattcattttctgtgaggaacagagtcattattctcaccaccccaagaagattttgctttctctatcttcaagaagagaataggcatgtgtg

SEQ ID NO: 27574 - DNA, 201 bp, Bos taurus
tgactcaaatatcataattataaaaaagatgaggggagaacagtcacgctctccatgtctgcactgattatatttggccattgcatgcaactcctagaagagaatacagtgtctagaatggaactcaaccatcagccccatctcatcaaaatgttagtattataactgaattcaaggattaacttcaacaacaaattttga

SEQ ID NO: 27575 - DNA, 201 bp, Bos taurus
ctaagtttccagtattctttgtgcttgcatacctccttacccctctcctgaagtacacttccccaatctcccttcatggacaactcttcattttttttcaatgcagctcaaaacatttattagcttcaaagccttctttgaaccatctgaatttccccacagataatttgtagctcccttctctgtgtctataatatttta

SEQ ID NO: 27576 - DNA, 201 bp, Bos taurus
ttcttgtgaaatcttatcatgaaaaaagataagtcaataattgaatccaattaatgtaccacatatttattatggtagagtacccagcccatagcaaactcgcaggaatcatgggttgaatgatggaggaaataaattgatggatttattaatcaataaaaacctaaccaaggaacaaaactatcagatacgtatataaca

SEQ ID NO: 27577 - DNA, 201 bp, Bos taurus
gtacaggctgggtgggagaataagagagggaaatgttacgaaagagcaaacctctacctgagtgtatgaagaagttattcttgcctggccaagaggcaagaataactttgaataacgtggaaccattaggtggcagttccactgaccctttccctctaaggccttcctgtttcagacatcaggtccaagtctcattttaca

SEQ ID NO: 27578 - DNA, 201 bp, Bos taurus
cttcatctgagacttcttacacaaaacttcctacttggtttcccccacaaagcatcacctaagactacttgtgtgtggccaggtcacttgggaaggtgatcctagttagaaagaggataaggagaaacatacagaacatgatacaagcgtgtattactgaagttggtgctgtaagcaatcgaagctccatttccccaggac

SEQ ID NO: 27579 - DNA, 201 bp, Bos taurus
tgacactaacttacactcattgggcatcttctgttggatttccaactgatagatttgcaatgatatgtcttttctgaaacctaaccgcttctttttaaccgatggtatatgtttgttggaaattgtaccaaatttactacctgcgtttgtgtgtgtgtttgtgctcagtcgtgtctgactctgcgacctcatggactgtag

SEQ ID NO: 27580 - DNA, 201 bp, Bos taurus
taacaagagcttcaggctgaaattacatctatgtgattaagtccaacatgataacaggtttttatggacttgtttacacagtaccacataggcatgtgttccgagaccctatccgacctgtcctcagtggacatttctagcctcagtagattctagcaatctgttcactgctgtgttttagccaaagcgctggggagtatc

SEQ ID NO: 27581 - DNA, 201 bp, Bos taurus
aaagctgctgctgctcctgccgccccaccccctatgtctccttcagagaccactcttaggagaggcccccccagggcccactcgggcggagaccctgtggcgatccagaaggtgtctgtgcccctgctatgctctgcaagccctgagctctcaccggccccaggttggcacacctctctccccagctcaggcggaaaagcc

SEQ ID NO: 27582 - DNA, 201 bp, Bos taurus
aatgacatagggaaaccaggtccgagcaggcggaccgagccacgcccgcagagctgtggacagccgccctgcaacgggacacacgtgaaggaccctcacaagctgtttgctcccggacctcgcggtgctcacactccattttctcgacatggcctgtgacggaaggactgtccatgtgtcagaagcaaacagctcggcaac

SEQ ID NO: 27583 - DNA, 201 bp, Bos taurus
ttcatttttaatatcgtttcctcaaaccatgaagaatatctacagggtcttcagtcagcttcctgttctgatgtaaccatttcgtgtttctttaattttcacattttccgtggcaagagcaacttttaaagtgatcagcttttttgattttcgtaaatgtttttttttttttccctgtgggtaagcaggggatgtttttct

SEQ ID NO: 27584 - DNA, 201 bp, Bos taurus
tgaaagctgagtcttgaacgaagcacctctatcctaatgcaaactgccttgcaatgttactaatcataaaaggccgatgaagttctgattttgaagatctataacccacttacaagatacagaactaggcaggatctatttgggggtttggtttggttttctttctggagggggaggccttgggtgttaggggagaacacc

SEQ ID NO: 27585 - DNA, 201 bp, Bos taurus
gggtcaccatggtccaagcagaccccaggccaactcagggttggttttatgagggcatctaatgccttgttggatattatatctctgtttgttgttgttcagtcgctcagtcatgtccagctctttgcaatcccatggactgcaacacgccaggcttccctgtgtttcactatttcccggagtttgctcagactcatgtcc

SEQ ID NO: 27586 - DNA, 201 bp, Bos taurus
gacggtcccgtcaagagagcttcagagatgagcgacagggaggttcgagggcacacaagtggctattgggcaagacgctggatcgctgaggaactgccctcgggttcccaagaggctgcagtgtagctgggagtgtctgcagggctcagacgactagacccggccgagagggcggcgaactcgggattccactcgtatctg

SEQ ID NO: 27587 - DNA, 201 bp, Bos taurus
ttccccgattctctgaaaactagtctcctcagaaatcaggcaaacaaattcacttcaaaataacagctccatttcaaaatccatactattgtgttaatgccaacataccgtggtgctttgggaaatgtgttttctggctgcttatgtcattcttcccttgaaagacgggggagaggcattccttcactgcaaattcttcat

SEQ ID NO: 27588 - DNA, 201 bp, Bos taurus
tagcaacttggcttatagcaggtacagttgaaaatcacagattctgttcagctgtttccagaacctagttctaccacttactgggcatttgatcttggccgtttttattatcattacctctgagtttagtttgtgcgtattaaatcggataatgcgcatcccatcccgagcacggtctcctgtgcctggtccccgggccgt

SEQ ID NO: 27589 - DNA, 201 bp, Bos taurus
gaatgtcacgccaggtcctgttcacgtggagatgtgaggaaggtcgacgtgctttcaggaccatcaggggtgagggccctgcttctaggataccagactgcgctccctgaggggaaggggctggtaagggcgaggaggaaagagcctggaggccagcggatgggcgaccaggggcctgcccacagcgccctcaggccagac

SEQ ID NO: 27590 - DNA, 201 bp, Bos taurus
cattcaggcctaaaatcctcaccaacagtcttatgtagaaaccaaaacccctcctgccctggtgctatgtactctcccagctgtatgtctcagcctctacttccgggccttttccaaacaccactttctttcttagaaagaatggaggcttgagaacaggagatcttttttcccccccttttaggaccctaaatggggctt

SEQ ID NO: 27591 - DNA, 201 bp, Bos taurus
gagcatccatgctcttaacttggcacgtagaggcggctcctccatccgcccatcaaggtctcgtgtgacctggtcctgtgtctgctgagacactacatagccctccaggccaaagcctcctctgcctcaaaacctcccctctgtcgcgtctttccctggagccccgtgccctccgagcccgtcttgcggcccctgcagcac

SEQ ID NO: 27592 - DNA, 201 bp, Bos taurus
ttggatataaagtagagtaatacacgttaaggcaaaagaagcctagtaaacacactcagaggtaaggggactggactgtgatgactcagtcctgaggtgcggagccgtggtctgaactgaagcttctccaagctgcacgcttccttcttcttgtgctgtttcccacagaaaagttgtttgtttagcatctctccatagtgc

SEQ ID NO: 27593 - DNA, 201 bp, Bos taurus
aatgaggagcattcttcctgctcctgcctttgaaaaaggaccgcaaaggagtgaggaccaagactcctggttaggacaaagtcgtgcaggccaaccctgtggtccaggtggtgagagcaagtttccccgcggctggggaggacacgggtgctctggagccctggggcacccaaagtgggtgtctccagcagtctcccgggt

SEQ ID NO: 27594 - DNA, 201 bp, Bos taurus
aatgtgctgtctgctgcccactgctctgtctttcagaaggaccaggacttgagcacgtttcacaactgaatctttgggtgtggctgctgcagtttctctggaagtactgctgggccatgagatctgaaaagcttgtaaatactgtggatcgctaaccagatatgctctgtgtcacctggattacttctgttgtttgtggga

SEQ ID NO: 27595 - DNA, 201 bp, Bos taurus
tgttcagggacctcagcaaccagcacccagagaaaagtgtgccccgagtccggagacatgctttcacgactgaagcttcaatgatcaatgccctcaggccactctgggctcctcagtgccagcgtgggtggctttcccaccccagctccaccctcaagccatgtaacctggcccaagtgggtccctgtccgtgtccaggct

SEQ ID NO: 27596 - DNA, 201 bp, Bos taurus
gaggaagcctgtgatacaagggggaggccatccaggtgggatcataaagcggagtacccagctgtctcctgatagcactgcctgtggggccctctcaacgcgtgtccttgcagacaaaaccaggaaccccttcatgactacactccctggaggcagcccatggaagagccatgtcgctgtgtcattaaaagtgaggttcta

SEQ ID NO: 27597 - DNA, 201 bp, Bos taurus
aagcaaaatttaaagtaataaaaacatctggacccctctaactgttatccatcactcctaacgtggccctcccccacctcccttcccctgcagccttgactcttcattgctgtccctcaggccctccatctgacacgggggcctcctgggaagcctgtctggctccggctgtcacacactagagtcattgtcctggcactc

SEQ ID NO: 27598 - DNA, 201 bp, Bos taurus
atgctaaaatcatcccaaatgttaacatttcttttctcaagcaggtcacagcttggaactaacgacattcgtgtgtgacttctttggacggccctcgcgtcgtccagataagaaccttgacgtgcatcgacggacacaccactgcctccgtaaaacactgcccaacacttctggtatcttcttcagctcatccggccccac

SEQ ID NO: 27599 - DNA, 201 bp, Bos taurus
gaggggtcaaaggccagactccaggccagactcgtacaaaggccttgtgcacacccctcggggtcgcagcagcttcagctggaggggtcctggtgggtgtcggcttcattctggcctgtttggttttgtctccttagttgcaacatttcagatagtgtttcaatcaacactgaagtgagaaaacacccacatttgggtctt

SEQ ID NO: 27600 - DNA, 201 bp, Bos taurus
ttttcatctataaatctaactcttatatcccatggtggtctcctgcagctctgacgaattctgtccgagtttggagcctgcatcctggcccctctgtagaacagactctcacttcccaggttttctatttttctgcccaggagcccgggttctgcacccaaggccagtcccaaggaaagacaagcttgtgtgcagcagggc

SEQ ID NO: 27601 - DNA, 201 bp, Bos taurus
gtgatgagggtggtttcgttgccccttgagaagcagcggccctcattagttaatacgcctcttcccattaaagggacgggacggtcaggcacaaaaaggaatgtggaaacagctggccgttgacgttgcacagaaggggccgcaagacagcgtgtccccgcctcgccctgccgccccatcacataccccttacggttgcta

SEQ ID NO: 27602 - DNA, 201 bp, Bos taurus
ttgtgcctcttcctcttcctggccttcttggtctctcaggtcagtgatgtttgatgcagagagattcacgactgttacctcgtaatcattgttctacttacttcttctgcctgaggcctgctttgtcttgtattaacattgctgctccctctcttttgtttttatctgctggatatataccagatcgggttattttgagag

SEQ ID NO: 27603 - DNA, 201 bp, Bos taurus
cccagcagaacacccgaaggagccgtgaagcctggcttcatctgatattatcatggaaccctcgctcttcaagagccacaaggaccattcgtgatgatataatttaatcacgtctcgtcttctcctgccgtgaatcacctgctggacacgtccgtccaccgtgactgcctggttctcagaatgtctgagacggagcatcac

SEQ ID NO: 27604 - DNA, 201 bp, Bos taurus
agtttgagtatagttttcagtataatttaagatgaaattcaaattggctatttgaaaaatgcctggaacgcctctgggaatacagtttgcctgccagtcacctagattccaggacttgcctcaatattaactgacatggtttgctaagtaggcccaggatctgcatatttaaggaaatcaattatacaagtcaactaatga

SEQ ID NO: 27605 - DNA, 201 bp, Bos taurus
ggtgagatggacaggccagcaacccatgagcagacttgggacgtgggtccgtttctgctgtttttgtgatccttcgtaagtgcccagtctaacaccctcatgtgtgattggtttccaggccttggtggccccactgaaccactccagtctctggtctggaccgacggggttgcttttccttcctttgtctccctgcctcca

SEQ ID NO: 27606 - DNA, 201 bp, Bos taurus
ggaatccagcgccctggccgctgggtgctggccgcccagccctgcccgctgccccagggcccgcacggcggcccgtttatcttccaggtgttacagtcgcgggccgggccactgctccatcacgctaaacgggcaattatctaccttgtcacttctgcctctgctcttttgacccaggggtcacaggggcccggctgtaac

SEQ ID NO: 27607 - DNA, 201 bp, Bos taurus
agcgccccttccctggcgcccggcgtcgctgacccgcggtccccgggtccaggcagtgccaccacgatcagcccgcgaccgcctctccagccgttcagttccctgggcccgccgcgggatgttccgctggcccgtcccgggcaccacggccgggccccatcgtctctgccgggggagcggccccgcagggaggccagcgac

SEQ ID NO: 27608 - DNA, 201 bp, Bos taurus
aagagggccttgtcaggcgcagtgtcacacccagggcagcatgaggcttttaaaaccctttctgtgagtcagcgacctcacctgtctatcagcgcctcgccgctcagcactgcgcccaggccgctccccgaacctctgcttcctccgagtcatctccccattgtttctccgtgccggtcgggcgagcagagctgaacagca

SEQ ID NO: 27609 - DNA, 201 bp, Bos taurus
agctttgaaacacctacattcccttcttcttgggaactaggtttatgatttggctcttgtgtgcctattatcttttaaccagaaaaaaggaaacaaatgcgctttttggtcctttaacagcttacactgtacgcagagacctgtgtgttgacttggctccaagtgtacactgacttggagctgtggtccaagaacacatca

SEQ ID NO: 27610 - DNA, 201 bp, Bos taurus
ggacatgactgagcacacacacccgtcttctccgggccaaggacgctgacgggcacttagtgggctctgactcagcatttacggaatgagcaggagagggcgggctagaggctcctcagtggcctaggcctgtccctcatttcggccccagcctccccagtgacttgatggtgagtccatctacaggggtccggtgtccca

SEQ ID NO: 27611 - DNA, 201 bp, Bos taurus
tgtttatcactgcatttcctggcatcgagaatgaacagagaaagtttacctattccttctcaaaccctcagcaccttccattcaccctgacgcgtgggacgtgccccgtgctggcctggcgacggtctgtcccggcttcctcaacccacattaggcatttgaactcagaacaagaggaggctcgtcaccagacgcatgttg

SEQ ID NO: 27612 - DNA, 201 bp, Bos taurus
ggcgctgtttccgcaccctacaggtgctgagccctgcggttactctgggaagcttgttctgttgtcttcattttattgatgaaaaagctgaggctcagaaagacgacatgcattccctgagtcacttgcgtagtgagtggcatttgggcctggagatctggctccaagtctgtgctgtaaactgcagacaggctctgctgg

SEQ ID NO: 27613 - DNA, 201 bp, Bos taurus
cctatggcctacatactttcgtcattgcatgtattatctgctgaagtatttattttattgtgtcttaaactgatagctctttggcaccagggtaaattaatgtgctgttgtgcaaaaggccattgtttgaacttactttggacattcctagaggttgatcacagcagaacagggaagcgcagagctgacttcgtggcggct

SEQ ID NO: 27614 - DNA, 201 bp, Bos taurus
ctctgggtcagaactcctggctctgcaggtcctgagccagatgcggcccttgaacttcagaaagagctgctatgtcccgtctccaacacaaagttcatctcaatcaaaaacaagtgaggccactgagccggcggctctcttcgcacacttggctcgtgccagtgactcaggccaaggacggggaaccacgcagcgtttcta

SEQ ID NO: 27615 - DNA, 201 bp, Bos taurus
atacaaaacaatcttctaagatacaggaacctgccagagactaatcgacctaatgtcaaacagcaggaataggaccagatgcaggtatgacgtggtttacgaatgcatccacttacgctaaactaaaaacgggtacttaatggaaagtccagacaaagcagttcataagtcatctggctatgaaattatctgcatgtgaaa

SEQ ID NO: 27616 - DNA, 201 bp, Bos taurus
gccccgcagcaacctcggggatcctcgtcacattcgtattatggtgcatcaaggcgtgtctcgtgggcatctcacactgtgccttctgtatgtttgtgtcgttggccagctccatcgcagcctgcttgtttccctttagcatccattcctgcctaagatccatcgctgttacctgcccactcagggagcccttagaagtga

SEQ ID NO: 27617 - DNA, 201 bp, Bos taurus
cgctgatccagacctgtatcatttaatctgctgttgattccttctagtgtattttcattttagttattgtatgtctctgatcattctttatattttcttgctttttgtttaaaattaataacttttcaatctgctcatccattcttctcccaagttctttgattaccttgatgatattaccatgagctatttaccaggtaa

SEQ ID NO: 27618 - DNA, 201 bp, Bos taurus
acaatcacacacacatcagtttcacgattgcctcaaaaatgtacgttacagcaatgacatgcaagaattattaaaaatccacgtggtagactgtcgcatcttccaagcacgcggcacaggcgcctctgccgtgcatcaccaacactgcggctcaaggtcaaacaggctggtctccataactgcttctggtgctttaagtta

SEQ ID NO: 27619 - DNA, 201 bp, Bos taurus
acttatttcattgcactcacctcactacgttgtaattatttccttatatacctattttcccttttgaactaaacatcttcagggcaggaatcatgtttctttgaacatctgggcctatcacagaggttcaaaatggacaggctgtagaggattattgagttggagttcaagacattctaagtaaataaatcagcatcaaaa

SEQ ID NO: 27620 - DNA, 201 bp, Bos taurus
acagtctcacctatggagcagctctctgccttttccatggggatgaaatcacaattgtttgttctctgtcctctacagagccctgattctgctccaaagaggctcagaaaaacagactggggggaaaaaaaaagatctctgtaacgaagagtaggggatgccatgtttagcccctctgctttttaaaatcatccttatgct

SEQ ID NO: 27621 - DNA, 201 bp, Bos taurus
gtaacagaagaggtgcctaggaatagcaaggcacccatttccgctttatggccatgaagtgtcttcaggaactgaggacccgagtccaaatatcccatcattcttactgcagacagttccaaaggtttgggcagtattgagccaggaactgtggataaaaccaaatacataggagactatatcttttgagtgaccacatat

SEQ ID NO: 27622 - DNA, 201 bp, Bos taurus
ttaaattcaggaggataagtggagggaactattttgggaacttttagaaaatgaccctaattcatcataatttgacacatctggcctatttggccaaaattgggtcagcagtaaatctacacacccaaggtccttccctcccctacgtctccatcatctccaagcgcccccagagcagcgccagcctgccccacccagccg

SEQ ID NO: 27623 - DNA, 201 bp, Bos taurus
tcatccagaagttttccaagttgctcatttttcatctcactacatctttcagaccgtatttctcacccacactgaaaggccttcatcagaaatgctcctgggagtaagttttgcgagcttatataaattaagatggaaatgtcatgataaagcagtcatcacaagtcccacttatttctaacagttttcatggccccagga

SEQ ID NO: 27624 - DNA, 201 bp, Bos taurus
caatagttgaattgcttgggctgcgtagacacagcccgactccaggtgggaagatccacattcagaatttggataatttcaaagagactcggccattctgcccctttgaggaaatgccttccccaaccacttatggaattaattgaccaattagaaaatattcaggaagagagagtggctgatctgaaactttctgataag

SEQ ID NO: 27625 - DNA, 201 bp, Bos taurus
acacaaaaaatatacagcaacttcataagtatgttaaatatcttcttacattcctactatttttcttgctttcttttgtcccctgcaaacaacatctgtttactgcatttttggtgttttttgcaaatggaaatgaataattcagcttgacagtacagtagtcaaatgacacctttaggcactatttacatccagtaaata

SEQ ID NO: 27626 - DNA, 201 bp, Bos taurus
ggaaaaaacagttgattttcaacttcttgctaaacaaaatttagtccttaatcaactaaatctgaagacatagggcaagtgacccaagaaggcctgttgaaaagagaccccagaaagcccagatgggacctttacttgagactcaaattgtccctgaattttgtaattaggacatggccaccacatgaatgcttagagaaa

SEQ ID NO: 27627 - DNA, 201 bp, Bos taurus
ctgtgaccttttcctctgatcctcctcatggcctggccctcctgtacaaaggtcccgcggggccacctcctcccggcctgccctccgcagggtggcctcgcggatgtttatccctgatcttctgggtatctcgtcaaacccgccagtgatgactcctgagtccaggtccctacccagaccctccccctgaactccaggcct

SEQ ID NO: 27628 - DNA, 201 bp, Bos taurus
tggggccagcgttctgtgattttagctcccgagtgtccggaggctctccagacaaagggctggtgtgctacaggaaggaggctcaagtgtgtccattcccacaaacgaaagtgcattggccctgggcgtccagcagggagccctgcccgagcctgggcaggggtcagggcagcgtcacacagactaacacccaggtcatag

SEQ ID NO: 27629 - DNA, 201 bp, Bos taurus
ctccccctgtctctcaggatggacaccacgcggccagaaccacccactatggctccctgccccagaaggcgcagcacggccggccccaagacgaaaaccccgtagtgcacttcttcaagaacatcgtgagtgttggcgtgggggtggggagtggaggggtgcagggcgagggtgggggagcggagaggtgaggggtgcctg

SEQ ID NO: 27630 - DNA, 201 bp, Bos taurus
cagtggagtgcaaccgtcacatctgtctggaacccaaacctgttcaccaccccacacccgacagcatcccctccccttttctcccaaggcccccacccctggaaatccctcttccactttctatggatttgcctatcttagacgttttgtgagagtggaatcgtacactatgtggcttttggtgcctggcctcccccaagc

SEQ ID NO: 27631 - DNA, 201 bp, Bos taurus
gccgcggggttgagctccctgtgctatacagcgccttcccactaactgtttcacatgtgtaatgtgtgtttcagtgctactcttcttgtttttaaggtcccgtatggctgcagagctgcccgtcaaagctcctgggtctctagacagtttcttgctgagtcagcctcctcagctttaatcatgctgttccccgttttaagg

SEQ ID NO: 27632 - DNA, 201 bp, Bos taurus
ctgtactcagtcagcccagtgagcctggtgcccagacacccccagtagagagcccagctcgccaggccatgtgacattccacagggaacaggattcgtcttgctcctcctgcctgggggccgagcatagagaaggcgacagtgctggagggactggagagttgcaggaaagaccgtgatcctcctcccgccccttgtgctc

SEQ ID NO: 27633 - DNA, 201 bp, Bos taurus
gtggatgtgggatgctgagcagggaggaaagggccggtggggcttggcaccaactcatggaggacttcgaatccaggggggaggtcagggtgtgaaattacaggtgaggggagaaactgtgtttttgaggagacagccatgaaacttaggtttaagggagatctatggtgtgccaacagtaccaacagattggaaaaagga

SEQ ID NO: 27634 - DNA, 201 bp, Bos taurus
gaattaatgtggagtgggtttgagggagaaaaaaaaaacaggacaaaggagctttgagagaggagataaatgttattgcacattttgatttggcctcctttgaattcagcctgaatgctgagtgaagttgttttttttttttttccccatggttgtccatttctgagaggatagagtgttgacctgtgggaagatactcaa

SEQ ID NO: 27635 - DNA, 201 bp, Bos taurus
aaaataggaaatgtctttatgcctctctctcagagtttagtgagtgtgataaacctcacacccgccccttccttcaccaagtgctcagcgagggctggccgtgtgccaggtgcttttctaggaaaagggatacatctgtgaagaaaggatacagaaactgcccttgcaggccttgtattctttaaatgattctatgttata

SEQ ID NO: 27636 - DNA, 201 bp, Bos taurus
caggcattagacagtttggggttttgtttttgataacgaggctctttctgttgactaaggggatggtcagcaggtcttgacctagagtgaccccggagcccgtggtcagaaatcaccgggtctccatcccagcagggtgagtctggagaccacgcgtcccttttctcctctttccactacgtgtgcggctgtggtccccgg

SEQ ID NO: 27637 - DNA, 201 bp, Bos taurus
cggaggcccggttcacactttcacgtttgtccggggtgaacgggaggtcaggaggggaaacagagttcacccagaagttgacagatagcgcgggctgtgcaggaggggacgtctagacccggcccggggccgcgagggcgtccggccggccgaaagctgctggctgaggggccctggtgatggatgggccgggccggctcc

SEQ ID NO: 27638 - DNA, 201 bp, Bos taurus
agtttagaatcatccctggatgatctcaaaggagagatggtgacaggttttgtctcagccacgatctggccaccgctcctcaaggctctgctaggcctgttgtcttggggtgaattaagtacccaaatctcacatcacactctttgtccaccaaggcagccctccatgcccgccacaaaccccctgcctgcaggccctgct

SEQ ID NO: 27639 - DNA, 201 bp, Bos taurus
caatatgtgagctcacaggcaaggtccggcctgctaatgttaatggtttgccaggtgtcttggacatgggggaacctcaaaaatgactgtggggagaatgagctggaaggaatcaggccacatcacttgtgggtgaagactgtcccatccagaggtgacataaagccacagaagagtcaatggggtctggcagttacaccc

SEQ ID NO: 27640 - DNA, 201 bp, Bos taurus
gcacagtaggctctggcagtcaccattcaattggtcatcggtggcctgagcagcagcatcttggttgttctaagtacagttaatctttcaattcagggtctgtttgttcccattgcttttgcggccagttctcagaactctggcagtttatgtcctgggtacagtctggtcatcatgtggtcaacttcttccacctgggtt

SEQ ID NO: 27641 - DNA, 201 bp, Bos taurus
cagggctacagtggcagtgtgaggggaacgtcaggttactgccagttcagatgaacttgtgtgtggagaacgcatcaaagtgagcatgtgcgctctgctgttactaaagaaagtgggggggggtatcccacagccgttccattggtctttggggtcttctcttttatgacaataatgctgatgtccacttaaaaacacaat

SEQ ID NO: 27642 - DNA, 201 bp, Bos taurus
caaggcatacagctcagaagtaagtaacgaactacggccacacacgacagcgtgaaggattttcaaacgtgcggcaacaggacttcccagcctcaccactatggacgtctggggccagacacgtcctagctgcggaggcacgctcagaatccagggccccgtaagatgttcagcagcaccgctcgcctctccctgccacat

SEQ ID NO: 27643 - DNA, 201 bp, Bos taurus
cgtgggtttgattcctgggtctggaagatcccctggaggaggaaatggcaatcactccagtattcttaggtcacctctccctgctctaggggaaggtagcgtggtgtgttatttacaacccacctgagactcttattttttggcttccctggtggctcagctggtaaagaatctgcctgcaatttgggagacctggattcg

SEQ ID NO: 27644 - DNA, 201 bp, Bos taurus
gattggctcagggcagggtggatttgatctaagaaggttttttccccctgcagaagacgttcaggatgacgtgagcaagcacctcctcttctttgtctgaaagccctcttccccaacccgagagtccgtgtctgtgaccagctgcccccgccagtcctcggtccctgcgtggcggccgtcctgggttgcaccagttaaagc

SEQ ID NO: 27645 - DNA, 201 bp, Bos taurus
ctccatatgtacagaatctatggcctctcacgcgtctgtttgctgatgaatttctcatcacatgaatatgtaacaatagtaatgtgatttttatagcctcgctgtcagggcctttccatttggaaaagatattcatcatttctgtttatggccaaattacttctctcaattttgtggccagcctgacatgataagtcatgt

SEQ ID NO: 27646 - DNA, 201 bp, Bos taurus
cattgtcatagattcttcatcctcacttttctccactgaactgatgattacaaagttgtgctgtatcttcatcctgcatatttctgagcaccgcaccctcctcttcagcttctttactcttggctgagaccagttcttctctcattaggctcttccatatgacacccctgtgctaatatcctatattcataatcattaaca

SEQ ID NO: 27647 - DNA, 201 bp, Bos taurus
tttgttaatctgaattcatagtctgtgatttctcctgtgtaatcgcaattttgctcattcttgggtgtacgcccttgactgaggtttatccctcacaccccgagtgaggggggcagatgatctcagatggctcagaaatgattcctaatttggttcagattttcctggtaaatatagctaagacaggcctggcacagagaa

SEQ ID NO: 27648 - DNA, 201 bp, Bos taurus
tcttcaccaactgagccatcaggatagcctgtcaagcagcacctgaagcctccccacccaccaccaggttagctctctctgcatcagtccccaaattcctccaggacaggaaccttgctttgtgtatccctgagtatctagtttgctttaataagcatgttccaaacagtgtgttggccacctggtgagaagagctgactc

SEQ ID NO: 27649 - DNA, 201 bp, Bos taurus
aggagtatgatgattctacctgagcaacttctctattaatccaaatttactgagatataaaaattttattttaaaaatcatagtacctcaatcatgtattgatatttctatgtctctatagtgaaaactgctattatctgtgttgataatgtgccttgcttttttataatttttaaaagataacattaaatacaattgaaa

SEQ ID NO: 27650 - DNA, 201 bp, Bos taurus
ttttcaatttctatatgaagttaatttatttttgttactaacttctaatttaagttgtattgtgattagaaaatgtgggatgttccttattaccattttttcctttattttctgatctttcctacatttgaaactgttctgggatcatatttctttgagaattacagcctcaaattttcctttagaaccagtctcttggag

SEQ ID NO: 27651 - DNA, 201 bp, Bos taurus
gcaggctgaatggagcgggccacttcagtcctcttgaaccatcatgagggaaggcttggcacttgaccttgagactcttgagtcctgaggccagagtgccgcccaagtcccaattaatggcatttgtagcgagccgttttatgagacttgtcatggttttgacactctttggcccaatgtcgcgtctgtctacagattagg

SEQ ID NO: 27652 - DNA, 201 bp, Bos taurus
gcgggcttctagaaatgtaaaatctgataattaatatatggtagcatcaacagctacgtgaagacaaaacatcaaagacttgaccatgaaagatacatatcatatgctatcacttatatatggaatctaaaaaaaaaaatgacacaaatgaatttatttacaaaacagaaactcaaagacatagaaaacaaacttatgggt

SEQ ID NO: 27653 - DNA, 201 bp, Bos taurus
ggatgggggagcctggtgggctgccgtctatggggtcgcacagagttggacatgactgaagcgacttagcagcagcagcagcagtagaggcctcaggcacaagggcgacctgctcgaggagcagacttcaggctggagtgagtgaggtggttaaccgggcgcaggtgcaggaggggaaggcgggaggtggcctggggcagc

SEQ ID NO: 27654 - DNA, 201 bp, Bos taurus
aggtttggagttgccccaaaactctcagaacagctgccgggttaatttggcaggaaccataatcctcaaactggcagaccctcaacattccctctgattagctaggagaccctaaaatatttcagcctttgtgaataaattagcagttgttttcctactataggatcatttttttccagccaaggaataggtgccctctgg

SEQ ID NO: 27655 - DNA, 201 bp, Bos taurus
ttatttgaatcctgcaaaatatgcttatgggaaagtttgagttctaaaagcaattatcctgttattatttgttctcagtatcttgtatttttttcaaacataaagaacgcttctctagttaaatccatttagtcaattcagttgccaaataaagtaaaggacatgggaagaaacagacttgtcattattcaaacaaggtgg

SEQ ID NO: 27656 - DNA, 201 bp, Bos taurus
tattaggaatgcgttgagctgcaagtaccagagtacctgactgtagtggttcaacatatgacggttacaggaaatctggcagcaagctttcgctggcaacagttccattctttactaattccatcaaagatccatgctatattccaggtcctaaatcctttactggaggaaattttactcatctatttcctgcctctctgt

SEQ ID NO: 27657 - DNA, 201 bp, Bos taurus
aatatcttcatattcaccttagtttacctaaatggaaatttcataaagttggaatgatttagatgttaaattagagagcacaacctgtaacatcagatttattgagtcctttaatttattgcatatagaattaaaaaagaaataaagactaatggttaaaaatgaacatactgatgaggtaacatgtacaagcacatttac

SEQ ID NO: 27658 - DNA, 201 bp, Bos taurus
acagtccatgggatcacaaagagtcagacacaactgagcaactaacacacagggactaagaactacttgatccctgatttacatctcttttaacacagaaaaaccactgaatattttcaaagtcctcttactaatagaatctattattaaaaaatatatagaaaaatcaagagtaggtattgagctacaataagggaataa

SEQ ID NO: 27659 - DNA, 201 bp, Bos taurus
agctcttattaatatttttcccagttcaaggtaactcagtaagttccaggttgaaactttagattctcttggttgatatccaaatgtgttatggccacatgtctgcacagcccaaagctcgtgctccccggacaccaccccgcctcattctgtggagcaagtggtcccatcggcccccgttttacaagctggccccatgga

SEQ ID NO: 27660 - DNA, 201 bp, Bos taurus
gctgatgaattaatgtatcttaaatcattggcagtgtgttagccaaatatacccacagtggatttcactagaaaatcacacacgaaataaatccaaaagcagtgcattatggtcagcaatcttctgcgtacttaggaacttgtcactttctaatgtgctgtgcttagtcactcagtcatgtccaactttttgcgaccccat

SEQ ID NO: 27661 - DNA, 201 bp, Bos taurus
gaagtacatataattaataccactctttcaattatgatgtatttcttgctaatctcagtattccttgtttccagtatcatttcattgttttcttcaactttctatttgaacttccacaggtcatttttctgctattttgactctagtttgaccttttctctgtcttgatctctcactgcctcagtcactctagagcttcct

SEQ ID NO: 27662 - DNA, 201 bp, Bos taurus
ctgtagggaaccaggaaatgccagagtttattctatttagttttctccaacacctcagtgacgttatttccacacatttttgaaagggggcctcatttttatttctcctgatacattcaggggagcacatcattatcttacattttctgcagctcctccatacgtgatgtttctaaagcccatcctctcacctgcaggcct

SEQ ID NO: 27663 - DNA, 201 bp, Bos taurus
gctcagtgaggtttattggataataaataaatcaaattattttttagcaggagaattacctattgactatttctcctgactgatttccagagcaccatatgtatcagtgatgacatgcaataattatataagacccccatattctgtataggactagtcctaaggacagaagtggaaacccaaagtttacataaagggaaa

SEQ ID NO: 27664 - DNA, 201 bp, Bos taurus
tctaactgcttaataattagattggcatgagacagtaataggagaaaaataaatttaattatgtatgtattagaactccagaagagcaaaggacagtcaggcaattgaggtttatatgctcttctgagccgaagacaagcagataggggtctaggatatgaaaagggaggaagataattcacatcagtcagataaaaacaa

SEQ ID NO: 27665 - DNA, 201 bp, Bos taurus
aaatatgagcaaatgctttctcagtgaagtcaatgttcaccagttccccattatttatttcctgtcctacaggctgtaagctctattgatccctactcttagccagcatctaatctcataacctttaagactccgaaagtggagacactcaaaatctatattgaatttcaattctttccaaaggcttttctaaggagaata

SEQ ID NO: 27666 - DNA, 201 bp, Bos taurus
ggactcttaatttcactggaacccatgtcctaggccttctgcttcaaatataggagatttcagttgataaacaagtttattccctaggtacatgatgatacagctctcgacttttcaggggataccaaactaattttatttttttctttcgtatcaactatgtcttgtccttcttttttgtgatcactgcccatttttcca

SEQ ID NO: 27667 - DNA, 201 bp, Bos taurus
tccagtctttttgtctccaagtagaatctcccttgcattagatagaacaataaattagaatttaactgaaataatgctcatttctccttctatctggttagataactatgactttgtcttcctatatcaaaaatcatgtttcttgtgtttctttgtaagaacaatctaatgcacataactcttttgcatcctaaaaatgtc

SEQ ID NO: 27668 - DNA, 201 bp, Bos taurus
ttatcatacataattactttaagtatttattgatggccccatttatcttcacggttgaaagaactgcagttgagggaggttaaataactcacaccaggtcgtatgtggccaatttcttccccatgcactgcaaaatactgtgatgtttgcatcttttaattatgtgcttttgttttccctgtgaggtttaatttttttttt

SEQ ID NO: 27669 - DNA, 201 bp, Bos taurus
gagggacaaggatgaggagtgagcttgcatcatgcaatgaacgtgtaggtgtttttgaacatatgccaacctcccggcccaccttccactgccccaccctcacctcgacctcccccaccttgactacccaccctcaagtccattccttcgacaggcctctaagaggtagtgtggccctcttgtgagtcatttcctaacagg

SEQ ID NO: 27670 - DNA, 201 bp, Bos taurus
aggatacagtccatggagttgcaagtcagacaaaacttggccattaaaccaccaccatcacaatttcagacaagatatgaccttaaccatgatgtggttccatcacctaccttagaggccagaaaactaagagactttagaatttaataaggagccccattaatgagcatttttagtccataacatttgaggtatcgtaat

SEQ ID NO: 27671 - DNA, 201 bp, Bos taurus
attctgagaatgtaaacaacttgtttagaaaagaaagaaagaaagaaaaggcatatgccaaaatattaaaaggctcagaagcatagacagattaattggattcacagagaaaaaagaatcacagagctgtcatattcagtcaagagataaaatgttgtttggatctatgatagggagaaaggcattaaagcgatagaaagg

SEQ ID NO: 27672 - DNA, 201 bp, Bos taurus
aattaatatatccagacaaaattatttctacaaaaagacttttactgagaaacaattgctctctgcctcaaacaaagagtagcgttatatacagtgatccacataagtgaaaatggtagatatctttttggtctaactgaaataaggattccttcgatggtctcatgaatcacatcacatctaatttccagtacaataatt

SEQ ID NO: 27673 - DNA, 201 bp, Bos taurus
gggtattttgtgaaaacttgccaaagcagcaaaagcatcaagatttattttgggactgacagaaagacacagtgatctggtttagagagcactgtttattatccatgtatttattcattcagcagtagttattgttgtgcatcttttatttggaaagcatttgatcagatgcagtgaggaatacaggttaagaagacaagt

SEQ ID NO: 27674 - DNA, 201 bp, Bos taurus
caagagagagccatgcagctccagttctcataatctcaaagcggtccccaggaggggatagggcagagagatgtggtaagaaaactttctctaagcaggtaatatttgaactgggcttgaaaaagataaggaggtggttgtttatatgatgtttgcggatcatgtgaacacacgtacctacaacacagtggaatttcttca

SEQ ID NO: 27675 - DNA, 201 bp, Bos taurus
actaagcataagttttcaaggctcatgcatgtttaggatgtatcagtacaaaattcatattatatggttgactaatattccattgtatagaggtgctgtgcgcgcagtccaatctgatcctttgccaccccatggactgtagcccgccatgctcctctgtccatggggctttccaggcaagaatcttggagtaggttgtca

SEQ ID NO: 27676 - DNA, 201 bp, Bos taurus
gctcgataaaggacagaaatggtatgatatagtttactctctcccaaatgtccattttgtaaactgactctggagtttgacataattactgtggatttcctgaaccactcttatgttatatgcctatatgatacatgtcctcttctctatgtgaccagcagatagattatcttgtcagttaagaataggaagtgtaatcaa

SEQ ID NO: 27677 - DNA, 201 bp, Bos taurus
actcagcctacaagctgttcccctggtgatgtgaacagctgttctctcttcttggctttaaagcttagagctgctgctttattagtgtggccccttgtggcctcccctggcctgcacagttgaatgctgaagggtttggcatcttttatgctcagaattgtgcactcacagcagctcctctgggattcttccagccaagtt

SEQ ID NO: 27678 - DNA, 201 bp, Bos taurus
tggatgttgaaaggtgggaggaaaggaggaaaaaaatgtggaaaatcttcaaatttattaaaaaataagttatttaaaactatgttcacaaatctactgtcacacacatcccaagggctctctgcttattcatgtgtattttcaaagtttatttacaatgtagaaacagctatgtttttcctgagtgtaatccaacttaaa

SEQ ID NO: 27679 - DNA, 201 bp, Bos taurus
atcaaatcccttcacacaatatcttcctttcactcatttgtagaaaatgcaaaggatatcagggttgtcagaataaaaaattcttttcctttaacaacagcactcaggagtagactttagagctataaaaggaacttcagagactgagagaggaagccctaaattgtttatcattactgtgtggggaagataagacaagtc

SEQ ID NO: 27680 - DNA, 201 bp, Bos taurus
tgtgtgctatctgtacatttatatatataaaactgttatgtataggtcctattaatatattgctatacccatcaagagtaaatatgttattggtatttttcacataaaatatatggcaatgtatcataaaacaatgtctaggcaatgtctttacatatggtgaactagcccatctattgcccattgattttcattgtgctt

SEQ ID NO: 27681 - DNA, 201 bp, Bos taurus
caggaaaggctaggaagaaagagataaaaatccatgcagttacttttcttttaaaaaggccatttagaaatgcctgaatattagtaaacctggattgcagtgtttcattgtgattttaaagtctacaaactcaaactgtcttgcaaaacatctattttctaaaaattaatctatttccaaaatagctatcaagtatctatt

SEQ ID NO: 27682 - DNA, 201 bp, Bos taurus
ccctggcagccttttgggtcatattctgccctcacccttctaacacagcaggcaaaggacctggttcctgccatgcagggaactgatgtgttaatgggactggccggaaaccaaaagaagcacacgttgaagataaatatgagaccgtgggtctggaacagagaaagctatttctacaccaggtaataagcccagttcaga

SEQ ID NO: 27683 - DNA, 201 bp, Bos taurus
tatggacaatcttggtatacaaatgagcataaggaaagttgcttatcttttggaaagaaagaggaggcaggtgcagtgcagaggggccatcagcctgctacaggggtcactgctaccccttactgatgagaggaactaaggggaagggtaaatcaagcaaggttaaatccttctctgctgcttgttggatatatgatttcc

SEQ ID NO: 27684 - DNA, 201 bp, Bos taurus
ccaccagggaagccacgtccttctgggaggactaaagagtctatgattctgctacatggctgatctgttgttttcattgttcccagttctcttggcccagctggtatattttgttattaatgctcacattcttcaaatcattaattcttaagctagtcttttgtaactcagaggaggcctgggagactaaagcaaagtaca

SEQ ID NO: 27685 - DNA, 201 bp, Bos taurus
ataatgttcataatagcctcattttaaataaccaaaaaccaggaagtaatccaactgtcaatcaacaaaaaaatggacaaatggtaacatttccatagaactgaatactatttaacaattaaaaaaaaaaaagccctaactgacacattcaacaacatgaataaattttatagatagtgtgctgagagaaggtagatagaa

SEQ ID NO: 27686 - DNA, 201 bp, Bos taurus
ccaccaggctcctctgttcatgggaattcttcaggcaagaatactggagtgggttgccatgccctcctccagggaatcttcccaacccagggatcaaatccgggtttcatgtattgtaggcaaattatttaccaactgagcccccagggaagccccacagagaactagtgcccttataaaagaggtaccaggaaaaggaga

SEQ ID NO: 27687 - DNA, 201 bp, Bos taurus
cccatttcggtgggagtaagaaaagtgcctactccgacctgaattgtttcttaccaccttctttcatcatataatgaagatgtttcctcacagagccccaaagttacatgttaaatagctgggaatgttgttaattaaaaataaaattttctcccaacccagaaaacctctccagaatagttacagagaaagaaaatagct

SEQ ID NO: 27688 - DNA, 201 bp, Bos taurus
tggtgcatggagggcaggactgggcggcagtatttgctggcagggagtaggggagagattgcccacatcagatgggatcattagttaccagggaaaccaggagaggcatactttggtaggaatagtcattaactggggcctgaggcaagttacctagaaaggtcagtcatgtacataagttacagctgaagcaagcactgg

SEQ ID NO: 27689 - DNA, 201 bp, Bos taurus
tggaaccataagcagcccataatcaatggtttcctaatgagaacagccagccaagcagccacaataatcaccttttggacaatcaatacagaaggaaatgtgaaaagagtttgatatcagttatttttctaattatgcctaaccaattctaattataaggatgtggcatgcattccagagacctttgatgagtagatgtat

SEQ ID NO: 27690 - DNA, 201 bp, Bos taurus
caactgatccttgaattctcagcagtaggacttgaagaagaaagctgatacacttggctcaagacaaaattggaagctgtggaggccagcagagtgaggacagctctctttctgaaagtcacgttaataatttgtgaactgtggtgtctgctggcctgtaacatgtccctgtgtcaggttttgtcatgttcagataactct

SEQ ID NO: 27691 - DNA, 201 bp, Bos taurus
ccccaagtagctttattaacaatcttctaaagtctctttgaatgagatgaaaaaaccatatacagcacatttttcactagggcacagcgctgtgggccccccaaggaggtgaatttgatatgatcaggcactgggtacagcttcaataaagagatgttctttaaggcagaatttcattaggtgaaaatgtggccaaagggc

SEQ ID NO: 27692 - DNA, 201 bp, Bos taurus
gcaagtcctgcaggccctctcagagggaagcttgcgttgggtttgtggtgtctgaagagatgccggcacgtgccgggttctggcgtctggctcagcatggctaatttatgaggccccagcaagtcagtgagaggaggagagatccaggcaggggaccctgctaattggccctttcagttcctggcaggcactactggtgag

SEQ ID NO: 27693 - DNA, 201 bp, Bos taurus
ctgaaaatgcatttgccttgcatacttactcatccctttgtgatatcaaactgtcttagtcacctttaaaataaagcagagatcattttaaaggcattaaagtgaaaggccaggtacacttatttctcagattcatttaaactgccccatcgacagacagttagcacctatcagagtggcacaagttaccagagaaacagt

SEQ ID NO: 27694 - DNA, 201 bp, Bos taurus
acttctgattacagaattgtgatatgtattctgaaatgacaataaaattgttttccagtgaacagtgtttttcgcaaattcaacaataagtgcatgactacttctgttaacatagcagtgtttacctgcttttttttttaaccttcccagatactgacttcaggctttcctaacttctacaaccatttcccttttcttatt

SEQ ID NO: 27695 - DNA, 201 bp, Bos taurus
attggccccaggttgtggatccctaggaagggccaagctgtttaagctccaggaaaagtgtgggcctgctcacagtctagtggtagctgccacctctggcgtcaggactgtatcagctgtttttcatctgcggcttcaggcactttccttaactttgacagtggcagtcatgtctaactctgcaggtggcactctaactgg

SEQ ID NO: 27696 - DNA, 201 bp, Bos taurus
gtttctttataaatttgcattacatgaataatgccttgaaaaaggtgacctcctctggcaaccctgtataaggccactattcttaatcactctcttctgggtatccaagttcacagcctttaaatgacaaaaagtatacaggttttccacagctatgtcagaatctgttctgggcccattaagaaaagagtgagtatttgg

SEQ ID NO: 27697 - DNA, 201 bp, Bos taurus
tttatccactgcttgtattccaggaacaaaacccattgtcttatagttttctgttcttattttctttgcttgtattttttagcatgcttcaatcaccttcgcctacccacataattagtaaataatctcccacattcatgaagccacttaatgatcaaatattttatattcactgcccaccggaatataaatcattatcat

SEQ ID NO: 27698 - DNA, 201 bp, Bos taurus
aggaagacatttggatgctaaagtgtaagtcaagaaatagagtgttcagagtcatcagcacacttataattctcaaatatatggaaattggttagattttctaagaggataaagagggaggggatgtggtggttaaattgctctggttttataaaaaagattcagggagaaaaaaatgggctacaatttttagagttctgg

SEQ ID NO: 27699 - DNA, 201 bp, Bos taurus
ttaatttgacattgaaagtcttttgcatgcaggccctggtttatctttacaaaccaaaaccctgcttttgtcattacaaaagttctgtgcctagatctctatggcccatcaattctcctgatggttactcctttgccaactctactgctttatcgtgtagttctcccaactgacctggagaaggaaatggcaacccactct

SEQ ID NO: 27700 - DNA, 201 bp, Bos taurus
aactaaagacaaagctatgaaatgttcacctgaaaaatgtttgcattttcatagaaaggtctgttctgaattcagtgactgatctgtggggggtcacagcgacacgagtgaaatggcattctttgttcatttgtcctgccacccaaacaacctgaattttaaatctttttctttttgaaatacatttcttctctctttctc

SEQ ID NO: 27701 - DNA, 201 bp, Bos taurus
ttatggttctttctgggcaaatatacatatattcactcctctaagctctattcttttccaaattttccatcatcttttgggcactattttatactctggacaaaattctctcattgttgtaaagggagggttttctattaggactaatgctaaaaggaaaaacatcttgtcaaaaatagaacttaatgagctctgcatttt

SEQ ID NO: 27702 - DNA, 201 bp, Bos taurus
atggcaacccattccagtactattgcctggaaaatcccatggacagaggagccttgtaggctacagtctatggggttgcaaagagtcagatacgactgagcgacttcacttactttgctaagatagcaaagtatatttagaatcaaaaccaaaccaagaaaaacaaaatgaccatagaatatgggcaccattggcccatca

SEQ ID NO: 27703 - DNA, 201 bp, Bos taurus
ccttctccaggggttcttcccaacccagggattgaacccaggtttcctgcatagcaggcagatgctttattgtctgtgctaccaccaacccacgataggagcatatatatcaataattgctttaaatgtaaatggattaaatgctccagccaaaaggaaaagactggctgaataatgatgaagggatcaattaaagagaaa

SEQ ID NO: 27704 - DNA, 201 bp, Bos taurus
tctttactgacattctctaaatcagagttgcaaaaactttttctgtaaagggacacatagtaaatattttaaaagtatagggaaaatgtctctgtggcagctactcaactcttgttttagtacaaaagcaaccatagacaatatataaatgcatgggtgtgcttgtgtttcagcaaaactttataaaagcatgtaagtgga

SEQ ID NO: 27705 - DNA, 201 bp, Bos taurus
caggctgaagctggtactgtgagacccagcagtgtccctggacaaagctcataaacgttacaataaatgaataaatagagctgaaggcagggaaaaaatggctccaaggccttatggctaaggcttggggacaccttgtcattactgtggcaggaaacaggaaattgctgagaaaaaaacccaactgagcttcagtcctga

SEQ ID NO: 27706 - DNA, 201 bp, Bos taurus
agcaaaaggcagggccttgaaagcataagactggagtgtaggctgcactgaggtgagaaatgttaagagtcagggattaagagtcaaggttgaagcccagggagtaatgaggccactaagacgagagtcaagtatgaagaggttgagatgcaactcctaagaacactcaatttttaaatcaagcagaaaaagaaaaaagtc

SEQ ID NO: 27707 - DNA, 201 bp, Bos taurus
ccgagtgaatgtgagtgccctcccaagggtccagagagcaccccgcctgacagtgcatctctgggtcctgccagcccacagcagtgcaggcactcggtggcaattcccttgggcctgctagcaaggtgatttctccattgctcctggctatagttgttcatttttttttcaagttttgttttttggtgttacgtgtttagc

SEQ ID NO: 27708 - DNA, 201 bp, Bos taurus
gtccagcgatgaggcggtagagacctggccgacccactccgccctctccccacccatcccctggcttctcatcacagccgatcccccagcctggcaggaaactcagggcctcccgctgccctgcgcagctacgaggactccttcccggcctcccagcagctgtgaactgcgcatgccctgtccaaggcggacagcggtggg

SEQ ID NO: 27709 - DNA, 201 bp, Bos taurus
tccttgcagcccctgcctcttatcttgtgcaaagatgggagtttctccaagaaatctttactgggaaactaagaggaaggaaacaggcagaagcatgaacgtgatcaggtccaggcaggcacccaagtcccttgtcccaccttggagcatgctgggcttgagctgagggcaggtgcctggctgtgtagttctgcaggggga

SEQ ID NO: 27710 - DNA, 201 bp, Bos taurus
ctcttttttcctccaaatcttgttcttctccaccaacctagttgctcagggttgccccaaacctgctgctatgcttgactcctacctctgggcctgtgtacgcactgaattctctccttcggacactcttcgctcagattttgcttatttgcttttctcttttaacagtgatgagaataaggtcattattctgtttatgtt

SEQ ID NO: 27711 - DNA, 201 bp, Bos taurus
atgctaaaaaaattagaatgattcagtagaaagaaaggaaaagaaggggagtcaatagaggagaaaacaagggtggccaaatagggtgaaaatatttcagctgtaaacacatggaacggaaaaagcagaaattaatggggaagaaactggagtttcgacagcatcaccaagaccggggaggccactggttctggcaataac

SEQ ID NO: 27712 - DNA, 201 bp, Bos taurus
aaaccagaatgccacaacccagagtttgcaggctgcaacaaagagttcacatgctgcaactaaggatgtctcacgtcacaacaaagatggaagatctcctgtgccacaactaaagagccagtgcaaccaaccaaataaataaataacacatattaaaaaacagatgaggacatagtaataatctaatcgggaaaataattg

SEQ ID NO: 27713 - DNA, 201 bp, Bos taurus
ttaaaaatacaaaatgacagaagtaaaggagtaaacttggaactctgacaagtctccagactcctaaaactgccatgtgatagcagtactatggaccaagcgaaagcataaagtgtctcttaagagatttcctctggaaaatacatgcaatttagcattcaaaggtctttaattttccatggcattattaaatagcagcct

SEQ ID NO: 27714 - DNA, 201 bp, Bos taurus
gtttgagcattctttggcattgcctttttttgggattggaatgaaaaccgacctttttccagcaaagcaaaagcacaggtgctaaaaagggaaacacacgcgcctttaaaggaagatcccttcactggagaatatttatacaccagtcttccttctcagactcatattcttcagcagtaagtggctatgacaagtcacctc

SEQ ID NO: 27715 - DNA, 201 bp, Bos taurus
gagtcctttgcactctccagaagatagaagagagtaacagaaagagatggacattttgaggtcaaaaggatgcagtttacaatctccactagtaacaaaactttgatgccaattctcaatgaaaagtaacttcttggtcttcaaacaggaatgactcattcatgaaggccgccacgtgcagctgctgtgaccatggacctc

SEQ ID NO: 27716 - DNA, 201 bp, Bos taurus
tgtggatagacatatatgtagactcagagagagtctcttagtcacctcgtggcagtttgaattacttttatagggcatttcttctgggtttcctttggccgatcatttttgacttgcctggttcacaatctggtatatctcgggatcctcccgtgtgtgtacacgcacctcttaggcaggatggattctactgaagaggcc

SEQ ID NO: 27717 - DNA, 201 bp, Bos taurus
ccgtggggggaagcatgatctccagagttcagggctgtgaaatacagggccaagttatgaggaaatagccaggggatcagggtggcctgtgaagctaacaaacaactgctgacctggctcaggtctccacaggtgcagtcctgggtcaggggagaggcctggcctgacctgggggtcaggaggagggtggtctgggagggg

SEQ ID NO: 27718 - DNA, 201 bp, Bos taurus
ttttaagtcaacactttgcaggcctccagagagggggttgaccaggcgacaggtgtgagaccagggcgaagaaggacggcaatcttggcattgaggaggacgggccaggagaggggaggaggtgagagaggccagggagcagaccatcgagaagcagaagcgggaaggcctaaaagaaagcaccaggctctaagggactga

SEQ ID NO: 27719 - DNA, 201 bp, Bos taurus
cgtgaagtcagtagaacatgtacatttcatgtaatgggaaaacattgccttcttgacagtgagtagagcttcagtcatcacagaaggaaggtatgtgagaaaattttttagaacaacgtgtcttcatagttatgatttcttggattgtggttacttttatcataacaaccatatattgaaacctcggtcttggaccatgtg

SEQ ID NO: 27720 - DNA, 201 bp, Bos taurus
tcaacaaggccaattgctgcctccagaatgcacaatgccttgcaatgcagttgggagcacccgctgggacacagacacactcgttttctcacactttgcacacttccttcctgtctggccctattccctttagcccaggacatctctctcaagatccaactcaaatacagcaggatcatgtctacagaccccagaggcagg

SEQ ID NO: 27721 - DNA, 201 bp, Bos taurus
aacactactcggtcgtgaaaaggagtggcattttgccatctgcagcaacatggacggacttggagagtagtatgctaagtgcacaatactgtatggtatcacttatctgtgcactctaaaaaataaaccagtgaatataaaaaagaagcaaattaatagatactgaaaacaaaccagtagttgccactagggagaggggag

SEQ ID NO: 27722 - DNA, 201 bp, Bos taurus
tgtcatcaatttaggctggcatgaaagtcagaccattttaagcaggtaccatggaagaaataataagaattctaggtcatatgtgattcactacatttactgtgttccccagataatatcaagctgttatcaattgtatttttgccaagagaagcctaaaacgtttgttgggtatggggcacacacagacagcagctaagc

SEQ ID NO: 27723 - DNA, 201 bp, Bos taurus
gcctttcaaaaggcagagaaatgtatcagaatccttaacaattcaacttgaacaaaaagtaatgctatcgaagaatgaaataaatgctgaaataactccccccacaactgatcaaatacgatcataagtatttggggaaaagctgtatgacagtgtgagtcctagtagacatttaattcttatactctgtaaaactacatc

SEQ ID NO: 27724 - DNA, 201 bp, Bos taurus
caacctccactttaggcttgaacctcttcattctctgttgcaaatgaagtcaatttctttgagaagattttgagagctgccttatggcctgtttctcccccaggcagtctttaagccaggactctggagctgagggtagaaataatgcatgtaaccttctcactgactgacatagtaactcaagaagctgagtgttcagtg

SEQ ID NO: 27725 - DNA, 201 bp, Bos taurus
ctgctctgttctctatagtgctggtgaatgtgacttgttacatcttcatgatttttcctttgttagggtaccaatgagtgggcatgttattaaaagaaacgtaggtagttgtagccctcaaggtagaagattcggccacataagcgtggtggcaatgtttcattttgttgtgaatgtatttggggaatatctgaaacaaca

SEQ ID NO: 27726 - DNA, 201 bp, Bos taurus
agatgttgtcttgcaggaagtgcatgttgatccactggtaataggttgagttggttttgtatagaaatacaggtttcaaaatttcatgggactcttccctgcttttcaaagaaatgcaattgttttactcttgcatcttcagacttctagcctattttattataatgtctcatatactggcttctcaggtggcagagtggt

SEQ ID NO: 27727 - DNA, 201 bp, Bos taurus
ttgtgaagccataaaagtagataaactttgaggaagttaatgaagagaaaattggaggaacaaaggcaagtggaaaaatctaaatgaacttcttagcccactcaaaatcttaccaaatgcctaggtttgcctggagagaagcataccatccttccaaggagaaggagggaagaggacaagagttaggaggaaaaataagga

SEQ ID NO: 27728 - DNA, 201 bp, Bos taurus
aatgttcagttctatctagagatgcagactgagaatgtgtgtcaagaatacaacacaatggggtaggactaaggaaaaagtcatctacaaattgaagcttgagtggcctattctattctaggcagttgtctgctgctgctgctgctgctgctaagttgcttcagtcatgtccgactctgtgcgaccccatagacggcagcc

SEQ ID NO: 27729 - DNA, 201 bp, Bos taurus
cccccacccaactgggtaattctaatagtctcaagagatgcttgatgtttgggaattatttgtgggtaccagtcttgggaaagagctaagatcatgagaccaggggcaagaggacagacataaaaaccaccaagaccacggctgatgttacgtcatttttgtacaaattttacaaagaaacctctttgggactgggtggcg

SEQ ID NO: 27730 - DNA, 201 bp, Bos taurus
ctcatgaactggtcttctgcctgaattagtcttctgaattataggtcaattttagagaagttgaaacattttaaaagcttcactgggatttgtcctggttgaataagttggttgttaaagtgttcattagaagttcgttcaactgaacagaagtattaagcatctttaggttactgtatttgtgtaagtgagtgcttataa

SEQ ID NO: 27731 - DNA, 201 bp, Bos taurus
cattcttcctccaggggatccttctgactcaggaattgtacccgactctcatgcttggcaggcagattcttgaccactgagccacctgggaaggcccccgaaagggaacgtacagcttttaaaatacttacgtagcaagagcagaagggcaagaattatgagtgcaattgctgcaggccccaagccaacgtaggagtcagc

SEQ ID NO: 27732 - DNA, 201 bp, Bos taurus
aatactgacactttgttaaaggtcttgggcaatcagcaagactctcattgtagtggaaacacacaagggttaaggcttggttgcccttttttatagtctaaagtagtctagtggtggagtaatcagctcactgcagtttgttatttcgaatctattactgccacccttgatagctcagacggtatagaatctgcctgcaat

SEQ ID NO: 27733 - DNA, 201 bp, Bos taurus
tacagtagttccagaataaacatttctaaattttttgtatgtatttgatctatttccagaatcttaaagtagttgtctttgacaattatgtccatttatcattgtttttcaaggacagttatattgagctccttactcagccatttcagaagtttcccctgctcattcttttgtactgtaccttgcatctctcaattccct

SEQ ID NO: 27734 - DNA, 201 bp, Bos taurus
tccatagttaatgcttaatacacgtttaataataatcgtattttagagtaaatgcttttcttgttgcttggagccattcctcttcaatcaggtgactccctgaaacataataccatgacctcttgatgttgcttaaaaatctctctctctctcgtttctctctcccctcagttatttaggactgtaccttgatgaatggga

SEQ ID NO: 27735 - DNA, 201 bp, Bos taurus
aaacttatattaccataatgctctcaatatttattacagcaatgaaatccttcaagttcttacatgacactgctagatgacatggccaatacattgtctttaccattttcttactgatgatgagctttttaaccaccactattcttgagatcgagtgaactccgggagttggtgatggacagggaggcctggcgtgctgca

SEQ ID NO: 27736 - DNA, 201 bp, Bos taurus
cgccatgtaaaccatacaatgacttatttacacacacttgtgtgcatatacacaaacaactattctttcactaatacttcctgatgcgaagggaagagggagaatactactgtgatttggttaaaatagtgcccaatgtttagaatagcattctttgaatttatctatttgtaaaaaaaaaaaaaattaagctcagtttct

SEQ ID NO: 27737 - DNA, 201 bp, Bos taurus
tccgcttttctcccctctctggaggataaaggtgggactgaaacttccaagcttctaatcaggcttcggctttctggtggccagcgcccgtctggaagcctacccatagttgcctcaatagaacaaaggatagatactcagtacgcttagtcctttggaatttagccctgtgtcgggatggggtcattagaataagagagg

SEQ ID NO: 27738 - DNA, 201 bp, Bos taurus
actggtatcagtaatatacaagaatcatgtacaacaaagctagttattactatgtttttgttcttcagtcactttcatgggttttgtttggaactctgcagtaaatctcactacgtttcctgtcctgtttcaatctttgcagaggacaaggtgccgactggaagttctctcaaactcaagtgggttcagttttgtatgtac

SEQ ID NO: 27739 - DNA, 201 bp, Bos taurus
tggctgaatataggttgttttcccaagtgagatcttaaattgtagcttcttgttaaagtaagttgacttttctgttttattttttattttatttgtagttcatttggccttttctctacccttaaaaatgagaatccagtcttactttcctctctatgtgggctgcaaaatatctggatataacctttaattaccctgtca

SEQ ID NO: 27740 - DNA, 201 bp, Bos taurus
tgatgaataccaaaagatcaactcttttattgttagtgattttttttttttttggtattgctagtgacaattttatagaaatatgcctatctacaggacatatggattttctctcctgttttatttttttctccagagtgtatataacttgagcttatatgattagtgtcattattcttcatgaattttcatgtgtttggt

SEQ ID NO: 27741 - DNA, 201 bp, Bos taurus
tattagactggagattgctgcgtgagcaataggtgattattaatattaccttctttcataagagagcttgcctttggtataaacatattttccagatgctataagtgaatgaagtgaactggagacctcagtgactccatatagtcaagataaaacaaagtgtgaaccagaaattgaagaattcatgtctactttgttaca

SEQ ID NO: 27742 - DNA, 201 bp, Bos taurus
agggggttgggcaccgggaaaacagaaccatgagtagaagcttggaattttcagctccagctgccattctcttggagggagtggggggaagaggggctgactatgaagttaatactcaatcatgcctacattatgaagcctccataaaaagccaaaaatatggagcttgggagttttcaggttggcaaacacatccatgta

SEQ ID NO: 27743 - DNA, 201 bp, Bos taurus
tataacacgtgaagtaatttactattccattgttggtaataccacaggaaattgtaagtgtcttaaccatatttcaaattagactgagtctatcttaaggcttgcatatccagacacaaataaatacctatttcaggcttcattctgcgaggagggcatatatggagactagtcattccacaagttgaaacagaccaagaa

SEQ ID NO: 27744 - DNA, 201 bp, Bos taurus
ctgaattaacaacatatgaacaattcaggaaattttaatactaaccttattaattattaacaatgtggattcaatgaatgttagacccatatgtgcatcagaggtaagagatatctttagagggacgatatatattaacaaggtctcatatatgactaggatttcaactaggtgagaagaaggaatgggaaagtttcaggc

SEQ ID NO: 27745 - DNA, 201 bp, Bos taurus
gctcctagcatgatctccataccaggcaaacattccagtatctgaactctccccgttggatgcccccgttggatctggttcttaactcggcgatccagctgcctctcaggcccctcccccacctgcattctacaggcaggcaacagagacctctacttgtagttccttatctcagcttgtaattccatgccagcgccaggc

SEQ ID NO: 27746 - DNA, 201 bp, Bos taurus
agatttttctggaaagctacattttcaagagacaattctgttgtttatcgatgtgttggattatttgcctttcatatttaatgtggtcatcttattcttttattcctttagttaaaccaattccagtgacagaaatagaaggatttcctttggctacattgacgaaacactctaacagtcatattaagtgtatatactgaa

SEQ ID NO: 27747 - DNA, 201 bp, Bos taurus
aagagcaggaaaggggagcaagaaatgttgggggagttgtgagaagtcctagtttcaagaatgatggccaagcaaggtgtggctgaaaaggggaacatttaaggtctgaaaaattgtgaaattgagattgacgtatatacactactgatgctaggcataaaacagacaactgatgggaacctacggtatagctcaggcaac

SEQ ID NO: 27748 - DNA, 201 bp, Bos taurus
ctaatgactcattgatcaaaaggtagggtctacaagtaagtttgaggctttccatttgctgctatgcccttagatgatgatcactttctcacattgtgattagtcaaaaaaacatgggaaaaaaaaaattggccctagtttcccttagaaacgtatagctcttaaacatatcctcccctgcctttctacagagaagagctc

SEQ ID NO: 27749 - DNA, 201 bp, Bos taurus
aaaatatgtcttttcgttacacaaactttttgctttaaagcaccacatttgaattgcttttcatagagacataaagcccttccagggagctaggtgaggtgggtctatgggatgccccatctacacttccatcagagtgatcatgcttttatctgttttatatgttggagttctgaataagatttatttttttggaaagat

SEQ ID NO: 27750 - DNA, 201 bp, Bos taurus
tatgacaaaacttacacattacagacaaatagataatcttatctaagtatgtaggattaaatagtcaaatatctacatatatgaaaaatagatgagacaagtttcattcaaagtcaatgctagatactgcctttgtcacattatggtcttcagtgtatttaaaatctacatgtgagtgcattccacagtcacaactggatt

SEQ ID NO: 27751 - DNA, 201 bp, Bos taurus
agggacttcgtcagtgctgggagggagaagagtagtgggttaaggttattacaacacacacacacacacaaagtgaggagcagttacccaaagaaaatcataggaggagagggagccagctgagaaatattgagtgtgacaagaattcgggagagcttctgccacatgaggtccaaacatggctacagaggaccccacaag

SEQ ID NO: 27752 - DNA, 201 bp, Bos taurus
tttgggttgtttatgatgtttttgacaaataaagcttttaaatttttaattagtcagatctctaaatcttctttatgtgtttgcctcttggcattactttccatctctctccttggaatcttctttttttggctcccttcctaggttattttcttttgtctgggataagaaatctttctttgtctattcacttttctcaag

SEQ ID NO: 27753 - DNA, 201 bp, Bos taurus
gtggtgatgagcttttaaaatgataatagttattaaaagtccaatagaaagaaaaatttaaatgtcgtgttctgctgttcaaggagcatttcacaaagtacgcactcaggtttgttaaaataaattgtattctcgttcccttgtatcaggtaatattgacaagtgaggcttcagaaaatcctgaaactcgtgtaatacagt

SEQ ID NO: 27754 - DNA, 201 bp, Bos taurus
tgaggttaggaattcttgttttttagaagacaacaacaaaaacacaaagaagaattcttgcagagaaaaatgcttcataaattattatttagaaaaagagatattacaaggcttactaagctagactatcaagagacaccatcggttaaacagatactattccaatttttccaaaaaggagaacactttcaaattcagcta

SEQ ID NO: 27755 - DNA, 201 bp, Bos taurus
cacttgtccagttgatactgaggcaggatcatttccaacattgccaaggaaactaggaaactcatgagacagctgaggaaacgatgacatacagaaagatctgtggttaattcagtggaaatagtaatgagcagccatatgtgggtgtatgtgtgcatccacatacatgtgtgtatgagtgaacacatttggtgaaagagt

SEQ ID NO: 27756 - DNA, 201 bp, Bos taurus
ataccacaaagcactataccttgatctagttggtttttactgtataagtgtgtgcaaaatatttgaatgcatatagttccagttaggagtccaaaactagctcaaacactaaagaaaagaaaagggaaaaatgcactttagaaagaataaaacactaactggatttctaaaatgtatacctaatgtgtaagcaacgagaca

SEQ ID NO: 27757 - DNA, 201 bp, Bos taurus
gttttacttatttttgagggtgggtttgaggaatggatgaccagtgccctttaaattacaagttcctgagcagacactcagctcacatgaggccagtcccgtttggcagctcttacccattcctggtcaccaggctgccaacttgttgaccttgaaaaaatggcaccaggcctatccttctacttttgctacattctctat

SEQ ID NO: 27758 - DNA, 201 bp, Bos taurus
atgactggtgttcctataaaagggggaactgtggacaccaacccacaaaaaggaaaaataatcggaaaagaaactgggagaaggccataatgggactggagcgacccatttacgagtaacactaaaggttgcaggcatcccttctagagccatccgacagagcccggccctgctgacaccttgatctcagacccccagcct

SEQ ID NO: 27759 - DNA, 201 bp, Bos taurus
cctaatctctttcctctgatctgataagctaatccttgctaaggtacaaatggattgatgagttgcatatttgcattttaataaggaccttctggacacagggccttaaaccagagaaatggctataaagactggccatttctggtgctatgatgaattggtagggaagaaaatatagagcaggtaagtaattttccttca

SEQ ID NO: 27760 - DNA, 201 bp, Bos taurus
taacctggcttccccctgcctattgtacttgattgtttcctgtctcctctctcccactgaaccagcttgctgaggccagggaccagcctgtcctgtcccctggggtatgtgcatccttagggacactgcctgagactgtggaaggagggaacagtgggctacacgaggagggggccataaccgagtaacttaacattagga

SEQ ID NO: 27761 - DNA, 201 bp, Bos taurus
tttatgacttgtaacatttgttgactcaaacgcagggactctttcttttccgaggggcctttcactgcagccaggaatgtgcatgcattgacgcggccataagctcttccttccgagcctgccatccccctcctctgggctcccacgtcaaccatgctgcttccgcctttggtacaggaggcggggagggttttcccacca

SEQ ID NO: 27762 - DNA, 201 bp, Bos taurus
acacggtcagtttgctgtgtgctcgcttggtgtatgtacacagaacagactgcagaaatacgtacctactctcaacgcagcatgcaagctgttagcaatcgtctttacattacctgaggcccactccatcacccctttcacttaatatgatagattgcaggacgtaatatagaaaaatgtagtgtgtgtggcatataaact

SEQ ID NO: 27763 - DNA, 201 bp, Bos taurus
gtaatctatttcatttggtttcatctccatgaagatgaaaaaggccgtgcaaagcaatgtttctttgcttgtttctgcccattttctgtagaataaaagacaacaacattcaaacaatatggaggccaaaaaagaggataaaaatcctgcatggaaaagagtacacaaatcctgcatggaaaagagtacaaattattcaga

SEQ ID NO: 27764 - DNA, 201 bp, Bos taurus
tcagtcaacagcttgacttaaccttgggcctttctgggttcttaagcatgtccttgccaagaggttgttctagttcagtagtgctaggcccaagcataggttcggacatcagatgttagagcttacacattttcagtcaatcatccactaactcggtgactatggacaaggtcctgagctactgaaggcctctggtcctct

SEQ ID NO: 27765 - DNA, 201 bp, Bos taurus
cctttaattatttctgagcctctgttcctgtgttgagaccattgtggtacattcctgactcaactcatggggccacatgggcctggctcagcaggccaggttggagcagagcatagtgggtcagacacagacagggatggtgtagacccctccctgtactgccagctatggccccaagggcaatttattattcctctctgc

SEQ ID NO: 27766 - DNA, 201 bp, Bos taurus
gcagatcacgtttgtatgaaagttcttggtaaacgcgaagcgcctgacaaatgttgcatatggtacatcatttaaataatgtctgtgtataagtctgcacgtaatacccaagtatgtatgcacacattcatataacttatatgtaatatgtgcttcagttaatttattattataatctagaataatttcatctaatgctaa

SEQ ID NO: 27767 - DNA, 201 bp, Bos taurus
ctttctatatccttcccagttttctgtagggctccctgactgtttttctttatatctaaaaacttcttatagctcctggcctcaaagaacacctgaaggggcatttttataagtgacttagaggacaggtgtgagaatgaagcaatttttttgatttcctggaattgtttatttcttgtggcctgcttgggaggattagag

SEQ ID NO: 27768 - DNA, 201 bp, Bos taurus
gaaatcaaggtaatatttaggacagaccagaaggaagaacaaccacaggacatcagtttgaggcgatagtgctgatccacaaaaatcattctttcaaaccgatttctagcttcattctccccagatcaccagcaacagaccactctcacccacacagcatatcctttattttctccagagatacagctccttttctgagca

SEQ ID NO: 27769 - DNA, 201 bp, Bos taurus
gtgtgtctgtgtacacgggcactctgcctgcctcccatcctgggaaggaaggaaggctccttccttgtgcttaggcagcagaatgccaaatgtgggggcagggctggaagagcagggcacacaggtaagaaaagaggccagtgcccctcaagtctcatagcgtccgcgctcctggtgtcacatgccacagcgtccagcacg

SEQ ID NO: 27770 - DNA, 201 bp, Bos taurus
ggattctttaccactagcgccacctggggagccccatatcatgcacagaatgctctgatgtctctcctagcaggcatctgcctcttcaaagcttcttttctattttcatattagtctcagtcacagctacactagagggcacttgaacaccacactcaatgcagacccaaccactggcacaggtactggtggcactttggg

SEQ ID NO: 27771 - DNA, 201 bp, Bos taurus
aggcagtagacaggaacagagtgtagcagagctttagagagagtaaaattttccttctggaaagtttcctttgctgagatcagggccctaataggtgaagcgctggaccttgagacttggagtgggtgtatctgagtgatgcatatgagaatttttagctcccagattctcctgaaccctctttgcctatagtagaggccc

SEQ ID NO: 27772 - DNA, 201 bp, Bos taurus
atgtattgctgtttgcttggtgtaggcagctttgtgctgtcgctgaatggatggttggtttcatctcctccagtgacattgtggacactctggatagccttgcctgtaactccaaatgcatgttttttaaaaaatcaatcacctcccatcccagacatattatcacaagaagggcaggatgacatggctcatcagactcaa

SEQ ID NO: 27773 - DNA, 201 bp, Bos taurus
ggctgggccagtaactgcttgtgccccatggtaacacttcactctgctggcagcaagcttcatactgagtgctcaatccgtgtcaccccaacaagtgctcggcaggtagccacagaacacacccatcactgcctcactaacatgtattctcaaggagctcgacactgagttgaggggaccctcacaggaatgaaacaagct

SEQ ID NO: 27774 - DNA, 201 bp, Bos taurus
attcactcagctgggacctccaggatgtggtgacacagatcctgaatcagaaagagtacactgcatccttccaccctcccaggctccgaggccctagtgtgcccccttcatctcaccagagctcctgggacttcacgtgcttagaaccagccacgcgaagatggcaagaggctcctgggccagggcgatagtgagaggcaa

SEQ ID NO: 27775 - DNA, 201 bp, Bos taurus
ggctgacggcttatcactgtcatcgccaagccctgcaaggagccaccgctctgaggtctcccatgatcccacggggctggcttcaatctggggaaacccccaggtttcaaaggagtctgggagagcctctgcaggtcacacacggctttaaaccccctcatgtacttatctgaacattaggacatctgcccccatggtcct

SEQ ID NO: 27776 - DNA, 201 bp, Bos taurus
taataaattacaacactcaatataaattcactaaaaagagagtggaaatgctatttatagtttacacaccttggttgttttgtagagattttgttttagcgattctacatggatttaactgaagaactgatgcaacttcacatgctccacggactgatctggtttttatctttataggctcatgagaaccagcaccctaaa

SEQ ID NO: 27777 - DNA, 201 bp, Bos taurus
ctttacccactaaactgaattgctgttttttaattaaatgcagatatctgaatatacttcgatttgttctatagtctggtccactgatctactctcctgtgctattcctgtaccataattgtttgtttacacaaactttaccgtgggtaacaactggcaggtttgtcctatagtcactattctttttcagaattttcttac

SEQ ID NO: 27778 - DNA, 201 bp, Bos taurus
ccaccccccgccacagtggcgcccgctctggccactccaggcttctggctgctcctcagaggtgtcgttccttttcattcctccacgcctctgcagtcacgtggcctctgttcagagtgcttgccccagaactttccactcaggaaacttactcaagagctgattcagacattccttcaacttgaagcctctggatatctg

SEQ ID NO: 27779 - DNA, 201 bp, Bos taurus
gccagcccccaccgggggccaatgtctgggtaggtttttgcctgagaaaacctcctcctcagtgtccagggtagcaaagggacagtcagcggcagaccagagctcctctagtctcctgtctcacacatcacacaggacgggcacatagtaggtgctggcacacagtaggtgctccacgcctgccttcttcagggagatgtg

SEQ ID NO: 27780 - DNA, 201 bp, Bos taurus
acatggtattatgagggctagagaccttgtactttcaaatttaattgttacagcaggagaaatgaaataagaaccagagtcaaaggggaaaaaacccacagaaaagatacttatccttaggagtcaacttatacacatatagtagatactactgtaaacaggtgatatttgtataatctagcagcaatgaaccccaaaaca

SEQ ID NO: 27781 - DNA, 201 bp, Bos taurus
cctgacaatttctctacagaatttttattttaattgattatatactcttgtgatatctaacactgtcttgtcaaatgaagactaacatgtattgagtccttacctatagtcaaggcattatgggagacacacaaatatttgtgcccaaaattttaacagaaagaaacataaaaatgcacatactaagggacagcacaaaga

SEQ ID NO: 27782 - DNA, 201 bp, Bos taurus
acaagcaaacgcgggagcattctccagctctgtgaagaaattgctggtgaaattgagtcagatactgtagaggtaaaaaaggaatcttcacaaatggaaaatgtaaaggaggagaagcctacagaaataaaattggaagagacagagactgaaagacaaatacttcatcagaaggaagcgaatcaggacgttcagtgtaat

SEQ ID NO: 27783 - DNA, 201 bp, Bos taurus
tggattttcaaccttagtcctcccctcttatcttcccattcctcttgccttttactctgttcttgaaatttgaggtaatttatgaatattatacagaattcgaggtaatatcatctttgtataacccagcaactgcctaataaaattgtcaatagtgagcagagaaagttcaaattctggttttgttaccttctaactaac

SEQ ID NO: 27784 - DNA, 201 bp, Bos taurus
aaggcagtgttgtgtcctccttgacccgtccaatcctgtgttaggatcttcagggttagcaggcattgagagcagaaaagttactacggcctgggattccagtggctacaactccactcagcaaatcaggtttcccccaaaaggtagccaccagtcctaagggacatcgtagagtgaaaacactttttaaagacaatggcc

SEQ ID NO: 27785 - DNA, 201 bp, Bos taurus
gggaagggtagccttatggagggggctttttggctagggatgtggttttaagtagagaaagaaccagggaaatatatcccctcccaccctatagtctcctcctgtgggctccctttacctgaaaagctggtatacaaaagaacccattgctccaggcaataaaaaagtcaagtgttagttgctcagttgtgtccaactctt

SEQ ID NO: 27786 - DNA, 201 bp, Bos taurus
gggagtgatggaggggccggggatgggaggttagcttccgacgtttttgggatttccctgggcttactccttgaggccaccgccccttttgtataaatttcagttttatcccgaggcagatggcgagcttacgttttgcttcgtttttgtttcgtgaaacattgttttgggcttccacggccgaagcacattgttagcttt

SEQ ID NO: 27787 - DNA, 201 bp, Bos taurus
gatggcggcctgcagggcagggctgcactggggttgatgctggaactctgacagaaagccaagggcccctggctcctaggaccagggccttgccaggctgcgcctctcgcaacacgagagcagagtaaacgactgcaaccgtcccaacattaatggcttccagatggccagggagcaaatagcacagggcacgcttggcac

SEQ ID NO: 27788 - DNA, 201 bp, Bos taurus
gctgagttaaccagaataattcaggccgaaaaggagtgttacaccgccactgctggcctttgcctgatgcactggcttgtctgacctcccggcccagaccacacagtctctggtccctgctgtcctttgcctgggaggacctggctagacggggtcaggtctttcactgtccagatactaatcataacgggatgtcattgg

SEQ ID NO: 27789 - DNA, 201 bp, Bos taurus
catgtactagagcgcaccaggctcctctgtcgatgggatttcccaggcaagaatactggagtgggttgctatttccttctctaacatatacatatatcccttccagtttggatttccctcccatttaggacatcacagtgcattaagtagagttctctgtgctatacagcatgttctcatcagttgtttattttatatata

SEQ ID NO: 27790 - DNA, 201 bp, Bos taurus
catggtaggattcgtgcccttataaaaagaggaagtgacatgaattctatctgtcatgtaaggaaacagcaagaaggcagccatctgcaaactaggaagatgggcctcatcagacacaaactgtactggcaccttgatcttggactttccagcctctagaaccattatgaatgtctgttgtttaagccacacagtctatgg

SEQ ID NO: 27791 - DNA, 201 bp, Bos taurus
tgaacataatcagtttttatttcccatggtgatataccaacagctacattcgtttctgatagtttgcaattcagtaataatagctttgttcagtttagtttattgaagacataaaaatacttggcagccagaagctgaatttcgtggttcaagagaacaggattccaagaggacctgtacatggaacatgggtatatgcag

SEQ ID NO: 27792 - DNA, 201 bp, Bos taurus
agaggacacaatgtgctcaaatctatcatctcaccagtggtataaatattgaaactaaggccaggaacatatggccctaaaactcaataaagcaagcaataaggcaaaatatccatgtatctatgtgccgccccaaattagaagttagatttcctatccctccccgaggagaacatatttctaatgccttttaccaaattt

SEQ ID NO: 27793 - DNA, 201 bp, Bos taurus
aatttagaaattcttaatggcaaccttttctacttagagtccaggctaaggcagatgtatttgttactttcccatgctagttttttctgaaccatcctttcagtgaagatggccacacagtcagctggcctccactatgcactacaatgctgttctccttccattccaagttatcacctgatcgtatttctcaggacaaat

SEQ ID NO: 27794 - DNA, 201 bp, Bos taurus
gtcctaattcatagaaattggtctccaggaactcaaagcaaaacaaggagcaaagacctgatgcacagacattctttgatttatagaagtctctgtatgtcatagagtcaaaaccagctcttttcttcaattagtttccaacttcatctttaaataccttattcactcagagatcatataatatttttcttaatcttttag

SEQ ID NO: 27795 - DNA, 201 bp, Bos taurus
caggccaaggtcacagagagaagaagaagcagagccatgacgtagacccaggtccatttccgctcttcccctttcactctatttgttctacagcactaacaaaattcatgctaagactgaaggggcccctaaccttcagatatcatgcctttagtctgagtcacaaatacagcaggaaaagaaagtagcgcctgtgtattt

SEQ ID NO: 27796 - DNA, 201 bp, Bos taurus
ggaaattacatagcaccatatgttttcaggaccgttggtaatttgaaatgcacataagagatttcccaagtcaacatttattagcataatcatttattaactgtgcaaatgacactgtccagacaccccaagtaaaatctacacagcaaaaatggcattgagtcaaactgttgttcaggagatttcagctttgaaggcaac

SEQ ID NO: 27797 - DNA, 201 bp, Bos taurus
aataactccatagatattgctgaggttttgagatttaatggctacacagattttatctaaatgaactatttgaatttgcttcgcccttctgttctcattcgcaggttcataaaatactcttgaacatccactaaaagaaggaaatctttatgggtgaagaagatataaacctgtcttattcttatgtaattttgagttttt

SEQ ID NO: 27798 - DNA, 201 bp, Bos taurus
agtgtattgtctatagcttcatttctcttgggtgtaattgggtagaatatgaatatttttaattttactaaagtataccagattgctcttcagtatggttctagccctgtccacaatgtgtaagtccattttccctctatggaaagctatacttaatttgtttttccttcaaaatatagctgtctttttaatagagctttt

SEQ ID NO: 27799 - DNA, 201 bp, Bos taurus
ttttctaattaaccgttttgttttgtttttagctcactccttcaaaccaacagcataaaactgatgaaaggggcagggctaattttggagtgttcagtgttttggcccctaggtaagaactgaaagtattgatagttattggtattatagagattgatttttattattacttgaagttaagagtaatacatagctgctatt

SEQ ID NO: 27800 - DNA, 201 bp, Bos taurus
gggctgaactgtggtccagggtaagtcgatgttcaaaccctcaacacatcacaccaccaccttatctggaagcaggatctttacagaggttaactgagcttaaatgcggtcgtcaggatgggccctaaatgaatgactggctcccttatgccaaggggagccctggacaaagagagacacacacagacacgcacacccggg

SEQ ID NO: 27801 - DNA, 201 bp, Bos taurus
aaggaatggggaagagggcccagaagtgaggacgctcgccaggatgcgaatccgagagtaattgagtgacctggaccaagacggtggtgtgttgatctgaaacgtgccagacagatggcctggagtttggggaagaaataaggcatttgatttttggatgtgccgaagtagaaggaccgcttgtaccccagagtggaaact

SEQ ID NO: 27802 - DNA, 201 bp, Bos taurus
tgagtgtcggaaatgtgatttctcaactttgctgctgctgaatgttgaacacaacctgtggcaaaacttctctgcttctagcaatatcgcagttggcaatgcaagcaagacaccccagggcgactgcgaagctctttgtgaaactcaggtaagcaagggaaaggggaatccaagacataaatcccaggccttccaaacaga

SEQ ID NO: 27803 - DNA, 201 bp, Bos taurus
aataatattggcaagtttgaataatatttgtcattgtaggtagagcaacagaactttgtttttcagagcaggacgaagcaaatatatcacaaaagtgaaactgccgaatttaagatgagttgaatcctactgtactcaagcaatttatccctcccttatttcatataaaaatgtgatttcattaactgatcacagatttca

SEQ ID NO: 27804 - DNA, 201 bp, Bos taurus
cctctattttattctttatttgatctgcattctttccatcctgttttcacatctcaacttattttgtgacagctttgcagcttcaagaatttggctaaacagccctctgtgctgagatgtccgggcactgcccccgcccccaactcacttctctacacagaataatttggggctcactggtaaacccatggtaggtaatga

SEQ ID NO: 27805 - DNA, 201 bp, Bos taurus
tgcaggcagattctttatcatctgagccacaagggaagccctggtatctctattcctgccttgcaaatatgtccacctgcacccttttaatagattccatgaatacgtgttaatatacaatatttatttctctccttctgactttagaaaagtacaaccttctaagactaaaccaggaagaaatgaaaaatatactccttt

SEQ ID NO: 27806 - DNA, 201 bp, Bos taurus
ctgggccccactcaaggtcattggcttccaagatgctcctgacgtgcatcctcctccttgcatctgagatgctcttccccaggtgtccctgtactttgcaccagcaccaggcctttgctcaaaggtcttcctcagtgaaggctcctgtgggtgccgaatttgaaattacactccctgcttccaacacacttctctgtctca

SEQ ID NO: 27807 - DNA, 201 bp, Bos taurus
tgatggctgtcttgacttttgagaagtgagggggcctagctttatagagtattggatttctttcatttctatgattaacctcaaactgatcaccgaagccaatgtctggccctcatgggccaagagctctgtttctgaaagtcacatgtggaaagacatctctacctcaggagcagttcatgctctacttatttccttgga

SEQ ID NO: 27808 - DNA, 201 bp, Bos taurus
tgcactgcagtgggtgaacgcgtctgtgccctgtactcgacactgctctgtgatgtaactcgtctcccagccaggctgtaaggtcccgtccctggcccccagctcccagaatggtcccttctacccgactgagctcagtgaatcaaagatgccaattacatggaaggaagggccggcctcttctgttgttagtatcttaac

SEQ ID NO: 27809 - DNA, 201 bp, Bos taurus
aagaaatttggtgtgtgagtgttgtgagcatgagtgtccagaccctaacctaaccactgactaaattatagtctcagaaatggaaagaaagcacagatcagagtgggtgaaataccgcagaatttaagcagctccagattaacagagatctttatgaacaaagaaaaagaacccacacagaacaaaataaagagctgcaca

SEQ ID NO: 27810 - DNA, 201 bp, Bos taurus
catgataaatgtgacaaaaaccagtaccaaggacaaactctgtgtttcactcaaatccatcaagtgaaaaaacagtgagaccaggatgtaaacatgttaggaaacaagtggactttccttgtgtataaaaagcatttaaaagacgcttgctccttggaagaaaagctatgacaaacctagtgtattaaaaagcagagacat

SEQ ID NO: 27811 - DNA, 201 bp, Bos taurus
tagaaggaattcctggggcatctaaagattcatcctagtggtttaagcctttatatgcaagtggctttgaactctgcttggaggagccttgcttttttcctgtgacaggttctggcctcaggcaggatctgagcaacttcaaaagagggcacctgctccattctttcttctgtgcaggtgtgaactgggtttcactggcga

SEQ ID NO: 27812 - DNA, 201 bp, Bos taurus
ggccgaaatcaaggtgtttcctggccgaacattggtctggaggatctggggaagaagtcacttccaggctcatttgtgttgctggcaaattcagttgcctgtggctctggcctgaggtacccatttcctggctggcattgggcaagcagtgctctcagcttttctaagcttctctgcattccttgtcatgcccctccagct

SEQ ID NO: 27813 - DNA, 201 bp, Bos taurus
acacacacagacacacacatatttctcgtgtatcacaaaatcttcttttgagttcctgctaccagtgaaaactgtaaacaccatccatggtttgtgggccagacagaaacaagagattaggggcagatttggtccatttgctatagtttgctgacccttgtcttgaagttcgtgttgttaaaactgtgtcataaagtttgg

SEQ ID NO: 27814 - DNA, 201 bp, Bos taurus
caattattgtcttaactaagatcctgtgggcttctgaaaggccagccatctctaaaaattagttactgaaggtaggcctggaacagaacctgtaaaatctgttctctttgcaaccctatgcactctacagtccatggaattctccaggccagaatactggaatgggtaaccgttcccttctccaggggatattcccaacca

SEQ ID NO: 27815 - DNA, 201 bp, Bos taurus
agactgatccaggtgacatggacctggcttcagcagccgtgggacaagcgccccaggtgacctgatgtgcaaccgaggataagaaagttcatgggtggtcgagaaaggccctcggcccgtccacacgttggatcagctggggcacttcacagatacaggagccaggctgcgcccccgaagatgggggtagacagagcctgt

SEQ ID NO: 27816 - DNA, 201 bp, Bos taurus
taatgaagagggtaatggggaatattttcttggcaatttgacaataaacatggacatctgtattgaatataaagttccatttgttggaactctgctcaaccttatgtgccagcctaaatgggaggagggtttaggggagaatggatacaagtatatgtatggctgagttccttcgctgttcgcctgaaactatcacaacat

SEQ ID NO: 27817 - DNA, 201 bp, Bos taurus
gctcggtctctgttccatgagctttgggtggatgctaacaggctccttgctcatagatcacagaatgtcatttctgtcacatttcactgatcgagtcagacggccagcccagaagcaaagggagaattagactccaactctttttcagtctgttggactgcacgagcatttcacccacatcttgcattaaaggaaactgaa

SEQ ID NO: 27818 - DNA, 201 bp, Bos taurus
cttaactccctttcttcattctccttcaagccatagtccagtgccttataaataataattcccaaagattctataacctaggaacattattaaggaaggcggttaatagagacaactgaacagctttatagaactgtaaggcataaaatattcagtacgatatttaagctacgtctaatctattccatttcagaaatgtga

SEQ ID NO: 27819 - DNA, 201 bp, Bos taurus
aaattttattttcatatttaaactactgactacttataagcaaagtagtatttattaaaataagataaacacttaatttatactaacatcctctcagatttatacaagtttttcatccttaatttttatacacacatcatgatacttttcaaacattattagtgaggcttatacaaaagttaaatatgacatcgaagccag

SEQ ID NO: 27820 - DNA, 201 bp, Bos taurus
gctttgtgtgccaaggtataaagtgaagtcagatgaatgcaaggagttaaatctgtgttgtgatgctgtgtttttaaaaattgcactatcttcattgtttgacatgaggaagctttatgtgaagtcctgtatgttgttttctcacctatgcatcattaggccccataataatgttccccccataattgtgcaggaaagggt

SEQ ID NO: 27821 - DNA, 201 bp, Bos taurus
tctgaccttaagagcacttctgcactaaaaactaaattcatcattaaaaccctgggactatggtaaacactttctgcatcttcagttctgctggatgcacggcactgtcatcacctcacctgttgagaccattcatttaccgtttatcacagagatgggttttgaacttatgaaaataagttcgcttttaaatacttttta

SEQ ID NO: 27822 - DNA, 201 bp, Bos taurus
gaaccctagtgctagcatggccagaacttcatgatttgttttgaacccactttacagcctgtgtccaccaatgcagcctctggcactggccatgacgccaactcaaactctttaccttccttcaagcacagaggtgttcccacatcgttgttcacgtcacttcctccacatggtggtctctctagcttctccactcaaaat

SEQ ID NO: 27823 - DNA, 201 bp, Bos taurus
gatttaatacattgccttaaaggctcttattaaaagtgaattgaattgaactgaactgaaatactgataaagaggtctgatgacagtgtcctttattccttatctccagagtaaaacgtcctgagaactacttcttgagaacactctgtgagctacagagcagttaaaatatttaaacttgaacttggatggccatcccct

SEQ ID NO: 27824 - DNA, 201 bp, Bos taurus
tgtgttcctggtggccctgttcatctgctcaccactcatttgcttgcatgcagccattggctcaatcgtggggctgctggcaggtaggccagggcgcccccggctcagcaggggtcattttcctgaggtcatttctcccagcacacagtaaagagtctaggcttactatcttctctgaagtttttagacactgtcagggct

SEQ ID NO: 27825 - DNA, 201 bp, Bos taurus
ggtagatccccatgaggttttctcatgcttctgctgtgtgcaggacaaacaaccagatattcagtggagctgaataattgcacaacagcattgtttaagagcaaaaatgtaggcacctcggtgcctccagccatcacccatccccaagcttccctggccaggacaggcagtgcagcgggtagaaattgtgcactttacgcc

SEQ ID NO: 27826 - DNA, 201 bp, Bos taurus
actgaaaaagaagcaatcctagcacactaatacagaaagaaaaggatactatgttaattcaagtaagatttgactatcatgatcaactcgtcttcgaaatcagagctgaaacagctaaagaaaatggcctagtcatttcccaatactgaatggaaaaagcaaaactcttgattccaactgaactacttactagctgtgtga

SEQ ID NO: 27827 - DNA, 201 bp, Bos taurus
atgcggagagaggctcaaaatattcacaagttaaaaaggtgaaagtcaatcaaagctgagcctaggaagacaaaatttgcttcccaaccgaaatccagacgtagatgcgggaagtcaagaacgcagcagaaaaccaagcacctagagagatcacaggaggaaaaagaaaaaaataggctcctggcaaagtctggcaggagg

SEQ ID NO: 27828 - DNA, 201 bp, Bos taurus
aagggctggtggctgaggccttaaaatcaagacaccaggaacgactgcttgattaaatgtctttcccacattcagctggagagtctagaagaaaagccacattgaggcctggaggctggaagcacagaacccaccctccctccagctcattagcatcattgccccctcccccgattccagtgacactacccaaccttctcc

SEQ ID NO: 27829 - DNA, 201 bp, Bos taurus
tctgaatgctcccagtaccatcagtgatcagccctctccaagcagctgagtccatcactgggcagtttggatggcatggtgcagaaggctctgtggctttccaccaagcatccatgcttcccttccgtgatgtacagagcttgcccggggcaactgtccagccaggtactacaatcccaggtgcccttgcatctaggtaga

SEQ ID NO: 27830 - DNA, 201 bp, Bos taurus
actgtacatgcttggccaatgcacagccagtgatgacttcgccatccacttctgcttccaggctgttccaaaggctggagaaaacaagtcatgctgacagaggccccccactcctggacaaggccatgtccctctctgttgcacactttcccgaaacactcttcccactcctgttcctggcagaaggtctggcctctcctc

SEQ ID NO: 27831 - DNA, 201 bp, Bos taurus
gagccctgggtgatccatgacatggcaggtaaaaaaaatcaacttttaaactgatacaggagctacttagctctatcctgatctctcaccctcggcctatctcctccaaaagccgtgctgtgactggtgttgatggagtctcccacgcacacctgttgctttgctgggcctcatttgccaacttgaatagcatttggtctc

SEQ ID NO: 27832 - DNA, 201 bp, Bos taurus
gcgtgaagctcttgtagcagaactcgcactggtagggcctcacgcccgtgtggatgcgcatgtggttcttgaggtcgtagttatgcacgaacttggcgttacagtggatgcacagatagggccgctcccccgtgtgcttcctcatgtggattttcagcttgtcctgcctgcaacacagagccggagtcagtccctgcctgc

SEQ ID NO: 27833 - DNA, 201 bp, Bos taurus
catcaggtttggtggccaaaggcacacaggcctctgatctctccccttttgctgcaagggagagaaggcgctgttttccccttttaacagatggaataaccgaggccagggacactagccaaggttgtttagctaagaagcagccaagctgaactcacctgtgctggctgcagttctcagcccttttgactccacagcctc

SEQ ID NO: 27834 - DNA, 201 bp, Bos taurus
gctttcttccacaagcccaggggcccccaagtcatgctgtggtttagggttcagattgtagcagtgcagatagcccaggatccgtccacaacgaaagctcgcatggaggtcctgagattggtgttgaagccctagtgggtgtgagtgcttagctctgttaaatctccagtaaagcaggagcctctggcctccatcagatat

SEQ ID NO: 27835 - DNA, 201 bp, Bos taurus
aatgcaggaggcccagaaggtacataagaatattatgcctaaaaaaaaaaaaaaaaaaagcacatactttaatttaaaaacattttattttgaaaaaaaatgctaagcactctcttggcctttagccagttgcagtcttttggttattgggggttttactgctgactgatcagagtggtggttgcttatggtgggggtggc

SEQ ID NO: 27836 - DNA, 201 bp, Bos taurus
ggctgagcgactgaactgaactgaacgacattttacatttgtgctaaagattagggacaatagaacatcagagaaaaaagcacatcactgggccacggaaaactcactgctctgatatggcttaattattcaactcagagagctgctatttccttttctttatgtctgaatatcaactgtggcctcataatcatcaggttc

SEQ ID NO: 27837 - DNA, 201 bp, Bos taurus
gcccaagtcagatgcccaaccctggctgcttccctgggctggagcaagactacagtcagccctaactgtcagccctaactgcagggctagagtggccccaactgggtcctgggagaaaggtcctggaagcaggggtggagcaatgtgcctgggtttgcaatgtggggagaagtgtgtggccacgtgcacacacggagcaga

SEQ ID NO: 27838 - DNA, 201 bp, Bos taurus
gggttgactgtttccaaatccagcatctgatcgctttaggaggccaagggctggcaggccaggggagtaaaattctttccattgcattctcatctggcctccttggagcctgggtttcttgaaaccctttcggggtccaggcagtggctctgggacctgcttgagtcaaatgtgcaccttgtgaaggccctttaggacatg

SEQ ID NO: 27839 - DNA, 201 bp, Bos taurus
aacgagggccctgaacagagcctaccctggaggagcagtggcagggagctgggaatggtggcatggagctagttatttgggttcaattttggattcatcaattgctttggcctcttgatggatttacttcatttttctcattgtagaactgatgttgagacttaacacctcctgatgattagggaataacattcattagtt

SEQ ID NO: 27840 - DNA, 201 bp, Bos taurus
ggccaattcatcttactgttgctgtgtctacacagactctttttttttgtctcaatgtggaagaactttagttgactgacaggcgctagccattcacagagtgtctaattagaactctctgtgggccatgtctaatgaaggctatggtttttgcagtagtcatgtatggatgttagagttggaccataaacaaagctgagc

SEQ ID NO: 27841 - DNA, 201 bp, Bos taurus
ctcccaaacctccaaacccgaagaggttttgctgaaccaaattgaataggaatgtctttcttgtgtcttttccttgcaccttgattcctgtaatctgaggcgctatggaaaacactgagactggctctccaaattaagtattcgatgagttcttgaaccagtccataacaataggagctttttgaagggtgcagctttacc

SEQ ID NO: 27842 - DNA, 201 bp, Bos taurus
tgtatatcacatcttctttctttattcatctgttgatggcaacttgggttgttctgtaccttggcaattgtaaacaatgccactatgaatggtggagtgcatgtatctttttcaactggtgcttttgtttccttgtctcttctccaccagggggggaattgctgagtcatagtgtagttctagttttggtgctttgggaaa

SEQ ID NO: 27843 - DNA, 201 bp, Bos taurus
gctacgaagctccccagggcctcaaactcaatttctcccccagcttcttcctaaaactaaagtaaacacactggagcactgtttaccagaagcggccaacgatgccccaaggagcagtatccctgaacttgtaatgctgtcagcagagaaaatgctgatgcgatatttgacacccagagttcaagggagagagcaactggg

SEQ ID NO: 27844 - DNA, 201 bp, Bos taurus
aatacacagtaaagaaaataaacacatcatttatttagtcaccttatttcctctttgaagcattttcttaatttgggtaatagctaggatgtccagtcatttacatttcagaagtgtgtgtgtgtgtgtgtgtgtgtttaattggtcttaaataggatgtgaattttgttaagaaaaaattatattttagtgtacttggtt

SEQ ID NO: 27845 - DNA, 201 bp, Bos taurus
caaaaataatagaattttagaatgtgaggacctcatagatcatcacacccagtgccctgattttaaagatgagattcagagtgaggaagcgacttggccaatgccatatacaacccattagttatctattgggaaacaaatgaactgaagtgagaagtgttctcacatacaggtcctcggccttactacagagtagcgtga

SEQ ID NO: 27846 - DNA, 201 bp, Bos taurus
ctgatctcctgacagtgacatcataggcttttctgcccagagtcatttataattagggctccaggtaaaaaattaacagcaggaacagatgggcccataaggggcaaagagtcttttcacatggaaatttcatcagtactttaagactgaagaaaactgtagagcacaggaaggctcggccccaaaataattcttctccat

SEQ ID NO: 27847 - DNA, 201 bp, Bos taurus
atgaaagaaaaagttttaaatgtatccaaactcagataatttgtcttaaggaataaggtaaaatgaagagtctcagtactgttggcttaaaatcttctgagtctcaataattcttgtgctcaaattaaatgaatggtttatattaggaaggggaaggtttacagtgggtagtgaagcttgtcaaaagtcttgaagatgtgg

SEQ ID NO: 27848 - DNA, 201 bp, Bos taurus
tcatcccagcattcaaacaacaggatcttcctaaaacagagctaaacatttcatcccagcattcaaacaactgttggatttggccatgctctccgcacccccaacatggcagcaagcttccacaaccacatcccagcctatgctcaagtctactcactcagcagcctcccctgcttgcttccagctaccctcgcactagtg

SEQ ID NO: 27849 - DNA, 201 bp, Bos taurus
aagaggtcctattttggttaaaattaaggtggcataatactttcagaaagagaaagtttttcatgtagtccataaacttcggcataattaatttcaaaaaggaagctcagatatgtcatgataagttggtagagttatttgactaagttgtgttttctgaggagggaaatcttacctacctgtattaatttagtaactttt

SEQ ID NO: 27850 - DNA, 201 bp, Bos taurus
ttcaagtttctcatttgcaatgccatgctcatccttcctctctcccttccctttgttatttggccttaaaaaaaaaaaaaaaaaggacaagctccatatcgctgtccaagtgctgaactctcaccagtttaaaaggcagtatttttataggggaatcgtgaggctgtcacattgatttcaggaagcctcggttccattctg

SEQ ID NO: 27851 - DNA, 201 bp, Bos taurus
catttacaaatcctgcaattgtaacagaatttttgtttctcagagacatgtagccattgatgttgctaacttttataatggttcttgaattttagtgaatcgctcattttaaaatgccaattatacttttctctagagtcatacatattccgttttcctctctatatgctcacctttgaaaggcagttaacttcttggaaa

SEQ ID NO: 27852 - DNA, 201 bp, Bos taurus
cacatacacatgtgtgcatacacagtatcacaaattttgtagttctataaattatttttattcagattgttttccagtttttgaacaactacatcagacaggaataaaatctcttctccttgtaaatagcctgagaatgcattcaatacagtcacgctggttaataattgttactgtcattttgaaaacacaaaagaaaga

SEQ ID NO: 27853 - DNA, 201 bp, Bos taurus
gttaatatacaatatttgtttttctctttttgacttaacttcagtctgtgtaacaggctcctggttcatccacctcagtttaactcactcacattaattccttttcgtggctactagtagagttttaaatcaattcatttctattgtgtttttgatttatatgcttgtgaagaagaaagattgaattccctagtttcagat

SEQ ID NO: 27854 - DNA, 201 bp, Bos taurus
ttgagatcagtctgactgactgacctccagatcctgagatcttaaaaagcaccagtgccccttgctggtgggctcagtctggccctgtgcatttggggtgtgtacttttcctaagagaaaattccaccttgagtgctgcacggggagagtcttactttgaccttccattattctctctctctcccatcttggcctctggaa

SEQ ID NO: 27855 - DNA, 201 bp, Bos taurus
acgggggcgctgctgcggttcccataatcaagccacagcgagggagggaactgctcttcttcacgagcttttgcctgcggtggtccagcgctctaacaggcagcatccatctctggaccagtttcttcattacgacgccctcgtcggttcccatccagtcacaccagagggccgtcccagtatgactgttcctaaggtgat

SEQ ID NO: 27856 - DNA, 201 bp, Bos taurus
tatcattgcattttgcaagaaggcgtgactgttgggatgttgtaaccaggatataaagtgttagtgagaggagaagcaggcccagaatccagagtctgacctcttttccccaaacaggaagccagtcacttatttcctgctccaggctaaggacccaaagaggtgccatttctcaaccacttagtttcagagcttttccac

SEQ ID NO: 27857 - DNA, 201 bp, Bos taurus
gcagacttttctgtcactcctcttggcttcgtggaaacagagcacgagttaatggtgatggcagattttcatttatttgtatatatcagtcaatagaaaggaaaatgatattggctgtgtgtttataagcaacattagaaatttgaacaatagcagacccttactgaaacaaaaataaaatatgagtcaacaagattcttg

SEQ ID NO: 27858 - DNA, 201 bp, Bos taurus
taatgaccactatcaataaaagcatagaatagtgattgctatcaatgaaagctctcaaactgatgtactatcactgaaaaagtctgatgtgcatttttttaaatccaatttaataaaagcctagtcacaatagaaatagtggataagtgaaagaaaggacatcatttaagttggatatgtggcccagataaaatgatttga

SEQ ID NO: 27859 - DNA, 201 bp, Bos taurus
aggcacaggtccagtcctgggtcttctcagttggctccatttactggcaggttgttgatacatgtttggccatgtggcaggaaaaactacctccctactctacagccttgccaaaagtgagacacttcctttctttcctactcaaaaggtaagtcctatgaccatagaatatagttattataagagagttgcacaagggtt

SEQ ID NO: 27860 - DNA, 201 bp, Bos taurus
atatgctgttggactgatacaggccgatccagctgtgttttgtgttccttaaacatctcacactattcctcaaatgtttggggtttgacaaaaccccaaacgcatttggccaagcacgttttcccttgatttttaaacacatgtgggttttatgggaaatttaatccatgtgtttttgattcctttacacttaactcatca

SEQ ID NO: 27861 - DNA, 201 bp, Bos taurus
ggagcacagactctaggcacaggggcttcagtagccgctgcacctgggcccagcagttgcagcttgtgggctctagagctctggctcagtatttgtgacgcaagggcttaattagatccccccagaccaaggatcaagccaccagagaagcctctgtgtattgtttttaaatgcataggtatgtgactctattctcattaa

SEQ ID NO: 27862 - DNA, 201 bp, Bos taurus
aatggtttaaagcatggcttccttcaaatagctattagtccataaaaatccttagtgcttgcaagagaatgttcaaactgatattggtgtcatgtcaaatgatatatttttctactgataagggtggcccaggcaaagatagcctgacttttaatctatctcctgatcaatctgttttctccaactcaatttgagaagaga

SEQ ID NO: 27863 - DNA, 201 bp, Bos taurus
attaccagagacaagggataaggaggaggaagaatgggagcaagctggtcaaaaggcacacatttccaagcataagatagataagccctgaggacgtacagcatgatcactgtagctaattccactgcaaattgtacaggaaagttgttaagagagtagatcctgagagtctcatcacaaggagaaatttttttgttttct

SEQ ID NO: 27864 - DNA, 201 bp, Bos taurus
tgggttatggtattttgttttggaaacctgagcaaattaagacaccataaaagccaactatcctgcaaacactgccctacacatagtaagtgttcaataagtgtaaataattatgtttactcatagtaaaccttttcttcctaattgattggagaacaattcagtggctacatattttcacttcagtaagcagttaagaaa

SEQ ID NO: 27865 - DNA, 201 bp, Bos taurus
aataggaaaagaatctcgacaagaataggaaaagaatctcccacagaaggatattgcacttcaggacttggatcaccccaaggctgtcctttcaaagcattctcttcctttaccagtggtctctctgctttgcttggcaactcaattctctcctcgttaacaagctacgtgatgaaggctggaggtacctctgtttatttg

SEQ ID NO: 27866 - DNA, 201 bp, Bos taurus
gagggcgcccggtgccttcgtgagcgacacaagccctgtgtcaagaactttattggttttctgcgtaaaccagggaatgtcggcctctctctctttcttattgctgactccggaccaccaggttccagtccattaaacaacctcaacaagtggtgcccgaacaggggcctggtacccatggcaggtttgaacggagtgacc

SEQ ID NO: 27867 - DNA, 201 bp, Bos taurus
ccgtctccatgacactcgtaataaaacatagtaccttattgcccctcagccctgagagccgactgactcagcccaagaacgctgtgatgtttctggagaatgtttattgtatatggggtaaagtgtggcgattttaggattctgccttgtgtagtttaataggtatatctacagcaagattttacacacactattatattt

SEQ ID NO: 27868 - DNA, 201 bp, Bos taurus
gatcccgtgacaccctggattctcggtgagtctgctgagtactgggaaagagaaaaaacgaaggaatcgacagctcgtttcgcgggactggtgctccggcagaaaatggctgctttttacagacgaacgttggcaatagacttgatgatggggcgtgctgaaccccagggaagtgaaatgtagccctcctcaaaagagatt

SEQ ID NO: 27869 - DNA, 201 bp, Bos taurus
ggggagagggggttgggggcgggagggactctggggaacacgctaggtggaagggcaggggtcaagaagtggggtcaaagggctgagactctggggaaaatgggagattaaatatcctctttttcaaatcaagaggttgggataattaattggtccccaaacatgaaagtgtccgatgactgttctgggcagtggccattc

SEQ ID NO: 27870 - DNA, 201 bp, Bos taurus
tgactgagctactgaactgatgtcatggctccagtctggtcatcatgtagtttacttctccacctggggtttccaatatctataattcagctcataggatgtggctcagagtattacctatagcccctgagaaggaactaaaggtccttggctatgcttaatgagtatattattatttggtctcctctgattgggcttccc

SEQ ID NO: 27871 - DNA, 201 bp, Bos taurus
cttccttgcctttctagcctgtgatacggaaaatgtgagctgttctcacacacatgtgcctgaagccccaaactgcacgatgtgtgctttgggttaagtatggccctgggtaggtaccaggctctgggacagatgtaccccaaacagggagtccccgacctctgggccggtgcctgcagccctgggatgagggtgttgctc

SEQ ID NO: 27872 - DNA, 201 bp, Bos taurus
tccattgccaccatcagatggtcatgctgattttccaagcaataaatgcttttgttgtcttgttttcagggtgaacaaaactttctgttttgttggctttcgagtccctgacaaggaaggcaacacgtggggttgactctgctccgtgtcgagtgggtgctcagcgaaacactggtagttgtacttctctaaagttgtact

SEQ ID NO: 27873 - DNA, 201 bp, Bos taurus
ttcatggagagtatcttctggttgggggcagaccttaagggaaaaaggcagatggggttacaaaataacacagggctgtcaaggcaaatctctctgcgggagtatgctgggcgctcgcacgctgggttttgctttgtgtttggcaggggatgtgttgggaaagacctccgtgaggaagtgactcttcagctgagacccaga

SEQ ID NO: 27874 - DNA, 201 bp, Bos taurus
aagtccgctaaggcgctctttagcgctgaccctgacgagtgtcgtgttcttcagacaaccccatctgcacttcacgctgttctcacttgtctttgttgttcggtcgctaagtcgcgtctgactcttagcgaccccagacttcagcaagccaggctttcctgtccttcacatctcccggagtctgctcaaactcgtgtgcct

SEQ ID NO: 27875 - DNA, 201 bp, Bos taurus
tggttagttgctgcgtagggattaccgaagaacccagtccctgaggatctctcctttcaggaacgcacagttccgctcactgcaaggatttctctgtcctgcgtggggccatcgcacctatcagtcctctgcgtcctgcgtggggccatcgtaccgtatcggtcctctgcctgctttcaggatcatcctgtccttcttagt

SEQ ID NO: 27876 - DNA, 201 bp, Bos taurus
ataaccaatcagcatagacgataaaatcagaatcgcaccgtttgggccctaggcttcctgtgccgggcgcgctcctggtgcccagtgacgctcctgcccttggaatctgggagctggccacctccttatctcctgttcctttgcttttgtcaggagccagcttgagtgggttatatgcgagcaaaggaaatgagaattttg

SEQ ID NO: 27877 - DNA, 201 bp, Bos taurus
tttttctccatcaagcattcaaacatggcaaccacgtgctggagagaacacctagctgtctgctcactagctaatgggtttatgaagcaagcctgtttccgattttaaatcagcaagggataatctttagagggggaactcaagagtcacccatgtgttacaaaagcaaagagatgacaaacaatcccagctccaactggc

SEQ ID NO: 27878 - DNA, 201 bp, Bos taurus
gcatttgctttctccaaagactctttcctattacagacttctggagaaatagtttagtggagaaatatgtatgatgatcaaataggctctaacctagtaggcctgtatgtctgactgaaaataccagaaagagaaagaaatacttagaaaactaacattagatacttaacatatagaaatatatatatctgaaatcaacaa

SEQ ID NO: 27879 - DNA, 201 bp, Bos taurus
aagggtcaactgtagtgtgaaaatcctaaattagagtcttgtggatagactagtacgtcagaggcttgaaaaaggtgaatttacaagcagtaagatacgcggcacagcagataacgtacttacagaattcattatttggagagtggtataaatggaagttgtggttaaatgaatgacagaggaagaggaaattaggatttt

SEQ ID NO: 27880 - DNA, 201 bp, Bos taurus
gatcctctccttgccgtcaagggagtctctgcttcaggtttcaagggccttatttgtggcaggaagagaaaggcccctcctgtcctctgaaggccctttccggtcctaaagttcgtaacttgaagattctggggctccattttaagtgtctgtgcaccaaaagcaggcagaaaaaaggttacataattgggagactgggcg

SEQ ID NO: 27881 - DNA, 201 bp, Bos taurus
ccacgactctgcttgctcctggctcactgctgagccccacgggaacaccaaggggacccagacaggcactggacctgagggaggcccacaggtgagtcacgtgacacctcggagcactctggggtcctgtctgacatccagccttttctccccctgcttcccttcgagatgcacagtcctggaggccgaggaaggagctgc

SEQ ID NO: 27882 - DNA, 201 bp, Bos taurus
cttttggtgttgcttcttgtatctttccagacatccaaataacaagctaaggtgacttttttgttttgcttttagagactgtctgtggccttcctttcacagaaggacaatggactccttggacgtccagttccccatcccgtccccttccacctcctcctaatacccctaaggtatcgatacacccgcaatctccttcag

SEQ ID NO: 27883 - DNA, 201 bp, Bos taurus
caccatgcccctggcgcccccagggggatgggccccactgcagcctcagcttgcctcagggcagggggagggaggctgggcacacaggaaggccggaaggaggggcattgttagggcagaaaggctgcagcgggtgaggagggaagaagggtgggagtcacatccaggcctgcctcacaagttcccactgacgacacactg

SEQ ID NO: 27884 - DNA, 201 bp, Bos taurus
ttacactaaatgcagaatggattccccagaaaacatcctcccagtcattttactgtaagcctctgaaaagtcactgcagcaaacaggtcctgccggcccttctcccagactgttccaagagctctttctgagtcttcagtgggctgagcctcacatccgcagagcttgaaggaaggcaggcaggtggccagccctgctctg

SEQ ID NO: 27885 - DNA, 201 bp, Bos taurus
cctgcaggcttatcgccaggacccagagtccatcggccaggggtgccaacctgtctccctgctgcaggactctgcctgccaccccaagaccaaggttgcacggaagccaggccctgtcctcgctacctaccctgggctctggctgtgggtgggccgcccccagccatcctctgtgctctcagtgggcacgggccgagctcc

SEQ ID NO: 27886 - DNA, 201 bp, Bos taurus
tggccgggttgggggtggtgagggcagcagggcgtcaggccccgcacagaggaaggcacgggcggcccccctgcaggcctggggggcgggagcggccagcacgggtgccgcctctcaccagcttggtttctgtattaaacttgagattctggatggtcttgttgtcctggatgctggtttccaatttcatcatttggttct

SEQ ID NO: 27887 - DNA, 201 bp, Bos taurus
caacgagcacctggtgcagccaaataagtaaataaaagagcttaaaaatcccacaggcttcaaagcttgagaccgcaaagaatttggtgaaatgcttgcagtgtgatctgatactgaggattcagaggtctaagcatctctgccgtccagcttgtgttctcctaaaagggggacactggttcacttcagagctgtctccac

SEQ ID NO: 27888 - DNA, 201 bp, Bos taurus
cagtcaggggtcaaacttgtaactcagaggagctgaaataaacgcatcacacagccgtgtttacatgtctgacctttctagagcattccgcccggaccccatgtcaccatgtcctatgcagacagtgtccacccccgagtcccaggaactggccagcagtcctgctgtgtgagtggccaggcttggcccagagacagccga

SEQ ID NO: 27889 - DNA, 201 bp, Bos taurus
ctgataacacaaatggagtggtgggggtcccaggagcatctaataacccacaaagtaatttgttcaagattaacaccgtttcctaaagagttcatacagctttcatacatcctagatgcactgtaggcaagaattgtatccaatccttcattttgcctcttaaaatctattagaattatttgagaaagtttaccgagtaca

SEQ ID NO: 27890 - DNA, 201 bp, Bos taurus
ttgaaaagggctacctattcttggcgcaactggatcatgatgctgtcaatacagatcctggtgcctctggtcattcttagcatcagcctctcattcctcaccttcgatataagcatggacaacagcccattggagctgaccctaaaatcatatggtcaaactattgttccattctacatttctccgaactccaggctgggt

SEQ ID NO: 27891 - DNA, 201 bp, Bos taurus
actcagtgcactgcatggtcccattgtgggagtcagtaaaatgtcctctgtgtttttcctagagtcatccctccgagctagacatgccttaaattcctttggggttccactgcctagatacagagtcatgaaaatttgaatatagggtacttttaaaaattcctgttgtctgaatctttcccaaccctggagtatatggcc

SEQ ID NO: 27892 - DNA, 201 bp, Bos taurus
ggggctgcgcccttcattttggcctctgttcatctgctgtcctgggccatttttctctgccctcttccatcaggaacgggccaggtgtagcacctcttcccggaagtgctgtgcaaatacccggcatgtgattcacttgggctgtctctattccacggttcctggcccagtggcattgttgaaaacaggtttgagtttgtt

SEQ ID NO: 27893 - DNA, 201 bp, Bos taurus
ttgggatttcatcgcaaaggtatggagtgcccacgtggctgaccttagttctgactgcagcccctccagaggtccagctgatccagtctgacccaaggccccaccataaattacatcattagcaactatctagagacccaaggaccccagatctacagacagtcttttcaggcaggactctccaaggggtggatgttattt

SEQ ID NO: 27894 - DNA, 201 bp, Bos taurus
ccttcaatgaacccacgtgcggcaggggcacaccgaggcgcagccacaccctgacaactgccaagctggccagcacctcccattctatagtcaatcttcacgcaaaatgtgccaagttctatggggagaaaacaagactccaaacctccgcctggtctgtcccttatcgccacacccagcgcttccccacagccctatcgg

SEQ ID NO: 27895 - DNA, 201 bp, Bos taurus
tattatataacaattgtctaaaatagaaatgaacttaaatatttattttaataggagtttattacctgttctatatattgagaatctgggaaagtgttactcaaaaaagaattaagtggtggggacactttccaggaactgaccaagcccacccaccttcacaagtcagatgaggggtgggggcccagctgcctgcctgcc

SEQ ID NO: 27896 - DNA, 201 bp, Bos taurus
ttccttctctgtgcacccccacctgtccttgtctggccacctctgtgggcacaaggaccttgttggtcccactttcactgtatcccttcaggaactgcacatagtgcgcccggcacatagtaggcccacaataaattctggtgaatgaatagggtgcctcctgggtgccaggtttcaatgcaaagttgtggttcttccccc

SEQ ID NO: 27897 - DNA, 201 bp, Bos taurus
atgccaaagggctcagatggggagcaatgatgagggaaggaggcaggcccccccacccccgcactgagcatccagagtcctcaggccagtcacttccccaactgctttttgtttaaaaaataaggaggttgattcctacaggcttttccttccccagaccccagagcatttgagaacagtgtcctgtaggccatggggtcc

SEQ ID NO: 27898 - DNA, 201 bp, Bos taurus
aacgtgggatcttagctccccaaccagggattgaatccgggcccttggcggtgagagtgtggagtcctaaccactagaccgctggggaactcgccagaccgacagcttagaaagcccatggccaagtgcctggtgtgcagcaggatttgtggcaacatgcatgtcatgatgcatcaacactgagggctttaaaataagaat

SEQ ID NO: 27899 - DNA, 201 bp, Bos taurus
tgctatttcctccaggtggcccttaggatgtaatttaatgtctctgagcctcagatgataaaataatatctactcataagagtcgtgtggacttactgagcgaatgtctgtaacacatttaatgtaatgtacctggtatattgagcacctcgtgtgctccataaatacggcttttattatttttcgttcccttatgaactg

SEQ ID NO: 27900 - DNA, 201 bp, Bos taurus
gctaaaagtctggaatatatatatatatatatatatatatatacagactggatttgagagagggtcagttctctctgaaagaagaatatgtgagatgagcggcttgagagcttccagcgtttcaaataaacaagtctgtcatgattgagaacagaccctcactttcacgtagaagaatatatgagagccagagagagggca

SEQ ID NO: 27901 - DNA, 201 bp, Bos taurus
cccgcaaaacaggagcaagctggctgaggggcgcttgtcagaatttgcagagatgagagatggcagcgaggcagagatttgtaaaaggcacagtcttggatgtcaggcagataatggtcagaattctacctgcttctctgagcctctgtgtctgcactggcacattgaaagaaaaaaaaaatgcctttttaggtgatgcat

SEQ ID NO: 27902 - DNA, 201 bp, Bos taurus
aggatctcaggatggtgcccaggatatgaatatgtattacagacaactcttgtctacaccacagtttgatgctcacaggatatttggactcttggtcagtgaagagtcatagatgttgagagatgcagaggtttttcatttctccaggatgcattgctgactgcttctgggaagccaacatttccccttctttcttcatga

SEQ ID NO: 27903 - DNA, 201 bp, Bos taurus
atgttttgctgcaagtggggtagattgagctgaagactgtgaaccacaggtaatgtaccttaaagccatcagatgattgtgaataaggctgtttagttccatctcagaagttcaatgaggttcagcctgttagtcaatagtgactgaaataatggcagctcttacccacctccacatgccttggggcttcctttgattttc

SEQ ID NO: 27904 - DNA, 201 bp, Bos taurus
gatgttaatatttaagaagtaggacactagattctattatctcacaagctctgtcaccaggccctctctgtagtcctgttatctaattattgggcttaaactgcattagtgtgctagcaatttgtctaccactggaaaagtaattgacatttgggttactgcttcatatttgggagacttgctagctagttccgaagagcc

SEQ ID NO: 27905 - DNA, 201 bp, Bos taurus
tgttcttaggcttgaagctttaaaaaagtaaataaattattacatacttacaaatggggacaggcatgatgaaaggatcaaatagggcatcccacaaaagagataatgatgggggtgggtggaagaaaaatctactgagataaggtggtcctggagggcttctctgaggaagtgatgagtaagctaataaataacagatgg

SEQ ID NO: 27906 - DNA, 201 bp, Bos taurus
attaagtttgaagtccaaagaataccctttgacggaccagtccaagcgtcaccctctaaccattgagacaagagtcccgtttggttttattaaccatcatcgggcaactttgaggctgaatacaagccttgggaatgaaatgcaaattctataataggaacatcattgtgataataatttattaaatttcccgagccgtct

SEQ ID NO: 27907 - DNA, 201 bp, Bos taurus
tgcaacaggccagatgttgtcccttcaccccgaggagactggggctcagggctaagtgtcttctcgtcccagatcaaatgttgaaaaggatgacagagccgggatcccagcttggcctctacaggtatggagctcatgctttctcatggtgcccagacccttccaggtgagttgagatgaccttggaaagctgaagctctc

SEQ ID NO: 27908 - DNA, 201 bp, Bos taurus
atagcaatcctattatattaccattacacagcatctagtggggaaagctgagaacatgttattagtgctgaaagggacaatttactggatttcgctaaatgccatcgcttcccaaaaaatgaatcaaaatgacttgatgatgcatgtctcactttaatgcctcactcagagaatgatgggaaagccgtcacgatcatctga

SEQ ID NO: 27909 - DNA, 201 bp, Bos taurus
gaataacggaccaaatccacagggccaaaggaagatggagaggagccttgagaccccaaatttcttaatcattgggcgctagctcacatcttgagaaaaactggcctctgtctgttactattaaatgatcgatgtggcgtgttaaattctgctgatgctgggctgtgctgaggctaaggtatccaaggcgcacagctccct

SEQ ID NO: 27910 - DNA, 201 bp, Bos taurus
accatgttctgatgtctgagctggagccccttctagccccagcccagcctctaaaaggcccagccctctggcacttcaactagaaacagcattgtcaccacagtctcatttctttttaagcagggcctcataaaaactcttctagcagctgtgaacgttcatcactggagcaataaatgatgctgctgctgtgattcatca

SEQ ID NO: 27911 - DNA, 201 bp, Bos taurus
taaatattcagttgaaggttggtcaaatgaattacctgcacagatgttacctgtgtaagaggctattatgcaactgccagaactaatgtttgtgtttgcagtgggcttttaatggtggacagaaatgtttacagcatgtgtttaagccaaaattttgcatcaaagacatctcccgattttgttactaacagtaatactact

SEQ ID NO: 27912 - DNA, 201 bp, Bos taurus
acacagcatcccccacgccaggcagcgctaacatgaccgccaggccccgagttcagcccacagtggctctctggtggtggcctcagaccaaggggaagccgcagcccaccaggatggtgtccctgagcaccagcacctccagtctaagccgctcccgccaccctcgagctggagcccgcccgcgttcagatggcctggtcc

SEQ ID NO: 27913 - DNA, 201 bp, Bos taurus
aggtttggagggccaacgggcagttagaaatatggatgggcccttgagctcaggaaaaaggtctgttcctgtggcaatgatgtggaaaatcactcctgtaggtaagcttcaggggccaaggcgcgtagctggctgatgtcagacagacggaagagaaggccactgaggaaggagtgggcaggctgagaacaggaaagagtt

SEQ ID NO: 27914 - DNA, 201 bp, Bos taurus
gctttctctcacgagctggcagggtgactcttcagcaccacactttcccacctccatgccttggtctgcattgtggccaccttctggaatgttcttccccatctcatttataaatccaaacagatccatcctcaccttctctgcgtctttgcgacttggccacacagaggggacgtctgttaaacaatcattcttcctatt

SEQ ID NO: 27915 - DNA, 201 bp, Bos taurus
cggcctgggcgggaggtgaagcagcaatgccctggttctggtgtctcataaatccaagtctccaggctggcttacagcttgccttctcaatctgttctgcgcgtaaccaatggccagaggggtttctctgcaaacacagagcccttaaataccttccctggatgctcagcacctgcagagttcaagcactttggcatggca

SEQ ID NO: 27916 - DNA, 201 bp, Bos taurus
ttggtctgggttattacagtgggctcctcctttgcacccattcactctattctccacaagctgccagagggaccatacaggaacataagcaggccatgtggttcctaggctcaaactcttccgatagctctcaactcagagtaaatcccacatccttataatgatccagcgggcctcgcagagccctgtcccctgttttct

SEQ ID NO: 27917 - DNA, 201 bp, Bos taurus
aacgtggggcgacggcccaggggtaccaccacttcctccctctgagttccccaagttcttaagcagcccctcccttcaagcaggggaaggaagcagccagtagacccgcttctttgtttcctttctttccctcttccgacagccatacttcatgtctgaccgtggaggtgacgcttctcaacagtgacaaatttatgagtt

SEQ ID NO: 27918 - DNA, 201 bp, Bos taurus
tgctgcgattcatggggtcacaaagagtcggacacaactgagtgactgaactgaactgaaacctcactgtgtcacttccatcttctgctgccccacctcctagggcctctgcttctacacatttctctgctggaacttccctcccctcccacttccatcaaattccccttcctctgcattttctccaaattatctcctatt

SEQ ID NO: 27919 - DNA, 201 bp, Bos taurus
caatggacccaggaaaaactttcggcaaaatccaacacccatgtatgataaaaaaactctccagaaagtgggcatagagggaaactaccttaacataataaaagccatatgacgaacccacagcaaatttcattctcaatggtgaaaacctgaaagcatttcttccaagattaggaacaagacaagggtgcccactcttgg

SEQ ID NO: 27920 - DNA, 201 bp, Bos taurus
cagtccatgaggcagagtgcagcaactctgagcaggctcccagctgaaaactaagacaattctgaatgaatgagaaatttctttgagtggcaattaaaaaaataaaaaataaaaatttatttttaagacaattttcaaataagttgaagcaattattttcagagccaaccaatagcaccaactaggactgggaagggaaga

SEQ ID NO: 27921 - DNA, 201 bp, Bos taurus
aggagacctggggtctactctgtgcctgagcctattgacttaatgtttcttgattgagtcatatgtcaaatgaaggctcataacattttccctacatggcgggaagggtaaacggtgacactattaaatagcaatgcccttcatcaggaaaaagccttattaaaatacagaaggcattgctgtcttaaaacctatggaaac

SEQ ID NO: 27922 - DNA, 201 bp, Bos taurus
tggttttccttctaccctgctggcttgcccccatcagcctccttgctgatgcttcctcatcctcctgacctggcagcctttagcgtgtgggccagatccagtccgctacccagtttttataaataaagtttcattagaactcagccatgccaagtctaatgacattaaatgccatgcaaattcagggagcagcatggataa

SEQ ID NO: 27923 - DNA, 201 bp, Bos taurus
ggggatttctgcctatggatgggttctgctgtcagtggcgggggcggggggggggttgtctgcagtcccctggggacagctgaatctctttctgtttgacgagatggaccagctcaggcagagtgtaactctggaaccaagggcactggcacacctggccggggaggaatcctctcctttgcttcccattggagttgattt

SEQ ID NO: 27924 - DNA, 201 bp, Bos taurus
ttgttaataatacatatactatctatggtattttgtatcttataggacaaatattgatgtaggtactgacagacaattcatcttgtaaacagactatgtaaatttacagtatcagtaaatacagaagagtactataactgtattttccttatgattttcttaatattttctataacttgctttattgaaagaatacagtat

SEQ ID NO: 27925 - DNA, 201 bp, Bos taurus
ctgttacctgtattctccagttaaactctcaaggtttcctgaagaatctaaagcaattgaactttttctctctgtaaatctagtcggcctattgaagaaccgaatgccctctcaacaagctgccagcccattagttggcaacatcaaaagcaagcagtgcacttaggaggcctcagcaatggtccaggcaagaaatgatgg

SEQ ID NO: 27926 - DNA, 201 bp, Bos taurus
aagtgaaatgcttcatggaaggcctcgcgcagcaggtgacacggccaggaatcaagcccaggtctctctgttggggccgaaggtttgaactcttcgctgctgttctttgccactacttgctgtgtttaactccttgactatattttgtcttgtatactctgatctaccttttatctgtgaaaatgggccccccactcccat

SEQ ID NO: 27927 - DNA, 201 bp, Bos taurus
agcggtcccttgagatgaacaagcacaagggcaagaggcgggtgcaaaagagacccaactacaaaaacgttggggaggaggaagacgaggagaaagggcccgccgaggatgcccaggaagacgccgagaaggctaaaggtacagagggtggttcaaaaggcatcaagacgagtggggagaatgaaggtgagtgcacgcgcc

SEQ ID NO: 27928 - DNA, 201 bp, Bos taurus
agctacaaaacctgtacacatcactctcaggccatttacaggaaggcttgccgcccccgaggggcagataacctggtcactgtctccccaggcagccaggagagggccagaacctgtcccactcaccactgcgtctgcagcatctaaaaccccacctgctcagagagagcgcttgtaaaatatctgcagaatgaagaacag

SEQ ID NO: 27929 - DNA, 201 bp, Bos taurus
tattgctttccaactttgtgttggcttttgccatactccagtgtgaatcagccgtgggtatacacatgccccctctctcttgaacctccctcccactccccgtggaaaactttaaaagatgtttgaaacgactcagtatgtgaaagaattgggggtggggatttgagctaatttttattaaatgatggaatcgtcattctc

SEQ ID NO: 27930 - DNA, 201 bp, Bos taurus
ggttctccccgggatcgccttcatgggcatgggcttgttcatcctggggaatggccactgcaggcatccacaggttcagtaacgggggcgagggaaaaagggttgcccattactcatatcagtggtatttgatggaaagagacaggtgggtctctcaagtaaaccgtgactatgagtcaaagggtttggagaacattgatt

SEQ ID NO: 27931 - DNA, 201 bp, Bos taurus
tgctactgagggatccttagaaggtggccgggctttagagcaggggagaggctgcctttggtccctacccggggatggctaagtgtgagacaagaccagcggaggccggacacagtgtgggctgcaggcgggtgtcaggttctaaaggggttaactggaaggtcaaggaggtgtgctttctaacggaggacataaaactgg

SEQ ID NO: 27932 - DNA, 201 bp, Bos taurus
tattctcatcaagggcccaacaatgcccatgtccatcccctggcagagctcacagataccttcttcctggtcgttctacttggatgtccagacgccacccgctgtccagaaagcaggcctttaaaataccatgagagtgaaaaggaatgtcgtcttcccagcccgatcattcagccacttgtgtgccctctgagggcaatc

SEQ ID NO: 27933 - DNA, 201 bp, Bos taurus
cgcttccagatgtgatctcgactggtcattgcacccctgatgcttctcacctagaaacccgagacagcgtagactctccttgcagacagcatggaagaggcgctgcggggccggcgtggagcacagtgcgtgccctgcccaagtccttaggaaaggccagccgtgtctgtgcttaccagttctgtgtaagtcaatttttcc

SEQ ID NO: 27934 - DNA, 201 bp, Bos taurus
ttgataattcattgattcttccagggctggttcactcctgggtatggctctatcaatatggccctggtgtgtttttgttggaatcgggtcattctctgctagtctttagcgggagagagtaggtgacgatttcttcaaagagaaggcttcttcaaagccaaaccccctctcatgctgagaaaatttgcaaaacagtcccat

SEQ ID NO: 27935 - DNA, 201 bp, Bos taurus
tcagtccatcccggtgctcgtacccacagaactccggggctctccttcaatgacctggggctcatggctctccaggcttcagatgaaatggaccatggcatgcctgggaacatttccagtgccagttcccaatgcctctttgtaagaccctagattggtagtctagcctgttaggcagttaaacttatgactcttgacact

SEQ ID NO: 27936 - DNA, 201 bp, Bos taurus
cctgtgatgtgacccggaatctcacttcacatgtttacactcactgggggcacacagataccatccctgaatggcatacactctcttctccagcctactcagctacacctcatgtctgactccgctggccactctccggtctttgaaactcaccttttccttggttttcatgcaatgctttcttctctgtttcttttccac

SEQ ID NO: 27937 - DNA, 201 bp, Bos taurus
ctttgcatccccatggactgtagcccgccaggctcctccgtccatgggattctccaggcaagaatactggagtgggttaccatgccctccactgggggccgacccatccctagaacttccctgaagttctgaatcctgttctctgcaagtgaaaggggagccttttccctgtgtagagcatgggaacacttttaggccaca

SEQ ID NO: 27938 - DNA, 201 bp, Bos taurus
ctcaagaatacccttcccttctactacccagacacttccttcatcatcttcgcttgtagaaatctaagcagcctttcaggccaagttcaaattccacttcttgcatggatacctctagggtctccaagacaaatttttattttgacaccactctgctttgtaatcagggttatgcctgtagcattgtccatggcttgaatg

SEQ ID NO: 27939 - DNA, 201 bp, Bos taurus
catttgggcagagttccagatgaagatagggagtgaatcatgtaattattggtcagtgtccaaggcaaggggaaagagcaggtggaaaggccccaaggtcgggatatttgtatgatggaggatctgcagtgaagccaatatggctgggggactgttacagggggcaagtggtgagaaaaggggccaggagccaaatggtga

SEQ ID NO: 27940 - DNA, 201 bp, Bos taurus
gagggcaaaggagggcccagtggagagtggggaactatgttttgtgtctcctttcctgaatctaataacaaatatagagaaagcagattggtttgtttccatgcctctcagagaagagtgtgcagagcaaatacgcgagacgtggaaacaggtcaacgagatactgagcacctcttctctgcagacctgggtattgtctag

SEQ ID NO: 27941 - DNA, 201 bp, Bos taurus
gtgcctcgcccaagccaccccactcctctgtggccaggcccctgtgtgtgctcctgacagcagtggggagagcaaactgcggcggacagctagtgagaacactcaggaagccggcctcaatctgtgggccggggacggacggcaagcttggcggtgctaaagctaaagccccatctttgggaaaacaggagaaactgtcag

SEQ ID NO: 27942 - DNA, 201 bp, Bos taurus
cagatcagtcaaaggagataggaatcaccctcgtctcagatggctgaaaactcagggcagctggaggttataaagaacaaaggcaatgacccttcatccacactgagctcctggaagataggaactaataaaaccagtaggaaataggaatgcctcagatataaaaaggctgaagatcatggattggcttacttcaccaga

SEQ ID NO: 27943 - DNA, 201 bp, Bos taurus
agtattcttgcctggagaatcctatggacagaggagcctggcaggctacatgaagtgacttcacacacgcgtgatgagagagaacacctggggccctccacatcctcagggctgacaagctaagacgtctcacccacctcccctgccaccaccagcccctctgggctggggatgcttagacttggctgtagaggccatggt

SEQ ID NO: 27944 - DNA, 201 bp, Bos taurus
ggagtcgtttgtgttgagtggaacctttgccaggcagctcggtctagagcatgcaggtgaaggaaaggactggcccagacccggtttttatggccctcatgccaagaacggtttatacatttttaaaggatagtttaataatttttaaaaaaagacaaaaatgtgacagagaccatttctgggcctttatagaaaaagttg

SEQ ID NO: 27945 - DNA, 201 bp, Bos taurus
gggccccagacttcttcccccactgccctggatcttctcaagtcagagaggaaacatgagtggctaccataatgggaatccacaaacaccaataaaggaatcgacaaatcagaactttaaagggccctgcgcacagtaggcctcagccatgacctaccgggaaaggctcgtctctatccctgccttctccaagtatgcttc

SEQ ID NO: 27946 - DNA, 201 bp, Bos taurus
gggattctccaggcaagaacactggagtgggtggccatttccttctccagttcatgaatgtgaaaagtgaaagtgaagtcggtcagtcgtgtccgactcttagtggtttttaataaggcctttattgagatataattcacacatcatatgattcagtgagttttagaaatactccagtattttatttgtgcagccatcacc

SEQ ID NO: 27947 - DNA, 201 bp, Bos taurus
tttattggaacacagccacacccatttgtttgtgtgtcatctgtggctgcttgtgtgctgcagaggccgagttgagtagttgagacttgtgtggcctgcaaaggtgaaaatatttactctctggtcccttagagagcaagtttgccagtgtctgaatatcttacctatagcctggtcttaagctcagttggatttccttgt

SEQ ID NO: 27948 - DNA, 201 bp, Bos taurus
gaggaagaggagctggggaaagccagctttgttggctattcctgctaacattcctgacagtttaacagggccgttcataaatgttgagaggcttgggcctattgtagtaactgaggattctgaggtagtcaaaagcctcactggagttagtttcgaatatctcagttttaggcccttctttaatgggaagcccccctctct

SEQ ID NO: 27949 - DNA, 201 bp, Bos taurus
gtatatgttttctttatttctttttttaaagtggtaagcctacttacaaccatactaggaatatagttttgtatcctgctacttttttcacttagcaaaatgagatttttccaagtttaattacatagctttaaaaataaccatcaccatttttttctttttcctgccttttaaattttttatcaaagtaatatatgcaca

SEQ ID NO: 27950 - DNA, 201 bp, Bos taurus
tggaaaaaccatagctatggctgtacacacctttgtcagcaaaatgatgtctctgctttttattttcagtgataaaagtcatttttcttgcatcccatttcttgcataatctggcaatggtcttggcttccaaaatatataggtaccatgaactcattcatgccccctgtaaaacacccacctccccattgctgcaggcac

SEQ ID NO: 27951 - DNA, 201 bp, Bos taurus
tctcagtggggagatcagagttagccaattaaaacgtttatttatttattttttgcattttcctgttttttgttcccataatttcatttcatcccaactgcccttagacatggatgaagaagcctgccagacgagagcaggactcctaggtctgacagcccttctcccttttacatggtcagaaaacatgctcatgacatg

SEQ ID NO: 27952 - DNA, 201 bp, Bos taurus
agaattaggttcaggtgggacccgactcaggtgttcaaatcatgtcatcataatgaagtctccctccgtcagaaggcttcctttcattttggcctcctaggcaggctccatggggcgacaaaacggcttccagcattcccaagcttaactccaatttcaagtctaggtataaagagccagggcctctaatctttaccttca

SEQ ID NO: 27953 - DNA, 201 bp, Bos taurus
ggcttctctttggaaaaatgcctgctacaaccatctgctcctctttaaaaagcaggcagtgtctagagtgagaactaagtgaaagagggccatggagtctgaaccaaaggactgtctctccccacaacccccaggtacacaggatctggtccaagtcagaagtacttggccctcaaacccatcactgttgagagcatctga

SEQ ID NO: 27954 - DNA, 201 bp, Bos taurus
cagtgggaggttcttggcaggatgcccaggccagaccagctgagcttggctggagcctgcaggaccctgccacggggccgtcaatctgctcagcgacgagtgctgcctaatggcacggaacgtgtttaaaatgcaacccaggtgccagaccctattctacatgcagtaccattagggaggctccatcctcggccgaacagg

SEQ ID NO: 27955 - DNA, 201 bp, Bos taurus
ttggttatatgatgaagtaaactcttaattttaaagacataataaatgttttattacttgtaaccaaaatagtcccaggtgataaatagatggccaaagacttgtgtgaccataggagcttgcctcagttctatctcactcctggttagatgggctgagcccaaggcgggcagcctctatgcttggctacatgcccagcca

SEQ ID NO: 27956 - DNA, 201 bp, Bos taurus
atggtccacaaggtcgaaaagagtcagacatgactgaagtgactgagcacacacgctcagaagtgacagcccatcactttggccatattcaattcattagtagaaagtaagtccagcccatcctaaagcagaggatattatacaaggacatgaataccatgataaaaggatagctagaggcctgccacatggtgtattcag

SEQ ID NO: 27957 - DNA, 201 bp, Bos taurus
gctgaactaacttcacagccaccaggaaagggagagggcagaagtgtctccacagcatcaccagcaccgagtattaacatgtgacggtagggtgtgggatcagtgtggccgccaaaacaatttttgcttgcgtttctttgattgactatctggccacatactgaattacatctcctcctctgtgtggaaacactgactttc

SEQ ID NO: 27958 - DNA, 201 bp, Bos taurus
cagttccctttgggcctattgaggacaaatccccccaccgcctctcagtcacaggtacctcttaatgaacaactctctaagcaatacttgatagctcatgctctccaagggcctccttgcctacacttgtctctctttttcttatcttcagctatacctcaaagatttaggtaaattcaaggaaagtcaattgctaagtgg

SEQ ID NO: 27959 - DNA, 201 bp, Bos taurus
ataaaagtatgtatcttcagtatctaatgtgagagtgggataatacagtgtccacagtgcacccagaatgatgcacaggatacggaaaaatgttagctgtcactacgttattcatggcaataaatatgtaagtgattgagcttgagggcccaggtcaggatctctgtgtatgagatgcatctttgagcacaaaaagttgac

SEQ ID NO: 27960 - DNA, 201 bp, Bos taurus
gtgcctctgtgatcatctactctcctggctgcatcctggcagcttccctggagatcaacaggccctgggtgggaacccaagggggcctaatggctatggttgtgaggctaatctgacaaccctgattccaaaaaaatgagaccactggttttttaccagaaccaagtgagcattctcaagactcccagtgtcagacgagca

SEQ ID NO: 27961 - DNA, 201 bp, Bos taurus
cacaaaggcctgcattctgctgaagtaaaacctggaagtcttcgcatttcctgggttcaggaacaaggtacagtgaagagaaacgcttggcaggaggtgtaagctgccctaggcctttactgattaatcctaaagggggcagggccggaaatggggatttgtacacttaggaagaaagcctgagattctaactatctgcta

SEQ ID NO: 27962 - DNA, 201 bp, Bos taurus
ttcaaataattcactttcctcctcttctacttccctgatttcatctaaaagcaagaataagaacctcagaaaaaactgcacagtgcaatagatatgaattaggtagttctatacttgaagggcctggggaagggactgatactgaatgagtggcctgatccttctacatatattaaaataaatttttttattgtagcaaga

SEQ ID NO: 27963 - DNA, 201 bp, Bos taurus
gcctgattcctccttcagtctggcgaggcttctgtccagacactaaattaattctatcataaaatgcatcctttccctccattttcctatcagtagagaacggtgagcatttacaggaatcaagtacgtcagccttcaaggtcctatgtgggacctggcgcacaggggttcctggaccttccttctatcccagactgaaaa

SEQ ID NO: 27964 - DNA, 201 bp, Bos taurus
gactaaaggaaatgcacagcatgccagggcctgaaggggaaggggagctgtggaacacagacatggtgaagggtggtggagcgggaaagctggagaggtcattggacagtggccagagcctgtgagcctcaaatgccatcgttatgatcttaatctttattctagaaataaagggaagactttaaacagttttaatcaaga

SEQ ID NO: 27965 - DNA, 201 bp, Bos taurus
tctttcaggtctggtatggactaaatgtccgtgtccagcactcatccccccacattcgtatgtattaggaggtagggcctttgggaggtaactagaaataaatgaaggcaggagggtggagccctcatgaatggcattagtgcccttatgagggtcacaagaaagcttgcactctatccccgctctctgccatgtgaagac

SEQ ID NO: 27966 - DNA, 201 bp, Bos taurus
ttcattgtggctgtaacttttgcagtttgaggtgcgacagcaaaagcagccctggtttctttttctttctcacagtctcatggatagaaaatctgttcttaccataggcaaacttagcatatgggtttttctttttcccttattaagtcaagaactttaacctcttcacttaaagggagcactttaagggttctcttaggc

SEQ ID NO: 27967 - DNA, 201 bp, Bos taurus
tggggctaaaaggggactgggaggggccttgcacatatcagtagtgatgctaccggttggaaaggaaaaaaaaaaagcatgaaaaaaaagaaattctgtcgactagccaaggccactttgtggtgtttcttccacagagtaatgtctggggactcaacaacttacctgttggttcaaggtgaatccagggagtaacacaga

SEQ ID NO: 27968 - DNA, 201 bp, Bos taurus
ccctttggcctcgcaagggctttctaagtgcttgaaaggtgtaacagggacactttgcactgggcggtgtttctaagccagcagccaggatatagaattcaaaatactggtgggcccctcagatggaagctatctaggttcacagagggcagccagtcatagcagactgcccactcccccactgcactgtcagggatgaca

SEQ ID NO: 27969 - DNA, 201 bp, Bos taurus
catgcaatgactgggctcaaccaagcagctcttacacagcttttctcatgcagttgtggtcagatgtcagctggggccattaccatctgagggttctcccggggtgcatgtccaagaggggtcactcacaatgctggaaggtgatgctggctgttggccatgagctcagctggggtgtcaaccagagggatgatgtgtgac

SEQ ID NO: 27970 - DNA, 201 bp, Bos taurus
gtttccagagagttctaacattgactgtgcttctgcccacatctatcaccccgcctgggtccctggtgcctccagttccagagctctgggaagattccactctcttctccttagtgatgcccccttctccctgcagccacttcagctttctcttccaaaaccaacacccctcgccagtcagcctcccttcttccacaagcg

SEQ ID NO: 27971 - DNA, 201 bp, Bos taurus
gtaaatcaaagttccatcagaagaacagaagccactctgagtgttttgattgggaagtggaaatgtagcagttgccccaccaatgtaaggctggggaacataggacaggcaagccattgtcatcaacctcaccccttggcacaaaagtgagtgaatctctggaacaatctgacagctctgtgcatcccaaaggcagggccg

SEQ ID NO: 27972 - DNA, 201 bp, Bos taurus
catggtttcccacatgctttagtcctcggggggcgttgaaagggaatcgagaattctttgtgccagttgtctaatccttggggtatctgaaaaagcagaatgcacttcttagatcaatattttcaaggctcatctgatgtgagactctgcctggggctggaggcttgattgtttccctctctccagggtgggtatgaactt

SEQ ID NO: 27973 - DNA, 201 bp, Bos taurus
caaaggcagtgtttatctgacttttcttgaacctgggtgggagcctgtgattaccgtgacagattgtggtagaagtgacagtgtgtggtttttgacaccaggacataaaaagacagcttgttttctgcctggctgtctctcttaaggctcttacttttagaagcccgtcactactgagagaaagcccaaaccggcccagat

SEQ ID NO: 27974 - DNA, 201 bp, Bos taurus
gggtggtggcctctgcccccaggaagtggcataattgatctaaacaaaccacgttttcctattccctctacttaatgatgggcttagaggtggagacatgaggcatttctggccaatgagacatgagtggcgactgtactggggctcccagtagaggttttccttgttgatcaagaggagacaaacagggaagaaacaatc

SEQ ID NO: 27975 - DNA, 201 bp, Bos taurus
taggtcctcagagcagatttctagaagtctttagtggtgatgctaataggagtatttgtttcctcttggctccccctgatgctcatgggggcccagattcctgaggctctgtgttcatcttcccaatgtcagaaaatggacaggacggttattgttgacttcttttcttctggctctttccccaattctagtgtttttttt

SEQ ID NO: 27976 - DNA, 201 bp, Bos taurus
aggccatcctgggtctgttcacctagggcccagccattcagaccaggatctttgcagactcagttgctctaaaaagtctttggggaacagaatgggggtctttgaaggccaaaacaatgagttcttggcggcggtaaatggaccacaactgaattgattttttaaattaagttttaataacgcagttaatataagaatgca

SEQ ID NO: 27977 - DNA, 201 bp, Bos taurus
cactggaccaccagggaagtcccaaggccaagagatttaaaatgctagctcttggggcatgtggatttcaaggatggggtggtttccatgatgacaaggaggaaggtggcctacatgaagaagaggttctaataagctgaggctgtcaggcagttttaaaaattaaattacatttttaataagcagtatattcccatggtt

SEQ ID NO: 27978 - DNA, 201 bp, Bos taurus
gcagaaatgttggacttgacctagagactaaacaacaagaataatgcctacaatacatgacacacaggtccagccatcttaagccacatgaatgatggcctccggatgggtcccagcatcacctccatttcacagatgagggcattgaagccatacataatagctcgtacatttcagggccaggattggaagccaggcagc

SEQ ID NO: 27979 - DNA, 201 bp, Bos taurus
tgactcaggaatgaccttgacaattataaaaaatttaagctaagtagcggttctcaatatggtataattttgctccccatgggacggacatttggcaaagccttgcgacatttttggtcatcacgacttggtaggagtgtgggggagtactcctgcatcttgtggcatcaggggatgttgctaaatgctctgcaatgcaca

SEQ ID NO: 27980 - DNA, 201 bp, Bos taurus
tgaaatactttggtccagggcactggactggtagtgagagaacaggtttacattagcagcaactcagttcatttccttgatattatttccaaagtgtaccgtatttacagtcttgtatgctgctgttggtactcggttttaggtggtatacaaacatacgtgaggatgttttctaatgcagcatttaatacgtaaggaaaa

SEQ ID NO: 27981 - DNA, 201 bp, Bos taurus
agttttgacaactactgagagccaagcactaagtttcagagattctgaataaagtaatgtagggtctagtcttgaatatcctacagaaacagttagtgactttctgccctcctgctccaaatgttggttgaaatatctattcaatctaacagcattccagcaacacatatatagatcaaattaaactaattaatatactat

SEQ ID NO: 27982 - DNA, 201 bp, Bos taurus
gattttggagcccaagaaaatgaagtcatctgggggcaggactgtgctcaaacaccttcccaggcttccttgaagctagcggtggccatgtgaaagcacttttgccgatgagaggtaagcagagttctgtcagagctttgtggggtagtttttgcttttgtgttaaagaggtaggctcagaactggccctctgagacttcc

SEQ ID NO: 27983 - DNA, 201 bp, Bos taurus
tgacataatgaaatttttgaaaattttattcttgtgacttgaactttgaaaaactgtgaggagcataagtattggaatgtttgaatatttgaagttccttgttaaagaatgtatttgagtatctctttgaaacagcagggaaatgaagggctgaaaaaattacagtgagatataggaatggatgaatatcttgtggcccta

SEQ ID NO: 27984 - DNA, 201 bp, Bos taurus
taaaatgttgagtaaataccagtgcaggtgtagtggacatagagatggctacaaaagaagtactcagtgactgaattttttctttactgaaattgttgcagtattgcttctgttttatgttttgggtttttggccatgaggcatgtgggatcttagcttcccacatcctgtgcattggaaggtgaagtcttaaccactgga

SEQ ID NO: 27985 - DNA, 201 bp, Bos taurus
agtaacatccagtgggaagctgaaagacacaagagttttccatgacacagtatgatttccccaatctaggtagcagcacaactgggagggtcaatggaattgctgtgcctacttgaagcagtggtgaagattcatagactgtaaaaaagatgacaggtgcccagctcagtagccttaccaaacacaaagtaaatcagagac

SEQ ID NO: 27986 - DNA, 201 bp, Bos taurus
acacagagggaaggccattcaaaagaggtggcacttgagtggtacaatgctgtgatttgtaataagaaatatgtatttggtcttcgtccacaatcctgctagcagttctcaaaaccctaggaatttcctagtttggagagtgataaagtgtctatttttatgttaatgaggtgacttctggactacacctaagactgtggc

SEQ ID NO: 27987 - DNA, 201 bp, Bos taurus
gaacattagaggcctggagataccagttaaacttcttagaaaatgctctgtatcttttctgtccagcacatcaaaaagtgtacaaggagatggcaacttattagactacagcccagggaagtgggccctcagagagtcaagtcaggcatttatcagctgcccactggacatgttcaccttaacatagagaagggcctgtcc

SEQ ID NO: 27988 - DNA, 201 bp, Bos taurus
tttactttctaaagttctctctggccccacaaggctaaggcaactagggtgagcagcgtcctctcacatcaggaaagttggtggaatcatctctggctagtctgaaccctggaaagtggcctcttgaagcccctgttgactcccaaaatacctgctttgagaggccaggtatggccaggtgattagggttttttttaatta

SEQ ID NO: 27989 - DNA, 201 bp, Bos taurus
cttgcctgaagccataaatccttaagattctctgtgatgtgattcagtaaatgtgaccatttcagctagatttctataatcaaaatatgtctaatataaaccaaagaggatgatatgtgatagtttgtccttattcttactctccctactactaatgttaagttgccaaggacataaaatatgcccttccatctttgtagc

SEQ ID NO: 27990 - DNA, 201 bp, Bos taurus
ttgccctttccttctctggtagatcttcctggccctaggatcaaacccacatctcctgcattggcatgagagttctttactactgagccactagggaaactcaggaagggtagatgggtattgataaatggaaaatgtatccaaagggaagggcttggacacgtgacctcaatagccagcttcaacacgcaggcatgtttc

SEQ ID NO: 27991 - DNA, 201 bp, Bos taurus
ggtactagggattcgggaaccaccagacagatcaaatcctgccttaaagcaagagagtgcctagcacattggtgacaatatggaaactcctgggagcagaagggcctggctcttgtgtggatcagtcatggacagtgcagattagtgcaccccgccaaagagctgtgactggagtccctcagagtccccttccctctggtg

SEQ ID NO: 27992 - DNA, 201 bp, Bos taurus
agcttgctagccagagctgccccaagacgggcttacttataatgctccaccccacaaaaatggagcccccatatctgtatcagctgacctcccctttgggtatggggccaggagttgggggtggggtgggggcaggctaaggaatttccattccctgggatctgacatctcaaacctcagtcctgaatgttaggatttctg

SEQ ID NO: 27993 - DNA, 201 bp, Bos taurus
ctatcttttaaagttactccttccccaggcccaagaaccacctacccgcaacatggtccagagagcaggtaagatcaggttcctgggcttccccagagcctgtgggcccaccctgtcctccccacccctaccacatccacggccctgcccaccacagccttctcaaaccttctggaaacgccgtgacagccacttatccca

SEQ ID NO: 27994 - DNA, 201 bp, Bos taurus
agccccaaccagggccgcaccaagctaggaaacaaggtttaatgttttcgcttctccctgggttcttttgtagcgccgtagacctgtccctagtcttcccgtggcctcttttctatgcgtctgtctctctttgtctctgccagcttcactctttgttcctctgcctccgggcttgtttctcaccaggtgccctgcccagtt

SEQ ID NO: 27995 - DNA, 201 bp, Bos taurus
cttcctgttgccagctacatcaaccagaggcccactggtccctgcacactggagtctccctcctgccgcaaccttgcttagtcaatattttattcattcaggagccacaggaaagggacttcttttctggtccagtgggtaacagtctgttctcccaatgcagggagcctgggtttgatccctggtcagggaaccattatt

SEQ ID NO: 27996 - DNA, 201 bp, Bos taurus
ggaccctcctggagaagagctagggcagagtctgctcccctagatgggactctgagggccatggcatcaggctggtgggtctactagtggcctctggctgcggcaccttccactgtggggacagtagtaagactccttgcctgtgtgagtcagcaaaaagcatgagaggtatagcaccagctgcaggtgaagggtccctct

SEQ ID NO: 27997 - DNA, 201 bp, Bos taurus
gtctcgaagcagagggagtgcggggacgaaagagtgaagggtccatggtggtggctgtaattcaggatgacctggatttagcggatagtgggccaggcggtttagaattgacatctcccgtggtctcattggctccaaaactgcgctcgactcggctgcgtccagggtctctagttccccctctagagactgagaaggtgc

SEQ ID NO: 27998 - DNA, 201 bp, Bos taurus
acttcagattgaggaatctaggcagcttgttggccctcagtcaaacgaagaatgggcgccccctagcagcagtaatcggtagtggacacggaaggatccaaatgaggggcccgggcagagggggtgcggctcaagatagggtagacagccgggcatagttttcttctcacaggagctaactccttccggcatgatggacac

SEQ ID NO: 27999 - DNA, 201 bp, Bos taurus
tgtacactcagtcattaattctcctctctcagctgtgctcagcactcctgggcattgagtggcaggacctggggttcagcttgggaccaggccaaccttcttccaggcttcagaacccccaactcctgcccccaccgctgagtcagggagcagcctgtgcctgtggagagcattagcttaattgtgccctgggctgtggag

SEQ ID NO: 28000 - DNA, 201 bp, Bos taurus
aattggattgttctactttggggcacaagcccttagccctgacttggaaatatcctaaaaactcctgccatttatttccaaagcttggatttggggactttcctagtggtccagtggttaagactctgtccttccaatgcagggggtgtgagttcaatccctggttggggaactaagatctctcatgcctctgggctaaaa

SEQ ID NO: 28001 - DNA, 201 bp, Bos taurus
acctgagacttcatctctctttggggtgtggctacccaaatggcttggccttttcttctcacacagctctggttactggagttgccggccaggtctgggacgggagccctagggaattcaatcccatcccaacaaaaggatcacagattccggcagcttggggcagggcagaggattctgggagggggctgggcaggctgg

SEQ ID NO: 28002 - DNA, 201 bp, Bos taurus
gagaaaactaaaggtgtgcctgccacgccaccctgtggagaagaaactcactttcttcccccaaggtggagacccgaaggccattcttaatccagaactttcccagcctccaatgtctgctttagctgcctcctcccctgggggagctcccaggcccagtctggcttgcaacttggcgcttatgttctccctgcctggaac

SEQ ID NO: 28003 - DNA, 201 bp, Bos taurus
ccagtccgaggtcaaaggcccaaggaccagaagctgtagtatcagagcagaaggtgggcatccagctcacgaagacagtgaatttgccctcctttcacctgtttgttccatttgggcccccaatggatggggtgatatccacccacactggggagagcagtgcactttaccgtctatgggatctcctgctaatcccttcca

SEQ ID NO: 28004 - DNA, 201 bp, Bos taurus
actgaagctacctggaaggctaatttttttctctgtgccctccctagaagacagagctagattatatgaccttaaccttgcccccagaatgcttgtgccaggggatatgccctccactcctcagcttacatgggtttcaatcccctgcttagactacagaacaaattcagcttccgccagcacttcgcaacccccactgta

SEQ ID NO: 28005 - DNA, 201 bp, Bos taurus
agggatcattgaaatattaacttttctaacaaagagggcatgtaaaaaaacattttatgcaaccattttgttttacaatcaaggaaaaatagtctcagggcggtcctgggcctgctcatttcatacagatgattagtgatggttagtgctggcccctgaatggtagagttcccagctcccaagttgccttctaggactttc

SEQ ID NO: 28006 - DNA, 201 bp, Bos taurus
tatagaaacaagcagttagtttgaaatacagcattaatggtttgttatatgtagaccagtgcacgctgggaatggttggccatggtgaagagcgcccatcagctctgacacggaggagcatgaagccagccccagggagcagctggctcataggttaccagcaagacacagaacacaggacatccagtggccatgaaacat

SEQ ID NO: 28007 - DNA, 201 bp, Bos taurus
tttcttaggtcagggtctaaactcaggaagacttagaggagatttaagtcttcattgtgtgatatatgtagaaggtagtagaattaacacagtgggccgtcttctttccttcctaaaggttcatcttaaatgggttctagtcataacaggaaggagatggtcaagccattggcttttagaaatctccttgtctgttaggcc

SEQ ID NO: 28008 - DNA, 201 bp, Bos taurus
cctccaaattccttggaaccactcagtattacaccatgaagagatgattggaaaagctgggggagtatctctgtcaaagtgagtagattttatgttttttgtttgaccctatattcagctaataaaggggtgtgtgtgtgtgtaaactatagctctttcctggaatagagagagcttcatcaatgagttcttaaaagttct

SEQ ID NO: 28009 - DNA, 201 bp, Bos taurus
agcatgagatatgcctcagaccattaagttaaaaaaatgaggcctgcatcctgctagtcaagtctagcaagataatgacccttagaaccaaggacaggactataagggaaagatgacattccaaagtagaagaccctcattataatgaaaactgagatgatttaacgtatttcagtatatgttaccacccttctgatttga

SEQ ID NO: 28010 - DNA, 201 bp, Bos taurus
aaaaatttgttttcagacagacagtgaggcagactcttaaggagggagctggtgtgaggagagagcagacagtgaagcccagagctttcagtaattgcacttcggccccttctctctccctcctcagtgcagagcatcacagcactcagttatttagagtccacacactaaagacagggagcgactggttcacgcaaatgc

SEQ ID NO: 28011 - DNA, 201 bp, Bos taurus
catttgtccacttcacaggggtcccggggaggccgagggagccctggatactccggcccggcgtctcaccattgtttatgctcaggaggcctgggttcttccccatctttaatcctgggatggaatggaaagctgctgcctgtgggcttctaccacattctctcctgccatatccttaggcattttttgagaacctaatca

SEQ ID NO: 28012 - DNA, 201 bp, Bos taurus
tcagtccccttggggtccaccccatctccatttagttctttgtaccagttaacttgggagtgctctgtagcgccctgccactcctctctccaccatgaacggtcttcccttgtcacactttcagcccttccttactctgctcatttggcttccctggtggctcagatggcaaggagtctgcctgcagtgtgagagaccagg

SEQ ID NO: 28013 - DNA, 201 bp, Bos taurus
ttatccagtgctgggaacctgagtgcttactatggccaagttttgttctctgtacttcccgtgttttaaaataagagggaggcactcaagatttctgatctacagacaggaaggaggccctgagaggtttagatacttaaccgcggttgcacagctcataggtgcaactccaggactcaccccaggcagtcagctccaaaa

SEQ ID NO: 28014 - DNA, 201 bp, Bos taurus
agcgtgaggcacaaaaaccttcatcctttaacaatccagccaggtatggacagcagtgtgtccatcaacatcactgggtgacttctggttaaaagaaaacctttggctgagagaaatcttcaagcctatgtatttgtatggacaagaaggtctgaggaggagtaaatgcctgaaaagcaaataaggatatatttcctctgg

SEQ ID NO: 28015 - DNA, 201 bp, Bos taurus
taaacatcgaggtagttacatctacttcacaagatccttagaaatggattacttttatgctatggtctctgaacacactggccaaaaaaaataaaagccacgctcatgagaaaaactttgatgaaccccaccaagtagttacagaagaaatagcttctcctagggccaaaaatgagatcatgagaggtcatttcttttagg

SEQ ID NO: 28016 - DNA, 201 bp, Bos taurus
ttttgtggaggatgaaggatcccacaagggctctttgagtacctcatgaggatttaggctcaatgcctcagctcatggtaaaatggagtatttgccctttgagtttctaccttgaggcccgtggcgggtaggggggagaccagctcagtcaggacaggaccccccacacacaaagcgccaccttggaatactacccgaaga

SEQ ID NO: 28017 - DNA, 201 bp, Bos taurus
acacaaataaactgaaaaagaaaaaaaaaggcctcggctcacactgtctcttcactgcttctcctcctaactgcctcaggttcttccacagatggcactgcatggcatggcaggcctcctcctcttgaaaactgagagtgaaaaactgtctttttaatggcaataatctcccactttgttgtcctcaccatctctgaattt

SEQ ID NO: 28018 - DNA, 201 bp, Bos taurus
taatgcaattatcacaacctattatgacccgtgtttgcttttttcccagtttgttctggtttgcattgccatcttagtgtccaacatagatgctagtagattggagctattcaatgaatatttacagagtggatgataaattcaaacacatcagtgactgtgtcatactgttataagtcccaaggctacctacatggtcct

SEQ ID NO: 28019 - DNA, 201 bp, Bos taurus
ctggcatccaagcccagaaaggcaatcatctgaaagatctgggttccttcagtggcacgacactgtggtttggggactcttctgttttgttttcaccatgcggcatgcggggccttggtctgtcaccagaggctgaacccttgtcctctgcagtggaagcggagccctaaccactggaccaccagggagttcccgacactg

SEQ ID NO: 28020 - DNA, 201 bp, Bos taurus
aggggaggcaaagaagcaaggagaggccctgggccacgcctgctgaagaggggagggcacgtgggtgcagggaggagggcgggaagagcagcagagccaaaaacctcatggagggaggcctgaagctttccctctgtttactgccacggtgatgtgctggacttggttcagtgtggaaaccacattttttccccagagata

SEQ ID NO: 28021 - DNA, 201 bp, Bos taurus
agggcccgtgctctccaacaggagaagacactgcaaaaaagaagcccacgctccacaactagacaatagcccctgctcaccaaatatgcatgcaacgacaaagacccagagaggccaaaaatacacacacagagaaggctgcgtgaggacacagggagaggacagccatctgcgagcctaggagtgaggtctcaaaggaat

SEQ ID NO: 28022 - DNA, 201 bp, Bos taurus
gtcacaagcccagggtccagttaagactcttttcgcctgctgggtggtctcaggagctcttggagttggtacctgggcctgtgtcagctctaccagggttctgtggtccttaaagtaaggaatcacctgaaggcttgttaaaaggcagatctgatgctgtgaatctagaaaggggcctgagattctgcatttctaacaagc

SEQ ID NO: 28023 - DNA, 201 bp, Bos taurus
gtagacattctttagtctctattccagcctgtgtcggtgtaagcactgcccaaggttctggggcccatccagtcttggcagagaagaaagcgttctcagtcggctgttggcttctcagcctcacatctgctgccccttgggaggtgtgcgctgtgagcctcctgtgggctctctctctccctttggggattttctgatgtt

SEQ ID NO: 28024 - DNA, 201 bp, Bos taurus
cagccgggcaaccatgtcaatagccacgtccacaaattctatacattcattagttctaattgacgaggacgcggaggactgaaaaccaaagtctagccagccttcccaaacacctgcccttagaatttactggatcaagaggctgaaaaagctgagggaagagggaatgaggaagggggaattggctttttagatgcttta

SEQ ID NO: 28025 - DNA, 201 bp, Bos taurus
aagatcctccggagaaggcaatggcaacccactccagtattcttgcctgagaatcccatggacagaggagtctggggggctactgtccacgggtggcaaagagtagaacacagctgaacaagtgagagcaacatcaaccaacatggagaggcttctgccaacaaatgcagggaaaggactgaagcagtgccacagcctagc

SEQ ID NO: 28026 - DNA, 201 bp, Bos taurus
gagtcccacactgtcatttactccagggcaagtgcagcgtgaatggccaccttaaatacaggtttttatgaatctatttattacatggtcggccacataatagtttgatgctgaactgtgtgttagctttacaggtacaagtgcgagtgactgaagggcctcggtgggtctggaatcaagaagagaccacaaaccatcccg

SEQ ID NO: 28027 - DNA, 201 bp, Bos taurus
atggggcaaacaggcctttttggaattagtttctcctcttggttaatgagggtcaggggagaatgaaggaacaaaccgagatgcttggtacaacccaggatgctgaccccttgagggagatgctgatggagtggggccagggccacctctgtggtccctcgggacctctgaaatcacagaaggttagagaggaagtcagga

SEQ ID NO: 28028 - DNA, 201 bp, Bos taurus
tggctggtggagggagggggtgcacgcaggccgcgatgccccatgtgcctgctcattagtggctggcaggaaagcacaggaacgagtggacattggcacaagctggctttctgttcttggagaaggccaaaaataatctcagtagatttaattaaaactgcagtgaacagatggggaagatggaaagaactccaactggag

SEQ ID NO: 28029 - DNA, 201 bp, Bos taurus
tatgctgaacaatgatatgtgtgaagaaagactcaaagtaagtttggactaaacgagtatttctggtaaaccaccaggaaagccacaccactaaacggtagcgtgggtctctgtcaaatgcagtgacagtcgctcacctcatgctgggtaccccagattgaagaactaacaagccagagatgtcaggaacacagaaactag

SEQ ID NO: 28030 - DNA, 201 bp, Bos taurus
tagagactagacactggacacccgtcccagccttggaggagcctgcctgtaggccgcttacacttgaaaccagagggcagccagaaggggtccttccaagaccagaaagaacatgatgggtgccgcctgctgaccttcagtctccagagatggatggtgtccatctgcacttgacctttccacgaggcgcgatcacgtttg

SEQ ID NO: 28031 - DNA, 201 bp, Bos taurus
cccccggctccgagctctccgggctgcagggagacagcagggtccttgcgcctctccaccagctcttctttgacctccacctgctcgtgaccactaaacataagctttctctctgggtccctttattctctctgcagtgtcagctgtctcctctgacctccttggggtggcctttctcaagtgcatctgtaggggagctcc

SEQ ID NO: 28032 - DNA, 201 bp, Bos taurus
ccgcagcccctggggagcctccgagaaaggccccttttgggaactaaggagtccatttggggaccatgattgcctctccaggatcagcctgctgggctgagcttgaggctggcccccacccacagggcaaaaagcagggaaagtagctcaagacttagtgattaaaggaatcaagtgtaaaacatgtcaaaagaacagtta

SEQ ID NO: 28033 - DNA, 201 bp, Bos taurus
aaatgtcagaaagaacatcacaggaagaggagaaatgggaaaggaaagattatttgttttgtcatttaaattctttcatttctttttaaaggcctacaaaatggtttccagttcagaatacccactatattcacttgtgggattcccaaagataggtggagagggccaggctccacggagtgcagctcagccgcactcttt

SEQ ID NO: 28034 - DNA, 201 bp, Bos taurus
gccaagcagagctgtaacaggacgcacccgtatctggctggagagcaaacaaggtaggctttcttcctctagcacacagcaggcaccacgccacacacacgcagtgtttgctatttttgcaagtctaatagggtctgctgcgggaggggtgagagatcaccagttcataatgactctcattatgtctggtacactttgagc

SEQ ID NO: 28035 - DNA, 201 bp, Bos taurus
caccactgctctcccacatgccacagtatttgagcttcgctagaaaatacaagtctcaggcagggtcccctgcctgaatacagacaaccgtgtttagcacatcaggaccttgatacacacagtgcacaggatcagatctgcccgtttcctttcctctaccccagacgatctctccctacaagccagtctacctggacatca

SEQ ID NO: 28036 - DNA, 201 bp, Bos taurus
gacttctcagctaaaagactgtgatttggaaatttagatttctgtctcctgtatatagagaccgaacacaatcaggaactcacattctgtaactttggctgttttgtaaaagcttaagaatgctcttaacttgtggagtaacagtaaatacttaaggacctaagatatgacccactatctaggtattatacccacaccaga

SEQ ID NO: 28037 - DNA, 201 bp, Bos taurus
ttacagaaaaaccacttccctagtgaattccacctcagcagcaactcacttcatctttttaatttaattaagtacaaagaaagaaaacagaatgaaactcagacaagctagcactgactgttaacgtccaggagtccctcatgtccctcctaaatcaaaatgcatattttaaagtaagctaaaaatgatacacaggcatta

SEQ ID NO: 28038 - DNA, 201 bp, Bos taurus
aagcacaattggcattggaagtgaggacagccttatagaggactaagccttaactagtgggtctgtactcactgcaggtggtaacactagaatcgaattgcgggaaccagttaagagttggaacagaatatctgcaccaccagtgagtgaatacacgagtatcaagggttgaattccagacctgatgtcacagaaaaatga

SEQ ID NO: 28039 - DNA, 201 bp, Bos taurus
tcggactcttcaagaccccatggactgaagcctaccaggctcctctgtccatgggattttccaggcaagagtactggagtggggtgccattgccttctctggtctaaccctatacgcatatataaagcagatagaactcttgtaagccagaatggttgtgagtctctcacttgcccagtaatgagacctaaatagagcgag

SEQ ID NO: 28040 - DNA, 201 bp, Bos taurus
cctcttgagctatgtgccgggtgttttcaagtttgcatttgaaggctggtggtttcacccagacaacctgatcagctgagtcagactggacaatagacaatgagaaagactttgatgtgggagggggtgtggatttcaataagatgggatggttaggagtgtcaaatgacacagagaatcctaaggttttaatagaaacct

SEQ ID NO: 28041 - DNA, 201 bp, Bos taurus
cagctcacaagatgaagtaatgggcttgtctctgtctaggtagggaattctgccaagctctgtgttttaaataaaacgaggcttttgtggttcttggcacaggcccaccagtgcaggctaaccttggcatctgtgtgctgggctttctctagaatgtggctgagaatggacaagagctcatgggtgacccaagggaaggga

SEQ ID NO: 28042 - DNA, 201 bp, Bos taurus
ctgaaggacttcgtagcaagaatttctctgaacttttcagacctatcactgagccagacggggcattatgctaaattttttaaggcaggaatttagtggtaacccgtacggagctaaaagggcaaaactggaaggcagtgagagaataaccttttacatcaggcaaaattgatggcccgattccacagcccagaggcttgt

SEQ ID NO: 28043 - DNA, 201 bp, Bos taurus
caagacaaagggacttggcgtgcatgcatgtgaccttctcctgtagagcaaggagctttcaacacccttctgtatagttatgaaagcacttattatgctgtgctaattgcttgtttataagtttggtgcctagttacacatgcctggcacctagagaggccctcaacgaatactgagggaatgaagatgggtcaagttcag

SEQ ID NO: 28044 - DNA, 201 bp, Bos taurus
gaagcatgtcatgctcactggaaagagcagttctttgagatctgaactggtgaatttttgtttctgtgattatttttgacttgaggctgaagctatagaacggaagctatgagctgtctgtgtgtctgtgattcagaaaaggctcattttacacataggaagtgttttcttatctccaggttagattattctgtcttaaaa

SEQ ID NO: 28045 - DNA, 201 bp, Bos taurus
accccacaaatcttttgttgggaagctgtctggtggaggagagtggtggcttgaggagcatcagaccaaggccctttgtgacccttacattcccttctcagcacctccctgggatccctccatggcagcacgtgagaaatgtgctgctgaatttcaaggggagatacagagtttggatctcaaatcccgcactgagatatt

SEQ ID NO: 28046 - DNA, 201 bp, Bos taurus
ctcgccagccacccctggagcacatggctttgaaactggtggagctatcaagcaggcgctcaactcactgtcccgaaccctgtggtttggactcctgcttcggccatgacgttagtgagaatgtagcctgtctgtcctacaactggtagagtccctaagtcttcgggtcccctgaattgtcacttcactctttagtaggga

SEQ ID NO: 28047 - DNA, 201 bp, Bos taurus
ttttcaggaggtaatttttacggttgaaaggcccactttcacatcatgctggtggtctgaaggcagaaccagagtatcaaagagagagaaagatgaatgcgtcttcttcaaatccacttcttggggcccgagcctccagaacagctttgtcaatcaggaagacgagcattcaggcaacgctttttcccttcaaggagccac

SEQ ID NO: 28048 - DNA, 201 bp, Bos taurus
gtagacagaaagcaacatattctattgaccactgaacttcagattgagaccctctgtcttatcctctgtctccatttctgctacatgaaatttcaattagattcttcaacttttcaggtcagtctaggatagtaaatggctttccaggtggctcagcggtaaagagtccgcctgcaatgcaggagatgcaggagacagaca

SEQ ID NO: 28049 - DNA, 201 bp, Bos taurus
aatgagctcctttccaaattattctgagttgtgtgagctctgggcctgaaccatatagactctcacttgagcatcttcacagagctttataaacaccaggctctgggtacacaagtcttggtcgcacctggagaggtacaactatttagcaaacccacaggaaaaacaatcattaataaaatagcccccaaaggcaacaaa

SEQ ID NO: 28050 - DNA, 201 bp, Bos taurus
agtgactaaacaacaacacatttccaaagaacttgttctatcctccttactgtttccttctgggctgtgttttagacaaagtgtttcctgcaattaggtcactggatctgtgccttatttcctttacctttaatcttttataaactatgacatttacaaacctccccatgaccaatctgtgaaacccaccatctctcgctg

SEQ ID NO: 28051 - DNA, 201 bp, Bos taurus
gtttgctataatcacattatcttccacatcccttgtttccccccacgctcaaattgagtaaatcacacctgcaatttaactcttaatcaagaggccctcgagtctgacttcggagactgactttcctgcttctcttgtgtcaggtgtgaaaatgaagaatgtcttatttgctccgcggtgatgctcagaggctgtaaatca

SEQ ID NO: 28052 - DNA, 201 bp, Bos taurus
caaagagctgcagtaaggccagccttaagcacagctgaaacaaccacatcagcaagtcacatccctcaggctctccattggtcaggcctgtacttggcacctacacataccatcccacctccttaaaacaacccaggttacagttgaggaaaatgaggcaccagggtgtgaatggtaggggtttggaggcccctcagcctc

SEQ ID NO: 28053 - DNA, 201 bp, Bos taurus
cagtctttcattgctttcagtgaagcacacagcaggcctaaacaaacacttgcttctaaggaatctttaaaactacaacatatgcattttcagccaacagcctggcttacagcaaccattagaaatgaagggcacaaggcaccaagttaaaagacaaccttctcgtcacacaaccacactcaacaccactggtctcagtgc

SEQ ID NO: 28054 - DNA, 201 bp, Bos taurus
ccaccagggaagtccctctgatgacctttgcttctccccactctgcctcgcaaatcccagggaatccaggccagagacgtgatggctgtggggaccttaaggaaggtcggagcagagacctgactcccagcccagagggcagggatggctgcagaaagcacccagaatgctgcaccctttcacggtcagaccagaccgaga

SEQ ID NO: 28055 - DNA, 201 bp, Bos taurus
agatgcgatgtggttttgggaactgtttatatcctggtgagcagaatagaactgatgccgagtctgtatgagactcacagactcaccagggcagcgttaacggcaacaggccatgtgatcaacgctcagttaggggaagtccaggggccgtgggcgtacatgggaggagttcaggaaagagttagcctgattacagtgcct

SEQ ID NO: 28056 - DNA, 201 bp, Bos taurus
acgtgcaccaccacaaccctgatccttctctcctgtacttgggagttggtgtcctggacggaagggactggtcttcctggttaggcatctttgcaaggagcctggggccacgacgggggcccgtctcctcccaaggcctgcttggtctgcctcttctccctgaagtaccagcatccagaaggtaagggtggatcaccctcc

SEQ ID NO: 28057 - DNA, 201 bp, Bos taurus
gtgctcaccccactgccccctcatattcccagcctggcccacctctccaacccagccagtactgtgcatctgcaggccttgagggaccagtggcctgtcccaggcaaggtcacaggatccccttcccctgcaggttcagccctgttctctaagccctcctacctacgcaggctgggaggaggcatcaccacctgctggggg

SEQ ID NO: 28058 - DNA, 201 bp, Bos taurus
tcggacacactgagcaactgatgcacccagagtttcatggagttttgccttccatggaatatcctggtctttcagccttctttcttgccgccttcacatactacaatgatttctttacttatctttcattgctatgagttcccaagatagggacactatcttatatatcctttatccttatatatcctattttataatagg

SEQ ID NO: 28059 - DNA, 201 bp, Bos taurus
gttattagcatttgtagatagtaattgaagttaatgggagtggatgaggccacccagaaggagaatgctgtactgataaagattttcaaaggcgggtggggaagacttgtatcagggtagaagggactgtcattactgtatttgaaaaaccataatcaatcagtatttgctatttgaatatatattgtttgaaactagttt

SEQ ID NO: 28060 - DNA, 201 bp, Bos taurus
ggggagccccatcctgcatgccccccggccctgaaggggcgctgtggccaccctgcggctgggacaggcctgccacttctgaaagctgcttttgtgcggctgctcgggctcctgtttcgttgaccttggatcctgcttcttatttatccaactcgaagagaaattcagcagcagccgaggggaaaaaaataacctcagctg

SEQ ID NO: 28061 - DNA, 201 bp, Bos taurus
ttcacttacaaaacaaagaaacaaaacaaaaacaacctttaaattcccttaagccacattaaagaatatctcatgagtctgtaactctagactggtgtgtgagaaaactgaaaatgtcctgtcctgtgaaactgtgatgctgctcagggaaactaacaaaggaagaagggggtcacctgtctcccaggtgttcccctgaca

SEQ ID NO: 28062 - DNA, 201 bp, Bos taurus
tctggctcctcttcactcaccccctccccgatgcctccatctctgcggttttttaccctctcccatcaggaagccatcctaggcagcctctgcccaaccgtgaaccgcgtgggccagaacctgtgctgcttgttttggggggaagtaactgtgtgtcccttctcttgccatagaaaggacatctcctacctagtttgtctt

SEQ ID NO: 28063 - DNA, 201 bp, Bos taurus
aactaacacactctctcagaattaaatcagaatgtaaaccagacttagaggtttatatgctttgcttactaattctcacaacatctggccaataatacatactcaacttctttctaaacttagggttttcttatgttacctttttattacgccttactgattccccactctaatgtgaagcacaaatagctctagcagagg

SEQ ID NO: 28064 - DNA, 201 bp, Bos taurus
cagacgcttaatgaactgagcctccagggaagcccatcgtagtacatttacaactcataagaaaacgggtcctagaggggctgatatttcagtatgtcaatgcaggtctgattttatcttgagaacaaacatcacaactgtccaatcaggaaaccagtctagtcaatcatagtagagcccccaattcagtcatgtggtgat

SEQ ID NO: 28065 - DNA, 201 bp, Bos taurus
agtgccagacaaagagaataaggtcagtgagagatcatttttccagaaccacacaagcctcctctcccctctaagaaagacctggctccttggccagttcccttcctaccattaggattcttcattcatgttaaagtagaaaccaggaggttaatttttgctacgtcaaccgtcagatcaggcaccagctgaggccttttt

SEQ ID NO: 28066 - DNA, 201 bp, Bos taurus
cctgaccccccatccctccacaacactgtatggcagtgccctgtcctctccaccagaccatgagccccagctgggtgtcacacctgccccgaggccggccctcgacacagtgggttggaagtttcgggagaatggagcccaaaccggaggagcccaaagatgctgtactcccacacatcactctgcccaaagacaggtgtg

SEQ ID NO: 28067 - DNA, 201 bp, Bos taurus
tgccaccgtcctctgagcacacgtgtcttctcagtgaaatgtgaggtgtgtggagatcagggctgaagaaaggtgtgaaacagcacctgtaagggggatgatgggaataagcgtggggcccgtctgggctgctctgaccttatgtagaacgaccagcgtggttctgcaggaacttcaggacactggtgtgggtgccctggt

SEQ ID NO: 28068 - DNA, 201 bp, Bos taurus
tcccaacgcccatcagtttatgaaagaataaacaagaggttgtatatatccgcacacaggatgctgttactcagccataaaaaggactgaagcgctgatatgcacctcaacatggatgaaccagcaaaactcacagtgagagaaaaggggccagacgtgaaagcccacacacatgctgtatgatgccgtttatacgtgaag

SEQ ID NO: 28069 - DNA, 201 bp, Bos taurus
cctgacacctccatctcctaccccttcttcctctaacttgacattacactgtgtaagtttcagctccaggatatacctcattcactggtcaccatctccatggccaccaccccagtctcctctgccatcctccattgcctgcatgttggagcagtcacagttcctctacctgccatccatcctttacacagcagcccgagt

SEQ ID NO: 28070 - DNA, 201 bp, Bos taurus
ccgtcccctacccacccccggccaccccctcctccacctggaggcccggtgggtgcccgtgagccccttggtgaccctgcactcatatcgttttgttttcattttagatgtgggccattttttaaagtcttcatcgaatctgttacaacatttcttcgcttttcatgtcttggcattttggccacgaggcatgtgggatct

SEQ ID NO: 28071 - DNA, 201 bp, Bos taurus
ccagcttcttcacccatgccaggccccagtaggtctagttgctttgggtcagatgctcactcctaggtggctgtaggggagggggagtcacatggtacaacacaagggggcccaggacccctgcagcaggtactctggggaactgtggcctttagaacagactgcgagacaggccggcccaagctgacctcttatagatga

SEQ ID NO: 28072 - DNA, 201 bp, Bos taurus
gactcagcaagtgactcagaactggaccccatgccccagctctttccactgtcccgtgtaactgggcagatgagttccacaagtggacctggccaagagctccaccctttgagactgaacttggtaaagcaacaagtacagcaacaacagcagggcaaataaccacttttgaagctaaaccacccagaaaatggtttgcac

SEQ ID NO: 28073 - DNA, 201 bp, Bos taurus
agtcgccaagcagcgagcccttcggatcgaggatcaccaccttgttgacctcgcgaagggtcagaaagatgtagcctttcttatccacggacacagaacctggctggcagccatgcaggccaggtccccggtactccccaaccacctgacccagcccatcacagaccaccaagctattctgctgccaatcggaccctacaa

SEQ ID NO: 28074 - DNA, 201 bp, Bos taurus
ctctgtttacaccagggctcagctcacactcccggagctggaggggaccgaaagcttagcaacacttgcccgagaagagccactagaagactggccccacgagcacactagtgatcagaccgagcccctgtgtacagggaccaggatgtcttgctcactccaacagtcttagggccacacccagagacaactgcatgcagt

SEQ ID NO: 28075 - DNA, 201 bp, Bos taurus
tccccgaacacacacccggaccgcccctcggagacaggacgcccaatccccgcctccaggtgccccactccgagttcaggccctataaatgctacctcactggagatccaccctccctactcccgcggagagctccgcaggattaagtcttgtgaatcccgacccccaccctcccccaggccccaggggcagatgagccct

SEQ ID NO: 28076 - DNA, 201 bp, Bos taurus
ggctcctcaccgggatccctgatgccagagggcctctgtcctcatgctccaccttgcctagaccctcagcactgccattccaggcccgggcaccatcctcaatctctgctgggtaacaaggagagctcagaagctgtacaatgggaagggtcttgctgtccccccagctacacgcaccgcgacctggctggaccaggacaa

SEQ ID NO: 28077 - DNA, 201 bp, Bos taurus
aaagcattggagcgtcagcttcaatccttccaatgaatattcagtatgtatattctttttcatattcgtttccattgtggtttatcacaggatattgaatgtaagtctctgctatacaacaggccctgttgtttatccagtcttcatataatagtttgcatgtgttaatccaagagggcttcccaggtggccctagtggta

SEQ ID NO: 28078 - DNA, 201 bp, Bos taurus
gccaaactccatcatcacagtctgaaagcttgcctgggagagagaagcttgggggctgataaggcggtgtgataagcagctgtgatggaagcgcgggagcggagcaggaggcagggaaacagctcacctctctgcgtttctccagcaggctctcgaggcgctcaggcgctctctgtcccgggcccttgttccgttcagcct

SEQ ID NO: 28079 - DNA, 201 bp, Bos taurus
gtttaaggacaaaggctgagaaaatgcaatgggaagagagaggccagggagttgactaacaggagaggaaacctctccttcaggtcattacacacaggtaatgtttctgcttgtccctctgacagggcctagaggttcccctgattgctgtggttcagtggtctacgccgaagttgcccttcacccagagcatctataccc

SEQ ID NO: 28080 - DNA, 201 bp, Bos taurus
tgcaaagcctcacagttatgggaacctctcccagttgtttggccacctctctcttttatgagcttcaaagcctgatttattcactctcaaattcccgcagaagggcgtagggcctataatttgggagcgtctctgctggggtggagcagaggatatctacgaggtaatgagcctgacagcccactcctacaggctcttcag

SEQ ID NO: 28081 - DNA, 201 bp, Bos taurus
ctccaggattcccagccatgggaatcagtaaggactatgctgtacatgggccagttgtttttaatttgcccttgatggactctggttgactactctaggtccacgcaaactggcagtcaatcagagggtcattctcaggagcaaataatgtcacaaaccctcctaactatgctaacagcaactcaggagtaaagttaactc

SEQ ID NO: 28082 - DNA, 201 bp, Bos taurus
aaggcacaagcccctgcgggatcacaggcaggctcccttggtctcctcctgcccctgctccagccttccagcacctgcgtgaggctcccttctcctgcccgggccccttttgctttcagaaccaacaaccttcacccacacacctgtctcaccctccttcctaactctttgcaaagcccgtgtgccttgcctctcagaaac

SEQ ID NO: 28083 - DNA, 201 bp, Bos taurus
acaggagtcagtgtctcttaggtcactttgtccctgaccccctcaacagagtcctgggctcaccagtccgggctcccattacacaatcccaacctgcgggtggccgggaggaggaaatgcgtcaaaggtgaggagcactttgagatgagcacacagggtatttggtaaactttagctccttcctggctctgggcagacact

SEQ ID NO: 28084 - DNA, 201 bp, Bos taurus
gtgacccccacctcagctgcccaaatcaagtgggcccaggaggggcgcaatgcccaagggtccccactgtccaggtgatgtgcgtgggacaagtagcttcagataatgaggcccccagcccctggcaggggacacacaagtttggagacaacagtgaggccaagaatgtttactttgaaaaatccattcgtcacagcccct

SEQ ID NO: 28085 - DNA, 201 bp, Bos taurus
cgagttttgcccaataaaagaagaaaagaatttgttttttggtttgttttttagaatttccatctccttcctctggtgtccaagtaaaactcttgggattacatcaaggcttgaatgacctataggctgatacccagcagcggaaatggtcaaggccgtctggggtctaggtgctcccttcaggcccctgccccacgtggg

SEQ ID NO: 28086 - DNA, 201 bp, Bos taurus
ctctcgctgcagtggcgtctcttgtggaggctctgggcacgggcttcaggagttgcgccacacaggctcgctagctgaggtgcgccggcttagttgccccatagtaacttggatcttcctaggccaagggttgaacccgtgtcttctttattgcaaggcagactgttcacccctggacccccaaggaagccctgctttttt

SEQ ID NO: 28087 - DNA, 201 bp, Bos taurus
attttggggatcatgctaatggtaaaaggcccatctttcagagatatgtgccgaaatatctaaggatgagatggtaaaatgtggggattgttttctgaatcatccagtggaggggggagagctggccgcgtggccagggatggtgtcggaggtgggtgaagagtccagcgcgttcaccgagctggcccctccctttgtgtt

SEQ ID NO: 28088 - DNA, 201 bp, Bos taurus
cacagtgtgaaccgctgactggtctccctggatcatctcccgggcctctcccgggggaaggagttggtgaccccaggccggccaggcgcactcaccgagcgatcttgatgtagtaatgtgtcggctttggcatcagaaactccccgggaatttccacctcggccgtctgtgccgagaagttgctcagaaaccggcacttct

SEQ ID NO: 28089 - DNA, 201 bp, Bos taurus
gcccattgcttattcaatgagttcttttgttaaaaacaaaacaaaataaaagtctgcagctttggtttgtttagctcctaaaaggccaggttatcaaagcacctgctgcttaaagaaaaagagggtgaagggaaggagtgggagaaggagagagttgggggggtggggagacccactgggcggtggccactcgggatgaaa

SEQ ID NO: 28090 - DNA, 201 bp, Bos taurus
ccaggctcctccgtccatgggattttccaggcaagagtgctggagtggggtgccatcgccttctccgtactcactgggtggaccctaagtgcaatggcagatgtcctgataagagacagaagacagactcacgggggaagaaagccatgtgacaacagaggcagaaattggggtgatgcttctacaagctggggaaggaac

SEQ ID NO: 28091 - DNA, 201 bp, Bos taurus
tgtctcagcagagagaagccagggaagcagactctgagctgctgagaaggggttcagcgttccctgcagaagcctgaggaaggaatcagggctctcgccataggccagctccctcacctgggctttccaggtcagccgcttcatgtacacaccttgatttgtaaataggccaatattttaaattacattctagtgaaaaaa

SEQ ID NO: 28092 - DNA, 201 bp, Bos taurus
cccgctgggctccagccacatccgcctgactttgccccatcgcaccagcccttggcgtgtgctgtgcccactgcctggaatccaacgctctgatctttgcgcagctggtcacgctcatcattttggtctccatgcagatgcccctcctctggaaggcctcccttgacttcctgggttaaaataatgctccgcgacctgcag

SEQ ID NO: 28093 - DNA, 201 bp, Bos taurus
acgagagtcttgatgaaaatgtatgtgaacagtttttctatttaccaaatatacttattttattttgcttcaagtctcaaacctggtctcaacttttcacttgtgttcacagttcaaaaaattccataaggagattatctatgagctggagaagaagacagagcttgatgtgaaatatatgaatgtgaggaccaggttttg

SEQ ID NO: 28094 - DNA, 201 bp, Bos taurus
accctcctgtcggaaacaacagcaacaatggacacagctgtgcaccctgccaggtagctttcaacaccaaggcgaaacagccgtcttgaggcagtaaaaccttaaggaatttatcacgaggtgacctgaggatgtggtggtggtgtagttgctcagtcgtgtccagctcttggagactccatggactgtagcccgccaggc

SEQ ID NO: 28095 - DNA, 201 bp, Bos taurus
ttggattttctatgagataaggctttctactatcccaaggtttaaaagtttagacattgtagaaaagaggactttgtgaggccccagatggtagaagggcgtagtgatgcccttaggattctcccttgcaggtcgagtctggtagggttccaggtgactctatccaaggccgtgacatcagccaccatgcaggtatctccc

SEQ ID NO: 28096 - DNA, 201 bp, Bos taurus
tcagagccccctgcgggggcaggaacccactttcagaggccgctacccccatatttattagaggaaaatcagaaaggacagataatgccagtaaaaaaggaaaaaaaccctcagccggccacaaagcatccctccgccccgatgcactgcagccccagcgtctgcgtatgctcttccagactcttttcttgggtgagaaaa

SEQ ID NO: 28097 - DNA, 201 bp, Bos taurus
gggagaatgccgtccctgcggccagccacaccagcattccggggagcgcagggtttgaccctgaattgggcaggattgccccaaagcgcggaacgctcagtccgcgccgcgacaaaggagcggccagggagcgctgagtccaaggttggcctgtcctttggttttaaaacaaagcgaaagaatattgtcagtcgggctgcg

SEQ ID NO: 28098 - DNA, 201 bp, Bos taurus
tggctgccagcccatttccccaaagaaccgaaaccccaggaggcacctggggaggtatcagagtctacagaggtggatgaacccctgctgcacgtggacgcgttcgggccaggtggtgggggccaccctgtccacccccatgccctggccaccccaccccggctctcacctctgctcaggcggcagggagaaagaccctcc

SEQ ID NO: 28099 - DNA, 201 bp, Bos taurus
tcctcctcttgctctttgcagaccccgccctcctctcaggtcccgtttctgaaggagttctgggcactgcgcattcgttcctaggccctcggattccccctctgtcataaactcacacaaccatctgtaagccttgacgtgaccccttcaagcagcaccaagggaggtgccagctgtacgcggagagccaagtcttcttgg

SEQ ID NO: 28100 - DNA, 201 bp, Bos taurus
cggaagtaattacaggcaaaaatgacatgacttctagtcctctcttaaaattctccaggaaaataaaacaacacattcttcctctcaaatctcttcaattgtaacaagatcatcaaaatgttgataactgcaatggcaccccactccagtacttttgcctagaaaatctcatggatggaggagcctggtaggctgcagtcc

SEQ ID NO: 28101 - DNA, 201 bp, Bos taurus
ccttctctccctgctctcctttcttggggcaacagtgtggccagccctggggtcctccctgttggctcccctcctggccaggttagcatggccacatccagcaggaagggaggtctgagggtggcaaacacgggtctgacaattgttttcttgatcacattcatgttgcacttccagacaaaccaaaccagtgacaacttt

SEQ ID NO: 28102 - DNA, 201 bp, Bos taurus
gcctcccaggctgtgctccatctcctaggaggtctccctccgagtcacgctgtttctgtcctctgcaggcctttgtacacgggcagtacttagtccttgttgatttcgtgcttactctggttttgtatttagggggaaaaaaggagcaggaacaaatagataaagaacttgctcagactgtaagacttacaagtctgtggc

SEQ ID NO: 28103 - DNA, 201 bp, Bos taurus
cttttttttttaatggtgttttatcaaactaaaaagtaaaaactccttaatatggtcagatagccagcctgtgtgcagatatcctacgttaccacagaaccgtcgtgtttgtgtgagggtgtaagttaagtccttgccttacagttattaagctgtctctcaggtggagttccgtctccaggtgcttctgtcccttgctgc

SEQ ID NO: 28104 - DNA, 201 bp, Bos taurus
ctcctgcattggcaagtgggttcttgaccactgtgccccctggcaagccctgaggctccgcccccccacataaacccacaaactgaaatggtctgggaaagaatagtctcttcagagcgtgggtggaaattgccgttatgagttgagagtgtaccccggaaggaaacgtacgctgcagagctgagtgttacaagccgcgtt

SEQ ID NO: 28105 - DNA, 201 bp, Bos taurus
gagcacccaggaagtcagagaagctgggaaaacccacgtgattgggactgaggatctgtttccagagaagcagatggtgtgacagaccacaccagcagcccgacttttcagggtccgctgtgaaccctgccggtcctgtggggttcctctactgagccttcgttgtctcctcacccggagacagaggcaatggctcctgac

SEQ ID NO: 28106 - DNA, 201 bp, Bos taurus
gttggacacgaccgaagcgatgcagcaacagcaacactagcatgtcttccttgatggcaggcgttacgaggaggcggccaggccacagcacactgtgtgctgtttgcacaacacttgtggggtgcccagcacatgccaggcacacacgagggcaaagatgcctcgcctgccactagggccgtgagaccatgacatcacctc

SEQ ID NO: 28107 - DNA, 201 bp, Bos taurus
aagaagctcagggaccaagagctgacccagggcctggagggtcctttccgagcgggtcacaggcagtgagtaagagggtccagccaagaagcctctccgccgtggctgctgcaggcctggcctcctgggagacgcacgcagggtggggcaggctgcaggaccccgccttctggggcatcggggtggcctcctcagacctgt

SEQ ID NO: 28108 - DNA, 201 bp, Bos taurus
gctgcaaggtcgtcaaaagaccatacattctggcagctggctggggtcaagtactacattttgccttcacaccaacaccaaggactgaccctgcagccaccgcaaacagcaggtatctttcctttagaaatgttcctgtagcaccctctactggaaatgttttaaaacggcactcactgtaaaagagaaatgcattaagaa

SEQ ID NO: 28109 - DNA, 201 bp, Bos taurus
aatggctaacacatacaaggtccatgagagaaataatttccaactccatccagtataagagggttagagtggtcaaacagcaaacgtgaatacggtggctaggttagttcctttgacacagacacatttggttggcattttagacagaactgctgtaaagatatgtatgcattcccatttctcaaaaacattcttgacttc

SEQ ID NO: 28110 - DNA, 201 bp, Bos taurus
tctgtttccgaggacaggttaagaaatcctggtctgagctattctgtgactaagaaatggaggaatgtggcaacaccagtgaaagtcactcaggaaatatgaatgacttgggcagagaagtggtgcaaatggttgacttatgaatatatttatatgtgaacatatgaattatagagacactctcattattttatcagttca

SEQ ID NO: 28111 - DNA, 201 bp, Bos taurus
agggacacgtgaatgtaatttcatggtgtatggatggcatgatacaagtttggtgcaaataaaaaatatattttaggtgagaaataaggggagatgaacccagataaatgaggagttagtgaattgactatatagcagaaaatgttactcactaactgtcatgtacctctgtacatattatctgctcttccaggccaaggt

SEQ ID NO: 28112 - DNA, 201 bp, Bos taurus
cccattaggcccaatataatcataaagtcctcataaagaaaatagggtgactagagagttagagaagatgtgataacaaaaacggaggttgttggagtaataccattgctggaagaaggccaggtgtcaaggaatgagggcaacttccagaagctaaaataggcaaggactggtttctgccctagagcctccagaaagaca

SEQ ID NO: 28113 - DNA, 201 bp, Bos taurus
tttcacccttgttgaacttctaacctacagaatctcaagataaaaatttatgttgttctaagtcaaaataaagtttaattttaaatttaaaaatatctttcctttctttttctaagtgtaattgtattatgtgcaatatttggggcatatttatactaagttttatgagttttttttaaattttcaattcaaatttaatta

SEQ ID NO: 28114 - DNA, 201 bp, Bos taurus
tgaagaacaccagctgagagcagacaggagtacctgaccagaggaaaagaatatataggcccacacaaaacttgctaggatgaaagaactagttggaaaagcaggagtgttagttggactagactgccctcagcaggtgggggaactgaagcaaaggtccaatccccacatcaaggcaattgtctgagtcagaggagaaac

SEQ ID NO: 28115 - DNA, 201 bp, Bos taurus
catttcagctcctcttacgtgtcttgggttctgcctctggcaatctaagaccaccgtggctgctcaggttgctgaatggccagttcttatgtgtgacccccaaacatgcaagtattttaattaatgagtgggtttccctatgggaccattgcacagtataaggaactaggcctccaccactcccataaatttctcagtcac

SEQ ID NO: 28116 - DNA, 201 bp, Bos taurus
attttcctctgcacctagaactacaatacttttttcaaactaatttttcttttgacaacttttgttatagacacgaaaagtcaaatataagtaaaacataaaaagaattaaaattggaaattataataagaactaaattaattttaccttcaaaatcttgacattttaaatctacatcatatgcaagcaaacaggtgtcaa

SEQ ID NO: 28117 - DNA, 201 bp, Bos taurus
atcatattaaaagttgtaatgtagatgcctttaaaaaggcaagattatactaatttttgtaaaaaggagattatagtatgattaaacattaacattcaaacgctgatttaaattgtgcatatatttttctcatttcttattgaatttatgatcattgatgagtcacttaagtaaatgtaagccacaccctaaaatttatgt

SEQ ID NO: 28118 - DNA, 201 bp, Bos taurus
tttttattcctgctatgtgaagcattaacaatattgaattcaatgctcgtatttttttctcagcaactactagtaccacttgaacattagtgatagttaacatttttaaaagatgtttctctacagttaaggagttaacctatttaagtgaaatatgacattctcattgcctggttatgtaagcaagttagcagactaatc

SEQ ID NO: 28119 - DNA, 201 bp, Bos taurus
agagatggaggttttgtttccctagtacacatggagagctgcttctgctggccttgaagaagcaaacagccatgttataaagtgactaaaaggagggccatgaggcagaggaaacagtgagcagcctctagcacctgaatacagccaccagccagtggtcagtaagaggtaaagccagggcctgggccctcagtcatatat

SEQ ID NO: 28120 - DNA, 201 bp, Bos taurus
gtttattgagagaaatgatgacttttttcatttccccaggctcaaatgatacaggtaatctagggaattaaaattagcaaatgtttctatactaagtctagaagtttcatcttttcccagccagaattctattcttgggagagtaggcaatctaggattcaaattttgccttctctggagttttaagattaaatcctagta

SEQ ID NO: 28121 - DNA, 201 bp, Bos taurus
aagaaaagtacccgcaccctgggaagtttccttgcccttgaggacatcagctgggacaggtggtgctgtggagccacagaagagaatacaacaggtttgcagtggacagaatggagagagacctgcacagatggtagctccccagcctgagacatgtatctgtcagtgtgtgccagggctggtggctgaagctcagacttt

SEQ ID NO: 28122 - DNA, 201 bp, Bos taurus
tcctgaggaatccataaataacaagaaaaagtgctggataagcaaggaaatgtggcagaattgaccacttctcttcctgttgcgtatcagttctgagctatagggagaagagtgaggggggtttttgatttggttgtaaaagtgtagttttttgatgcgcattcaaccagacctttgaaaacctgaaaataaatttaccca

SEQ ID NO: 28123 - DNA, 201 bp, Bos taurus
gatatgtaaatggttgtacaatgttctattatatgaatatactattgtttttttctttttttgtttaataacttgttgttggataattagtctgtttccaatttttgttacaatgatatttactgttgtaaaactccttgttcagatataatttgccacttgatatttcttttcctcaaatcagtacctagaggcaattgc

SEQ ID NO: 28124 - DNA, 201 bp, Bos taurus
catcagattatatatagtatgtctttgaaattaaaggcattaaatggttttcagtgattattcatcactaaataagtaagttgtttaaaaatagcagtgcagttatttgagtttttaaaatctttaactggaggcaattgcatttttagaaaatatagagaatgcctcaaattgtaattgaattgactaaatcaggagttg

SEQ ID NO: 28125 - DNA, 201 bp, Bos taurus
tgtttttgaatatgaatgtgacagcattgtcttaagcactggttttctgtttggtctgaagatctcatttttaatataaagttggccggagctacttacaagttttaaatgcttcacagagttgtgctgtagaaattaaaatgtatgaaactttcattactatttaaattacttttaggccttttgtaattaaggaaacaa

SEQ ID NO: 28126 - DNA, 201 bp, Bos taurus
gctttgtgcacttaattgggtgttatctaaataatgtctcatagaggcctttgaggtagaaatcattattttcccctttgcagagaagagtttcctataattttgagaggctcagaaattttcacaaacatacagatgccagtggtggaaatttaattagaatctacatctatgagctaacagcaggttgggttcctaacc

SEQ ID NO: 28127 - DNA, 201 bp, Bos taurus
tttattccccttccagcaagaatttcaacctttactaacactaatatattgacaaatatgataccttctctttcttctcaaggagcagagactgtatatatcagggtgatagaggtctgtgtgtcacagagcttaggatcaacatctatccctttctttgggaatttacaaatttcagggatggctatatggcaataataa

SEQ ID NO: 28128 - DNA, 201 bp, Bos taurus
taagactgttaaaaataaatggaaatgtagagtgttcttaaataacccaaaagcaattatctaagctaacataactactgtgaacattatatttatctcttaacatctaggcatcacaatgacataagaagcataatatctgataaatgaaaatatcaaaattaatcaagtgattagaggtaatcaacttatcccagggtc

SEQ ID NO: 28129 - DNA, 201 bp, Bos taurus
ctttcttcctccttcttagcttctttctctttgttaaagggagcagatctgttgtcatttaattttgcctcactgggaaaacactgaataaatgtcatttctgatgagtgttgccaacattcttggaggcactgctcttgaatttttagtaaggattcctcattcttgaggatagtgtatgtgtgtgtgtgagtgtaatga

SEQ ID NO: 28130 - DNA, 201 bp, Bos taurus
aatactttctgtctgtcctttctacgactgtcttgtcaattcttaaaatgagaattacttggattcagtatttcttaatgatggccttatgcttgtgatcgccacaccaggcaaaaggcactgactctgatcagtcagttcagttcagtcgctcagttgtgtccgactcttagtgaccccatggactgcagcatgccaggc

SEQ ID NO: 28131 - DNA, 201 bp, Bos taurus
gtgcatttcaaatgtctaccttctgcatttgaggatgtacagatgccagcaccttgtagactgacatggctatgtctctctatttctggctctttcattagtcggcagggagtcaaattgaccagtatttggctcttgaaagcacttgggatagtaatcatgtcagtgggcagaaggaggacaatatagcattgtgttggc

SEQ ID NO: 28132 - DNA, 201 bp, Bos taurus
tgttgaacttatgtgtaatgagagtgttccacaggccacagagaaagattattaaaggttagagggctcagaaggtctttcactaagctgcttatggcaataacaagagattacagtgggccaggcattgtgctaagggctttctttctacataggattgcaatataattgtattaaccagaccacgacatccagagaatg

SEQ ID NO: 28133 - DNA, 201 bp, Bos taurus
atatgaaaccagaagtattaatgggagtaattataaatgattcaaagaaaaatatgtaattttatataaacactttggattgacttaaatatttagtttaatttctaccatgtattctcccagtaattacttccttatttcatatgcatgaagtatgctagacagctgagactagaaaagaaaattggttcagttccctgt

SEQ ID NO: 28134 - DNA, 201 bp, Bos taurus
cacatgggagcaactcagcctatgccccacaactacggagcccaggagcctcgtgcggcaaccaatgaaaccctcgcccctagaccctgcgctctgcagttagaagcccgagcaccacaacaaagaccagcccccactcaccgaatctagagaaagtccatgcagcgacaaagacccagcatagtcaaataaataaataaa

SEQ ID NO: 28135 - DNA, 201 bp, Bos taurus
ttactccagccctactgttatacttctgtggaagagaggactatagtaatctaggtgactgccaaaggccatatcctctgtctgtctttgtgaacagagacggggagtcagcacataatttaggcttggtacaaaggagtgctttcttgcaagaggtgacatttgatccaattgttaaagattgaaagaaatagttggtta

SEQ ID NO: 28136 - DNA, 201 bp, Bos taurus
cgtaaaacagaaaggagggcataactggccaagaaggataggatgcaggataaagatctgagaactttcaaaaggagttatgatcaaggagaagaactcatatggcctaactgaaggtgctcggtccttcctctttcaactcttctatctgacaccagtctggctacttcagtcttcccagtgaggggggtgttggtggta

SEQ ID NO: 28137 - DNA, 201 bp, Bos taurus
gtaaatccatttaaaaagtgtcctaaaagttcttctttactcatgttgatcatcataaatttagtcatgggtactgtgcagggaaaggcatgtcctgaggaactgtctatgttgtagctggacctttagctgttacaaaagaagagtagagtggagtcaaatactgctgtatcactgtgattctgaaaaagatcagaaatt

SEQ ID NO: 28138 - DNA, 201 bp, Bos taurus
caataaaaacaggaggtcccctacatttgaatcttcaagcagcaaactctcacagatgggaactgtgttccatcggcgttaggcatgagtgaaattgcagcttgcccttcatctcctattactgacggtcctttagctccactatcccctccttcctctctctcctcccatcaataactcttctttgcctgtgccctcaat

SEQ ID NO: 28139 - DNA, 201 bp, Bos taurus
ccctacagctgcaacagcagaagggaatttttgtcctcatgacttttgtactttaggatagtgtgggacaacccacacttcaaaaacctgagatgttaccatgagaacacacaaaaactcccagaagataactatgtagctttgtttctatgaggctttgtttgctcagtgcaacatctctagcactagtcttcaatagtc

SEQ ID NO: 28140 - DNA, 201 bp, Bos taurus
tttgttaaaatattgctttcgttttatgctttttttttggccatgaggcatacgagatcttaagtttcctggccaggaatcaaacacacacgccctgcactggaaggtagattcttaaccactggaccaccagggaagtccccaaagactactttttaaaaaaatcattttattttattttggttgtgctgggtcttcact

SEQ ID NO: 28141 - DNA, 201 bp, Bos taurus
gaatcaatcttccttgggggaaaaaaaagtgaggcatgtgctgtaaaattttctcaacgtgtatttctaacttgaaacttataacggcatgtttttcttttgggggaagaaaaaagcctaaaatcatgactgaatcaagtgagaagaaagtgagttcagagatgtctgtaatagaagacagacaatccatttgaaggcagt

SEQ ID NO: 28142 - DNA, 201 bp, Bos taurus
tctgcaatgagggagataaaatccagcactttgctggacagagtatatataataatacaggtcgactatttgacacagtggcatgtagactaggcagtcaaacaatgttgtctgtccctctgagttgggactcaaaatctccaaacttgtggacaaactggtccgtaatttttctgtttaaattctggttaagttaaaata

SEQ ID NO: 28143 - DNA, 201 bp, Bos taurus
gtccttgcaccaagtcattctccatcaaagattctttgcctttttcactcataggctatttagtattatctaaaacgatctccttcattcatgtgctttcccttttgtttattgtctgacttaagtctgttcgagcagacccttgtctgtttcatctgttttgagaaaaattcctgacttgtgtcgagtgttcagtaaata

SEQ ID NO: 28144 - DNA, 201 bp, Bos taurus
acagcagtctctgtgagcacactcttcagttaaacatattttacatataacatactgaatttactaatgtgcttgaatttttattttacaaatttcatcacaatctctctttatcagtgttgtatgtgatactacataggaaccacattctctaaaaacattagtttgagtgtatcttttgtagtctacagcaaattacat

SEQ ID NO: 28145 - DNA, 201 bp, Bos taurus
tacttcaaaagtaatgtatctatgtgtgaaatttatttctaccttaaaaaatataattttccattgaacttttaaaccttgattatatgtatatagttttcttctaggagatttcttctttttctccttctctggggcttgatttcaatgatttgggaaaaggaaagaacaagcaatgctctgaatgtgtaacaggtacaa

SEQ ID NO: 28146 - DNA, 201 bp, Bos taurus
tttcaccacagatatttcagtccaacccggtcctacattatcaggcaaacagcaccagacttcttgttaaattatttcagcattcccacaaagttaagagatattttgagatggtaggatcttcacattctcaatttgcacaactctgcttcagctttcaatgttttgatctacctatagtgtagtgcagttcaattcaat

SEQ ID NO: 28147 - DNA, 201 bp, Bos taurus
gccttgctaggacattatatagctttcagtgatcctctctcctgaatgttaaacacttgattgattgtctgccaggcatttatttagctatgataattcatagctgtctttagatagctttgatgaaatatctagttcctgtccttttgctttattttgtgttttatttgttgcatatttctggattcttttcttgaaata

SEQ ID NO: 28148 - DNA, 201 bp, Bos taurus
agtgaggagaggggtggtgaatcccagtgactatgcctggatttggctggtctacatgtctgcgtccagccctaggcccactaccactgggtaaagttaaactgaaagaagaaatagtgttgtgtcacgtcctgacgctagaacaaaattggattctggccattctgtgttacagactctagcctcagggccctcagcaac

SEQ ID NO: 28149 - DNA, 201 bp, Bos taurus
ctgttctatttctagcatattctggaactgctggtgggccagggggtaagggagtaactagctggatgactgtaataaaacagcaacaggcagcctcagatcagaaatttgcaatggccactccagccagcattattattcaaatccacatgtaacgcagtggggcctgatctgaaatttctgcctagtgggtgcctaacc

SEQ ID NO: 28150 - DNA, 201 bp, Bos taurus
ttggatggactgaggcttggagagctgcagtggggagggtagctggaccaacttctgcacttggctttgttctcattcttctccctacgaggtaggctctagtttttccagggctccaggggaaagggatgaggatgaaaagatttacttactggtgtggttgcccctgggtttccctggtagctcagctgataaagaatc

SEQ ID NO: 28151 - DNA, 201 bp, Bos taurus
gagttacttctccactgatctccagcaacatattgggcacctaccaaccaggggagttcatctttcagtgtcctaaggtttggccttatcacattgctcatggggttctcaaggcaagaatactgaagtggtttgccattcccctctccagtggaccacattttgtcagaactttccacaatgacccacctgtcttgggtg

SEQ ID NO: 28152 - DNA, 201 bp, Bos taurus
aatacaactctttcagaacctagtggtcaaaagtaagctaaggttatagaagaatttaataatacagtaaataagcttgatttaatagctacttaaatcagtagatgaattagtgtatactagtttttggaagccaattgtgagtatctcatcccatctccatattcagtgttgtcacattagtaactagaaatagatcat

SEQ ID NO: 28153 - DNA, 201 bp, Bos taurus
cctcccctgttagccttctctgctggtttctcctatagagctcccgttcccaagctttactggttgtgttctctttgggctgtcatcctggagacaacccactctccctggggaccattcgctgtcagcttgtcattatcagctttctaatcatttcttctcatgttctctcactttcttctttcattttgcttttatgct

SEQ ID NO: 28154 - DNA, 201 bp, Bos taurus
aggacagaatccatactccctgtcctgaaggcttcatagtattgtccctgcctatctttccaatctcacctcactggaccattctccctttctgattctgcactgcaactacactgctctttaaatcctctaagttgctcaatcttagataacatcagtgacagttatcagtgaaaaaacctttggtatattaattcattg

SEQ ID NO: 28155 - DNA, 201 bp, Bos taurus
aaaggatggctttcttcagcctccattcactgcacctcatctgatggcagaccccagccgtatggccggcacacttctctctctgctttcccaccaccgcatggttattgccacttcctgccttttttcttggtgcccttctggaacaccgtctctattcctctctgtccaaattccagtcaaacttcatatccctctacc

SEQ ID NO: 28156 - DNA, 201 bp, Bos taurus
ttttttccccactgttctagacataagccctgcagtacagcagaggtccttcctaacctgaaacttcttgggtgctcctgatcaatttccatctctctaaatactcacatgttcaatgaacacaactgaccttataaatgaaggcccttaaggagggataggtttctgtttggagaaactgcagtatctctcccacaatga

SEQ ID NO: 28157 - DNA, 201 bp, Bos taurus
ggtaattcagaggcagacagacagttgctggaagctgcaaaggctggagatgtagaaaccgtaaaagtaagacatgatcttatggtttttttaacattgggtttttattttgacagtgtttaatgaatctgtactgttaaaaaaatctagttatttatatgtgcattgttttaaaaggtaaataatgctaattagttctgc

SEQ ID NO: 28158 - DNA, 201 bp, Bos taurus
tgctgactgactgatacccctgtcttatggggtcaaacaacttgaatgtcttagtgaggtaaatactttaaaaaatggtggctgtcttttttccattaataatctcatgaataacctctatactcaaatatgggaaggaaagaagaacatttaatcactctaaacagttatattaaaaatgatcacaattccatggtagaa

SEQ ID NO: 28159 - DNA, 201 bp, Bos taurus
agaaaaaagctttcctaagatttgaataggaattatgatactgcctgaaaattacctagtttggtcacagcacctaagtcctaacaactccttgagccatgactgaagaaggcaaagtatgttccattcaggagccactgaaggatccaggtaattaaatcgaaatcacacagtagtgaaattcaaaaggcaaccctactg

SEQ ID NO: 28160 - DNA, 201 bp, Bos taurus
ctctctgttactgcctttcttctgtttcttctcggggcctccccttaagagcctagcttgaaaattacacatactgaataatgttttttctctttgcattccctaattctctgggacaccttctatctccaggaaaaaagtcctgaggtacagctgataaacccggagaaggcaatggcaccccactccggtactcttgcc

SEQ ID NO: 28161 - DNA, 201 bp, Bos taurus
actagagtttctgtcttttctggatttatgcccaggagtgggattgctggatcatatggtaacaccatatttaggtttttaaggaacctccatactgttatccataggggcttatcaatttacaccctagagagatgtttttatccccttcggctgttagaaataaattgcattttttctttggacctagtatgtttttat

SEQ ID NO: 28162 - DNA, 201 bp, Bos taurus
aagctagaaaatcacatacttgcttcaaagctgagatgtacagcataacattcaaaagctaaaatgtttttttgatctaagagagtagggccaaaacctgccaaaatgtatttatgtaccttaagggggaaaaaaaaagcatcggtcacaagaggcattggttagcaatgctacatgggagaaaggaaggatcttgtgaaa

SEQ ID NO: 28163 - DNA, 201 bp, Bos taurus
tgacagggttgttggttaaagtgttatctacatagtggtggtggtgctgctggctctgtggagtgatctgctgtggggcaaccccacagaaatatgctccatggaacgtctccttcaggaggcctggttacatttgcacatgagttcagagctataacaaaatgcagttagcatttatgaattttattgctttgtaggaac

SEQ ID NO: 28164 - DNA, 201 bp, Bos taurus
gcctacattaaaatttttttcttatatgccttcatcaaaatgacccaattaatttatgtttgcacagctgtggagagaagaatgggtttgaatgggagacattagtgaggattaatccttgctgactgactaaccatgatggtatcctcctcctccttctgcctgttaaaaaattaaaacctaccccttatccagttacac

SEQ ID NO: 28165 - DNA, 201 bp, Bos taurus
ctctccagctaaagctttaagtaattgaaaagttctgaatttctgtttggaaagcatgatgatactcagtaagaccagaacaatccaaataatcctaaacgtacagagactagattcataaaaccccagagtaattttttttatccccatctagaaaaatcgtatttcatagcagttcttacaatgccctgactctggatg

SEQ ID NO: 28166 - DNA, 201 bp, Bos taurus
tattccttattatagcgtaatatcttaaatgacacagatttaattggaaaagtcactgcataagtgtatttttatctactctaggaatatgaagcacggacagggagagcctgtaaaccaccacctcagtcttcaagacgaaagaattttgaatttgagccactttctaccactgccctgattcttgaggatcgaccatcg

SEQ ID NO: 28167 - DNA, 201 bp, Bos taurus
agttgctgcttggtcgtgctgtcccaagaagtggctgattgtggaaccctggggcattccagaggtagtgctggttcactagtgggtgagtcagggttcacgagatccaaggattggtgcctgaccactggaaggtaaagccaggtgctggatcacatgctggcccaggggagcagagccagatcctggaatctgcctaag

SEQ ID NO: 28168 - DNA, 201 bp, Bos taurus
tagatcatcatgaccactaactgtcttctgtttgaatctgcatgatctggtggttctgggctgagggtctgtttaatgaagtccatgcctctgatcctccactgaatctacacctgttgttctgtgtaaaatctctcgtccttgctcttgatgacaaattgaaattataatggagtaatcacagttcaggcatacaaaaat

SEQ ID NO: 28169 - DNA, 201 bp, Bos taurus
caagctgtgaggtgaaagtgtaaagagcacagtcctgcccagagcttagtatcatggaatgttcatctggggctgatggttgagccctttaatgatagaccagaaaatgcatgcccagaatatagaactacagttcagtcctattgacactgttcagtggttttccccaccaatttccagaaactacttttgtgacttctc

SEQ ID NO: 28170 - DNA, 201 bp, Bos taurus
aaaaaggagcagggtgggtgggaatgtaatatgatctgtctctaacaaggtttcatgtggccgagggactcagagcatcacagaatttcagggctggaaaggaccacaatttccaaatgttatgagtcttgaagtccagaccaatccatcaagatgagagaatactacaaccagtcacacacgctccctgaaacaaagaat

SEQ ID NO: 28171 - DNA, 201 bp, Bos taurus
tactgacacagaccagatcctttgctgatttctggagatctaaaaacgtgtagtgttctcaaagtgagttagtctcatagaggagacggacacagacagatgccgaggagggtatttaatctgtcattagagaagggttaagagactttcaggaagacttcctggaagtggtgacatgtacactaattatcctcaactcca

SEQ ID NO: 28172 - DNA, 201 bp, Bos taurus
tattgaacttctaatttatgactgaggtgggacataaaccagtttggtgtgatgattggtttttgttttgctatggtaataatttttgttcaggtataaataggtggactataaagccactgtgaaaaataggattatatggtcatccttgcttgttgaaggatctcctggctttcatagaaaatgttctgattagaaagg

SEQ ID NO: 28173 - DNA, 201 bp, Bos taurus
ctaattatttccccttcacataattattttttcctacattaaacaaaaatatttttttctttcaattactgactgaaaaagcatattagcaacataacccaatgagtacgtgtaatttttgtattatgatgacattttaatcattttcagtgtgaactcgttcccctccccgacaaaaacagattagcactaaaggcatat

SEQ ID NO: 28174 - DNA, 201 bp, Bos taurus
cccttccttcccattacccggtcccgctacataccctctcctcacccttggtccactgtttcctggtctagagagcaccgggccttatttacctttctattcccctcccctaaaacctctaaggctttctgccttcctccttcggaattccattctagtctgcacttatggccaagattgggaggtatggaataaaatgag

SEQ ID NO: 28175 - DNA, 201 bp, Bos taurus
aagctttctttttagataactgaccttaaaaaatacaggcatgtaaaatggtggagtccttttccctaagacttgatggcatttaaaataataagcatagaagagtggcatttgaatcaatgagttgcatcttgtcagctcttattagcttattgcttgaaatgtcagtaagccattggtagcagacatggctgtagctgt

SEQ ID NO: 28176 - DNA, 201 bp, Bos taurus
tctgcagagctgaccccagcaaagaagccaagtcctgagatgaggggaacatgcctccttcccaccccagactctctcagggtggggaacaagggagggtgggaacatacggacaaaaagtgatgttgaaaccagagtgatgccagagactcggagacgaagattttcaggtgacaaaaaccacccggggcagattgttcc

SEQ ID NO: 28177 - DNA, 201 bp, Bos taurus
aatataatatatataatatatatatataataatataataaataataatataaacttaaggtctattgtgtcttccatcaatcagaagctacagtaataatccttgctgagaaaaccctcaataaagtagtagtacaaaattgaaagagtctgtaattttctacatttgagctatataatcacaatcacatgtcaaaattac

SEQ ID NO: 28178 - DNA, 201 bp, Bos taurus
attttggcacatgtcagccctatggagcgagggagcatcaacctagaattcaaacaagttttaccagtcatttcacccgatctgtaaaatgggtacaattacatctacttcacaaggctgtgtgcatgtatgtgtgtgtgtgtgagataataaatatggaatccctttgtaactccaaagcttgctaaaggtgtcagctgg

SEQ ID NO: 28179 - DNA, 201 bp, Bos taurus
ttgaatgttcccaagaaattgttcttgaaaatggaaagagagactgactcagaatattcaggaggcctttgaccaaaggcctggagcattgttccagccttccgcctgtgagcctaaagaaagccctgcctgagaaccaccccacagggggctccactttggccctccccagctccacctcctctctgcggggtgagtagt

SEQ ID NO: 28180 - DNA, 201 bp, Bos taurus
tggcagcgcactccagtattgttgcctggagaattccatggacagagaagcctggagagctacagtccatggggtctcaaaagagtggaacacaatgtagtgactaaaagtaacagacttaatagataatggcatattccctgggatataacatcctagttttttcggtttttatgatactaaggttgatcagtggattca

SEQ ID NO: 28181 - DNA, 201 bp, Bos taurus
atgttgggtatgttagttgtattaaatgcattttggacttaggatattttcaaattaccatgggtttgtctggacatcccactgtaagtggagaagatctatatttcaaaattctcatcagatattgtttctcctttctattacttgtgtgtgcttgttaaaatctatgtaacattagtcaattcagttcagttgttcagt

SEQ ID NO: 28182 - DNA, 201 bp, Bos taurus
ggagagaaagagaatcagagtagtttcaactttttacaaaactacaaacttgggccagtttgaaaatatgaacattccataaagtgaacatgaattctttaatttggtaacaagaacaaggtaaatcatatggaaagtcacacgcaaccagtgcagttaggttcaatccgaatggagttaagacagccacacgttcatcct

SEQ ID NO: 28183 - DNA, 201 bp, Bos taurus
acttggctccagtcttcaccacaatcatttctctttcctttcacatccacactccttcagtgaatctatgctggttgatttcatttcacaactgtttactcgctgtaatctggcctctgaaatagatctatttctccactgaaatagatctctccattgatatcacctctgttccctcctgacaaatttttaagttggagg

SEQ ID NO: 28184 - DNA, 201 bp, Bos taurus
ccatttctctctcttgtccccccgggcctgtgcagcccgtggctcaatgccctcctctcagccagtcccctgctcactttcctggcctgactgatggtgcgagatcttcttgtgtatgctttgggggaccctcttcaagtggagggattggggcttccagacaggtctacactggagcaggggagacgtttctctgcagtg

SEQ ID NO: 28185 - DNA, 201 bp, Bos taurus
accccagtcgcgcgctctcccggggcccctcccacgcgctcgggaccccaggcgacgcgtcccaggggtgggggcacactccccagggtactggggcccttggcgctgaaggacggcgtaagactccccattctcggtcgggaattcgttgggaccgaatctcggtaaatcccgcgtcggccgagggccgcggcgaggaca

SEQ ID NO: 28186 - DNA, 201 bp, Bos taurus
ctttcccaatcctgccctgtcttcctccaacaggcttaggttggcttatcaagaagtctgggaagagggagttcccttgtggcctcctggttgggattccaggcgccccaggttcaagccctggttggggaactgagatcctgcaagccacctggtggggccaaaaaaaaagccttgaaacagtatgatcaaaacaaagtc

SEQ ID NO: 28187 - DNA, 201 bp, Bos taurus
ggaagctttacttgttgaggtaggccaagtgcttggatatagctaggagctgaggaaaggaaatttagccaggcacatggaacatggtatctgtgggcaattgaagcagatctggggacccagggaagtttataagggcaggatataatttcagagggagagaatagtgacaaggaatctgggtacagatagtctggggag

SEQ ID NO: 28188 - DNA, 201 bp, Bos taurus
tcctgattaataggtctagtttcaaggtggaaaggccttcatgacctttgagtatagtgttcagcttgagacagtccagctggtcttgcttggaccatcaaatcctagttccctttggcctttcttagaggccactagggcagttccaggatgtgagagaaaactatagaaggaaagaggaaaacttgtagagaaatatgt

SEQ ID NO: 28189 - DNA, 201 bp, Bos taurus
ttttaagcctgaagtcagaggcgttgattctgcacatcggccaccagcatcttcagcagagcagagctgcagagaaaagcaggataggggtttcaagaaccgatttcttgatggctccttgaatagacagaacttataacagagcttttccaaggcagttttgtttgccagaacttaagctttctgtagttcttttgaagt

SEQ ID NO: 28190 - DNA, 201 bp, Bos taurus
tttaactaaattttgttctcctcagaatggcccaagtagagactggtgggagcaggacagagaggaacactccactcaaaccactgggccctttgaacagttgacccttttcttattcatctccaaccaccccaccccatgcctgccagcttgcaaaatactgtttgtttttaatttttaagtataaataatcccagggcc

SEQ ID NO: 28191 - DNA, 201 bp, Bos taurus
ctatcttcagagactgggcctctgggatttctttttacaaactgatgagagtaaaaattctgttggaaaccacaaggctcactctgccaggacagagtctgggccactctcagacccttccattttcaacaactatggggccaggcgtctgagaaataagcaatctaacaatactttcccagcacttatctgacttgaata

SEQ ID NO: 28192 - DNA, 201 bp, Bos taurus
cacgtgcatttacattgatgtgataccatcaccaccatccatctacagaattcttttcattttacaaaataaaagctctgcacctatttttttgagaggggccaacatagctccccactctccacagcacgcactttgacggactccaccacagtcaagggcagctgctggcccagccgagggcccttcttcaggcactta

SEQ ID NO: 28193 - DNA, 201 bp, Bos taurus
cctctatatcagctttcatctctcctctttatttttatttttaattgtttaaaaaaaaaaaacacatttatttgcctatgccagttcttagttgcagcattcgggatttcttagttgtggcctgcaaactcttagttccggtatgtgggatctagctccctgacgagggatggaacctgggccccctgcgttgggagctca

SEQ ID NO: 28194 - DNA, 201 bp, Bos taurus
atctgtattaatgctggttgattgggacacaattgcaggctgggctggggaggaatgggagtaaaagaaggctgagctctctaatcaacagcacttgcccatccctagcctttaatttaagtgacagaaattctgcaaactctagatgcaggcccaaactaaggaggaaaaagtcccttaaacatatcaattattttattg

SEQ ID NO: 28195 - DNA, 201 bp, Bos taurus
gtgtctggggttgcaaggagcccaagagagatcacatacctggttcaggagtccagtgtcagcaggtcctcggaataatgtggccaggtgctcagagggttcccccagcccattggggagagaggagtaaagaccatctgctccaacctgcggttgagttggtggcccctgtaaaaggccctgggtcccaggccgagctga

SEQ ID NO: 28196 - DNA, 201 bp, Bos taurus
ttgtaccacatggcttgcaggatctccgttctccagtcagggattgaaaccaggccacgacagtgaaagcctggagtcctaacccctaggccaccagagacttctccattgtgcagattactgtatgtcagttatacctcaataagtctgtgggaaaaaacaatatttcccaccaaatacttcttcaggggcttaaaggcc

SEQ ID NO: 28197 - DNA, 201 bp, Bos taurus
atattcagtcaaatatacagtggggatcccatggaaatttctggagctcctccgtacagctccttcctgtctggtgaactgctccgtgaattccggccacgacagccttgctaaactctgatctgttcctcggctgagtgaggtcttcatgcaccacgtgggtttccactctctgtgtcgtaatctggaaatgactccagg

SEQ ID NO: 28198 - DNA, 201 bp, Bos taurus
tgggcagcccgaccccgctctggctgccacgcctcctctctggtctgcgttgctgcctccacttcccacgttttagggccgttttgattacatctggatcgtccggcatcattcgtattgtaaggtctgctcactgctgctgctgctgctgctgctaagtcgcttcagtcgtgtccgactctgtgcgaccccacagacggc

SEQ ID NO: 28199 - DNA, 201 bp, Bos taurus
cagctcagcctctccatgcgggggggacgtcaactagccacagaagcagaaatgtcattttcagagaacgctctggttaacgaggcctgagctctctggggtttgaacgtccttgcaaggctctgggcaggaatctgcacttgcagtttgcttgaccacaagcccggtttttgtgtgacgctcaccagacccctggccctt

SEQ ID NO: 28200 - DNA, 201 bp, Bos taurus
ataaagcgcagaataatacctatatgggcaataaaagcatgctggagactcaggttcaaataatgtattgaaaccattgttaagtactacttcaaaatgaagttcaaggatggtatcagatatgaaagaaagcaaaagtcgtaattcaaaaaatttcagaaatgagtgacagaactgagggaaaaatcggaaatttaaaag

SEQ ID NO: 28201 - DNA, 201 bp, Bos taurus
cgctgacctctggccctggggccacagccgggcccacctgtctccttctgcttttcctgaaatatccgagtgcattttcgcgtcggacaccctggctcccactctcactcacggcctcctctgacacggtcctctgtcccctcggcccctgggggttcccttaggggcctcctgtggttgctctcctctctccacccccta

SEQ ID NO: 28202 - DNA, 201 bp, Bos taurus
tttcaacaaacaacagaatgattgttacatcaaattactttcatagcaacatagtactcttctgagtccttgagaatggtccccttccttaggttacttggcctgaggaggcttgttaatacatgttgaacggcatgcgtttggggttaggaaacgtgcaggctcttatgtggttcttaaacagtttagatttagcccggg

SEQ ID NO: 28203 - DNA, 201 bp, Bos taurus
ggaagccccggccttgattctcttctgggtttaggctgttccaggcctgtgaatgtcagttcgtcagccactaactatatctactctcggccttgggttcgtttgacaaatatttgctgaaggcctcctaggcccagcctccctgctgcatgggccccggcatctctttgagtttctgccaacatgctattagcaaggaca

SEQ ID NO: 28204 - DNA, 201 bp, Bos taurus
ggtggagaccataccagtcccttgaaagcacaaaactgatttgatgaacaagaatttcaagaaacaccctctattgtccagtttcctatattttcagccgagggcaaaaatcaaggtttagctcaggagaaggagcaggaagtgggtttggctgactgttgaaacctgctggaaacctggttttcattggaaagggctgtg

SEQ ID NO: 28205 - DNA, 201 bp, Bos taurus
tcttcacataactaacttcctaccctcatactccttgccaggattctaacacacattgggttatatattagttctttaggttgttttggaagcatttgtcttagaattgccaacagtaactatagaactgtagcagcctgttgctctgaatcttcccttcacaaattaacctaaaaattatcttttttcctatgtttaaat

SEQ ID NO: 28206 - DNA, 201 bp, Bos taurus
gctgggaagggaatcttgaaacatgagcagcgatgacactgggaaaaggagagtggttctaacgtgagtcaccagtgttctctgtaggtcccacccacactgctgaccttggattttcgttgctgccctttggttctttgggtgacctcagcagagtcatggtgtgtggaatctgcagaggccccaaacccaaggattctt

SEQ ID NO: 28207 - DNA, 201 bp, Bos taurus
cctttcgtgtggtctagaaggaaaggccctccatcatgcttctttgtgcatacccaacagagctcagaagccccagatacgatggtctttctgatccatcactgcccaggcctcatctttcaaaaccattgcctttgtgaagctcctgtgactctctgtgagctggccttctgctctcctgccctcatgctctccctgcac

SEQ ID NO: 28208 - DNA, 201 bp, Bos taurus
gagggccataggaagtacacgtgtgcagccagaggggatggcatgtgagataaacgtgcggtgggaggagacccgctctccagacctatgaaatgacaggcggccctgggcagggttctgggccttctacccgagccggttagctgtcaggagctggaggccacccaggctcagtgacaccagcagcccaacggtatccca

SEQ ID NO: 28209 - DNA, 201 bp, Bos taurus
tttggtgggtttgaagtttagcttccacacttcactgctgtgtgggcctgagcatgtgtcttagcctctctgagtaagagggtctcgttagctgcaaagtatggtttataatgggagcttcccattaaatgtgatgacacaaggtgggggctggcacatggtgagtgcccaagtggaccttagctatttggacactcagga

SEQ ID NO: 28210 - DNA, 201 bp, Bos taurus
gaggagaaacctgagagggagaaccctacctaccaacaaccagaggccttttctggactcagtgacagagacggaacagagagggggactcctggcactgttgagtcccccgttcccacctgaggccccagtgctgccccacctcctgggaaacccccaacatccttacctgaactgcctatttgagattaagctacctgc

SEQ ID NO: 28211 - DNA, 201 bp, Bos taurus
aacgtacgttgaaactttatttaggttaccatccgaggagtagctaagacgtagggtttaaggttgaacaaaatagggcctggatgtagtttaaagaatggttgccaaagagaggcaagggatacagtctactctgttaaaggttaaaggaaatgagggtgttcttacattaaaaggaggggtctgtctggtttggccctc

SEQ ID NO: 28212 - DNA, 201 bp, Bos taurus
tattgccttttaaattttcaagtacctccccgtcccccactcccccgccaccaatgtctttggctagctctctgtcaagagtttgttttcttgatggttcgtctatctgtgttgatttgtcccatttgggaatgagaacttttgttttaatgcaaaaatttgataatgttgagtggccaacacatatgaagttcaaaaagc

SEQ ID NO: 28213 - DNA, 201 bp, Bos taurus
gccgcccgggggctccagggccacctgaactttgaacacattaaagcccagtgaagctcatcggtgacaaaaaaaggaagcaattccccaaatagctcagcgttggggtggcctggcgaggggacctgatgatcacccctgggacgttctgcccacacagtgctggatgccaagcgctgatgtgaaattaccagtgcatct

SEQ ID NO: 28214 - DNA, 201 bp, Bos taurus
cttttgctgatggactgagattgaaacatgaggctgctggaaagagtttctccttcccacatagtagacagaaagatgtagacgttggaggagagttgaccgatgagggctgcggaatcaggggtgaaacttgggtggggtagacttaaggtttgggaaggaaactctagaccagtggcccccaacctttatggcaccagg

SEQ ID NO: 28215 - DNA, 201 bp, Bos taurus
cacaaaagatctctcttttcccctcttgtgcgtaagacggtgtcagaaagataatcaaccagctgagctctctgcacagagaggtttttagagtagccaagcctggcagttcaagccagcagaggccagtttacctccctcagcgctcagtggttcccagttccaggaactcctgcagtgtggagagtgccttcctcttgg

SEQ ID NO: 28216 - DNA, 201 bp, Bos taurus
aaaagggaaaagcatgtgtaaaggcctggaaggaatagaataattagacacgggtgaagatggtttgctgttgccttcatgtaagtaagatggtgggaactgtcagtagataagacgactgaggccctttataaatgggcactgtatgatatattattaaggaaaataaacatttactgaacacttacattatcctaggtt

SEQ ID NO: 28217 - DNA, 201 bp, Bos taurus
ttctttggtcacactcacttctttctgatctgagtcctctcccaggtatcctggggcttgttagtgggttttctgcatctgctttcagttttcttccctgataattcccttctcagagcctttggaaggctttgattggtgagagaagcaagggtttggcgggctttctttcagtcttggttttctttgctaggcacagga

SEQ ID NO: 28218 - DNA, 201 bp, Bos taurus
ctggctgttatcctcattaaaattcgttttcaaaggctccggtgagcggcctgctaaagataaactatcaggagagaggccttcaaagaaagtgctttaatgatgcaattatcttcaatcaactcagaacatctttattgcattagaaaagggcaatttatctcggaatgcagaaagaggtggtctagcctcagacacagg

SEQ ID NO: 28219 - DNA, 201 bp, Bos taurus
gaggatgcagacaactgggagctccagttgaggttcttgtgtgtccagtaaacttagagcctgcagggcactgggatcagaaggggccaagtcagtctttaagaccagggtgactcaggtggggagtctcccaagggcatctggctatgagtaaggtcctcaaggtcatcttggacctagagcaggccaaggcagaaaaat

SEQ ID NO: 28220 - DNA, 201 bp, Bos taurus
tggtacccagcgtatgcgttagcacaactgtaggccattcccaccgtcacagaatgtgctattggacagtatcagtgagaaggaatgttggctctggaaatggaaggcctgggttggaacctggccttgttgtttagcagctgggaatctgtgtgtgtccttgagcacatttaaaaaatatctctctgcctttcttccttt

SEQ ID NO: 28221 - DNA, 201 bp, Bos taurus
agaagcgatggccaaatatatctaggaaggtatgtaggaagcatataccaaagtgtataatatgcttaattatgtgcttaattagaaacagaaacaaaattaacagtacttaaaagtagtacatattccatgtctcatattaataccttagttcagctcccttaaagagtcacgagatgacccttcatgccttccacaagt

SEQ ID NO: 28222 - DNA, 201 bp, Bos taurus
agccactgcagtaagaagccctcacacctcaactagagaaagcctgcatgtagaaatgaagaccagtccagcctaaaagaaaataaatgaataattttttaaaaaaagtgtcatagtcattagaagcctatttgggaatctcaagttatatgataaatatctgctttcagtttcatcacagaatctttattcagcctcatt

SEQ ID NO: 28223 - DNA, 201 bp, Bos taurus
tgtgcatcttaacaacttgactgtcccctttcattttttaagaaggaggaaataatgcaaaggcttcaagagaaataagtaatgtatgcccataaaggtagtcatttctcttgtcttagattcttcacatcatcctggacctagcaaagtcctctagctggaaaaacttctaaatgtcaactcttatgaaggtgacagctc

SEQ ID NO: 28224 - DNA, 201 bp, Bos taurus
accctctaacggtttgatcatcttaccttctaatggaaacagtgggagcatttctcaggccatcctgaagtcagggcccaggagccctgggaacaggacaccaaagaaagcggagggtgagggactctcgcaaggcaaatatttagtgctagtcaacacaggcagaattcttttgtcttcagaaccattgagtccttataa

SEQ ID NO: 28225 - DNA, 201 bp, Bos taurus
gaaccatgtcatgtgactgagtcctcatcatggacacagacattttatctgtcacttctaagtcacagttagtcacatgatatgtgtcgcactggtccagtgtactctttttatctcagtaatgattgtaaggtatagtctctggattatgccgccctgaagacttcactcttcttcaaggaactggttatgaatcagtgg

SEQ ID NO: 28226 - DNA, 201 bp, Bos taurus
ggagagaacagtcatatattctaataaaacattccagtttgctggatatagatgtaacatgttagaccatccaagctgagattagattattttaaaaaattggtaaacagtattgacccaaagccagcaagtgatgagaaaatttaaagatgtaagtgggagaatgatcagtttcacattaagatgatgaagaaagctaaa

SEQ ID NO: 28227 - DNA, 201 bp, Bos taurus
gttaggagtgttagtatagagacactaaatgttttaagaaataatatgaataagaaaaatttcagcttatacctaaaggaatattaaataacagaataagataacaccaggcctgatgagaatatataacaaggaagtatatactagtgattaaattgataggggtcctttaagattctgggttacaaataagggaagtca

SEQ ID NO: 28228 - DNA, 201 bp, Bos taurus
atttcgatatatggcaaaaccaatacaatattgtaaagttaaaaaataaaataaagaaaaaaaaaaagatgattatcctagcttatccaggtaggccctagattaagtgacaaatatccttataagagacacagaaaggaaagatgctgggagaaaaggaggacatgtgaaaatggaagcagacactggcatgtagtcaca

SEQ ID NO: 28229 - DNA, 201 bp, Bos taurus
agaaggatgttttgcttccttattaacatatctgcctccttttgaagctcttctagaattatctggcaggcaggagtgctctcagctctggtctttcctggcgcaactaaactcctatatgtttccccaaatcaattattttatattaaatgtgtctgccctctctgggatgatcatatcactaataaagtatgtatactt

SEQ ID NO: 28230 - DNA, 201 bp, Bos taurus
ctatcccagtagccttgtatgttttgtccagtttgtatggtttgattcgctttctcttagatgtcaagtaaagtacttggttggcacataattaaaagatcaataattctcctaaagtgaaacaagaatgttctttttcagttctgacgttagctgatgtttctccaagagtgatttttggttggtactttccaggtacaa

SEQ ID NO: 28231 - DNA, 201 bp, Bos taurus
ttcataaatggccaagaaacttcacccataacaatgtgtacattttctgttttattccttttaattttcttctcatggttttggaaatttacttgcttacgatttatgtattccctggtggctcagatggtaaagaatcaaccttcatagagttgaatgcagtacatatccagattgataataatctgggattccctggtg

SEQ ID NO: 28232 - DNA, 201 bp, Bos taurus
taaaggctgtaggtattgccttaaagtattgaagggtaaaggcaattataggcagagactgtaacatgcaaatatgttactctactggattctaccaagggaagttcacatgtaaaatcagcaaataacctgcaatttaggtaaaatgtttaagtatattatcactaaatctgaattttagagagaagaatcagtctatat

SEQ ID NO: 28233 - DNA, 201 bp, Bos taurus
gaatcttgccttcccatggaaggtgtggccgtggaagatccccatggtaccaagacctgtgtgccgatgcagtagcctgacatctgtgtgtgactatgctcctgcatctttggcccagtgaattccttgcagttagacgattcctctgtgtctgattagaggtgttggcagtgatgatgcaagagcagggagaatcatggg

SEQ ID NO: 28234 - DNA, 201 bp, Bos taurus
agtgtgtcaggcacagtcaggcttgtataacataactctgcctcttgatcatagttgtaggattcacatttgagcatttcttcaaaatctttttttctccgttttactacatgcattttaatagaaaaaaaatagtctattgttagaattcggcagaatctcagaatgcaatgaaaacaaaagatggaaagagaaagaaat

SEQ ID NO: 28235 - DNA, 201 bp, Bos taurus
tccatctttttcccttcttttttccttctctcccccttcctctcctccttctaccccagtactgcttgtctctggtctttattctcagttcaaattctcagtagataatctaattaaccaacctatgaatggatgtcaatcccaagtcagctgtcccttcacattccaatcaacagtgaccactgagaataggataatcta

SEQ ID NO: 28236 - DNA, 201 bp, Bos taurus
gctgaaatagaggagctgattcaggccataccttgggcaaagcatatttggggagcttcatctgggcaaacgcattccttcggtaggacacgtagtaatgcggccgtccccctgatgtcagctgcaacgtaagcacaaaggtggtaaaaggagtcactaccagttacaggtcacagaagaatagtccctgcccggaagggg

SEQ ID NO: 28237 - DNA, 201 bp, Bos taurus
ggacatgggcatccacagggtggggagaagaagctggctgtagaggatgggagaaaagtgattccttctgctcatggtcggggcagcaggtaggtctgcaaagctgcccaaggaaagggccttgccagtctcaataagccaagccagagggtttctcctccccagcaaccaggcagtctgagcccggggagtgttcacatt

SEQ ID NO: 28238 - DNA, 201 bp, Bos taurus
ttcatcacttccttaaatctcagagatgccccaaatacatctgtgtgttcaggacgtttattccatacagtggccgagtgcctaccacagctgtctttcttctaggggcataaggagcccagtcttaatgtcaaagggacacatggagagaaacaatctaatttcatatcaaattttccactgtccagtagagggcagctg

SEQ ID NO: 28239 - DNA, 201 bp, Bos taurus
tatggaacaaacctgtgtagcctacaaaggaagaagagactgagggagctgtcgattggacattttccaccaagaaaagcagttgctcttcagtttcaaacatagttacacctagttttgatatttataataccagcaagacaaagcgttctaaacagataagatgagcagtgacttgttattctctcatgttatgaagaa

SEQ ID NO: 28240 - DNA, 201 bp, Bos taurus
ctgccgtctatggggtcgcagagagttggacatgactgaagcgacttagcagcagcagcagcagctgtaccaagcataatataaagttattaataactgccgacgtttactattataaaacaagcctcgtactaagcatttgatacatcatatctcatttaatccccacagcaatgtattatgcaggcaccagtactgtat

SEQ ID NO: 28241 - DNA, 201 bp, Bos taurus
tctccctcccctgacttccattccatatctttgatgggctattccttctcatgcctgtaagctgccacatgtgtcaatccttacatagggatttctacatgtctacatagcacattttctactttttttttttcacctgaaaactcttatctatccctttttgtttactaaggacacaatatgctacctcttcttggaagt

SEQ ID NO: 28242 - DNA, 201 bp, Bos taurus
actggtagagttttagtgaccttattcttacagttctcttataattatgcctgagaaggtttaatttttttctaatattttatttccaattgcttctagccggtaggagtatgttctttctatgagcttttgcaaaagaaatttcagatcaattttatcaattttatttatgtgatttccatatcttcaatcatatcaata

SEQ ID NO: 28243 - DNA, 201 bp, Bos taurus
ccccaaatattccctcaaagaagcccatgattatttggtattattcatctatttagtgagcagatgatatgcaacaaaacagacacataaaaattcagatgagcaactgctactgctgctgctaagttgcttcaggcatgtccgactctgtgcgaccccatagatggcagcccaccaggctcccccatccctggcattcta

SEQ ID NO: 28244 - DNA, 201 bp, Bos taurus
tgttcatttcattaagtgatttaaaaagctattttccgaccttgatgcattatggaaatgacagagactaatttgccttgaagagtaatcttctggaaatcagaactttgatctcaatgatgttgccaaacacacactggagaaagaactccatatacccctttaactaagacttttgcgcttcttttgtgcttgagttta

SEQ ID NO: 28245 - DNA, 201 bp, Bos taurus
acaatgagtttggaagtgttccttcctctgcaaatttttggcagagtttgaggacaggcattaattcttctctaaatgtttgatagaattcaccagtgaaaccatctctggccctgtgcttctgtttttggggagagacttttgatcacagtttcaatttcagtccttgtgattggcttattcataatttctatttcttcc

SEQ ID NO: 28246 - DNA, 201 bp, Bos taurus
atcaatgtttcatgtttccaggtcatttcactgcttatgaagggactgccctcagctaggagacaatggtggatatgagcatataggatagtcaattgggtgattgtgacacctctgcactcatgtgctgctacctgaaagctcagtccttgtgacttagaccatcacaggactctgcaagtttagatgttcacagggctt

SEQ ID NO: 28247 - DNA, 201 bp, Bos taurus
tcaggttcccaacctggctctgtgatcttagctggcttctgtgagtttatgagtaaaattaattcaagaatcagggacaaagaggcaagggtgagaaggcagaagaaagtctgagaaaaaatatatttttaaaatgtaatgatatttacccaatatccaattaccccaggctgcctgcccatgtataatgcaactctatct

SEQ ID NO: 28248 - DNA, 201 bp, Bos taurus
gaactttgacataatcatctgtctcctgtcatatcaactcaattgggaagccattcctgatctctagccattttccaacatgtatttagtattttcatgcctttcagctatttgcttcattgttattctagttagactcaaggatgttaaagaggttataagccacttgccagtttctataagttggcagtatttgcatga

SEQ ID NO: 28249 - DNA, 201 bp, Bos taurus
ttgtctagtttgtatgagtcaaacccattctatgctgagtcattcaataaattcctttctttgtactttataatggaagataaccaagtaataagaagtgtcattatttctgaaaactaaagctacatagaagattgggtagggaaaaggaatgctgagatcagtgtgcctccttaaatatttaatcagtttaaaacagtt

SEQ ID NO: 28250 - DNA, 201 bp, Bos taurus
tgcttttgtgtctgatgagaggttaagaataaaccaagatattgtcctgggccatggtctagattattcagaagatcatatattcctccgtctctctcatacttgactgatatggcttaaagttggtccaattgtaggttcatgaatgaaggttccttttttcctttaggctatttctatttaaaaaaatgaaagcatctg

SEQ ID NO: 28251 - DNA, 201 bp, Bos taurus
ctgatcctatccttggttttctctccagagcatgctttagtatctgtagtaatatggatatacagaattttccaaaccacttagttctggttcctttttaggtaattgtccctccatctctttcctctcacattttactattagtagcaagcagacactaggctgtaccacacactgcttataaacatcaaagttcattgt

SEQ ID NO: 28252 - DNA, 201 bp, Bos taurus
caagtaaaaactggagaaatggccatagtgataagggaagaatgagattaattccagcaactgggtaccatgaagaatttagagtattattcctagcctcgtgttatgagttgttgactaaggccttaagcatattaaatacttgtaagtatgaaacaagttaaatatatttaaggattaacctgagtaattctaatgaca

SEQ ID NO: 28253 - DNA, 201 bp, Bos taurus
catgtgtagaggccatccaagtgtcaagcacatttggtggtgaggagcggggagtgagaagatgctgagttcccctgtggccatgtggcctaacaaagaacatcagcagaaaatgtccttgctcttgttatgcaattacagataccattagaagagtaagtgaaagcaaaagcacctacggtaacttaaatatctgttgtc

SEQ ID NO: 28254 - DNA, 201 bp, Bos taurus
tagaagaggcatataaaaggaatcgtacagatctttcttctctaaaacacaagataggtccttagaagttgctcaagttgcttcagcttttattatacatgttttctgaaaaaagcccaaaaggcttatagtaaaagatggtgaagaataccaagagaaaatgtaattctggaacttagtcctttaatatctcataatgaa

SEQ ID NO: 28255 - DNA, 201 bp, Bos taurus
tatccagttaaaattgtcttagttggattcactgtcactctatgacagccatcttcctttcctcctgttgggtttttaatatttatcttcattaactttatcctgaatgcacacacaaggcattcttggttgaagacagactttttattaattacttcacagtaagtaatgtgtactgcctctcccttccccacttcttac

SEQ ID NO: 28256 - DNA, 201 bp, Bos taurus
cccttagaggaatctcatcaggattccaagattctagtgacacagagtttggaaaaggctcccatgtattagggattgcaaccccttttccttctataagaaggcctaaattttacttacctttaattctgatcattctgagtccaatgtcagtattctagcattaggaatagttattgactgtacatgtgaaaactcagc

SEQ ID NO: 28257 - DNA, 201 bp, Bos taurus
cacccctgccattgtggagatgtgaaattgatgcactgacaatttctctaagctttcttcacctatagggcataagtgatcatagtacccacctcctcgactggtgggaatattaaaaaaaacactaggcttgaacaaggggcctgggacacaccatgtgctttgtaaacagtagttatagatgtgtggatgtccatgctc

SEQ ID NO: 28258 - DNA, 201 bp, Bos taurus
tttacatattaggaaaatcagctatttccaatatgttacaatttaatttttagtttgactgttgtcttttgattttgattttatgtaaaataaattcatatttagagggcctcttccacatcaagattttatgtgcatgtgtatatatatatatatataaagactgctattttctgagactgaataaaacatcagaagttg

SEQ ID NO: 28259 - DNA, 201 bp, Bos taurus
ttctgtattaacctttatactgcattttactgtttcttgctattacagggcactgatatcacatgcagtcatgaacacatgctctatctggcctctaggcgcctacctctctgttatttttcttatctaatactttcaaaagggcattttcatgacccaagatgtttataagtcccattctatcagcagtaccttttggag

SEQ ID NO: 28260 - DNA, 201 bp, Bos taurus
atagcagagttttgtctaggcctctcagctttcatacatacaaggcttaattctccaatgccttgtaatagttgagacatatcttatgtgtcctgagcatgggccccagggcctagcagaaaacaagcatgttttaaaatcattcaataaataatatgaaacacaaatgaacatttggggagcccaactaaatacctattg

SEQ ID NO: 28261 - DNA, 201 bp, Bos taurus
gagaactttaattagacaggaggtcctcactctctcgccttcctgaccacctgctcctgggcctgtggaacttcaccttgatagttcatttagggccactatagtatcatccattactgccctccttgttcctactcaggactgatagaaaagttgggaacataagctccagctctcctgccacttcctcgtgttcccagc

SEQ ID NO: 28262 - DNA, 201 bp, Bos taurus
gttcttctgtgacgatggctgtgcctggaggaggggagcaaaggaatgagagaggttcctgacaaacacctagaagctgcccagaatggcagcaggcaggcgagcacagtgagaggccccagactccgtttggccccccacccacccccactttgaggggagcaggtaggcctctgactccaaggaaacctccaggcaaga

SEQ ID NO: 28263 - DNA, 201 bp, Bos taurus
atgttgttgaatgagtagcaacacccagtctggaaaagagctcagtggaggtcctagcatcgtagcatggagctgggagtgaaggagatgagggtttgtgttttttttttttgctgctgagatgagacttgttaaaacttctcctctaaatttcatgtactgaatggaaaggggaacactggggttgaatgtgaaagcatt

SEQ ID NO: 28264 - DNA, 201 bp, Bos taurus
tttctgatactctgatttatgacagagggaaaatacacctgttaaactagaatttaggtagattcagcaaggcttgaatgtatcttttccttactatacataaaagactttagaaatgtgactgtttcataatcttctttaatttttagtgcatgtcagtgattagtcaattttccagtctttggcgatgttttcatttgt

SEQ ID NO: 28265 - DNA, 201 bp, Bos taurus
ggaagattcaattataaaaaagcttattttttacatttctttcactgatattaagaaattgctttctagtaatcagatcagaatttcattaaagccatatgatgtaaagtgttttaaccatatttcatgaatttgaagggttgaatactaaaacaattcaggtagcttgtagaatgttgtacatgggattgatgttttcaa

SEQ ID NO: 28266 - DNA, 201 bp, Bos taurus
cctgatgaacactcttatgaacgagtctatctatactctgttccccctgtgtttctggggtgcccctgcacaccagggaactgggagggggcagaagggataaggaggatcacactatgtgagagaatgcacagccctcaggaggggaggcagacccacccgtgagctttagggaggcctcagctgaacaaagttgcagaa

SEQ ID NO: 28267 - DNA, 201 bp, Bos taurus
aaaggatggagagaagcaaaccactcagccctggacatgtgcttcatccagaataagaatcagcccgtgagctctccagcaggttaactaccttgccgttcggggaggtatatggggttaattactaatgaggcatgggctggtggctgcacacaatatccttactctgacactaaactctctgggtctttaaaacatatc

SEQ ID NO: 28268 - DNA, 201 bp, Bos taurus
tcacctggagaggtccccggagaggccagggtctccaaaaagcccagcagacctgcacccaggacccttcaggaccatcctgatgatgcctctgatgctccgtggcttcctggggccttgggcacgcacggaccaggccatctggggaaagaggaagacagcagggctctggccaccagcggaggaggtgggggagggtgg

SEQ ID NO: 28269 - DNA, 201 bp, Bos taurus
ttcttaacaagaagtctggaggcaggaggcccagggttgctttagtggttcaacagggtcctcaggaactccatccagggtcttcccatttgtctacctttatgcttttgttcttctgtctgtggcctccttttcccagggtcttgacccaggtatcatgtactttcatgccaacaggcagagcaggaagttaggggtgga

SEQ ID NO: 28270 - DNA, 201 bp, Bos taurus
aataattatcaatatgtatgttcttattaccattttctcacttgttttgggtttgtttttaataggcctttttccttcccttcctcttctgttctctttctgtttgatgaccatttttgtgtgtttggactgctttttcttttttgtctgtttatcgtagttttgggatttgttgttcccatgaggttttgatatagcagt

SEQ ID NO: 28271 - DNA, 201 bp, Bos taurus
taaaataattctgggttcctcatattggcattcagcacccttcatataattctgacctactttttcatcctaattacccacctcctcttttatttactaactgaattgattagtttctttgttggcaatgtgtgcatatttctagctctgtacctttattgttcccagtatctagaatgctcttttctcatccccttaaaa

SEQ ID NO: 28272 - DNA, 201 bp, Bos taurus
tgtaatttgattcaagatctctccactgggaggtccagaactggaatttgaacctaactccagtttctttccattatttggcctatttcgggcctgaccaagtatatctctgtccctgactcaggagcatctcttgtgtcttttcattggcttggcttcctataggttactggtgagcaactagagtgagttgtcaaacag

SEQ ID NO: 28273 - DNA, 201 bp, Bos taurus
agaattcaaacctaagtattagtactctgaatttagtatatcttatacttcagtgtcagaaaccatacccccaaacgcctttcatactgctaccctgggagggctagctctttgcgtccttgggggaactaatcaaaacagcacaaggcaatttgaaaacttttgaccagagtagaaataagtttcatattttgggtcaga

SEQ ID NO: 28274 - DNA, 201 bp, Bos taurus
tcagggaccattcacaaatgacaagggccagaatgtagaggataaataatatctcaggctctttattctcagtgggacagtcttttcaatttttaaagttttaaaagttcttaggccacattttgtgacatgcaggatcttagttccccaaccggggatccaacccatgccccctacatttggagtgcataaccactggaa

SEQ ID NO: 28275 - DNA, 201 bp, Bos taurus
cagaaaagatagtgtgagtaataacaccccacagaaactgattatttcagctgtaaaatacaagttccatgcagagtgatgattttgagaataagatggtgttttcaaagataaaaagtctgtatttttggtctaactttttccactgtgcaacaaaggaaaacctcattatctaaaccatgtttttagcaagttactttt

SEQ ID NO: 28276 - DNA, 201 bp, Bos taurus
ctgtgttatattcctattggatactactgaacttggggcgttgagggggtggcgacattactatgagcagaactgtctgcgaagttgtcacagaaacacctcgacccaagttgacagttcagaaggatgagtcaacgttgactgaatagagagaggaggcagacttcttaaatggcaggaagagctagggaggcaagatgg

SEQ ID NO: 28277 - DNA, 201 bp, Bos taurus
gtcaatgatgagctaacattgctctccttaatcttgcttttactaaggactccaggtaatcaagcgaattattggatttgctcgattgctttcacatggcgcacagaatataggtgaagagctctgtgtgcctctggcagggccaaaccccagcacttgtgggcactctagcttttaattgactgtctacgaggctcacag

SEQ ID NO: 28278 - DNA, 201 bp, Bos taurus
aggctgacttctggcttggccattgggagatcccatgagaaaagtggggcgggggaggaagagagcagccacagcactctctccttttctctctgactttatggcctccctccagtggctcctctgtcgtggcccaggctccccccagatcagccaccatggctccagtgaaataagagcagcaatcagcatttacatagt

SEQ ID NO: 28279 - DNA, 201 bp, Bos taurus
aacaaaacagctatgaattcacaagggtaattatcaccctatttcaggtatgtgacaaataatattttatttgtgttaagtgaatagttcctggaaggatgcaaatatgcatttactaatttaaagttacatgtatgcacacaagtagataatttttgaaaaattatgtgctgggaatttttggtcatacataccatgcaa

SEQ ID NO: 28280 - DNA, 201 bp, Bos taurus
aatgcgatgttctcttaagttccgatttgggcttgctgtgcataaagtgtgtcaaacttcagctacagaccagggggtgaagtcggtcaatttaattccccaagatctaaagaaggccggtatcatttcatatagccctggcagagcagatcattaccaggcacgaatctgttcgttacgtgctgagggtttatagcaaaa

SEQ ID NO: 28281 - DNA, 201 bp, Bos taurus
aatccttctaagaaagctaaaattaacctcgtgttaagtgccatgaagtaaaaggatatagtgctgtgatacagtgagtttataatcaagtgtttatccaatgaaagactattcagctttaaggacaaagctcatcgtagtcatttcacatagaatagagacaggcatcttatcccatgagtgaggatgatcttcttttat

SEQ ID NO: 28282 - DNA, 201 bp, Bos taurus
aggatgttcattgcaacgttgaaatagcagaaatttagaagcagcataaatttagattcatcagtgggaggggggtggtcaatacaacagaatacagtaattaaattacataaatgaatcatacacacacgtgctcacatatgcatccatgaactattatgttgagtcaaaagatgattttcaaaatgctgcttagagagt

SEQ ID NO: 28283 - DNA, 201 bp, Bos taurus
agcccattttacagacaggaaaacccaagtccaagatgatttcctcattgcatcaaggaacagccgttagggtctcaggcagaagatgccacatgactccagcttttatacttgtcctctcctttccatccaagtgccttttcccaaaagtgggaagaggaagaaggcgaggttacttgtagctcccctgaaacaagattt

SEQ ID NO: 28284 - DNA, 201 bp, Bos taurus
ggcagaactgcaaagttgtggcgattgcttggagatagcatcacaaggtttttttattctgtaagacgagaagcagcctgcctgtgcctgctggtctgaacgcagggcctgtggaaatgcctaagaaagatggaagattttagaggaaagtgtggtctttggaaaacataaaaatgagtagcaggccaccgcaggggcctt

SEQ ID NO: 28285 - DNA, 201 bp, Bos taurus
cacccacaggataagtgtcacaatcttttccaagggatctatcgaccctgagataagaatccctgccttagatgcttgccatatttgaaaagaaagctaaggttttatcatttcacagcagtcttagtaccctggagagcctctgtattttaagttgctcataaattgactgtggtcatatgtgttagtggcttccatgat

SEQ ID NO: 28286 - DNA, 201 bp, Bos taurus
aaaagagaccctcccttggggattccagtgaccacccaggtttggggaatcacttttatctaatccacagcctctcatcttacagacaagacaactgccatggaaaagttagctcacagaggtctcaaaccagctcagaaaagaggaccagaaacagggcttcctgaatgccagcccagagttctcaaccagactgtgggc

SEQ ID NO: 28287 - DNA, 201 bp, Bos taurus
catttactgcggtagtcacagtattacttcttagagtccagcatattttccttgaccttaaatatattttatagggctttagttatagtaccatatattcagtaatgccttaacatgagaggatgaagtaaaatttcaagaaaagttctatagttttctatatcagttggaaattttgtgtgaccttttttagtaataata

SEQ ID NO: 28288 - DNA, 201 bp, Bos taurus
gaaataccttggtgcctagcactcagagtcctcattggcttaaataaggtctcctacatttagatagcaaacacaacattgctagctaaacataaagtattctagcagagatttactgtccaacattttcatttatacatttttaataatgatttattgattatccttaatgtacaaggaacactgctagagaccagggaa

SEQ ID NO: 28289 - DNA, 201 bp, Bos taurus
cctggaactcatgaatgataccttatttgggaaaggggcctttcacatgattaggttaaggatctaggttattctggattacccaggtccagagattattctgggttatccaagtcggccctaattatagtcaccagttttcttataaaacagaggaagaagattagacaacagaaaaggtaatatgaccacagaagcaga

SEQ ID NO: 28290 - DNA, 201 bp, Bos taurus
gcacctgcgaggggcagacctctcttttgatcccgctgattgttagtagcacatttccatttcactaattgcaggaagtgtccccgagtgagtggccagcagtgtccccagttctctgccgcttttgcttagtgaagacattccccacaccctctgcccaaggtttggacccgacctgaatctgtggccagggggtcaagt

SEQ ID NO: 28291 - DNA, 201 bp, Bos taurus
aagacgcagtgcaagctttccgattatcctgtggagccagtgctcctccttggagggaagtcgcaggttcctcgaggcggcctttaatggattcctaactccgatgttctgaccaagtttcagagaggtcagcaggggtccctgggatgtccctccaccccatcacgggtttgccaacaaccaggccccgacagagctgct

SEQ ID NO: 28292 - DNA, 201 bp, Bos taurus
ggcaaactaaggcctagatgtgttcagtatctctgtgatgactgaccagctagaaaggagcagagacaaactctgcacccagacccgggtctatgttgacgctaaaggccaagaaaggtcttaacaaaattgttacttttggtctcggatctgaacagtgcctggcctacaggaatgtttagcagctggtggcatttgtta

SEQ ID NO: 28293 - DNA, 201 bp, Bos taurus
gggccaccgcactactcgcagggggactgtggatcatcgctgcgtaaaggcccgtttttccaggagaaggtgtaaggcctaaagggaagtaggaagtgagtgtgaatgggaaggagtattgccctgcctttcaggacccaaacccctggccataaccggctcgaatttagccccagaagcactaattctgttgaaggctac

SEQ ID NO: 28294 - DNA, 201 bp, Bos taurus
aaaaaccagtgaactgtgtactttaaaagggtatgcagaattgtctggtctgtggatcatgccacaaaacaaaaacaaaaccaaaccctcaacaacaagaatcattcaatgaaggaagaaagattctgggagctcagctaaggccagttctcagcagaaatctcactctgaacttcctggctatggagatggcagaggaac

SEQ ID NO: 28295 - DNA, 201 bp, Bos taurus
acgtgaggaactgaccttatttagaacttttatctataataaggacagactatcctaaatatactgctttagagtacagaactctcacacgacaaaagtttacaggctttgttttcactgactattatcttagctcgtttctcaaaaatatcactggttgctaaaaccagaaaaacaaaagagagaagagatgagatgaga

SEQ ID NO: 28296 - DNA, 201 bp, Bos taurus
catcctgcctgttttaccaactgaccctataaaaagacaaagcacgatcatttctatcctactgttgactcccccaagcaagacaattagttcggtggtctatcaggagacagatggcctgctcaaattggaaaatttagagtctcctttaaaaaaaaagtccatctacaaagatgtgggtggggtacagaaaaaccaagg

SEQ ID NO: 28297 - DNA, 201 bp, Bos taurus
ctaaacagtatatatataggttcattttagctgtgagctttctgcctctctcacatcacatgactgatgagcctcattcatgtcatcagaaggtcctactgagggatgtcagagattttgtctgttttcttcactgctatgttcccagtgcccacaacagtgcctgctcagcctaagtgcacaataaacatttgttgaatg

SEQ ID NO: 28298 - DNA, 201 bp, Bos taurus
acagaggagcctgacaggctatagctcatgggatcacaaagagtcagacgcaaccgaagtgactgagcacagcacaatggcaagggcctatatggcacggctctacactttatcaaatttattacacttactattcagaggggggctttcctgaaggctcagtgggtaaagaatacacttgcaacgcagaagacacaggag

SEQ ID NO: 28299 - DNA, 201 bp, Bos taurus
aaacacactttgtgtgatgggcaatcgctttgcactcactgacagaaaaaagaatataaggggtgccaggaggcaaaaaggcggggccccaggaccacagtgttccctgccagcagcccccttcaccctccttccactcatctgccccagtcctaaaggtcccagcagaacaaagcgtcctcacggccccgccccccaaaa

SEQ ID NO: 28300 - DNA, 201 bp, Bos taurus
aatacatatgatcataattgtagagaagaggagcaaaggacttagccattttaagtagttgtttcatcccaaatggcactgtaaggttgggcaggtcgtgcactgcacaagggcacctgactaagggggcaaataaggactaaaatccagcgatctgccttagtgcaaggttgcatctatccaggaaaaaaaaaggtgtcc

SEQ ID NO: 28301 - DNA, 201 bp, Bos taurus
tgaaatcctgttttattccccaccacgtccaagcctttcatcctacccctcaagaccaccaacggtgccagccgtgtctacttcagagttggcctgccttcaaggtccccagcccccgaccacgctgttccaaagaagtcagcaggctgcctccaggtccccttgtgcaaacacactttcgagtccggctcttttgctggc

SEQ ID NO: 28302 - DNA, 201 bp, Bos taurus
tttgtatagggtgtgtgtgtgtgtgtgtgtgtgtgtgtttatggccagggctgtctccccaacactaatgttaactcaagaatattaggccggaacttccgtggaggtccagtggttagactctgctctttcagttcagggggtgcaggttcgatccctagtcagggagctagatctcacatgctgtgtggccaaaaaaaa

SEQ ID NO: 28303 - DNA, 201 bp, Bos taurus
tctcgattgtattttggcaactttcctttctcagcagatgtaattcaacctgctcaaagagccatcattctgaggcttcttccagctctgaggtgtctggagacaaagatctgcaaacctgacatctttctcgaacttcagagggaaggtattttagaaatctggagggcagtttcagcctcccagcagtagtaatttcag

SEQ ID NO: 28304 - DNA, 201 bp, Bos taurus
tcttttcagatgtggatgtagacagtcccggagtttgtggccttgtttgcaatgaggataagctcctgcaggccctgcctgcttccttatccgcagctccgtgtcctgcatctccccatcctcaccaggcacactggtctccaattgtgtgtgtttctcactcagtcatgtctgactccttgcaactgtggactgtagccc

SEQ ID NO: 28305 - DNA, 201 bp, Bos taurus
gaaagactatttgctctgggttttctgttcaatccaaaccaaaaagcaatggaaacacatcagaagcaaggctatatgtttcatcccaattttcactgtggtcgggtacttttatgcaggcagagacctttaaagttttggggtgtacttctccaaataaagttagacttcttaggctcttccctcgctaaccggtatgat

SEQ ID NO: 28306 - DNA, 201 bp, Bos taurus
gccctaactagtcactcttgcaaaactattttagagaacttagataacatagagttccagtctttaacagctttgtccagggccgtgcagatcttccattactgatggtcacatctggagctgaaagggacttcaaaactatgaagatcacagcaatttcgtctagagagaatgagggggcaactgtgggtgggggaatca

SEQ ID NO: 28307 - DNA, 201 bp, Bos taurus
gtgttgtacaccctatgggcttgggcaaatgtgtgatgacctgtatctaccattatcgaatcatgcagaataattttactgccctaaaaacccccctcggttccacctatccctcctttcccacaaaattaacaggaatatatttttttttttttgctacttacatcgccctagggctttcctggtggctcagatggtaaa

SEQ ID NO: 28308 - DNA, 201 bp, Bos taurus
tgcacctacaggggtgcccctccaggctgttagggagctgacatgggtccacagcagagaatggattgccagttgccatctgtccctagaaactggcagcgtggaaaaaaggcttcctgtggggtgtgcagggccagtggcccccactaactgcatctcagcctccctttcttctcaggcctgttaagtcatccagcatta

SEQ ID NO: 28309 - DNA, 201 bp, Bos taurus
ggcaggtgggcggctgccacccagacgcagttcttatttgccttctaagtccttgtctaaatctgcatggagacgatggaggcgaattcagaagaggatcgtgaacacgtttccgggatgctaatccttggtcacgtcttgaattgttgttacagcctcctttttgtgccatcctgtccctctctaccatccccttaggct

SEQ ID NO: 28310 - DNA, 201 bp, Bos taurus
gggaggctgcctgccggagggaccacgattcccaaggctgatgcctgcccttccctctgttccaacagcctcaactgtaatgaagagtatgtggaaatcatagacgggctgccagacagtactacatttgggaagttctgttcagggggacacctggtgtttcgatcttcttccaatgtcatgactgtgaagtactacaga

SEQ ID NO: 28311 - DNA, 201 bp, Bos taurus
ggggaccgtgtgtgatgacttctgggacctggccgaggctgctgtcgtgtgccgccagctggagtgtggccaggcggtggtggcccccacgggggcccactttggggtgggttctgggaagatcgtgctggataacatgcagtgtgtgggcagcaagagccacctggagcagtgcatgcacgggggcgaggccgggcacaa

SEQ ID NO: 28312 - DNA, 201 bp, Bos taurus
gctgaggggtcctttttctccagatcctcacttttactgtctgttcacagttccagctattcctcatgctgttggggggccccctgtaaatggtaatttatcttctattctcagattatacaccaaaggtttctttttcatcaggttcagcagccaaaggaccagtggtctggggctgagagcgtttgaagggctgaggga

SEQ ID NO: 28313 - DNA, 201 bp, Bos taurus
taaagtgattgggcaaaacaataaatataagaatggacaagacgcttggagagctctgcccggtaagggaggcccaggccattctctctcctccagcctctctgcaagtttagatttcgtgaagctgcttcagagcacataggttttgtgaatctcggccctggctaatattttgtcatgtaatgcctgttctctcagctg

SEQ ID NO: 28314 - DNA, 201 bp, Bos taurus
gagggtacctgcatgtcccatccctgggatgaggtctggggagccggtgggatcccctgaactgcccatcactgggccagagctgtgagcagaaatagcccggcactgggtgtctaggcaaagggagtttgagtgaccccagagcggtgtgggactggccagatggctctgggtgctgactggatgctggtgggaggaggc

SEQ ID NO: 28315 - DNA, 201 bp, Bos taurus
actcactttcgattcacatgacaacttccactccttgctgtgtgcggctcctgactctcctggtcagcgattgggactgagccaggtgctagcaggctgacgtttcaccagccatggctgccttgccatcacatcaccgaggactgatttagacctcgcattcaccatggaaacagaatcccacaccacctctgtatttcc

SEQ ID NO: 28316 - DNA, 201 bp, Bos taurus
gttggcctgaattcttcccatctttcagtgcccacgcttgttgctctgtgactccgcaatttctcccgctggaaaatagtgcctatttccctccctctagaatgtggactggcctcgtgactgtttggccagtagcctgtgacagatgtgaaggtctatgggttctgagcctagttctcaagagggtaggggaggaaggag

SEQ ID NO: 28317 - DNA, 201 bp, Bos taurus
ggcctctccgttcttggctgaggcttgtgcaagtcatcacctgcaggagcgcctgcctaattcacacagaggctccagaggcggcacagggttaacctggctgcattggcctttggaggcccatgtggtcagggagcaggtggggacgtgggctgcaaggctaggggacctttgagactgcctctcacctctgccacccca

SEQ ID NO: 28318 - DNA, 201 bp, Bos taurus
gatcagagttgctggccagcctcagaagaggagagaatcaggacaaactgctctgaatgatggaatgaggcagcgcatggcagggtgtaccttcgggcaggggggacagcaggggcaaaggccctgaggtaggagcatgctggcttatctgcagaacaaagacaaggctcctgggctagaaatgaaggagcaaagggaagg

SEQ ID NO: 28319 - DNA, 201 bp, Bos taurus
ccctcccccacccccacttcacacagtcagggccccataaatacgtggtgaaagaaccagtgaagcagtcactgaacagacgagcagcctcccctctaccttaatgcccggcccagagccttgtgcaaagtagatgctcagaaaacccttgctaagaagttaaatgcggactctgcagactttctagctgggtgtcccctt

SEQ ID NO: 28320 - DNA, 201 bp, Bos taurus
ggcctggcacacagctgggattcactcggtgctggctgggtgaacgggaagctggttctagcctgtttgatcacggtctgcatgactgaagcatgatgaggtcagttaagcacattctaggccaggggtgaggccaacacacagacctttcagcatttctatctcatagacttgaactggttccttttttttttttttttt

SEQ ID NO: 28321 - DNA, 201 bp, Bos taurus
cagcctttcttgcttcagagacccagaaggcctggacccggacaaattctagaaacatagcataggtgtcaggatgagcctgcccgggcaagaaggccccagcacacccgctcagaactctttgaagcttggagtggggctcaggaatgcaacattcgaaagctggcctccccagaacatcccctgatctgccctcggctt

SEQ ID NO: 28322 - DNA, 201 bp, Bos taurus
tcaataaaaagcatcagacgggcatgtcagaaagagctgagatcctgctgtaaggacttcgtcttcaccctcttttctcagctgcttaaatcgctgtcacagcctacctgtaggaatcttagacaagggggttttctctgatataattatgctggtagtaaaaatcttggcgccttttctccactttccttcttagccact

SEQ ID NO: 28323 - DNA, 201 bp, Bos taurus
ggctcctgtttgcttcagtcgcagtagctggagaggctccagcggggctggaggattttcttgcacggtggctcactcccttgactccactgggagcccagcggggactgtgggcctccctacccgagagagccaggtggaagtgcagagcaccgtggtaccgagtcgtttccagcatctgcttgaggagcagatgtgaag

SEQ ID NO: 28324 - DNA, 201 bp, Bos taurus
gccaggcacttgatcatttaaaagaccacctgcagcccaagtgcctgtcaggatggccggacattctgcacacaggaggcaccggcctctcctgaacgttcgttgtcagtgaggctgcagtacgaaaacggggcttgtgatgaggaatgctgtgtgaggagaaggccttggctgggtgcctgggccggggtttgcctcagc

SEQ ID NO: 28325 - DNA, 201 bp, Bos taurus
gagtgctggccaggtgctgagcagtggggagcaaggctcgccctctgattgagaagctctgagaggcgaggagcctcaggactctgcagagggttagacgcatcctgcaggcacttccggccactgagggcactgccctcccatcccgtccttggcaaaacagcccctgaatctgaccgcctctcagcacccctgccaccc

SEQ ID NO: 28326 - DNA, 201 bp, Bos taurus
tgactctaaaggacacacacccaagctgtgatgcaatctccactagcttgtaatctgattatgtggtctttccttcccacttggccaggtcatctactcaatgtgaaaggaaatgaagaagtggcatgccttagtaaagaaagaaggcaaagtcctaaccttagctcttgctacatggccaggatacatcatttaatccct

SEQ ID NO: 28327 - DNA, 201 bp, Bos taurus
gagaagcgagccctgaaatgagcacacggccccacgagtcattcacaaccgaagctacacaccaggatcaccggagatgcttcgaaactcctgacaatcgggtcacaccgagggccagtgacttcagaacctcaaagacgggctcttcatctcgtgaagcagaatcacctggagggcttgctaaaattcaggtggctggcc

SEQ ID NO: 28328 - DNA, 201 bp, Bos taurus
caccactgggtctcttggggcttctgcctttgcaaactctgtcttcattcagctctcctccaggtgggcctccaccctctccatcaggtcctcctggccaatgtgccaatgcatcactgcctattagagcccaggcaggactcttgtctttatcacaacaacctcaggggcacacccactatatggcagggggcgaggggc

SEQ ID NO: 28329 - DNA, 201 bp, Bos taurus
gagagtcagggaagtcagccacggtgataaaagtgtctgtagaagaggtggagggtgcatcacagcgaggggtggacaggagacaggccgtctcccacaatagttcattaccagcctgggctttgggatccaggcgtaaaggtgtcttggagggcagaaggaaggatggggcaggaaagcccctgaggccaggaaccatcc

SEQ ID NO: 28330 - DNA, 201 bp, Bos taurus
gggtgtgtcttgtttggagctggttggttgaggcctggttggaagaagggagtcagcttgttaattcaacgagccatgcatctccctgctcctggcttcattgtgcctggcctgtcccccccagagcagcagccaggtcatcctctcatgtccccctgctgccctccatgaagcctttgaggggttgtcctctgtccttga

SEQ ID NO: 28331 - DNA, 201 bp, Bos taurus
gtgaatctcgaccagctttgccttcctcgcgtgttttctcatcttgaggcctctgcacagaggttctgtcctcagttccaggcctgaaagtctgatgagaaccgctccagcggtccccggaatcatggctggaacactgccctgaattcagggcttcctgtgcagtctgagtccaggggagggaaaggtcgcaggggccgg

SEQ ID NO: 28332 - DNA, 201 bp, Bos taurus
agcgaagttctgtgggggatgtgcgccccaccccaggcccagagcaccatagtgggtgtgggtgcagggttccttttcctcccatctgcttccctctttacgacacttagatcatctgggaagtggcctctgtagggtgcaagaggggacttacggctcaatgatagtaatctatgagccagagaaagtgcagtggagcaa

SEQ ID NO: 28333 - DNA, 201 bp, Bos taurus
tattttgtgtgtgtggccatacacatttcgtaggaaatgtatgacttagatattcacaccattggtcatagccataaggagcaggccacactttcagaaatcagtagccaaggattaaaggatccaacagatggaagatgacagaccctctcttccaacctggccatttacagatgaagctcagacggggactctgcccac

SEQ ID NO: 28334 - DNA, 201 bp, Bos taurus
gggcttaaaaatctctgagggctttacaattaataagacaatgtggaaggccattacagcttgtaaaatagtatacaaaatgaacgtgttataattattataattgtggaaagacctccaggccccctctagtccttagggtactcctcttgctggctagatgagctcctttccagctctcccttagaaccacccctttct

SEQ ID NO: 28335 - DNA, 201 bp, Bos taurus
aagttgaatccagtcctagctaatacaacaagtcactgaatttgtcggcctctctgcttctgggtaaaggtagagggggccacagggagcactgctagattctggtggtctctgcaggtgtgcccagccagtggcaggaatgacagcctgacagctgtgcaaagagatcaggagcccagatcaggaggccggagatcagaa

SEQ ID NO: 28336 - DNA, 201 bp, Bos taurus
cagaggcccagtcgtgacaggacccctcccactgagaagcccgactccccagggtcccttcacagatgatacctgcagacttcaaggtaaataccctggtaagtagagaggacgcaggccggccttccccctggggtgaccgtgagcccgaggcctggcaggttcgatcccagtgcagatggcaaggccagtggcgaaccc

SEQ ID NO: 28337 - DNA, 201 bp, Bos taurus
ctatttccactcctgcccaaatagtttaactcattgcaatgaaaagctctgtatgccatttcttttatagaacccatttctttgattcacttccaaatagtttaaagtttgagtataaaatagactgcagtctagatttgaactcctcaaatgtaagtactaacctctgtgttcctgccgatcattcacaatccaccaggt

SEQ ID NO: 28338 - DNA, 201 bp, Bos taurus
ccaaccatccttctctccaacttggttccagtttttaattatatggagcccaacagatgtctcttcttacagccaaagagcattttatcttcattcatatgttttatgcttttgatatatttcttggccgcccattccctaggctggaggatcctggggtcggggtagtagggtgggggcgagtggccctgagcaggagcc

SEQ ID NO: 28339 - DNA, 201 bp, Bos taurus
ctccatccctccctctttcgtcctccccttttttactttttaaaattttgtgttgtttgaagtccagtaaggagtgtatgagatacacatgtaagctgtggagtgaaagtcatgagcaggacacctgtcgccgcttcactgagtggggtttgtctgggtgcttcctctccctccccagccctgagcaacacacgcacttgg

SEQ ID NO: 28340 - DNA, 201 bp, Bos taurus
cttgtttaaatgggtttaaatgccttacgttttaataagctttgttggtttgtccaactaagactttttctgctgtacacatttttgtcaccatctcttacaatacgtcatagcaaattccacttcaggttgtactgaattagtgtttcctcaactttttggaaaatattctcagcatggccatagtttgtaaacccttga

SEQ ID NO: 28341 - DNA, 201 bp, Bos taurus
cacgcctcctccccagggctggcctgcatcccagatgactactgcctggactgtgccttgcacgagtgttctggggcaacaaatccctgggttaaccctgttctcgatgacgggctcctgggccagtggtggtacctgtggtccgagcatgtgtccacacgtctgtccgtgtgtgagagtgtgtgtgcgcaggcgcactct

SEQ ID NO: 28342 - DNA, 201 bp, Bos taurus
cctggcctgagggccctccccgttcggtgatcttccaccacttgcaaccacctcggtggagattcgtccaaaagacagtaactaaagcttcgtacacatgtggcggattgaccgtgcggcccccacccgccgcctgcggggacgagcctcccaaggacgcccgggcctctctaggctgtccatcccacgtgagcacacccc

SEQ ID NO: 28343 - DNA, 201 bp, Bos taurus
taaaacagatctgacaggtaaactatggtctttccgacaaaggcggtggaggcggtgcgcccttggataattatttcactaggattcagtgaagcctctgaaactccggctccgcgtggacagggtgcttttatttcctttgtatataagggctaaatgttttgggaaatcgctgtgttctaacgaagaggttgatgcagg

SEQ ID NO: 28344 - DNA, 201 bp, Bos taurus
gccggacttccaggctcagatgtggcacgcccctttgactcttgccgcagccctgtgaagctaagtcacgactcacttcctggcagatgtttcaagggccgaagtgctagtgtcagtcaccatttgatcccccttctgggtggctaaaaagccagtttaggaggagacaggacggcccagggccctcgcagctgtctggct

SEQ ID NO: 28345 - DNA, 201 bp, Bos taurus
caccctccaaggccagcctcccccagggctctgcaaggggaccggtagatagaggtggacgggcgccctgagactggatggggtagggggcaaagacaccgtgacctggcctcatccataacttacaaatatcactgagccataaaggcaaaaggagaagggggcggcaggggaagagacggttagatagcatcacccact

SEQ ID NO: 28346 - DNA, 201 bp, Bos taurus
gagggtcaggtggttcatgttccatgtccttggagcgaaggagaccctgcacgtgcgcagaaaggctccctgggggtcaaaaggcagggcatgccaggccgtaataagtcttgcttctttcttcccagatgcctttgtgttgaaatctaccttggctgaggggtgtgtgcacacctgggggagggtcctgagacagattgg

SEQ ID NO: 28347 - DNA, 201 bp, Bos taurus
ccgaggaagatcaaagatggccaacaatccccagaagatggggcagggggcatctggggcacagtccctgtcacgtgagtctcccacaggggaagtgagagtgtatagggatgcgtcagggcctagctcgtccagctctgctggacaccatccaaggcacactcacttctcaccctgcccagaacatgagggtgacgggca

SEQ ID NO: 28348 - DNA, 201 bp, Bos taurus
gatgttgtaatacagaactgctggggtatctttcacagctggttcttatggaactcagatattattgtgcaaattacacggccttctagaaattgtttcttttgaacatttccaacataaaattaatcatcttcattatttttaagtgacctcatgggcaatacagtctacgggattctccaggccagaatactggagtgg

SEQ ID NO: 28349 - DNA, 201 bp, Bos taurus
agggccagacacagggtcagtggaggacgaggcagggccatgccctgctctccacccacacctgcctctgtggaccggccctgggctgggttctgtctgtactctgcctcatcttggaagcttgttcatgtcactcccccctgcctgggacttgcagtccctgaggaatccaggagtgagcccccttggatttcctttctt

SEQ ID NO: 28350 - DNA, 201 bp, Bos taurus
gagtcctgaccacacacacgttaaagctctcccgagctctgctttctgagcccccagagctggccgttgcgggtggagaggcagcctggtgtctcttgatctggaaccgagagaggaacggggccttgagggtgttctcatctgcacagaattctagaagaacacgcaatagtgtgtccactattgaagaaggcagcctct

SEQ ID NO: 28351 - DNA, 201 bp, Bos taurus
actgagtaatgatggcaatgtttcttaggctccggggcagggagatgggaccttcccgggtgtctgcaagcaagaaagggaggccagctcccacggtccacgctagtccccatctggggacagtccagcctcagggcatagaatgtggattcaggccagatggagcaacactgggctgcctgtatcagcatccagggttgg

SEQ ID NO: 28352 - DNA, 201 bp, Bos taurus
agagggttcagggtggggctgactgctgtgtacagcacggcgacaactttgccgttttccaaggaggagccggaccccgggaggatgtaggtgtagatgacggtggagttgtacaaggtgaccaccaggaggtgggaggagcaggtggagaaggcgcgctgcttgcccgcggccgagcgcatgcgcaggatgctggcgatg

SEQ ID NO: 28353 - DNA, 201 bp, Bos taurus
ggcagacgctgggaggacaatctgctctccttgggccgccgcttgaacattcgtatctcgcagaagcaccctcacagacgccctagaaggatgtatgaccgaatgtctgggcaccagggccggtcagcttgacactggacagtgagcttcacaccttccaaccgacctggctctgagctgtgtgccctggggtccctctcc

SEQ ID NO: 28354 - DNA, 201 bp, Bos taurus
gtcggatgcctccctgcatagctggccgcaggcgggcgagggggagccagctccttgggcacaggctggagcccggcctctcccaggcctcaggggtttctttccatccctgggaaaatcaggaatactgacaacgcttctgtacacacactcttaaaggtggctcattatacagaaacctaacataacctagcatggcca

SEQ ID NO: 28355 - DNA, 201 bp, Bos taurus
gccagtgcccagcgcccccggggacaccagctaggggaccacctcactgaactcggctctgacacttaaccgccgggtcagtgtggccccaaaggatcagagctccctcgaggcctgccccagcagacccccgtcatgagcatcaggtccccaggccaccacatgtctctccagtgtggccaccatttggggtcccgggct

SEQ ID NO: 28356 - DNA, 201 bp, Bos taurus
gtgttttcctaggacccggaggagacgaggtcaggagcatctttccaggaaagaggaaacagcagccggtgtttgccaatggggaaggccagtggcgctgatgggggtctctgacggtccctgctgggaagctggggggacgccaagtcccagccatgagcatgatgcctgactcctgccagaggccacccgactcctgcc

SEQ ID NO: 28357 - DNA, 201 bp, Bos taurus
ggcccgatcaccctaaaacatgacaaaaacccaggagcttgtaattaatgggggggcagagaaggcagcagagagctgggcagtgacctgtgccgagggtgcatgtctgccaccccaggggccgggactcctggactgatgccaaagcacggagatgggagaacgcgttccgctgggggaggggaggtgcagctgaaggcg

SEQ ID NO: 28358 - DNA, 201 bp, Bos taurus
tcaaagacaagctcgtgtgtgtatcggggaaacgcaaggcagggcaatggcaagctctcctgccagccccgcagagcagccgtcggcttggtgaggccccaggggatggtcatcttacgtggtctgggtgctgctccaagagcggttcacaccctctcagccgtgagtcagggggcctccgctcccccagtcaccccctcc

SEQ ID NO: 28359 - DNA, 201 bp, Bos taurus
agaggccagagtgagaccactgccctctccctagacggggccttaagacactcagctctttcactcagttcctctaaggaagcccctctctcgaagccacatgcagtcagcctggtgcggggcctgggcccggctgggaacgcacgagcacagcctctggctggaaaaggccacttgggaggctggttctggagtggaggc

SEQ ID NO: 28360 - DNA, 201 bp, Bos taurus
tgggtgtccaagcctcactcagggctgccagatggtagcccaaggcgcagcatggagacgccctgccgggcggcccggacagctcacgggagaccaggccaagatgtccaagccgcagaacttaagagggctggactcagccatgaggtttcctgcatccaactgaggctctgataggggaggggtgggcctcggacgtgg

SEQ ID NO: 28361 - DNA, 201 bp, Bos taurus
tgactcctgggacccccgtgagtgagggcaccctgcgtgtgcgccatgacggtcatttcactgagcatcgcgtcctcaaggcttgtgggcatcgtggcctatgttgaaatcccttcctctttggggctgagtgatgttccgtgtgtgtggatgggcatctgcttctctgtccatccaaccacggccactgagtcgctgccg

SEQ ID NO: 28362 - DNA, 201 bp, Bos taurus
ggtggcggggtttcagctgcctgccgggaggcccttctgtccagtgacccgatctgctccttagccacatgcagcgacagtggtcacatgcagatgtggtcttcagacaagggcccaggccttccagctgaccaggtgcccatggtaaacagggctgaccgctttcatccaggccgatgactcttgatgcatcgttgtctg

SEQ ID NO: 28363 - DNA, 201 bp, Bos taurus
cccggtgggggtgacaggaggggactgtggggggaaagctcacgagggtggggctccgtgaatggatcagtgccctgataagcacctgcaggagcaaacgcgtcttggggccacatccacccttggctgcccatgcaccactcggtggcgtcagctgtcctcccagggcaggaacctgacctgccaagccctccctccaag

SEQ ID NO: 28364 - DNA, 201 bp, Bos taurus
agccaggaggtaagatggccctgcctctgagttctgaactggaagactaaccacttctgatgacgagttacatggtcttcaggaccgagtgggaaggcccggcatccgaggatgctgacccagcggcactgggttgcccgtcaggggctttccagggatggagcatgcaggagccctcctagacaaaatgtcaccagtgct

SEQ ID NO: 28365 - DNA, 201 bp, Bos taurus
caatggcaggtggggaagtccatgtcacatatctacacacacctatgtatgtgtttttacaagcagattctagttctcgtttttactgctctatttaccagctgaagacctgactcaggccttccacacctgcagccctcacctcccctccatccactccctgaagtcaaggcttttaataaagcctccacttagatattc

SEQ ID NO: 28366 - DNA, 201 bp, Bos taurus
tcctaacctcaactatctattctggacccttaatttaacccatacccttctcaatgcttcttacccacaattgactaaagactgctggatacgtctatccataactcccctgggagattcagccctccctacatccatccttgactggaccacaggtaacatgtccctacaccactcatactgtagggagcctttattcat

SEQ ID NO: 28367 - DNA, 201 bp, Bos taurus
tcacccagtgagacagctgccttccatgctggccatgaccccagcttggaaaccgtctgcagagcagagcctggggctcacccagcctgcccgcttcattcgcaggccagcggttccgttcgtatttgtccaggtttcgtagttattcatttcaagaggccgggtctgatcctggctacttcactgtgggcaggaacagac

SEQ ID NO: 28368 - DNA, 201 bp, Bos taurus
atagctctgcaccggacctgggagccttgtaggagaaccagaccagacacttctgcatgcccagcacgcctgcccattctcctggaggcatgctgaggagcagtccaggcccccaagtcagaaacctgagaagtgttctcatgagctcaccctcagctcccaccctcggtcactgcgttcctttctcacaggcaccttccc

SEQ ID NO: 28369 - DNA, 201 bp, Bos taurus
aaagggaataaaattccttgtgctttatatttgttttttttgttttattgtactaatatagcattatattgcctggcaactcagaccaacaatctcatactcatgtcataaaatttatcttctgtctgagagcagaggttttaaagtcagacgtctgaatcagctccagcctctggcattcagcagctccatgacctgagt

SEQ ID NO: 28370 - DNA, 201 bp, Bos taurus
tcctgtaaaggtgttatcatattttcacaatttaaaaaataagaaaagagagagaaaatacactttgcaatgcacagtgtcacaagctttaatacatgtggacagagcaccggatgaacaaagtgtcagatatgtttattctgttcaagttgcctgggaagggtcttgtcaggcagagagaaatagcaatgataatccaat

SEQ ID NO: 28371 - DNA, 201 bp, Bos taurus
atcataatggttgttttcatatccctaaatgaagtaagtataattttaaacaagatcacttgtataattactgagctatggcaaccattcatctgtgtgctaacaggaagaaaaggtaacatcccccatcctcagggttaattagctaatgtaagcattggcttaggacccagtgtccagatgtgaacgatccctcctgac

SEQ ID NO: 28372 - DNA, 201 bp, Bos taurus
gttggcagaacagcagaaacgaggagaggatctttcaacagtgaaaggtctgcgctgggggcaggggagagaagggggaggccagagcactcaggatgggattcaccagctgaggatcccttttgacccttcagcttcttccacgccagttggcagaagcccccggggcctttttctgcactgctctcccatcaaccacag

SEQ ID NO: 28373 - DNA, 201 bp, Bos taurus
agccactggtgaggttgatgctggtgaggcagggccccattgaatagcgagtcttcagaccttgctgtgcctgggatgggcagggagtctggagggggacgggagacctgtgcacatggtcccatttatccaggtctggggaggagatcggaagggtaacagctcttccaaaggccaggcagttggcagtttaaagcggcc

SEQ ID NO: 28374 - DNA, 201 bp, Bos taurus
ccagggtccgtgtttttgatgatacatttgatgaagcgcatggagcgtcgaatgtacaaccactgggttgctgcccatgtggctcaaacctacatgaggagggcaggctgcccgatccacagtggcctggactgtgaacagaaatcaccttttatggccatcccaccctggagtaccaagtgttttgttttttttttttgt

SEQ ID NO: 28375 - DNA, 201 bp, Bos taurus
cacccaaagcacatcacctgccctgcaggtccattgtcttgctcactttgttgcgtgcagctgaagagaagattaaaggtgtgcccagtcagtcctcagcgcccccaggtttggaactttgcttctaaatgtccctataagctccagctgtaacagcaattactgtcttctctctaacaaaggaaggaacttagtttaaaa

SEQ ID NO: 28376 - DNA, 201 bp, Bos taurus
aatggcatcactgattcaatggacatatacttgggcaaactgcgatatggtgagggacagggaagcctggcatgctatagtccatgaggtcacaaagagtcgggcatgatgtgcgactgaacaactgcaacaaacagcagcagcagtatatctgtatggtgtctttccagcccatggaaagacatccttgtgttagtaagg

SEQ ID NO: 28377 - DNA, 201 bp, Bos taurus
tagatcgtaaatactgtaggttttgtgggccacctgggctctgctgccactagtcaattcttcacttttgtagcttgaaggaggccactgacaaataagcgaaggacacagctgtcttccaacaagacgttctttacagaatcatgtggcagaagcactggcctgtggacaactgcctgtcgatttctattttaaagtact

SEQ ID NO: 28378 - DNA, 201 bp, Bos taurus
tgtctctccaccaactgtctttccaccttctccctgtcacagccttgcttcctctccattaaaatttcctcatttccatattcccactcaattttcaacccaaccagtcttgtttctgtgtttgccatcttttatgaagatggacaacatacagcttgcattccgtgtgaagttttagagtgatcacctccactgagcact

SEQ ID NO: 28379 - DNA, 201 bp, Bos taurus
ctgctaagtcacgtcagtcgtgtccgactctgtgcgaccccatagatggcagcacaccaggctcccccgtccctgggattctccaggcaagaacactggaatgggttgatattggcccataacgtagaataattacatgttttatactttgcttctcagatcatagcaaacaccctcttccaacaacatgagatgactcta

SEQ ID NO: 28380 - DNA, 201 bp, Bos taurus
gctggataaattttcatgtggagggaagaactggagagagcagcagaaagtaaaaattcagagatttaagaacatttaacatacttctcctgccccactgcacaaatccatctgtagaggctggaaaacttatcacctcaagaagactgaacacaattttttccccaaatcactggctgaccagtatgttattaagtctta

SEQ ID NO: 28381 - DNA, 201 bp, Bos taurus
acacccccactgcatgcataagaaatggcctttccatgtaggacctgtcagcttctgcaatccacttctgtgttgatccatatacaatgcttcttctgacactggctgggatccaggcctggagaaccgcctagcgagaagcgctcctgagcaggcacatggctatatacagtgcatctgtcacgccaatgggtgcaaact

SEQ ID NO: 28382 - DNA, 201 bp, Bos taurus
ataaaatgcactctacagtgatcaaagctattatagtctactaaaatttatcttgaatataatagaaggaaagggccacatactaggtgaatgtctttatcttcaattttatagacgttcttgaatggattctgcctttgatcattcaataatggcctctcctgagaaccaagtatcttgaaagtgaaatttaagaacctt

SEQ ID NO: 28383 - DNA, 201 bp, Bos taurus
ttaattaaaaaacatttattcggcttaagttgcattagtatttcaggccacgtaaacttgtagctaatcttcaatccgcttgggttttaggtgtgaaaagcggaccaacaaggcacagtgttgtggccagctcacggaaaggctgccaggacctcctcagactgcgggaggaatccgggaagaagggcagaggccaggagg

SEQ ID NO: 28384 - DNA, 201 bp, Bos taurus
tctagggactaggggctaacggtgcacccagagtgcacctaggcctgccccttcactgggcgcacttgtctgccagcctgttgtgagccagccgagagcagcagctggagcccagcgccagatcgcccgtccccctctctctgccacctttccaggctctccccagcaccgtcactcggcccatgttgccttcctggtgat

SEQ ID NO: 28385 - DNA, 201 bp, Bos taurus
gaaaacaagaaggctcactaagtgccggacagaataagccttatcactttcgttaccaaattccactgtttagagaccaaaatgtttaggctaacatcgtcccatcatctggccttaatttgatttcacagaccattcttccacataccctgggacaacaaagaaaacattttgaatttctcaaaactctttttccttacc

SEQ ID NO: 28386 - DNA, 201 bp, Bos taurus
actgagttgttagtgacctttgctggaatgatttcagtgaagccagattgccttaagtggttagatatgataacaatgggtttaatcattttttcccccccaaaaaaagcttggctaagaaaaaaggaagataaagataggaatagctacaaagagttgaagcgtcaagggaaaaatgtgtttaaaatataatttgtttgt

SEQ ID NO: 28387 - DNA, 201 bp, Bos taurus
ctcagccccagtcgattctgagttattctgcaggggctctgtggggtcacgtgctgaactaaacccaaaggcctgaattcctttgttaaccctgaaaccgttccaacttcctcaaattcctttagatcagtgaatgatctagaacaaattttgaccttcaaagttgtttggaacaaactggaatctaaaattaaggtttgt

SEQ ID NO: 28388 - DNA, 201 bp, Bos taurus
catcaccaaatgatatagaggagtgtctatcaatctgtccagacttttaaaatattaacttggtaggagttgtaaggtttacagaaacttcaaggctcttcctgctatgaaattaagtataaacagcctaagatagcctggaagaattctcctaagatgaagaaatgctattaaaaagttaggtgtcattgaagagaagtg

SEQ ID NO: 28389 - DNA, 201 bp, Bos taurus
cacttccttcctgacatacagactgtctggctggactccgcagtgttggatactcccggattgggagtcttggctccattcctctctgttgaaggcgtgggatccacctctcctcttaggagatgctacgggtgggaaaccctgctcttatactgaaggtgtcaacacgctttgtctttattcacgtgtccccctttcacc

SEQ ID NO: 28390 - DNA, 201 bp, Bos taurus
aggccacagtctacgggatctcaaagagttggacatggctgagcaattaacactttctacttcgtttcgcttttcatgaactcctcctaaggtttgcagacggtaaccaagggcccctgaatttcacataacagtttcttccagtcataaaattgtatttcaacagagaatgtgttctactcgagcttatggttccttttt

SEQ ID NO: 28391 - DNA, 201 bp, Bos taurus
tagaaatccctataatgctcttaacatactaataatgtcatcccacagatagatagtaaaatattcccaatcaataacaaaggcgaaaacttgacacatgtgatctgataattatgggagaacgtgtatctgcacacctagccaatttccagtgtctaacttagcactaaaagaagacaaatttggaagtttccaaactgg

SEQ ID NO: 28392 - DNA, 201 bp, Bos taurus
tgaaaaggatcaaactgataaggtttcctatattttggatacaaaattatgtggataacacagcagatttttaaaaaatatctaacccaaaatcctagtcattgaagttaaaacatttttaaaggcttatgttataatcaaggctttgatccagaatttctactgtttacaataataaataagctaaatattcctgggaac

SEQ ID NO: 28393 - DNA, 201 bp, Bos taurus
caatattattattatcattctgggcagcctttcacagacgaaacttgactataagaaaaagaagtttttctttattcctcccaaatatcaaaaagtttcaatgccttttagtatttcagcttactaagatttaaattgccaaaatagcaagcacatttaaacacaggcagtcactgatacaactgataaagaatatattca

SEQ ID NO: 28394 - DNA, 201 bp, Bos taurus
taaatgcaaatttctatatacatattacattaagtaattatccattataaatatcttgcctttcattaaaaacttcaaacgttcatatattcatcttttcgaactatagaaccacagtccatgatcatttttcctttttttttgggaaggaacaatagtattaatataatatgttgtactgtagttcccctgtaaatcatt

SEQ ID NO: 28395 - DNA, 201 bp, Bos taurus
ttctttatccaatagagaattgagatagtaaaagaaaacctgagagcatagttgactgttgatgaaatataatcagagatctcattttctactaaaagaattcgtacacactacttgagtttttgcaaagaactgggcatatcataggctttgcttgcaaagattccagaagtcaagctaataaatgcatatgtagctcta

SEQ ID NO: 28396 - DNA, 201 bp, Bos taurus
tcttctgcccacctcattctctctcttttttaattatcaaaaatctgtttattattaaaattcattgtacaaacatttctatcccccaaaatattaattcctctagcctattttctcttctaaaattgctacttagactataaataagagaataaatcatgtaaagcatctgatttccagcattctgttatgggtcacaaa

SEQ ID NO: 28397 - DNA, 201 bp, Bos taurus
caaaaaattattagctaatgtctcttaattcctttattattttaacatccactgatattatatgccagtcttttactagctcactatttattaacatctactgattttagttgaagcaagggcttgttcttggttgcccttgtagaaaaatgtaggtataattcttttgcctccttatttaacagtaaatttatatattta

SEQ ID NO: 28398 - DNA, 201 bp, Bos taurus
catttcgctgccaacagtatttcatccagaatgaatttccttacctaaagctattatagctttgccaaggttgttgtaaatacgtacataatgatgaatcggtacaggttgatatcaaattgttttttcttttacttttaacttttaatgttttactgaagtatagttgagatatcaagttattgtattatcactctgtct

SEQ ID NO: 28399 - DNA, 201 bp, Bos taurus
ttcagaaatgtatataccaggaatggagtttattaacaaggaatgtgggagaaaaggaaagtgggagccaggagcaaaggggaagattttgttcttgatcttattaaatatttgtcggtgtggggattgtttattggtttatttgcttgttcatttatgttgatgggaggagagaatgagcatcaagagtttgcagaaaaa

SEQ ID NO: 28400 - DNA, 201 bp, Bos taurus
gaagttatgagaaccaaatttcataaacatttttctattgatacttcctcaatgtctggtgattcttggttcccgttatacctgaattaggcagtattaacaagttctgatctttataggcgataaaaatcttgttattaaacagactttgaaagagctaaatgttattttctagaaatgcaaaaaatatcaaaatgaggc

SEQ ID NO: 28401 - DNA, 201 bp, Bos taurus
tcctcccaacatttgaataagggaaaatctagtcaccgagtcaatgaaaactatgctgtgctcaccagtggtactttgtgtatttcacgggaaaccatttaaattacatgaaaaaaaaaaaaaaagaacaagaaaacttgtttcatccaaaatcctttcatcttcctgttcactcactgatttatttggtataaatattga

SEQ ID NO: 28402 - DNA, 201 bp, Bos taurus
caccggatgctgtgtcagactattcattattccttcccaatccctcacacctcatggccgccttgggccgctaatggccttggccacagaaaccaccaaatgtgcgcctgatgtttcactgccaatgaactgtatgaaccagcatagctacacaggatcagtgactaaccataggtgacacttgttaatttgtttttagat

SEQ ID NO: 28403 - DNA, 201 bp, Bos taurus
tattgcctgggaaatcccatggacagaggagcctgacgggctaccgtccatggagtcacgagctaccgtccatggagtcacaaagagttggacacaactgagcaactgagcttgaggacagggctgcacatgaaattcatttaaagaattcgatttgaagtttgttgtttgtagagaccatgaaacatggcatagagaggg

SEQ ID NO: 28404 - DNA, 201 bp, Bos taurus
cccagagatatggaagtaactaccagaggaagtaaaaggaaaaaatagttaaaagtgtttgcctctgggaagtagcactggggatggttaaggattcagctggaccattatttttcattatacttctgtacaactattattaaaattcctatgtgtacagtatattagcattgtaaaattattcattctgtatgaaaattt

SEQ ID NO: 28405 - DNA, 201 bp, Bos taurus
ataatgagggggtacgaacagatttttatgcaagaaccaacggtgtaggggaaaatagacttcctagaattgtgctcaattccaggtacaataagtgaagatggggatttatagccaaagatggggagtctgattaaatcgatgtgataggattcttgctgaaggcaggagtgaccagatatcacctgagaggcagtgatg

SEQ ID NO: 28406 - DNA, 201 bp, Bos taurus
tatttgcttggccaaaacattcatctgggtttattctgtaccttgaatgagctttttttgccaatccaggataagatttgaacttaagaaagtgacacacgagtggcccaacacatatccacttggaatgttgaggtggagacaggtaaattccacaataaacacttgcccaaatctttggactaaatcacataggtggta

SEQ ID NO: 28407 - DNA, 201 bp, Bos taurus
tgtcagggactgtcatttgtattctctacccagaaaggggtcttcagaagattgtaaatgaggtgatggtgctggccaaataccctttgtttggccccttttttgtatccaaaagtaatgaaaatggagcttaatggtacataaataaaaataattacgtagacgatagtggtagtggtgcattacctgaattaatacaca

SEQ ID NO: 28408 - DNA, 201 bp, Bos taurus
gaaaggattttcacataatttaacctagagggctgctcttacattttactgcaatatcagaaaatgagatccctctttgttttgattgaagaacatacacgtctagagaagagcttctggggaagtcttctgaaacaggttaagatgtgtgatgtatcaacaaggacttctgaatagattacagtctttctttaaaaagat

SEQ ID NO: 28409 - DNA, 201 bp, Bos taurus
ctaacaaccacccccattctttatatcaaataaaagtgtaagaaagcaagatgactttataaagtaagatcattgaaaatgttacttagaattaagatctaatttcaagaggacaaaattggatgtgaggactagggtttatagttttccagcagcaatgctaagaactggtttttggccaagattataccatagcaaagt

SEQ ID NO: 28410 - DNA, 201 bp, Bos taurus
gctccatatcatttttacaactttggtttataaactactttagggctagtcatagcagatattgtcacatcccttatgttttatgtttaatgttattgctcataaccgatttttttagggaacattgcatgctatgtgtagtgtacaaactttatggacatgagcaagtttttaaagcaattgtgatcatcaaagtatagt

SEQ ID NO: 28411 - DNA, 201 bp, Bos taurus
tgcatttcccagatacctggaaggcattacccatccgggcctgggactcaggaccagtttaagtcaccctccctctgcacctcagccccttccttctcacggtgaagggctctctcgggccttctctatgtctgctgcccaggctgctggcacatggggctggtgtgacagctctgccctgggcctctagatcactcagct

SEQ ID NO: 28412 - DNA, 201 bp, Bos taurus
gttcccccattttatctgcaaacctagcttctccaaaacaggatctgatcaatggattctagtctccatctagtacagagtgcagcccctgttggtcagagcaatcctgacagacatttactggatgctggccctgccaatagttggttttctttgggtcagcttttaattccatcaatcacttgcagacagagttccagg

SEQ ID NO: 28413 - DNA, 201 bp, Bos taurus
caatactccccttgaagagctaattggaagagttcaaataaaagcttagggagtattttttcatgggtcttgtttaatggccatgatagaagacacaaatatttatcccagatttacataaacatacacgtatattttataggtatgtaaatatgtatttacatgtattggtgtggtgtgtgtatgtggtgttggtcattt

SEQ ID NO: 28414 - DNA, 201 bp, Bos taurus
gagctgctctctgcaatggggacatgaccccgtggtgctgaaccacacgggcattttcccacctccctggacctctcggcagcctttggtgtggccgccccttgctacttctggaaacactgttccgcgtgctccctaacgtcatagtccttccctgcagccccttctgcttccatcagcctctgcacccatggtgctcag

SEQ ID NO: 28415 - DNA, 201 bp, Bos taurus
aaattaatcttgagcagtaccaacacctatagaactggattaataactaaaaatgagcccctgttaaggagatgctagtaaaagtatacaggaatagggcaaactttataaagtaatttgaatggttgatgtttctgactcaggtgtcactaatcgaaaacctaaccaagcgatgctgcgcaccttgggtgtgttaacatt

SEQ ID NO: 28416 - DNA, 201 bp, Bos taurus
gatatggcagggagaggtgtcgtgaaatgacgcgggacctgaaagggagccttgaaccaacagagggtcacagatcacagattagaaaccggcctgatagctccattggtaaagaatccgcctgcagtgcaggagaccctggttcaattcctgggttgggaagatccactggagaagggataggctacccagtctggtatt

SEQ ID NO: 28417 - DNA, 201 bp, Bos taurus
tatttattcgtttggctgcagtgcttgtggtgcagttaccctactgagcgtgctacgtacgttttcatatttattcttcacacaagagtaggagaaagccctttcctccattttccttggaggaaatgatggcctcgtagagatttttggactttggtcaaggtaacgcatctaataagtgttagatccaggagctttcta

SEQ ID NO: 28418 - DNA, 201 bp, Bos taurus
gccacaatctggctgtcagctcttggcacgtgatgcaaaggtaaagcctgacctgctaaattattcatcgtgtccttaagattaaaaacacggggaggtagaggaggaaaaagacacctgctcagaagcaagttcttcttctcagaagaaccgtaatactcctagtagtgggagagaaatttctcttgggctgtcttaaag

SEQ ID NO: 28419 - DNA, 201 bp, Bos taurus
ttgaccccaataaagcaaaacctcaggtgctctgcactctccctccccctaccagagacttcacatgtgaggcccaggtgtgctgtgtcatttccaagtcttgtagtaagaaagctttattttttttccaagtttcttatagttattgctgaggggcatcttgcaatcatcttatgaactacatgggctggtccagccaca

SEQ ID NO: 28420 - DNA, 201 bp, Bos taurus
taagctctctaagctcaacaaaggggacaattgtttttcaaacccctgtttacatcatgtttgctgctgttccattggccaaagcataaccatgtcaaaaatccacatgagaaaaaactacccaaggacatggatacagggaggggaaccatgatggccattttgcaatacacacatatcagataattatgttgtacatct

SEQ ID NO: 28421 - DNA, 201 bp, Bos taurus
aattgacttatcttcagtacaacactgaatccacaagaaagagagaacagatactgattagattgaaatggaaaactgagtgtacatttctactctagtgtgaatcacccagaaaaaacaccttaaaagaatgaattaaaaagacacataaaataaccacgaccagagagtttaaaactttgagaaattcatgaatgataa

SEQ ID NO: 28422 - DNA, 201 bp, Bos taurus
atctcggcccaggggagccaccaggagccatgtcccaacggcagacccctgaccctccactgaggtctgaaggttagccctaaccagaggagtgaagcgcgtggcccagaggcagggacccagaggccagtaaatgtgcacaaagtggacacgagcatatcggctgaaggtctcataagccgcttgaccctcatcctgaaa

SEQ ID NO: 28423 - DNA, 201 bp, Bos taurus
tatgctgttaaaagcatttttaaccccatttaaaaatgtgactggtgcagaaaagttaaatccttggaacaaggtcacaaaaccgtaaatctacgtctcaatgcttaaaccaaagatgatcagagattaaggaaactttaaaaaaaattattaacagtgacttcctgataggaaaaattaggaataatgactggtaatttg

SEQ ID NO: 28424 - DNA, 201 bp, Bos taurus
tcagtgtctgcggcccttgcccgcgtttgacgcgtggcctttctcttcctggtagtgtttgactacagctacagagactacatcctgtcctggtatggaagcctcagcagagacgagggccagctctaccacctgctgtccgaggacttctgggaagtcgccaggcagctgcgccaccggctgagccacgtggacatggtc

SEQ ID NO: 28425 - DNA, 201 bp, Bos taurus
attggcagaagctgtcattttcagtgtaaacagttctaggaagcagaccatgaaagaaggcatcatggtgtacaagtgaggtactcctggggagaacagggaagctgggaggactgcccagtcgtgggggcagagtcacatagtagtctcctgccattgagtgtggccttctttttaatctcagattaaagcaacctgaga

SEQ ID NO: 28426 - DNA, 201 bp, Bos taurus
agtggtgcttatttttggaagacaccaggacaactgagtcacccatcgtattttagggaaaaggatgaaacaagaaaccccaaaggaacaggtgaagattcgctaggcagatttctgccttgtactgaaagtcttttgggtcaagatatatgtacgtgcatgagctcagatggaactttcctgagccatggcggggctgaa

SEQ ID NO: 28427 - DNA, 201 bp, Bos taurus
ggaaatgtgatgtattctgtttctgataactaaactgtgatttttaaaatttagactctcaatggcccatatgcctaccttccaaaggagatagaaatgtaatgtatactgaatgctgggtgaccggatggggatacagaaaattaagaggtaagaaaccacatttctctgtctgctacagtggaagatacagagcacagt

SEQ ID NO: 28428 - DNA, 201 bp, Bos taurus
atacatccctagtctctaaacaacacctgtccagagcagaaattgagtgctcttatctgcccgaatttgggtttctcaacagactgatattcattccttctttcattttcagcctggacttcacccatgtgcggagcatgattagagactcactgaattcattgctcatacagatttttttcaacccccccgcaaaaaaac

SEQ ID NO: 28429 - DNA, 201 bp, Bos taurus
tgtccccagcgagggtgcgatccgcccgcgccgcccaggtggccgcatctccggaggcttaccgtcctgggggaaaaaacttgagcagcgaaaaaggaggtgagtgcgcgagggccggggagaaaccaagtttgtcaggacttgtccgggcagccgagccgcggagtttgggagttgcggccgggaactgcggcggattgc

SEQ ID NO: 28430 - DNA, 201 bp, Bos taurus
tttatgttcctattattctatttttgtaactctgttcttggggtccacattgcataccaggagagcaccagcttttccaaaaccttttactacaattaacaaggaatctggtgcagtgttaattttgaataaagtgtgtgttgaatgatagcaccagctgacggggaggcattaatgctgtttgatttcatgcaggcaaaa

SEQ ID NO: 28431 - DNA, 201 bp, Bos taurus
gtgtagatcaagcacctctcatgggtcccttcagctatagctaggggcgtggtcaggtgagcaaagttcgggaagggaaaggcattaaatcaagtcacaatggcctggagattaataataaataagaagtttttatactctcttcgatgtgactgagaaaccatttaagtttttaaaactattcccaaaataattcaaagc

SEQ ID NO: 28432 - DNA, 201 bp, Bos taurus
atatgtagtgtgcactgtatcctctcacgtagtaagggggattaagtcttcgatgttagaggtgaattatcttgtcagcagtctctcgggacatgttaaggcccctgggccttgactgcttctccatctgcgacagttttgggagcagtctgactgtcttgcaaaatgcatggtgacccttcaggagccactgttggttct

SEQ ID NO: 28433 - DNA, 201 bp, Bos taurus
cccaaaacacacatacctacatatatatgcctgtgtatatgagtaaaatgtgtctgtgttcatatctttatcaacttctctaccattgggtcaagaaaacattcaagtttcatttcattcttctactcctgagtggctgggggtgggagataccttttgttataactgggagttgttttccatttctttttattctatttt

SEQ ID NO: 28434 - DNA, 201 bp, Bos taurus
cgatgcacattattaactacaatgtattaatctttaaaaaataaatctttttttctatacctctactcatctgtttgctcaagcactctattgagatggcgggtctattctgaagagttctttcttctgaccctaaggtctgactgcgtctgtagctaagagtggacttcccagaccactaacttgcagatttcagttttc

SEQ ID NO: 28435 - DNA, 201 bp, Bos taurus
atatttattcttaacatggtaaaacttcaggatttgtagtatttacatagctcccaaccatttccattgctgcaagacgtgggccatctataaatctcacgtggtaatcactgacatttgtctttgttattgtcacctggtatcttcatcaatgtcaaaataagagtcttaaaaatgaagctctacaattttactggcccc

SEQ ID NO: 28436 - DNA, 201 bp, Bos taurus
gtttactgtccatatgttttttagcattaaatcataaccagtcactgaagccagtagttggaagtgaccatatcacattttaagtttagagttcttcatgcgcttgaggtgctcagaataaccacagttatcagtttgagccagaagaattttggaggttctcacgttaagcagatagatgccagaatttcaaaagtcaca

SEQ ID NO: 28437 - DNA, 201 bp, Bos taurus
ataagacaatcacctctgtaagaaatttctctgtaagaaatacagagctaattactatgtgtcctacagaatgccactgcaaccagacaacttatggaaaaacagatctttttttattcatgctgtccctttgataaggataacagcatattatttctggaaaaaagtaaattattgtcttcttcatacttgaagatatac

SEQ ID NO: 28438 - DNA, 201 bp, Bos taurus
tgggattctccaagcaaaaatactgcagtgagtagccatttccttctccaggggatcttcctgacccaggattgaacccagaactcctgctctggaggtagattctcaccgtctgagccacccggaaagcccttatacagctctgagatagagaaaaacactggggcttggatagagtggtcagaggaggtctctctgagt

SEQ ID NO: 28439 - DNA, 201 bp, Bos taurus
tttttcatgacacaagctaatgatctggtgctttcttgcatgttgaggttaatagataactaatatattttagcacattcattatggccagttttccactaagaaaaaaactgcatattgggttgttctgctttgacaaatgtggtgctacatcgtgaaggctgattaaaatcaatacttctgtggaaaattacatacaag

SEQ ID NO: 28440 - DNA, 201 bp, Bos taurus
gaatgagtcaaataaacaactcacaggaaacgtagctcattttgctctactgagcatttaggacacttcaggccatgtgtaagttgcttatagaataaagaattgtttcagaacactacagccatgatctcattaaggtctcagtaacctttatttttacccagcattagcccagcatgaataaaagctgatttcaatgtc

SEQ ID NO: 28441 - DNA, 201 bp, Bos taurus
aggatcaaattcaagaacaatagaagagaaatatggccttccaccacccgctttgttatcgcttctgtgaatccacaattttctttgcagtttcctggaaagcagctttgaaagttacactggcctcatgccacatcgataagcatttactaagaactggttttgtgagtggcattatgttaaaaacgtcttggcatagat

SEQ ID NO: 28442 - DNA, 201 bp, Bos taurus
agaagagtctaaaatgacttcatgaattgttctgttgttatcactgggattgccagaggttggaagatactgatgacttctgggcattgttttcttaatggggactatttttaaagtttttattgaatgtattacaatattgtttctgttttatgttttggtgttttggctgagaagcatgtgggatcttagcttcccaac

SEQ ID NO: 28443 - DNA, 201 bp, Bos taurus
tgagattccagccagtgatgaaggcccacagttctccaacagtaacgtaagtgtacaagtaggcagacccagtcttgggaactcgggccccaaattccgcatagcaaagccctgccatcacagaagccagtgcagcaatgagaaaggagaccacgatgctggggccagaatctgctttggccacctccccggccagcacgt

SEQ ID NO: 28444 - DNA, 201 bp, Bos taurus
gaatcttggtacatcagtgttttgtgagagcggttttggaaaattaaaatgccaagtcatttggagataatcatatgctaaaacacaggagtcttaatttattactgtataggcagccaaagtttttgattactgtttgttttgatccattatgctgcttttctttccaaataaagaaatctatattatagattaagactt

SEQ ID NO: 28445 - DNA, 201 bp, Bos taurus
gagatgaaggtcagcttttgtaatatgccggaatcacacaagtgacaagggtggtgttattgtttagtcgctaagttgtgtgtgtctctgtgtttcctggattattagcagccagattctttaccgctgagccacaagggaagcccaataaggacataagctgcttcgatcatgtccgactctttcagacaccatgggata

SEQ ID NO: 28446 - DNA, 201 bp, Bos taurus
gtatccaccttgtttcctgagaatgctgggtgtccttgtgcttctaataaaggctttttttgttgcttctgttatcaatacataagctggccaaatgaccggatgtcttcctcagtgtccagttatcacaggggttccctgggagcctggaggactaaggggaccctgccctgcttgggcccctgtggtcttaccatccca

SEQ ID NO: 28447 - DNA, 201 bp, Bos taurus
tctataatgacaacacccaacagcacagaatgatattgaatcacctaaagccagtatttaaaccataaatagagggaagctgagaaaaacacatgcatttggggaattataattaaactgaaaaaaattcaaataatgcagcttcccaggtggtgctggtggtaaagaacccacctgccaatgcaggacacataagagaca

SEQ ID NO: 28448 - DNA, 201 bp, Bos taurus
gaacaatatttaaatgtctcgagggtttggaaataatttgtgtaacttctttcaaaatgcttatgcctacaaagctattactggcctattcctcatatcctgtggcttttactaggtgtgctaattataagtgaacagagaagccttgctggaggccactcacttctgggggcttagaacatctgatgagagcactgctca

SEQ ID NO: 28449 - DNA, 201 bp, Bos taurus
atgcttgaatctgccctttggaactcagagaaggcctaggagactaaaccttttttctacaaacacgaaatggggaacatggaaagggttttgttcctggatgggccccagagagtcctgtttagtttcataacctcaagtaattcctccaaaacagggattgtttacattattcaaatgggactggaaaccctagtgtcc

SEQ ID NO: 28450 - DNA, 201 bp, Bos taurus
tgggatgagaaagtcaagtgggccgtatcacaggcagttttgtggaaaatggcaggaaatggctgtactaggttgttacgggcttgggatgcaaaggcaaaggttttggcctgtagcacacaggaagttagtggagacccagggaggagatgaaataaagagcatcttgaacatggcaggaggtttaacttgggaaaatgc

SEQ ID NO: 28451 - DNA, 201 bp, Bos taurus
tggatcaatcccaatcccccaatccatcccatctccattccttccttgaactaattttaaagtctaagcagtatagtttgaccaacttacatgaaattttctgcctttagtgaacttataacttttgggcttgaaccttggttagtttgtaagtaaatggtaaacagtgattgatttaatttattgcttagaaatattatg

SEQ ID NO: 28452 - DNA, 201 bp, Bos taurus
cacagtgttcacctacagagaatcatacaaatgaagatgccatctctaagaaagtgggtaaaatctctgtaaactgcacctctggccatgtacaaagccagtgtgattattgcccaatatcgatgccctggggacctgataccatgcctatcctttggcctccatggtattggtctgtgtacagaatggctgggccatttc

SEQ ID NO: 28453 - DNA, 201 bp, Bos taurus
gccttttccttacatttgtatactccaccaattcttgcccttcaaaactcagcatacttgattttaattccggaggcatttggttctaattccagaagccctccatgaaacttgcactgctggcactccaccaactccctagtcaaaactaaccatttgtttgtttctcagcagttttatgattctcgattgtcacatgtg

SEQ ID NO: 28454 - DNA, 201 bp, Bos taurus
caaatgtctgcaaactgttataactatatgaccatatgctatgtggttattacacttcatgcaaactgtaacattaaattacagataaaacatcaattatatatttctgtgcacagttgctatttttatgacaataggtgaaaaagcagaatctatgaaatcttggattcatgcaatgtttcctgtctatgtattggcaac

SEQ ID NO: 28455 - DNA, 201 bp, Bos taurus
gtatgatccctaattcctgccactctagtcttaatcagtggtggaaaaatcatctcagaactattgtctcaattggccatttaaatttaatagtaaaagaacagttaatgataactgcattctgaaaccttcagaagaaaagagaatgttttattggcctttttttttttttttttcttttttctgtgttgcaatgttaaa

SEQ ID NO: 28456 - DNA, 201 bp, Bos taurus
atgaactagttaccagaaggctacaaccaggatattgaagtacctgctgtgtaatgtatttaaacactgtaaattatatgatttctgatttctcacactcgttcaactgatatatgtgagtgtgaattgcatgatatgtgggctgatttctcatgaagaagaaagtagaggagaaagtactattattatagcatcaattca

SEQ ID NO: 28457 - DNA, 201 bp, Bos taurus
gcctcacaaattgaatttggaagtattccttctgctgctgtatactgaaagagactctagaaaaaatcagtattatttcttctgtaaatgtttggtagaactgaccagtgaaccctctgggccaggggctttctgtttgggaagtttaataattatcatttaatttccttaatagatagaaacctattcaggttgactatt

SEQ ID NO: 28458 - DNA, 201 bp, Bos taurus
ccttgagggctgcttaacatgtacagttgctcagaccattgtgtaacactcttcctcccctgcagcctccttgctctgatggattgcagggaccagctagcaggaacttattttccaccctatggaaagctaacaagacatcaggaaatatgtccactcactgtatctattaatctgggatatgatatacttgtttgcatt

SEQ ID NO: 28459 - DNA, 201 bp, Bos taurus
ataagacttaaatgcaggattagagaacgaatgtgccagaaaatgtgtacttcctttcagaatcagagtcaaaagatcctcctgaattctcagtggtgccaaatcagaaagaccttttctaatgatttaagaaaaacagtacaacatctaatttgaaatgacaacctgaggcctgactttcctcatctaatttgaaaatct

SEQ ID NO: 28460 - DNA, 201 bp, Bos taurus
taaatgaatccaacatagtaaacctctatagtcatgtaaaacatcaaacacaagggtatttaatatttcgtatgataatcttctgtcccatgggttagtacgaatcatattttattctggatatggaggatgttttgcagaaagttttaccagctttcaattcagttcagttcagtcactcagtcatgtccgactctttgc

SEQ ID NO: 28461 - DNA, 201 bp, Bos taurus
tgttctccactatggtgtattaaataaagcagctcataaagtgtaaataaaatgcgtaagtgcattaacagtcttctcaaatgctttttaaaggtaaaactttttgtaatcagtattaactaatttctgtaagagcctgatgcagtatgaattcatttgatgttaatataggtgccattttcttctggagggcagtgataa

SEQ ID NO: 28462 - DNA, 201 bp, Bos taurus
atttgaaagttcgaactgtctttagtgtcaacctcttcaatttccagcagatggcgccataacaacacgccaggaaacgtgaacggcctaacaggatgccaagcttgtttaaggtcaggagtaaaaggctgtttgcttactaaatgaaaaatcaatttgagaaatgccattctgtcacgatataaggatgattttggccaa

SEQ ID NO: 28463 - DNA, 201 bp, Bos taurus
ctgtttgatggttagtgtccggtcggtactgttcagagttcgtttccttgcccttgaggttgtggatccattttctgctcaatttctttacattagcttttaagtccgaaagctcagattggttgtctccatattccgagcgggaaggcagcgatccactctcagacttgctcccagaggcataagaccagggctgcagta

SEQ ID NO: 28464 - DNA, 201 bp, Bos taurus
ctgcatcttgctcccttaaaagatcttttgaaaggagtcctgcaaaggtattttgattacattgtgtgtatacactgaatacagtggaaaagttgtagagaaaggaaagaactatgttttctatctttttttttttttttccataagcagtgtgggatagaaaaaggctttacggctttatgactctccagctaatcacct

SEQ ID NO: 28465 - DNA, 201 bp, Bos taurus
atttgagaaaattgctttattccaggaactgcctcatgtagcagaaatttatttaccatctgtgtggactttaaaaattttccatcttaactgatacacaactgaaatagaaacagactttccgtgcgtaggttttccacaggcctcaattttttaaagagtgttagctaagaagcttttgggatttttgtggtcccaaag

SEQ ID NO: 28466 - DNA, 201 bp, Bos taurus
tataaaaattttatttaaaaacatttttttaaaaaaagaatgagtagtaagcttgaaaaaaaattacccaaagggccttctaggcaaggtttgcgtagtgaaagcgttaaaatctgcacacttcccagttcactattggacattctcatttaggtagaaaccttattgtgtttttccttatagttatattttacactttca

SEQ ID NO: 28467 - DNA, 201 bp, Bos taurus
tgaaagcataccagattctctcccaggttttacatttagatttaattcaaatatagtcacagtgccacatatttagattctagagctgagaacaacatttttgaagttccccctttcggtcacagtccctgtattatatttattatttttgtgaagggacagacagtctgacctttcttccctcagcctgcctagattaag

SEQ ID NO: 28468 - DNA, 201 bp, Bos taurus
gacagattctgtaacatgaacattattatgctcgttccacagtcaaggaatctaaggcgcccactgcctgttctctgtgctaacaaacgggtaaagaagataaagagaaacaagtgagcaaataggctgttgtcattataattcatcataacaccactcacagggttcccgcaacaccaagtgtattcaggcctcatcgga

SEQ ID NO: 28469 - DNA, 201 bp, Bos taurus
aaatgttccgtgtctctctataaaagaccctgtctttaaaagtcaaaagctggaagtggctgatatataatacaaccaggaagagtgatttgttaaaaaataaatatatatatataattcctgtaacatttaattgctcctttcatgctgctgtttccaccatgtccctctgtcccaataaatatttagatatggaaatgt

SEQ ID NO: 28470 - DNA, 201 bp, Bos taurus
cccactctaaccagatttgctatgaacccaaccaaaataatacggcttatttctcccatcatgtgacagttcggctggctccctgccacacattcaacacataccctaagtgaaacagtatccatattctattgtggttccaggtaagaaaggaagtacaaggttgccaagagtcagagaagtaccacctcgttagaccca

SEQ ID NO: 28471 - DNA, 201 bp, Bos taurus
ttgactaaccatggatgtttgtctttctctggttggtcccaggttagaagacagatggagaagctgtcagttgtcactcaagttctggccatttggggtttattattatggaagttactgtttggtttcctggattgttgttagagatagcagtctgaccttctgtgcctcccacttcctgggcctgttatggtagataag

SEQ ID NO: 28472 - DNA, 201 bp, Bos taurus
gctgtctcacgatcaagaccccactgaggactattttggcgtttctgcagctgctggcagagcccagatgggtgtaaccacgttgggagagttagtgataatgtaaacagccgactcccgcaaggtaggagggcggaccaggggcgaggcgttttctaaaatcgctaatgttctgtaagaacaaatacacgcggctgagta

SEQ ID NO: 28473 - DNA, 201 bp, Bos taurus
ggatgcaagtgagctgtgttcaccctgcagggcttcctggaagaccaaattgctcaagaattcctcataccctcccgcccgccccggaggaggaaaattcgagatcacctaggccaacccttctgttcacagagatgcaaacaggcccaagtaaagcaacctctcaattggccagccatgtaaaagggaaaagccaggtgt

SEQ ID NO: 28474 - DNA, 201 bp, Bos taurus
ggacttccctcgtggtccagtggtaaagaatccaccttgcaatgcaggggactcaggtttgatccttggtcggggaactaagatcccacatacaggaagcaactacacctgcatgccacgattaccgaagcccgagagctctggagcctgtgtgccgcgaccagagagtctgtgccccgcaacaaaaaacagatcctgtgt

SEQ ID NO: 28475 - DNA, 201 bp, Bos taurus
cttcaagtcaattatccaagaaggtgcacagggctccatagggcccaataccagccctccaaggccaggtgggcccaggatccccgagatgggccagtccgtcagcctgttgctggctctgagaactctatgtctggccatgtccctcacccctctcccagctgccgtgactggcccctccaatgttgccaagaggtgtgg

SEQ ID NO: 28476 - DNA, 201 bp, Bos taurus
aacccactgatcttattcaaatttccctagctttattgatacttatttgtttgcatgcctgtgtgtttattaagttctatacaattttatcatctgaacaggctcatatatctgctaccagagtcaaaatactgaatattccaacaccacaaggatgctcctttaaaccacatccacctccttcctgccctaccccacccc

SEQ ID NO: 28477 - DNA, 201 bp, Bos taurus
ggaaacaacccaatggccatcaactgatgaatgaataaacacaatgtaatgtatctatgtaacaggatattattccacaaaaaggaatgaggtactgataaatgctgcaacatgcctgggccctgaaaacactgttaagcaagtcaccagtcacaagaggctactgtttatgacttcactcatatgaaatggccagaatag

SEQ ID NO: 28478 - DNA, 201 bp, Bos taurus
gataaagagcagtaacaggtgtgaactgagttgctcatggaagtggaagcaaaactactctggtacgctgcaggctttcttccttgagagagggagagtgcgagccatgttcccagttcactgtgaatgtggttgttccagcacagtaaaggcagcgtgtgtgagttactggccgtggtgaaaagggaaggcttatccatt

SEQ ID NO: 28479 - DNA, 201 bp, Bos taurus
cctgatgggaagttatcagtgcttctaccaagtctgtctgctcctgttcccacaacatttcctgccagaatcaagccagaatgattccagaatccattgtgtaagactaaagaagagtgtctttctgctcacatttgacagctggtgtcggctttgatgactgaatcagcaaaacagacagaactcacacttttgtcaact

SEQ ID NO: 28480 - DNA, 201 bp, Bos taurus
ggtttgaaagtctttgtgtagttcctttcttggccacagagacctggtcaggccaccttgcctctcactcagatcatccttcagaactagatatggtgctgatgtttccaatgggaagcataccacttgacagtttattactatgatgcacatatcttcaggttcttgtgtttatgcagttgtgagaaatcagagcctgat

SEQ ID NO: 28481 - DNA, 201 bp, Bos taurus
aagggatgtggcacatgaacaggggtggggaggactctagcaacaacttttttgtctatgtttgtctattagtttcccgagtctggccctgctgataagcgtcatgtcgtggctttccagtgacctggtctccactctactttttgaaatactgtgagctccagtgaatgcaactaggtcttgttgtggcgcatccagcag

SEQ ID NO: 28482 - DNA, 201 bp, Bos taurus
gatgtaagtaacagtatttttcatatgggtgtatcattatataaggttcataagaatccttcaagctaatctcagagttgcttcagagtcagttactaatggtcaaacatgccatccggacccaccagctttgctttgacactagaatgaagatatttaccccagtatccactttacgtgaccgcctctacatcggtcata

SEQ ID NO: 28483 - DNA, 201 bp, Bos taurus
gtgaacccaggctacctagatttgaacccagccttcgttagctgcatgtccttgaataagttaccttacttctctgtgcctccatttccttttgtgtaaagtgagaggaaatggtttacttacattttttgagattgagtggattaaacgatttcatatgtacagtgctaggtggcgctagtggtaaagaagctgcctgcc

SEQ ID NO: 28484 - DNA, 201 bp, Bos taurus
tattgcagcattatttataatagccattataaagcattctaaatgtccatcaacagagaagatgtggtacatacatgcaatgggatatcagccataaaaatggacaaaactgagtcatttgcagagacatggatggacctagagaccgtcatacagagtgaaataagtcagaaaaagaaaaacacaaatatgtggaattta

SEQ ID NO: 28485 - DNA, 201 bp, Bos taurus
tcccctgcattggaagcatggagcctcaatcactggaccagcagggcaatccctactttcctagttcttcttaacggctgtgttttccaaatgttctgttttcatactaaataattctgaatcaatattcttaataaatatgcaatttgaatttgaaaataaataaaagagaagctgatatctctaggtaggttctagaag

SEQ ID NO: 28486 - DNA, 201 bp, Bos taurus
tggagggccgggtgggcagaggaaaatcagaagcaaaactgctgccatttcatcaaactttaaggtttgatactcagatggcaaacaaatgtaatacaaatgaatataatgcattacaaaaaaaaggaatatatttctaacaattacaaaatatgttagagcagtataaaagtagaggatggtctgcatcatacataacaa

SEQ ID NO: 28487 - DNA, 201 bp, Bos taurus
gactggcctttggccctctagaaagctcagcgattcacactgagtcacttccttccagttcagctggcatcaaggacttgttcctaatgacggaaggaaatgttctgtgtccagtggggcctttcagagcatagtcgagcaggagtaaataaagggatgcagggtttgaatacaggttccaattcgaagggcttttcctgc

SEQ ID NO: 28488 - DNA, 201 bp, Bos taurus
tgtatactcctgtgccttttgatgagaaacattaaacatttttaatttagtacatcaatttgaaaatctaatttttttttaatgctttgtagtggcagacgtgttcacggtgctgtcacgaccatcgaagaattatgagaaacttgaaccgcaaaaagtaaattagaaaaatctcatttcagttactctaaaaagagggga

SEQ ID NO: 28489 - DNA, 201 bp, Bos taurus
gatacaagacttagtgattagggaataggattttaatgtccatacagagtaaaagatgtagctgtgggtccagatgagaccaattgctggaacagacatcagcaaagagctggggtccctaagagctgcccaggttgttagctgaatgagaaaacattgttaagtcccaagaaatggcatggaaatatcccctttatgttt

SEQ ID NO: 28490 - DNA, 201 bp, Bos taurus
aaaatgataatgttaaaacctctaagtacaactgtggactcccctatttctttagctatgtcacttttgctttttcgtttttaaagctctattatttggcatcaataattatgatctctgtgtcatcttgatgaatattccccttagcattagagaaagtccctctttctgtctggtagtattttccgtcttgattatttg

SEQ ID NO: 28491 - DNA, 201 bp, Bos taurus
ttaagtgggtggagttacaaagggctgggaactgtaaaatggcataactcacagtccaaagatttgaacttgagccgcttggctggactggtattaaagcgcagactgacacgccacacagagtgccttcctcacgcagagaggcagttctgaaaaggacagtttgctggggatgaggagggggaggtgaggccaagtcat

SEQ ID NO: 28492 - DNA, 201 bp, Bos taurus
ccgggagatggtgagggacagggaggcctggcgtgctgcagtccattgggtcacaaagagtcagacatgattggatgactgaacaacagcaataaccatagagaatcattggaaccatggcccaagagaaaccaggcaaaaaggactgcgaggccctttagggatgtgattttggtcattccactaggcaggttaccagaa

SEQ ID NO: 28493 - DNA, 201 bp, Bos taurus
attattagaaactgtcatgaacagttcaaagtaatgagattgtcttataagggaaataagataatcacaatgtagaatgaaaaaaaaaaaagctttatttacatgtgagtttagaccatctctaccaccttgaaacatgagaggaatcaaagctctgaaagtttgctttgtgggcaggactgagtacttagcacagagtat

SEQ ID NO: 28494 - DNA, 201 bp, Bos taurus
tggttggtgagaatttcatttgaaatcctttctgtatcttaaaaaaatagtatatctctggggtacaagattattcttccatctgaagcttcccttttgacttcttatatacgtctctctgtttttatatgctcacttttcaaaattataaaagttaagtggcatttttagtcgctgctttaaagttattacacatgaatc

SEQ ID NO: 28495 - DNA, 201 bp, Bos taurus
aaatgataaatataaaactgctaaaattgtgtgttattttatcttttcagttgtaaaacatttcattgtgttttacagtattaccaatgtttaaatagacgcagtagtagtttctatgcttctaaaaacaaatagaaaattatgaacttttacagttccaaaaagtgctggtatgttgttgttgttcattcactaagtcat

SEQ ID NO: 28496 - DNA, 201 bp, Bos taurus
ctccctctgtgtatatatttcctgagacttaccatttgcccccaaggtaaagtgtattgagaatcttgtcctttggtcaatttttttctatgagactttagtagtcttctcaggttgtttagaattaatgaggcaaatgtcctcaatcaagaagcaatttaagaacatgctgctaatttcaatgagttctgtaaatgaact

SEQ ID NO: 28497 - DNA, 201 bp, Bos taurus
gaagtcgtgtctgactctttgcgaccccaagaactgtagcatgccaggcttgcagcacacccacattttgccaacagattaagaatgtaggaagaaggaggaaggaaatgagggaaggagagggaaagagaatatgaatgagaacgagttctgagcaaccagaaggatagagttgccatgaaatggggaagattgggaaaa

SEQ ID NO: 28498 - DNA, 201 bp, Bos taurus
aaccttgtaggtatctgcagttgtcatggatccctgagtgagatctgtacaggttgcagagacagcaagtgattcttctaatgaaaagctgattttctggtcccaagtgctatatgggaccccaatctggagccaaacctgggcatctgctgggcatgaggattctttgtgtcttgctcttcatgctgttcatgatcttgt

SEQ ID NO: 28499 - DNA, 201 bp, Bos taurus
atctaaagttataaattcatcccatggtggcaaacacaccaaaatacattgtctctgcaggaagagtgaagttagtatgccctcggtcttctaaatacacccattacataagtgagtcctcttctttgaggaagacggtgataaaaagctcttgtcatattttctcttgtggagagtagagtagaaatctctttcatctgc

SEQ ID NO: 28500 - DNA, 201 bp, Bos taurus
tgactaagtgttgtccttgtgccaatgaacagtattttctccttctagatttctactggagtgtgatgtgatgtaaaaaaaaaaaaaaacatagcagctttattcataaggcacaccaatccttatgtagagacaccagaaaatgtcacactgtgctggcttcacagtctgcatcatattagctaagctagtggtcataaa

SEQ ID NO: 28501 - DNA, 201 bp, Bos taurus
tcctggctgagtggcaccaaaaagaaaaaaaaatgtaaaagcatgttcctccattgagaattaattgtaaaatgataatatgggtcttgacttaaatttcatttattcagagtagattgttgatgtagtgatttttttctggaccactcagatgcttcaggagaggagtttgaaagttgaattctaatggtgtgatggtta

SEQ ID NO: 28502 - DNA, 201 bp, Bos taurus
atcaagacataggcggtaacgtccaagtcaaggctgcctgcctcagagtgatgtgggactctatggaagctgggaatcgttcttctgtctggaggggtacactggtggagcttagtccttctcaggatcatgagaatgataacagggcctggagctccctttcatttttcctctgttccactgtgtccacagggaaggtta

SEQ ID NO: 28503 - DNA, 201 bp, Bos taurus
ttttttttaattaatcccaaagctgatggtcaaataagttattcatttcttagaagagcatatggcattttctagagaagaatttatttacacaaccaagattataaatcccacacctacactctttcacagacatcatatggtagcatgattttttttttaaggtgcaaaatgtaaaaacagattctacaaagcaaaact

SEQ ID NO: 28504 - DNA, 201 bp, Bos taurus
atggggctctaataacattgctgggcagttcacattatagagattcctgttgagatcttccaaaccctgtaagaggtggccttggaaatttaataatttaccagtttgtcttcaggttcaagctaaaggttgaagcgtttttaggttcaagccatgggcaagtaaaggcatttgttgaaagtgctgggaactggccaggaa

SEQ ID NO: 28505 - DNA, 201 bp, Bos taurus
ttttgggtacaacacagacacgttctacggtccttcaccccaggaacataccagggggtgtccatgcccctctttctccacacacctcctgataccggccctagttccctacctgcctgccttctttctttaattcttacaaaatctgactcatcaccagaggaattcagggtcaccctgaaatctgtaagatcaccgtgg

SEQ ID NO: 28506 - DNA, 201 bp, Bos taurus
cctgtgccaccgctggccatcttacagcacccttagccaagagcatcatttgtgcctgagatcccaaggatctgtgggtccacaggggagcactggaatccacccaggtgacaactccggcctgcacaaacccaaataccgactccgtttccatgggcactttggccggacggtactttgttcaccattgcatttgggaga

SEQ ID NO: 28507 - DNA, 201 bp, Bos taurus
gggaacaggtcagccgatctgaaggccgcagggactgccacgccaggaaagtggcggcagtgatgacaggcaaggggtgccgcccggtcaccagccacgtttcatcggccagctccaccaactgcagcgttcgcgacagcatcttctccttgtcttccacgtacttggctggcacagatggggaggcttcaaacagcttga

SEQ ID NO: 28508 - DNA, 201 bp, Bos taurus
agtactgtaaacttctctgaaagtaacatccagaggatgaatagaagttaaacggatgaagaatggtccaagcagagaaagcaatatgtgcaaaggccccgtggcaggagagagcagcaacgggaggcattgtaaaaaggggctaattgactggatctaaagaacaagaacaatcgtagcctgcaaggaggctggaagagt

SEQ ID NO: 28509 - DNA, 201 bp, Bos taurus
ccatgacgctgcagcagaggccagatgggccatgttttctcaagcgacgctgccagctctccaaatgtcataactggcgaggcatttcacttgggggcatgctttggggtcgagggtggccgggaagcattgacaagcctatttttattctctttagtctcacaatacatttcgttcttctttattgaagttataaaacta

SEQ ID NO: 28510 - DNA, 201 bp, Bos taurus
cacctcccctcttctctcccgggggcaggccatcctggcctcccgcactccagggcagacaggactgtgccgagctgcccacagctctggcaggagtgccggagacagctcagctaagtggcctgaactaatgacttcaagacctgcggggctggcccggagagagagctgggcttcggcttgcagggaaaaaaaaaaaaa

SEQ ID NO: 28511 - DNA, 201 bp, Bos taurus
cctccgctaagggtgctcgtccttgtgggctggtgttgggaacatccatcttcagagaggctaacacagaggaagcttctgcagttgatgtcgcagcagcggggccagttctcaggccaactagaaaaagatggatgctggcctttgactccacccacctccctgctttgtttgcgggtcctcctcttccacacagccagc

SEQ ID NO: 28512 - DNA, 201 bp, Bos taurus
ggcaccgagaatcaggggaagaatgactgtggccctgtgaccagctagatggtgtccttgtcccctgggtgtgagccttgggcagagcagagagtccccgctgagagctaggggtgggccagagctagttcactgtgcttcctaacctcctggggaaactcttgtctctcttcctagtctgcttcaagaaatgaaaaggca

SEQ ID NO: 28513 - DNA, 201 bp, Bos taurus
tcaagttgggacaaaagaacttaactcttaagtgcaggatggaaggaaaagcaggcttaatagcagcatgtgcaaaaagcaaatagaggttttagctaaggataaattcaaggacatcagtaatataatgtagtttccataagagctactgtcatcctgggtttcatagaagtataatatctcagtgaagtaaatgacagt

SEQ ID NO: 28514 - DNA, 201 bp, Bos taurus
ccctgccagggagatggtaccctagcaaatatcccaggctttgtgttgggacccaggggcaagggtgaatcagaccctcgacttatttcctacaggtttgattgttttctttcactgtttgcctccaatttaaaatagcataattggtaaagaatcctgcagtgcaggagacgctggtttgattcctgggtcatgaagatc

SEQ ID NO: 28515 - DNA, 201 bp, Bos taurus
gtgctctgtcagttaatttctcccctccccacctgcaaccatggatcttctatttttttcccccagaatgtcatatagttggaatcatacagtatatagtgtctgcaggttggcttctttaatttagtagtatgcacttaaatttcttccttgtcttttcatgaccttgcagctcatttctttttagggctgaataatatt

SEQ ID NO: 28516 - DNA, 201 bp, Bos taurus
tgattatcacaagacttataaaaacattttatagtgataacaggctatttaagataacagcttcaatttcatataaaattctacgcttttacttctttcctcccacatctcatgctattaatgctgttataacattttttgatagagtgcatccttgaacaaattgttgcagttctagttatttttaatgcttttattttt

SEQ ID NO: 28517 - DNA, 201 bp, Bos taurus
tttttacacaggccggggagatgctagcaatgaggagtggccataaatacaggtgaagcttcactggatcatctgccacttacctcctactatggagcccggttcctaagaggccactgacttgcacctgtggcccaggggttggggaccctgcattaatgtgctccccattcatatctttatattgctgggtattcctct

SEQ ID NO: 28518 - DNA, 201 bp, Bos taurus
tgatgcttaccagtggcctggtgcccaccgaagcaagacctgccttgtccacgtgccatggcttctgagcaccatggctaagctgactgcaccccagaaatgggctggtgcagaaatctggccatttactctgttcccagcagctgtgggcagagggccttgatatcctcggagcagaactgagcaggaacatgtagagca

SEQ ID NO: 28519 - DNA, 201 bp, Bos taurus
ggggagcaaggaggaggtgagcgggtctggagctgagggaagtgggtgagaagcaagggaggggacaagagagctggaggcaggacagtgaggtgggtgcagggcctcacgactttcatggtgagaaagatggaaacccatccttgtgctctggacctaggagtgaccttgtccttgaggatttagtgaatttaaagaaga

SEQ ID NO: 28520 - DNA, 201 bp, Bos taurus
tggccccatctcatagggcaacacccctgtgcttaaaaatgagaagactacggtcagagaactggccttgcatttgaggataggggccactgctgggttcggggcatggggagaggagcgaaggggattttgcccatcttgagcttctgtggactgttttacaattgaagggggggatttgccatttcatgcggccctcag

SEQ ID NO: 28521 - DNA, 201 bp, Bos taurus
tttacactacttcttcccatcattaaatattctttgagaaaatcatttttaatgaatggactgttttccattcttaagctgggccatcaattatttaaccgatcccctattcgggatttttaggtagtttctaatattttttctattatgctaatgactgagatgaatattcttggccataaatcttgtacataaatttta

SEQ ID NO: 28522 - DNA, 201 bp, Bos taurus
ggagttggtgatagacagggaggcctggcctgctgcgattcatggggtcgcaaagagtcggacacaactgagcgactgatctgatctgatctgatctacattggctcagggccccaggtgaacagagatatctgagatcaggtacctgagatcagatctctgagatcaggattttccaagggtttagagtttatctcccag

SEQ ID NO: 28523 - DNA, 201 bp, Bos taurus
tctaaaacagagctcctaagcccaagacatccacacacttacggcacagcaactgggtacttggagtctgctgaaaaagacagattctaggtttgcacaagggtctctgtcatttacagacaagatgccttagggagcccttggtgctaattcacagccacccaaagccaagggtgacacaggatgctctacaaataaaat

SEQ ID NO: 28524 - DNA, 201 bp, Bos taurus
ctgaaagcagaggatttccagggaagccaaaggcaaggcacgatcaggataccttgacaagcatcctctgtgagcatcccgtgtatgaggctccagcgccgaggccagtgccaaaccgcagggctgaaggaggcaggcgggagatcacagcacagccgccaacacgcagatatagggtctggagttggggaggcaggcgag

SEQ ID NO: 28525 - DNA, 201 bp, Bos taurus
cacacacacacccccgccccctcagcgtcctggcccagcggctggagaagtggctgcagttgatgctgatgtggcacccgcgccagaggggcaccgaccctgtctacgggcccaacggctgcttcaaggccctggacgacatcttgaacttgaaggtgagcctgcgcccagtctgccccaggccatgggccccctgacccc

SEQ ID NO: 28526 - DNA, 201 bp, Bos taurus
cccagaccagcagcctctgcattgcctgggaacttgttagaaatgcagtctgttgcattagaaactctagggcaggacatggcatgctgtgttttaacacgttccccaggtggtgctggggtatgcagaagcttgagaaagcttcctctgttccaaaggaagtccacaacagcattgttataatatcagaaattggaacca

SEQ ID NO: 28527 - DNA, 201 bp, Bos taurus
tcccctctgccccggcccccagcagcagcctccatctgcaaagcctggcaccttctattccggagcccccacagcagaactcctgcctcttcgtcaccccaaaaaggcagaggccccagtgcccgtctgtggctgggaaagctggggcagagggaggctgccaagagacgcatgtccagaggcatgagcgggaggaggagg

SEQ ID NO: 28528 - DNA, 201 bp, Bos taurus
taagaaaatgtggcccatccacgcaatggactattattcagcctcaaaaaaagaaggaaattctgacacctggtacagcgtggataaacctggaagccgttacacaaactgaaagaggccaggtatgaaaggacaaatacgacacgattccacttctgtggggatgtagagcagccacagtcacagagagagcgcggagca

SEQ ID NO: 28529 - DNA, 201 bp, Bos taurus
agcgtgtttggtattctcaggcctcctgaacttggagaacctctgtttcagccattgaacataaagatcaggagcaatactcaagactgtgaatgaatccgttcccgaagacatctctcctgcccttttatgatcctcccctcccacaatggcaacccactccagtactcttgcctggcaaaccccatggatggaggagcc

SEQ ID NO: 28530 - DNA, 201 bp, Bos taurus
cacctggccttctctcgaggtttgctttactcgctgttggagcagagggtctgaagtggaaggccttaaccccctcgtggcccatggctctgtcccaagcccacttacagacttaatctgggtagctcttaattcaggctgtacttctgaaacactcggggggctggaggactccacgacacacccaggtggccacatccc

SEQ ID NO: 28531 - DNA, 201 bp, Bos taurus
gggcttttccagggaagggcctaggtgagaaggaccaccaggctgcctcccctgccacttcaggggttgtgagacaggccccagcgactcagtctttgatgtgaggcaggcgtgtcaagcttgtctttaccccgttgatgtgtggtcactggccccaccatagagacgacactgggctcaccagagagcataaactccagt

SEQ ID NO: 28532 - DNA, 201 bp, Bos taurus
tactaacaggatggtcaattccaaagcgttagctcagaagggcagtttggggtacaaatgctcctgagtgaccaggccgggccctggtttctctggattcctctgtgtccctgtgttttcctcttcttgatgtgaggtttgagcctactgaacttacttcttcatgtcgcttggcctcctggcaatgctgatgggcagaca

SEQ ID NO: 28533 - DNA, 201 bp, Bos taurus
tgatgtcaaactcatgaccattcagtgtcttttaagaggggcccatacttggagagggtttactttggtaagattttggtgggccatatattttcttatagaaattaacgcttattggtctataataaagactattattcctaatatttaatgtgctagttaagcttaaattacaggccagatttttgactttcagaatgt

SEQ ID NO: 28534 - DNA, 201 bp, Bos taurus
actgctgccagcatgagtgccagtcattagtacagcagagctgggtggttaagagagagtattggggtaggttatatcattttagcaccccagatttagcagtactgtcctttaggccaacttgaagtttcagccgcatcacctgcattgtcagactgtgaaatcttgcccggcaatgagatccaattccagtactgaatg

SEQ ID NO: 28535 - DNA, 201 bp, Bos taurus
tggtaattataatggaatgcagggcctgtctcatactgttgtgactgttagggataattgttctgattggaatgtttgggaacctagaggtaaatggaaccagtggaaaactggtctttacccaaaatgttatctctactggttcgtcttggagcctgaatgtttcacttgttactccctttctgaccaaaccattgcctc

SEQ ID NO: 28536 - DNA, 201 bp, Bos taurus
gggccgggacagtggtgggaggactggaccctgaaatgggaggaagtttcagaagaagaactgagatgcagtagagagtggggtaggcggaagcataggcattggccggtttctcagctaaaagtcggaagcgatccacaagacggtgctgcccaggccaggccgtggtcagaggcaggagccagggcattgttgtcaatc

SEQ ID NO: 28537 - DNA, 201 bp, Bos taurus
agcctacaccaggcagatgctccgagcctctccaacccccactcagccaggctgcccctcctcccgtcccagcacaaacaggctcatcatgaaggttttccgtgactccttaggaaaccgaagacttaacaaagatctcatgcctctaaggtgcatatccctgcctgtttgcttacaactctctctgttgcatgccccctg

SEQ ID NO: 28538 - DNA, 201 bp, Bos taurus
ggccaactaggccctcctcacgctgacgccacagtgatgtactcagctcctcccccttcacactccagggagccctaacaccttgccatgagtgttccacggtgcaaggcctagtggaagctttgtcatgcacatggaacaactcagttcagtcgctcagtcgtgtccaactctttgagaccccgtggactgcagcacgcc

SEQ ID NO: 28539 - DNA, 201 bp, Bos taurus
taagctttttctccaaggaaatattaaatatgttttttagattttcttctatttctttctcattcagtgtcttaaactctaccaaatctgtattgtccttataattgaatctcctgtaggtgagcgtgaaacccactaagcaatgaacaccttctggggtctgcaaggagcaaaatgacttgcttgtaaacacagatgctg

SEQ ID NO: 28540 - DNA, 201 bp, Bos taurus
tgaaatgctcttagaaacattaacacacacattcagttatttccctttttttttatgcgcagactgcaaacagaatggtgatcagtaactcgacacagaccgtgtcttctgtatttttaacatgatcctttcagattatgacaccgttctcatctttattagtatcattgcttcttgaaaacctgtctttgaatagtaata

SEQ ID NO: 28541 - DNA, 201 bp, Bos taurus
ttctcttggccagacaccaggcacaggttccacctgcacccaaggggagttgacaaaaggatgtaaatcattgagaatcaccttagaattcttccttccacggaggagaaagttcagagatgatggaaatctccgacgtggtgtaaagctcagggtgacaaaatatccacccagtgtgaactcaggaacaacacggcctta

SEQ ID NO: 28542 - DNA, 201 bp, Bos taurus
aaatgcatcagagacataaacagagaacaggaatgaagttagaacacacatcacagcgtgaacttgtgacccgcaatgtggccggcagcccatgggaagcagtcagccaggtcagctccacaattcagaatgtccaccggaagggaagcaggccaaccgctcgggaagaattgtgtaacttacagcgtttccttttcccca

SEQ ID NO: 28543 - DNA, 201 bp, Bos taurus
agagcttggtcttcaatgggagacaacattttatgtcctaactctacagtgtctgggaggagaaggaaattttagggcctccaaatgccctcatttgatttattcagattgggaaagtatttgtgaaacatagacttttacatagatctcatttcagtttcagcatttgactattcacacgtcaacaatgcgcataaatct

SEQ ID NO: 28544 - DNA, 201 bp, Bos taurus
ataacattgtaagatgatgccttttaagaatatgggctacaaaatcataccacctggtttcataactcagctttttccatactaactttgttagcttaaagtcttcaaacctcagtttccttgctataaaaaggaaatcattattagtagtgtctacttcctggaacttctttgaggcttgagagtattcatttaattcct

SEQ ID NO: 28545 - DNA, 201 bp, Bos taurus
aacggcatgtgggaaatttgctatgcaatgtttttctactccactcgattatacgctgtatgaaggtagtgagtcatgagtcagtctccacctctggccatgctcatgctatcagctagcccacagcaagtgcactggaagtatttgcgaaatgaacatcaaaatacaaatcccataaattaaagtcagtgttcatgcttc

SEQ ID NO: 28546 - DNA, 201 bp, Bos taurus
aaccaaagacaaagatcacggcactgaattccatggctgtgtagaagccacatggcctctacaagtaacacagtctgtaaacacaggttcagtacatgcaattgtgtgttatccttagggacagtggggtatatagcttacctgggaacttggaataagttaagtgattcttatacagtgataaataaacatcatgctaac

SEQ ID NO: 28547 - DNA, 201 bp, Bos taurus
accaagaaatgaaaagggtataatgaagtataaggaatggggtacagggcaatggtacaaagtaaataaacaacactaaggcaaaccttggtaaggccaaaagtcttcaaagacaaaacaaaaaacagacaggcaaccacagggatgaataaaaagccaaatatatcctgtgttggaaactgaacactgcagcgatgacca

SEQ ID NO: 28548 - DNA, 201 bp, Bos taurus
ctcacgctgaaaagacccaaactccccaacggttatcaaggaagggcaaatttggaggggagggctgccgagtgtctgaccttcctctgactggttggtgaggaggtaacagggtgaggttccaggatctcaatcatcagccttctgggtccagccagttctgagttcacatactgtgttcagtcccaagtcaccatcctt

SEQ ID NO: 28549 - DNA, 201 bp, Bos taurus
atctctgattaaggatgctcactctccaccttaagggcctaaagtgttagttacttgtgacatttaggccagtgcgggcgagggggaatgtgcacattaccgagtcacaaatagtatttccacgtcttctcaggaatctgcccaactgacagctagaatcgtgatctacatttaatgctcatgttatttggtcctgctgct

SEQ ID NO: 28550 - DNA, 201 bp, Bos taurus
cacttgctccctccctccgtggttcgtgcactttgcttccacggttcttgctccctaaacatccttttctgtctattcaggcccttcctaaccttcaagcgcagtgtctgctctgactctcagatattcctgcagatggagctctctgtgccagtgaatgccttgtgtagtgtcctgtccatcacaggggggcccaggtgt

SEQ ID NO: 28551 - DNA, 201 bp, Bos taurus
aactgttgaagaagggacagtgtccttccattgtctatgctataagcttcactacatcaagaaatacctgccaggctgtagttggctccccttaactccactgtttttaaatactgtatggatgcagatggtggccattttaaataagagaagacataacgcaaagtgtagaaacagtggaaataaaaaggcactaataca

SEQ ID NO: 28552 - DNA, 201 bp, Bos taurus
gaaacgcccgcctgcagactcagaactgaatggccagtcgaagctctgttctctgctttagtgaatttcacaccccgcccctggatggcccgtttctctcttccttcctcttccttcttgcctttcaagccctctgtgagtggttgcagtgactagaaggtcagacgagtgggggcccagactctgacctggggcgttcct

SEQ ID NO: 28553 - DNA, 201 bp, Bos taurus
aggtgcctggaaactgaggccttccacgacctacaagaagcagcattttgacatgtgtcatccgaaggtatggacggcaggaggctgcttgtcaaagaagtgtggccctaggtaaacagacctgtgctcatcctctctctgccccacagcctaggagtcaggccttgggaagggagagaggaggggtcagaaccagacctg

SEQ ID NO: 28554 - DNA, 201 bp, Bos taurus
cctaaaagatacaagtcttgcataattctttccctgtcatttaaaacgaaacttgctttactctgaactgaggggcattaacgagtcctttttcatcacttcgatctttatctttaaatgatcttaatttaagaaataattaaagaggacctccctggcggtccagtggtaaggaatccgcctgccaatgcaggctggatc

SEQ ID NO: 28555 - DNA, 201 bp, Bos taurus
cgcatcagtgatgctgcactgagtgtttaaaggtgcagcagatacgcgcgccctggtccctgcacactcatcggcctgcactcttcctcaggcgtgtggcagacacagcaggggtacacatcttccatcacccttgagaaagcacagccagcactgggaacagctgcccagcagacaaacctgtcagaaacacccttccta

SEQ ID NO: 28556 - DNA, 201 bp, Bos taurus
tggattgtttccatgtcttggctatcgcacaatagtcacctttcagctgcacctgtatctcccttactaacatgtaagctcctcaagggtaaggtttatgctttccgtatcttttagtgcctagagtagtaccctgcagagaatgtcataaagcctatgttaagtgcacagaaaataatatggcacctggctacaaaactg

SEQ ID NO: 28557 - DNA, 201 bp, Bos taurus
atgcacagaagaaaaaaaacagaagaggaagctaaaagggagacagtcatgtctggtcgctagctcgggtcattctttgttgtggggctgttctgagtattgtgggatgtttacagcatcctggtctctacccactagatgcgagaagcactccccactcttatctctggttttgacaatagcaatggtctccagacattg

SEQ ID NO: 28558 - DNA, 201 bp, Bos taurus
tgacctcagtttatgcagcgctccaggcctgcagcaatgacagggaatttaacagtatcttttggaagaagcagttcaattcaataactccccaaatgcctgctacctgcttattatagtcttctttaccccttggaatctttgccatcatacctaaaaagccaaatttgagatcactatgcaatgctcactactaacaat

SEQ ID NO: 28559 - DNA, 201 bp, Bos taurus
cacagcattcatggcacgaacagctgttgttattccgaatctctgtggtttaccctgttgtatatctcaaggagtttgtgtagtaacaaagctgtaatgacaaagttgaaatctgtcatcaaagtgtcctctaaattttctaagtctcttttaaactaaagccaaacagattttagtcttcatcaccttttccgaaaagct

SEQ ID NO: 28560 - DNA, 201 bp, Bos taurus
aataatttgggggccaactggctgttttgcaatttcgtgatgacgctgatgattcctgtgtttgtgctggggctttgctggagaattccgtcctcccttccgtcatctcctgaccttgaactggcctgcaacaggctatagaaaccattttgagtttctgcaaaagagagttaggttaaaacctcaagcacgggttggatt

SEQ ID NO: 28561 - DNA, 201 bp, Bos taurus
gcctcttcttccctggccaagtcgaagtgagtggagtgttcagctaaacttagaaaccacattgagtaggaaagacagtctggaggagaaaatgtagatgctgcaatgtggcctatatgagagccatgtcatatattattgtaaatggaacaattctgaagtagctgctgcaaaagtcacgttttgttgaagttgagcaca

SEQ ID NO: 28562 - DNA, 201 bp, Bos taurus
agtcatgattttgtgaatggattacgtggaggacttgtgaagaagtgcttcaaggctggggataaatgtcaaaagcatcccagtggagattgctgggtgtatgggtcatatgcacagaccctctcactcaacaacaggattattgtccacacaacttatcttggaggtgtcttgttcttgggaagtctttttctaccagaa

SEQ ID NO: 28563 - DNA, 201 bp, Bos taurus
catgtgggcctgctggccctctcccttcccttctcattgcccatcgtgtgcttgcacactgaggctaaacttgcagtcagcaagtctcattctctaactcgatggaacctgccaagggccctttaaactctgggtatttccgtacctagcgtcttattcctttgtggagacaaacactcctttttgggtagctcttgtgtt

SEQ ID NO: 28564 - DNA, 201 bp, Bos taurus
ccagcccagataaggaaatggcaacccactccagtaccaggattcttctgggtaaagtcccatggacaaaggagcctggtgggccacagttcatgggatcgtgtccaactgagtaactgaccacagggtgtttctaaaccaatggttttgctcttttctagcaccccatccagaacaccacttttttttttctctattgtg

SEQ ID NO: 28565 - DNA, 201 bp, Bos taurus
tatacataacatacgtgtgtgtgtgtgtgtgtgtgtgttcagtgttttgaaaagatcctggcctggagtaagtgtacacagtgagtgtaagataaaggcccgccattgcttttatcacttattattactcttgacttcaatctaattctctttcaggaactagaaagttttccagctacccatgaagagaagaatgagagt

SEQ ID NO: 28566 - DNA, 201 bp, Bos taurus
ctgaaatggccatatggccaaagagaaccactgttatactcattgggctaagcattcttattctggtatttacaaacctctaaactagcaatgcccgaagtggcaggcctactgaagcccctgcataatcaaagtcttgccttccatgggctctgcgtgtgtccttggatggccattgcagtagctgtttcatgactactg

SEQ ID NO: 28567 - DNA, 201 bp, Bos taurus
ccagagcattggagcttcagcatcagtccttccaatgactattcaggactgatttcctttagcatggaccagctggatctccttgcagtccaagggactcgcaagagtctggccttcagtgtatttctgtaaattcagtatattaacaatatacttgtttctcttcctccactgcatttttcttcttgctgctaagtcacg

SEQ ID NO: 28568 - DNA, 201 bp, Bos taurus
ccagggcggcagcagccaggctttcatcgtgaagcgcgtacgggcgggtcgctcacaggaacccaccgccaagcaagtacctcgtgatgcgcatgcacagcgctgtacgcgatctcagctgttaaacacaggcattatttacaaagcgagaggtgagagagcctgaacactccgtcttggctaacttgctgtctccccaca

SEQ ID NO: 28569 - DNA, 201 bp, Bos taurus
gatacaggcaggaatgttagaatgattaagctgagtaaggacagaaaagcgtgacctgggtgaagaattgaacctgtggaagctgcagattctggccttgcgggctggaggcttcgaggcttgctgtagtcaggaggacctgtcaggacggagggtggcgtttgcagtgcagaatgtttgaacctgagattatggtggcct

SEQ ID NO: 28570 - DNA, 201 bp, Bos taurus
ttgacccttaagtaacatttctttttgaaagctagcagccttctgccttggacatggaggttaaatcctaattatctccacagagagagatggttgggatgttctgacaacggggtggaaagggctgagaggggagtttatctagtagaagccatggtccctgtcatgcagctgcttcctctaatcagaatcttttgtttt

SEQ ID NO: 28571 - DNA, 201 bp, Bos taurus
attttactgctctgctgatacaacctttatccgtatgaatctcatttctagagaccagacactgagggcatgatatcttgtgtaacagagagaagtgtatcctcctgaagccacagaaatgcacttcagagggctctgaggagctctggatctgtgtgtctctgctcagaaagaattcagggagaggcaagtgatggataa

SEQ ID NO: 28572 - DNA, 201 bp, Bos taurus
aagctccgcctaaagctgagtgcccctgctgagtttgtgattaatctctccatccgaaacttcactctccttctcggcccatccttgatcccctcggggttgaggactgccaaagaagcaatgggactgaacctgagcagagccttcagggccctccctggggccaaatccccccacgtcccctgttcctcatgtgtagaa

SEQ ID NO: 28573 - DNA, 201 bp, Bos taurus
ttccacactggggggtagagggagagccccatttgcaggctcatttctggcatcctatccaagttccctcctctgagctgtcatcatgcatcatgctacctggcacattatgctcactgggggcctgcagatacttcaagcagtgaaaatcctgcttgtgataatacagcttttaagtctaactctgacaaacaagtgtga

SEQ ID NO: 28574 - DNA, 201 bp, Bos taurus
ggagttccatggtctcgtctccactcccccagaccccacaccgaccccctaaagtgcagggggtgcagtctcatcacccctcagactccagctgccccacctcatctcctcccttcaagggtcaccttccccaggacagaactggctccttgagtataaatactgtgagttcccatctgtctcctctgtagagccgtgacc

SEQ ID NO: 28575 - DNA, 201 bp, Bos taurus
gaaggtaaatgacatcatggccagattcagacaggggtatctgttccgacctccccaaacttcatgctctgtatgacccacttgccaaggcaggcatcatcgtgtcacatttataaatagctccaaacacctaggggcttggggcccctggacacaaaaggaatgtctgtctttcttcagcggttgctttgcatgaaataa

SEQ ID NO: 28576 - DNA, 201 bp, Bos taurus
attagtgctgggcttcagggctccaggcagctctgcctcccagttggtgccctgtcatccttggcagttttcatacccagtgcatttttaggccctggggaaaaaaaataacagctttaaaataaggcaacagaatttggggcagaatttcttaagcctgtgtgtgagatttgagctgcatttcaggggtggccaaagcca

SEQ ID NO: 28577 - DNA, 201 bp, Bos taurus
atctttcaatgaaataagctctcaatatttaaggaaatataaaggcgtaggcagagtgggatttttagatctggacagacattcctttgcaacagacactgctgccagcagctgtgcgactccacaagggtctgagcccagggaggctgtgacaagggcggccgcaccagctccagctccactgtccccgccctccaagaa

SEQ ID NO: 28578 - DNA, 201 bp, Bos taurus
cttaatttatagggaacctcatgaaattccgtgagggcggatgttgtcccccaggtctctgtggtcctggccattgtggggccctgagtcctgattggacagcggctcagcccatgatgtcattgcagtgttttagctggatgtcagccttgcaggccagctaatcaggaccaaaaacccggccagtgtcttcatgcagaa

SEQ ID NO: 28579 - DNA, 201 bp, Bos taurus
aatgacaaccccacagggaataaactttaaaagctacaaaactcgggaggatttacaaaggagaggatctgtaaagagatttctttggagagagctgctgtctttttgtaagcacctcccaccccccaccaccaccacttttcaaggagagggcatcaagagtgtcacttgctctccctcacctaaggagagccagcttca

SEQ ID NO: 28580 - DNA, 201 bp, Bos taurus
caagctggggctgcagtgttcacagctcagtcaatgatggaagatggggtgtggagcgctagcctgtgtttgggctgaagtacttactggcattggcctcgtgctcagaggcgaagctcctggcactcctgctggacacttgctcttgggcacaaagtcccttgctggccctgagctggttggggctcctgaagcctattc

SEQ ID NO: 28581 - DNA, 201 bp, Bos taurus
acatttaataatatgttaatgatatcttaataaagctattttttaaaaaaagcaagtaaatagaatttctcacattagccactaggcctaatggtgggccccaattgaacatcccacctgtcctcagcaatctgttcaggctggtcacagttttgaaattgtatgttggttactttccttcctgcctggtccactcctggc

SEQ ID NO: 28582 - DNA, 201 bp, Bos taurus
aggcacctccatagcaagtcttcctttgtcatcttttgatcataatccctcatcccaccccttgtggctttcccactccatgggggccaaagatggctggtgagacactgcatttagggagaatgacccatgacccctcctctttttgctatgcagtgtcactgttaaagcagtaagcactgccttaagtgtaaagcacat

SEQ ID NO: 28583 - DNA, 201 bp, Bos taurus
ccttgctaagaatctaacttctgaacatgtcagagtggaaaaacaggaacctgggggaaataaataaaatagctgttttaagacattgggccagtgttgggagggctgtgggtccccaagagatgtgaggctgccattttcccagttttctgccacagccaatgcaaatggtccttggcgatgaggccaggactaggctgg

SEQ ID NO: 28584 - DNA, 201 bp, Bos taurus
agttggacacgactgagtgactgaactgaactgaactgatggcagcatgtactctctccgtctgcactgctcaggtttcagattgctcagcagggccaccgtccaaagctgacattgtgttttgtgcccttcccaggtccaagcagctcaggcaaccagctgcttggctagcgcactgttccaggtgggccgtgcatctta

SEQ ID NO: 28585 - DNA, 201 bp, Bos taurus
ttatctttgtgcttataataaaactatttttcatctacaaaactgtccttgaactttaatgaactatgtatctaggcagcaagatccagggaaaatagcattgaaaaagtgctccacaatctgtttccctattagcccatctaagtttttcttgatctctttcagggaaaattttttttaagatgatgaatagtagtgaag

SEQ ID NO: 28586 - DNA, 201 bp, Bos taurus
cagaggctgggctcatagccttactcttaggaccacagctgattctcagaacagcatgaagtggggttgctgtgcagccctaggggaagcccccacctgcatgttagtgggcccagcaggagtgctccactccggccactgcaaacagcgtcctttcatttatttgttttctgttcaagttactacctcccacaaaggagg

SEQ ID NO: 28587 - DNA, 201 bp, Bos taurus
tggccaatcattttgatgaaacagcatccagaaatgccaaaaaatgaattctcctttctccactgcactgtgacttgtcaagggtatgaacaacaatataaaattctcttttttattcaaaaggccaccgtggtatctagcaatgtgatttgtgcattacaacaaacttctgaactgaaatgaacttctggaactctgatt

SEQ ID NO: 28588 - DNA, 201 bp, Bos taurus
atcctgtcccttctaggtcagcactgtcctttgtgcccatccattcctccccatccccgacgcccctcattgcatcttcagctgctgccggaatatcaccacttggttgtctaagaaaccattcaaaccaatgaagttcaaagctgttctcaactccccctcaaccgtacactctcacctgtgtttcccacctcagctgct

SEQ ID NO: 28589 - DNA, 201 bp, Bos taurus
tcactttcaatgctttagtgttataaggcagccctattcatctgtcactgcttctcaattcctcatcaacagttacaaagttcaggaaagatggtcatatccttattttgaagagccagacataagcccagctctgtttgggacatttagtcctagatgggaaagtggcggggggagaccaaatgtctggcctgaacatgg

SEQ ID NO: 28590 - DNA, 201 bp, Bos taurus
aactgatcatcactaccctaaataggatttcttgtcccataaaagatgaatgaaaacaacaattattcttgaagctaagacaaaacagaaacatgtattatcatttgactcatttaacaaagaccagtggctgagctagacattaattcaatattatttacttacctaatttctctcttcagttcagttcatttcaatcat

SEQ ID NO: 28591 - DNA, 201 bp, Bos taurus
gggctgaggcatccaagggctcccagtgccttgtccactcccaggtcaccgggcatcctcctttatctggacactggccgcccaggactacagagttaccacctcttctgcagctagggtgcttgtgtgaccaggctctcttccagaggggatgggagtgattcgcacaaactctagaatgtgtcctgggagagagaagca

SEQ ID NO: 28592 - DNA, 201 bp, Bos taurus
cttgggaaggcccttgaaaagagaagctttcagcttggtttgagggagatcaaaaccattcatttaaattccattccagtctgtttatgaaattttattttaggatacttcagatttattgatcacttgctgaaaagagtgaagtctctgcatgggagcttctatttaattcatctatgttgctcatgctgtgatttcaaa

SEQ ID NO: 28593 - DNA, 201 bp, Bos taurus
attaagttttaactgctggggtgtttattatgatacatcaacattgaaaaaagggtttggaaaatatacttaagattcacattatgttttatgattatctatgggaaactaaaactcatctatgcctaagtaagactttttgatcagatgatgggagagtgttttatcaggtgtggagaacacaggaacctgaagggaagc

SEQ ID NO: 28594 - DNA, 201 bp, Bos taurus
aacagccgaggcaaaatctccaggcttttttttttttttgctacccactccccgccccgccccccgcaactgaccctgttggggtttgaatggccccagcacttagaaaattttcccttagcccagatccacttctccaggtcctccagcatatctgatgctcctgtgaaaactgaatattcatgtctggccctgcccttt

SEQ ID NO: 28595 - DNA, 201 bp, Bos taurus
cctgacctggaagcagtggcatcctgtaggttccagcagcacattctctggataccatagcttcatgctctaggactacccctgttgggttgccttggtccttctcttgaggcaggctggctattgtggatggtctcctaggcattgcttggccttggtccctttgattgccaagtcctgccttcttgctgatgggtgggg

SEQ ID NO: 28596 - DNA, 201 bp, Bos taurus
tgggggagtaagttcttgcctctcttctgtgataattattgtctgcgtgaaagtgtgagggaagatattcaaacctgatttagtttgtgcacagcaaaccgtcggggaagcaaagccttagctgaagaccacaggctgaagcccaggagtccatctttcaaaactttaagacaatgacctctcctactcttgtgtgcggat

SEQ ID NO: 28597 - DNA, 201 bp, Bos taurus
gctgagcagagggcgggatggagacctggaagccattaatttaattctgacttccccacgtgctgcttcagtagccagtgtcacatttcctgtgtctcaccggccagactcaaggctgggcaagttgcttcctttttggttattctgcttttggtccacttgtgaatattgtttcccaaactagactgtgctttagagacc

SEQ ID NO: 28598 - DNA, 201 bp, Bos taurus
cacctctgttgtgcctctagataggcctgttctgacctggtcttagttcagccaatgactccactcccatctccatgaccaagccccatcttgggactcgggcaagtgggtctctctcacttttttcctattcccgagcttctttcttgatgatctgcttctgcctttgtttcccaaagctgggagtttatcttcctgtct

SEQ ID NO: 28599 - DNA, 201 bp, Bos taurus
tggcaacctgctccagtattcttgcctggaaattcccatggtgagagaaacctagcggctacagtctacagggtcgcaaagagttggacacgactgaagcgactgacgcacatacacagcacacgcagtctggtgccagaagccgtgtggtatggcccctcagaagagacctgtgctgaaggaacccagaggagaacatat

SEQ ID NO: 28600 - DNA, 201 bp, Bos taurus
agacagagaaagaataagggaagagagacaggaacataaagggaacaatgggtgaggagacaacggagggaaatatgagaagagtggccaagaataaaccatgtaaattcttgccacaaaatctgaaccttcaatctttgatgtggagagaataagaccatattttaagatcaaaaagtaaggcccaaaagacaataaaac

SEQ ID NO: 28601 - DNA, 201 bp, Bos taurus
cactggccccgattcccattgtcaacctgcccagagccttctgctctgccccacacactcagcacagccccactttaaaagactcttcaggggacttccctggtgggccagtggttaagaatctgcctgccagtgcaggggacatgggttctacctctggtccaagaagatcccacatgccatggagcaactaagccacaa

SEQ ID NO: 28602 - DNA, 201 bp, Bos taurus
caagtataattaaattagatgtagtcacacctggagggttttgtccaccatctccatcaacatagagaatagacccacgggtctgttctctggataatcacggtagaaactgtaaatagcggtagcatggaggactaacagggaggagcggggaaggccctgccacactgcgctgggcgttgctttcccttccaccacaga

SEQ ID NO: 28603 - DNA, 201 bp, Bos taurus
ccatccaccccatgcagaggcagctcatgtttgggtaacaagatggtctggtgcgccaggctttcccagctcctgactaatcattgcctgtgagacccaccgtgtcctgactccactctcttgtctactcgtgtctttaatccaccttctttgatgccaacagagttattttcctagagagcagctctgtcacttcccttt

SEQ ID NO: 28604 - DNA, 201 bp, Bos taurus
ccgggtgcagaggaaggcatggaggggaaactatgtcaggttcgtgaccctggaaagactgtcacgggcaggcatgatgatgacatgcagccttctagcttctctgaccctgagacaggtggatggtgtctctgatcccagagaccgccatggcaagcaggaatcagccagagcagatctggggcactcacggccttatta

SEQ ID NO: 28605 - DNA, 201 bp, Bos taurus
ccctgtgtgaatttggtaaggaaacccaacactgggtttcagttttcattacacaccggaaacttggcctgagatcactaaaaagttcactgtggtttgtgaacctttcaagcagatggagccaggtttctgccatgcgcctgcccccgccgatgccagggggggatttatggggctgagcgggaaccaggtacaattcca

SEQ ID NO: 28606 - DNA, 201 bp, Bos taurus
aagatgagcaaacaaggtttctgatggccattctgtccaaaagtaacttgatacttaagtgttgggcaccctagtaatttaattcaggatgaatgcaaatcgctgtttgttttttggtacaggccttgcatttccttaagtaaaaggctcaataacagtcaagaccatcataagtgggcttggaggccacaaggaagaagc

SEQ ID NO: 28607 - DNA, 201 bp, Bos taurus
gaggattaaatgagatcatccgcatgatgggcccagaggaagcctgctctttcctccacccggctgccccatgctccctctgccatctggtcctcccaggttggggccctggtgacctgcagacacctgggaaaatcaaggctttgggcatagattagcttgaccacactcctcacttctccttggacacccagggcccat

SEQ ID NO: 28608 - DNA, 201 bp, Bos taurus
tgtgcatgtgtaggtaaattgatcatttgaggcatcaacctatggaataccctttctctctaccctctaacccactgggtctacaccactgggactacattggccccaggaaggctgtagttggaattatggtgaacaaggtttgagacagaaaagactggcagggccatgcctgtgggcagagaagtcctcaccctcatc

SEQ ID NO: 28609 - DNA, 201 bp, Bos taurus
agcgtcagtgagtcaaaagtatgatgaggccaccggggcaactagtgggatcttagatggcagcaatagcatcgcaggatctagagtttcagtcatggtacttagtctgtgtggcccagccaagatggaagcatacaaccggaaacaaaggggcttggaaatcccagcacacgtggtaggacgagagagccaaggatgtcg

SEQ ID NO: 28610 - DNA, 201 bp, Bos taurus
ttttctctggcttacaagcacaaaccatcacacaaatggttcataaacctctttctttcgtaacacgggcttccctggaaccataaagctctgtttctcctcccgacctctctagaaatgtacagccatgtgtattttaaaaaagagtaaacaattttgaaatatacatagacttttatgttcaaatattattattttgtg

SEQ ID NO: 28611 - DNA, 201 bp, Bos taurus
gcttcagcatcagtccttccagcaaatattcagggttgatttcctttaggattgactggtttgatctcattgcggtccaagggactcacaagaatcttctctagcaccatagttctgtgactagcctggcctaaaataacatgcttaaaaatatgactgaatgaaaacatgtgcatgcacgtgtactcagttgctcagtca

SEQ ID NO: 28612 - DNA, 201 bp, Bos taurus
gctgttctataccctgctcatcatgggtgtcttccacaacgaggacttgaaacacgtcttgcagttgattgagcctagtgtgttcaaggaagccgccagcacggaggaggagagcgaggtggcggagaaggaaccctttgtggaagactccaagctggaaggagccgctgaggaagaaaacaaaggggctaagaggcccaa

SEQ ID NO: 28613 - DNA, 201 bp, Bos taurus
tccaaaatcatgttatgtatttatcagttagttgttgaccaactagggatctcttagtttttctaagtagtagaatgtacatcaagagcttgctggtcaagtgtcatgagagtgggtgtacacctgagagctttgaagacatccttgcaggccaggaacaatattgtcaacaagtcttcctgtcactctgcagacagttaa

SEQ ID NO: 28614 - DNA, 201 bp, Bos taurus
ttagaaaagagctgataatgcttggttgcttttggtgatcagaactttttgcctaagggaaaattcaaattgtggagctgttcctgtttttttttttttttcccttaaccttcctttgtgaccttggaataatttaaagactgaaactataggttgaaggtatagtgcatgtataacacccttaggcagttcaaatggaat

SEQ ID NO: 28615 - DNA, 201 bp, Bos taurus
ctgaaccctcctccctcctccctccccataccctccctctgggtggtcccagtgcaccagccccaagcatcaaaacagatttctaatttacaaaatgcaaaagattaatactgtggaatatgagatttcttttgtatgaacatggtagctcagagctcaaactccacagtaatatggattttgcaaagaaaaaattatttg

SEQ ID NO: 28616 - DNA, 201 bp, Bos taurus
accttgttgtttatatatatacaacaagataatgtatgtttttctatatagaagcaaatccttgaatgtaatggagtttgggaggttagggtgaggatgtgcataggcacaacaaatcctgatgataatgttttgaagaggcagagttacctttcaggaagtttaagttagctatacaaggcaggataaagtacagggaaa

SEQ ID NO: 28617 - DNA, 201 bp, Bos taurus
ctaaagctcacagaatccagtgaaggtgtccatagatgtcatgacttcagcagcgattgttcttgagcacaaagatgaagaagtgtgaagcagttaatgcgccttgatgcagactccatggggctggcttttggggcaaccacaagcttccaagaaattttcattaagcagtctgtgtgcactcccaggaagacgagatgg

SEQ ID NO: 28618 - DNA, 201 bp, Bos taurus
ttcctgaccaggaatggaacccgggccccttgcattgggagcatggagtcttagccactggatcaccaggcaagtcccttatgttgtatattcttgacaccctggcatctggggcctcactgactggtaagaaactgcccctaacagggctagccaattcttagagatggtggacaactcctctgtgaaaatgactcttgt

SEQ ID NO: 28619 - DNA, 201 bp, Bos taurus
agttctttatcttaccatatccctttactctgttgatgtaacacacactctagttgctctcctctgaacttaacttctaaaatacattttaaatgcctacaaaatgcatttgaccatgtggaggctaatgcatatttttacgtaatacaactactcaaagactttcagcctcataacagccacaaaataatagaatggaac

SEQ ID NO: 28620 - DNA, 201 bp, Bos taurus
attaagcattattcctgggtgtgtctgtgacggcatgcatggacaagattaggacttaaactggtagactgagtaaagcagattgccctccccaggggggcgggcctcataatcagttgaaggcctgaaccaaacaaaaagtggagggaggatctgttgccttcctgcctgtcagattgagctggaatgccagtgttctcc

SEQ ID NO: 28621 - DNA, 201 bp, Bos taurus
tgatgccccagtggggcctgacttgtctctctgcagacggcggcttcccactgcttaccgtctatctctgggtcttcctgtcacccgcgtccgttcgtgagggcgagtgccagtggccgggctgtgcccgtgtgtacttctccgtcatcaatgcctccttcccagcttgcggcgccctcaaagcccgggagctctgcttcc

SEQ ID NO: 28622 - DNA, 201 bp, Bos taurus
caaccagatccagggagaactctctcttcaaggtagagtctgagggtgacacttggagaaacggaagtggtgacaacaggcgagggcctggcctcccagatgcccccctactccttcttgaacaggggtctggatccccagagacgcccccctcttgccattcccagaacctgtggatctgctcccctctcccctccctga

SEQ ID NO: 28623 - DNA, 201 bp, Bos taurus
gttgttttgccaggcaaagggggccacagtaggcaaatgcccttgaaactatgtcccaacctagaggaggtagtgaggagtttttatactaatgatcagcgtgtggacattcttctgactgtttattggtgaggtaagtagaagtcagcaacatcaatcttctggttccaaccagtctgggatctgcatgcttgagttcag

SEQ ID NO: 28624 - DNA, 201 bp, Bos taurus
tgctctctgcaactagagaaagcccacgtgcagcaatgaagaccaatacagccataaataaatatataataaaaattgctggaaaaaacaattacaaaacgtgtttcaaaatctgacgtagagagttccttgtgaatttttccataaggtggctgtagatgccccccaatcaaactcactagaaacacatctgaagctgac

SEQ ID NO: 28625 - DNA, 201 bp, Bos taurus
cctttgtgcctcaaaaccctttcttccactaacacctggagctgctgcttcttaccattgttctgtcttatgaggaaggaggctggctttgcttttgaacatagaagacaaagttagtgtgtagcaatcaggtagtcctcagtcttgtttgcttctaagatggcatcaaaaccctaatgatctcccacactttagcaatgt

SEQ ID NO: 28626 - DNA, 201 bp, Bos taurus
acaaacatgaaatgcaatgtcagctggagaagctgacaggccttgctggagcaatatgaccatgggctctgaagaataggaattaaggcaggagggaaagctggggacatactagaagggccaagatgagagaaagagggagaagacagagaagggaagggatacagagacagggaggactcgactggaagagtgtgtgtt

SEQ ID NO: 28627 - DNA, 201 bp, Bos taurus
cctggccaacacacctacaatacatgaaacccctgcctctactcacacacacagactcacactttcatttaatatgccttggaacacattccatctcagactataattatcaaatggccacactgtgattcactgcttcaacagaatataacgcaattaccaacttcttagacactgaggctaattccagctttgctcttg

SEQ ID NO: 28628 - DNA, 201 bp, Bos taurus
tgtcctcgcatagagagtttaaaatgtttacatttaatgtaattataaagaaggatttctgtcactttcgtttttatatagcttttgtccgttatttccttcattactgtcatccttttttatttttgtttggttttgtagttaaattcctttcccatttctctagttattttctttgtggttactgttcgttgatttgta

SEQ ID NO: 28629 - DNA, 201 bp, Bos taurus
agggcttacaaggtcctactgtatagaactgggaattatattcaatatcctatgataaaccataatggaaaagaaaatgaaaaaacatacgtcactttgctgcacaaaagaaattaacaacattgttaatcaactatacttcaattttaaaaaaaaatttttaaaaatccataaaatacatgcaaacaaatgattctttca

SEQ ID NO: 28630 - DNA, 201 bp, Bos taurus
agagtctgcagtgtgggttgtcttcatccatcccaacagaggcacccagacaagaccactcaagacaggattcccggcatccccgcttcttgggcctcgctgcctgcccaccacagaggcaacggatgctcctctccatctggctttcctctctctctctgcttgtgggaggatatcctctctttgcagttggaaggagac

SEQ ID NO: 28631 - DNA, 201 bp, Bos taurus
gacaaaactacaagcaaataagctattttctggaaatagaatcttcagagctgagtgaagaactgaatgtctttctctcctcacctacctgtggccctaatagatcttctctggggtcacaggaccagccaacagcagaactgggaccagaggtagttccaccagttcctcttttgaaggactttctattcactatacaag

SEQ ID NO: 28632 - DNA, 201 bp, Bos taurus
ggctgaaacctgatatcttcccttgcttcccacatcttataccttctctggataccctgcacacacaccagatttctcactgtataataactgtttgcatgtctgtgtcatcagtgagactgagcttccaacaaagcaaagataactacatattaacctttggatttctgggttcactgtgcccagcacaatctcaggcac

SEQ ID NO: 28633 - DNA, 201 bp, Bos taurus
tctgtcaatggaatagctggctcatgtataaaggaaaaaggcaaagaacttcagccttatctcttatattgttttttaagagaaatgtctcgtgtgttacgatgtttggaatatctcctagcaaggctgaaaagcaaggaataaacagcaataattcagtgtgcctaatggcacaaaataaaggaggtattcacaaacaga

SEQ ID NO: 28634 - DNA, 201 bp, Bos taurus
accccacctgcccccgggtgacctgggtcagcctggccggtcagtgccatgtgagacgtagcagctgcttgctgttttttttgttggaatccaaggtgccgcaaggacaagaactccacacagggctgtccccaagtgatggccttctctttgtcccacctttgccacttccttttgtgccactgaagctgactccttctc

SEQ ID NO: 28635 - DNA, 201 bp, Bos taurus
aaaaaaaaatcaacagcttttagtatcattaaattgacctctgaatagaataagcccgagcctccaccacacaacatcccaaaacaggtatggaactgtggccttaagatgctctgtgtgagtgctgtaacattttaatttacagagaagcagtgattgatggcctctcaaaagcccccctgctcaatactttctatttta

SEQ ID NO: 28636 - DNA, 201 bp, Bos taurus
aggatttaaatggagtcttacagctatttggagtagaaagaataagaattcgagaatgctgaggcaaaagaacacaggagacaaaactcaagctccagaacttgaatactgagaagagtaggaagaggtttggattttttttttttttttgactgagctaagtggtcttattcttttaaagaaagtcaagattacaaagga

SEQ ID NO: 28637 - DNA, 201 bp, Bos taurus
acatctgtgtggcccatcacgagagcagcctctgacagatggcactgcaccagccatggctaccccagcaggaagagcatcagtaaccatgggaaccaccagggaccaaggtccaggcccctccaccaaatgggaaggcaggggatagggaggagcccagatacaggcaaacaggagtggcttagggctgaatctgattta

SEQ ID NO: 28638 - DNA, 201 bp, Bos taurus
catgtgggatcttagttccctgacctgggattgagcccatgtcccttgcattggaagcatggagccttaaccactgaaccaccagagaagtcccagtctcgcaggaaactcctctcaatttttttcttctggctcctctacttcctcccctgaagcatgggccttccttcagattctccacctggcagcgatttcattcac

SEQ ID NO: 28639 - DNA, 201 bp, Bos taurus
aggcctgactgtcagttcaagagggaaatggtgtcaggacatctttcagagctttcccacttgcctctgtatagctttctgctcacacctagtgaaaaggatctttgggagaagatggcccagttctcatgctttgccatttcactgtttcttagcaagccaggcctcccactcttagttcctgaaactgttccggctctg

SEQ ID NO: 28640 - DNA, 201 bp, Bos taurus
ccttttcatctttcctgacacagttaataggcacggttttcaggagatgtgtgtttatagcagatttggccatgtggtctccaggtgaaccttctggaagcggtgaaaatcacacccggatagatttagatttagaatctctcccaccccctgcaaaatagataaaactggacttgttttgtagagtagggaagagaagcc

SEQ ID NO: 28641 - DNA, 201 bp, Bos taurus
cctcctttctggctctccagtcaccatcctggaggacgaaagaacctgggacttgggcaaaataagattgtgtgttctaatgcttcttgggtgcttatccatgtgttcattgagcgctgactgtggaaagcagaactccaaatgttgttgggattttggcctatcttctcaaggccctgagaaatgaagttggttgagata

SEQ ID NO: 28642 - DNA, 201 bp, Bos taurus
cttccaagaatcattttcttggtagagactggcctcctctacagcagctggagctggtgtgattctggagttataggatttgggttctctcagtaagtctacggcccttagctatcaagcagaggggcaggtgtaagttggtccagggcagctgagaggaggtgggctgtttctttaataaaagagtcaaaggccagagca

SEQ ID NO: 28643 - DNA, 201 bp, Bos taurus
gcgtgggtcaacgatggcctactgcagggtcgggggcactgagtgcagcagtgggtgcatgggacctttagaatagtgggtcaccattaccttcattaccgccaccattggcctcaggtcaaacaactgggaaggaacacagccccacccaacaacagaaaattggattaaagatttactgagcatggccctgcccatcag

SEQ ID NO: 28644 - DNA, 201 bp, Bos taurus
ccttgcatacactgctattgcctctcttgaagttttttccctcttttttatactctcatatctttcaaacactccccagacctggccacattgtattcaaccttaaagattcagctcaaatgtcacctttccccaggaatatgtatgtctttgatctcctgccttcatcaatctgggttatatggccttctttgtactact

SEQ ID NO: 28645 - DNA, 201 bp, Bos taurus
gtgaaattattgaagtcatttgctccaatgggtgtgacaaaacatacaaagaggatggccagaaagatcatgatttgttattgcgtgaggcaaatcaaatgagagaattgtgatactgtgtacctactgttggtgctgactagtgtgtgtgtgtatttgtagagatgtttgtgaggacgattaccaaatgtaaatggtgat

SEQ ID NO: 28646 - DNA, 201 bp, Bos taurus
gcagttaattgcagtgactgggggaaatactgttgttccatgttaatacgttataggatttagatggttcaataaactggtgatagtcataaatctaccactgcacactttattacatccatatcacataccacctaaataacatgtctgaaacaactcaaatgcaatttctcctcagggcagaacgcagtaacctcttta

SEQ ID NO: 28647 - DNA, 201 bp, Bos taurus
catccgcctcggaaaagtcctttcacagcatggtcctcaatactttttctaaggctacttctcagacatcactgaattctttctttggggatcattatttttgcaagcatgagctcttgacaaattcttcatggcaatcagttttctcttaagccctcctccctaaatagaaacagttgatcataaccccggggggaatta

SEQ ID NO: 28648 - DNA, 201 bp, Bos taurus
gtatttccttgtacagcaaaatctacagtttattattactgccttgaaatgtgtacactaccaattttttcccaactgttttagcaaaattgggctcccgtggaagcccttgcttgcaaagggatttttagttattcacaattaatagtctcaatggtaaaagtgactcaccatctcatcattcccattgaacagagggaa

SEQ ID NO: 28649 - DNA, 201 bp, Bos taurus
aaaataattttattgtcatattgattatttcccaggcttttatagcatgcaatgcccttctatgaataacttgaactattttacattcaagttgccactgaaaaaaaaattaaattttaattgaaaaacaactacatatggaacctttgggatctctcaagtatatgatgcttaaactagttttgttattggtttttcata

SEQ ID NO: 28650 - DNA, 201 bp, Bos taurus
tcccatctccaccttggcctccctaccctcgctctcctctcccaactcccagggtctccagagaccagagcccaccaccttcctgctgcagcccaagcccaccaggcctcaaccttcccacttgaccataaggctcaagaccgagtttggggacaaaagaataaggtgctgaaaggcatcagtcagtcttgaaattcccaa

SEQ ID NO: 28651 - DNA, 201 bp, Bos taurus
cgactgaagcgacttagcagcggcagcagcagttagggaaggcctctgtgagaagttggcatttgagcaaggacttgaaggaggtgaaggtattagccccgcagaaactggggaagagcttcccaggaagggagttgaccaggtgcaagctccagactggggctctgcccagcaccgggaggtcagtgtagctggtcagac

SEQ ID NO: 28652 - DNA, 201 bp, Bos taurus
ttgttattgacattttagtatagtttcaagtcactgacctccctctacctctgtatgaagcaagggtctgaacttgggtttagatacagtacatgttacaatcagtcatttctaggaaatgagatggtagccccaggcctgatgctgtgctatgtaacaccctctgatcctggttcactgcctacagacctgaggcctgag

SEQ ID NO: 28653 - DNA, 201 bp, Bos taurus
ttattatgattgaaagatgcccttcttaataaccatcatggaagtttgaaaaaataaaagtttattactttgaagatctgaaaattacagagcacacccagggccacactatgaggtcatgaagagagggagagacagggagacatggagagagagaaagagagagaatgggcctcagctcagtcactcagttgtgtccga

SEQ ID NO: 28654 - DNA, 201 bp, Bos taurus
ggaataggcaggatgcccttctcctgcctacagctgcccctgtctccttacttgttgcctcaatgggcccttatctttctggcccctgagtatatatataaaagccttgttcttgctaattcaacccctgctcatgtgtctttgctccttgactcaactttggaggaagagttggtgtgtatgaatgctgatatgtttggc

SEQ ID NO: 28655 - DNA, 201 bp, Bos taurus
ttgcttttattcttgtcatggttgaggacagttgatgataatgcaggtagaactatcattaacttgttaattttgattattttcagtctgaattcttgatgttgtaccaccaggctctgtcctctgctttatcctgtttaggtgaaaggaaggcagcattggccagtttagggtggtacatcagggtgatgtaggaagatt

SEQ ID NO: 28656 - DNA, 201 bp, Bos taurus
tctatttctgctctcctcttgttttccttcatctaccaaaaaatggctcttcattacagcacttgatacttcttaagagtttccctcaaaaacccaggctcataagagattccaatccaacaggacttctattacctgtggcttctgcacttgccctgtagtcctcctttccttccccacactgtgctgtgtggaacttgt

SEQ ID NO: 28657 - DNA, 201 bp, Bos taurus
accaagtaactctatgtggccaagcaaaacattttatgattcattcctaaatttaagctggtaatagtttttctgttacatgaagctgaaataatgtacccgattcaagcagatcaactgaagggccacagtaattggtccaaatcaggttagaaaaagtcctctagaacttttgaaagtgagctgtaaagaaaaaaaaat

SEQ ID NO: 28658 - DNA, 201 bp, Bos taurus
aaactatccccccagtgggactgagccactgggcaatggactcagtaggaatcttggctgtctgtcagaacaggatgcccagaggatatattgttgtcaatgaggcccaaaatgggctagcagttaggtgtaatggagataagcaggccaagtgtgtgagcaggaaatatgaagagacacatgtcaatgtggttaatatta

SEQ ID NO: 28659 - DNA, 201 bp, Bos taurus
gatcttcatatgtcaagtaattctggtatgtgaagtggacatttgaattttattttgtggagatggtggattttgttacattgttctaagactaccagtgttttagccagtggtctgagttatgttctcctcaaattcatatgttgcagtcctaattctcattaactgagaatgtgatgcatacattggtgatatagtctt

SEQ ID NO: 28660 - DNA, 201 bp, Bos taurus
tgctgtcacactcttgtccgttggcttcacttaccctggatgttcaagcaatagatttgataagtaaacatggtctatctgcttggttcaattgttctgtcagtgatagaattctgcagcaagatgcttgcaatttcctccaagaggatgcagagtcatccacttttattcctagccttaagctcccatttctctgactga

SEQ ID NO: 28661 - DNA, 201 bp, Bos taurus
gtgtaaagttataacatagatgtaatataaaacccttgtacaaacgtttctaagaaaacaattcagttaaattgatagaggcattgtgttaaacatacagcagtcagatttgtaggagtgtgttgttgagaaaagggtaatttctgtgaggcatattacagctaggtgtagctttggaggtataggttctacagatgttat

SEQ ID NO: 28662 - DNA, 201 bp, Bos taurus
aacaataatgtttaatgggaatattaatgtttttcttgtaccttctgcctaggagagcacttgtttccaggcttcctacaacaaaacattaagagtttagttcacatcatgctgaaactataaagttgagtaaaaactgaagggaaatacatcttcagtgagattccatcatcccttattaatgccataattgagggctat

SEQ ID NO: 28663 - DNA, 201 bp, Bos taurus
tgaaaaccagcagtggccataggactggaaaatgtcagttttcatggagaatgcagcacttcttaatcatgggttttgtttgttaatttgataaaataattattgtattctaaatctttctatttctgagctaatctgatttgtcatttcttaacattttctgtccatttatattcctgttgttgttcagtggcccagtcc

SEQ ID NO: 28664 - DNA, 201 bp, Bos taurus
atgttcacagattgtagaaagtgatttggcatggggctagaggctaaattcttctttactaagttaacattatttctcatgatttcactaagcaatttttaaaattttccattcagatacagtttgttttacttatttactggaataatacctgtcattcagagagcatttaattcactttttatgaaatgcactatctct

SEQ ID NO: 28665 - DNA, 201 bp, Bos taurus
attctaatataaaaaagatgaagaagagatactggaggaagtgccaaggttggaccataactacatattgggttataattcttgccaactctatgatgaacctatttacaatatcactgctttacttaccaaagtccaagaatacatttttatttctgaaatgaaagaaatctgtttattctcttcaaattctcaagatga

SEQ ID NO: 28666 - DNA, 201 bp, Bos taurus
actatttttcagctttgtaaatgttttcccatcaatattgatttataaagactattattttattagaaaactaatggttaaatgtgtatacagttgtgagcagagggagttttagattcctcactagtattttttgttttgttattaggtccaagtcagaactttctctttttatcaaaccaataggttttgaatttctaa

SEQ ID NO: 28667 - DNA, 201 bp, Bos taurus
agaacatgttttccaagtcatgatttaaaaccatcttattttcttatagaaaatatcacagtacatgatgataaagtacagaatatttttagcattaagataattcagaaatcctaactactcttacagtgatcccactggcatattttcagtgctttacccaacttataaagattatacatttactaaaaaacctaggtt

SEQ ID NO: 28668 - DNA, 201 bp, Bos taurus
agtaacacaggtggagaaacctgggttggagttgagtagagctgatgtggcagaaagaaaacactcagatattgatggtgaaattaattgactggaagaacatatcatcttacttaaattggatattaaaaaactaaataaattgataaggtgggtgaaagattaggaaacaaggaagttccatattcagtctaacgttgt

SEQ ID NO: 28669 - DNA, 201 bp, Bos taurus
taacttctttttttaaattcaagttcaaatggttataaagcagtggacacaattcacatcatctgcaatacatttggcccgtgaattgctcataaacatacagtgcagtggtggctcaagaagttttgcaaaggagacaagagccttgaagacaaggatcacagtggccggcaaccagaagttgacaacagactgagagca

SEQ ID NO: 28670 - DNA, 201 bp, Bos taurus
atattatgatttaatacagtaccatgttaacaatctatatacatatgctgataacatctgttatcacatatatgtgataatttaaaaagctcattagattcggatgtgtaatccccaaagaaaagtgaatagttatatttttgtaacttgattaccacttgctaggtatttaaaaaaagaatttagaaaattcacaaatat

SEQ ID NO: 28671 - DNA, 201 bp, Bos taurus
taaagcaaaagtctgctcgctgtgttctagccgtggatattatgtaaggctaaataggatgtccacacctgactctcctatttcacactgaactaaaaaacggaaaaatatgaaagaagttccacattacagaggagatgctgctcgataatacagtaattcagatctatataagacttttgtagctattattcagggtta

SEQ ID NO: 28672 - DNA, 201 bp, Bos taurus
gtactgccttttatttttgtgtcttggcctctgtaattacttctgtaccattgctacatctgtcttttatataattcaccaccaccactaccaacaacaggctaaagttagaattggccaattactgtatatgatgaagaatataagtactagatggtatagatctttcatattggtctgtgttataaactattctccagg

SEQ ID NO: 28673 - DNA, 201 bp, Bos taurus
tcagacctgtcagatactacggacgtccacccatagctcctcagcacatgcagttccatctcatagccatactaacagttaaggccagaggcatcaaatcaaactctactcatgcttacaaattgcactcaccacttctaccaactcatcttacccagaccctgcctgagagtggctttttttggccacaggagcttgatt

SEQ ID NO: 28674 - DNA, 201 bp, Bos taurus
ggtgcctgcagagaccatttgcaagaaagtagcatcagcaacagtcaccaagagaagacagaagtcagattgcatagcagccagaaggaatcaaaaacaggctcagctgacccaaaggctacaaggccacaaatgtcaagttcttccctcagtgcctgctgctgtcaactacaaaacagtctttcctggcaaggacagcag

SEQ ID NO: 28675 - DNA, 201 bp, Bos taurus
tgccaagtctaaataaaaagcagaaaaataaaatcttcaagatcataaataaagatatgaggtttttttaaaaaagtgcacacagctcagttggcctacaatgcttattctcctttcagttctaaacctccactgtcagatcatccaatcaaactatcttaaaccaattcaatgttattatctcagcaaccttgcctggaa

SEQ ID NO: 28676 - DNA, 201 bp, Bos taurus
ttttcattctattacagaggttatatatgtctcccattattatttgcaggaaaaaaaattcatttaaattacccactctactcctcaaaaaaatgtacattgataagagaaggaatgaagtaaactggtttcacatgctgtttattgataagaaagtctccaaataaagttggggggtacaatttgataccacatatcaaa

SEQ ID NO: 28677 - DNA, 201 bp, Bos taurus
ctccataacatatgtttccttcttcagtattctgtgatactaagacttaaaaagtgatcttgacattgtgcaaagtcaaaactcttttgtttttttaatagatgaactattaggttgtaatacatgtgctcatcccaggggagaggattctttattcttccccttgctactcagtagattttaactttacaacacttaaga

SEQ ID NO: 28678 - DNA, 201 bp, Bos taurus
tttcacaaattgaacataacagaagctgtccatatggccatatgaaaaaaacaaactgggaaattaccaagtgtgaactccctcaggtggtaaaagcttattgtgttctagaaacagaaaggccaaagtgcagagatctaacaaatgcaaaggaaaataatatgaagtagagttgacagttaggcagtagaaatttcatgt

SEQ ID NO: 28679 - DNA, 201 bp, Bos taurus
gcgtgctgcaattcatgggctcgcaaagagtcggacacgactgagcgactgaactgaacagaaacttactaaataataaaatagacatgacttcactagagaatgagaatgtttaggcctaattcattggtcactctgcttctcattcctatttctttatccaatgctctgaatatttttttgttttctacatatttccca

SEQ ID NO: 28680 - DNA, 201 bp, Bos taurus
ataggaaaagcatgaatattagcattttcttcatactcaggatctcaaatgccccctgcagttacatatgtcctttcaccttcctagctattcagctttcggtgtgtgtgtgtgtaactgttagtcacttggtcgtgtccaactctttgagaccacatggactgtgtactcttgtcttcccctaaacccccacctctaact

SEQ ID NO: 28681 - DNA, 201 bp, Bos taurus
tgtactaccaccatccactcagcttccttttatctttctctcccattctttgtttcattcttctcccagacgttagtccttttacactatctcaacctcttctaccatccttttagggaattaaccaccaaatttaagtcaacgtgtttgagttcattccctacccttactaaacccttgttgagttctcacaacaaggac

SEQ ID NO: 28682 - DNA, 201 bp, Bos taurus
ttctggagtgtggatgagaaattactaaatttaaagggttttcaatttaacttaattgtgtctatatctgctcatttcacatttgaagatctgtcaagggaaaaaaaatgtgattaaatttcaaaatatccttagtgattacatgagtcaacaagaaatgtaaactcttacagttgatgaaaagagtagagcacccaacag

SEQ ID NO: 28683 - DNA, 201 bp, Bos taurus
ataaccctaaagattatttaaaagaccaccagaaaggaaaagaaaactttatatattaccataacctctgcacaacatttaccaatgtaaacacagccttgcagtgaaaaatgaaagtaaaactggaatccagttggttccccatgatttagtttaaaacagtaagcacactcactgtaatatacaagtgacttgtcaaat

SEQ ID NO: 28684 - DNA, 201 bp, Bos taurus
tgcccccacatggtatgcaaggttcttcataagtagttatccacttgtctctaggctcaacttttgcccttcattctccagccacacggaatcacttgaatgcaggttcttaaatgaggttgttttctctgctttcaagtcagcgctgctccaattccatctcccccttcctctgctatctttgcccctaccttcattttt

SEQ ID NO: 28685 - DNA, 201 bp, Bos taurus
caggtggattctttaccactgggccatcaggaaagccctccttcatggatcacagcattgtcatagtgagggggcttgcataactcaatgaatctatgaaccaagcaatgcaaggccaccaagatgagcgggtcatagtgaagaactctgacaaaatgtggtccactggagaaggaaatggcaacccactcttgtattctt

SEQ ID NO: 28686 - DNA, 201 bp, Bos taurus
tacaggaaaatctcctataataagtaagtgaaggccgttacaagaacccttgattactgccactaatggaacttcttctgaagtttcagccactgatgaacaggtaggaggccagggaatcagctgacaaaggaagacaagcatcagggctatacggtagatgctcaaggaaaccggaaactgtgaggccccacagaggct

SEQ ID NO: 28687 - DNA, 201 bp, Bos taurus
ttactgaggagaaaaatattcagttgaccaaaaagttcattcatatttttccatcacattttatgaaaacccaaacaaattctttggccaactcactaaatcatctgtatataatggtttgcccaatgtttctgaattagtaaatggcagctccaagaccaaaagccacatccgtgattcccaagaaggaactaacaatgg

SEQ ID NO: 28688 - DNA, 201 bp, Bos taurus
gttccccaaccagggatcaaacccacaccctctgcattggaagcatggagtcttaaccactggaccactagggaagtcccaactggacaaattgtaaaccatgaagcagcacattatagcagaaagataaatgaatgttaaatgactgctattagaaaaaagaccctacccggtttcctcttcagcctccatccaatagtg

SEQ ID NO: 28689 - DNA, 201 bp, Bos taurus
cagtacacaaaatttcacatagcattaaatacatttttgtgcctcagatttgggaaaagggaatggtatgtttctatcactgaataaccttaattaaactatctctttgcacatgatattatctgtctatctattacctattatctagcaatctgtctttgctgagtggaaaagaacatgtttctaggactcaattaccta

SEQ ID NO: 28690 - DNA, 201 bp, Bos taurus
aaaagctagggtggtcctggccccaggcagagttctagaccatttctgaactgctgccgccacaagtgctagtgatgtctgccctcacctggctcaggttcttcttaggcctgagccagctctgcccctacaactgcatgctcttcttgtctgtggcagtctttgtcctggagaagagctgtattgtggaaccaatggggc

SEQ ID NO: 28691 - DNA, 201 bp, Bos taurus
attgttgtattaaaaataatttatttagtggatttatgttcttaactacaaaacttgagagttgtactgctaccatttagcagaatccaacaagttaacagggtccaacatattttcagattttcaaatatagcaaaaggctatatatacactggcaaagcaaaaccaggaataaaaaaatacatggatatttacaactgt

SEQ ID NO: 28692 - DNA, 201 bp, Bos taurus
ttacagatggctaccttctccctgggtgttcacatggccattcctccctctgtgcattctctctgtcctagtctcttcttatagaaacaccaggtgtaacgggttgggccctatctccacattcagaatgcagtcacattctgacttactggagattaggatttcagcatatgaattggggaggagggggacagaattcag

SEQ ID NO: 28693 - DNA, 201 bp, Bos taurus
ttgattaccttctatatgctgtgcttgcacagagatgatggtatacaaaacaaagtgaggtaatagtaaataggcaaatacatactgaaataagggctgcatttgagggttaagacagtgaatttggggagcatattggacagggacccaattcaggaaaaagaagaaattccagggccaagtgtcagctaagagctaaag

SEQ ID NO: 28694 - DNA, 201 bp, Bos taurus
acataatagggaggaaaaaagtaaagcaataaaagcattgcgtccctaggactagagatgcgaaaagtaacctggaaatttcctaattttattctaagaatgtgtccatcctatgccgccgagtggggaaggctacggctccacagcgcagatcactgggcgtctcattccgaccgggccgcgcgacctaactggccatct

SEQ ID NO: 28695 - DNA, 201 bp, Bos taurus
tacaaatacataaagtactcacatagcacaatcaaatgtgaccgtatataaaacgaaaaggatattaatttttctgagttgagatgattaagtagcttccccaaaggagggtaacggcttagtgagggcacacatcccaggagaatcagcttatgtttggctctggttatagcgacattaagacgtcgccaatctttcaac

SEQ ID NO: 28696 - DNA, 201 bp, Bos taurus
aatataatctgaggtccacttgggagttgtggcccatgacagaagtggagtgactctacgttttgatactaacagtcaagccattgagacagatcctgcctttgggccttgagaagctggaatcactgggtcagaaactcaaattaagatccagtaacatgttggacttccctggtggtccagtggttaagactccacact

SEQ ID NO: 28697 - DNA, 201 bp, Bos taurus
aaaaaaacgtttcaattctcacatacacttttattctgcaataatgcatctgcagttagaattcctatattggtgtttctcctttaagaaaatatacttgctcttttttaaaaaaaattttaagtttcaatctttttgtattaaatacattcatttttggaaactaaatccccccaatacttattgaattaagtccttgta

SEQ ID NO: 28698 - DNA, 201 bp, Bos taurus
tttgctggttgagagtcctgataataaaaagaacatttttttttttagtatagtactctaagtggatcaaagtgctatagaggttagtggctacttgtgcccttcataaagaaagctgaaatcagtcttctcaagaggaagcctgattctccaactcagggcactttacaaggacagtgccttctgtttttggtctttcat

SEQ ID NO: 28699 - DNA, 201 bp, Bos taurus
ccaaggagcaccaagcctggggacagagtgttcccagcagctgtaggcagccgaggagctgcaaccctctcctaggtctcgtaaggccctcctcctgtacgacggggagcattcttttgggtgcatgcaaatggggggctgagactggtaaccacaacactaggtctttcagggctcaagaggaggcctcctacacgaaag

SEQ ID NO: 28700 - DNA, 201 bp, Bos taurus
ggtcatatccctgatcaaattcaatccagaggcaggggagatacagctgtgaacccggtgactcaagtcctgcctttttggcccattggaatgaatggtcccagaacaaatcagtgcagcctgaggaagcacacattcctcatttgtgtttcagggctcccctgcacctcactgtctcctaggcctcatcgcaaagcacct

SEQ ID NO: 28701 - DNA, 201 bp, Bos taurus
tgtcccaggccgggccatgcccttggctctggcctctgtgtgccgtgtgtggtgggtgcaccgggggtggtttgtggctcagagtatggaaattgttttccccagtttggaacgctggccttgtgtgggggccgctcagatttttccagacacagtgtactgcaaagagctctggtgtctctgttttgcaaaagcagggtt

SEQ ID NO: 28702 - DNA, 201 bp, Bos taurus
tgcacttgctacgtagcttatctaaaataatcatcatttggaccctctcacactggctccttcccatttttgaagttccaacttcagtttcatctcctcagaaaggccttcctccaccacctaagctaaagcattttcacattttctcgaattccatcctctcttcattacgttaccatattttaacttctctacagcagt

SEQ ID NO: 28703 - DNA, 201 bp, Bos taurus
gactgatgagagtggaatgagcccgcggggtggggtcagccaggggcaccctggcttcctgcccagcataggggtgggggtgagggaggccctgagatggtgatcaagggagtctgggtcacttgcagaattaagagacttgacccagagggaggggaggggcaaaaggtcagccatcctaacgaggagactgcctcctct

SEQ ID NO: 28704 - DNA, 201 bp, Bos taurus
gggccatcccggtgagtctgagccgtctgcctttcttcctcactgcagggtgaagatggcttgccagtccagggctgctggaacaaggtaagctttcccggggttccagggcctcagggcagagttgtacgtgggctccattttctgccgtgggataaagcatgcacgatttcccttccaggccttcctgcagatgaggca

SEQ ID NO: 28705 - DNA, 201 bp, Bos taurus
taaggggaaaccaaggcccagagtggcagcaaggtttgcccaggccccactgcagagaggagacagagcggaaactcagactggatctccaggcaccaagctgaaggcttcttagtgttttctggcctggtgctagaagagggtcagcctgtacccataaaatctgcttgtctgaatccctgaaatccccaaggcgagctt

SEQ ID NO: 28706 - DNA, 201 bp, Bos taurus
ttctgtccctcccagcatccttttacaggtggggaggctgaggcccgatctgtggacccagctttctctccatgatccagggggtccatggaggtgaagaagagctcagtgcttccagggccgaggctggggcatgtccaccagttcctctggccagtcatctggggcccaggcacatggcctggcctgccagctcccagc

SEQ ID NO: 28707 - DNA, 201 bp, Bos taurus
tagggtccacagcccccagccttcccagcacctcaccagcagctcctgatcctgtaggacaaaggtctggtctcctccatctctgctcgcaggctggttttggccctggtgggagtggcggcgggccatggcccaggtagaagcaggaatgagcctgccagtctctgctgagtactttgccccctgttcccgctgaggctc

SEQ ID NO: 28708 - DNA, 201 bp, Bos taurus
agtctgatagctaacatttattaagcacatattacgcattaggtgcagaaatagatactctacatactcatttaattttcctaaaattccttgaaaaatacgctggcattctccttttatagatgaaaaaccagacttagcatatcatagcaatgaggtagtagagctttattttaaccacggttagtctgtcttaaaaac

SEQ ID NO: 28709 - DNA, 201 bp, Bos taurus
actaaggcaggttactctccttatccaatcccaggatcaaccccgatgcattaacactattctgataaacccaaatccacctgtaccttcattcaagtgagaagcacaggcccttttcaactctgaaaactctagaattcaacgagtggggctcacactagaaatattagtagcacttggaaatatctttgaaatgcagat

SEQ ID NO: 28710 - DNA, 201 bp, Bos taurus
tgaggctgaaggggaggtggatttcttacattccaagtgcttggttggtatttctgaatggcccatcctggagcctcctcccaggcctgctggccaaacatatggtcatttgaaccttatggctgggattagggtagcaaggaactatcttggagccccctgaggcctggagggaagggttaaggagcagggatcataggc

SEQ ID NO: 28711 - DNA, 201 bp, Bos taurus
ctagggaccagaacagccagtataaactcatttcgctgctgaagggctgtcacaggaatgtaatgtagtaatttagagcgtcctactctaggtgtggcctcggaaccaggcttcactgggagcgtgttagtgatgcagtctcaagcccccgggctggctgagtcaggagttgctaacatgccaccctggtgactggcaggc

SEQ ID NO: 28712 - DNA, 201 bp, Bos taurus
actgaaggaagggcagactggctgggggcggggtggatggtacttataacctctggttaagcccaaagacactgtgtaaattatggcccgtgtcttcctttgtccctactttgcattcctgatcagatcgtcactttctgctgggagagagatcctctgtatacagggcccagggccttcctgattcctggatcttgttcc

SEQ ID NO: 28713 - DNA, 201 bp, Bos taurus
aaaggtgaacctgtggactgaggctggactgcagacaaggcacctgcgaagatgcagggagagcattccaggcagcttcagggaaagctctggagaagggagtaggcctcatctaccgtcacggtccttggggcaggggcatgccacaagctctcacgtgcatctcctgtgattgaaagctaaggtaacccacacctctgg

SEQ ID NO: 28714 - DNA, 201 bp, Bos taurus
gagtgagtgctgtggctgtgtaaacacggagtctggtgcacacatgtgggtcctagtcttgagtggtcagacagccgttggagcattgtgtacacacacacgtgggcagactgggccgggggtgcatacctagacagggccccacacggggaggggacgtcagggagcccccagaccctcccgtggtggccagcctcaaag

SEQ ID NO: 28715 - DNA, 201 bp, Bos taurus
ccaaggtgggtatcccattgccaggcctgtaataagagtcacacagtcttttgtgctcttcaactgactccccacccccatgagcattctcatcacccagcaaactggcctcttgccttcccttctgtaggcatctctgaatagcatcccaccggcccacaagccctcattgcctaagccagccctggagagagactccaa

SEQ ID NO: 28716 - DNA, 201 bp, Bos taurus
ggatgcttcaataaagttcacccaatgctagatatcttttatctgaaaatgaagtaataacccacatatgtgtccaagcagccaagtgtccccagcccttagatccaggagcagcaggaggaaggccacaggaggggcttccagggaacctggcctgggcggccccctgggcactggacaggccagcccacactcctggct

SEQ ID NO: 28717 - DNA, 201 bp, Bos taurus
cttacttttgtttgtttacttcagttaagtgtttattgaaagtctactatcgatgtacaaaacatcacagataataatctctactctactgattacctgtatttgtgaaaattcaagccgtgtctataatttatggacaggaattgattacaagagtgaagtcagaagattttaggttaaaaattacaaaagctatagata

SEQ ID NO: 28718 - DNA, 201 bp, Bos taurus
ttttccacattaggctagagcaaaggagtagaaaaacctgcaagattagatttcaaaaaagttgccctctctcaattctcctgaattcttcaaggtatgacggctaggtgcagtctggaagaatctttctgccgtttttttttttttttttttttaacatagactggaagcactgtagttgtattgtagtatttccctggg

SEQ ID NO: 28719 - DNA, 201 bp, Bos taurus
cattaaatcctcagaacaatcaaatgagacaaatactatgacccataaacctgatatatcagtcaaggtacaattagaagaaaccacatggtaatttgaataggaaaagtttaatataaagcattattaattacaataggcaaagaagtactaaggggtagagacttaagatatagggagcagtcactacttacagggcta

SEQ ID NO: 28720 - DNA, 201 bp, Bos taurus
tttaaatttctgacctccagaactgtaggagaatatctgttgtttaaaaatacgaattttatggtaatttattacagagacaataggaaactaataaaacgaggaggaagcgacttgccgtaactgtgtggtgaaggtagtctaatgctaaggaaatctttgtgttccctgagttctttgatttttgtttcaggaacaagc

SEQ ID NO: 28721 - DNA, 201 bp, Bos taurus
ggcagtagggcctgatcttatcaactgtatttttcatttctacaggttctgtgtgtatggtttcaattctgctttgtcttcctacacattcttttatttggttactggcctcgtatctgtttagtcattttttaaatccctgtattatgtattttcttgggttattctgttctctatagttcagcgattaccagttgttac

SEQ ID NO: 28722 - DNA, 201 bp, Bos taurus
gagcgatgaccactgtctagctgcagtgcgcaggcttgtcatggcactggcctcttttgttgcagagcacaggctctagagcgttcaggcttcagcagtttcagctacacaggctctgtagttgtggtacccagccttagctaccctgtggcatgagggatccttctggaccaggaatcaaactcatgtgtcctgcactgg

SEQ ID NO: 28723 - DNA, 201 bp, Bos taurus
agatcccctggagaggggaatgggaacagtttcagaaaaaaacaaaacatacgtcaacagatgaatggataaataaatgtgacatattcactgcacagaatagtattcagtcattatatgaataaagtattaacacatgctaccacatgtaaatattgaaaacagtaagtgaaaaggccagtaataaggatctcctgttgt

SEQ ID NO: 28724 - DNA, 201 bp, Bos taurus
aacgcagggggtgccgtggtggcctaaacgttagttttctggctttcactgccacagcctggcttcaagggtttaatctctggtctgagaactgaggagagaaaaagaagagaattcaaatcaggccttgagatacggagggcctggcagacgtttgggcgactgtgtggtcaggggagggcatgaaaaggagaggaatgg

SEQ ID NO: 28725 - DNA, 201 bp, Bos taurus
tcaggtatgccaatggtttttaattactccaatgtgtattccaagatggcatggaaagatttgtatgctaagatgttatgcacaaaacagcagacagatatgtttagaatgatcccattttgtattattttatatatggaagagcatatactaaaatgtggtgggattgagtcgtgggatttcaggttaaaattttttgtt

SEQ ID NO: 28726 - DNA, 201 bp, Bos taurus
tcacataggccatcttaaatgtagtaagaaagacagcatttttcatccctaagcccacaatctcatgagcccaaaggcaagactttccacatctgtttaatggttttgagaatattctgattggccctgcctgggttacatacccaccattgaaccaattagcgtctcagaggtggggattttggccagccttggaggtac

SEQ ID NO: 28727 - DNA, 201 bp, Bos taurus
ggaaaaaaaagtcttgatttgcagtatttttcagttttatgttacaactaatttcaaactaccaatgtgaagtcagtgagcatgaatttgggaagagatacgtacagtttgctcccacaagtcatttccagggtactgctgccaactctgtacatggctgtaaaaagtaaagctcaattcatggaatttgacatgtctcta

SEQ ID NO: 28728 - DNA, 201 bp, Bos taurus
ccacttacctggccttagcatgttctgctttctgttgttgcttgactggtaagctacagaagagggactggattttggcctttttttgtgagtctccccttaacacacacacacacgcatgcgcgccccacatagcacaaggctgagaacactgagaatgctcaataaagaaacatttttggcctgaatgaatggcctgaa

SEQ ID NO: 28729 - DNA, 201 bp, Bos taurus
gctgggagagacgagccagagggccccttgcctgcctcagcgggaaggaggatccagagacggggtctcactggagagatctggcatttgggctctagcaattggcaggtgttttacaggccagaggaccacagacaaatagatgggcatttccttttcctttttctgccatttgcctcttttcattctctggctccccac

SEQ ID NO: 28730 - DNA, 201 bp, Bos taurus
aggcctggggtacatgttctggagactgccagtacggttgcagtggcctttctagctgccatgtacgactggattcctccatggatgcacttgagggccaggtgacttccaaggtctttgaatggctctgacagccatgacctagatggtcatgtagctgagtggaggtagggcctactcaggatagcaagggctccccag

SEQ ID NO: 28731 - DNA, 201 bp, Bos taurus
ttactgccattctgcaggtgaggaaatgggctcagggaagtcagtggggaggtaggtactcgatgagaaggttgagggacccaaacctggcccctcagtctagccactctgagtcgctaccctgaaaacgaacaagctcacagccccagccttgagactgtacacctgtctgaggagtgaacacttggcccgtgcagctct

SEQ ID NO: 28732 - DNA, 201 bp, Bos taurus
gaggacaggaatgtaaattcctattgaaagccgtcaatagttaaaatttggagccccattaatatagttcaagtcagaatgcacttaagtaatgaaaagctcaggcggtggcctggagtttccccttcctccatcaggcctgccaattagcccagagtaatggatgcccagaccccaggacaggactgagactggctggaa

SEQ ID NO: 28733 - DNA, 201 bp, Bos taurus
ctgttgtaaccaagccatggtgctcattctccaccatccttagctccatggcactaggctttcactcataactctgagaggccatggattgaagccgggtaaaacccagacatcagccaatcagcagcagcctttcctggtttgccatcagttcagttcagtcgctcagtcgtgtccaactctttgcgaccccatgaatcg

SEQ ID NO: 28734 - DNA, 201 bp, Bos taurus
ttttcactggtaggctcccggtagtcatggcctctattcatggcctacactgttctgtttgtcttttcttcttagctttgtactccttttcacccagtgcaatgtcttattgccaccagtgaggccactgagcaatgcttagctccacaacaggctctcaggtcacagaggaggccaatcccagtttgcacccatgctact

SEQ ID NO: 28735 - DNA, 201 bp, Bos taurus
ctcctcagcatcccttctttccacttcaggaagcctcgtatccatcctccgttcatccgtttaggcattcactctcattctcgttctctccattcccacataggcctgtcattctcacaccatgtgctgaggctccccctgtgctacagtacactcatagggatgctacagggtgttttgagtgttggaaggcagcacagt

SEQ ID NO: 28736 - DNA, 201 bp, Bos taurus
gatagatagaactcattggaggcagggacccagttttgaaaaattcagaaataagttttcttatgtagaatgagtttgtgttaggacaggccttgaacagatagaatttaaatctagatttgatttaaagctctgctctgtggttattaatctgcaagcagtgtgcaaggggattggaaagaaaagagccaggacttgaga

SEQ ID NO: 28737 - DNA, 201 bp, Bos taurus
tgccacagctaacagaaagcttcaatctgagccgttaagaatttactagttttgtctctcaacccctaccgcgggagacccctgaacctttattttccttcgaggctgtcctgggttttcttctttaacattgtccctgatttatggtatgtccacatttccctggatagtaccatcttttgagttatacatcatcagggt

SEQ ID NO: 28738 - DNA, 201 bp, Bos taurus
gtgccttcttgtccttgctgtccccaaaactagagcccaggtcttctggctcctgctctgagcacttttctcagttgtttggtaaggtgtgggcgggccccgggtgccagtttttctgcagagcccagcacagccctggataaacaaaaatgctgcgttggaccctgtcacttgatcaggtgtttgatgagggcctctgca

SEQ ID NO: 28739 - DNA, 201 bp, Bos taurus
ttggactgattggggtcagccttaacttgggttccattggtgctcagcacgacacagggctcggctccagggagttgtacaagagctaaatggccatcagtgatttgtaacacactttgaatgcaatctcattagagttggattcgaatccagagtcacagctggaaaccactcagcagccagttttggtactgagtcgag

SEQ ID NO: 28740 - DNA, 201 bp, Bos taurus
acccttcaataccttccaaccatgctgcgatggaattaggattattcattatttttcacagagatgataaaacactgggcctaaagttggtgctcagtatttcttagctgatgaagatagacagaatggtcctaagggaccacactgaagcagcaggccccacactgtgcgaccgcgctgtctgcggttccctcaccctct

SEQ ID NO: 28741 - DNA, 201 bp, Bos taurus
atgatggcacccaatcagggcctctgaggatgcatgagaggaaatccaactttatggaacagggactctaaggtgtggccctcattggccaagggtcagcgtgggctggagagccaggggaaggcaggaggctgggggaagaccagggaaagaggaggaggagaaggatgagcaggaggcacctggctgggccctggggaa

SEQ ID NO: 28742 - DNA, 201 bp, Bos taurus
cctctggagctgccacacacacacagcacactggcttgtgaacgtctccagacctggctttcacctggaacactctttgtaactccagtgccaggcccgcataaggcactcaaaagatgcttgttaagtgagtcactgaatgtccatttccaacatggggacaccgaggcccacctcattcgatgcagttacaacctaagg

SEQ ID NO: 28743 - DNA, 201 bp, Bos taurus
ccttcacccaggaaaggtcaattaaggtcatgtcattctgcacctctcaggagcccctggaatcacagcttctatccttccagctggcttttggcacatgcacgccttctctggccacccccaggggacaacagacactgggagagtctggcctcagggcaggctatgtacccatgggaattttctaagacttggggataa

SEQ ID NO: 28744 - DNA, 201 bp, Bos taurus
ttgccagcaaggccaatacaaggtttgcttttccaagctttctggtatttttcccccaatttctggctggttgaatcttcagatgtgaagcccaaggatacagagggccagctgtactttgtcacatatctcatactgctttccgaagatataaattattacagatgctcagccaaagcccccagtatacccttctcttat

SEQ ID NO: 28745 - DNA, 201 bp, Bos taurus
ggcaggctacagtccatggggtcacaaagagtcggacacgactgagcgacttcgctttctttcactttcacacgcttgtcagcagaaggcctgaagctcttttttcttgagcttggtggaggcgggctgctgtgcagcttgtgggaccttggttccctgaccagggattcaacccgggcctgggcagtgaaagcactgagt

SEQ ID NO: 28746 - DNA, 201 bp, Bos taurus
cctggggttttagcctccgatctagggttttttctgtgaagagttgggtgctcagaagtagatggggatctatatggagctggagccctgagggccctctgttctgcgctgattcatgttgtaaaatattgagtggattagcagtgccatttaacccaatctgggtgagccattatggagggaaaaatctgtgtatttgag

SEQ ID NO: 28747 - DNA, 201 bp, Bos taurus
gtgacctcaggtaaattgcttcacctttctgggccatgtgagcctcatctgtgaaattcagagaaagccccatccttaggaaatctcatcatgtagtaataacatctggtgacatcattggcctttaattgataggaacaaagcaggaaatttgaaaggaaatatgtctgtgtttcctccctctccccaccacccaattcc

SEQ ID NO: 28748 - DNA, 201 bp, Bos taurus
aactgttagaaggtgggagcaagtcaagagaagtgataaagcctgaatctgggcagtggtgggagatagtgggggcaggatggggtggatgtgtgtggccgcagtgggaggagtctctgaatgtaccaggctcacaaggagaggtgcctgctgcctgatacccggggtccaggggagaattaatgggtgcatgtgggcgag

SEQ ID NO: 28749 - DNA, 201 bp, Bos taurus
tcattttttactttgattgctcacagtgtcccggccttggcccttgcaagttgttttctctgtcctttggatctgtgggcagggtttatgaaaccccagagctccccttgaggcagccaaggccaggctctgggaaggagcaccttgaaggggagtagaagtgaggggggagatggtggtgcttgacaccccttccccaca

SEQ ID NO: 28750 - DNA, 201 bp, Bos taurus
gttcagttatccctggtcctgagtgacagggacctcatatcgctgggcacagggcccccagggacctgggctctcagggacagcagcctgcctcccagcattgtgacctacccccaggtctcttgctctttgtgttttctagattgtgctctggggaccggccttggtttctggaaccccagcctcctgtttgcttttggc

SEQ ID NO: 28751 - DNA, 201 bp, Bos taurus
ccaggaggtgctggctggagagaaaggaagcggagcttctgaacaggtggggacccagacaaaacagtcctacagagccaggaagagctgagggttttctctcaggaagtactgtcccctcctgccctttgcagttgtccttctgcaagacatgtggcatgacctttcatgattacacatgtggaatgtgtccacatccca

SEQ ID NO: 28752 - DNA, 201 bp, Bos taurus
gccctgtagtgaggagggtgggggaaggaaagcagggttgggtggcaagggtgggacagctttactcctgccttggcccctgcccctgccccgacagaggagaaagaggtcactttttagctccactttctaaaggtctgcattttacaaactgtggacaggaagacatcctgtagagcccagaggccactgggctcggga

SEQ ID NO: 28753 - DNA, 201 bp, Bos taurus
aaattggagcaagttgaagaagaggtgcctgccatggggaggcaaaaccaactcagaggcagtgctggcagtgtcctgcaggctgggcccccaagggtgaggggcactccctccttgcccactcactcgtctcgcccccgccttctccacctggtgtcacctcccagaggtgcacagactaaagaagggcctgggtctcca

SEQ ID NO: 28754 - DNA, 201 bp, Bos taurus
ctcagggccatgagactcagtggctgagatggggtcctcttcatttcactgcatccctcagccacctcagagtctctaaatggacgacagaagcacagagggggtggaggtttggccaaggccgcacagccactgagcagtagctaccaaatgggatgcctgaggtcttttgtaccaatgagttgcacccacgagtcacct

SEQ ID NO: 28755 - DNA, 201 bp, Bos taurus
gcgcctccccttgttccccctccttggccacagcaggcccaccctgctccccaggttgctgcatgccagctctcagcaatttggcaggcagtgctgaaatgtcaacctccctggctccgagaggcccacgtctgctggctatgagggcaccgggctccaggcagtcgccatgtccaaggtccccaagagccctccgtgtgc

SEQ ID NO: 28756 - DNA, 201 bp, Bos taurus
tagcaagaccacttgggaggattctcctggggggcaggagacacccgaagtcatccaccggctgtgccttcccggcggcccccttgggcggcagcgttccgggagacccactcgtacaagtgttgcttccaattaattgcctaggcgggggagggaaggggcctgtcgccgcccccgcccggaggctggagcgccgctcgt

SEQ ID NO: 28757 - DNA, 201 bp, Bos taurus
cacctgagccaggccgagggcaaaggaggctcgggagacacatggctgccatatggtagtcctgccacgtgctgctccagcctgagacacagtcttggggacaatggtcctggctgggcctggaatcacttcctggtttgggggacatccatcctcagccttcagagctggccaggacacaaggaacctgcccagagcaga

SEQ ID NO: 28758 - DNA, 201 bp, Bos taurus
gggtccagctgtctgggagtaggcaggacctgactccccacccaggtcatcacggggcccagccctggctcacccctagtcatttgctgaaggcctgagcgggctggtggaaaggcacttggagtctctggctggaatcagaaaaagcacacggcgtggagatggaaggacccgtctgccagtatgggacatcggggccat

SEQ ID NO: 28759 - DNA, 201 bp, Bos taurus
cccttcctgggaggatggaatccctctcaagcttctcatctctttcttttcatccttaccatagctaggaaaggactcataggcccgcctggataatctacagtatgttccccatctcagggtttgtagccttgatcacatctgcaaattcctttgtcgtttagggcaacatagtcacagattctgggggtcaggatgctg

SEQ ID NO: 28760 - DNA, 201 bp, Bos taurus
aactgaggggaatacactcacctgacatgtatggtgccacgactcggatttaacctggctgaaacaacctcggtgcgggccccccacaaggaggaggccacgaacagcaggatcccaactcaatgaaagctcctgtggttgaagcggaacatgaagaaaacccagcgcaagggaactaacaataggcccattgtgctggag

SEQ ID NO: 28761 - DNA, 201 bp, Bos taurus
gctttcggagccctgctgctcttgtctccagaggatgggagaggagatgagggaagggcttctcctgatctcaaggagctgggccagccctaatcctcatctttggaccaagagcagcccctctttgtattcctctgcctaggacatgcttcccctccctctctccatattgctcctgctcacacagtcccagagtttcct

SEQ ID NO: 28762 - DNA, 201 bp, Bos taurus
tctgcccggaactgtctgaggcgggccctgggttgtatgcactttccaggtctaaaccgctcaggttcaggtactggggtattccacaaaggagcagacagggttgggcctgcattttgtacccttcccaggtccgagcagctcaggtgaccaggtgtttggcgagcatgatagctctgacttatcgcctcctcatcccgc

SEQ ID NO: 28763 - DNA, 201 bp, Bos taurus
ctaagcctccagggctcatctttaagtggagggtagcaaagttttctttacagaacagacatgagaattacctgagattacttacgtaaagcacttaggattgggccagacagatcatgcaacatagtaactggtagttgttagtttcactattgtaacaattacattaacacaaactactacgtgtcaagcatagctaga

SEQ ID NO: 28764 - DNA, 201 bp, Bos taurus
tggcccacacaggtatgtgtttgtttgtgtatttttccatattttggcttgccaagacagagggcaaggattacttaattatagactccacttgaactgggagtggctgatccttgcaggccctcagctcctgatctcattggttcaggcgcatctgaggctgggaccaccaggaggaatttgcaatgatgggcagtatgt

SEQ ID NO: 28765 - DNA, 201 bp, Bos taurus
caacccctgaaggggatatctgtggtcattgtgtccacccttcgtgtcagggtttattgggggcctgcttttggaaatgaagtctgtctgatgtcctgaaaaacttcccgggggaagctgggatgtctgtgccgctttggctgggctacactctaacgcctctctggatcttgtcctgccagttctgtcctcctcgttcag

SEQ ID NO: 28766 - DNA, 201 bp, Bos taurus
gacactgaggatggccaggaaaagatcgaggggctgttggtgtctatgtcagttggggccccagtagaaaggatgagggggcctcaacaagagtcaccgggtgaggttttattcacgaaggtggggtgtaggggacccctggtggaaagggcagtggcttagtggcatcccacacagcacccccaggccctcatgctgtaa

SEQ ID NO: 28767 - DNA, 201 bp, Bos taurus
cctggcagggtacagtccatagggttgcaaaaagtcacacatgactgagtgactaagcacagcacgttgccaaaagcacctacacgtggcctccacatgtagcttgctccacatgtagcatctccaccatggtgcttggtttctagagggaccattggaggccaagtctccctaagccccaaagcaggagctgcaagattt

SEQ ID NO: 28768 - DNA, 201 bp, Bos taurus
gacagtaatatatatgtcatagggctgtaagggagattaagttagtcctcagtacacgtacctggtccttagttcatactttttagtgcacataaggccttgatatatggataaatatattattatcaatacaactttgtgactaaaacaaaaatgcctactctagtgtccgcattggagaataggcaggcaaagtaaacc

SEQ ID NO: 28769 - DNA, 201 bp, Bos taurus
gtctgtaactgagaaagttagaaattttgattaaatggctctacatttccatttaagaaatgtgtatgttaacaggtattggagcaattctctgcacctacgtaagagatccctctttcttatcttttcctatctaagttgttttcttcctgatttggtatgattaatagtgggagttgggcccacactcaaaacagcata

SEQ ID NO: 28770 - DNA, 201 bp, Bos taurus
acctggttaaatgtttgttcattatgttttattaagtattcctaaattgtttcaaaaaacttatagcagtttttccttctgacaaaatacatgaggttatacattatctcatattctcaaaagcagttttttaaaccattcaaatgtatatttagaaagcattttccatagtctagacattatgctaagccccaataatta

SEQ ID NO: 28771 - DNA, 201 bp, Bos taurus
attattagtttcttttgtattatcaaccatgtttgttttgattgaaataaactctaatgaaacagaattatacttctgaaattttctccaggggccaattatatacttatttattttatgaatatctaaggagtactgactagatcctatgctttgtgtaaggcactcatgatactataacaagcaagacagaccaggtac

SEQ ID NO: 28772 - DNA, 201 bp, Bos taurus
catgcacaaaagatgctgaccttttctctgaaagacagtccaagactattttggtgcccttactaggattcttattcctgagatgattaagaacacatttggaatttcaagtggagcagagcacctgaattgaaaagatgtctgacaaatggtttttaggtgaaggaagagagttggacattctttctgtaaaatttttaa

SEQ ID NO: 28773 - DNA, 201 bp, Bos taurus
aattagcatatgaagcagaatgaaagtatcattaaattgagaagaatgaaacagtcctctctgatacaaggcacctgggaatcgtaatggaaggaagacccgtataataccaaagggagaatgaccacagttctagcagtcataattctctattttcctagctgtgcatttattatacttcccaaaagaatcagcactatt

SEQ ID NO: 28774 - DNA, 201 bp, Bos taurus
tcagattacagtgagaagcactcattccagacctcatctttcccaagatatggggtctatagagagcccatggctgttcctctgcatccacttggatgctgattgcgttcccttctcagatcaatagcttaataacagatagatttgattagcctccagcccaattcaaaacaccaagctgacattcatctcgtgtgaccc

SEQ ID NO: 28775 - DNA, 201 bp, Bos taurus
aagatacagttgatcaggaccatgaaacttcaaaggaacaaattttcacttaataactcatgttattttgtaagcatgtattattaatatatgccagcttttgagtgctttgtgtagagtatgtcacttgttcttaaaatatttacagatggagaaactgagaaaataaattagcatgccagtgtatagctccaattatgc

SEQ ID NO: 28776 - DNA, 201 bp, Bos taurus
ggcacttgccctcaccaagaactacatcacatctaatattatgtattaaaatgctccatttatgtgtcaacccctctctctcacaaggtgtttagtttaagcatctccaaaattcttttactctaccaaactctccatttcctgccggggtccagccccggtggatccagggaattcgaagtggggacggcgtctgcgagg

SEQ ID NO: 28777 - DNA, 201 bp, Bos taurus
gaatatgagtaaattttcttcctgtgtaataactctcccctgtatttggatgatgggcagaaagaggctcattgtgacctccggttagcaagctggtacagtggcccttgctgctgttgaacgttattattaatctatatctatgtaaaggaaggcttcccaggtggctcagtggtaaaggatctgcttgccaatgcagga

SEQ ID NO: 28778 - DNA, 201 bp, Bos taurus
ctctttttacccaaagcgtgatacatttacattttttagttcaacaaagttattatatattacaaaatcattcatttcttgatgaaaattttagaaatatattgactactcttatggaaggtgatagagaaaactaaattcaacattttattaatttatatccttttgcatttattcttttgtggttttgttcagtggtat

SEQ ID NO: 28779 - DNA, 201 bp, Bos taurus
aagtaatttgcaatcctgggaggtggaaggaggattgtggggcctaaggaagaggtgtacccaggaatcatcccaggaaggtggcttgccttcagaggggaaagcctgtgcacctgcagcagaggcccccaggtcccagactctctgatctaaaggaaacaggaggtcagggcagccagaacacacattagtgacccacat

SEQ ID NO: 28780 - DNA, 201 bp, Bos taurus
ctggtgggctacagtccatagggccacaaaagaatagtacatgacttaatgactaaaaaacaactgctcagaagagatactagggaagaggcgatactaactggcccttcagtcccctccactgattcacatttctaaaatgcacattgtattagttaattccctgttgaaaaattacgaaattacgatatgtatggtcag

SEQ ID NO: 28781 - DNA, 201 bp, Bos taurus
gactagtaagtgctctgagtagtatcatcatcaaagtttttagcattcctttctgtgctacaccctctccttcatgcactttcatcctgtacatcagttcccttagtactagataattaaaaaaaatcctgccaataaatctgctaaccagtgaaacattggagagacacactccccaagttgtcttttcatcagtggtgg

SEQ ID NO: 28782 - DNA, 201 bp, Bos taurus
ggtgaggctaagaaacttggccagtctcacagaaacattagtgatagagctcggatttgagccaaggcttctgacctcttgaccagcatggttgctggccatgcatacagcccgaattactctgtgagactgattctgactgagaggggagagagggggaatgaaactggccataggacaaaaaacatgctgtgttaaaga

SEQ ID NO: 28783 - DNA, 201 bp, Bos taurus
gaccgggaaccagaccttcaaggcaacgatatggagccacagccccagcaccattccgaagagtgtcctcaggattcacacttcctgagcccaagacttcacatgccagagaagcagtgtcttccctctttgccttctatgatcctgactgccctcacccctactggagagctctttcagtgcaataacatccaaataatg

SEQ ID NO: 28784 - DNA, 201 bp, Bos taurus
agaccctgcagggtgcctgggctcaaaggagatgaagacagaacctggaaattctctcagtgacactatctcatagtgaaaagtcagtgagatgaaggccatgaaggcattagaaagagcccaagctccaggcaaggtcagccaggttcaaatctcagctcttccattcatatgctgtgatctaggacaagttacatggcc

SEQ ID NO: 28785 - DNA, 201 bp, Bos taurus
agtggagctatggagaaagactgcccaaagaggccttctgattgccagctacgagaggctcgaaaaaagactctgatagcagttgaggcagtctgtgtccctgtatgcttggtaccatcagagtccccacaagccaagcagctgcgccaccttcatgctcaactgtcactggggcagaactgccacaggaaagaaaaggct

SEQ ID NO: 28786 - DNA, 201 bp, Bos taurus
cacctccctgttcctatggttccagttgatgtacatgcatgtcttcacttctcacagtgcaagatgctgttggccttgttaaggaaaggaatctctccacgccagtggagacttgcttgtttagatctggtcacaatgctttcctctgcacagtgccctgtgccagcagtgagaaagggcacctcgtttattacatggact

SEQ ID NO: 28787 - DNA, 201 bp, Bos taurus
ccacaccagctgcccccgcggccccacagtagccagaatcccctctcctctgtctgccttccccatcagattatctgtgttctgttccttgtaggaaaggatgctatggccacctggtcaaggatgcccactgagatgacagtccttggctatagtttctcttatgaaggagagaagaagccatgataaactttgcaaggc

SEQ ID NO: 28788 - DNA, 201 bp, Bos taurus
cggccacaactggagaaagccctcgcacagcagaagacccagtgcaaccaaaaatagtaatagtagtgaagtttttaaataaggcactgaaggagcaggttggtaagggccctctcccgagcatgaagcactgttcagccactttcccctgaatctagtgagttcttacagcactggtcctcaaacttactgtctacagag

SEQ ID NO: 28789 - DNA, 201 bp, Bos taurus
ctttcagaggaagccaatgagtctggacacagacaacagaaagaccagagccctccagaaaagaagacccgagtctgtcttcaggcctctggactgggtgtaatgaataggacccagaggcaccacctgagtaggcgagctatggctctcaaggatttctggagattctgtgctcatcagtgaggcctctaaggcctgctt

SEQ ID NO: 28790 - DNA, 201 bp, Bos taurus
aaattaactcgagacattacgaagagtaatttacttttcctgccttgacttcctgaccatctattcatttctttaacccttggtatctgaatttcacctttgcaaaggtcacctgtaacctaataaacacttttgggcctcctttctaagtcaacttgaactttttgtagctttcagcctcaacccatcattcttggaatg

SEQ ID NO: 28791 - DNA, 201 bp, Bos taurus
cttgactgaattctaaaaattgaaacaaggtaaataagagggatgcgtgtggggggtcagagtgaaaggtcaggcggaagagttaggcaagggccaggccgtgtggggtcctacatacagactgagctgaacgtttctaactgtcattttggattttgtgacatgataaaccaccccacacgccagtgacttgaaacaact

SEQ ID NO: 28792 - DNA, 201 bp, Bos taurus
catcacttagactatgattcactttaaggcctgggaccagaacgcagaaggcttcaagaaaggaatcaggactcctgcacccaccggaatactgcaagtacccacagatatcctaaacactcagggccccaggattatggctgggagggataaggtcaaatgggaggggggcagaggaatgggaggggtcacatccaccag

SEQ ID NO: 28793 - DNA, 201 bp, Bos taurus
ctcagaatccattctatccagatggggtcatttttgagctatgtaataatgttactgtggctccatgcaaggaagtattatctaaaactcagttatctctcgaaaaagagtgggctggatctataggaagcgtgaccctggtaactgggtgcgtgtaagcaggcaaaattgagtctttttcctaaaaggggacaggtgaaa

SEQ ID NO: 28794 - DNA, 201 bp, Bos taurus
tcagcataatgatgagaaattcaggctgagagaggtgagtgatcagttcaaggtcactcagtgcagtgatgtgtctgactttgtctctcttcaaggaacattggccaacgctaaccttagatgtcagtggcatccccttggaggaatcaggtttgaaatgacattaggagaggctcagatgctgacagtggcacagtttgg

SEQ ID NO: 28795 - DNA, 201 bp, Bos taurus
ctgctgcagcagtttgattagttaggtgatgaactcccttatgttctctaatgaagatgaatatagtgtacattcatacacgtggggttttttaaacagacgtaaagtttgtggctgttatagttcaaaaatttcggtaatgtttgtaggctgcatttggcagtaggacatacagtctctgctggtagtcagagcacattc

SEQ ID NO: 28796 - DNA, 201 bp, Bos taurus
ctgatctgggcaagcagactcagagggcggcccctctgggctgcagaccttgtggccgaccctgaaacttccggcatccctgcccaaagccccatcccgattcctcctggctgcccggggttacagtgctcctggtcccgggagctcggctcagccctgactgccccatctttccaccctccccataaattcacttcctct

SEQ ID NO: 28797 - DNA, 201 bp, Bos taurus
ccttggatgggagggaccacctcttgactggaagtggtttgattctaacttattgctctccaggccctgcaactgttgttatgctctggggtctacggtcatctgggagaggggctgctatgctgtttagttgagagcaggttagcctgagaaacatggtatagattcctttgcactgatccctgccaggctgtcttgctg

SEQ ID NO: 28798 - DNA, 201 bp, Bos taurus
gtaccgtgtgctgcacgttaaatcttgctgagcccctggtagccgagcttgtgcacagtggacagtaagagtatccccatgctcctcctgccttcccagcgttggccactgcaagcccaggttgaagtcttgggtctttgggcaatgtgcagcccacagagtggacatagttcctctcatggagctgatggtctggttcag

SEQ ID NO: 28799 - DNA, 201 bp, Bos taurus
gcagactgcgtgactcccaggcacttgccaagactggccatgtatctgcagccctgcctgggctgggctgagggaaaggtctgaagttcatagtcacagttggtgctgataccagcctggcctgtgcagcgggtacttgccttcagcatttttgctaattgtctcatgctgcagcacttcattccagggtcttgttggggg

SEQ ID NO: 28800 - DNA, 201 bp, Bos taurus
gctggattagttggataaatggatttagaccagaggtttctaggatagagactctgcgggagctggcctgtggtgagcacgccactggcctgagaccttctcgagccccctgagtctgtctgtcctcatcggtcatgtggtttacctaagcagaaccattacagatatcaaactatactctgaaaacctgactactagaac

SEQ ID NO: 28801 - DNA, 201 bp, Bos taurus
ccttcatttttacacgggctgtgagcagagtctggccatgggaaggctctctgtcacagccccatcttctgctccaagtagctactcatcggaggccacccatacagggttcctgccctccctgggcagggggagtgggggagtgcaaggggaggatggtaacagatcaggcccacccagccccctaacgtctcagccccc

SEQ ID NO: 28802 - DNA, 201 bp, Bos taurus
ggggtcccaggccctctgtcactcagcaacggtgcgacagggagtattccgaggctctgttatctcagaactgactgtgcagccacgtggaggagtgaggagctggggcctcccggggcagtctgctggggttctgtgggcccgccacgcccgctagccctgagcagctgcgtgcggcagtctggaccagggtctgtaggg

SEQ ID NO: 28803 - DNA, 201 bp, Bos taurus
gcatctttctcttcctctccaagcccgctcagaaggaaaaggaaactcacccttacagcgcccactgtggccccttgtcatcattctggccgccctgagcggagggcatcattcagccccacgttccaagttaggaaacaaggctccaggaattgcccaggtccacacagtttattacagaagggggccttctcctgcagg

SEQ ID NO: 28804 - DNA, 201 bp, Bos taurus
gtcataaagaaccaactcgcttcttgtacgaggcttgtacacgcacctgtctggactgagaaaacagcaacactcgttggccctgcttgtgccatatttttagcaaggactcaacaactatcattttcccagaacgtttccagtatccaaactgatcttctcctagttcctcgtctggaatgcctttaagattcttggggc

SEQ ID NO: 28805 - DNA, 201 bp, Bos taurus
aacaatataaaagtatggataatgatacgactgaggaaaaaaaagcgttcgctaaatacaatctaagttataaactcagttatatgatgcttttcagatacgaaataggatgaacacttatgtttcagaagggtgaccccatgtatgcataacggaagaagcgtctgaaggtctgagagtatcagtgacacagcaaggcta

SEQ ID NO: 28806 - DNA, 201 bp, Bos taurus
ttcttaatacaacatgaaacaatgaaaagggcctagggtgttgtccccaaatttcgcagagcataaaaatcacctgggcagcttaaaaaccctggaactctggcaggcctcgctgcagaccaattaaaccagaatatctgggatgagagtcaggtatcagtagttttcactgacccccaggtgattccactgcacaggcag

SEQ ID NO: 28807 - DNA, 201 bp, Bos taurus
gtgttgttaaatttttggttagtgggcagatcttatgttgtgttctaaactacaaaagcaaacaaaactaaagggattgggagaaacttttggaggtgatatatagatttatggccttgattgtgatgatggtttcatgagtgcatacttatctccaatgtcatcaaattgtacacattaagtatgcacagattttaatat

SEQ ID NO: 28808 - DNA, 201 bp, Bos taurus
gcggcatgaggcgagggtggacagggtccagtggtccacgtgtttcatggggataatggctggtggttctgcagtaactctgggccaggcactgggaaagtagatggagcccacaccctagaagcaagaccatgttctgctcccctgatttggagaggtgtggcatgaacaggactggccatgccatctagctccttaact

SEQ ID NO: 28809 - DNA, 201 bp, Bos taurus
aaagagggtggaagggggaagaacatagaggagaaaggtgggggggagggtgagacaccgcggaagaagcaaaggaagagctgagtgatcttatcatttctctaaagtagaaccagctaaacaaagtggaaccttcagaaacctagaggtattttgaagggtcagtgtatgcagtttcacaggtagaacttctgtggctgc

SEQ ID NO: 28810 - DNA, 201 bp, Bos taurus
gaatcatacgagatgagactatcctggcccgttccttcaaatgccccctcgtgaagccacattccatctacagtcactccacgcgttaggatcatggctccgcaggccaccaacaatgatccttcagccgggacctgtcttccaaactccattcacgtgtcaacagctggttgcacgtccccttggcgagttgaagaggca

SEQ ID NO: 28811 - DNA, 201 bp, Bos taurus
aatccataccaagggagttgagagctgtccaagtggagaagctgcagcggaggaccggggtctgggacagaggatggaggtcacgccaggagaagaggcctgctttgagtagcacagctcttcaaaaactatcgagaaatatctcaaatgtgagtttcccagcatgcgaggtatgcacacacaggctggatggccgtgggg

SEQ ID NO: 28812 - DNA, 201 bp, Bos taurus
gactcatagctgttaagaataaacatgactgagaaaaaaggtgtgcagtacatgtgtaaatacactgacaggtaggaagtgtggatttcaagtttaccaggttagttgacaggttgacaaagtctgcgtagtccttgttgatgagctcaaccatggctgttttaagcagcttgtagtagagctccaggtcatctctgagtg

SEQ ID NO: 28813 - DNA, 201 bp, Bos taurus
agaccctgtacctacctgaaaggagcccaaagtttcccccacacctcaagaaacacaacgagattcccccctcagtgtcagatgtggcccttatcccctgcagcgcttccagagcaatcacgagttccttcttgaaacttgaaatgaggcttgaccctcattttacaactcgagtggaaagcacagttccatgcctcaaaa

SEQ ID NO: 28814 - DNA, 201 bp, Bos taurus
ggcactggccatggatgaccttggagaagctatgtgaacactatgcctgctgttctgaggcatcggtgtttcatatgaaagtttcctggctcagcagaggggtggccaaggaccttcatggcagcaagtgctggttagactgcctggatgacagggattcctgtttgtgtgtcatctgccggtcttcttatgctactgttt

SEQ ID NO: 28815 - DNA, 201 bp, Bos taurus
acttccaatccagataatggagccaatgagacaggaatcctgacaaaaggactggagaattataacaatgattttcatatcaaaagccttgacatatcaacatttcttcagctgctgactgaataaataataataataactgggtaaatataataataactgggtaaataaattatggcacagtcataccacttcagagaa

SEQ ID NO: 28816 - DNA, 201 bp, Bos taurus
agcatcagtttcatttaatgtcattttttacattttgacaattttcaaaaataactgttttctaaaactaaacgtagccacgcttatgattaaactggtgattctgtgatgtttttagtggaagtgccaagatctggtaaacactgatttctgaaatcaccaaccgggcctggcagcaacactatccagtcagaattagct

SEQ ID NO: 28817 - DNA, 201 bp, Bos taurus
caaatacaaacagaaattgttaaggaagtggaagtgtggtgagtcctcctctcctataataaagcttgttacatattgctattgttgcttgtcagtcaaagtgaaataagtgctgttttgcctgaggaggacagggttggttatctctactgggcttgtttcttacctccagatctcctggaaccagaaactagaatctta

SEQ ID NO: 28818 - DNA, 201 bp, Bos taurus
gcagcaactttgtgcgagcctttaaaaatgttatgtgcctcagtttcttcctctgtaacatagtagcgatttaatgaggaagcaattaactttttccatgctacaggtaatatatgctatttttttcctttaaaaatataagtggaaataaacgatgaattagaatcctttctaactccttgaggaaaaaaaaatgcctta

SEQ ID NO: 28819 - DNA, 201 bp, Bos taurus
agaatttcaaccatggttggattccagaaacgtttaagtgctttttgctacaaaaggagttcagaaatccctatgcaatattaacaaatgacacatattatgcaaagcatgtacgtctttttcttctttccacatttccttagagttctgctgtgtgtaaagcactgttctccgaatggaaaacaactccccattgcccac

SEQ ID NO: 28820 - DNA, 201 bp, Bos taurus
gggacacgccgctgggacgcagccagggcagaggtgctcttgatgaagagtcagtcacacatgataagaaaggccaaggccaaggggacagaaaggtgtatcacagagtgatcaagtcacaggcacagctcaaagctccgttctgctgccctggctgggggcccgacaaaggccacctccctatctcaagttcaggacctg

SEQ ID NO: 28821 - DNA, 201 bp, Bos taurus
caaaccaaaagagaaaaaatgatggggatcacttcgaggggaccacaagtatttggaagggtgaggggagatcttaaccacagcagaaaaaaatgtgaaatagaagatgtggaagaggacttccctgatggtgtggtggttaagaatccacctgcccatgcaagggacatgggttcaatccttggtccaggaagattccac

SEQ ID NO: 28822 - DNA, 201 bp, Bos taurus
tagctgcccatagtgaatgatcgggtattagtctgaaactcgctatttctactgtgtagggtccttggaagtaaattgaacacacgagtgcctctgtgagtattgcccccaagtgtgtctagtccatttagtggactgtcctgtgggttcactttcattccatgctagaatggcagcttgatctactcatgcccaaggaaa

SEQ ID NO: 28823 - DNA, 201 bp, Bos taurus
gttcttaattatcacataggtcacagatagacttatacatccgtatgtttaataaatttactggcttgaaattgtgttggagtgatattatttggcctggatataggacctgagtcttaaattacagtcacttatataccattctggaatatgttgctgttgctcagtggctaagttgtgtccgactctttgtgacaccat

SEQ ID NO: 28824 - DNA, 201 bp, Bos taurus
catcttattaaaatgtgcatctaataacgcaagacgtgattgaatgtcattcatttcgatcccattgatcacatagtgtctgttggtcccagtgcaatttgtcaaggtaagacaatagtttaaagatggaagcaaacgagcttagttactttcacaattcccaaggacaaaaactgctttttaaaattttctacacgtatt

SEQ ID NO: 28825 - DNA, 201 bp, Bos taurus
caggcaggttctttaccactagcgccactgggaagcctaaaaccccgtgctttgggatgaagctctaagacaagccaacaggcctcttttacagaaagacgggctgtgtttcagtctgccatctgtgcagtgactgcaggcggtagcctcccgcgcactgactctgagatcatcgtaaccctgtgggaccaaggaaagcag

SEQ ID NO: 28826 - DNA, 201 bp, Bos taurus
gtcacttctttctgctcatgccttcagactcataccactcatggcagcgatccacatggaattataatacatggtggatattgccgtgttgccagaaggcagacccatttcagggcccaagagtgagcacttgtctaacactcagaaaagaaattttctgaggagacacatgtactgacaaagcaaaggactttattggga

SEQ ID NO: 28827 - DNA, 201 bp, Bos taurus
gtttaaaactagggcacccagatctgggagaaattactaaaccccattgaatggtatttgaccaagtcaatttgactgtcaaaatataccagaccttctacaatctagctccttctatttctgcattctgactcttcatgttatcttacttgttctttccattaagccactccgacttatgtcctggttcttgcatacacc

SEQ ID NO: 28828 - DNA, 201 bp, Bos taurus
accaaactgcaacccagagccccatttcctcatagcatataaggggttagaattccagtgtatgaatttggcggcagggccacaagcatgcagtccataacggatggagacatcattttctggtattttaataaagacctgggtctctgatccagaatgaaacataagacagagggagaagaatagtccttcccctctcgg

SEQ ID NO: 28829 - DNA, 201 bp, Bos taurus
tataccatcttgaatggcctaatggtgtttttccccaggaaatatacttgcagataattgtataacattttaatgggaaacattttgacctggattaaatatacaaggcaggccttgttataactcccacttcacttatgcaaaaattgagtttcccagaaactagagagttgcttttatatctcagggataaatggcagt

SEQ ID NO: 28830 - DNA, 201 bp, Bos taurus
gctgttctcgttcagtttatggccagagctacctgagcacctcctcctttagcagtctctcttctgcctccttcttcctttcttatcgtcacagtgatcgccttttaattgggccaccagagacaacctgaaatctagggagggcagttcgtggtcctcttcttacctcagtgtctaccgctggctctgggctgttctctg

SEQ ID NO: 28831 - DNA, 201 bp, Bos taurus
tgtttttagaagtaaaaccactctttaataatcactgagaagttaaggtttaacaggcagtatttccttttttatttttcttttctcaacattagcttttgtaacttttcttcacagaactgtatagttgtatattagttagcaggtttggaattagtgttaggtgttagtttagtatgaggttttagatttggtatagga

SEQ ID NO: 28832 - DNA, 201 bp, Bos taurus
gtcttaagagtcagactggaaggagccggggccgagcaaggaggctaggcggtgtcctgacctcccctgcacggtttccgggtgcggatacacagcagtgaacccgaaggcagcgcgcacggccggcgggcggaccaggccagttcactccagtgcagccgcagcgccccccgtttccaaggcgaccggcgcgcgcgggcc

SEQ ID NO: 28833 - DNA, 201 bp, Bos taurus
ttatgtgtgaaggtattttaatagagaaatggaaagataacttgtgggcattgatcatagtcattagtgttgtaaggggtatgaagagcatgagtagacttatttaccagaatcaagaatgctataattaaaaaaaaaaaaaagaatgctataattgaggagaactttttaaaataaaaatcattctagaaaaataacatt

SEQ ID NO: 28834 - DNA, 201 bp, Bos taurus
atgtatctatttcacactagattattgagaatatggaacttgctttaatatgttcttcaatacccaggcctttttcagtgatttactgctaaataaatgtatgttgaatttaataatatagtgactgcatattaagttacattttctcagcttttggagaagttaacaattgtttgaaccttctttagcgctgagctggag

SEQ ID NO: 28835 - DNA, 201 bp, Bos taurus
gtttataaacataaatcctctacaatattgtttttgttttaatcttctgaaagagttcctttcctgggaaggtaaactcaaccacagctttgagagagtccgcgtttaacatgagatgacattggttcatctaccaccttattgtacaggcagattcaggagaatattgcctatgtagttccatggtcatttctcagactt

SEQ ID NO: 28836 - DNA, 201 bp, Bos taurus
gagaaaagaagaaataaaagagggccaggtaaagaccaggcatgacagcgtgtcatgaaccagtgatggtaaacaatctaatttgggtacttgaatcacatgcatacacacaaacctaaaataccatagcattatttgctatgaaatgagtaagtacaagttgttacgggagtacaggaagcaaaatttcatccaaagtgg

SEQ ID NO: 28837 - DNA, 201 bp, Bos taurus
tatggacatggggagaggctaggagagggtgagatgtatggagagagtaacatggaaacttacattactatatgcatggccctcttttattctttcctttttcttttcttttatctttagtctcagttcagttcagtcgcttagttgtgtccaactctttgcaaccccatgaaccgcagcacgccaggcctccctgtccat

SEQ ID NO: 28838 - DNA, 201 bp, Bos taurus
ataacgtataattcacagggttgccaaagaatttcatgggataagactagaaaggaggcacaagagcccagagtttcagagcagaggctttgtggtcaggcgcgaataggtttgaatcttattctccaactagatatgaccttcaataaatcactaaaatctgcaaaatggagatcataatttttatttcagagggtaagg

SEQ ID NO: 28839 - DNA, 201 bp, Bos taurus
ttggcaggcagaatctttatcacctgagaagccccatataggcctatatatattttttttaattgtctgttttgtcagttaacatttaagttctttgtgagttttaagtttcaaaggccgagattaccatgatttcaaaaacaactgtttttggttattaagattcgtttttatattatagaatgtaattttcatattgag

SEQ ID NO: 28840 - DNA, 201 bp, Bos taurus
tgacttggtgatttcacataaaagtgatttcacatatctcaaggatcttcaaaaagacaagatccattatttctctagctctctgaaggatcagtagatatcacttttcctttttgcatgaaaaagtaatcttttactcttctgaaggatgtggctgatagttatcccagtttcccaggctattcgaagtatgaaatgaat

SEQ ID NO: 28841 - DNA, 201 bp, Bos taurus
tggcgaggtttaatgttgctctcatagactaggtcttaacagatatcctcaacgtgagccaagttctcttaatggatgtgctggaaagagctcagtgttacagagtcaagaatgtaatttgagctgtgcagaaaggaaacaaattgatcattttggcccgcatacctgaatctgaagcagcccttccccattagggaagac

SEQ ID NO: 28842 - DNA, 201 bp, Bos taurus
ttttgaaagggcagctcttttgttacatttgaaaggacttaaaaatgagaaacataaggattaactttttaattagatataatgattataaactcttcatcgcagcagttttcctttcattataaaaggaaagttgacagtttctgttcaattaatgttcattgaaatgttttttaaatgaaactattgctgagtagaagg

SEQ ID NO: 28843 - DNA, 201 bp, Bos taurus
tgtcattctctgattagaaagtaacgcagttcattgtagaaaatatgggaaatatagatatatataaaataaattaggattgctcacaatcttatcaatagaaggatctatttattatgtttcttcatagtcagtgcatgtttttacatagttgaacttttcatccttcctttttcatttagtattacagtataggcattt

SEQ ID NO: 28844 - DNA, 201 bp, Bos taurus
agtctctgagttatgttttgccctgcgctacacgcccacttgctgcagtgtggagcctggcactataatgtctctcctgaagcaaaggatagtaatgagacggagtgaatggggcaagacaggtaagacaaatggaggatgactcagctagtgggcgcctccagggaaattttctctttgttggtggtggctccacataat

SEQ ID NO: 28845 - DNA, 201 bp, Bos taurus
gtcacaaagagtcagacacaaatgaagcatctgagcgtgcatgcacatcccttaggaagtgaagaagcaatgggggctctaaagaaggtggatgttgtatttgttttttaagaaaatctctctgagggtcatttgaaggagaaagtgcagaggtgagtgactgtcaagaggagcctagttaggaaaccctggcaggttcaa

SEQ ID NO: 28846 - DNA, 201 bp, Bos taurus
gtcagaggagcatgacatcttcaaagcatggcacagggctccaggtgaccatggggttaaagacaagagggatgagaaaggggaaatgaggaggaagaaaatggtcactttagtgaggaacactgtcacataaagtggtctcagcttaaacatgaaggcaactagaagccaatgaacagctttaggcaggggaaaaaaaaa

SEQ ID NO: 28847 - DNA, 201 bp, Bos taurus
tgttgagaaaacgtggtgggtaggaaggtcttcaagtttccacatcatcaaggtaatgctgttaatactagcgtgtccttccattcctctcccctacctattgcctccaggacaagttttcggcctggtgacccacaggtctgaatccgggattcaaattgttcacggctttttctgtctctcatgaagaattaggtaacg

SEQ ID NO: 28848 - DNA, 201 bp, Bos taurus
tgtggtgcaatgactagctgcccaggctccatattgcttccaaggaagggtcagagaattggggaaggaaaggcaagacaggttgcctaaaacctaaaattccttaggtaccttctgaaagatttgtgtttatccaaaaaccatgatgagttttccaatcagagggagccgcaagagcaagaaggtatgaaaaaaggccag

SEQ ID NO: 28849 - DNA, 201 bp, Bos taurus
ctccctactgtctaaatgacggcctggggagtcggaccttccagccccccaggtttctgaggctcaatcatactcccttagaaaatcagcacactgagaagcattaatcattctcctctctcacagataaaatagttttcctactgatcctgggcaggaagttctctcagaaatgatgtgtgttctaaggtcattcctttc

SEQ ID NO: 28850 - DNA, 201 bp, Bos taurus
ttccacaaggggagaggtttgaggtatgtgggatacagaggtcacgttgcagctcgccagcgtgtgacttagggtgaatcacttaaacccttggtgtccttaccagtgtaatgaatgataagaaccagttcttgtggagaggtccggattagatcatgtctgtgaaagcatttggtcaacagtaaagggccataacagaaa

SEQ ID NO: 28851 - DNA, 201 bp, Bos taurus
atttttagaagcactgacaaacttgagatgaaagttttcagagtggaacaaagcagcctttggttgccatcatatatttgttttagaactagcagtgccttcatagatgtattagtccaatcccacccagtgaaatttccaattgatctgaagtcacatagagcgtgttcaaactagacaccaagtctgtgtttttctttt

SEQ ID NO: 28852 - DNA, 201 bp, Bos taurus
atagaaaaaaattcctatatgaaaattagaccatgctcctcttctgcttcaaaacatctaatggtctttcagtttaacacaatatcacatcctataatttgttccttatttgcctcttcagccagaagttcaatatggctctttaatacaagcactgtcaacatttaatgtcttcctcggatggtctagctggccatatcg

SEQ ID NO: 28853 - DNA, 201 bp, Bos taurus
ttttatgatttcacttgtctttgtcctgtttgccaaatccaggtcgaagaaccttgaagtcagggagtaattttcaaaagtccataatagtgcccacagcggttagctgggtatagagggagccctccagacaggctgtgcttaattaattccttttgataatatgtaagacattgatagaatctgagctcttctcccagt

SEQ ID NO: 28854 - DNA, 201 bp, Bos taurus
ctcagtgactcaaggcattctgatgaccactttgtctctgctgcccacgatgacaaatgtgacaactatgccagtggcaccgatgggctcactgacactctgtctctgccattccacagcgcctttggcatcatggataacctctatggtggcatctcttgctgtccatgttcattttcaaacttccatctatacaatcta

SEQ ID NO: 28855 - DNA, 201 bp, Bos taurus
gctgaggagaaatggttgatgtataaaaactcacctatttaagttgatgattttttctaaggagtggctaaattaaataaccaggacaaaagatccatgcctctgctttttaaaaaccaggttaatattttcaatgtgattggtgtcattgggtatttccaggtgaaaggctaggcatgcagtcccttcagggaaaactgt

SEQ ID NO: 28856 - DNA, 201 bp, Bos taurus
aagcatggcagcattaccttgtgaattttttttgagttgcacactcacattatgtacattttcccatgtatattttctagttcaataaaaatatttacaattgttttacaataccaggagaaaaagattagaaactgatgcattgatagtaataattattttaattaagcttcttggaaactgttattgtgattgactgat

SEQ ID NO: 28857 - DNA, 201 bp, Bos taurus
atttatatttcaggtacgatttcattcaaaagacatttccctctcctcatctggattagttactgcttcttcgaacttttattgcatcacatgcattaccgaaatcacagaactttcagactgtttgaatctctcccaaataatagagcttcatttttgtgttttgaaaatttgacataatatctggaattattaattcaa

SEQ ID NO: 28858 - DNA, 201 bp, Bos taurus
tcgggcatacatttattttatatttcactaaagttccttaacatatgtaaaaattattcatgttttacataaacaaagacttgatgatgattgacctggagggtagggaataaaacagaatgattatgtctacatttgtctctttctgaaacccaagtactaagctaccattctctatctgttctactcttctgttatcta

SEQ ID NO: 28859 - DNA, 201 bp, Bos taurus
gagataagtttgatatgtgaagagtaagacattaaactttttgtaaaggaaatgtgagtcagcagggagatgcctgtcctgtagttttcacaaaaataattagcagttgattatctggcctggatgtcccagtggaatctgtgcagtgttgaacatatcttaaagcccagaccacagtcgtctgtggagaggaatcccagg

SEQ ID NO: 28860 - DNA, 201 bp, Bos taurus
atggcagggaaaataatggcatttgagtgatgcataacctttcggtgggacaaaggtcatggctatgattcaggtcttaaatcttttagccaagttattatcatagattaagcacttataaaattatttaaaattctaatatatccagatctcttggttttgccttcagaattgctttacagtagtagactgaagtcaacc

SEQ ID NO: 28861 - DNA, 201 bp, Bos taurus
taccccttcaccttcatccttgtttttccaaatagggcctcttggagcacgggctgctcgtaatgatttgccttttcaggcgtggttcactggacagcacagggatcagtttcatcattactttttaggaaactctctgcagatcagtacagtaacatgctattctacactccttgttaagtattttttttttcctgttct

SEQ ID NO: 28862 - DNA, 201 bp, Bos taurus
cttgtgggcagcataccgtcattaactattaacttcttctacctactgggggtttcagtgtctgcaaaacaactcaaaaatattgttgcgggtggcccttcttggggaaccaggactttgctggaaggctgcaatgtttttctcttgacccttcatttcctcccggtctcacatcctccattccctaataagcaactcttg

SEQ ID NO: 28863 - DNA, 201 bp, Bos taurus
ttgcaggccgatgctgggagacgagaaccctctggggtgcacggtcatgaaagtctttcctaggaagggtgcatgccctgtggtgtggtgggcatacagcgggggagggagagaaggccagaggtgggacaggaggggtgaacaggtagacacaccagatgtggaagagccttcgttgccaagtgtctaggagcctggact

SEQ ID NO: 28864 - DNA, 201 bp, Bos taurus
gctattcagtcccttgtgactcagttctcttgaacatgactccatttagtttatactccaacaaagtgaagtttttccatctgcaaagtaagacttagacccctgaccactacctcctgacatgccatctctctgttaggtaagaggaatctaacacttcatgaacatcattaatccaacagatattcattgaaagcccac

SEQ ID NO: 28865 - DNA, 201 bp, Bos taurus
aagcctaaacaaattcattccaatttgcatagctcttaggttattaaattcttgggaaatgtcctaactcttccatgtgtatcaactttcaatctaattcgactaaccactcttgaacacttagtcctgggcctctgctgagcacatgcctgtgtcttttctcagaaatcatttcactagatctcggtcacattgtatttt

SEQ ID NO: 28866 - DNA, 201 bp, Bos taurus
gaagtttctcttctcatcacagatggcctgtcttttgagatacatttcacggtcctttcagtgcgtttccagagtctgaaaagaagagccgtcaccacgcgtgcgccactgtgatcctcacggccaggatcacgggcctcattttccccatgtgtttgcagatgtgctactttgatctacattccattctgacgtgcccgc

SEQ ID NO: 28867 - DNA, 201 bp, Bos taurus
gattaaaagttggtgattttttaaaaagcagtgtgtagaaaagaatacagttctttggcaagtctgaataaatcaggagcagctcggaaattattgaacactgagaggaaaatcatggctctgacaagcttcaaattgttcagtcagatacttaccctctccaccctgcctccagctcctgatctgaaaaaaaatgcaaaa

SEQ ID NO: 28868 - DNA, 201 bp, Bos taurus
caagatgggcctgtcagaacccaggggcagggtgagggagaggaggggtaaggagaatgcttctagaggagcctggaaaagcagaaaagtctgaggggagtggggcagagcaccctggcccaaaaaacccttttaaagattctcttagattctcttcctcatctgcagtaatatagaacaaagacagaccaaagaatggtg

SEQ ID NO: 28869 - DNA, 201 bp, Bos taurus
ttccaggtcctggttgcctgaggttctggaatttggaggctccagcctggtggttaatggtgacctaaagcctctcagcacccctttccccgtcatggacaagtcggccgtggtcggccgtggtcctcaccatcaattaggctgacactcggcagggtctgcccggctccagactctctctcttttctctttctggactcg

SEQ ID NO: 28870 - DNA, 201 bp, Bos taurus
gttagttgattatgtctgaaccagcacacaaggttttctgaggcaggtgaggatctactctttacagagctttactggtttattcttacaaataatagagttttaccgtatagtcaaagctattgttatgccagttgtcatgtatggatgtgagagttggatcataaagaaggctgagcaccaaagaattgatgcttttga

SEQ ID NO: 28871 - DNA, 201 bp, Bos taurus
gtgtgtcaggtctctgtaggtctgcagggagtggcatgtgagtgcatcatggtctctcttctctgaagaagcagggaagaggccttgcacgtgcagtcctacattcatttatctgttcagccaccatcccctgatcatcttctctctcccagtccccatgctagggaagctgagatgaactgaaggccagtcctccagggt

SEQ ID NO: 28872 - DNA, 201 bp, Bos taurus
ctgaaagtacagagggaggaatgatcttaaaagataaattcctcattcagtcagtccagatattcaccataagttacaaaaacaggcatttaggccaaatcagtctttagaacactgttgcaactggatcagacagtttactgtggcagagcatacgaggaggaaactaggagataggaaagaactaggctgaagactgaa

SEQ ID NO: 28873 - DNA, 201 bp, Bos taurus
ttgtttattcagttacttaggatatattctgtcttctgtttttaccacaggcaacttcagagtggaccttggattaccctcccttttttgcgtggtttgagtatgccctgtcacatgttgcgaaatattttgatcaagagatgctgaatgtccgtaatctgaattactccagctcaaggaccttactcttccagagatttt

SEQ ID NO: 28874 - DNA, 201 bp, Bos taurus
gcatggtacccgtgtgtgctcagctgcatgtcccgcagaagactggggatcatcaccacctgctccatgttgcgcaccacggccaggtaccggtccatgacggtcagcaggcagttcttggggtagcgcttggtcagcacctgcatgatggctttatcttccatatggagtcctgcagactgcctcggcctctgtttccag

SEQ ID NO: 28875 - DNA, 201 bp, Bos taurus
cccatgaatccaaagttatttgacttgagaagccatcctggaaaaaaaagataggtggggaactccattccataagaattattctagacactttatgattctggatcatatttcagagtcacctggttaaggatgtcaatcaagtttatggcaaaatagttgactatgtgtcctttcattttcacttcagccatgtcttcc

SEQ ID NO: 28876 - DNA, 201 bp, Bos taurus
ttctgcaaaagggtctaacatgcagcctggcctgcagctgaacaaagaattgagcaaatatagaaggagagctagctggctacttacaggcccctcctccgccagaggcagagaggcaggcatgccacagccagagccagaaggcaaggggctgccacaatcttgggccctgagacagcatcttccaccaaactgtgagga

SEQ ID NO: 28877 - DNA, 201 bp, Bos taurus
attgcttcagataagaatgcagtaaattgtgtgtagcaatgcctgttcatctcttttagagttccctgttgggatccaaagaattaatttgacatatatcagataaaaagcagtagaaaatggagacatgcctagcactgttacagactgtcaagttaatgtgatgagtcgatggttaatgtaatgtccccaccacttttc

SEQ ID NO: 28878 - DNA, 201 bp, Bos taurus
tatctctgaatcctaaaaggtcatttgacagttttatttctctgttctatatactttggcccttctatgtaggatgaatagcatgtatgttaatttacgaagttagatcttcatctacctgtttaatcagtaacaatttattatgttcttgccatgtgccagatacactgtagcaagaagagttcttgttcttttactatt

SEQ ID NO: 28879 - DNA, 201 bp, Bos taurus
ttaaaggaatgacaggaagcatgtttatgaatgactgaatggtaaaatattcccagattcatgacttgcatggaataagaatttaataaatattggttcttatcataggaacacctttgtatgactctaatccaaaagtaaatgtgtcagagaaaagtgagaagttattttttactgttttcaacagaaaaactaaagaat

SEQ ID NO: 28880 - DNA, 201 bp, Bos taurus
tagtcttctgtaatctaatacttgttgatctggctactcaaatactagtgtcaatgtttatgcctatctatcccctgtttgagtcccctgtttcattgttctttcatttgccttgtgatctgcatgtagggtaaaaaaaaatgtgcataaaacaaatgatttactgcaagtcaacttgttattattttagccatccatttt

SEQ ID NO: 28881 - DNA, 201 bp, Bos taurus
ttcatatattttttcttcttgagtgcatcacttagtgctttgtgaatattaaaagaatctaataagtgtaacaggacctccctgttgggccagcagtaagaactctgcttaccaatgcagaagacaggggtttgacccctgggtcggaaagatcccctggagaaggaaatggccatgcactccagtattcttgccaaggaa

SEQ ID NO: 28882 - DNA, 201 bp, Bos taurus
agtcttacatttaggcctttaatccatttgatattatttttatatatgatgttaaagaatcttctaaatctgtttgtttcttttttttttttttacatgtcgctctcagttttctcatcatcacctattgaagagactgccttttctccactgtatattcttgccttctttgttgtatttcaggtgaccataagtgcttga

SEQ ID NO: 28883 - DNA, 201 bp, Bos taurus
atcctttgaatgtgtctgcaactctcctaacattttccaaaaagtcaggcctctccagcagtcccatggtgccgttagaatagaacatgttccttgcctccgccttgtgtttctttcaggtcacttgctggcagctgggcattcatgcacagcatcatgttgaaattttcagatgagggctgtaagaacagcataatggag

SEQ ID NO: 28884 - DNA, 201 bp, Bos taurus
atgctcaatcattttttatggctgacttcaaagcagtatactagtaatatagatatctcttttctagagagactacaaaagctctagaaggattatacagagtgaaattgggttcagagtcccaatgtctgcaggctcagctaatataaatgcttcagtattatagatggtggggagttgtttgctttttcctctcaattt

SEQ ID NO: 28885 - DNA, 201 bp, Bos taurus
aactttaaactttataagtataacacaacagtagcacagatatccgttccctactgggcaaaacccatatttttgcaaaatgtgtgttatatatgagcatctgtcttctaatttttacacaggggatagactgaaatcatttcatgaaatatatcatgtatcttgtctagtttaaaaatatcctatgcaatatatacagtt

SEQ ID NO: 28886 - DNA, 201 bp, Bos taurus
taagaaaaggaattttttaaaaaaacttttactcaagtacttagtataaatatagtttgagtgtaaatgcaatagttgccttgattgtatcttgagaaacgtaccaaattaaacatttctcttaagtgatgtgaattcagttcagtaactcataatttccaagttgaccagagtcaaaactttcaataatatttaactctg

SEQ ID NO: 28887 - DNA, 201 bp, Bos taurus
atttaaaatattgcagttatcctccttttcctcactagcttattaatggtaaagtagataatatatagtgcctattacttaatagatgtttgaaaattttacttccatcctacttttaattcagattttactttgtgagagactaagtagattcagctcttcatatattctttttaattttaaatatcttttgctttctct

SEQ ID NO: 28888 - DNA, 201 bp, Bos taurus
ctttctcccaggtcccagtggcttccaataattccttgcattcctcggcccataaacttcctaaattcaatctctgccttcaactgttatggcctgccacgtaaggctgtgtgtcagttctcccccttgtttctctgataatgacaccagtccattagatttagggcctgttccagatccaggatgatataaccttaagat

SEQ ID NO: 28889 - DNA, 201 bp, Bos taurus
tctttctgacatcactttggcaatgataatttattatgtacctactatgtggactgtactgggctggcccttgaaaaaggtctaagtcagacaatgtcatagagaatctcaaatttaataggaggggcagataatactcataaaaagtttataagatttcactgtactcagggaaccaaataaactcctcccaccatgatt

SEQ ID NO: 28890 - DNA, 201 bp, Bos taurus
gctccatccatggactggccgagaggaggactaaggcccaaagattctttatgagaaccagatgccctagtgtacttcacaaccaacacacatgccacagaagcctgggccctgcaggggtgaggacgctgcttcagcttcacaaccttcatgaacagagggttgtgacatcatggcagaggttgtgacctactagggaca

SEQ ID NO: 28891 - DNA, 201 bp, Bos taurus
aagttcaaagcagaaatgccagggtaactttatcttcgtctttccccaggcctgatatttacaaatcacattgaaatttacaacacctattatgtgacagctctacgatatacagtggtgatgcaagggtgagctctcgaggggggtctgcagcctgtgagaaagacagacgtcaatcaaatgatcaaaaaccactctgca

SEQ ID NO: 28892 - DNA, 201 bp, Bos taurus
ttccttcatgagttctgaccaactgagaaataaatgagttagcaagaggccaagcatcatctttatcaacatgacagtgttgggagagcatagcctcccatgaaagccaaaatggactggccatcttccctgcctccagcctggatcctggcacagccatctgctcccaccgatcggggtggagaaagtgaaagaggactc

SEQ ID NO: 28893 - DNA, 201 bp, Bos taurus
gagaaagaggtgggggggtggggacgctagggtgggggctgtgaggaaatggttcatggagagggggggcgcaaggagtaattaggctgacatatgcaccacccaggacccaggagccaagccagggagggtcacttcctgatttacccctggcgttggggcacacctctttgcagggtagaagagaagtgtgcactggga

SEQ ID NO: 28894 - DNA, 201 bp, Bos taurus
caatcaaagacaaaaagactcaatgagatgcagaaacattaagtacaactaaatctcacacacacacacacacacacaccccttcagccccaggccactctcaagtctctaacactcagcacttggtcatcagccaaagcatgtttggttttcccaaaccgcaaacatgtcagggagcggaggaccaaaaggaagtgcagc

SEQ ID NO: 28895 - DNA, 201 bp, Bos taurus
agaggcttataagctgtaggaagccatgcgcaggggtgtgaggcaagcaccgccccatgcccaacaatgccccacctgcttctcagcctcaggaatagcatcagctgcaaaggcctgaaagcagtgaggggtaacagtgagatgggaggaaaagaggaccctgactagtcgtcagcagcccacagagtccaggagccacag

SEQ ID NO: 28896 - DNA, 201 bp, Bos taurus
ttatgtgcattatctcatttaatactcacagcacctttgaaaggtaggcaccattatcatgcccttaacataagagaaaacttaggcccagcacttaagtaatttgccaaagcatacacaccacaagagatggagcccggctttgaacgcacacagctgccccttgagcctgaacaattttccaccacgaggtacagacga

SEQ ID NO: 28897 - DNA, 201 bp, Bos taurus
caacactatttcaagctaaagcaataggactgttccgtgggaaccccatcatagcactactgttccaggctagctcatgaaagggcccaactccaggatagtctttaaaaatagtactagtatcagcctagtcccataaaaccaaaattactttagtttcattaagggccaaacaggatttttgcagattggccgagaaag

SEQ ID NO: 28898 - DNA, 201 bp, Bos taurus
tgatcctgggcaagttacttaatcactctgggcctctggttcctcatctgtgaggaggggtttgcctacctcaagctgtctttgacagaatgaaaagaatacacattcacgggggcctggccctctacagggggcttcccacgcgacgcagacagtaaagaatctgcctgcaatgcaggagactcaggttcaatccctggg

SEQ ID NO: 28899 - DNA, 201 bp, Bos taurus
agggagctgttactcttgctgggcctgatggggaaaaggaagaagctaccagaacccagggggggctctggctggagctgtagttgtcactctggttttaggaaagggccaccagacaggggctatgtcctcaagtagcataacactgccaacttccatctcacagcctggcggggaggcagccagggagctcaaaacccc

SEQ ID NO: 28900 - DNA, 201 bp, Bos taurus
agaatcaaacaacttccccaccaccggggtgccctgtaattctttcttagcaggagggtcggaggaggaggaggaagtagggggctagcaccccaaagccgagtttctcaatcaaacacctcatccggtaactcatccatcttgtgggcagaaatgggcaagagccaggagcatttggagagagtccttcctgggagaagc

SEQ ID NO: 28901 - DNA, 201 bp, Bos taurus
ccaagggaggctaaaatctgaaacacctgtacagccactttgaactctttatttaaagaaatgtctactatatctgacttgaaaagcaatgaacagttcctatttgggacagctttcgttcatattgtttctttttaagagaaatagttatctgtaaaagattttggttaaaaccaaaggaggattgcatcatgcctagaa

SEQ ID NO: 28902 - DNA, 201 bp, Bos taurus
tttgtaaagtcaaagccatagtcatctcccaaaaggggagatacaaaatcccatataccattctattcatctcgatagtgttcatttcttttctagctcaatcattctctctcttgggtatcttgaaacttaaagatctaaactgcaatctctagtgaccccattaacattaaataataagggaaccagagagaaagatga

SEQ ID NO: 28903 - DNA, 201 bp, Bos taurus
ggtggaggacagctctttgtctgctgcattttcctggctggggcttggggtgtcactgtctgccctcttgtcactgtgagtcaaaaatatcagcagtgtcatcctggccgatgaggcctgtacgtgtatgaacagagccttcagctctcaaaagaaaatgttgcttgtgcttcatccttaccagaaacattctctaaagag

SEQ ID NO: 28904 - DNA, 201 bp, Bos taurus
aatcagtgtcaggacttgcacctgcctctcagaacctggaccctagcttcacccagtaaaggacaggagaagaaggtagaaatgcaatatcacacatctggcttgtactttctaagcatttgccttaattaaatacaaacaagacagtgatgaagagataatgggtacagttccatcaatgaccaactcaccagtcttttt

SEQ ID NO: 28905 - DNA, 201 bp, Bos taurus
cccgccaggttggtgagtgaaaggaccaagactgggccaggtcccggggtgtgtttgtcaggaaaagaaaaacagaagttgggtggtggttaaaccctaccgagagaggcccaacttgtcctccagcctctgtcctcgaccctcccagcagccttccatgtcccctccccagtccggttgctctcatccccatctgccagc

SEQ ID NO: 28906 - DNA, 201 bp, Bos taurus
cgtggttatcaggggtgtcagtgaaaagggcactctgcccagttacagaatccaagttaagggccgcttccagccccaggccacagcccatcattcgcttcttccctttcctaaggggatccccgggctgggccacagtctctccatttcagtggacaaccaagtgtcaccttttcacagatcagcgcgtataactatcgc

SEQ ID NO: 28907 - DNA, 201 bp, Bos taurus
gggtgtctgctgcacggggcaaagaagggggcggctggcgcaggtccagaaccctctccaccagccagcaactatactccttgcttcccagcggccagtcggggtcccgccacaacctctaccaaaggatccgtcatccccggggtcctaccttggctgctcctctccctgctctgcagtcttcgtgcagttggtggagga

SEQ ID NO: 28908 - DNA, 201 bp, Bos taurus
tcacaccagccctgaaaatcctagatcagtcctttgacctttcagactcccgaataatccaggtttattgtaaagaaaaccctctttaatggaatagatacaattatacacattcatacttagggttttacagtcacagctagatccccagtgctgcttagcgtttttcttagttgctacttgttagctccctcacacatg

SEQ ID NO: 28909 - DNA, 201 bp, Bos taurus
tgactaacaacacatctcttcctgtcactattgagacttatagcctacacataaaacctgactgtcacacagctcagtctctaagggttcagcctcatgagtcttttttacgtaagttaactgtttgttcttttcttaccagtaacttgggtcagggatggtagacaagggcctttctgcctgtgacccctgctctgtaaa

SEQ ID NO: 28910 - DNA, 201 bp, Bos taurus
gtgcacgatctcaaagatgtctttggacataccaactttctctgttagactatgcactccatgagggcaggaccaggactcattcatctctgtactgcttgggggcctagcaacagagctcagcacatggcaggcaccagatagccagaaatgcaaaccatttctcagggaagtaattgattaagtgaagccaaactggag

SEQ ID NO: 28911 - DNA, 201 bp, Bos taurus
ttcaactgccaagggctcaccggaagcgtgttgggctgcggcggtctcacttgagccacgctcactcaaagtgttgtcgattgaagaagtctcatataaagcctcatccaaagggtttgcaagtgaaaagtagtcacttgagagttgctgaactgatgcttgatgatccatagagccaagaaactcatcagattgagctga

SEQ ID NO: 28912 - DNA, 201 bp, Bos taurus
gcggtgcagttcccctcgccatacaaacagatgcccctcttaaaaatcgtgcagaccttacacaaggtggctggtgctgcagagaaacacacagggaagcggaggccggggtaggatgggctgcgaccaaggtgtgtaagacacagtaggacctaggagttgaggggcaaagcctggctctaaatacttgtcctgcatgct

SEQ ID NO: 28913 - DNA, 201 bp, Bos taurus
aaattcacccgacatcctcatcctccaataggtatttattgtgcatcctgtaggctacacactgaggaggagagatgagtcacatgtaccagtcatttccgaattcagagcctcacggctgagactctgaattagcaagctttgttttaataatggtgtttgcttaaataaggggcacagaggagggacccctagcaccat

SEQ ID NO: 28914 - DNA, 201 bp, Bos taurus
ttctctgctcgcagcctctcctctgatggcctttgtgacaatgtttcagcaagagcagggctttacttaagggtaagggtttatgaggggggatcccttcaacagtcatttcgtgaacctaggccatgggctgcgcatcgtgtgacagtactcagcgagcagagtcagccccctgtcctccacctggagacactaggaaac

SEQ ID NO: 28915 - DNA, 201 bp, Bos taurus
agatcacctccgtaaacgaccatttagggcaaaagtcgtccacagccaggcagaggaacccccgtccggccctgctgcctccttgctcagaagccttttacaaaggcagactccctggaatggctttctcagctcagtccggggctgtgagaaaaatgacttccattccctgcacggctggagccttgggcctttgccaca

SEQ ID NO: 28916 - DNA, 201 bp, Bos taurus
ggtttcccttagcaaccatatcacttatccttcttcccaaaacggctctgtaaataaacattattttgaagagacccactaaagattactctttaacaaacgatctgctttgtctcactccaaattaggtgttgacatggactcttatttaaagaaaatacaatttttatccatcataaacatttggagaaatttttcgaa

SEQ ID NO: 28917 - DNA, 201 bp, Bos taurus
tgatgcagccaagaaaatacatgtaattcttttttttttttttttaattttcccctggatgttgtattcacatgaacttaattggtttacccaaattttgttgatcctccaccctaaaacttcaataggaattcaaatgcctctgcaattgggtataatcactataagtaaataaaagatgatgtggtggatggataagta

SEQ ID NO: 28918 - DNA, 201 bp, Bos taurus
tgagcctttgagagagatgaatgaaaaaacaaaacaggaagaaggccttgggaaacttacaaaatcatgacaaacacaagcttatgagaattttgaggcacgcttattataatttgcttgtcgttcccgagtccacccagtgtgtggtttaaagaagaaatatcaggtgtttctgccaagattttcaggagaaactgagtt

SEQ ID NO: 28919 - DNA, 201 bp, Bos taurus
gtactacagcacgcacatgcacgcataggctggttcacacccttcttttccctcccctttctctatcccctgtcaaggaagctcagcctccatctgcatcaccacaaagggctacacgttgcttgcttaagatatacacagcgtccatcttccagagaacacagccaagcaagaggcccagaaaaatcctcttctaaggag

SEQ ID NO: 28920 - DNA, 201 bp, Bos taurus
cagcaaaaaaaaaaaaaaagttattaaaaggagttaaaatgttcaagttcaggctttgaattctatctagctaactagtttataagggctgctggtcatcctaagattattccgctcttcccacaaagacctgcatcacttcctggcacctggatggggacccagcaggaggcgtcaggagatgcgacatttcccagccat

SEQ ID NO: 28921 - DNA, 201 bp, Bos taurus
tgcatatgtgggggaaatcaggaagtgaccacacacaggtccatggggaagtgaagactcaggaaatacctgaggagaacttaagtttaaacatcaggctagtccttggcacacagtgaccaacaagttttaaaaaataataataaacaaaaacagagaaccttagggaaaagggaaaatcagatttccagagttgccacg

SEQ ID NO: 28922 - DNA, 201 bp, Bos taurus
cccaccctttaaatgaggtgcaagggcgccccctggtggcggtccgctcccatctgtgggattcggttctccaacccaggctgaacccaggccaggcagcaggaaagccccagggaattcccagcatcttcctcctaattttatttgggtgcccgggacgccctcacaccccacccagcctgcacatccggccagaagtgt

SEQ ID NO: 28923 - DNA, 201 bp, Bos taurus
aagactgtaagggaagccagtcatacactgcagtgctccagggaagcgaggtaggactgtgttccctgggaagaaggtctaaaaacagtctgtaggaacttggttgtctgtgttgttagggccacgctgtgacaactggagctgtctctccaagctcctaccattaaacaacatgcccctatcattaaacaacacgcccca

SEQ ID NO: 28924 - DNA, 201 bp, Bos taurus
ggcccaggttgggtgttgtctggaggggagggccagactttcagggagaagaagtagtgagacacgagcccttgagtgtttgctcaggcacattccacttaaataaacagctcatgaagctagttttcctaaggatctccttgccccaggaaccagagttgggcgtgaagaacggcggctgacctctgcaacgtgacaagc

SEQ ID NO: 28925 - DNA, 201 bp, Bos taurus
taggggtcaggaacatctgtgaggaatccttgagcttgggggccactttctgtggttgtggaggttagtgaggtggtgcaaggcagccaaatccaggctgctctccaggctgagggcccgcatggcgagcaccacccagggcggacacctcttcctcattctcacagttgcccattggtgtgggaggtggccctgaggagg

SEQ ID NO: 28926 - DNA, 201 bp, Bos taurus
taatgatgcttaggggaggacaaatgctaaaactaataataatttcataaactctatttcagttcatcatcattagaaaccaatgaggtagctgttatcagcccagtattactgatgaaggagtggatgctcaaagacatagagtgtatttctgtgatcacacagctggcggctctgggggttaggaagcaaatgcacatc

SEQ ID NO: 28927 - DNA, 201 bp, Bos taurus
tcacacaggggcctgaatggagatcggagcagtgcctgcctgctgggagtcatagcctcggctcattttacttccactcatgctgggaacttttgctggcatgggcccctggcacgctggtgtgccggtaacaaccagctttctgcaggagaaaaaacaaacccttatttaaagtctccaaaacgtggaggcaaccaagtt

SEQ ID NO: 28928 - DNA, 201 bp, Bos taurus
ggtgccacatgacaactcagttccgcataaggacagagggtgagctgctttctccccaccctcttctgagtcccctcagcactcgggccctctcgcagccatctccctgatgggaatatggctttgtctggtgcagtgcagcctggctggggaggggagtgagcagaggccctggtggaggtgggacagagcatggatgca

SEQ ID NO: 28929 - DNA, 201 bp, Bos taurus
ggggtagggtgggatctactggcgggcttcctgcctggaggttgattggaactagctcttaaacactggtgatttttttctttagagaccacatgtgtgcgttcctaaatccatgatggtcattttgttcacaccacgggtggggcagccctgaaacaggagagatttcttttcggatcaccatctgagattcagggctag

SEQ ID NO: 28930 - DNA, 201 bp, Bos taurus
ttctgtcttcgattgtatgtccttcgtgaagcctcctctcatctctcatctcttggttcttcaattacttttaaagtcagcccaacattgaccatttgaccactttaaacagttaatgagctaaatgttttatcttaccaaccagactatgagcaattctgggcagagccaagtcttaactgtctctgtatctcctttatt

SEQ ID NO: 28931 - DNA, 201 bp, Bos taurus
tggttacaagaggactcattcagcttcagaggtgaccttggctctgggctctgcttctgtgaccttggcacaagggcccacacttgtgacctcgggcagggttccacatcaatctacagtttgtgaagggactgggcagcgagactaaaggcgcatgtggtcaacgtcttcaaaggccttgaaggttgaaggttggtttgg

SEQ ID NO: 28932 - DNA, 201 bp, Bos taurus
ttgatgcagacagcccacgtctgtcggtgaggcgtgggcttctgtgatgtgatattactgtttttcctctgggacatggacgtcaacagcctttaaagcaaggtagcttccacagcatacttgaggtttactgacttgctttatgtaaactggcaaatcacactcctggccctatgcgcacaagaggatttctgtaaagac

SEQ ID NO: 28933 - DNA, 201 bp, Bos taurus
gttgacacacagggctcatctcagatctgcagttgcacagtggtccccctcagtgggagagcctgggctgcttcctgcaacttgagatttccggctcctgcgacacgatggccatgtggccacagcctggagggtccacagccctcctgtccacgggctctgctgggtgctcattgagtcatggagaagcagctactctgg

SEQ ID NO: 28934 - DNA, 201 bp, Bos taurus
tggtcagcagagcttggggaaggaactccccagggatgtcgagacaggctttccttctgtgtctccacaaatacatctcccgtgggccttcatcaaattatgcaaatctagatgtctttgcctgtcctccaggaaggctctcgccagaccctggctgaccttgacacggccaacctcaactcctctccctagttcctggct

SEQ ID NO: 28935 - DNA, 201 bp, Bos taurus
ccatgggacgaccataaggatgggtcctgggaccacgcagggaggaagactgaacatggtgggcttctctgtcaaagaccccaggaatctcacttccacatagtaaggcccatatgaatgtaaacacactggggaagtaactcaggaatggaagtttttagcccaaattaaaggttgctagttagaattcagtcacaacag

SEQ ID NO: 28936 - DNA, 201 bp, Bos taurus
actcagggtttttttaccatgttcgattagtttcccatttaagttttttcagagtaggcatcatttagagcccagcagtccttgtgaatatgaagtgtccgtgaccaattgttttaagattgcaatttcaaaaagagccacagggaggcacaattttttcatgtcttactgttgttaacggggtaatcagagtttgggggt

SEQ ID NO: 28937 - DNA, 201 bp, Bos taurus
aggaccactgggtaaaactcatgaactggcagcacagcaccatgtacctgttcttcgcagtctcaggcatcatggacatgctgacctatctcatcacccatgtccccctggggctggacagactggttatggctctggctgccttcaatgaaggtaacaaggtggtatggatggagatttaaagggactggagcacaacag

SEQ ID NO: 28938 - DNA, 201 bp, Bos taurus
tgttgccaagagccaggcttccatgtcactgctaaattgatggaatcgaggaccagccatgccagcctgccatgggacacggaggccctgagaaacagttcacactttcttccaaaacaaacaagggcttgagcagcggatggtgaacagcatggcgcctacagagctggccgcctgcaggagagttggcgcccatgcagt

SEQ ID NO: 28939 - DNA, 201 bp, Bos taurus
ggaacattttagagttttatgggacaaaatgtttggaagaaatacaggactttgattacatcattttgtagcagcgtaggtaaagttcgttgttggccaagtaaaatattatcatgttaaatattactgagactaaggtgtggctttgtgatgttatgtgggttactattagtcttatgtatgtttggaaatatttgaaac

SEQ ID NO: 28940 - DNA, 201 bp, Bos taurus
catttgcttattcttattatttttgttctccttgtagggtggccagatactgcagaccttgagcatgtgacaggcacgtggtttcttcaataaaccttggcgcttccgcagttctcctggggcccacagactgcatagtcctaaagagtcaaatattaagctttctcggcagccacaccttcctttgatgtttgggttatt

SEQ ID NO: 28941 - DNA, 201 bp, Bos taurus
tctcatttcttgtcatactccccaaacatacccctaccaagcagttcctccttaacacttctctctcagtgctatgctttcatatatttaacttcctctagctgcctaccctttttgcttagataacacaccagtcattttatgagatgtagccaagaagttaacctcctcctcctgaaagccttccttgattcatcagtg

SEQ ID NO: 28942 - DNA, 201 bp, Bos taurus
ggagatcacatggttcaggcaggaacatgccttcaagcaagtgacactcataatccagggaccatgtgcatgaacaaaggtgtgaaggcaagaaatcaaacagtgtatttggagaccatgtgcaacgggattttgaaaacatctcaatcgcaatttgggcggaggttccaaacaacagatactaccatttcaaagtgaggt

SEQ ID NO: 28943 - DNA, 201 bp, Bos taurus
tgtgatcggattgcttacagactcctcacttcctttaggagaacaggccccaggaaagctgtaggtcagaggtttggctccagggactgtgccctccagttacacctgcctcaccctgggggcccagctccataaccaagcagaccttggttttggaacttggcctcctttggcaggaccctgggtgaattccctcacttc

SEQ ID NO: 28944 - DNA, 201 bp, Bos taurus
tcacactcggggttgtcggccccagcacgcccactcccggagccccatgctgccttcctgtcctcgatgccagagcagctggagcgtttccgcttgctgattggcccttgcttttccctgccctttaggactcaccccagcagctgtttgcctccttccctggggcccttgctagggtgttaagcccattaatcaaacaga

SEQ ID NO: 28945 - DNA, 201 bp, Bos taurus
ttactgtaaagggtaaaacttggaaatagctgataaaaagaaagggaggcacagggcagggtggggaggagcttccacaccagcatggccaccttgaccaaccctgaggctccacactgctcttttccccttccttgtccccatggagctttcgcaccactgaccactccctcctggagcacattatttccttctgtgact

SEQ ID NO: 28946 - DNA, 201 bp, Bos taurus
atcttgacctgagtttgccttgagatgacttagccactcatgctatggaacaaaagtggtcctggtgagaaagccaggagcgactgactatgaaaacttgcccagttccacctctgttgctggcttacatgctggtggactccagggactaaactcctctcatgcttcctactattcccatttttgctgttgtttagttgg

SEQ ID NO: 28947 - DNA, 201 bp, Bos taurus
tgccatctttgatgtttgcattatgctgtgggcccacgctggaaccaagcctagaaagcaaggcttcataacagcttaggaggcaggagaccagagacacaggatggaacaagatctcaggcccagggaacacagcatgctccctggtgacagaaggcccctcagagtggcacacagccttgggaaaggtggtaatgctaa

SEQ ID NO: 28948 - DNA, 201 bp, Bos taurus
ataatctagatgctgggctgaagccagccaagtgaggggacagagactggctcatcaggtagaggaaacagcaagtgcagaggccctgaggtggcttgttcaaagacaaaatagaaggtgggcatggctggaaggtaataagcagaggaaggagggagatgagatgaagctgaagtggtagccagggccagctcttggctc

SEQ ID NO: 28949 - DNA, 201 bp, Bos taurus
gggatagaacccaggtctccggcattgcgagcatcatcagttggcatatctgatgccaagatgactggagacagctttgagagggagatggtggtgggaatacccttctttgttacaaaacctagggacccagcggcagtcctttgcctctcgtgatcccatccgatagaacagtggtccccaatccttttttccacagac

SEQ ID NO: 28950 - DNA, 201 bp, Bos taurus
ggcagaccattaaggcctccaggttggggcagggaatttaaggaactgagacctgggggttggaagagctgggcaaagaagggactgagttgcttctgccgtggagagctgcactgctggcctggggaaaagccttgctgcacggccttcctcagtccagcagtaaggggaccggggatgctgagcctgtgggtggagcct

SEQ ID NO: 28951 - DNA, 201 bp, Bos taurus
ccaaaaggccttcaagggacacggagcttccgcttcctgccctttgggacattttcttttggcatgcttcctttctttcctagcccaaacaccttgctgctcgggggtgaggccacacaaaggggaaccaaggtgcgcttgctgactgtcaacatcaacgtcaactgccaaccaggaatgtgagctgtcttggatgttcta

SEQ ID NO: 28952 - DNA, 201 bp, Bos taurus
ctgacccctgcatggggagcttagtgtcttaaccactggaccaccagggaagtcccaagcaagcaaatctttttttcttatgttaatggccagcagagaagggctacacagagagagatctaacaagcaagggggcatgctggcttttcctgagggtctttcctgcatctccttcggccacactggtgctggtgcagtggg

SEQ ID NO: 28953 - DNA, 201 bp, Bos taurus
cagcttgtctctgctggtcaggaagctcaggccccatctgaggggcgaggagactcctcattcgggcacagaaccctgcatggggtgtgagtgacacaaccgaacaccaaggccctcagtgttttacttcttcattaagcaagatgaaaagacgaaacaattagaaagcaagtctgtggaggcactttacctacatgattg

SEQ ID NO: 28954 - DNA, 201 bp, Bos taurus
ggctggccaggcctccaggggcccagaaaattccaggaaatttcttctcttatataaggtgctacttgacatactggtagcaatttgtgtacctgcaagtgggcatgtaatccaggcccaattcaggcaaagttagatctgtcagaggcagctcctctacttctgaaacctaaacaagactacctcctcaatttaacttcc

SEQ ID NO: 28955 - DNA, 201 bp, Bos taurus
tttcttctattacctgagtctccctgcatctctcacccctactgtcctgagcttaggtctctacctagggtctccaggtagaaagaagtgatacttctacgcccaaggtgccagtccatggcagctcacaaccaaatggtttgtaactccggccctggaggaagctcagagaggctgaacactctgtgccccctggcccac

SEQ ID NO: 28956 - DNA, 201 bp, Bos taurus
acccaggagggaaagaagaaacactgggaaaagaatagtgcctaccgagggtcagaccttcttgagccttccggttaaacttggaggccacttccttccttctggagttcctgctccagatgtggaggggagagagctgtactcactgctgatgagtcacagggagagggacagcttcccccagaggccctttgattccac

SEQ ID NO: 28957 - DNA, 201 bp, Bos taurus
tttcaatgagtctaccctttccttgaagccacttggagtagggctcctctcaattttgattcagacttagttctagatccttcacacccagacacaagcagaggcaacatttgtttcagcaccattaaaagtaaaaccctttattctttactgagaatagcgtgcacagaacaccaaatacagttcaccagcatcctgggc

SEQ ID NO: 28958 - DNA, 201 bp, Bos taurus
tgtgtgtgaagactgggagtgaccctggggtatgacccttcaccttggaaccccgtggcgtggcgccgatgagcttctgtatgttatcgaccagtggttttgggccatcaatcaatggtgccccggtgtccacaagggcctcgcagcctccagaacaagcaataacctttctttcaaaggagatgctgagaaacaatggaa

SEQ ID NO: 28959 - DNA, 201 bp, Bos taurus
tccagtgaaaattggaataatagatgtgactttaaatatctagcagcagagtataatcagcaggatgaagggctaggatgggccaacacttgtctctcccttaaaaacaataaaaacaataattaaacagcttgttgttgtttagccactaagttgtgtacaagtcttttgcaaccccatggactatagcccaccaggccc

SEQ ID NO: 28960 - DNA, 201 bp, Bos taurus
tggtcaattacatatgctatcttgctgtctccacacaagcctggcaaggcatgtcccccattgtacagatggaagaagtctcctccgatcttcttcatccatactggagacaggcacataataatcccacaagtaatacatgttgactaaatgaatgggtgcatttacagatacttccaatagaacacattggtgcatcca

SEQ ID NO: 28961 - DNA, 201 bp, Bos taurus
tctcgacccagaaatcgaaccaatgtctcttaagtctccggcattgcaagctgattctttaccactgagccaccagggaagccctagaaggttttagcacagtataaataaccagttgtgggcactgctatatttaaaatggataaccaaaaacaacttactgtgtagcacagggaactctgcttggtattatgtggcagc

SEQ ID NO: 28962 - DNA, 201 bp, Bos taurus
tgtgacctcgaggcttcgaaaactttggacctggagagctgctcacttaaaatcattcatcctcaaggatgagtttgggcccatatggttcctcagtattgcctcaccggttctgtggcttgtggctgctcagtaacaaaagggaccctccacggagggtggaggattcaagttgttgttggctgtagaaaggaggcctct

SEQ ID NO: 28963 - DNA, 201 bp, Bos taurus
aatctggggtttagacctcacagcagcccactgggtggtgaacaagttcactggttggccaaggcagagctggttcacagttgccaggcaagaaacaaccctctagggcacagatgagccaaggctgttgggcaggtgcacacagcatgccccacgtgcacaaggcctgcagcacacgatgtccatgccaggcatggaggg

SEQ ID NO: 28964 - DNA, 201 bp, Bos taurus
aacctggaagtcttttaatgtatctttgtctttatattgaagttgagcttcttatagatagcttatattgtcattctttttaatctgatcttatgtctttgcattggtgtgttttggccatttgcatataactaccagtgtgattgaattaaaacttaccatctttttgttgttgttgttttctatttctactgttttttg

SEQ ID NO: 28965 - DNA, 201 bp, Bos taurus
atcctggggaggcccctcaggagcctagaccagctccctaaggacccacctgtctcctccgcctggactcatgttcagctgcctcccccggtcactcctgctggacactcttgtgctcctgtggcctcagcttagccctcttcctgtgttaactcagggaggagccctttgttggtctcattttgcaggtgaagaatctgg

SEQ ID NO: 28966 - DNA, 201 bp, Bos taurus
ggcctcctgtatccgtcctgagaacattgtgaatttttccctgatttgtaagaatgcctggactgtcactcgcactgtgaccttttggacgaggttgtacggaagacactacacactggaggcctctctgcctttgcacctgcgacctgagtcaacagagaagctgcatgcactgtcttcaggcatgtgtgatccgatctc

SEQ ID NO: 28967 - DNA, 201 bp, Bos taurus
ttctccctgctcttgaggtccgcactgcagggctgggtcccagccagcaggtgggacggctccctgagcctgcaggctggccccaccgcctcggacagccaccaatcctctgcccttctgtggggtgatgatgtgctggattccctgggtctccctcccaccgccgggtcggtactgggggcgccctcgcaggccccactt

SEQ ID NO: 28968 - DNA, 201 bp, Bos taurus
aggccctggatctaaacttcagttcactgtgtgactgaacatgcgtgtcttgccctctctctctgagcctcagatgctacatctgtacaaccaccaagtcagaggagacaaatcagggccctccctggtggctgaccttgtagaaggctcctgaaattcctcctagttctatgctagtggtaaagatcccacctgtcaatg

SEQ ID NO: 28969 - DNA, 201 bp, Bos taurus
accagaggtggggtggggtcgagatctggtaggcggggacctgaattgggcggggcggagtaaggggtctgaaagtgggtagaggccaggaaccaactcgaagaggacaggggtttgagacagggctaaggactcatggagggatgaagcttcgaagagtgagggttgaggcccccagcggggcttcgggaactagtgagg

SEQ ID NO: 28970 - DNA, 201 bp, Bos taurus
tgtgttcatggggttctccaggcaagaatactgcagtggtttggattcctttctcccgtgaaccacattttgtcagaccctgactaggcctgacaggccacgccatgtagcagaatgacatgtccagtgccctggttaatacacatgtatgaaatatgtaaatatatatatatatatattgtttgtttgtttgtttatagg

SEQ ID NO: 28971 - DNA, 201 bp, Bos taurus
ccccagggtccctggcagcctggcctacagcctgaagaagcgctgagccagcccgcgggccgctcgaccatctcggcctctgtctgtgtctgtctgtccagctctctgttgacctactgccctcctgcctggtatcctgtcactgagggtttggtcaggtgtatataaacgtcctctgtgtcatgggtgaagagtggccca

SEQ ID NO: 28972 - DNA, 201 bp, Bos taurus
cctggggcggggtgggggtgttgtcttctgcccagacctcagggaattgttgagttaactctctctctcaactgtttagcccatccagtttcccttctggtagatggtgcaacttccattcatcttgagaggttactgagaggaagaataaataggtggttgagcccactcaaagagtgggtcttttgttggggggaaggt

SEQ ID NO: 28973 - DNA, 201 bp, Bos taurus
cacatcaatgccaggcctgtctcccttagaaccggatacagagaactggggggccttcaccttgggcacattcactttgcccccaggcccatgaatgtcaatgtcaggagcttgaacttccaccctggagccagagatgctgccctcagtttggggcacagagatgtccacccctaaactcccctgtggcttggcaccttt

SEQ ID NO: 28974 - DNA, 201 bp, Bos taurus
ctgccccaagaaagatgtgggagttgctgccccctggtggaggctcacagcgagaactcctcttttttcctgtctggcccctcccagggctcctctccataagtcacacttggttcctgactcacccaagtcgctgcccacacccccacccccatcacacaggcctcttcgggttacacacactataatatgacagcaatg

SEQ ID NO: 28975 - DNA, 201 bp, Bos taurus
tgcgggaaggagaaaaagaaaaaaaggatcagagcatctcagctgggggtggggggtgtcatcaacttcaaaagcagaggtgagcagggggcctctggtctagcctccccagcccagaccttacctgttgaatgtatcggtctgtggttttccacatgtaataaaactgaactatgctggccagtgacttccagggtagct

SEQ ID NO: 28976 - DNA, 201 bp, Bos taurus
ttttaagggtctgtggttcaggccagaactagaatccagacaccaacagtaattaatggtttctctctttattgtttctccttttatcaaaacctgtcacggctgggggccaaaaggaagtaaaaaaaaaaattcccacaaatatcccccccacttgtccccagtgagttctcccccacccgctacccagggccttgggcc

SEQ ID NO: 28977 - DNA, 201 bp, Bos taurus
tccatgggattttccaggcaagagtactggggtggggtgccattgccttctgtacctgcttccttttccggaaattacgatgattaatagtacacttactgcaggggcttgttgtgaaaattgaaaccaggaaatagtactactgtataacacttggtgtctgcaatggtaggtaaacgttatacatgcaattgctgtttt

SEQ ID NO: 28978 - DNA, 201 bp, Bos taurus
ctggtgaggagatgctggagacagaaaaatgagccattacttttagtactcgagaactacattaaaaaaccctggagcatttcgggcccacttctcagtaataagatgacatcactttttagttcaggcatatgcttgtcattttacattcatcatggagtggccagtgcaatttcaaccaccaagtcccatcccgatact

SEQ ID NO: 28979 - DNA, 201 bp, Bos taurus
accgcattggagaccttcgggccttcctgggccaagaggcaggcaacctagcgggtgagtccgggcgcccccatctccctccccgcgcgtcctcacctcccaccccatgggcccttggtttaaatggtcgccaacttcgagctctgttcccagattgactcagacggttctctaccctactcggtactggcgaccgctccc

SEQ ID NO: 28980 - DNA, 201 bp, Bos taurus
aagattgatcctgagaaaggtaccagggtgggccagagtccatgagcttcctgagcttagggataaaggtgaagaaaggtagagtgatggtcggtgggagttggccccagcggggaggatgtaggcctgggaggaggatctgattcgcaaggttacttagttttcagggcaccaggatgttggagtcaagttgggggccca

SEQ ID NO: 28981 - DNA, 201 bp, Bos taurus
ccactccagtattcttgcctacagaattccatgggcagaggagcctgacgggctacagaccacagggtcacaaagagttggatgtgactggggacaataacgagcaataatgctgaaaatgttgctttttctctttcatcttcaatattaaaatggctacacaaaaatccaccaactttgataagtttttaaaatgcacac

SEQ ID NO: 28982 - DNA, 201 bp, Bos taurus
catgttgccagaagccctgctggagtttgacggtcccttggtgcaaaagtctggatgcatttgttctgtggctcgagttccactgttctcacaggcccacggtcttacctagagagaaggagagagaggagaatctttctagagaaacagtgtgatgaaaaggaaggggtgagggagagaaagaaaggcaagttagtgagt

SEQ ID NO: 28983 - DNA, 201 bp, Bos taurus
aaaacaaaatgagatttttgttaagagaaactttttaagtgaggttgtaccatttttttttcccctgtaaaggttttattatgcacagaataaggagagggctcagtcctttgcagccacttccctctggtcacttcttccagcaagggtaccactaacttgctttgcttggttaggttccctgctggcatctgtgggtca

SEQ ID NO: 28984 - DNA, 201 bp, Bos taurus
tgagttcccctctcattggaaatttctctggggaagccccatgaaggaaatatattttctaaaagtttctcagctacagttatggcatcagcctttctgcataggaaggcttcaatccatcctgagaacatacaagcaattacaagaacatattgataaccgtccatatagtcaaagctatgatctttccagtagtcaggc

SEQ ID NO: 28985 - DNA, 201 bp, Bos taurus
ctctgtcacttccccaaatcagtagctcttcgagtggcttcagctgccttacactgtcacagcaagacaccgtggttttgattgaatgtggagaggcagagagccgtgtgaagtgcgagtgcctgggggttgtggggcagcaggaagttcaaggagagggagcccctctgggatgaaaggagccggggatgggagtagggg

SEQ ID NO: 28986 - DNA, 201 bp, Bos taurus
cagcagggcagccttgcagacctgctctcctcatcctcctgcctccccgatctcttctgcctccttccccacctcctcagacgctgctgtccgcgggccctgtctgtcccttttctgttccagccctgactctccacccaggtccaggtacgtcccccagagaagccctgccccccctgcctggaagcccaccccagcttc

SEQ ID NO: 28987 - DNA, 201 bp, Bos taurus
agggcccaggtaagagcaggcagaggccagcggccgggaggggactggatcttctgcctaggacgcccactgcccgcatccacggagggccctgcccagccgaaagctcacagtgggacatggtcaggaaacacacaggcactgttctgcccgaagagcaggccagtttcctgagaaaggcctggccttaactgttgcacc

SEQ ID NO: 28988 - DNA, 201 bp, Bos taurus
cttcatcctcccaggggcaggcagctggggcctgggcctcccagctctgtgttcttaggctgtgtcccttgggctgtggtgggggaggtgcttagaagcatgtgtcctgggctgtttgccagggcccaggccaggacaagggcatggggcctggtggctgggggaaggctggactgagactgctgggcattaacaataacc

SEQ ID NO: 28989 - DNA, 201 bp, Bos taurus
ggttcctggaaaattccaggtttgtttcagcctcagggcctttgcagttcctattgccctgtcttgaactctgtccctggcttggggcttttactaagcaacaactgctgggccctccttccctgcctccctggtaactactctttatctttactttttgttttctttatgtagcattcaccactccagaattatcttcat

SEQ ID NO: 28990 - DNA, 201 bp, Bos taurus
tttttcatgtcattacaatacagctgagtagtggtgatggagaacctctggcccacaaagcctgaaatatttataacttcgtagaaaaagtctgctaacctctggtccagcggaatgaccagagctttggaaagaactggaagatgggtgatgaagaggtgagagagagggacttccctggtggtccagtggttaagaatc

SEQ ID NO: 28991 - DNA, 201 bp, Bos taurus
ctgggaaccccctgggtggtgctggtgggtgaggggcttcagagggttgtgtgggaggagctgggtgtgaagcatgacctccttgaggctggagactgtacggcctggggattatgggctcaggcacgggcctgccccgtgtatggccttaggtggggcagctgcctctcgagtcttgctctgtcatctgtcaagtgggca

SEQ ID NO: 28992 - DNA, 201 bp, Bos taurus
caggggtgcccactcctccctggggcacggaactgactctggatgccccccaggggtgcccgctcctccttggggcaggggcctgactctggatgccccccacagcttcttcctcaccgtctcatactacgggatagtcctcgacctgcagaacctggggagcaacatcttcctccctcaggtcctctttggagccgtgga

SEQ ID NO: 28993 - DNA, 201 bp, Bos taurus
acagccagggcctccattagctcacataaaaggtggttcccctcctccagacacatgcaaggctggggaacgcagtgcagaatggatttcagccctcagctgggggccctccagggaaacacacacacagctgcacctggctgcgccttgcagtgactgtgctgaccgctactggccatccacgacttctcacctcagcaa

SEQ ID NO: 28994 - DNA, 201 bp, Bos taurus
cccgtttcttgctctgagaagcagggcagcatgccagcagcccggccacctctccctgtgacccagggcccatctgcaccctctgctgggacgtggggcctgccgaggaagccagcacctctctccctgcgtttgctcctctctcccctgttccttccactctcttcccagttggccttcagatgggacagaggcagattt

SEQ ID NO: 28995 - DNA, 201 bp, Bos taurus
tagatgagaagaatttatctacgaagagactgtattttggggccaaatggggtgaactgacaagacatgatttcttgaggggcagcagggctcaggacacagacattctctaacccggccaggagagttgaagatttgaggtcaggtacaggctccacctacccaaagtgttctgttaacaactggatccctgtatcttga

SEQ ID NO: 28996 - DNA, 201 bp, Bos taurus
agcagatataggtggggagggttatgtcagccagagtcagaggcccagcttgagccctatttcccaatgccccagggtcctcaatttaggaggaaagatactcctgccacctcaatgccctttggctgctctctggccagacattcatgaccaccagctcagacctgtctgctctgtctccccagtgccaggtccctgagc

SEQ ID NO: 28997 - DNA, 201 bp, Bos taurus
gctgcggccatccaggtgagcggagccctggctcatctgtctagtggagataagagtggtacctgcctctcaggttgctgagtgaaggcaccgcagctcccccctggcccccttccccactcccccaccccaccccattcaccaggccaggccctggggagacaaacaagaagcagccagcacagccttgctctagaggtt

SEQ ID NO: 28998 - DNA, 201 bp, Bos taurus
tgggccagggaaggacaggccccagggatagaggctgggcaggtcagtggccgccagcccctggcagtgcccttttcctgcagctcctcggagtggaacgccgtggacccttacatgcgggagcagctccgggtcaagatggaggatggggagttctggtgagcagccccctcctcagtctgagtgggcaccccagctccc

SEQ ID NO: 28999 - DNA, 201 bp, Bos taurus
cgtgccctgcccccaccctgggtgcacgacggggacccgggtgtcctgtgtcttggtctctagccagcaaggcagagcccctcctggcaggagccatacatatccctcacttgccaagcactttacagtttgcaaaggactttgcgatcgatagtaatggcgcagggcccctgggttcttgctctctgcagggtctgtgct

SEQ ID NO: 29000 - DNA, 201 bp, Bos taurus
caggaccaagcctcagaggtgctgcaggtccccggtgggctgagcctcgaggaattttcccgctttgtggatctggagagtgaggagcctgtgtctggagtgtgcaaagaggaggtgggccctgcagacgaggcgggaggcggagaggacggcttcgagcccctgcccaccaaggctgatgccctccaggctctgggcacc

SEQ ID NO: 29001 - DNA, 201 bp, Bos taurus
tttttcaccttccaggtgaaaaccatccaagtcttggtttcctcagttggcaaatggggattacagtgcccctcctaagggggccactgttaggtggacacggaagcctgcggaagggctgtgagctgtagagtgtgctgcttgagttgtcttctgtaacctggtatctttcacgggccctgggcaggactcccaggacag

SEQ ID NO: 29002 - DNA, 201 bp, Bos taurus
tcttagccttttacaggtagcagtggccctcaagtcaagacaagaacctgctcaattaagtggtctgcccatggtctaagcagtcagtgcctgctgacccaagggccccgttctgttctctgtggtggccacagggtccagtctcttccccataccctgccaggaccataggaggaagaaccgcattccctaaatagtagg

SEQ ID NO: 29003 - DNA, 201 bp, Bos taurus
tgcacgggggaaaagcagagagttagcccagtgccttctgagaagacctgcaaacaaggagccccattaagaggaccatgtggccaagcagtcagggctcggtgagccagacaggagagaactgcaggaaaactggccaaacactacctccctatacccatctcagaaattcgttagaactgctgattttaataggattct

SEQ ID NO: 29004 - DNA, 201 bp, Bos taurus
ttctgtccccacgtctttgtgtctgatgtttctggtcccagacaggtgacctgctgatgcgttaagctgaacttatcttcaacagcttttacgattgtgtagtagaggctttttaaaaaggttttaaatctctttctcttttttctttccctactatcctttctttttatctttctagtccagttttccttgtccatttgt

SEQ ID NO: 29005 - DNA, 201 bp, Bos taurus
gcttgtcttggcaggacctgtacatccgctggaagggaccctcctttgacgtgcaggtggggctgcacgagctgctgggccatggcagcggcaagctctttatgcaggtaagaactcgagaccaggggcttccccagcggtccagtggctaagactccacgctcccagtgcaggggcctgggttcaatccctggtcaggga

SEQ ID NO: 29006 - DNA, 201 bp, Bos taurus
cccaagggaagagacaacagagccctgctggcatccacccccagcacccaggaaggagacagaaagccaaaggccgggggccatttaccccgatgcagacgctaaccctgtcccaggtcccagagactcacgatctcatcctccacgtcccggtggaactggtgctgctcgcgggaggcctgcaggcgccggcagcgctcc

SEQ ID NO: 29007 - DNA, 201 bp, Bos taurus
ctgcaggaactgtcctttctacaagggctactcagtaaattagtcatgaaagccagctgagggccagtgaaaccggccagtcacaaaaagacaaatactgcgtgattccacttagatgaggttcccagagtcaccacattcacagaggcagacagcgggagggtgggggccaggggcgggcggtgggggagttagtgttta

SEQ ID NO: 29008 - DNA, 201 bp, Bos taurus
ccgccccctccagtggatccctgcaccctccgacccggggggacgggagggggggggtgggagttggatgggggaggctggggagaccgggcctgctaacagagtcagcctttctttccactgtggcagcatcaagccaactcttgctttgtggttttgggagctgacgtcatgtcctttggccactcacttttttttttt

SEQ ID NO: 29009 - DNA, 201 bp, Bos taurus
gagctcagttacagtctggtttgcagacagtgagatgaccaccctgcagcacacacaggtccctcccccatagaaaagcagcagcctgccctctgctagtccccgagagcagcagagaggctgacccggtaagtgcagagggtcttgaagaaaggagacactgacacggcgtttgcgggcctgttttgcagaagcggaaaa

SEQ ID NO: 29010 - DNA, 201 bp, Bos taurus
gcggactcctcaccattgagcctctagaggagccctgatttttaatttgaagaaaatgcgcgcccttgctctagacagggaacaatggatatagttacattgtataggccactttacagctagttacaaatggctctcttgggacttccagagcatttaattgttaacaggtatttttctaataatttacttttagatctc

SEQ ID NO: 29011 - DNA, 201 bp, Bos taurus
tggagacactgcgtgtaccttgcatttaatagatgatactgaacgtacattccgcttggagctaatctagtactgtaaatttaggggtaggtgtgtcagacgtgactgtcagtcttgttaattacattagtctgagcaacagcaactgatcattttgtagttttcctgaatgatattgtcagctttgagtattaaccatgg

SEQ ID NO: 29012 - DNA, 201 bp, Bos taurus
acttcagaacaggctggcagctcctcagaagatttaatgtggagttaccatctgatctggcagttccatccctaggagtagacccaggggcaatgaacacccagggccccacaaaaacatgtaccggagcggtcaaagaagcattttaaataatagacaaaacatatggaaacagcccaactgtccaaacgagtggataaa

SEQ ID NO: 29013 - DNA, 201 bp, Bos taurus
caggagatgattgcgggagccagggtcacccccaggaccggagggaagaaaggacatcagaggggctccacaaagaccctcgcgggcatggccagcattctcgcacgagaccccaggcgccacacaccttgaaggaaaagtatcaaccaaaggcttctccaggccaaatctcacgatattaaaaaaaaaaaaaaggcaagc

SEQ ID NO: 29014 - DNA, 201 bp, Bos taurus
gcagccagggggcagaggccttactcccttctcagctctgctccccagactgcagctccctggggactgcagttccctgtagcgaacagagcatctaggttcctggggagctctggcctgattgaaccctgagtttcctcagggccaaaaataggctagagtctgcctcagaaagtaatctttctccttctctgttttccc

SEQ ID NO: 29015 - DNA, 201 bp, Bos taurus
gcagcaccctgctgagcacggctcccaggggctccctcaggctcaagcggcccccactgcccaccaggaaatagatcatcggtttggtgctgctgctcacagacagagagaagcaggtgaaatggccgaagagagtcttcgcgctctggggcaggtccagccagtagagcaggaacccagagatgccgaggggcagggcgc

SEQ ID NO: 29016 - DNA, 201 bp, Bos taurus
attacagcaatgactctgacggacagagcccatcctcacagaaggcacagtctatcggcagaggggaaaatacacaatcagacgattgcccccggccgccgggcatggtggtggaacgggggtgactaacgagatggggactcggagcgtgggtggggctgggagggtctgaggtccggggggcagctgggagaggccagg

SEQ ID NO: 29017 - DNA, 201 bp, Bos taurus
ttggccagtcctgcttttttccctctgtagaaccatagctgctttgtcaggggccgaaagatgaaaggaagcattagggccaagggctgcccccatgtcatgcagagaagctggtgcatcagcccaggggctgcttctgtcaattcaggggcatcccagccttggcctttgtaagctgtgtgactctcagcaggttataaa

SEQ ID NO: 29018 - DNA, 201 bp, Bos taurus
agcgctccggccatgggggcggtggtggccgctgtgagaggcccgcagaagtccactcgcagtggctgctccccaggcagggcgagatagcatctggtctacaaaatcaagcatgaagggtttgtgtgacagccgtgatcgagaaagagggtggcatcctcaccaagctccctggtggctctgggcctcctggcggacagc

SEQ ID NO: 29019 - DNA, 201 bp, Bos taurus
caggttgggcctgaaactggccccccaggtgaagatggaggggacgctacctgcggggctgcccacagtcacctcaattcctgctgtggtctcagattccagctgggaaagcccggcccagccccaggctccagcatgtgactctgagtctccaggactgggttcggcttgcacacaaatccaggtgtgtggaggccaccc

SEQ ID NO: 29020 - DNA, 201 bp, Bos taurus
aaaagagacaagctatttatatttttttatatcacgttggaaaatatgctgtgaggcagggtttcccaggaaaatttctggaacccggccaaacaagcacatttctactctgcaggactcctcagtgcctttccatgaatccccaagagtgtgtgacatagacccagttaattggccctcagaatcttttttatggtaact

SEQ ID NO: 29021 - DNA, 201 bp, Bos taurus
tcagaaagaaccacggaaagaaacttggaaaatttatcaaagaaccaaacgcctcccccggagctctggccaacaggctctgggcccgtgggatttgaggaaaagaagttccaggaaaggcaattcgcggagtggagacagtacccagagaagagtggcccagtcccccgccaatcccgatccacagccaagggccacccg

SEQ ID NO: 29022 - DNA, 201 bp, Bos taurus
gaagggtcttccttggcacccacccacaccctctcctgggccacctcctcccacccacttcaggcgtcacctccggtccggaatcaggctggctgtaccccccagctttcaggcctcagttggcaggagccgagtagccaatgaaacctcaactcaccacagcttagatggctaagactcccagcgaggctgcctcttgcc

SEQ ID NO: 29023 - DNA, 201 bp, Bos taurus
caggaatgttactgttggaaattatcattttaaaaaacttgtaaaaacaaacctccatagctgataggaatggtctcaacttgcagccccattatactaatgatgatctgaagtttctcaagcacgcagagaaacgtaagagaaacgttccagcaaagggaggggcgaaaacacgaacatgtttgtcttgaacatgtggtt

SEQ ID NO: 29024 - DNA, 201 bp, Bos taurus
catgaggggcgagaggggctgcttggcaggtgacctcctggaagaggtgactccacggcgtgagaactcagcgatggggagacatcagccatgagagaggcgaggccagggtgttctgggaaaaggggaacagctagtgcaaaagcctggaggtgggaaccagcctggcaggtttgagggccgcaaggacggccagtgtga

SEQ ID NO: 29025 - DNA, 201 bp, Bos taurus
gaatggcccccaggtgagcagcccgcctctcctgcagggaaactcacagagctgctgtcatgcaagaggcatgcaggagtctcctgaaaaggccacagtgcaggtattttagggtcaaggttgcatgtctttctgtgtgtgtgtttacagctcttttaagaatgtaaggcccgcctgcttgcagggcgcacccagacgctt

SEQ ID NO: 29026 - DNA, 201 bp, Bos taurus
ccaccgctgcccgcaccccccaccttctgggaaacagcaggtgagccgagcctgcagccatctcctggggatttccagccagcagaggagtcgcacccctaaaggcggctcaggattccagggccttctagagatcggagagacgcagcagcaacccttggtctctgcagccggaatctggctggactgttcagttttagt

SEQ ID NO: 29027 - DNA, 201 bp, Bos taurus
atgatgcccagctctgccctcccctcccacctggtgcccccacggggctcttcatgctgctctgctctcgtttctgaaataacaaggctgcatctttggggacagtggtcgggccatggacccacgacatgcactgtcttcctgagtccacagcctcactgagcttttcctgttcatccttgacacatgcccgcctcactt

SEQ ID NO: 29028 - DNA, 201 bp, Bos taurus
acccaggctcctgactcccctattttggcttcaagtggcttgggaaaggctgaggcaggatgtgggggagacaggggctttctggctccccaaggcctccgtgtaacttgaacagcgcacaccagtgagggttagtggagatggctcgctgcaggagcgggaagacacacatggaaaagccagggtgcctgaggccatgtg

SEQ ID NO: 29029 - DNA, 201 bp, Bos taurus
accgcacgatgctcatcgttttatgtgcgcaacgacaggaaagaggctaaattgaagagcacggacgctgatgatttaatgggagaaggggcccctcagcgcggaggagacccagcgcgtgactcagaaggcagcacgttaccaaggagacgagccgctccgactcacccaaggccagtcacactgacagctgcccttacc

SEQ ID NO: 29030 - DNA, 201 bp, Bos taurus
gcacctccctccttgctccccctgctggaaccccatgggagtgcagccgcatgctggggctcccctgggaggcgacacccacccagacaaagcacccccatgggcctgcgagctcttagaatccagttcacggtatgtgccctctcgctattaaccggccttctctttgtatgtgagccacgtctggcttggctgaaggtg

SEQ ID NO: 29031 - DNA, 201 bp, Bos taurus
aatgcccatgactgctgttgctttgtagagagactttacagcataaagcaaaaaatatttactctctggccctgaaatgagcagttctcattttaccctatgttctgcaggcttttgttacgcaggttggtagctgacagactgccatctaatcgttactgatcaggtcagggtgaccagccccacacggtggaggagcag

SEQ ID NO: 29032 - DNA, 201 bp, Bos taurus
tctttagcgtctgggccaccaggggagccttggccaagggctgcgttccctgtaaatgtcttcagtggggattccatgtcattcctgtgtttgagccagcgcaggggtcacgggtccttgcctggccccaatcctcctggggttcggagcccccagcccctgctacggtgagtcccagtagtgctcggccccaccctgcac

SEQ ID NO: 29033 - DNA, 201 bp, Bos taurus
acctctgtgacaccctgtctccccgtctacagaacgggccacacccttcccaggtaccaaagggtgagcgccttctgtgctgtctcaggacctgctagagggcatcacgccatcttgtaagccaccgtttcctcacggtggggaaaacacagactgccaaagcttctgagaagccattgcctgtccctccactgagtacac

SEQ ID NO: 29034 - DNA, 201 bp, Bos taurus
ggagggttcttccttgctgctcctcgtggcggctggccgtgcctggcgctcctcggttggtgggtgatcgctctgcttccggccatcttccctcggcctctcccgctgtgagcctgtgtctctgagtctctccttgtgaggacactggtctcggaatgtaggtcccagtcttatgcagtggaacctcagcttcacagacgc

SEQ ID NO: 29035 - DNA, 201 bp, Bos taurus
cagtattctggcccggagaatcccacggactgtagagtccacgtacagtccactgtatagtcgtgtgacagtccacggctgagcgactttgactttcacacgtccatggccattcttggtccatgccaaatggttgtaggtgcagccgcccttcagagccttttggtgtggaccgatgcctgcatgtgactgcaccctcct

SEQ ID NO: 29036 - DNA, 201 bp, Bos taurus
ggactccaggcgggacccaggcccgaagcaggggctgtgtgcatctttgaaggcccaggagtctgctgttttttccaggttgtgactcagggctttgggttaaatacatgattttgatggatttacagtgtttttttccccctcttatgatttataacagtaagacacccaaatgaagctacttcttagaaggtaaagagt

SEQ ID NO: 29037 - DNA, 201 bp, Bos taurus
gcagctgcccatctctgctctgggcaccctgggatctggtgggtaggtttctagggcccctgctgccttctgcccctgggcctctggttgatgcccagctcgggggtggtcaggtctcacacgcattttgcgaatgggaatgctagctacgagggatgacctgggcctctctctctgcccctgccaccctgggactcagcc

SEQ ID NO: 29038 - DNA, 201 bp, Bos taurus
ctgtgtcccctgcagagcccagactgaaatcagagttcctggtcctctgacccttggcagtggatggccactggcctaaaaatggccctgctgggatgcacctccagccagtgtggctctctgctggctgcctttccccaggacagacaaggagaaacccccttccccaaaggccttcctcctgtctcatttctctcctgg

SEQ ID NO: 29039 - DNA, 201 bp, Bos taurus
gccctcactctccccacagtggagcccaggcacctgcacacgtgcgcgtctgtggcgtctcccggcatgaccacacccatggacaccgtctctacctcacaggggccgcgtgtgacaccgtcccagcaggccatctcaccgggggcaggagccacgagagatgccacacgagctgagagtcgactcagaacgcggtttgag

SEQ ID NO: 29040 - DNA, 201 bp, Bos taurus
catcgctcaaggacctgcccgcctggcgccccagcttctactccctggtgggtggctcaggtcatctcactggttcccattcagcatgtccggtgaacacggcttgaagggcagagttacgagctttacaagaccaggcaggagagacatccccgagccggacaccacgtccaccccatcccccagcacaagccggtggaa

SEQ ID NO: 29041 - DNA, 201 bp, Bos taurus
gtgcacactcactgtggcacacacacacgcgttcccttggtgtacagtcacagtgcacactgtcacagtgcacactcactgtggccttcagcaagccagcggcatgcccacgggtgccctgacagttctgacatcaatcatcaaagaccgaaacgtgggctgcggcccatttcctggaaatctccactgtttcccccaaat

SEQ ID NO: 29042 - DNA, 201 bp, Bos taurus
ctgagcaccacagccagagcacccccgccttggcagcgactgctactattggcccagccagcggatcatccacctggcagtcgagagcctggggcaccagtgacgtccaggtcctctttacccaccgcccaggggagcttcagagacaacacagcaaatagagcacaggtgcccgggcgtccctccctcacacgtccccct

SEQ ID NO: 29043 - DNA, 201 bp, Bos taurus
atagtaaaatggaactttaaaaaagaagtggggaattgtgctaccagctcccatcagatgggcagcgcccacaggagccctggctggcttctatacctggcacaaatcccgtccttgccaggccttgtctggccctaaaatggcctggatggggactctggatatttcaaaatggattttttttttttttttttgcactta

SEQ ID NO: 29044 - DNA, 201 bp, Bos taurus
aggcccccgtcccatctgctgcagagctcaactgtccagtccacgtccctttaagaccgagagcctgcgggaacctcgggggcgagtcctggcaggctctggtttggagccctggggcctcaccccattccctggagaaccaggatgtgttccttgtcatccggtcgtcctgaccaaatgcaccaggacactgggcacctg

SEQ ID NO: 29045 - DNA, 201 bp, Bos taurus
actgctgtgggttggggactggccgccgccagtggtggctttaggggtggaggtgggccgccagccaagtaatgggggcccccagcagctgaaagtgccaaaatccaggttttctcttggagtccccggagggagcttggtcctgtgacccctggattcaggcccagtgaaacccgattcagacctctggcctccagatcc

SEQ ID NO: 29046 - DNA, 201 bp, Bos taurus
ccctgaatgccaggctagagggatgcaggaccccgggaatccctggcctgaagctgcagagacacgacattggcggggcaggcagccgcacacaagtgaaggaggcagggctgggctgtggcatttattacatctgctttgacaaaaataaataattcacacacattcttcagaaacatgaaaaatgaagccggcggagca

SEQ ID NO: 29047 - DNA, 201 bp, Bos taurus
agggaggtagccaggaggagaccaacggcgtccgcaggtgctggcgcccaggtcagccgcggaggggctggacacgggccttcaaactattcttttaacatacttgttccttcctgataaccacgcgggaattccaaggagtcttgaggccctggctgtcacagggcagtgctgagctcaagttcatcaaaactcagcttc

SEQ ID NO: 29048 - DNA, 201 bp, Bos taurus
gtataaaagattaacggcccgattgaaaaactgacacaaggcatggacagggagtctacagggaaatagacatggaggaaccctttggttagaaaattatatgccggggacgcccctggcaggccactggttaggactctgagctctgaccgccgaggacccagtccctggtctgggaacttagagcccacaagccacatg

SEQ ID NO: 29049 - DNA, 201 bp, Bos taurus
agcaggcacatttctaaattagaaggcataattcttatgccaacaaatgttggagaaccactggtctagggaatctttaaaccctaattatacatgaccartgacccttatttcatgttcagtcacctgggaaaacaggctgcatgtggtccagccgaggagctgtcagctgctcaccagctgttaaggggtctgtgttaa

SEQ ID NO: 29050 - DNA, 201 bp, Bos taurus
tttaacttgccgaggtggttttgagacgtgctctggcctcggagcaccaagcacacacgctggcccttgctgacgcggcctctggtaccagctgccgcccygtcaccaactactcgcttcagcctctgcccatgctacaaacccttcactacgtctcagcacacgctgagcccggcccccatcgccccacatgctttaatc

SEQ ID NO: 29051 - DNA, 201 bp, Bos taurus
aagtgaactatgtgacttccccacgagacccttaaatggcatcctactgcctggctcaagaaacaaccaagaggtatcttagatcatgcaaagggagccargcaataagacagaaggatcatgggttcccagatactgagggctgctaggctgcttatactggggagattttgcgagaaagaacattcgatcaagttgaaa

SEQ ID NO: 29052 - DNA, 201 bp, Bos taurus
tggcctccaggctattatttttttttttcaggcaaatttcctgccttttttttttccttctttttctggcttccatttgcttcagtggcagcaacagcagyagcagctggccctctagattagctttaatccgcttgctatttatagcacactctgtaaacctcatcatacttgtgattccctatttaaatgtgtcttcct

SEQ ID NO: 29053 - DNA, 201 bp, Bos taurus
taggagatgggctcccatacgccaggaggcccgtgccactatttcattaattctgtatcatctcaggacgacattttatgcaactgaatttttagggcccmattaacaacagttgggagccacttccaatttgtaagcattgaaaataaactgagtctctgctcaatctctgatcaggagataccaaggcctggccaaagg

SEQ ID NO: 29054 - DNA, 201 bp, Bos taurus
tgaaaaccattcagatcagagatgtcacatagcttaaccttgcagactgcaggagtaaaaataggcccatgagtagaaacaggcccatgagaccttcccamtgctggagtgtggcaaagacttcctgggcaccagctgaatccagactcagaccacggggactgtgtgataggaggcagagagggccctgcagatgggtct

SEQ ID NO: 29055 - DNA, 201 bp, Bos taurus
gaccaggcctgagagcctctggaccataaggtgctgccacctggcaaagcttttctccatcatcatgacctccagccatgctccagctgagcaaaggacarggagctggcctctgcaatgtgcatgattcactgcacttaccttttcatcagagccatttttccaatattgcacatggtaagtccatgagttataaatgtt

SEQ ID NO: 29056 - DNA, 201 bp, Bos taurus
gagagccaggccatgtctgtggacctcactgcgactgtcgtcctaccctttggcacctctgcaggcagttgcttcaggaaccaagcctcctccaacacttracttgaataacggccaaaccaaggccacacagaactgaacccgatcctgccccagaaataaatcatttccactttagcctcctgaagtggaagttacctg

SEQ ID NO: 29057 - DNA, 201 bp, Bos taurus
aggaatgtctagcttcaagctgcctgtgctagaggcaggcatagccaaggagaagctgaatggggccagagcagtcagttcaccccaggccagaggccacygggagaccctgctgcgttgactcattacagcgaaacgtgcagccaaagaaactgaaaaacttcacgtgttggcccaacccctgaaaatggtcggaaaagg

SEQ ID NO: 29058 - DNA, 201 bp, Bos taurus
ttgaagggattggctttctcagcactggtcagcttgcacatttagagtgtgggtggaagccgaaagacctcgaagaccaggtgaggagctggggtagacakcagggagtggtgacgactgtggcttagagtcatccttgcgtggctccaactctctgggcctgcagaagctgggctcatgtatggctgtgccttccaactt

SEQ ID NO: 29059 - DNA, 201 bp, Bos taurus
cattcagctttaaaaacaaattaaagggggaggccttcttggtaatgatgacacttttacttttgtttccattttatttgtttagactgaaagaaaggatycgggcccagaaaggccaactctctaaaatggatttgattttgaacagtcaacaaaagcaaaaaatgttcttaggtgctatttacatccgcacccaaatta

SEQ ID NO: 29060 - DNA, 201 bp, Bos taurus
tctgcagccccagctgacatcttgctgcaatcaggtgagaaactctgagcccgacccatcctgctaagctgctccggaattcctggcccactggcactgcraggtgagaagcgtttgtcgttgtgtgaagcagttaagttttagggtgttttgttacaaaggcgtgggccactaatacagttacttacaatgccataagac

SEQ ID NO: 29061 - DNA, 201 bp, Bos taurus
attaaaaagaacctgggggtgagcaaggtcaaagctgctccaagctccatgcaaagattgaagaaaaatgaatttagggctgccttagtgctgatgagaayaagttgctggcagaagttttttctaatagcaagtggtaagtattaaaatacaaagctttcctgttctaaaaaggagacctggtgctaaagaaagctgcat

SEQ ID NO: 29062 - DNA, 201 bp, Bos taurus
tggaaacttagggctgaataagaacatcagggtccgagagggaagtcacaaaagccaagtgcatttgggatttttgttgcttagaaagaggcctaaatccrgggaatgctctctccctctagcccttctctccctctcttgccttgccacctcctacctttggcccagctacacagcttccccactgttcctcccctcctc

SEQ ID NO: 29063 - DNA, 201 bp, Bos taurus
gtgggcctgggcccctcctggggaggcccgatacatgtgatgggggtttctgacttggaaacaatttcataagccatcctgggagtaggtaaggcaagagrggcccccagaacctcaggcccgatcctcccgggtttctgagaacctggccgctgttttctttcccccaacagacatgactaccttggtgcccccagtggc

SEQ ID NO: 29064 - DNA, 201 bp, Bos taurus
ttaaaccacagcagtggactgcctcacggtcctggaagctgggagtctgaggtcaaggtgtttgcaggtgcggtttcttctgaggccccccgccttggctygcagatgtgggtcttcttgctgtggagggtctcagtcctcatctcctcttgcttcttggctgccttgggtctttgttgctgtgcacaggcctttctctag

SEQ ID NO: 29065 - DNA, 201 bp, Bos taurus
ggaaatattgaaggcaggaggagaaggggacgacagaggtggactgggtggactccaagagttggtaatggacagggggcctggcatgtcacggttttackgggtcgcaaagagtaggacatgactgagcgactgaactgaactgaactgagcaggggacggaggggagatgggagcatgaaggtgaaggcctaccacgcc

SEQ ID NO: 29066 - DNA, 201 bp, Bos taurus
ctttttatgagcaagcaagagcccattttagagaggccattcacaaagagaatggaaaacagcttgaatggaatgtgatttgagcactagggccatgctckgctctgtaggacgaatccaagagtgggactaagttgcagcaacagactggtgaccaacatgttcccccgagacatttttatgccctatggatggcaacca

SEQ ID NO: 29067 - DNA, 201 bp, Bos taurus
gtttctttctagcattctaagatacaataactgttgctagtagttaatattaagaatctatggaaattactgcttgttattctatctatatgatttatgartgactactgattaaaagaaggttggattaaaatttttgagtacaaaagaagtacatgcttttagggggaagaaatgcagataatacagaaagttctgaag

SEQ ID NO: 29068 - DNA, 201 bp, Bos taurus
tattctcctgagagtgaaatcagaggatctacaatatccacgatggcaacaccgtttttgtcagctgtcacattgcccaggtctccaacatgcctaacatygaaaaagcagagggattaggactgatttctgtctatctaactttagttcataagctaaattaaaaatggatgagtcagatatataagggtgacttgagag

SEQ ID NO: 29069 - DNA, 201 bp, Bos taurus
gatgtggcacaggctggtaactgggaggttagacttttccttttttaaatatttatttatgtgcctgttccaggtctttgctgcagcagattcttgtgaayaaggccttagttgcggcaagtgtgatctagttccctgaccagggatcaaacccggacccccagcattgggagcatggagtcttagccactggatcacaag

SEQ ID NO: 29070 - DNA, 201 bp, Bos taurus
gaattcgctaatgagaagatccaagcagatccacttgtgatctgagtgttcattgctgcaccgcctctccaagctcccaagggcatctctctacgtaataktaatgcctggccaggtcccatccattctgacagacaaaggacaggcgctactttacatttatgtgcagcctctttatttcattatactgagtgccttctg

SEQ ID NO: 29071 - DNA, 201 bp, Bos taurus
gaattcagatgctttccagaaatagagacgcagatgcagagaataaatgtgagaataccaaggcaggaaggggagtggggtgagttgggagattgatactrtataaaatatgtaactgatgagaacccactgcagagcacagggagctctgctcagtgctgtggtgaccctgagaaagaagggcacgtgtattcgtatggc

SEQ ID NO: 29072 - DNA, 201 bp, Bos taurus
tatggccttgacttaatacagtgccgctcctgttcagggctgtgcaggctctcccagtgtctcaattacaggtttttaagttggagtctgttgggccatgyggggtcatgtttgcacctctggtctacctggctcttgctgggaagttggggtcatttgtgctttgggtggccccagacacgcccaggcaggctctcaaga

SEQ ID NO: 29073 - DNA, 201 bp, Bos taurus
acatcaagacaaaatggaaggtaattgctttccaagaggagattaaagattaaaaatttgcagctgagtctttaatgcttaaagaattaaaggggggagtrggaagtaaaatggataaaggtagtcagttacacgcttccaattataagctgattaagtcctaggtatgtaataaaaagatgagtctcctatacacacatt

SEQ ID NO: 29074 - DNA, 201 bp, Bos taurus
actcaaatttgccttcttattcccaattttattgccacaagcatcactcagaggctcagttttttttttaattgacaattctaatagaatactaatagctytatatccttcacagttctcttccacaatccattattcacactaagccagttctaatcacactatttcctcaattaaatcctttagtaagcagcactttat

SEQ ID NO: 29075 - DNA, 201 bp, Bos taurus
aagcttcccttttagttcagccctgggatattatttaattccaatatggaaatttgaattttcctgtgggaaatctatgggaagacaaatgtgaagtgaaytccttcttattgcacaatgaaaaggagctttgaggacagtccttttttaacttctctgtttctggatggtgatgtgtatgaatctgaagcattgaccttc

SEQ ID NO: 29076 - DNA, 201 bp, Bos taurus
ttctgctgtctggctttcacactctaggccactatccacctcttcaaaccaccctaggaccacataccagataaccagggatagtcccaaggccccagagyctgctgaaattattcacactagccagtcctaagcctgtttaccctgcatctctgttccttcctgtggaaactataagaaagtctcttatccacattttta

SEQ ID NO: 29077 - DNA, 201 bp, Bos taurus
cctcactccttctgccacgtgagggcatgagaagacaacggtccatgaacgatgaaatggatctttaccagacactagatcttctggaaacttgatcttgkatttctagtctctagaactgtgagaaatatctgttgtttataagtcatccagtatatggtattctacgataggcagccttaatggataaacacttgaatt

SEQ ID NO: 29078 - DNA, 201 bp, Bos taurus
accatctggaaagttctcatcatattttcatgaacagctatgcttttatagctaaatttatggggattatttctctctgttagattaactaccccttattytgttttcttttatttttgttgttacagttttattatattgtatataatctcctgcttctcaatttataacttagttttactttgaggcaaatgaagaatg

SEQ ID NO: 29079 - DNA, 201 bp, Bos taurus
aagcttctatgtcctttgcatacagtaatacttttatattgtggaaaatagtgaccttttccaaatgggcgagtgccctttatgtgacatctggacctccrggatgtcgtgagaaggcagtttactgcccacgaggaatgcacataatgtgtcacatgtgaaaacaaaacaaaacaaaaaagctgctagtgagaggctgta

SEQ ID NO: 29080 - DNA, 201 bp, Bos taurus
gcctactagacattatttttttaataagacagtttactttggcaacttctcctcctccttaaaagtactgttttttttcaatctctatatctctatgaacyactcagattttttggcccattaaattttcaaagtttaacaagtgagcaggaaacacacccttccataccctgagttaagctagtacaaggaaccacagaa

SEQ ID NO: 29081 - DNA, 201 bp, Bos taurus
atgacttttactttgaaaactaggataggcctgagcaaaccaatacaatggtcatcttagtatggaggtgcagggattgacatgattaacaggctcccagrtgatgttgggccttgcgggtggctcagatggtaaagaatctgcctgcaatgaagaagacctgggttcaattcctgggttgggaagatcccctggagaagg

SEQ ID NO: 29082 - DNA, 201 bp, Bos taurus
tctctgtatatttaaagaaagagttttatgcatttgatgaaactatttttattgtgtaggattgcagtatcataaccctacatgtttaatttgtcctgtckgctccattatccttctccacctctccagcaaggtacgtgcaaagaaaatgcacattacttcaaccacacaatcttgccaagcaaagtaaatacaagagat

SEQ ID NO: 29083 - DNA, 201 bp, Bos taurus
aaacagagtcacctgaaatatttctgtggttgagatgtgcaatgaatttagctggctgtttgaaaactctcctgattctgttagctgtttcccctgtcttyctgctggttctcatcattcctctctaattttgaatgtggttaaggggaagaaaggcaaaataaaagtctattttgaagcaaatgacaccacccatgacta

SEQ ID NO: 29084 - DNA, 201 bp, Bos taurus
tcttgcttggagaatcccatggacagaggagcctggcaggctacaatccatggggtcacaaagagtcgggcatgactgagggactaagcacacagcacagygcaaaacattagaggtttttttcaaagagtaatcttaataccgaaagccacaagtactgtctggtacctgtgaacagacagtatccttgacatgtttgtg

SEQ ID NO: 29085 - DNA, 201 bp, Bos taurus
taaagatggtgaaaacatggcattaaaaggagctaggaaacatgagctatcggtatctatgtgctacagccaaagcaagacaagataggccgctaggggcyggtccctgtgaagagccagtttaaagcataaaaaatgcagtgaagcggtctgtgaaagcagtagctgctgagtcacaggtgaggagaagggaggggacca

SEQ ID NO: 29086 - DNA, 201 bp, Bos taurus
gaacccgacaaataacatgaactgggtaaaaatgtttttctccatttcattctaaccccttctttctcatgttctaatccaggaggagtgactagcaggargtacaaagaagagaaaggagtataagaaggaaagactgcacccctttcttagataatagctcaaacctgagccaggggaaaggagagaagctcagaattg

SEQ ID NO: 29087 - DNA, 201 bp, Bos taurus
taactgtaccaaagttgcccactagtgaccctgagatttataccaaaatcatccacctctgaagtctgtgttcttagccaccatgctctgttgcccctgcrtgttatgcttccttagggctaaagactctccttctgtgattttttagaaccaaaatcaaggagtgttgattttgaggaggggagagggataaatcaggac

SEQ ID NO: 29088 - DNA, 201 bp, Bos taurus
atttctttaaaatctagtcaccaggaaggatgggcctatgccttgcagcctctgtcggaagacagaatcctaacttggacaactgtcatccatgagaagcrtctggcctatttggtatttgcactgaccaaccttcacttccctcactctactgagacccctgctaaccccttccctactccctcattcttcttttacaat

SEQ ID NO: 29089 - DNA, 201 bp, Bos taurus
caaaaatagttacatgaaaagaaaattacctaatttatatttcccgaagagtatcctgcatatttaaaaactttagcattctcttatgtagggtttccctkgttgctcagatggtaaagcatttgcctgcaatgcaggagacccggggttcaatccctgggttgggaagatcccgtggggaagaaaatggcaacccactcc

SEQ ID NO: 29090 - DNA, 201 bp, Bos taurus
gacaagggaggggctgtcaaaagaaacactagtccagccttgggccaacgttctggttccccctccagggatacatataactatctttgagcagttttgcrgatactgtaatccccaccagatgggagaaattaacagcctggtgcccacaagtccataggccccagacccaggaacaagaaggctgaagatgctgaatct

SEQ ID NO: 29091 - DNA, 201 bp, Bos taurus
tagtacaatatgccaggtaaaaagtttagcagttttacaaatataaatagttctaaatggctcttctagccaaaattatcaccactcagtgagtacaattyctccatctctcataggtgcactaaattttcatgttttattggcaagagtgacagtactctaattcctgtgcactcattatcagcttagtgcaaatcaatc

SEQ ID NO: 29092 - DNA, 201 bp, Bos taurus
aaatttttggccccacattcatttggaagagagtctgagtgttgtgttggtgaagtatgaaattgaagtgccctgttggctactcttagactcctctgctrcgttcctgctataaacttgaatggccagctaagcaaaacaaagaactccagacctatttttctaaggtcctttactgaggtctgttcttgcctaatcatg

SEQ ID NO: 29093 - DNA, 201 bp, Bos taurus
ttcctactccctcaaaataagatattatggccttgttgtgcctacagattcttcataacctgccttcactcgtttttctgccctcaacttgtgctgctctytaagtggtggcctcctggttgatcactgaatatactaagcatgattttactcacaacctttgcaaaatctgttcattctgcctggaattttcttctccaa

SEQ ID NO: 29094 - DNA, 201 bp, Bos taurus
agttggacacgactgagtgacttttactttcactttcttttaaaaacatgtattaaattgcttaaagcattataaatgaatatctaaggaaactgatggcygcttacttcctagattactgatgtctcaattaactcaagataacaaatcattgtgctcagttttatttttataaaaattgattccgaaaggcaattgaat

SEQ ID NO: 29095 - DNA, 201 bp, Bos taurus
caaaatccactagagccatatgttacctcttccaaattgaaaacacttcatcatgccagatacaaattgagtgtattgtgcttcccaagtttgcttttatrttttctgaaagtcaagttcatctggtggttatattctgacagcagagcttcttgtattcccatgtggcattgtatagacatcatagatttacagtgtgtt

SEQ ID NO: 29096 - DNA, 201 bp, Bos taurus
aagggaagtcgctcagtcatgtccgactcctagcgaccccatggactgcagcccaccaggctcctctgtccaccggattttctagaaagagtactggagtrgggtgccatcattatgcacctattatcataaaaatgacagtaatggatttcagttcagtttagttcagtcactcagttgtgtccaactctttgcgacccc

SEQ ID NO: 29097 - DNA, 201 bp, Bos taurus
ttaaatctgcatgagtcagactattttgatcactgctttgactctgctgtatgttatggtagccacacccacctggccttttgggatggaaagttgccatktcacccctgtcacctctgaatccaattactttcattgcttttattttcccaattcatggctgcagttcctactgtaaggcctgaactataggaaagagga

SEQ ID NO: 29098 - DNA, 201 bp, Bos taurus
gtgagatgaaagcaacaatatgcttcatcataagacatggaggtacaacctggctgccaatggaatcaaaagaagttgctttcactgtctctcgggaaaarcctgtagtgagccaagttctgcagaggagctatgggcagggctgttataaaatgaccagaacctgtccctgacaatttagggagaggcaaaatacttgtg

SEQ ID NO: 29099 - DNA, 201 bp, Bos taurus
agaatagcccattaatttccattggaaacattccagtgaatagcaagagtttgtgatgctttctttttttgttttttctgtagtaatgtctgagctccacraaatcaagaggtgaaatatggaatcgtgtgctttaaaaaaacatgtgctacagaggcaaatctggcctcagtcctgaattccatagacagccccttattg

SEQ ID NO: 29100 - DNA, 201 bp, Bos taurus
tctccagaggatcttcccaagtggttattaaccaattttgcattcctgtgataaactgatcagttattgtgttagctttttaattgttgtaccaaacctargctaacacagaataactgattggtttatcacaggaatgcaagactgcttaataattcaatagcaatccaggttactcatcatactaaaataaaaagggga

SEQ ID NO: 29101 - DNA, 201 bp, Bos taurus
tgtatcacggaggttgagaaatgaaatgcaggaggaaggtgagatttttgctttaagacatggcttactttacctcactatcaatggagggagaaaggaaygcacatgggatctttgaccatcactttacccgctgctatggtttcagagaatgtttatgccgtcttagagttaagaattcaggactgcccagcacgagaa

SEQ ID NO: 29102 - DNA, 201 bp, Bos taurus
gtaggatgcatacgtagcaaatgttatgagccggttcatttaactcctgtttctaactttcattcctacttaaccaaattttaagataaaatctgcattckcatttgcttttggaacgtgactttctgaatgagactcacaaaattcttttcaagtgagaatgacaaactttgtgagaagaaaggtttgttcttttatact

SEQ ID NO: 29103 - DNA, 201 bp, Bos taurus
tgtgccagctaataatcttaccctcaccaggtggaaagaaggctactttctctctctggaaataaacactcacctggcccaggagccctgctcatgttcartcatgagccctgtacactagaaagtcttcctttaacaatggctcgagtcttggccattctgtagggtagggaatggatgaaattccaaatcaaagtgctt

SEQ ID NO: 29104 - DNA, 201 bp, Bos taurus
ttgtcatcccactggaccttaacggtgcaaaaacagttaagagaaatttgaggaatagttaagaatgactaaaggaaattaacatacacatttccattaakagtcccttacatccaccaggtaattgatctttcttgctgaacgtgggttaggtcagcaatagaacagtacattggatgaatagggatctgtacaaattgg

SEQ ID NO: 29105 - DNA, 201 bp, Bos taurus
agacagaatcacaaactttcacagtcaagctaagccagttcaagactttaaactctgagtggtcttcaaaatgcattgaaaaaaactgtttccaaagataygtgtcaaataaagatgtagggtacaggtaaactcgtaccctattagaatgtaaattggacagatcttcccggaaagcagtctggcaacatacaccaaaaa

SEQ ID NO: 29106 - DNA, 201 bp, Bos taurus
agtaattgccgtgcgagggcttggttgccccacagcatgcagatctcagttccttgaccagggatcaaactcatgtcccactggaccaccagggacgttcycatgctgacagattaaacgcaagttattaaagagaaacatgagtctccctaacgtaggtattttggattatgtatctgagagaaaaagagctgtctttac

SEQ ID NO: 29107 - DNA, 201 bp, Bos taurus
gattctctaggccagagtactggaatgggttgccattgccttctccagccctctgtcttagagaaggtaaaaagagatgagagaaacatgcaactcaagaytgacttctgggccacaaagaggaatcagcatgaacttttagaaaggaagatgggttgagaagcatgtgaaactctcaaatacatcacagtatctgtcata

SEQ ID NO: 29108 - DNA, 201 bp, Bos taurus
tttgtaagtgatgctcagtgacattaccttaattcgaaaggggaaacatctaataggattgaagtggttctggagaataatagatatgaagcttgatgaaratagcacatgatattcccatcttagaaaagtgttagtttctgcagttaaccagcagtgacattgctggcaaagctcatcaagaagagacctcaggccaag

SEQ ID NO: 29109 - DNA, 201 bp, Bos taurus
tatggaagaataagccattgcacaagactagaatatttcactctcacccagtaattggttggctctttctaattaaattatcagatgtttttattgagcaractactgaaagcagtgaccactaatgagacacagttccccagaacagatggcagttcagctgtcttgagtgttgcaaaatgcccaagaatcgggccacac

SEQ ID NO: 29110 - DNA, 201 bp, Bos taurus
ggtgcattgctggagatgaacttcaggatgggttttgaaaggtttggagcacatccatttgcaaagaggagaatagttctatatggatgagagaatgaccrgggccagtcttcctttcttacactgttgtaaaacttgagttccgccaggagagggccatagatgggaaagaattctcagaaagtgagggagactctaact

SEQ ID NO: 29111 - DNA, 201 bp, Bos taurus
gagatggtgagggacagggaagcctggtgtgctgcagtccttggggccgcaatcgggcatgacttggcaactgaacaacaacaacaaagctagggccaagyaaaactacagaggctcaaaagtattcgctcttttccaatatcagatgcgataagtgaaagacttgaaaaaaggttctgtagtcaaggcctatgtaaattc

SEQ ID NO: 29112 - DNA, 201 bp, Bos taurus
cttatttattttggacgtgctgtgcagcttgtgggatctcagtcccccaactggggattgaacccaggccacagcagtcaaagtgccgaatcctaaccacyagaccaccaggaaacgcccacttttcttccttttaaaatgaccagcttgacttcattacagtggctgcttagagaaggaagcccgaagattcagttcttg

SEQ ID NO: 29113 - DNA, 201 bp, Bos taurus
agaccccacaagaagatgttatggttactgaacaagaatgcccagggaaaccatctttggtttagagataaagatcactttatcaggccctgtcctctcakctctcttcagaaacatttgggacctctctggtggtccagtggctaagactctgagctctcaatgcagggggcccaggttcgatccctggttgaggaacta

SEQ ID NO: 29114 - DNA, 201 bp, Bos taurus
caaaacaaccacagaaacctttccaactccagcacattaatcctaggttcacagtggatacaaactaaccacagaggcttctccaactctggcctagaacycttgatgtatggctgtgtcctcaactgaccttaggtagcagggagcctgttcagttcagttcagtcgttcagttgtgtctgactctttgtgattccatga

SEQ ID NO: 29115 - DNA, 201 bp, Bos taurus
ttataatataaagtatagatcacttaaaaaaaaagattcagtgaaaattatggaattacatagatatcaaaaaaatgtttttacaaataaattagtttagmtaattctgttacaacagataaatcccaaatatttagtagttgcttatatttttacccatgtgaagtccaaatcagctttcctgataggcatacgactttc

SEQ ID NO: 29116 - DNA, 201 bp, Bos taurus
cgtgaaaaaaaggtttatcagacttccacggtggcccagtggttaagactccatgcttccactacaggggacatgggtttgatgcctggccagtggaagtmaaattccacaagctacacactcctgccctacaccaaaataccaaagaaacagatagaagcagggccccagaaagaatggagaaagtgccctggatttcaa

SEQ ID NO: 29117 - DNA, 201 bp, Bos taurus
ccactggctgtgtactctgtggatacatttgttattcatcttgctctccccgtgagtagggttatataagctcaactcaaatagaaaattcatcacactgraatcatcaccctgcactcaaaccccactgtaccacctgcttttggagtctctgttatgtaggcaccagagagatggatcccttgatcatggggggtcttc

SEQ ID NO: 29118 - DNA, 201 bp, Bos taurus
agtctagtcgccatccatcactatactgttgaccctgttcacccacccttcaaatcccttcccctctggtttatgctctttatgagtttttattttaatayctattttgaaatataattttgaaatcatataaatacttgctttgagaggccataatgttgaacagatgtagcttaaggtatagtttaacaataatcttat

SEQ ID NO: 29119 - DNA, 201 bp, Bos taurus
tatatgtgctaaattttaatctttatatccctgatgaaccatgcatgtcatacttttagctttcaaaattgaattaaaccccatatcataagaaaatttcwatgacatattgttcacagctttctttctctttatctttagctcctaaaacacaagggttttaatgtttacttttttcactaacaattaatcttgatggaa

SEQ ID NO: 29120 - DNA, 201 bp, Bos taurus
aagattcaaggtctatatgtattctgacttcagaattcaacagaaactgatttttcaaatgccttaatattaatagtactgtccaatgtagcttccttttrttatctctttacatatgttttcaccaaaagcctcaagaatgctttcaaaagcacacagaagtgccctgatgaaaaataactttattttcagttcagttac

SEQ ID NO: 29121 - DNA, 201 bp, Bos taurus
ttgttgtaaagagcaaggtttgggtgcatgtaacccatttagttatcgggtcataagcaatcgtttcctgaccagttagtgcctgtctttcccccatgatkagtgccttataaatgctgcactcggtgttttatggctttactgcctacccatttagagaatactgtcattcattcaaatgcacactgcaaacattgtaga

SEQ ID NO: 29122 - DNA, 201 bp, Bos taurus
ccatgctgaaaaccacccttttgcttggcctccttagagatcatgtggatgatggaaacttgaaagcccagcagtagagagaagccggaaatggctatcartggatccattcttaggccagaagctgatacgaacatgtcattgatgatgctgacttcaaagtgttccttcagagtcctgaaaagaagcagtaagaaatag

SEQ ID NO: 29123 - DNA, 201 bp, Bos taurus
tgggatgggaatagaaataataaaaaaagtgagtattatagtaaagacaggaatatcatcagcacatgagttttgaaaaatagatgaataaataaaacaartaatgctcagaagagtaatacgttttatgaaggttaaaagaggatagagtgcaaaaaggaaaataatccaataatatactacagaaaaaaactgtctgca

SEQ ID NO: 29124 - DNA, 201 bp, Bos taurus
atcatatagtaaatgcttacaaaaatatgtttttgggtgaatggttttgtaaatatagaagaaatttctgataaaatttctgattctaaggcttgaaggayataatatttgtgaagttactgctatcatagcaggggttcaataaatggtagcttgcttctccccaggagccctctgaattattttcccaactctgctctg

SEQ ID NO: 29125 - DNA, 201 bp, Bos taurus
accaaatcaaaaggggatactattgatgagatttgggggtgtgattgttatctatggagtggtttataaactgatacatttttaaaaggatcacatcaacktgcagtgaaaaggaaatagacaatataaattaatattatttttgacccatgcacttctataagcaaacaaaataatgaaaaaaaaaaaaaagaaaaaaca

SEQ ID NO: 29126 - DNA, 201 bp, Bos taurus
aagtgaaagtcagtatgtgaaatattcatgactgaatatctttcaacatcactcctaaattgatgaagtaataaatatgaatccacacctatagctaaagraatgaaacataaatgtttgggccaatgataacaactactgtcacacatgaattttaaaagcagcataatcagcatcagttgacttaggcatttggttaat

SEQ ID NO: 29127 - DNA, 201 bp, Bos taurus
agaagaaaggttataataaagagtaattcatgtataaatgtaaatgaccattcacattcagataaaatcaaattgattgatttccttggaacaggtaatamattgaaaagaaatagtacaatttgagagttagggatatgtcaggccattgttcactatttgcactaatttaaaattttaaattttactccaaaagttttg

SEQ ID NO: 29128 - DNA, 201 bp, Bos taurus
cctggcgtgccacagtccatggagtcgcaaacagtcggacacgactgaccgactgaactgaactgaactgaatttaacagaagcatgtttttaaaagttaytgaaaactgtattatctggccaaagcagttcttcggccctggggtaataaataagttatgacttcctagtgtctcactgaactaccaaagtgtaatcgtg

SEQ ID NO: 29129 - DNA, 201 bp, Bos taurus
caccagagcagtgaactagaacagcagacgtgggaacagaatacagacgtcttccatttgaagtccttaccacgtggatgctttacttgctgtatagccckttgttacttttgattcacatgccagtgttctctgccttgtcacctgccgcatgtgcatgacctgttctaaggacatcagtgggctccttgtgccctaggg

SEQ ID NO: 29130 - DNA, 201 bp, Bos taurus
tttcttattgatttgtactatggaggttgtttagacacatttatgttttgggtttgtttaagtttttgcttttaagtttcattatgtggccagccacttaytcaaaataaccatatatcttatatctgaatatcatcatttcattgttgttgtcagtcactcacttgtgttcaactctgcaaccccatggcctgcagcaca

SEQ ID NO: 29131 - DNA, 201 bp, Bos taurus
atattatgttaattaacatcataaaatatagagcttgcaaaatatcactgcttcaatattactttttcttcctggagaccttctaacttaaaaaaattctrgtatttatatctcattgatttacctgatttagtctgtcaaaggtatgtgaaatagctggtctcacttttgcccacagaaaactgtgtagcatccataaat

SEQ ID NO: 29132 - DNA, 201 bp, Bos taurus
cattacctccaccgtagtttggtctcaggtcaaacaacagggagggaacacagccctgaccaaaaccagaaaatttaattgaatttaagatttactgaacmtggccctgtccatcagaacaggaaccagtttacgcctcagtcagtctctccaatcaggaagctttcgtaagcctcttatcacctccagcagaaggcagac

SEQ ID NO: 29133 - DNA, 201 bp, Bos taurus
tgaaattgaacctgaagaagatcatcaaattcttgtgtgagaggaataagagcaattgatcctgagaatgaacacccagaaaaaaaggagaatcaaagtaraagatgcttcaggaactaaaaattaagaggcatcaaataatatgagaatacaaagtcactgagtttagccctgtatacttgaactcagccttaaaataca

SEQ ID NO: 29134 - DNA, 201 bp, Bos taurus
caagacataagtcattataaagtcatgcgtgctagaaattaactcatttattcattcatgagtctatttagttatctacaattttaggttgagattttaaytgagattgttaaagacccacatgaagattataaagagtaatacagagacatcccatgtacaccctacctaatattctccaatgataccatttaaaaaaaa

SEQ ID NO: 29135 - DNA, 201 bp, Bos taurus
ttaataatttaacagatacaaagagtttaattttggtcttagtacattaccagaactcagcaattctgattttaaatggtgctacatgtatacatcccgtrcacacatttattaacacatacaaaaagtcactccagcctggaatgcttttctaataaagaagtaacacacaatatagtatgtataagaaaaccaggcttg

SEQ ID NO: 29136 - DNA, 201 bp, Bos taurus
ctcatctccaagccttaatgtaatgcttagagcccacaatctggtccttcctctctttctggtacatttctgaatgtctgcctagccaaactcatccaaargtcgtatttcaatctctttcccttgctgtgtttaatttacttggtgagaaaaagcatagagtaagtaacaaatttgttaaaatcaactgtgaaaaactca

SEQ ID NO: 29137 - DNA, 201 bp, Bos taurus
tttgctttcaaggaccatggactcaaggctgtgtatatgccagacttcagtgaacattcagggcagtcaaagaatttcacagaagtttggcaaagcaacartctaatgctaaatatttaagaatgtgttcttaaaagtacctcaaacatttcttcctccaaaaagttctccctgatcgtcactttaactcaagtcacaact

SEQ ID NO: 29138 - DNA, 201 bp, Bos taurus
ataccttgcttcccacaaaatattggagagagtctaaacagtttgattcagaagcaggaggaataagtagttattttgtttcctgaggttctaaaattaayagcttctatgttgatttttatccaggaaagagcacttgcaggcataagttcatttgatagtgtttgttcagctactggggctacaaaggaaaagggactg

SEQ ID NO: 29139 - DNA, 201 bp, Bos taurus
ctggggcctcagcattgctctttatttctagcagactggacttttgacagtaacagtaactgggccagccgtggtaaacaaaggtctattctgtcaggccyatgcctattttcttgccattgctatagtgaacactcctgtctggtgcctactgtattggcactggggtggccagtggtagatgtcatcctacctggtagg

SEQ ID NO: 29140 - DNA, 201 bp, Bos taurus
attcaggtttatctcatcaactcatttgggtataacaatacatagcaaattagcaatacagtatggaattagctattcaatactgaccatgattgaatacmatcttggagaacacagaaatattgaatgttttgtgctgtttacattgaaagtatagtcaagtaagccctgctgctggataagatgtctggttaatgagaa

SEQ ID NO: 29141 - DNA, 201 bp, Bos taurus
gactttaggaagggatttttcccacagtgttttactaaaatttatttcaacttttattactatagttaatataaagagcaatttggtgatgtcttccaccycaggaaaattatctccttgatttacatgatgaatgcaggggttgaagtatcattaaccataaggagaataatttttgaaatcctggtttgtaagtagtta

SEQ ID NO: 29142 - DNA, 201 bp, Bos taurus
atgtacgccagattaataaaaatactcaatgtttggtgtccctgatatttcatatctttgcagctcctgaactaaggccagtatgttttctttgaggtttkaaattcattccctgcaccccaaccccccaaattttaaagtgatgtgccttgactgtgattcataaattgacagaaatggccttcatcaagtagattgctt

SEQ ID NO: 29143 - DNA, 201 bp, Bos taurus
gaaatatttctaaataagaccagattacactgaagatgaagtttctactattttcaaatatatatattttacctcaagcagtaagtgtgttaatagatatkaaaaggaaagatggatgggcattagactgtggaagtcaattaataaagaaaacaatactttataaaatcaaatagaagttatcaactaaattctcatttt

SEQ ID NO: 29144 - DNA, 201 bp, Bos taurus
taaatgcttagacaagtaaaataagaatgattattcaaaataataagtgaaagagaaaatctaggaaagctagctgataatgccaaataatatttattgtyaaattttattttcaatgattaattatctctaagaatgtagaactggaagttcatcaaaaaagtactccatcagcatgccaacaattatttatccaataaa

SEQ ID NO: 29145 - DNA, 201 bp, Bos taurus
cactcatttaaataaaaaacactttagagaggacattcaatgtgctttatagtaattaggctataaaacataaaaaaacactctaagggcttaaagtccartgatatgtagaaatataaacaggtcatttaatgaaatatagaaaatgttaacaccaaggtacttacaaagaactttgaaagcattaagggctacttgatt

SEQ ID NO: 29146 - DNA, 201 bp, Bos taurus
gcaaattattgtccagatttctgatttctaattgccaattctcagtcagtatggcccatataaaggaggaacagaagcagagagaatcttcctcagtcaaygataattttaagttgtttttgtaatggagtttccctgtaggtagctgaacatgaaaatatacaattcactacttaagctttgggtgaaggcatattttta

SEQ ID NO: 29147 - DNA, 201 bp, Bos taurus
caatggcgttttctagaaactggcatgtcaaaggtagctcatggcctgaggacacagaacaaagagctctgcttcatttgggcccaatagagttcacctgkctgctgaggaaatcaatgtctttactcacctttaacacactcactaccattatcaatttttcttgggccaagaatctctcttctacaaactatttatgta

SEQ ID NO: 29148 - DNA, 201 bp, Bos taurus
gatccaagatcatggattgaagagagaagcaaaggagccaggtactggatttcccatgaagatattttgctgattcctggacttggaaggacatgaggaamaaagccaagtaaaaagtaacaacaacagcaaaaaaaggtaaagcagaattttcagcagtcatttgttgctaaggaaacaaaaactggaattcaggaccct

SEQ ID NO: 29149 - DNA, 201 bp, Bos taurus
aataagtcactgatgactctacctgcaagattttgttatactcagagaagcaaattaacttaagttatatactgtgcaaagccagtgatttttgtaacatygagattggtatttaatattaactttatacctcagttatttgggtgtactattctcagaagacaatttgtatcaggtgtttcttcttattttaatgcacac

SEQ ID NO: 29150 - DNA, 201 bp, Bos taurus
cttcatagtctcaaagtgaattttattttgaatgaaaatgctcaaaatgaaaacttctctgagtttagtatatattagaatttctggattcagttcaatcmtagtcaaccgctttcagtagcaaatagagaagaaagcaacttgtttgctctttcttgttgagtgagaatgttgtcattcaatggaaaaaatgcaaaagcc

SEQ ID NO: 29151 - DNA, 201 bp, Bos taurus
tactcagatatctagattatattttattgtgatatctgattgtaacatatttgctgatttatgaatatttttgaattatgcagtgtcctggttttttttgktcacatcatgtacttattatgtttattagcttctttgttaataaacctattttccttcttcacttagactctcatctgagtgaattgcactttcaatatt

SEQ ID NO: 29152 - DNA, 201 bp, Bos taurus
catggactgcagcctacaaggctactccatccatgggattttccaggcaagagtactggagtggggtgccattgccttctccataaaatgtcataaacagkattaaaataaaaatagcatataatatgcaaaaacatgacactgaaagttaataaaattaatcattaaaaacatggatatcaataaagaaatgcaaacaat

SEQ ID NO: 29153 - DNA, 201 bp, Bos taurus
aacaagaaacagattgcataatttctaaagtttcattcaggtttattatttctctgactggataaagacatctttcagaagggttctataaaataaacatrcttttcacatatcgttatttaacataaatgtgcttgcttcattgctgtttataacaatacttataaattttaaaaagtggtaattttgagggttacagat

SEQ ID NO: 29154 - DNA, 201 bp, Bos taurus
cacagggatcgaactcgtgtctcttaagtctcctgcattagcagtagggttctttaccagtagcgctgcctgggaagccccaaccaatatgtagcacttayacatagcatttataaagtggttaaacttggacagttatacaacacttaaggtgaatggtgtcttttttttttttttttctgtattctcggagataatttt

SEQ ID NO: 29155 - DNA, 201 bp, Bos taurus
tgtttaggatcaccatgtgtctataacagttccactaaccttcatgttgtgttctttctaaatgatactcctggatttgtaaaatgtggtggccttgatcyacattaactacagaaacttaaattcagactgaaattactgggttcctaattcatgcttaaggttgtttatctctctaccagccctgactaaaatctattc

SEQ ID NO: 29156 - DNA, 201 bp, Bos taurus
tcaattattttatcatcacttcatacattatacactaagatctaccgatacacatttgctcccatccaatataattatttcttagcttttaagcagaagcrtaccttccttgtgtattgaaaattgaagaaaatatgtcatcttcaacatttagaaaaatttctcaacctgtaaaatgcatctttacatttaagtattcgt

SEQ ID NO: 29157 - DNA, 201 bp, Bos taurus
catgaatatgcttgtatctgtcttgtataaagttatctaagtttgtgtaataatgggaaaactcaaagtacagtattgacctcatgtttattttagtctaytactatacaagagtgagatatttagtaaagagaagcctagtaatatgtttgcagtctcatctaaattctaactttaaacaatttttaacatttacatcat

SEQ ID NO: 29158 - DNA, 201 bp, Bos taurus
aaaaagccctccctgtgttactctggttctagtgtccagtctcaccattctgccacttgaaataagagaaggtttcatccttttccaggccaaggctgatrtcagttcagttcagctcagtcactcagacatgtccaactctttgtgatcccatgaactgcagcacgccaggcctccctatccatcaacgattcccagaat

SEQ ID NO: 29159 - DNA, 201 bp, Bos taurus
tatccacattgaaattctcagaacctatgaatgaggctttatttggagaaaacaaaaattttttggtagatgcatttaagttaagatctcaggatgagatyatcctggcctatccactaaacccaagtatccttgtaagagacatacaaagaaagatatacacaaaggagaaggtcatgtcaagaagaaggtcaatttgga

SEQ ID NO: 29160 - DNA, 201 bp, Bos taurus
cttatatcattattccttgtttcccggggtccatataatttggtaacatctttggcaatatcttctcagctgaaatggatgctggtcaaaaaatatcttcyaggctaaaaaaagcaggtaggtgggaaagattaaaatgacatctctctttcagcataggcagcctcatttaaaggattcctttaaatagttttatttaat

SEQ ID NO: 29161 - DNA, 201 bp, Bos taurus
aacactaccattaaaatcaactgtgtcatcatgtttagaatggcttaaagtgcctttgccaatttcttacagtcatttatataccagaagtaactgatacrcatcttataaggccaatgaacagagatacttattgatcagttatatgatataaaattacatttgaaatgtatttcaaaaagtacttcttaaggattttat

SEQ ID NO: 29162 - DNA, 201 bp, Bos taurus
tattaataaaatatacatttccttatatttcaattgaatatgtctactctaaagaatttgtccattagacaacatgaatgcctgtgatcaaatacttaccrtgtatgttctagaaacattgaattgctctgattgtgcttatcatctcacatggatcttgggtcatgtttcgtgttttttgatttggtcttttctaaaatt

SEQ ID NO: 29163 - DNA, 201 bp, Bos taurus
atgtccctcccctaaagatttcaaagccaaagtagagaacccacttgtatgagcctatgacacaggccacctcactgattttagggatcagtcaaaaggayttgatgtcccacccagttctctataaaataagcaaagtgagcctcctactcattttctgatgcctttcaaatgtattagagctcacagcttgcactaccc

SEQ ID NO: 29164 - DNA, 201 bp, Bos taurus
actccatccctaggtagctgcacaaagcaatgaaagtttataggacaaacttgatcaaagtgatttaaatcttcctggaaagcatttccaaggactatccyatggaagtcaggcctgaggtcatgattcccaacaactcagataaaagaagaggatattcttataatttcaagtttacattgatctttgtacagtctgaat

SEQ ID NO: 29165 - DNA, 201 bp, Bos taurus
gagctataattacaattcaccattcaaataaagaaatttagctcctttgataaacaccttattaatatcaatactgaatttctcactggctttattttcaytgttgtcaaaactgacaaatgcaatagtacatgcattcaagaatttagcaaatgtgcagtcagaattttgtctcagagttaagttttatgagtcattttg

SEQ ID NO: 29166 - DNA, 201 bp, Bos taurus
tgtttagagtcaatgaaaatggctttaagcataactagatgtatgtgtatttaatacatatatgcatgaacatttttctttttggccataccatggggcaygggggattttagttccccaaccagggactgaacctaagccccctgcatgggaagcacggaggcttaccacggggccagcagggaagccactgtacacaca

SEQ ID NO: 29167 - DNA, 201 bp, Bos taurus
gaagtctgggctgtgtagtttcaggtggaggccagcacagatttatagactcatctctcccatgacctttgattggagtgtgtgacacctgcagtctcgtrggggccccacactcagaaggaccatgtgcttgtttcagggctgtactttgtttttcttttaagtacatatatttttgatgtgggccaaattttttttctt

SEQ ID NO: 29168 - DNA, 201 bp, Bos taurus
tggccaccaagttaccctggaatccggtcttcccataataaactgggtgtttcgtgtgtgaccaagtttatgatgggaagctcaggttacatggtaacttratggcctagagcaagttgtttctcaaaaggagaaaagattcaagttagtgagcatagtaacagtccatcatcaaacagaatttgtatgtattgagattgg

SEQ ID NO: 29169 - DNA, 201 bp, Bos taurus
gttatgtttaaagttttctgcattgttttctttttgctgtttaaaaggagagcagacacttctgataaagtttgtgtcattagtctgcataattttcattytgtttgtttttgctaataatcatgattctgggatggttttcttatcacaaccagttagtgctgttatatatttcgcctgaggcttacgcggtgttctaca

SEQ ID NO: 29170 - DNA, 201 bp, Bos taurus
ggacgaggtttcattcattcattgttttgggaacacttgttattttgtcttacataggctgggatacccatacattctaaatggatttctttattcaatcrtttattcacttattaaatcaacaaatatttattaaagtagactagggtccagcctgggcttcctgggtggctcagtgagtaaagaatctacctgtgatac

SEQ ID NO: 29171 - DNA, 201 bp, Bos taurus
ttttttctgatttatgtttctagttaaatcttgaaataaaaaagaaaaacaaatcacccatcaggtctgatatttttgtgaaaaaatgagagaatagaagyattgatgttttcaatatctgcatatacaagagatccaagatagggaaaattcctgagatttagatcagcatagattaggtactgtgctgccctctaacag

SEQ ID NO: 29172 - DNA, 201 bp, Bos taurus
aaagaagcagatgcagaggacattattggagaactatctatgttgagaagcaaggatgactcaggtttttggcttgagcaatggggtagactttagtgttkttttttttttttttaaaacaggtctaggaagagacagacacacttgtacatagtgaagcagaaggagaatgggagggaagactactattttggccatttg

SEQ ID NO: 29173 - DNA, 201 bp, Bos taurus
acaggttttgatgctattaggatatagcttgataggatggtgttccatagggtgcaaagtgatcaatcatctagcagctaagatcactgggtcccatcaastgatcagaccctcaagggaatggattgcttgtgtctaagaattcaaagtttatatcatacaaataataaaagagcacagatatcaaacacagtaacatgc

SEQ ID NO: 29174 - DNA, 201 bp, Bos taurus
tcacaaactaaaaccagctgtgcataatgtacaaaacatgtcatgaccaagttaggtctatctcaggcatacagtgctggcttacactgaaaaatcaatcsatacaatttgccacattaacattttaaagagaatattgcatcactagctttaatatagaaaaacatctattagaattcaacatccctttatgatttaaaa

SEQ ID NO: 29175 - DNA, 201 bp, Bos taurus
caattcaagtttcacagcaaaattgagcagaaagtacaaagatatccccttcctatacccctagccctagccccacacatgcactttttaatcacttctaytgcacaaagggaagtgaatgcagaactagaagccaaatgttctacttctaaattctgtgttctttctactttatagcaaatagtcctctctaaacacagt

SEQ ID NO: 29176 - DNA, 201 bp, Bos taurus
ttcagtccatgaatttctggctaaacaggtcactgctaatccatggttcttcctatccaaaaagtttcttcagacatgcaacctctcatatttttttttcrggtatgtaggattattatactgttcctcatcacacacatcacaaagacttacagcataagaagctgcctaggacctcttgttacttccttgcttctccta

SEQ ID NO: 29177 - DNA, 201 bp, Bos taurus
taagtatcttttctcacttattttttcagatctgcctgcctattaactctttagtattcgctttatagaggcagaccccccaatgtgggagggcctgtggytgaaatagtaactgtgactgaccggattgctaacccttcctaatacagaagttaagccttatcaaggccacttacccagcgagatgtaagtttcattgac

SEQ ID NO: 29178 - DNA, 201 bp, Bos taurus
ctttttcctccttggataggggagtgggctctaatcatagtggctggtttttctgaggcacagcccccatcctgaagcaatctattccccccaaccaggarttatctcattaacatacaaaaggcagcaaatttctgtggcagaaaccaaaggaaaaggctaaatatttatttaatctttcactgtatcatttagattaaa

SEQ ID NO: 29179 - DNA, 201 bp, Bos taurus
tcgcctgggccacgccagccattctgcggcagtgtttgattgctaagttttagctaaaaggatagataaggaggagtatggggcaaattgttcagccagartttggcctgaggaaagacttcaaaacttgcccctgcaacgctttatacagttttaagctctatcggaagctttgcataaagcgaaatctggggcccattc

SEQ ID NO: 29180 - DNA, 201 bp, Bos taurus
aatcaaatagttctgggtccaaaacataattttttcttttactatttgtgaggctgtgtacagaatgtaatatctccaagagtcttctcatccattacagraggttgctgatgttatgagggttaaaagaaaacagtgtctgaaaaagtgacagcattaaaatctatgatgactattagcttatagggattacttcatgta

SEQ ID NO: 29181 - DNA, 201 bp, Bos taurus
gcaagggcagaggccttcacttcaacaatctatagaaaacaatgctgtcaacaatcgctgagagagcttggaggaggattctcttcccagctaagccttcrgatgagacctcagacttttgggccaatagcttgaatgcaaacctgaatcagaggatccccataagccatgctcatattcctgacacaaagaacttgtgaa

SEQ ID NO: 29182 - DNA, 201 bp, Bos taurus
ttattgaccatcctgctggcaattggcttgtcctaggtcttcctcttagcatatttccctcaccagggcttgactggcctaataactggtgctgtcttggkttgatgccccctgtgtgcccatagcatggaagctaagctcctacgggtgccctcactggctgccagccatgtctgttgactctctttacactgggcctgg

SEQ ID NO: 29183 - DNA, 201 bp, Bos taurus
attgacagttttggtcagagtaccttggacaaacactttccggaaatattttagatggccctgatctccttcctgtattgaaactgatattgagtacttcktatatactaatctctttaaattacttatgtggattaattttggaatgctcctaaatccccatgaaataagtaaacattttcatcacctttttgctgacgg

SEQ ID NO: 29184 - DNA, 201 bp, Bos taurus
gtggaatgtcagttccccaacaagggattgaacccatgctcctgcagtgggagcatggggtcttaatggctggacggccagggaagtcccattccaccttyttcatgccagtattgtcagttctttcctgtctttgcctgcccagtaggcacctggagcaaaactccaactctgcacttatccctgttcaacggcttcagg

SEQ ID NO: 29185 - DNA, 201 bp, Bos taurus
ctttaaaacaagctttttctatttgcttaaaaagtctgtgattattttcaggacagtgtctgagataataaactattaagtgctatggcaagatattgaartgattcatcattacaaattcgatgcatctttttaaagacaatattaatcttactgtgcagtaaaaatataacttattttaaaacatatctattatatatt

SEQ ID NO: 29186 - DNA, 201 bp, Bos taurus
gctgaactaagtgtctcatctccataaactcagaggcacaaggtttacagaaactgcaacttcaacattctttgacagtaaatatgactataaatcaaggsgtacatttattttcttccagggttctggttttatgccatctgctcacgtggcatcttgcccatttggaacaatgtcagattgtgtaggatagaggtgttg

SEQ ID NO: 29187 - DNA, 201 bp, Bos taurus
acaacttcgaacaaatttgacaaagtgattatcaggcttctgttttaagtttaaaacagaatagtccaaatagaggccagaattaaaggaagaggattttmtttcatctcaccaaacttccctccttatttacagaagattcccgttctattgtcattaaaacaaaagggaaagaattaaaaaagggaagtgttggtgaaa

SEQ ID NO: 29188 - DNA, 201 bp, Bos taurus
aatttcaggctgtgtgtagcccagccaggcccagaaatttgagttatttgagcatgatactaacatctaccacaaagacagaatagtgtaaggcatacccyaggcccttaaacatcatccttttgttatttggttgagtaacaatgaagagagtttaaggtgtgagtgaaatgctatccactgtttccgtgataggatttc

SEQ ID NO: 29189 - DNA, 201 bp, Bos taurus
ctatctcttaaaaaagaaaaagaaaaagaaaaaagcagatacaaaagcaaaattcctggtcctaatcacaatgatgtatagtaagccctgtctctgaattygtggtcttatatctggagcacagtcctctggtcactgagaagtatgggatgtcaatactttctctttgtacttctatacaatgcataaggataagtgtta

SEQ ID NO: 29190 - DNA, 201 bp, Bos taurus
ttcatagtaatttaaaatgaacattaagttctatacaatgagaaattgcccaagaagaaaaaatattgtattaacacaaaaggaaaagatcctatctcctrtatttctacacatatatttagggcacacacacatccctgaaagcataaagtttatgttgcaactgtaatctctggtgtattatgtaatgcctccaatctt

SEQ ID NO: 29191 - DNA, 201 bp, Bos taurus
gcatctctccagtctccacctctcatcagaaccatgtccagcttgcagatacgtgaacacatgtttcccttcctccccagtactttctggatgtgttccaktccctctggattccaagtctgccttcactttagacactcttctgagttctgagtctcatagttttgagtctgctgtgtccaccctaaaggatttagttcc

SEQ ID NO: 29192 - DNA, 201 bp, Bos taurus
cagcaaacaggtagttcagaaagcacacaaaaattttgcgaagaggaccacagaaaaaaacttgtgaggggttgtatcaagagacaaaactcactgcagargaggtaaaaatgagagaataagataacaggaaaatatggaaacttggatggagaccaaggatatcaggctgtgaatttcacaagtgtccacaggtttgcc

SEQ ID NO: 29193 - DNA, 201 bp, Bos taurus
cattatgttaatttaaagaaaaagtatcattaatatatctatttcagaaacaaattgtggattttcctccttttgtctccccatgcagattattaattctrtataatagaaatataagtgtacacagaattttttacaacacattttacaagcagattttcacatcccaaaagaaaatatgactttaaatttaattcttac

SEQ ID NO: 29194 - DNA, 201 bp, Bos taurus
tccaaccctattctagttaaggttacctccctttcctttattttgcattattaaataagcttctctattgtaatcctcatcacattgcattctaattgctygtctatatctttctgcagttggtagctattgtatgaggtttgttgagtgtgaaacaaatgcacagagtagaagataatctgagaagctgacatgaggcca

SEQ ID NO: 29195 - DNA, 201 bp, Bos taurus
ggctttcctggaaatataataactggagtttagcaggaaatacttgggcaggatgctgctgtttctgctataggcactgtcactaggagacaagagaggamtccttggcttccacagtgtaagaagaggtatcctgttgcatcgacaccgcatgtggtgggggtgcctcaaacgaggagggaagtagggcgctggcaggca

SEQ ID NO: 29196 - DNA, 201 bp, Bos taurus
aaatagaccaaagtagtattttagatatattcactttggatagaaagatggtcaaatgatgtatttcctttatcctcgtttaagcaatgcatggatctgtrtctttgaaagaaagggttggagtgaagtagattgactacctttgatttctgttggactgtggagaaggtgaattgaatcaaatggatgtataactttcct

SEQ ID NO: 29197 - DNA, 201 bp, Bos taurus
agagacagaaaattaaaagataggcttgggagatgtctaaatttaggactccctgttactgcttcagatccttactctatgtactttttaaccttcattcrggacctatctagatgttgcccatagacagtaatataaaatagggtcctggcaagaaggaagaaaagatacaagcaattcactcaatcttgcttttctctt

SEQ ID NO: 29198 - DNA, 201 bp, Bos taurus
ttacattaaatttttgtccttaaaacaaaagaattaaaggagaatttaattgcaagaatatgaatcaccaaaaacttagtttaattatctcagatggctamaaagtgttatcctaaatcagtgaaaatagatgtattttctgaacccctataagtactatggggtcaaattatgcaggagggacatgatgtcatactagtg

SEQ ID NO: 29199 - DNA, 201 bp, Bos taurus
tgcaactgtaattattttgaagactttgttaaatgtcaggccaggtaaaaatatgattataatagtccccccttatccacagagggtatgttccagcaccyctagtaaatgcctggaaacataaggattcctatgcatatttttattatacatacattaccatgatataatttaatttgtaaattagacacaataagagat

SEQ ID NO: 29200 - DNA, 201 bp, Bos taurus
tgatggacagggaggcctggcgtgctgtggttcatgggatcgcaaagagttggacacgactgagtgactgaactgaactgaaggttatacagcaagaagcrgcaaaactgaaacctcaaccagggccttctggcccaagaattcacgttctcacctaatacacagtgctgttctcttggtacactaccaccaccctgcaaa

SEQ ID NO: 29201 - DNA, 201 bp, Bos taurus
aagtgccactcccctgagatccccgtgttatgagaagcctgggctatggtggggagaccctggaagatgaggctgcatgtggagagagaggccatggaacyctgagatggcagacatagagtgaagaatctaacttggaagtagatcttgcagccccaaagaccagaagaggccatgtgggttggtgatgaattacccagt

SEQ ID NO: 29202 - DNA, 201 bp, Bos taurus
ccttcctcatgttctgtacacttagatataatgggatattgctgttacctacccaagtctttcagagaaggcaaatgaatcttccatttggaactgggtcycatctagcagtttgattatatttgaaagagaggactaatcttaaaatgttagttcatttgtaagtcaagctgtgtgtgtgtgtgtgctcagtcatgtccg

SEQ ID NO: 29203 - DNA, 201 bp, Bos taurus
ggctcatactaccacctgagctccacctcctgacaggaggggcataataaatataatgcacttgaatcatcctaaaaccatcctccctgcctccccactcmcaccagtccatggaaatattgtcttccatgaaaccggtccctgcagccaaaaagtttggagaccacagtcttagagaacccagtggaggaaatcagtaaa

SEQ ID NO: 29204 - DNA, 201 bp, Bos taurus
gatgaaataaaaattcacattttaaggcaagaaagaaaaatttaagcataaaatatttttctccctatttgggcctcctccctccctgccagtgtgcatcrtgaatctgcactaagcattaaccagacctccccaatggcagaaatacctgctcaaccataaagatcattttttcttcttctggcgccagccctgtaactc

SEQ ID NO: 29205 - DNA, 201 bp, Bos taurus
atatttaagttttgtggatctgtgacttttacatcaattagaccactcaggttaaccacataataaatttagctaaaaaatgccattcttgataaattatrgtttctttccatccattaaaatcaaagtattttatgatataccacaaaagtgaatcaaattttgtttcaataattaaacttctccagaattgacatggac

SEQ ID NO: 29206 - DNA, 201 bp, Bos taurus
cactcctttaaataaatactcctttaaatagaaatctccttcataaaatagaggaactctagctgtgagactaaaaaaatatcatagagacttcctgaaamaaatatgaatctctaacaaaatttatatgggagtctatttttttctaaattcttcctttgaacatatggaaatgggataatttataaaagcctgacctca

SEQ ID NO: 29207 - DNA, 201 bp, Bos taurus
gggttgcaatttccttctctacctgtattatatttttctaaagattacctaatacctgtgtttctcaaagtatgtcatgttacatagaaagcaatgttgargacttccatggtggtacaatggataagaattcacctactaatgcagggagcacaggtttgatctctggtctgggaagattccatatgtcacagggcaact

SEQ ID NO: 29208 - DNA, 201 bp, Bos taurus
atatagacacgcacagagagaagactatgcgaatacagaagcaaagatcctagtgaggcagctataagccaaggaatgccaatggccacaagaaactagargaagtgaggaaggattctcccctggagcctttagagggagtgtgaccctctcaacaccttggttcaagacctctgtctggcctctataactgtgatggaa

SEQ ID NO: 29209 - DNA, 201 bp, Bos taurus
cataacagatttcaattttatcttttgattttcttcctcttgtggtacttctatatttttcaatcatactatctcttatattggcttcatctttttttgtstcttttcagtttcacatattcttactttgtcttcatatgcttttgctaaaatttttgccagtgtctattcctcatctgcattcttgagtctctcagtaat

SEQ ID NO: 29210 - DNA, 201 bp, Bos taurus
gagtaaacaaataccttgggtcttcaaagagaggaaaagaggccaggttgaaagagaaggaatggggagagaaaagaggtctaagagcaggggagagaaaragaaaaaagaatggccttacacatgtctcctgccacctgcagatacccagatgttacaggacttttccctggcttccagaggaggactagaacttggccc

SEQ ID NO: 29211 - DNA, 201 bp, Bos taurus
gaaaccaactggatctaaagctatgctgtttttccttaaaggtgcttttgagtttcataaaaatgtctcaggtttgagaatttcctgtgtcaacattttaygaaatgtttagaaaatgatgatttcagcaacagtccccaaagaaccaaagcaacaatattaggaagggattgaatttgacatgtttgtctttaatcctaa

SEQ ID NO: 29212 - DNA, 201 bp, Bos taurus
taaattgttaaatacagagttcttgcaaatgttccaaccaacgttgtgttcaataagtgttagatattattttatgataaaacaacatattttagattaaygtatttgcttgccagtgtccaaaatacaagaattgtttgtgatattgaatgtaatactgacaacaagtatttatcctctctgctttatttttaattttac

SEQ ID NO: 29213 - DNA, 201 bp, Bos taurus
ttaccttctccaggggatctttctgacccagggatccaacctgggtctgccgcattgcatgcagattctttactgtctgaaccactaagggatatcacatyttttaatgcagaaacatccctgtcattttgatggtttgttcttttattatcaaagatttagattgtatccttagctcatgttagtataagaagaactgat

SEQ ID NO: 29214 - DNA, 201 bp, Bos taurus
aacatgtactctctcctctaaaattttagtgtcacaaaggactgtatattatgttttgtgaaatgagtgtttcacttccatgcacatatatgccaataaaycatactttaacatggttgtaattcttattagcatataaaaatttaccagcagtatgtatgcagagatgcccataagtacacagtagattacatgaccaaa

SEQ ID NO: 29215 - DNA, 201 bp, Bos taurus
gttatagcaaaactccaaatgtcttttatagtgcattttctcatttttgcttccattttgacttagaagtatacttggtgtactttaatgattgagttctrgctgagagatttagttctctaattttgaggtaggagatagatgggcccctgggctgaacacctggtatatgtccagtgtagtaaaattcaagccttgttg

SEQ ID NO: 29216 - DNA, 201 bp, Bos taurus
gcctgcgtatacttacctgagtagaaaaagatctttcacctattttatttaggctttcatttctcaaattttaactaggagctaagtgtaatttgaaactrggatgcactagttttgctccaaagaagtataattattcaaattatctgcattaaaagtgtaaaccttttaaagcaaagcgttacttaatttaaaagagag

SEQ ID NO: 29217 - DNA, 201 bp, Bos taurus
gctgtttaaaattgaacatatttgtctgtatcatgtagaatgctcaccacctcttcttgacaaaataaagcattaatcatggcagcaaccataacattccygtctcttttattgccaaaaccagcaccctgtgacacagtgagaactggaattttctaaccttcagttcagtggattggaaagttttcattagaagtaggt

SEQ ID NO: 29218 - DNA, 201 bp, Bos taurus
tatttttggaaccaagtagttaacgcctcactatcatttgcttcaaaaaaaaatgataatagattgatttatgccacacattaatatcaggagtgccacamaaatttgcacaaagttctcatttataaaactggagttctttgtactgctttacattaaaaactattcttaggagtcctccaaactatatgaaaagaaaaa

SEQ ID NO: 29219 - DNA, 201 bp, Bos taurus
gataataacacttaatgtctccaaaatatttcttcgagtagatattttaaatcttattccccacttctctttggttgaccatttatattgtttgtaacaayactgtaatgaaagcttcaggtctagggatgttttggaatacaaataatgaaagaaaggtcacaaataacaaatctaaacaaatccaaataacaaatctac

SEQ ID NO: 29220 - DNA, 201 bp, Bos taurus
ttctaattcaaaaccatttgtggactgttgtatttatttctggtcctgagtaacttctaggattttcaaaatcagcaacttattccactagatgttactarttgtactagtattgtatagtaacaagtaagagacattgttaagtttggccaaatattaaaaaaatgaagaaaaattatatattcctcttagctattacac

SEQ ID NO: 29221 - DNA, 201 bp, Bos taurus
tttctgcaggatgttaataaatccttcacgaagagtggataaaaggaccaagcctccctgtgacttattcccagtttctctgaatttcctagctttatgcwcaaatgactgcaaaggtttacatttcttaaggcaaacttctagctacaaccagttttttttttttctaaatactgaaataatcagcacagcagggaaata

SEQ ID NO: 29222 - DNA, 201 bp, Bos taurus
atatgtaaatgaatgggtgtggctgtgttccaataacactttatttacaaaaacaggtggcagggccaaatttggcctatgggttatagtttgcctagtcytgccctacagcaactaaccatggaaagaacattcatcacctcaaactatgaaagccagcggccatgagaagaaactaaagattcctttccaagcaggatc

SEQ ID NO: 29223 - DNA, 201 bp, Bos taurus
tggacaaatttgcctcttttacctatagaattatttattttatgctgttatttgttggtttactaaacataaagaagattttgcttgtttaagagtattargtataatctagtataatacatttaaggataggaatatccagatttatttctaaagttttctaaactaactttaacactcactttaacatataagtcatta

SEQ ID NO: 29224 - DNA, 201 bp, Bos taurus
aaataaaacttatgagctaggcctggaggctactttgagtaatcacctttttcctaactcagagtgattttttttaatttttattttattttcctcctgcyctctctctcaacactggccatcctccatttttttgagtatctttgattttgctacatagagcaaggattctgatacttagctgcatactatatgggagct

SEQ ID NO: 29225 - DNA, 201 bp, Bos taurus
cagatgatagaagctgccattttgtttatttcatgataccaaggaaattttttttaaagttcttattagagtatatgggtaggccacaatagttggcatamttttaatattacgtacatgattagggtagacacacaacacccttcccttggctaccttctggctagctaggtttggccttgtgacacagttctcattagt

SEQ ID NO: 29226 - DNA, 201 bp, Bos taurus
cacaagtgtgggcatttttgcctaataaggggtcaggaagctggctggtaagtatcagggggcctcttggcaatggctccaaaggggcttagcttcagagrtgaccttggttctgggctttgtatcagtgggcttggtgcaaggcctcccacctgtggccttgggatacgaatccacctagacttaggaagctgtccagat

SEQ ID NO: 29227 - DNA, 201 bp, Bos taurus
ggtttcaagcatgaattatgttatctgatgagtcttggttagaagtgaaattgcttccaaaattttttttttttttttgtctttaacactcacccaacttratttgaaaaaattcaaactcaaacaaaagaataatttggagttcactttcaggctaatagttaattagcaattttaataaagaagtggtttattgagtgt

SEQ ID NO: 29228 - DNA, 201 bp, Bos taurus
ctcttctttttaacatcaaatcttaaattattttttaatcttttattatgcttcatatttgaatgataagacacctgtaattttaatttcaggactatttrttggataccaagactaaattcttccattgagtgtttctcaattatgaaggcacagactaagtacttggaaacatggttaaaaatgaagattctcattcca

SEQ ID NO: 29229 - DNA, 201 bp, Bos taurus
atctatttgtataacttccctagctattctgtaagttcctggcatagtcaaagatgtttcaaccaaatgtattgagagtgagaaaaaaaatacgtagagcrggaggcataacttaaattgctttcacaactctcctaatcattttcctaaaaatctatagaggtatcagcttggtatattgaaccacagagaagaactttt

SEQ ID NO: 29230 - DNA, 201 bp, Bos taurus
agccactaaaccaccaccaccacccgccctcactccacatctacccagatcccattagcgggtgtttacctctcctttggtagttgtgaatgctggccacyagcaactcacaggtactctcttctcgagacagtcattttcatgcagaggtgggctacctttccagggagcctccattctgaggcccccatggcccctgtg

SEQ ID NO: 29231 - DNA, 201 bp, Bos taurus
taaataaatgagaggtatttataatctttcagtaaacctcacaactaaaaacaatattcagtaaattaattagatatgcatgatattcaaaaggacagaayagaaagaaaaaataagcctgtgtttgggaatcacagaaaagaatgtttaagttgaactttgacaagtaaatgacttgaacatgttcaagttattagagct

SEQ ID NO: 29232 - DNA, 201 bp, Bos taurus
ccaccaattcttcagaatgctttgctgtgtttagcagaagatgtactttacacagatttgatgtaacactgacagcagaagttcttattccaatactgatrctagtataattttttataaataatgtcttgcctgctgtgcctcaaaattttcatttgacactgcttccttctggaatattcacaatgtgattgagaaatt

SEQ ID NO: 29233 - DNA, 201 bp, Bos taurus
atagtttatctgctgaagttcagcactggacagtagatatgaatttttagcaaaaagaagtgcagttgatcttactgtgtaaggtgcttaaaaaatatggygaaataggaaatactcatctatcaaattatatatatatgaattaaaagaagtaattttcataaatagatttctaattataaagaataatgttaaatataa

SEQ ID NO: 29234 - DNA, 201 bp, Bos taurus
gtgtcatagcaatcagagctatttctaactacttacatgctaaattcaaagtcatataaacatttaaacaattaaatagttttatcctttggatcataagmatttaggataaaagaaaatgtactgttcataaagtagatcatgcctttgaaacaattaaaagtgattaaatatttcactcagttatgaataccataaaac

SEQ ID NO: 29235 - DNA, 201 bp, Bos taurus
ggtgataattgttgggtgtacagcaactctgcaggtagttaacagacttaccgatccttacaaagaattttgcttgaccatgaaataattttacctcccaytttaacaaaatgtgttatttcaataatctaattcagtgtgttttttagaagcaaaaccatggatttactgggatagaaagaaaaagacaaatcaactaaa

SEQ ID NO: 29236 - DNA, 201 bp, Bos taurus
aaaattcatggatactgcacaatgagagtattcatgatggttaagtaagatgaccatacaatttattaaccaaatacgggtgatgctgagaataaaagaayagttagaaaaaagtatataaatacaagtataaaccaggagaatcaaactggcaagtatgctcacattataattaggaaatattttctttgacttttaaat

SEQ ID NO: 29237 - DNA, 201 bp, Bos taurus
atcttacattatctatatctaattgtgtatctaaatgcccactttggattcaatatgtcctaaacaatgtttatgactttctctctccttcactccacatytgatatcctcccaatatttacaacatcaatgaactacaacaccaacctttcttcctgctttcagaaactttaaacctgcaaggtatttgattcctagttt

SEQ ID NO: 29238 - DNA, 201 bp, Bos taurus
tgaggcacagccaacctctgcctccccaagaggccctctcatacctctaggtatgtctctgtttctgctgtgggcacggtgggtccagctcagaccctgaygtggcccaattcccatgtatacttgcctctaaagtccagtactactgaagctaggctggtttcatttgtgataacactaatctattcagatattccacag

SEQ ID NO: 29239 - DNA, 201 bp, Bos taurus
ggatgcccaggttgatgataagtcaccctctgaggatgcaggtcccaactagatcccttctcctcccctcctagtagattctgcatagttttttgtttatrggcttggctgtagaagagccattatgctagtcttctggtgattcttagcaagaattactctatatgaagttatagttttgatatgtttgcaagtaggggt

SEQ ID NO: 29240 - DNA, 201 bp, Bos taurus
aatggcaaaccacttcagtattctagccttgagaaccccatgatgtagtcctacttgtttacattttgtttcccttgcctgaggcaacatacccacccccmaaaaaccctgattgatggcaaagatcttaatgcctgtgtttccttctagaattttttatggtttcaggtcttacgtttaaatctttagtcaattttgaat

SEQ ID NO: 29241 - DNA, 201 bp, Bos taurus
catttcatcagcatgcacttatagcattatcagatgactcacacttgtttcaagtcattcttatatatcttataataaataacactaagtattaaatttcracataaattgaatggataagttctaggaattttttaaaagctttaatggattatgatgtgttctattttattttctcctgagattcctattgaaatcacc

SEQ ID NO: 29242 - DNA, 201 bp, Bos taurus
attttaagcttatttttcctcccaggatacagaaagtgtgcagattatttcatttcttaaatgtcaaaaatacaaaaccctatattgtaactctgtaatcrcttactgctttagaggtaaattggaaagaagagactaaaacacatctctggcaatatactattttcttggacttaggctccagaattagcaccaaaaata

SEQ ID NO: 29243 - DNA, 201 bp, Bos taurus
gttaataatattttattatatgtatatataatataaatattttaattggtatcaatttaccacaaaatattctgtaggatattcatggacaagatgatgcyaataaaatgactaagagaagaatcaaaagaatatatctgttttttgcatataaatatgttaatatcattacttacattaaacaatttttcaagtaaatat

SEQ ID NO: 29244 - DNA, 201 bp, Bos taurus
ttacaaatatatgttattttgcataccatcccataatggtaaaattctttaatttcttgatataattctacagacatttccctttccctcctcttttgctktctttgcctctgtaacaatatctcattatttttttggtgggtaattagtgatataagagggtatagtggacttttgaaagtcgatcctgtaggcaatcat

SEQ ID NO: 29245 - DNA, 201 bp, Bos taurus
caacatcagcagcaagtgaagataattcccacattaaaatacatacatacagataaggttgaaactttacttcacatggaattttggcctctcaggaaaastttgtgtattccttcagttcagttcagttccatcgctcagtcatctctgactctttgcgaccccatgaatcacagcacgccaggcctccctgtccatcac

SEQ ID NO: 29246 - DNA, 201 bp, Bos taurus
ctgacaatacttccatctcagaagttaaaatactgttagacagagaagaccttatgccctccaaagtaaagatttcagcatgtatccttcagataatagamaacacacacaaaaaaatcacatacaagtatgtatacaatagagaaaggttatggaacagggtcccatacattttaaaagtggtcttaaattgctactgct

SEQ ID NO: 29247 - DNA, 201 bp, Bos taurus
ttcatgttagactggaggctatttaaaacatattaactctaaaataggttagaaatgacaaatatgatcatgcatacagtcattctcaactttatgccagyggaaacaggatcaacatctgcagcacagtaatttctgagtctagacctggcttcagagtactactctgtacatcaaacagaggttagtccaaacaagtat

SEQ ID NO: 29248 - DNA, 201 bp, Bos taurus
agaagtcacactaaggagctgtaggggcaattctctggggaacttaaaaaaaggaagcagaattccaaggtttgagtcaaggtctttggttacatatggarccacagatttgttcccagaatatcttaacaatatcgtcccctaaattcctttagcaacattggatttgttcaaagctgttaactgaatctttcatataaa

SEQ ID NO: 29249 - DNA, 201 bp, Bos taurus
tgctgacaatggaaaatcttacaagtattgaacatgacatttatgacagtcttgctgtcatcttggcttcttttattgaatatgcagagaattataattgrgctaacaagcctggtagcctggcctctttccaattatattaaccagcctagtctagtattagctgcctgaacacacacagaaacagacattgaacttttg

SEQ ID NO: 29250 - DNA, 201 bp, Bos taurus
gtggttaagattaccaatcatcttggaatagtgcctatcaagtagtaggcatttaattcaaaagaactattaaatcacattataccatatactctattttraacacatctaaagttgcaaaaaagtctatctgaacttaaaaacgtggacggtcttacagagaaatgtatttgtctatctatacctatgtatctatatgta

SEQ ID NO: 29251 - DNA, 201 bp, Bos taurus
acataattattgttcacaagtgataagaacataaattggatgactctggtgagcctgggcagtactgaaatgctttgctggccttatcttaacgtgtattrtcttacgttagggcatcagcataacagcctgatgaacagtcactactctctttactcagtttatgaataaaatcactgaagattatagtgattgaatcac

SEQ ID NO: 29252 - DNA, 201 bp, Bos taurus
ctctctttttaccatcttctttccttgcagaccttcaggccattgacattaaagatatagccaaattctctaactcctttttgcctttagaccactacttytcttgtgtcctaattatgttaaaatccacccttctgcattttcaaagtaactatcatttccaacaaatgaagacattagcatctttaaagacagtcccat

SEQ ID NO: 29253 - DNA, 201 bp, Bos taurus
taaaataaaataaaaaaaaaacaaaaccagaaacatgttgttgttaacagtgactgacacaacatctgtgaaattttcaaccaaaaatttgcttagcccamtgcttttactatgctactgccgttgtttgctaaatatccagacttcattcatttatcaaaatttcagcatcttataatgcaaccaaatatttatctagtg

SEQ ID NO: 29254 - DNA, 201 bp, Bos taurus
cagaaataatcagtcaatgataatcagagataatttccagtgatcaaggtttttaattagaagcagcagttatgctatcaaaagtggtggtgtccttttgyagaggaaagatctggaagacaattctatagtttcatttttattgtagtattttagaataattttaggacctggggaatctaaggagtttatagtatctgc

SEQ ID NO: 29255 - DNA, 201 bp, Bos taurus
catcatgccgatgtctatgcactttatttgttcaaagatattatcaaattatcaagacaaacttttaaattacagaaaaccaaaacactttcatattttgycccacactgtaaaaccatcaaaagaaaattcttctgattctatgtaggcatattaagacaatatgatattgtcatctcaacacaaatatttattttaagt

SEQ ID NO: 29256 - DNA, 201 bp, Bos taurus
aggtctctgttctctgctggtcctctaagattagatttatttttcttaaatcctatcttgctagttgagagtggttttcccaactttcaatgcttgactcrctaatcttcttcaattatattcatcccggtagtgtgtacactcaagtggattttattaccatcaatatgctgatgactctctgatttctatccccattgc

SEQ ID NO: 29257 - DNA, 201 bp, Bos taurus
ctaaaattgcatattacttttttgcaactgtagcctacaaaaagtatttttaacattaaatgtggaactagccctagagcgtaccatgattgataaatttrccactgtaattcaataaatatcccttggaaaaagaaatactttgcttagagggaacattttatttctgtttttcattaatttattgttatttcctattat

SEQ ID NO: 29258 - DNA, 201 bp, Bos taurus
caggggtatcttattgtgaaaatcctgtgattgatagctgttgggaaacaggacaaggagattttttacatctgtttactgccttgaagtttctccattcyatcccacactgactgttgtctttcatagaagagctagaatttctacccttccgatgcagatgccacagagccacaaagttgtagggcaaaatgaaatgat

SEQ ID NO: 29259 - DNA, 201 bp, Bos taurus
tccctatttgaagagtgactacaaagagtcatgaattgatacatagctcaagtgtgtccagtagaagtggacaaggggatttaaaagtccacttagaattyttgaaccctgataacctgacagtgatgcagcggtgcagttttacttgcacaaaatcatttgtccaagtggtacatctttttgtaattcatctccccaatt

SEQ ID NO: 29260 - DNA, 201 bp, Bos taurus
ggtttttaataccacagcacctagagtcttgtcaaatatcatcttgttaatttttctataaagattttttctaacggtaggaatgttactgtttagctgtrcacactgcttgttcatgtataataattattaaaaggcaacttgaatcaggaatctatgcaatttttaaaaatgtgtatttcaaaaacttgtatcagtgca

SEQ ID NO: 29261 - DNA, 201 bp, Bos taurus
tcactcatgggtggcagagagctaaaagaagggccagtgtttcaaatactgtcccataaattgacagtggactctatgatactattaaaatttgcttcacrtcaaggccaaatactctttctcttagactggtcacacttcaactaaataggaagtatatgacagagaaatccaattgaggagagagagagagattgggtg

SEQ ID NO: 29262 - DNA, 201 bp, Bos taurus
tcatgacaccaaggattcaagcaatggggtaatggagatcttggacatttatttcctcactggtgaaaattaaatgaagactcaggagtcaccccaactayagtgatgagaagcaagtttcagcaggcagagtgtgttggtgagttcttgctacatagccgcttatatctttgaagacatgttaaagtctttctgtgctgc

SEQ ID NO: 29263 - DNA, 201 bp, Bos taurus
aataccaaggtagtaattttgcctctcctttagtaaaacattttgaaattttatagaatatgacagtcaaaggaaaaagatcctctcaaactgttggccamagtgtaacatcttgaggaaactatttgtaaatttatgttgagtaacatatcctaagagaattagaaagatcagtaaaaatatacctatgaagattttttt

SEQ ID NO: 29264 - DNA, 201 bp, Bos taurus
ttaactatcttaattttactcattgcagaagctgcaatcttgagaagttaagtaattatcattcatttattctacatacatgcttgtgggaaatttgctarttgttgcaaaagaacaaagaatacatgtactaaagttttgtaataaacactcaaaatattttcacataacagacaccttcttttaaatgaaaatagtctt

SEQ ID NO: 29265 - DNA, 201 bp, Bos taurus
ctgaatcttttcattttctcagttatgtaagaagcaaggtcatccactgaaagtgaaggtgagtaagaagtattggagggttaggaaataagaggagtatraagtctttaaggtgatagaagaatgggaggattggaaagtatagttttattagtttaaagtatcaggagcccatttacagttcctggtcatggtttcaag

SEQ ID NO: 29266 - DNA, 201 bp, Bos taurus
acagtggccattttaaaaagcatgaggtgaaaactaattgtgatttttgacttgcatttccctaaatgtgatacctagtgatgctgagcacctttcatagrcttgttggccatttgtacgtcttccttggagaactctttattccaggtctttgtccgcttttaaatcagattatctcttcttgttgctgtgcattatagg

SEQ ID NO: 29267 - DNA, 201 bp, Bos taurus
cacccagtagccctatatatgtcaaatcatgtcacttctctgtccaaaccatacactgagttccttcttgtctgacaataaaatccaaagtctctcacatrgccaacatggacctacttgattttgtagtcaacttcctctcaggtctaaggtttcaccacttcattcctggatcactctgtttcagccacagtggcctcc

SEQ ID NO: 29268 - DNA, 201 bp, Bos taurus
gaattaaaagtataaaataaaagacaagatggttatttacctctttcagttccattgtaaattatctatttcccttgtagtagaaaaccaatgtgaggctyattaatctttgttgaactactttgcaggacctccgtctgcaccgagaaatgtgatatctaatataaacgagacctcggttatcctggactggagttggcc

SEQ ID NO: 29269 - DNA, 201 bp, Bos taurus
tgaatgaaaagttttgtcttgtatcacattgcccatggcaaattaacacctatttgatttttagaagataaaaccaaatgaaaacttatctcaggcattayatgttaaggaatcttattttacgtaataatttattccatattttttctctgtgattctgccaagttaatgccagaaatattctactaccactttgtctta

SEQ ID NO: 29270 - DNA, 201 bp, Bos taurus
agatactaaataaacaacttatattatactatcacctattcttaagtgatctgatgctagaaaataaagttataagcaagtttaagacataattttccttwaaaaggcttatgatcggtttcaaaagagagaaatgcacaattgataaatattaattagttttattttataatttataatttcatgtgttaaaagctagta

SEQ ID NO: 29271 - DNA, 201 bp, Bos taurus
taagaaaagtattgtgaaattacctaatatacacatagtgatgactgctgtctgtaaattgttataactgaaacatttctcctggaggtgacattgagaargttcatgtgggcactcacaaaacaggctgcaaccgctttgtctttatacagtttattatgccctaccagaaatgaagttttattttatatcttaaataaa

SEQ ID NO: 29272 - DNA, 201 bp, Bos taurus
aattaaaccaacacaaacgtctgtaatacagtataaaatacaacaattgggacaagaagagtctaaataaagtgaaaagccaaaggcaataaaagtgcatktagatatcagtccagaaagaaaggccttacatgtagctagttgagacacggacatgataaagtacgtactccatttacttcattgaacattctttagatc

SEQ ID NO: 29273 - DNA, 201 bp, Bos taurus
tccaagctctcttgactatttcaatagtcttgatctctactaaatagtcttgaataaaatgttcattccctaactccatctgcttaaggcaatgtttcttwgacaaaatgcaggactgacaaacaagtgaaaaaaactaatttgagagagggtaaaaagagctggtcagtttagtcagttcactctctcagtcgtgtccga

SEQ ID NO: 29274 - DNA, 201 bp, Bos taurus
cacactgtgtatacaacttggcctaagtaaaataactcggctgacccatatttacatttcactgctagtgtcctaaacacaacgaggatgggcccggtggmtggtcttggcacacagcacgatgtttgtgtctttcttccctgggtgccccagacgttagcttcatttctgattggcattagcatctgcagctgtttctgc

SEQ ID NO: 29275 - DNA, 201 bp, Bos taurus
ctgatgggggggtcatgctcagtaaatctttaatccaattttctgttgatgggcagggctgcgtccctccctattgtttgacctgaggccaagatatggcrgagttaatgaggaaaatggttcttcaaaaggtcccatgcatgcattactgcactgagtgcccccaatcctgcagcaggccaccaccaacccatgcctctg

SEQ ID NO: 29276 - DNA, 201 bp, Bos taurus
taaagctggccttggtcccatcattcctctcttgcttgttcctcttcagccatgcatgccatcttgcaggttctgctgtactctatgcaaactacctcacyagggcctttgtacttgctcttgtctcttccatctgaagtgctcttgatgaaaatgtgcacatggttctccagctccatttcttgggtcttggctcaagga

SEQ ID NO: 29277 - DNA, 201 bp, Bos taurus
gttatttagggaaatgcacagtctgtcctcatttttgatagacattaaaatacaaattagctaataatcagtaaccatttatactccctttggagtctttrtgtgaaagtattagtcactcagtcatgtctacctctttgagatcctgcggactgtagccctccaggctcctctgtccatggaattctccagggaagaata

SEQ ID NO: 29278 - DNA, 201 bp, Bos taurus
atcttgaaattgttctttttaaattgaacattgcctcagtaactattttacatgtcctcatattttgaaaaaaggttattttgttttccaataaattacartatttaagagggagcaagagatacctggactaacaggaaagtttggccttggagtacaaaatgaagcagggcgaaggctaacagagttttgccaagagac

SEQ ID NO: 29279 - DNA, 201 bp, Bos taurus
caaaggatttgaggatgtgcactaatatcataaactgtcaaaaattcaactaacattttaccattaaattgacaaatgtttattgaccaacataatgggtwtgaacttattgtgcatatagtcccaagctaatgatatgcatcttcccatttgacttttgaaaagatattctgcaagacttacaatagcttagggaaaaat

SEQ ID NO: 29280 - DNA, 201 bp, Bos taurus
gatattctttgcaactggtaagaaaaaaaaaatcaatttgttgttgtttactagctaagttatctccaattccttgcaaccccatgaactgcagcatgccrgtcttccctgatcttcagtatctccagagttttttcaaactcacgcccattgggtcagtgatactatccagccacactttgccaggcccttctcctcctg

SEQ ID NO: 29281 - DNA, 201 bp, Bos taurus
gttttatttagggcatatcttcaaagccctttaaatgactgctaaaaagctgttccatgttgtagaaggatagatttaactatgtaatttggcaatgttgyaatgttatatgacaaaccaataaccttaataaaaatctcaatatttatgtgaaattgataaaatgttattaaactttagtgtagttgtctaatatttaca

SEQ ID NO: 29282 - DNA, 201 bp, Bos taurus
gcaagatgtcctccagtcatgttccttactgcttatgacagcaagccacattcttatttttgagaaacttaaaggcattgaactttataaaactatctctrccttttaactatactttccctatcccattttgttcccatgacagtctaatgtcttcagcattcagctgagcattgcattgcccaagggaaaactagtcac

SEQ ID NO: 29283 - DNA, 201 bp, Bos taurus
tggtcactcattggatcaaagcagcccaaagacctatcactttccatttctctgtgccaggttattatagaaaataacccagatgtagttggattgtaagrcaaatagtcaattttgtttccttaaaaaggaggccaaaaaatatttgttcttgtttataaattcaggtgaaaggaaaatggtgtacatctctgaggctca

SEQ ID NO: 29284 - DNA, 201 bp, Bos taurus
agtggagtaattcatcagagttttggccttatcttaaagcagggatccccaaactctaagccagggatgagtaccagtccatggtctgttattaattgggycacacagcagaacatgaatggcagttgaaaccaaaaccaaccccctgccagcccatagaaaaactatcttccacaaaaccggtaccaaaaatgttggaga

SEQ ID NO: 29285 - DNA, 201 bp, Bos taurus
agtaatacacagaaggaaacttcaaaaatagaaatatctacaatgttacactaataattttattactattctagtgaaaggctgtttaactttacttccayttctttgctcagtggttaatccttttcctttgatcttccttccctggaattttttattttaacattcttgtttctcaagggaatgttcttgagatcacaa

SEQ ID NO: 29286 - DNA, 201 bp, Bos taurus
ttcttataaccagatagcagttgaattgtgtaccgaatgctgaggttagaggcagaatttgtattccagtcatagaaatttatacgtatattccatctttrtaattttaaaagaagattgacattaacttccgtatatagttcacatcctacacagctgagtctgtatgaagccctgtgtaaatttaagaactaagaatat

SEQ ID NO: 29287 - DNA, 201 bp, Bos taurus
agtcaacaacaacaagaatataagaatatgatgaaagccaaaattgacattctacatgtgacaaattctacctgtacatatcatgagaaattaagctttgrggatcatttttctttaagtattataattagtatgtctaagtacaatcagtcaaattctcctaggatttgatttcctatgatttcctactggagagaggga

SEQ ID NO: 29288 - DNA, 201 bp, Bos taurus
ttagatatttttagtcaaggaagcatgttaaaatgtagcaatatacaataaaataacatgaatagaatgtacaaagatacaaaatccacataaggaaagasaaagaaagaaaaaaatgcaactgttataaaggaaagcaaaacaaagagagtaacccaaaaaagggataatatttgaaaacacaaactaagcactcaataa

SEQ ID NO: 29289 - DNA, 201 bp, Bos taurus
attgttttgggatgtcatctgttacatttttaattggttactcttttttgtatagggacattattgtttttcttcttttgaaattgcttctggccactttkctggaatatcttaaaccacattttttttttttttggttatttgattttattaatttctgcagaaacaagtacatcatctgaaaatactatttggccctac

SEQ ID NO: 29290 - DNA, 201 bp, Bos taurus
tcctgaaaactcagtggaggagtcagatatgtggataaaaacagtctttctgcactttaatgatttaataagccatctgaaaaaaaaaaaaaaaaagaacrtataaagtattatggcagcaaaaaaagggggatgggatttaatctgcctgtttgaaaatggaaaagcttctgagattataatatttaactgtatgttgaa

SEQ ID NO: 29291 - DNA, 201 bp, Bos taurus
aaaagggtggcctcagaaccagtaatttatcaatctacccctcatacctcaaaagccagatacatccaattattccacaagctacacaaaggaaaaattaracaaagccaaaaaacgggccatcaacagaaatctagaaggccatagatggctagttaatgaacatggacaatatttctttcttcaaatacagctttgtca

SEQ ID NO: 29292 - DNA, 201 bp, Bos taurus
cctgccagaaatgctcagagggctcagagaaaccttgtgtgcaccaggacacagagacgccaacagacactgagatagaccccacagagactgagacatartaagacctataatgagaattaaataaattactggtgtcctcgatcatgcatgtggccttttaagtaaatagttctcctttttgtacttgaatttttccct

SEQ ID NO: 29293 - DNA, 201 bp, Bos taurus
ccccagatactctgatattattcgagattgttgtctggctatggacatatatataatcaaatatagcagatgatatattccaaaagtaatagtttggttayaaggccattcatgatttcatgtatcttatattctatccattagtcacagtgaacaacctgcaaattccaaaatagtgatgataggaagtagtttcttgac

SEQ ID NO: 29294 - DNA, 201 bp, Bos taurus
ctggaagaacatggacatggggaaaccttaaagagtaaaacagattaaaattaaggagtggttatagaacaagaagtctgtacagttaatacatatcaaakcagaacattaagaaggaaacacattgagcattgtgcaatgcaatgcagaattgagaaacgcaacagctaactggttcacaagtggcaacctgaaagggta

SEQ ID NO: 29295 - DNA, 201 bp, Bos taurus
gaaaaataatgagaaaagagagcagatgctcatccaccacccatgaccaatatggtttatgcagactcttgatgacaaataagaggatcttgaaagtctcyttataagctttcaaggatgcatttacttatgcttagtaaagtttatataaataaaatctaggtaccatatctcacctatatcccctttgatcgcttccaa

SEQ ID NO: 29296 - DNA, 201 bp, Bos taurus
ctggttacatacaagagaactctcataagactatcaactgacttagcagcagaaactttgcaggccagtaaagtttattgctggcaaggtatattaaagtkcatgtagtcatctccaactccttgcaacccctttccaggctcttctgtccatggaattttcgaggcaagaatactggagtgggttaccatttccttctcc

SEQ ID NO: 29297 - DNA, 201 bp, Bos taurus
tcaaggccccattgatctggcacttgcctcctttctaggatcagttttgctaattgctatgcacacttcagttctaatcaaccacttaacctctccagagmaactccttctgcctggaatgttcctctctctcagaggccaatactttctgtttttaggttcaaattaagacttccctcctccacatagtattataactcc

SEQ ID NO: 29298 - DNA, 201 bp, Bos taurus
caccatctactaggttattaaatctctttgctgttaagtttgatcatctagaagatagagacagtaactactattatatcagagttgtttcaaggattaartgagataatacttctaatgagcttataactgtgattggtgtgtagtatttagggaatgttagatattttttccctgtaagaatatggtaataattgacgt

SEQ ID NO: 29299 - DNA, 201 bp, Bos taurus
tggttcctccttagactcttatgggcagcaattttaggcaacttgcaatttcctgaacacattatgctgttcaatcctcagtgctgtgtaattcactgttygctctgaaaggaggccctggcctatttgtcttactcatcaaactcctacttttcttttaactctgcctaaaacactacctttattatgacacgttctgct

SEQ ID NO: 29300 - DNA, 201 bp, Bos taurus
ctcacaagtagttttcatgcttaccaatgttttggtttccacttcctgtataaagggaattataacttagtgtatgtattgtttgtccccagaagtaagargataactgtgtatgtttgcatttaggtcatcctgtccattgaagaaggttacagactaccagctcccatgggctgtccggcatctctacaccagctgatg

SEQ ID NO: 29301 - DNA, 201 bp, Bos taurus
ggtctttttcaacacttttttggccagagggagaggggaaatggtagtcaaatttaaacatactggatgttttcatagttaggagaaatttaattactgargtaatttttggaataaattatggccttaatatgtgcttgctacctttattctcagcaatgcaaatagccatatgacatcaacttaatatcaaaattaaaa

SEQ ID NO: 29302 - DNA, 201 bp, Bos taurus
aaagcactggtaaaactgcaaccctgcttctttatttctagtatgttaatggtttgaaggattgggtaatactctggagcctaatatttgtttattatccmttgagagctagaaattgtgtttacttactgcttccaataactctgtgaggtcaggatttatctcatttattcatgagaaaaaacaagatttagaattcaa

SEQ ID NO: 29303 - DNA, 201 bp, Bos taurus
ttttcagcacatgtgcttctaggactcactgttccagacgtcctttccgactttaatgaactgtaaaaactggaaaccttaaaagagacccagaggtttcygtgatgcagagtttctgttcagggtgatgacaatgtttcagaaacagacagtggggatggctgcacaacagcgtgaatgcaattagtgtcactcaactgg

SEQ ID NO: 29304 - DNA, 201 bp, Bos taurus
ttataataagccctgtgttatacccaaaatgagttgtagaaaacttcctgaacaccttttattctctcaagtacatgcttttgctaatgaaagtctctccrcagagaatctccccactatcaacaaccccatctttatttacaactgaaatggtggtctttctttcagatctttctcaaatgttatagctatcatgatgga

SEQ ID NO: 29305 - DNA, 201 bp, Bos taurus
ttggggctgactcatttgttttatcatttcttgtgaaaacgagaggtggcaactatcactggagagcaaagggtgacttggtgactgatctctttaccaarctgagggaagcaatcacacgcgaggttcagaagctccccactccctgagaaacccagcagcttggtagaaagggagtaaattctatacaagcagacaggt

SEQ ID NO: 29306 - DNA, 201 bp, Bos taurus
atatttgccctgtgctgtcactgttgatttctcaggactcaagttcctcattattcttcaaagcacagcgtgtgcagggtggctatatatatatttttttycccataaatgtcagtaattgaagatattttaagggaattacatcacaaagaagcaatacttagaatgtgcccatgtaatgaggtcctgacccttcctggc

SEQ ID NO: 29307 - DNA, 201 bp, Bos taurus
tcttggagctttggcagtgggatctgttggcagctctgttatcctaggccgtctttgcctgtgtccttgagttcctagacaacctggaaaactgacatgcrtatacccacagtctttgctgggcctttaatggggatattttctctgttaccattttttcccctccttccggttgacaaggtcttcccctgcctgtgactt

SEQ ID NO: 29308 - DNA, 201 bp, Bos taurus
taaacattttaaaatgtgacgactgacactttagaggggcacagaaaaattcctagataagacagtatgacaacattaaccacattatagaatacaggggkttcccaaataccacttatatcttgtgcttctgctaaactatactaagatttcatggaaagaaactgaaacccacttttgatcactgttccttatgatttt

SEQ ID NO: 29309 - DNA, 201 bp, Bos taurus
ccaagatggagagaggcactcatctagccagtctgtgtgacttgtgcttagaactacgagcagggagaaaccccgctttgtagcaggaaaatgacaagatyttgaagtgattcagggcaatggcaggagtgggatgaagggaaagactgagcctacaccagcatcttccatgaatgaggctggggctgggcaggtgtgttg

SEQ ID NO: 29310 - DNA, 201 bp, Bos taurus
gaagttacagataataaaagcactgcttttgacctaaagtagttattaaaaagttttcaagcttgtaccagctacaaagcattctctgatattttggcctygtattagtcactagattagtatcctaagtaatcatttcagcttaaatctttctgaacattgttttctagatgtagagctgtttcaacttctgcttatttg

SEQ ID NO: 29311 - DNA, 201 bp, Bos taurus
aaaacaaacaacttacccttgaaacgtcaattggcattgcaatgtatgagtgtgcaacaagaataaaggaaaaagaaatgataattatatttcatggcaayagtcactgacaaaaagaagaatgcattagatatgagaaaaggacatctgactcattcagtgaccacccaggagaccaagaaggaagggactccccaaatt

SEQ ID NO: 29312 - DNA, 201 bp, Bos taurus
atactttataaatcaactatatttcaattaagaaaaaactctagagagtattcaaattttccacatttgcaatgcttttttttttcaatttgtttaaaccrtaatccaaattaggtctatatgtcacaatttaaattcctttagatctataaattttccaatatttcccatcaatttgtttattgaagagagtagaggttt

SEQ ID NO: 29313 - DNA, 201 bp, Bos taurus
atatcactatacaccattagaatagctagaataaaagaacagtgaccacaccagatgcagccaaaaatacagagaaattggatgacttattattgctagtrggaatataaaatggtacagccattatgacaaacaacttggcactttcttctaaaattaaaaacacatttactgtacaacccagctgctgtactcttgggt

SEQ ID NO: 29314 - DNA, 201 bp, Bos taurus
ggaccataacgtactgtaaaatttgaggtatgctcaaacaccatggtgtctttaataacaagaaagcacgctgaactatagagccatatgttttatcacarcacattaatgaccacatgctagagaagaaattggaaaaaaaccatcagctatggcaatgactcaaacattctctattccagtcttcagaataccagtatg

SEQ ID NO: 29315 - DNA, 201 bp, Bos taurus
cgtcttaaataatgacttgaatcttggctgcaattataagataagatttttctcataaccttttcacaatggattttcatcagctcctttataaaggaaaktaaaatttgcatttaactttaagctcatgtatccgaaactggacccaccattggcacattcagacatggtattttaaaaagaataaaatttgctttatag

SEQ ID NO: 29316 - DNA, 201 bp, Bos taurus
aatgctgcagaagtctccagaggggcctctggacgctgcgcactaccggcagcaccgggagaacttgctggtcacaaagcacagtggggagtgatgagtgragggccggctttcacccgcggggggtgggagacaggacgcaggagggcggccgcatcgcagccggctgtggacagcccttctccgcgcccacccagagct

SEQ ID NO: 29317 - DNA, 201 bp, Bos taurus
ttaaaggaagcatgtagattcttaactgactcaccctggaagtgacaaatgccacagtctactgctcagaactggaaatgtgattctgatcaaatggtgargtggctgggaaaagtgtggaagagtacacagatatttgataagtactaatgatcttttccacactcttgatgtttgatactttgaaattacctatttaaa

SEQ ID NO: 29318 - DNA, 201 bp, Bos taurus
aactaataaggacctactgtatggcatagggagctctactcagtactcggtcatgaactacgggaaaagaattaaaatgaagagtgaatacatgtatgtgyataacagagtcaccatgctgtacacccaaaacgaacacaacagtgtaaagttattaaaaaaattttaactcttgtgttagacttgaataaatcacattct

SEQ ID NO: 29319 - DNA, 201 bp, Bos taurus
ctgccactcctggagccattgctagagaagtggcccacgggattctaaagatggttagtgctgttgtgaaatgttacaacaaagggtgaaaggcccaggayacacctaggcatttacatttccaagtagagcctgtttggcttttgtgtgacccaagccatggctcaggctgagctggattcttgccaaggtgggccatcc

SEQ ID NO: 29320 - DNA, 201 bp, Bos taurus
tattaaactaaaaacgtttgctgtcacttgtgggcagtgatgattttttagctcagtacctaccaaccttccccatttctttttttttttttttttggccraatgtcttgtggaagcaacagtgagagcacagagccctaatcactgaaccatcaaggaattccctccaccggactacacagtccacgggattctccaggc

SEQ ID NO: 29321 - DNA, 201 bp, Bos taurus
ccggcccagagtttgaccctcccactgagaaccacctggaaggcggcgcttcccgaagcgggggagggggggggggtgcggtgccgcctggagagcagccytgcacatcgcctatgatcaggccggaggccgtgatacacgtttcagtaaacagactggattgtccagagggtgtatgttgagttgctgctgacagtggtt

SEQ ID NO: 29322 - DNA, 201 bp, Bos taurus
taaatacgtattttacatttgttaggatgaaagaaaagagagcgtttgcatcttctttgtccacccctcccctgccacgcttaaacattttactggttacrttattctctgttgatgcaacttttctctgttggtggacatcaaactctgcacatactcttgattaagtgtatttttttctaaaatgggaatttattttta

SEQ ID NO: 29323 - DNA, 201 bp, Bos taurus
attaatgaagaaaacctggtcttctcactggggccatgtccccagaccttgattcaagcaggtaccaccagcatggatgataggctgattcctcctttagytgatgggaaaacaacccagaggccactgtcccctagtacatcatggaaacttctccaccacatcctcctttcatcctgtgaaaacagtgacatccatgcc

SEQ ID NO: 29324 - DNA, 201 bp, Bos taurus
ttcatcaagggagggtgagaaagatcaaatactcataattcccaggaaccaacatgccaccttgttactttctgctcttgtttccagggcctgacacagtragaaccattaatgatgacttgtcagtcagtcagttcagtcgctcagttgtgtccgactctttgcgaccccatgaatcgcagcacgccaggcctccctgtc

SEQ ID NO: 29325 - DNA, 201 bp, Bos taurus
tgatagtaattttcaatccgtgtgccctttggccaggaaattctacttcaaggaatctgtcctacctaaatattcatatatgacagtctttacaacatcartggttgtaatggcctgaaaagggaagataaacatccattagtagaaagtgattcaatcacttacagtaatccatattaccatatgccactgtgaaaaaga

SEQ ID NO: 29326 - DNA, 201 bp, Bos taurus
gcagggttatttagcttttttgtgaggtaattcaacctcaatgctaattcaaccattgaacccagagatttgcccgcgttggctcacagaaacctaaggtyctgttaatggcacttaggaaacgatgtggcataagggagacctaagcaattggctcgacaggtagatgagggttccggaataggaggccgagccccagct

SEQ ID NO: 29327 - DNA, 201 bp, Bos taurus
ataacatacttatgagctgagagaacagagccagtagagaggaagcatatgaaaaacagatgaatagctacaggctggggaaacatggggcagaggtttaragagagacaaaagtgggagtcagtgggggcagggtggacaggagatgggattaagggtggggcagggaagaaagggctgaagtaaagagttcaaatgttt

SEQ ID NO: 29328 - DNA, 201 bp, Bos taurus
ggtcacaagtcacctctggggcttttccccctaatatggattggcagccgcctttccctttgctggctaaagtccccagccctcccagggaaacctcctcrttgttgtccagcaggccactctctcctgtctccaggacctgctggaagcctgtccacatccatctcagccaactccaggatccgcaatgcccgggagtct

SEQ ID NO: 29329 - DNA, 201 bp, Bos taurus
atggtgtccactgggcatgcctggtatcagagcagcgggagtcctggtctctctccctcaaaagactccatgcttctggccccatgtctagcccaggcatrcaggggaactcggaaaacaccaccgaagggaactgagccaaacagaatggacccggccacctcctgggccagctactctgacctctgaccttgcccactg

SEQ ID NO: 29330 - DNA, 201 bp, Bos taurus
tgagacaggctggggacattcaagaggaggcccccatcttcacggcaaccacaggaataaatgatggagagcaagatggctgtgttcagactacaaacacmtgtgtgggtcacagaggccaagacgggctctaggaagtggtgaggtttgtgtggggaggtgcaagtttcagacagaagtgacagtcctggaaaaatcctg

SEQ ID NO: 29331 - DNA, 201 bp, Bos taurus
aatgaggatggagtgctactgggcccccactggtacgactccaaagccataccattatttctaacattcagccagtagtaccccaatttcaaccctaagayaaaggccacagagtctacactggatttcacaacaaggaggtcactagtgacctggaagagagccgcaccagcaggaggagtggtgggagagatgggaaga

SEQ ID NO: 29332 - DNA, 201 bp, Bos taurus
ctcctgcactatcaggatctgggacatagaaacacatttggaaagacagaggcttgactttatcacagaaatgaatcccccatgtggaattttaggttacygtttcactgtcaaaactatgaacaggcaactccaacccatactaagaataggccgcccttaagtcctcacttacacagaaactgcaattgaggaaaagtc

SEQ ID NO: 29333 - DNA, 201 bp, Bos taurus
tgtttcatcgttattattactattattattaaaaagaaaccatttcaacaagtagagatgttaaacttagactggaactgagaaagaacataagttctccrgaggccaaaggaaatcccaccccttgtaacaacgtgaatgaaccttgagggcattgggctaagtgaaatcagtcaactagagaaagacaaatactgcgtg

SEQ ID NO: 29334 - DNA, 201 bp, Bos taurus
aagaaaaaggaagtatgactgacgtatgattctcagtagttagcccccaggctcctgtatcttctgtttgcctgcaggttaacagacaatatccttatggytcttccttctgaaacttcttgtaaagtttagcttcttattcctattcccaacttgctcaggaaagagcttggctctgggaataagaggcctttgctggtc

SEQ ID NO: 29335 - DNA, 201 bp, Bos taurus
cagagacaacaacattccttctcagagccctggtctgtgacaaaatgtgccccgtcctagagcaccccactggggggccagaaccagtggaatgacatatmtagaaaacccttacagactgccagtccttcatttacaagaaagggaaactgagatccagtaagaagaaggcactcaaggccacacaatgagtgtagaaat

SEQ ID NO: 29336 - DNA, 201 bp, Bos taurus
aggttcacaggttctggcaggtgggaggcaaaaatgctgttgctactttcagtgggaaaaattgttcagggatgcctgctgcctccctcccaaggggcctrtgtttaccaggagtgtgtgtacctggcaggctgaagagcttaccaactagtcatgcccacctatcgcttcctagttctgttggccacaagttcacacatg

SEQ ID NO: 29337 - DNA, 201 bp, Bos taurus
gcctgggcctgaggtttggagcacatggactgcagaaccccctgctcatatccaagtgagaagaaacagcaggtcaggagccagctactctgtaaagccaragccatgtgttttggcctctgtgaccagtgttggaaaggtctggagcatttcatttttacttgagatttttttctgctctgaggtaggagatctgctttg

SEQ ID NO: 29338 - DNA, 201 bp, Bos taurus
aaattgtggtaagtcaagtaaaaatgcactctcctgatttttttttgctgaaatatcaccataagtaactcaaaagaaaagtaggctcttctttattctgrgaaagggatatttaaagttcctttcagtgctgcctttcagtgtttgcaaaaggtaaaaattcagttcacttactattgcaatttctttctgcagatatgc

SEQ ID NO: 29339 - DNA, 201 bp, Bos taurus
tttataaggccacaagtcatagtggattacagcccacccaactccagtctgacctcaactaattctaccttcattgacactatttctttaaaaaaaaagtyacattctcaggtactggccattaaggttgcaacatacctttttggaagaacagaactcaacccataacagccccctaacatagaattatccagcccaaaa

SEQ ID NO: 29340 - DNA, 201 bp, Bos taurus
tgtaattgtgtagactttgatgagacagcttccataaatgttgcccatggagtaacactctcgggcagtgagttcccatttcccctaaggccatatttttmtaaagtagcagcaggggtatgactttcacatagaccccccataggaagtgctgtcatttcctgtgctgatttatccaacccctggcccacacctccagtt

SEQ ID NO: 29341 - DNA, 201 bp, Bos taurus
tggtggcagagctggaagagaccagggctcctacctcctcgctgaacctctgtaccacactctgcctgctgggcttccgagaagctccagggcctttctcyagtctttccttcctgaggctacttaggagtcagtggttgcttgtttcctcttgatatctttgtggcaggactgctggtggggctgtgtgacaaagcagag

SEQ ID NO: 29342 - DNA, 201 bp, Bos taurus
tgaccttctcacacgcagggaccacatcagagcatggcaagtgtgaaagggagtctcagatatgccctgtgggagggtgggggagggcctggcacatcgayctctaggaacctgagaaaagctgacaccccacccaacagccttagaggacatgggttgggccacccaaaggcaggctgccttgttcaactcagcttgtcc

SEQ ID NO: 29343 - DNA, 201 bp, Bos taurus
atgtcccaggattcatgattatggcactcagccacactcaccctgttaaggggcagtctagaaagccccaaactcagctttgagactactcaggccctggmgaaagttcacccccaaaggggatgggaagctgcattcccacgcaggtatcacaggaggttcattagccaagactaaggccataagcacagacagagccca

SEQ ID NO: 29344 - DNA, 201 bp, Bos taurus
tggtgctactgtgacagttatatggtccatggtgctactgtgacttcggcacccagtgctgaagttatgacattgacagatgctttgtctagtggccccaraccaaagaatccagaggacaggggtgcaggcttgtttctccctaccagaaccagaccagtggctcttatcagaaatacttaagcaatttattggccaaca

SEQ ID NO: 29345 - DNA, 201 bp, Bos taurus
agcctaagatgaggctggccaccagagcaggtggtctgaagacccccactgcgtcctccccagtcctcaagtcccagtgctccaggcccctcaaccctacrctcctgggggcaggaggcagccactcctgagaacagctcaaagaactgccctgtgtggtcagggctgggggagacccaggggcccctcccctgaagaagt

SEQ ID NO: 29346 - DNA, 201 bp, Bos taurus
gggtcaacaatttgatgccaaagtttctaccctgaacccctgtacgaactctgggatctcttcacaccttggaagagcctgctacagagctggtttttcarctccaacacagaggccttcatcattttcagtctgcctggatttcagtgtcttctaattggctcttgtaccaagccaatcttggttttccaacaacttggt

SEQ ID NO: 29347 - DNA, 201 bp, Bos taurus
caggcagattctttaacatctgagccactagttaaaataaaatatcaaacataccgtttgggaacatggttcttcatgacatatacatcttgaatactttrcagtattgtatatatgcaggcctacacatatgttttaatgagtatgtactattccatcacatgacccaatcactattgggtcattcccaatacagttgga

SEQ ID NO: 29348 - DNA, 201 bp, Bos taurus
actccaggttttactcgatgtgcttttacctgctgatgcaggccatggtggaaggctttggtgggaaggaggcggtgttgaggacactgaaggacaccccrgtgatgatccatacaggcccctgctgctgctgttgcccctgctgcccccgaatcaagatcaccaggtgaggcgggagggagaggctgcctggagagcaga

SEQ ID NO: 29349 - DNA, 201 bp, Bos taurus
tctcaaaactgtcaaaggtcatcaaaaccaaagaatatctgagaaactgtcatagccaagaaaagactaagaagagacatgtaatatggtaccctatataygatcctagactggaaaaatgacattaggtaaaaactaaagaaactggaataatatatgcacttcagttaataaagcataaatattggttcattgattgtg

SEQ ID NO: 29350 - DNA, 201 bp, Bos taurus
tttaaaactgtattcctaaagatgaacagcaaatagtttggaactgtaattttaaaaatatcccattcatgatagtgactaaaaatataaaatatatttamgtatagatttaacaaaaatgcaaaaggtcttgtaaagaaaatgataaactttattgataggcaataaatgaagaaatctactatatttgtgtgtaggaag

SEQ ID NO: 29351 - DNA, 201 bp, Bos taurus
gagggaggagcaagctgtctggcttcctgagctccttgcctctccagggacatcattttcagattagattaccaattacctctgttcaaaggcctctggckctctcttacacatcgtcctgtcccattcacttgtgatcctctgcctggaaaggatgagaacagaggcaccacccttgcagtctggcctgtaatggcctac

SEQ ID NO: 29352 - DNA, 201 bp, Bos taurus
gatttttaaagttgtatttctttctgcttcatttctggcacattattttttatctgactgcacttaaatttcatttacaaatcttctgttttgctatacarcttttaacatatgtatatgatgttcctaagaaaaatgttttacattgcctcttagttaccaatctttagtaaaacaagtctgaaagtattactctcattc

SEQ ID NO: 29353 - DNA, 201 bp, Bos taurus
ttacttgaaaaaaaatatttagcttctaaacttgtgacatttacacattcattttgttctgctctttctggcagcatcccttcctgaaactggccaagccrttatccagcttgacaccactgattatggcagctaaagaagcaatgaagagtaaccgttaacatcattgccgcggcctcatattcttttttccattttcta

SEQ ID NO: 29354 - DNA, 201 bp, Bos taurus
gggacacccccagggaagccgtgatcggacaggacacagccaaggaagaaactccccgaagcctgacagaaaaagataggctcggccctgattcaccgcgrgcagagagccatggacctgagtacaaccggagagaggtttaacctcagcaaatgggactaaaactaatgatcgatgctgctgccgctgcattgatgtagc

SEQ ID NO: 29355 - DNA, 201 bp, Bos taurus
tccaactgttagcactgtatacctcatgcgtacattcagctcaaacagtggattagaaaatcaaattagaacagtctggcctgggcactgctgctcactcraccccagtgcctccctctttttgctctgctcaccatgtgctcatccagtgcttggtgcctcgcacagcaagactcttgtgtctgctttctgggcccaaga

SEQ ID NO: 29356 - DNA, 201 bp, Bos taurus
tcaaagccttaactggtgtgtatgtgtgcttggggaaggttggagagggtgcactatacaagacattgtgacaataattagggaaagttaaatacagactrttttccagaatatattagagaaaaacttttttgtacaagacatacatgtgtgcaagagtatgtatatacttacgtagcagaacatatatttccatataca

SEQ ID NO: 29357 - DNA, 201 bp, Bos taurus
gcttaacacaccctcctggcctagcgccatcctcctggtggcccctcaattccacctttcctgtctctcctccctttgttacttctcaggcacccagtctrctggctctcaactaatgcaggccagtttcctgagagaatacatgcttcccttaggaagacatcccagaatggggagagtgtgggctaaagagggaaaatt

SEQ ID NO: 29358 - DNA, 201 bp, Bos taurus
tttgccttcaaaagatcatctatttttaagccattaattagtatataaacagatggcacaacaactaagagatcttttttagagtcagaggttttggtgtrtattcaattagaaccccaaatggtatgcttctttgttcacacattaacaaaagttattgcatccaaaatttagttacaataattaaaatatctactgaca

SEQ ID NO: 29359 - DNA, 201 bp, Bos taurus
tctttgcgtctcgggcctcccaggcctcctctcaaatgaagatttaacccctactgccctgggagaggtgaggatcaagtgccacctcgtgtactgcaggyagccctgtgctgctgtggccgttgttgtgtgtccggtctcacaacactcttctactctgctgacttctgggaactcagccctggcgggccctgtagccat

SEQ ID NO: 29360 - DNA, 201 bp, Bos taurus
ggatgagttgactgcatctccaggcatttttcagatttcattttctagtggccagaccctctccctgtcacactgttgggcagggaggtggaacgtctgamtgcaatgcagaacatgtatagtggcctccaggcgatgctggagccagtgccaggcccctagacttgctgagggtcctcacttcgtgaccagaccctttaa

SEQ ID NO: 29361 - DNA, 201 bp, Bos taurus
ctgttccctcagcctagcatgctctccctccatcccgctcttctgtttgccctgcttatcctttgaggcccccatttccagagagcccctgagggcctccrtggtcccagctgtaactcccactcctcagcactagctgccctgagttatgagcaacagctcataactcagcggccagatgcttcctgtgtgtgtgtcccc

SEQ ID NO: 29362 - DNA, 201 bp, Bos taurus
tcctgaaggacctgaatcaaaagtgtgatcagtgtcattcagagtctccctccccacatgactatctaagcgggcttacaagtgggtctctagggcctaarggggagaatgtctgaagaaggttgtattggactcaaaacagagaatcatttcattctaggtattggcaggcctgtctgcttctgggagcaaaactgcccc

SEQ ID NO: 29363 - DNA, 201 bp, Bos taurus
agaaatggtagatttcatcttataagtgcaaattagtgtgtgtgtgcaagccacattgctttgtgcatgtgtttccttgcacaaaggttgtgagttcatckctgcattcctggccttttctccttttcatatccttctcccgccatttgtcactctggagttgatcactgctccctggagccttcttccagtgtgatggat

SEQ ID NO: 29364 - DNA, 201 bp, Bos taurus
agaggccaccctgaggacattgcaaagcaggtgaccacctctgccctgactgcacacgcacagtattccagtggtgtctgccagacccaggcctttacttyagctaacctaccacggaccttcaagcaacaacttatggacaccaactctgcccttcttgctggcctcatttctcttaaaccaagaccaaaatctgggtcc

SEQ ID NO: 29365 - DNA, 201 bp, Bos taurus
ttgggattaagtaataaaacatgagacaaagggactcagaattctgagacgaagggctaggttttctcttccttctgaacaaaatgttatcaatgaggagkattcacttctatggagaacctttgggatttccattccaggcaattcagtggtaagaaaagtaagccaagactctctaagtaaaaatctatctatatcctc

SEQ ID NO: 29366 - DNA, 201 bp, Bos taurus
tcaatgagttttaatggatttatacagttgtgcaaccacgaccacactcaagctttaaaacgctttcattactgcaaaaatgagcaatccctgatcccacygccagcccctgacaaccacagataagcttgtgtcatcacaattttgccatttctagaaatttcatagaaatagagtcatggagtcttctgtgtctggttt

SEQ ID NO: 29367 - DNA, 201 bp, Bos taurus
cttcctaataaacacacacaaaaatgaaaacgctttggtgaattgggtgggccagtgattagacatcacaggtgacctagaaagcaggtgttttgttaggratgaaagctagatcacaaaatgtgagcaaaggaatgtgtggatacagagctaaatgcaggacatgtgagctgttccacaagagaaatgagatggcagttt

SEQ ID NO: 29368 - DNA, 201 bp, Bos taurus
caggacaagattcccgtctgatgctggccgctgccacttattctcacaaacagattcttcccttccccattattgtccatcctccctactttgacacaggytgtgattggcctagagtccatttctttcatattttctttagactgctgacccttgcttcctcattagtattcccttcattctgcctagttctaattccct

SEQ ID NO: 29369 - DNA, 201 bp, Bos taurus
tttagaacaaccaatgccaggcagcccacccatggtactgcctttgtgtaagataaaaacatgctagaaggtgtcttctgcatcacccaaaggcagagagkaaaacagagtaaaaaacagagagtaagggtcacatttcatccccattagtaccaaggcattctgctcatgcatagaccaaatggcttttttctccccaat

SEQ ID NO: 29370 - DNA, 201 bp, Bos taurus
taagaggggcaataggtgaaggcatacgtcctgctgcagatcaactttgggagacaaaatttcctgggaattaaggaagaagagcaattaataagtatgtytctcatgtatgtgtagattgcacatcattggtaggtttccttgaaggatgatagaggattaagaatacagactctggatacaaaaagcttgagttcaaac

SEQ ID NO: 29371 - DNA, 201 bp, Bos taurus
caagttttatcctcaacatgttttgtttctttacagttgctttaggtttccttatcactttaacatttgcatcaaatagaatcaagacctacatagaaaakgctgtcataatatctgagaaatgagttcttaaaatttttagtcaaggaaagtatgtctccatctacaatatattcagactttcagaactccgtgggcagc

SEQ ID NO: 29372 - DNA, 201 bp, Bos taurus
accagggaagtcaagattagagttgttatctctaccaaatactggtagagcaggcagcaagctgttgaatgaggactgaccatacattcaatagtgacttracaggattgatttcagaggagctgtgggaatgtctaattggagttgatagaagttataacaagagttaaaggaaagaagaaagtaatattaaatgactct

SEQ ID NO: 29373 - DNA, 201 bp, Bos taurus
tagactagatggcatattaataatagatatcaaagttctagggactgggaagttcaagatcaagatgccaaatgattcagtgtctagtgagagtattcttyctggctcatagacactgtcttctagctctacctttacatggaggaaaaggcaaaagagctctgtaggtctcttttacttagggcattaatcctatcgatg

SEQ ID NO: 29374 - DNA, 201 bp, Bos taurus
gcctggggacagggatttttaaaactccctaagtaatttgtgtcagccagggttgagaaacactaacttaagacataacctagagcagttctcctcaataytggccgcacattagaatgtccagggggacttttaaaaatactgttgccaaggccctgtccaagacccaattaaatcagaagctctgtttgaaatcagaag

SEQ ID NO: 29375 - DNA, 201 bp, Bos taurus
gtctctagccattgccaattttcccctggaggaaatatctgctcccagttgagaaccatacatatatagtgtggaactataaagtctatggtcaagaaatrgatttggaaatcacctttgaggtaattgttaaatcttaaataatggtggaaattctgcagaagcatgtttaaggtaaaaataaataaataagaagccaaa

SEQ ID NO: 29376 - DNA, 201 bp, Bos taurus
cttcattgatgaagactgtctcaggaactttactagatataatttgaaagccatcagttaagtctcttttctacaatagatccttcaccaagttggccctmaacaagtatgtcttatcttattctatgtcttagttcagttcagttcagtcactcagtcgagtctgactctttgcaaccccatgaactgtgacacgccagg

SEQ ID NO: 29377 - DNA, 201 bp, Bos taurus
tttggggttaaaaaatatgaattttggagggtttttgtttgtttgtttagaattccatgatttgctatgacatacatagtgcacaatcatttatacaagtygaatgagaaatttacattaacaattttcatgaaagtgaaggtttctcagttatgtctgactctttgtgaccccatgtactatacagtccttggaattctc

SEQ ID NO: 29378 - DNA, 201 bp, Bos taurus
gcaggagatgcaagagatgcaggtttgatccctgggtcaggaagatcccctgaagttggaaatggcaacccactgcagtattcttgcctggaaaattctayggacagggatatagtccacagggtcagaaaaagttggacatgactgaacacaaacacacataatccccaatatagaaaaaccatatactccctggaaagg

SEQ ID NO: 29379 - DNA, 201 bp, Bos taurus
tttgcagtaatggtagaatgctttggattatattcttagattcccagagatctggtgttcatttgctttatatggaaattttagtgaaaagtttgaaaagyattgttttaagtgcatttgatgcttctcaaatattctttcatctatatggcatgctgaggcttttgctcagttgtgtctgattctttgtgaccccatgga

SEQ ID NO: 29380 - DNA, 201 bp, Bos taurus
tttattatcacctctataactgttacattataattatattatcactactaaaatcattcaagctttaattccttaaaagagagcaaatactgattcttgaytatttgcttttattactatcagaaatgaaatgttgaccccacactccccagtgaagatggaaatcacagtactgctatagaaagactgttttctagtcag

SEQ ID NO: 29381 - DNA, 201 bp, Bos taurus
aaaaaatcagtcaactttacttatagtacattcctcttatcttcactctaacaacttggttatctgagactttaggccaaagcacagaagagtagcaaatkggatggaaggcaaatctttttctaagtaggcatgttaatggcagtgggaaacttgaggtattaaaaacaaaggaggaattccctggccgtccagtggtta

SEQ ID NO: 29382 - DNA, 201 bp, Bos taurus
aactttgtttacccctttctcaagcacctttgatatcttgtgcttggtttataacacaatcctgtaccatactgtccagaagaaaacatatatttttccartattattatattctatataaaaatgttctgtatccaattcccagactagctttcaaggcccaactttattttttaatctaaaaagttagtataatttaaa

SEQ ID NO: 29383 - DNA, 201 bp, Bos taurus
agtagcatggtttcctgtttgaaaaatgcatttgtatattcatcaaatttataggataaaaaagacaaaatctcttttcttagaatagataaaaggagacratgtgtggttatttccatagtttccaaaaaagtattagacaaacatttaacaaccagcctcaacttaaacaaacaaaaataagaaaacattctcagaata

SEQ ID NO: 29384 - DNA, 201 bp, Bos taurus
tcatcaaccttaaagacccctatgtcctcttttgctgagatcatcatgcctcacccctgggaaatacgtataaagaccctggcacagggcctcgcacacarcaggcactaattaaaggctcactccttctaccaacacatcctctcccagccaaggcaagatggcagctgtgaaacaaactgtgttggccaaccagatgag

SEQ ID NO: 29385 - DNA, 201 bp, Bos taurus
cccctgggctgtgagcggctgtgagccggggctctcaatgggccacttctgcatgctcagcattccctctcagccccagtaggccagcggcccccaccccytgaacgccctccccctccccggtgccccgggctgattggaggaaaggaaaaaaacaaaacaaaacaaagacttggccagatttcaggcctcgatgatgtt

SEQ ID NO: 29386 - DNA, 201 bp, Bos taurus
gaagcccattcaccttttgtttgaggccaataagaactcctcttgggatactgtggaagagcacctagcaccaagagttccagaccaactggttcactctyaacttggccacctatgatttgcgtacactaacaagttgctaaacctgttagagctttagtttcctcacctgtgaaatgaagacaatgacaaaggcctcct

SEQ ID NO: 29387 - DNA, 201 bp, Bos taurus
actggcactgggtaaatattgtttatgcatgtgtctaagacatggctggctcctctgccccacctcttccagtgtagtgaggccccctcttccttctcttrgacacctcttctgtagccaagcacactgcccaccttcctccactgccctgactccgacccctccacgccttgtttgagcacccttcctgacggacatggt

SEQ ID NO: 29388 - DNA, 201 bp, Bos taurus
aggggcctaagactactagcctacttatctattggtatgtgcccaggggcaaaggagaacaaataggtattatttggttggagctgagaatgaatggacayggccagaaatgaacctgtatgtgaaaaatggttttaggaattgttgtttaccttagatcacataaattatgtacattattccataatatatccatgttta

SEQ ID NO: 29389 - DNA, 201 bp, Bos taurus
ttttgaccaacccagtacttcaggtctgtatctcttcccgcactgatggggagtggggtagcagagagcataccccctctagttacccccatttccaaggyagaagaatttactaattgtccagagccaggacattcaataatcccagtttacttgtggcctggcttaccctgccttatacagcagcatgttgtgatgtgt

SEQ ID NO: 29390 - DNA, 201 bp, Bos taurus
ccttccagtcctgattctcctttcacaagcctcgctgggtcagtctacaccctgctgtataattgagagataagtccctctcatggccctgctccaagackgactcctctgacccccagctcctaatttctgtgcagtgctctgtgtttactctgaacatgccctcgaccttcaactactgatacagctctgctcattctc

SEQ ID NO: 29391 - DNA, 201 bp, Bos taurus
atacttcccttctcccagcccaggtttccccctatgtaaccgagagtcctgaacctaagctttctaaaatcacagaggtaggaggaggcctgactacaacyctcagagtccaagtttcagtccaacggtctgctgcgccccctggtgtccaattctctgaactacatgtcagtcgtagggagagggagggccctctggatt

SEQ ID NO: 29392 - DNA, 201 bp, Bos taurus
cccagctttcctcttccctccccatgccaacttcctctggtgaccagattcctgctggcactgaagtgtccacatccctagaagtccagcctcaacctcaygggctcccctctgtacccccttacacacacccatgggcacctcccctagactccagaccacatttaagaacaaaatttaaaccagacacctgtacagaaa

SEQ ID NO: 29393 - DNA, 201 bp, Bos taurus
gagggctttctccgtgtttaactgcaggcctctctacgccccttccacctatgtgagaatacagacatcaagcatttggctgttccacacagctgagggcrtatgtgcatcctataaaagcagccagcaatattaatcatctccagcaccggtgaacaagtctggcacacttagcagagaaaaatggagcctcaggaacgg

SEQ ID NO: 29394 - DNA, 201 bp, Bos taurus
caccttaaaagggtgaattttatggtatgtgaattatatcttaataaaacttttattatagctaagtgaataatggggggaaacagcttgcattttgcctrgttgtgctataatccactgtgccaattgacattcctaccaggtgtgccttagatggtttcaaggtggcacatttgccatcttggctgctttctttgaaat

SEQ ID NO: 29395 - DNA, 201 bp, Bos taurus
ctgtgcactgaggttggtggctcatgtctagggtacctgggagtcagtgagagccaagtgcaatcccctggagcctgcatgtctctgactcgaaatcctcrccaaagcagagctgctggaggtggctgtgcagagatgggaagactctcagggctaagccagcagtgccccacaaaggcaccaatgctgtgccccttccca

SEQ ID NO: 29396 - DNA, 201 bp, Bos taurus
cattcatattcttgatacacaaaaaacactaattttgaattatgaatcttgtattccatgttaccctttagacaaggactttttagttccatactatcccyaccggtatttattacatcctcagcactggaattgactactggttgcctgttattatcattcttctattgtcaaacaattgtaaatgctattttttatgaa

SEQ ID NO: 29397 - DNA, 201 bp, Bos taurus
agactcatctagactccacccctggccactgggacttaggtcggggggagggtacactcttcatcagacagcatttcccagcttgtgatgcaaccacttayaccccaggcctgcaaccgcttccatttcatagcctggtttacagcggcctagtctgtgatcagagcacacagcaccataccacatgcaaagacgtgagaa

SEQ ID NO: 29398 - DNA, 201 bp, Bos taurus
ccacacctgcgagagggcagggccactctaggaggagattgaagaagagcatccttagacagaagagtcccagagagaaagctggtcttcactgacagggygaaaggaagtgaggccatggattcacatcagggtaggctgcccctcaccccagaatttagaccccaaaaacaagatcttcagctaggctctaggtggagg

SEQ ID NO: 29399 - DNA, 201 bp, Bos taurus
gagttggttaccaggaaggccccataggctcctttcaaggcagcctccaccgatgctttgtcattcaggtcccctttaaccacctcggccccaaggtcccrgagcacctgcgcctttggttgggtcacatctcgggtcagcgctctcaccacatactttttgccctccaacatggcccggccacagagctgccctgagctc

SEQ ID NO: 29400 - DNA, 201 bp, Bos taurus
ataagaacttgagttctgcctataagccaacatctgatataagacatgtagttttaaaagcatagagcgtacttggtaggaaaatttggtggtgaaaaaamtttgtttttaaatatgtttgagaaatgttttggtgactcttgcactttctggtatttaagttgaggaaattgaaggccatatggattctgtttctgggct

SEQ ID NO: 29401 - DNA, 201 bp, Bos taurus
ctgttttcagtaagaatccaaatgttccgaacctatatatgtgaagggcacacttaatttttattgctgttcatggagcaagaaggtccactcttagtttrttataagtatcttatgtatctcaaatctgaatcaaatgtataataacctttaacctgatcattgttcttttatgcataaaccttcataaatggcctagtt

SEQ ID NO: 29402 - DNA, 201 bp, Bos taurus
ggcctggcaccctctaggcctttaatccacggttcataattcctcagcaaagagaagccactggccctccctctctgcctgaggttaggttagaaagtgtragtgcatgctccctaccctggtgggttcctgggaagcccagagcttggctccgccagggaaagcagcagagatctgagctgcagagggatgtgccttcag

SEQ ID NO: 29403 - DNA, 201 bp, Bos taurus
tctcaaaaaaaaaaaaaaaagtattaattagcatatgttcttgtgtgggttgatagtccagggctctgagcaggcacagccttataaacagggttccaagyagcccgctgcacaccaagtcaggaccagggtgcagagagaggccttcatgcacttctgacagctcagtacctgtgagagaacagaggtgatgcagggact

SEQ ID NO: 29404 - DNA, 201 bp, Bos taurus
gtgcagtacttttcttgttaaactagtaaaagcattactttaaaaagtgagattaatgctgctgttttaaaaattaatgatatataggtttgtgctaagtyactttagccgtgtctgaatctgtgtgcccctatggactgtgtgctcctaggctcctctgtccatgggattctccaggcaagaatactggagtgagttgcc

SEQ ID NO: 29405 - DNA, 201 bp, Bos taurus
agaagggagtcacaggtcatggcgaggtcggcggcggggaggaggaacggaggaagctgactggaagtcaggaagtcactgctgcaggtgggggtggattrggggaatattgaagaatgatggactgactcattcttgtacaggagaggctgggctggcaaaccatgaggtcctccaggttgctaggggctggaatctggc

SEQ ID NO: 29406 - DNA, 201 bp, Bos taurus
gagaaaagaatagcttctttctaccttagaatgggcttagaaatagaaagtagcttacctgttcatagttaaaggtatccaacattcccagaataaggccytggatttctccaagttttccttttccataaactgggtcctaattagaaaaaagttgctaaagattataatttcattcttgttattttaaatgtattttaa

SEQ ID NO: 29407 - DNA, 201 bp, Bos taurus
attttatgattaaatattacaatttaacacttaaaacagtagatttgtggccatttgtgcatgtattttactcatcctaatgggctaaagatcaccttttycaaaagtatagtcctcttgagtgaaataagctatgtcttctctgcttaggcatccatgcttaagcaagtgtgccttatttgaaaactgatccaaagttac

SEQ ID NO: 29408 - DNA, 201 bp, Bos taurus
ctggtccaaccacttgcgttctggtaccttccggcagctgagctaataaacctgctgggctggaaggtggcaggtgggcaatgttgtgggtgacatggccrggcaggcagattttctgcgaaaggaaggcgtggctttcaggtggggcatctctcaggcagatgccctctgaagaggcttgggggaaaagaggaggggcct

SEQ ID NO: 29409 - DNA, 201 bp, Bos taurus
acagatttatttttaaaaaccctctaattattttgccatataagagcaaaattcaaataatataaataacattttggtataaaattaataatatggaaaayagatgtaagccaaccaagaggtaaaaagtttttagcaataatactgtatataaccatcaattgaccatccaggctgaaagtttattttccctttattgat

SEQ ID NO: 29410 - DNA, 201 bp, Bos taurus
acaattggcactagccttcccacagttatctaaactgaggaaaagctatttgggtcctgtggtgagatggtacagaggaaaagaagaaaatcacagtccayggagatgttcagaaaataggtattgactatgatatgggggctgcgtgcttgactcagatgcaatcatttgtgatagaaattttgcacttaaatttggttg

SEQ ID NO: 29411 - DNA, 201 bp, Bos taurus
gctccatttcggcctctgagtctccacctaccatgtgttctcacctgatcccaattcacagaggacgtaggactgagcttcctgccgcagaacccactcaytgcatctggatctgtcctcttcccattcaaggccagttgtcttcctgtgctctggaatccttctgtctcctaccaagaatcttccaatttctccttttct

SEQ ID NO: 29412 - DNA, 201 bp, Bos taurus
cggaatttgaagctgggaacgtgcacactgatttcatcgctcaacaccgcaaagaactgttgcccgaccggaagaccacagccaaggagtttttatgtcaygcagctctggccctcatcctcaaggagaaagctgtgtctgatgtcttcaaaattcagacacaaggtatggaatatttttctatttcttctgctttgcaaa

SEQ ID NO: 29413 - DNA, 201 bp, Bos taurus
gttaatttctctgtcttgtatctgtggccacctgttaactggattgttttttctagtctccttttctcttcccacaaataaaaatcgattgaagcatttgmatttacatgtatgtactgaaataattatttctgttgtgtttaaaaatgtagcacaatattttgatacgaatagagaaaatattgtgactatcagatgttg

SEQ ID NO: 29414 - DNA, 201 bp, Bos taurus
gtgtgggcttcagaattcaagagctcagtggttgtgcacgggcttacttgctctgcggtctgtgagatcttcccataccagggactgaacccaaagccccygcatgccagattcttaaccactagactgccacagaagtctcatatccactctcttttagatgattttcccaaataagtcattacagagaaatgagtagag

SEQ ID NO: 29415 - DNA, 201 bp, Bos taurus
gacaattaccttctatagagttaatcagttgttcagttctccagtacaaactatctctttattattcattttaaacattgaccaattgttggatgataccrtaagaagcaatgtatatttttctgttctctgtatatgaataatttcctattgattggagtattaatagtgctttaaatattctcatgaataagagaatat

SEQ ID NO: 29416 - DNA, 201 bp, Bos taurus
gttagctttaccaaaagaaaagtttatctcaggactatagtttgtatttccagcctccaaaatagggcaggagaaagcagataactcagtgaaatcaccarcatgaccataaattcaattcatataatggcagatcaataataccatttcttttttgaagtcagatcatcattgtaaagggaaattactgttagatgtatc

SEQ ID NO: 29417 - DNA, 201 bp, Bos taurus
aataaaatacctcaaatttctctgcagtcccctctttggtcacactatttaggatttttatttgtctgttctacaactatagctaacttaggatggaaagraatttactggaatgtgttaaatcagaatcagagaaaaggtctacagtctattttctataaggctgctagagcaacttaatacaaatacaagtcattcaag

SEQ ID NO: 29418 - DNA, 201 bp, Bos taurus
ctgataggagacactcccactaagagcagtgtctcactattgggtgtgagtttgagtctggaggagggggttaagaacagtccaaaaacttggctctcacycattttccactgtgattctgaccacagagtaacatgatcaaccttgaagatactggggctttaaagatgggtggatgttcagaacttccagggacttcat

SEQ ID NO: 29419 - DNA, 201 bp, Bos taurus
caaaaaaagatgttaaatgtatttacagctggtgatgctgaatagaaggtccctgaagatgtcaaatatcaggagtccctaccctacagcatgtattataytagatactgaggatgaaaaggtaaataataagcctccccagcccctgggaaactccaccttgcggtgaagatagactcatatacattagtatagatttaa

SEQ ID NO: 29420 - DNA, 201 bp, Bos taurus
ctcagtcccaggttgctgaaatgacttgtaggcccaagaacacacattgtgtgtgcatgtatgtgtgtgtgtgtgtgtgtgagagagagagagagagagaragatgaggccattttgtgagggacctgggggaaaggggagagctctgtaggagaaggaaccagttttctctcctggatccccatgacttgtatgctggag

SEQ ID NO: 29421 - DNA, 201 bp, Bos taurus
ttctaaagtaagttagagttcataagatcatagaacaaagccctctggaattctcccctttataactcagcttgtcctgaaggggccagaaaatcaggccrcagcccagacagagaaaattgtgctacatggaaaatgcagagctgagtctcatctcacacctgcagaatctgctgtcagctgttcaattctaagttctgt

SEQ ID NO: 29422 - DNA, 201 bp, Bos taurus
ccccttacacagatcagactctctctgaggtcttcagggccttgtctcatttcctttttcctaattccttttcttttgcccaaggtttttggatagaaccrtatcgaaagtctagtctatggtaattttagaatttgagctgctggcctgctgatggggtaagtcaaatgggcgttcatgctaataacctaggtgagagca

SEQ ID NO: 29423 - DNA, 201 bp, Bos taurus
catccaatgactttcatcatatatagggtaatacagacaaaaatactgatgaagatgcctttgtaatgtaagctctatgttccattcacaaagttacatgytcctcttaagaaaaatacgacactgaagatcaaactaatggattcttttagttaaaaaatattaagtgggcccacatttcccttccaaaaatatgcataa

SEQ ID NO: 29424 - DNA, 201 bp, Bos taurus
aggaggacagaaatccctatggacactgtagtgccattgggcagttttatcatgggtagatgtaggccaggaatgacttttactcagaataggcataaatrtgtagtttcctccagagtgaagttctttgggaatcaagattaatgtcaatcatatttaacacatttataaatgttcaaaaagaccgaatttattcagtgt

SEQ ID NO: 29425 - DNA, 201 bp, Bos taurus
acactgcctgaagtaagtgataaagactgaattaaccaaaagaagagggtggaggacctagcagacatccaagttgagctaatggtatcttgtctcaagtrttttcctaacacaggtatttcctttgcactaaaattgtgtaatggcacacatgtggaggatactgcttcctcaaattcctttaataagcctctctcagat

SEQ ID NO: 29426 - DNA, 201 bp, Bos taurus
gaaacaagaatggtggatttggggaagaggaaataggaaaacaagtgggatgttggatggagcctagggagggcaagtccaaatgagaagctcacggtgaytgaggacatcctggggaaaccaggggtcctggagggtaggccttaagaagaaaccctcaaagtcaaaatggcttagtcataatttagtccgatactgctc

SEQ ID NO: 29427 - DNA, 201 bp, Bos taurus
ctcatgcataaatttcaataggccataataaatttgtaaacgaattaaggctttcctgtttatccttggcattgctaaaaccacatacttcccttagctasactgacaaaccttttatgataggccagccaatttagagtgtcagtgtcaactgtatattaaacactgtagcgtttcttttattcctttttaaagataaag

SEQ ID NO: 29428 - DNA, 201 bp, Bos taurus
aagtcgctgatgccgtctccccttcaagaaccctggatcagccggggctggacctcggcataaagtgtatcatggagaagatgtttaatcaattgaagccrgtattactatttctttatgttgtggctttgctgtttaagatacactatccatcattttttcttggtgatctgttatgatacagttcacaagctatggccc

SEQ ID NO: 29429 - DNA, 201 bp, Bos taurus
acaacattatgtgtataagggtggtcaactgactatgcatatgcataggaacccctgtcttcttctccttttaccatttctttctggcctggagtattttmtttttgtggatattttagagttaacttcattttggattctagcaaacctgatcattgaaaacaggtgaggccctgtctcaggtgcctgttctgtttacag

SEQ ID NO: 29430 - DNA, 201 bp, Bos taurus
cacctgagcctaatcactcagagcaggtggaagtctctgtctctgggaaccgggctttgcatctcaactctgaagaatctaaagtgagtattttcttggtrataaaggccatggactcccagtaacccagtgagtggctcagggctccacatggctgctcatatttcaaagaacacatgttcattgttatccatttacaac

SEQ ID NO: 29431 - DNA, 201 bp, Bos taurus
tatagatttcaccaagtagctgcaagcctaccgccaccaagaattatttataagctctctttaagccctccaaccatgcacaatattcctgtttaaaatcygtctaggggttaaaattgtagtgtaatgtgatttttccattagacctgcttctctctagttctgtggagaaagaatgagtctcaaatgggccatttcttt

SEQ ID NO: 29432 - DNA, 201 bp, Bos taurus
cccaagcttctacatcaaatcgcttggagactgaagaccagaatctgagtcttcacatttttactctctttcttgagcccacatagtaaattcaggccacrtctccatatcagtaactcaactattgcagaatgactcaactaacagggaacaaaaggatttcacaagttttctggagcattgcatggccttagagggtag

SEQ ID NO: 29433 - DNA, 201 bp, Bos taurus
tctcactgctctaggggctagaaagtccaagataaacatgctgatatgttttgtttctggcgaaggttgtctttctggcttatagaaagagagtcttcccygctgtatcctcacatcatcacctggcagagagagggagcaagctctggtgtctcatcctcttattagggtcccattcttaaggcaccatttaaccattgt

SEQ ID NO: 29434 - DNA, 201 bp, Bos taurus
ataaaagtatacacctcaaaggatcgttgtgacctaggcgctgttgaaatatatgtaaggttttcagcacagtacctggtacattttacatgcccagtaaktgattgttattactactagtagtattactaggtacctgtctttgggcaagttattctttctgggtttcaagtacctctcttctaaaatgaggatataatt

SEQ ID NO: 29435 - DNA, 201 bp, Bos taurus
actctctgttagaggatgcctgcgtgtgagcggggcgcgcgctttggcaccgtccccgtttaagaagcgttctgtttgcaaagtactccaaaagtgacgtyagtcacaggtacttcttaaagtctaggatacaatgagaaaaggaaaaatgtttgtattttatattacgtgattccaaaattatgtttggtttatttcagg

SEQ ID NO: 29436 - DNA, 201 bp, Bos taurus
ttgttactcaaaatgtttacagtgaaatgagactgaattgagagttgaaattctgaatcaaaatattggaatttttagatcaatcaatttagaaaagaaartcattgcattaataagaaactacaaccccttcaacaaaataatgccctcatacatttctaaatgctgtgtgttttcatacataatatgtcatttgtcaca

SEQ ID NO: 29437 - DNA, 201 bp, Bos taurus
ttacctatgcagcacttcagggttcacaaaggactgatatattttttccttaccacctgctggtgatcagcttaaggaatcagaacttcaggcatcaatarttaatttgggtattttgccctgtggaagtaaactactgattctcagtaggcactctgctcaagtttgctcactgagctcaggagggtggagtccagaagg

SEQ ID NO: 29438 - DNA, 201 bp, Bos taurus
ctatttcagtttcaggaatcctactctttcctcacatgtgccattacttggatattaaagtaaaaaagacagaattttcagtggtagaatttaatgttcargactcttactctacagctgcaagcaggaagcaattatttttatcttgattacttaaatattttgagattcatcctgttccttgaagactttaaagttttg

SEQ ID NO: 29439 - DNA, 201 bp, Bos taurus
ggcctctctgtaccatgggccaaaccaaaggttaatagtccacagatagtctaccagggtcaacctttaagggacagagcgggcagacataggagtaaagyggatctggaagggccaaggagaggtatccagtacacagaggtacaccatttttttcatacattaaacaacattatatttcatggaatttgggaagaaatt

SEQ ID NO: 29440 - DNA, 201 bp, Bos taurus
ctgcttaaaaaatgcaaacgatgcctttgcctccgtgtggcctgtctctgccaagaaggcagtgaaaggaagagaacgccccactgccgagtgtgccgatygcccaccccaggcccgagaaaacaacagagggtgaccacagccgtcagtggaggtgactgaaaatctgtaaaggcaggtgactgaaaatctgtaaaggca

SEQ ID NO: 29441 - DNA, 201 bp, Bos taurus
ataattaagccaatgcagaaagccaaaaattttaacataaatttgctagcaattttatataattgtattttggtaatgagacaagtaaatgttcatattaytgagaagaaaagggtcaaataccttaagagctttgaattgttttgtattttctccaattgatctatttctttggataatctagcaatttcttcttccaga

SEQ ID NO: 29442 - DNA, 201 bp, Bos taurus
accagttggtgacctttgtgttgggcttggttcactggacagcccccttgtgaaagaatttatcacctcctttgctagtacagagcagagaaagggaagaratggagggccttgtttgtggagctgtgtgaagacagagaagaggtgggcgaggggagaagccacagcgagaccctcgctgttctgagcagactgggcccc

SEQ ID NO: 29443 - DNA, 201 bp, Bos taurus
atatatacttaatttcagcttcctcggtgatacagtgaatatatgaattagaaaatataagaaaatggaattaaattttagataatcagaatttttaagtrgaaaagttggagaaggacagcctgttctagaaacaatttaagcagccaagaactgaggaaaagtagagtagagaagaagcaaactggtacctagagagtg

SEQ ID NO: 29444 - DNA, 201 bp, Bos taurus
agcacttaatttcactctcagacgaccttacaaggtggatgcttttattatctccattttataggcaactgaatctcagaggtattaaataatttgcctgygatcgcaaaatccgtagtggcaaagccaggatttgaactcaagtaatctgattctaggatctaggcctgtaaccactatattatgcaatcaattttgatt

SEQ ID NO: 29445 - DNA, 201 bp, Bos taurus
aggtgccctgcctctaatgcgaaagctttgtcacatgctgacagacattagatgttagtaaaatggatcttgtctggtcactgctgctgagaagcttccaytggagcgacactgcccacctgcaggataacaagtacaaactctttcgtctaaccccaaagacccttcttaatagcattgcaacaacctaccttttcaaat

SEQ ID NO: 29446 - DNA, 201 bp, Bos taurus
ttgataaagcaatcatcatagaaagaatcagaccagagattagatatctaggtatgtagaaagcccagaaacacattttcattgctgaaattttatctcarccttaaagaacaggtcattataaagctgtttctaatccagatcataggagaatgagtatatcatttgatttgattttataaggttaatataatttaatac

SEQ ID NO: 29447 - DNA, 201 bp, Bos taurus
gacaaacactgcaaatgggatttgggagaggagtgtagactgagttgcatttggggccaaagatgctgtggaaacgtttaaccttccttttctttttcagragtgatctacattcttttctcataataccatctaaatttgcataaaactagtatactcaaagggtttgttgcctgattttttggtttaccattgttatct

SEQ ID NO: 29448 - DNA, 201 bp, Bos taurus
acaatcacaaagtcaaagaaaccggccttgaccattctcttatctccactttgtccccactttgcttgtccctcatccctcttgtcacctgccagaggcayatgtctgcattccatggcccttccagtcaagagaagcccaaatttcacagttcctactatctcatcatcctggttcagctagcaaacagtaaaaccatga

SEQ ID NO: 29449 - DNA, 201 bp, Bos taurus
ttttacttattgttacaaattctaaagaagagttggagatgctagtctatatgataggatgttacaaaatattctttagggttgaagtttttgtttccttyctgtctaataggggaaaagaaaacatgaccactggtgcatgcacccacacacacaacacactgtagcaaatagagcccactgttaatatacataaatcct

SEQ ID NO: 29450 - DNA, 201 bp, Bos taurus
gagagatttggagaggcattttatgtgattaaaaattctgtcagtggttgctcctcctaaccacaactgtctttgttttctatagctgtgcaatgagttcrtacacgctagtgacttacacaatacccattgtcccctcacatgttcagtaggtcagaagtccaggaaggcacgctaggttatcagcacaggctcccacaa

SEQ ID NO: 29451 - DNA, 201 bp, Bos taurus
cgtgcctccattttgtcagtaatgcctaacgtggctcccgacagatattattttctttccattttgtgggtgaaaatacaaaaaaaaaaaaaaaagcttaygaagagaacctgcaatggttatcagctattcgttttcagatttattatgtatagcctgtgtcattctgtaactccaactcatattactagagttgcttcc

SEQ ID NO: 29452 - DNA, 201 bp, Bos taurus
tatcaagggcatgagtagaaaatagactagaaggaaagcagacccagaagcaacaccagaactgacaggatccctgggtcagtgagcagtggccacacccytcccattatggagtatctggagtgaaaatgagcttctatgttcccttgagacaatcccgcctacagggatgtctgaatgtatggccactgcagtgacact

SEQ ID NO: 29453 - DNA, 201 bp, Bos taurus
tatgggcttggcaatctgagtatcctgtaaaatcatctttcttgatcttaaaaaatatgtgagcactagtcagtgtaaaatagaaatccatatactatgcmaagtttatgctatattataaagaatcgaacaataaaaagtgtttttaatatattaaccacacctttataatttctattggatgaattaatttgacagagt

SEQ ID NO: 29454 - DNA, 201 bp, Bos taurus
tgactgattattaaacgaattacaaaatgtatcctgtcttggactggctcctttgttaacacttgtgccatattattccttttagaaaaggtttttaattrtcttgatatatgccaacatactcatttccaaatacattggactgtacattggatatccttaaaaatagtttcatcactcagtaaattaatattgaataag

SEQ ID NO: 29455 - DNA, 201 bp, Bos taurus
catttgagttttatttttgaaagtaaaaattttaaagaagtgtatgtatatgctctatttcagctgaccctctgtacctgtggatgtactttgccatttcrtataagggattcaagcatcctcagattttggtttgggatgaggatggggaggctgtcatggaacacatccctgcagatacttagggacaactacatatgc

SEQ ID NO: 29456 - DNA, 201 bp, Bos taurus
ccattttctttggttcatcctttttccaggtcacttaaagaacaggacatttgagggcattttgataacacaactgaatggaactgccttaccaaaatatyccagagttaataaatattgaattttacaggattttctttagacttagtacactctgactatatacatttgggaatatagttgaaattctgtgtgaatgta

SEQ ID NO: 29457 - DNA, 201 bp, Bos taurus
tatatctaatgtgtatatgtacacatacctacttttatctatatatgtagcaatatcatatataatgtatttgattcatttatcttggattacttctcatyatgcaaaataaattagttctaacttttgctatgaagaaatgcttttttaactgccatgtcagtgtcttcctttaaaattcatagatgtattaaaatctgc

SEQ ID NO: 29458 - DNA, 201 bp, Bos taurus
attctaaaaataagactgctgttgaccccattctttaagaattcagttttatgagatcattttctttctttcaaatgaacattgtaaaaatatgaactagktttcaacttaaattgaaaacaaaatttaggaacatgcaatatattcatattggaaaattcataaaaaagttctttgctttttatgtttaatataaattta

SEQ ID NO: 29459 - DNA, 201 bp, Bos taurus
ccatgaaattcaagatggataaaagtcaatgtttcaggctcatctacttccagctttctttctataatgaggtaaaaacaagctttaagtgtgtttaaagrctcttctagtttaaaaaagaaagaaaaagaaaaatagctttatcagtttctgtatcaagttctaaaagatagtttctattccaatatgctaaagattatt

SEQ ID NO: 29460 - DNA, 201 bp, Bos taurus
atcacacggaaaaacagaaacttggtatttctttggcaagctagactcagaccactatgacaagaaggagaaggaggattaagatggccaggagagaggasactcagaggacagtgaggacatgggtgagatgaatgattacaatgagtagcctgatgatggagaatcattgagacggacacgaaagcaacagaaagaatt

SEQ ID NO: 29461 - DNA, 201 bp, Bos taurus
acacaaaaacaatctggtcattgcctaatgggatttgcatctacattaagggaaagtaaataaaatatcacaagaaagcaccactgatttgtctgatggtyattatcatctcatcacacgtttctgaaagaggaaatggaaaaggccagaaggaaaaataactaattacatcagatctgacccctcctaaagtgcttgggg

SEQ ID NO: 29462 - DNA, 201 bp, Bos taurus
ttaaactggcaatactgtggagcagaaatccccaaagtaatgggcttataccccaccacaagaggaccagatgagagaagggaagtaaatagttgaacttytatgtattataattttttataaagcataaagagaacaaaactaagcttgataatatgtatacatggtttcataccagtgacctcacacagttgtatgttg

SEQ ID NO: 29463 - DNA, 201 bp, Bos taurus
gatccatttttcactgtgagggaatttggcatccttcaagttttactaccactgaatggaagatcaagttaagcttccaccctgtaccttaagcaccctaytgatttgtaacagcatttatatgaaagtgaagagaagtttatcatgcagaatggactttaaaatttttagatttggaaacatactgatggtagtccagac

SEQ ID NO: 29464 - DNA, 201 bp, Bos taurus
gggcagagggggcaggtggcagggggaggtcaggggtaaagtagacagggaaagcacaagaaaacagacagtaaattaattataaggtcatgtcaacagaraagtaatgcacaagacaaacagctctttatgtaaatattaagtcagatttatttcttatcacttgggaaaggataagttttattctagaaatgactgtat

SEQ ID NO: 29465 - DNA, 201 bp, Bos taurus
tatattcccaaatattctaattggtttttcatttatattttaggatcatttttgtggctttccatgatgtctcaaagcatgggtgatgataactttagtaktttagatgctaatgaagcagaaatcgaaccagaaaacatgagagaaaagttcttcagaagcttagcagtgttactggaaaacaagagtaataacaccaag

SEQ ID NO: 29466 - DNA, 201 bp, Bos taurus
gccttaagactctgatcttgaagactcctctaggtccagcttactcctgatattcattgttatttcacatttatttgggtctgcatgatatgtctcaaatrtctccagacttggcctttattaagcaagttctacagccaagggtctccacacccaagtagccagcgccagttagcataaacactgtatcaactttcaaaa

SEQ ID NO: 29467 - DNA, 201 bp, Bos taurus
gaaatgaatttctcatctaattattcatttctgtttatatattctttaatgatatgtttctatggttaccagcgttgttaaacgctgcctgtgtttcattytgctttgatgctatttgaggtagcatgccagcagaagaggttcacttgtaaatgaaagatgtgatttaggcatgtatttgacccaaggttgcgtgttctc

SEQ ID NO: 29468 - DNA, 201 bp, Bos taurus
aatgttcatccccactaggtatggtgtcagaggaggcctagtagatggtcaggattttcaccagcccccaacaatcatgagcttcccatctcaatgtgacrtcagtgaaggccacatgaggagtagtgatgaggtactgctagagagttatcagtgcaaacatagtgaggagcttgaatgtttgaatgctcatccctatcc

SEQ ID NO: 29469 - DNA, 201 bp, Bos taurus
gggcccagctggggtctacttgatccaggaggatcggggagaaagtcagtgtgattcaggcacgcacagtcattccagacaatgcattcttcagtgatgaygcagtcttgatattatcaaaagaaatgtttatttccccccatctttagagctattttaccagcactgtattgctttcactgagagattaactacaacact

SEQ ID NO: 29470 - DNA, 201 bp, Bos taurus
gtgcttgtatggtggttaatggtcataattttccctgtcttgtgcctggcaagcatgcttagtctgagtggaggcaatagtggtggcctcgctgggaaatkagcctgcttgctgggtctatagcaggatgccattgtcgtcctcctctggactttcatgaaaacttgagcctgtaaccagctggctcgaatgttggcccac

SEQ ID NO: 29471 - DNA, 201 bp, Bos taurus
gggtctcctaaggttgcactgagatgttggcctgatctgccatcatctgaaaggttgaggttggaccagatatgagagccagatggaggctctcgcctggragcttggccatgttcaggggatgctccagcatcgtggcccttgggatggcaaacttcttagctggtggtcgtcctttgccagaccaagtgttccaatgga

SEQ ID NO: 29472 - DNA, 201 bp, Bos taurus
acagggaggcccggcgtgctgcgattcatggggtcgcaaagagtccgacacgtctgagtgactgaactgatctaatctgacccattggccttttttttttwaattgagcttgcatgagctgttaatgtattttgaagattaatcccttgtcagttgtttcatttgcaaatatattttctcccattctacaggcctttagtt

SEQ ID NO: 29473 - DNA, 201 bp, Bos taurus
ctatctctctctgctatccctccatcatttttagttttgcttgctccttgggtctgccttccccttgagccttagcccaggtcccacacacaggcctgaargtctaccacagtcaactctgacacaactgttaggacccaaaggaaagagtgaaggctcgagggaatgaggggctctggggacagaaagaggcaaaaaaga

SEQ ID NO: 29474 - DNA, 201 bp, Bos taurus
gcgcagcaccctccagatacaggtaggtaggtattcattaaaacataaatttccagaggtactgcttatctgtttttgctcatcttaatataaaaatcttracagttatggttcgagttcacctggatgagatttctatgtgtaaccatacctaaaggggttctttaattaaaactcttatgaacactcagaagtgttgag

SEQ ID NO: 29475 - DNA, 201 bp, Bos taurus
gtgccgttttcttctatcctggatgaatggaagaatcgtggagacatttctagggcacagaggacaacatggggtgaattaataaatttgcttctgaaaaygccgagtttaacataatgcaaggacattgctatagagtgcatgtttgtgtcctcccctcaaatttatatgttgaaattctaatgcccactatgatggtct

SEQ ID NO: 29476 - DNA, 201 bp, Bos taurus
ctatacagtaaaattttttacaccctgatttcctagtgccggtggctcaggaaggctatgaaatcttccataacttaaaaggaccatatgttcattgagarggaattactagaaatgatgaacgtaatttttcttctttgtcatgactcaaaaaccaagttgggtctggggcagggaggtgaggcctggcttcagataagg

SEQ ID NO: 29477 - DNA, 201 bp, Bos taurus
ttctaaaaataaaccatctcatgaaaaatactatgagagtcatggttcaaagattaataaatatttacattgcgtgtgtgtgtgtgcattttagacacacrtttagaagacaaaatgtcaaagaagagcctcgagagatgccagctttgccccgcacatctgaaaacatgatccaacaagaagaacagttcttcagtagaa

SEQ ID NO: 29478 - DNA, 201 bp, Bos taurus
gacagtgttacatacccacaagagagttttacaaatgaggtgagactgtgtaaccaacaatggaaattaatatgcttttatggtggccggagatgaaaaartggcttcattctatagccatcacaagtaagacgtttgctatttatgaagtttagattggcatttaaagtgttgagtgtatgtggaatacctaaggatttc

SEQ ID NO: 29479 - DNA, 201 bp, Bos taurus
tcagaagtgcaaaataagagaatgcaataattagaactgtcattatattctcttcctctgatgctgatattagctggttttaaatgtatttttaacctttrgtggtcgttattaaatttttaacataaaattcaaactgacttcatttttttatacttaaaaatgatttgaaagaacagattcagtttaaattagctgatg

SEQ ID NO: 29480 - DNA, 201 bp, Bos taurus
ttaccatctgtcctcatcgttaaattggctggcctgtcctctctattcagaactaattcaagggcgccaaggtttcaggagccatggcattcctgggggcrcatctctgcagatatcacgagggaaattttctagacttcgtaattcccctgtgcttctcggccaggctcctagtgtaaagaaaagttagataatgggtgt

SEQ ID NO: 29481 - DNA, 201 bp, Bos taurus
ctgtccagtgctgaggctctggactgttggagaagcgtgactgtggttgtgctgtctgcctaacgccttacaacaaagagttctttccactcctggggccrtgacacagcatatgctgcagccaaaccgacctcctcgtttccaaatgccttgcccttccccagtggaatggccacattctcacatcctgccttgctttgg

SEQ ID NO: 29482 - DNA, 201 bp, Bos taurus
cttataaactcttccacggatgatttgaacttttgcgtgactgtctgggattttttttccaaagctccgagcatggccgcctgtggtatcaaggtgttgcraaacagtatctgtgttgcgcttcctgttttaacctacctcgtttcgttcgtttcgtttcactgttcatcacagcagtgttatctccaggagacatataga

SEQ ID NO: 29483 - DNA, 201 bp, Bos taurus
tggaggggccagcactttggggcttctggccacaggtgggcaaggacttcactgtgcccttctccatctcctggctcactaagtcctggaggtaaagctgygcaggccagcatggctgtgggtgactgcgtgctgagtgttgatggtgagaacgcctcatccagcatggccgtgggtgactgggtgctgagtattgatggt

SEQ ID NO: 29484 - DNA, 201 bp, Bos taurus
ctgcatccctcgggtgtgtgtagctggagcggtctcccagcaagtaagcgcagacaccactgcggtcaaccagcatttgcagtcaccagcgcagtatcgtraatggtttcgcctacccgcgggccggcgctccctagtaaactgactgcctccagccctccgaaccaacccccggtttcctgggttactggcctctgcgct

SEQ ID NO: 29485 - DNA, 201 bp, Bos taurus
ctgaaaggccagagagatcaactccttctagagaagtatttttctctgtgtttataatcacttgtgtagtgccccctgagggaggaactggagctccacayggttaattaacttgatcccaatatggctagcaagaggccaacctggaactcaaacccagaccctaaattgtatggtatctctacaacaccatgttgccat

SEQ ID NO: 29486 - DNA, 201 bp, Bos taurus
aagagagtgaatgctacggagaggcagtttctgcctgcagagaatgtccaagctgggtctgtggcagatggaacacaggtgggcccagtggcccctctgaktgaaggagatgaagtggggaatctgggatagccaaggtagctggtgttcccgggaaagagtgggagagaggagaaagtcgcacacagagaacttcagaca

SEQ ID NO: 29487 - DNA, 201 bp, Bos taurus
cattgcctattgttgcagagagtcaatggttggtggcaatggcaacagaaataagcttgttactgttgggctcaggagccctactggtgggcccagggackcttaattcagcagaagctattcaacccttgtcaatgctgcactgaatatggctgctcaccaggcccattctccagctgtccccaggagaagctcatgact

SEQ ID NO: 29488 - DNA, 201 bp, Bos taurus
gagatgctaggcctctgagcagtttatagtcttgtgtgaatcacggaaataagagaggactggaagagcagcaagcatgagggccaggaggagaggaaggyggaaggtgggagcctacctaagtctaaggaactgctaaacaagcccccgtcattcaatcacccttgatggtcttctctatcttctccagtgagtaactgg

SEQ ID NO: 29489 - DNA, 201 bp, Bos taurus
tgtaatattatttattacaagagtggttattataaactgcatatgactgtgaatcacttactgattaaaaatagcgagttcaaacagattcagtccatcaraagtcagcaatgtaacattcgttatacaagggatttcatgtttccggctatcagaattttgtaactccattgtaccagtggttgatgtggcacttgataa

SEQ ID NO: 29490 - DNA, 201 bp, Bos taurus
ttcttattttgcctctgctactgatatgctaagtatctcctttcttgctttgatttgccactttttaaagtgaagatagatgttgggtgagatgatgttcrttttctttcacctccaaaatcctcctaatgattccaaaaatcatcttagacatccagatatattttattgtacccttttttctaagttgccatcactcct

SEQ ID NO: 29491 - DNA, 201 bp, Bos taurus
aaatgtgttgttgaaacgctattcttgcaatgcatctgtttagaaagcaaacatatttaaaatgagataagtgaaaataaaatattgcatcacacagagcytttcagtttaaaacaggtgggatcttgaattaaaagcagcatgagtggaaggcattataaaatatacccacctgtggtttggagctagaaagtttggggc

SEQ ID NO: 29492 - DNA, 201 bp, Bos taurus
ccatggggccacaaagattcagacatgactgagcgactttcactttcaggggactttcattgtcttaaaaaggaatgatgtggtaagaggatttgagtatrtgccttttctcttcaaataagaagtattaaagatgggaaataatttaagagagccgtgcatcagcttatcatggtcaggttaccattttgtttataattt

SEQ ID NO: 29493 - DNA, 201 bp, Bos taurus
tggccaacccaatattagtacattagcatagagaaaactatgtaaataaatacacatgtacattgggcaatgcatgctgaaaaatgttttactgacagggwctgtgacagtaaacatttgaggactgttgttctggattatattctttatgagagcagagaacctctgcatcttgttcagccctttgctgtgagtggcagt

SEQ ID NO: 29494 - DNA, 201 bp, Bos taurus
tatttcctgcttctcccagaactccttggcttctgaaaattttccctccaagactctgctcctcctccatcaatttgtgtgccttctcctcccccaccagycatccagggcaatccttttgggtttaaaataccagccagtttctcttgcttggaaccaagaatcctaactgacaaaaagttattagaatttctaaaattc

SEQ ID NO: 29495 - DNA, 201 bp, Bos taurus
gccttcttttaaaatttttctatttggacttcagagaaggcagaaagagaaagtaaaggaggcagttctagctgtgaatatgacacttcattctgattccwagtaacctaaatctaaagcccattttactaactggccaaacgatgctgttccaagagtggacctgatacaattggatggtcagattctctctctagagaa

SEQ ID NO: 29496 - DNA, 201 bp, Bos taurus
aaatactgattttttctggcattcctttaatccaactcttcctcatcttgtaagtctaaatttacttaccatttgcactataataacaaataaatcacacmaacagaaacttaaccagcatattttctgaagttaggccatgttgaaggaaaatttctgctagtgcacatccaaactggtagaactactgagacccatgaa

SEQ ID NO: 29497 - DNA, 201 bp, Bos taurus
caggggattttaccatggagggatcaggctgtagctgtctgagctcactgaccaactttagcttcactaaaagtagagcagacagtatatgcttcctgatrtaatggaaatatgaagtctacagcatcatctctgaaaaatctttactttgcaaattgaatctgaattcattcaagcctttaagctaactaacttcctttt

SEQ ID NO: 29498 - DNA, 201 bp, Bos taurus
gtcctgctacattagttactggtttgttttcccttcacacaggcatgtttgtaccctgacataaactgcatcctgtttccaagcagatgagatccaaatgyatgtgagtgattcagaacaattagtctgcaagtctgaataagcagctccagtttcagactgtaggttaatagtgtaatttttgtagaaggataaaacttt

SEQ ID NO: 29499 - DNA, 201 bp, Bos taurus
ttggaaggtttccagctctttcaaccaccagaggagatcgaatcaattactttttttgtattcacttaattagtggtgcccttgtggcccaaagatatgamaataaaaccagagaataaacagtttataagatggtcacttgggccttgatgagaacctacatttagaaattttataaaagacatctgctgaatatcatga

SEQ ID NO: 29500 - DNA, 201 bp, Bos taurus
gctgcagaatatttcactgtgttaactactgagaaaagtttgtgtgtttacaaaggcatagattaaagaaaacatttcaagagccttctttcagtagaaaygcactttagtccccaacagattgatctagaatcttcagaaaaacaagtgcatattttcctatgagagtgtgaagaataactgataggcaaataagggaaa

SEQ ID NO: 29501 - DNA, 201 bp, Bos taurus
agtttaatgttgctcattgttaagaaaataagttctctgagacatcttccctagctttccttgtctgctcacataaaaatttaacttgagctatatacggrgaataactggctactagtcatttaattcaggaatgtaaccttgggaaaggagtctattggatagattcttaatttcaagagccctttgaatctgaaagta

SEQ ID NO: 29502 - DNA, 201 bp, Bos taurus
tttttgacaggtaacctgtttaagaattcttacaggaagaattttaatagtaatcttttattaaagtgtgttttttaaagtatgacggcaggaataatatmtttggccagataagacttaaatctatccatctcagatgctttctttcccacatacactgtaaataattaacacatattagttggatgtgttaatgtttca

SEQ ID NO: 29503 - DNA, 201 bp, Bos taurus
acagttattcaaaaataaaacatttggtaaggatagtaaccttctgaaaggcattgtatatcagcatcctcaaaatctgaagaaaattgggaagagagagmtcagaaaagcaacaatatctatatgaacactgaatagatatacaaactgaatagatagaagagggaatttctactatgtgttaaatgcattttatacctt

SEQ ID NO: 29504 - DNA, 201 bp, Bos taurus
cactattttggaaccatcgaagttaactcacttatcatctctctgacaagtactataaagacagaccagcaatgtgtgaacaaaagataaatagcagcagrtctgtggatggggaaattcaattcccaatgaactgaatagagtagagatgaccttggctgtcctttctggaatatgtggcatatgattactctccagtga

SEQ ID NO: 29505 - DNA, 201 bp, Bos taurus
tcaataaggctaaaataaaactggaaatgcccccataaaatactccctacacaccatattagcaagcactaagtaccaattgacagtgatctaccctgggragggggcaagagtttggaaacagattctttcttaagttttggctaataggaaaagactaaaattgagaaaaagcctccagcagtccaacccttacttagg

SEQ ID NO: 29506 - DNA, 201 bp, Bos taurus
gacatttctgtgtttcctatttttactctggacttccataaagtacttcaacacagagcatctgagtcttgcaactttcaactatatcctactattattayatacaaccctgttgatagaatggtaaggtgggggaaaataattaatctctaatattatgattaaatctgtcttttatgtaattatcttttgataatattg

SEQ ID NO: 29507 - DNA, 201 bp, Bos taurus
ttgatttcagtgcattccaaaataagaaactgttcttctctaaattaggatacaatgtgaatagctttatctgtttaggctacagggttgtcagactttamgttgttacaagtatcactggtgggaaatgattcagcatggaatccatggccagactcagtggaagaatcacaatctgagccactggacatatggaacaaa

SEQ ID NO: 29508 - DNA, 201 bp, Bos taurus
agttttgttaatagaggaggtccccctccaaagcctctccagtactctaccctgtgaatttcctacatatacagaggcctgaagcccagctttagatgcakcttaagcttgaggagccacacactctctcttgtcaactcaaacactcgtacttttactgaatgccacatcactactgttgggcccatcattatgacagat

SEQ ID NO: 29509 - DNA, 201 bp, Bos taurus
gtaattgttagtaaacgtaagtgggcatattagcagtagaatgatagaaccgaggtaaagaaaaggggctggtgatccagaaagtatataagcatctttayaaagaacagagatatagaaacaaaccctcttgtcttgttggaggaccactgagaccaacagaatgccagtaagactcttggattccactcataaagagca

SEQ ID NO: 29510 - DNA, 201 bp, Bos taurus
acacacacacacacacaagctgaaagtatttaattattgcttaaaaggttagataaaaaggatcaggaatgtgagtcatagatttaggcctggttcaccarttcactgcttggtttgagtcaatttcacataattaactttttggaaaaataagctgggaaaatggaataatatgggtactgaaggcccacatatagaaat

SEQ ID NO: 29511 - DNA, 201 bp, Bos taurus
tgaatgggttaataaacacgtgaaaagtattacatttcaggtagtgcaaaaattgaccaccaggagattccatttcagaaaatatataaatccaaattgtraagtttcaatcatactgaaggttgagaatatagcaaaacagggacactctcgtgtgtcctggacagtttccagtgtggtacatctccagtgtggtacaaa

SEQ ID NO: 29512 - DNA, 201 bp, Bos taurus
gatctagactactttattaccaaagctttaacttcttgaaaaaattaggttgcatatatgtcccaatttagaaatgtccagccatccaaatcattagaaakgtgtcttatttattttgttattcaatgctctattctcattttaataatacacaaatatatagaagatactataataaactgaaacagtctgtggcccccc

SEQ ID NO: 29513 - DNA, 201 bp, Bos taurus
attgtcagttagtttttcagaagttcactatgcccttgaatactatttaactgaaaactgagacacaaaatttctaggaaaaaaaatggttgaaagaaagwttggagggtatagctatcaaagagaatttttgtataaaaaagagatttggaagcttaacagtaataactactgaactcttaatatatgctagacattttt

SEQ ID NO: 29514 - DNA, 201 bp, Bos taurus
tgtctcctcccactgaagccagggtgaacctggaacctagtggatggctgcaggcacaaaggtcactgtctgtcctacctttgatgctgaaatattatttmtgaatttcctgagttggtccccaataaagaccctcctgcccaggatcgtttgaggctgtaaaacaagaccaagtttggttcagaagcaaagaaagcttgg

SEQ ID NO: 29515 - DNA, 201 bp, Bos taurus
gtcagaatcacaagacctaactccttcattctgggacagttcctgtgggatcaggagagggggttggggctgtgccttcattttctcagtaatgcctaacrcggctcccaatatctcccccttattttttggagcataagtatgaaactcagtacataaagcagaaacacttcagttgagtattctgaaaaggcacggggc

SEQ ID NO: 29516 - DNA, 201 bp, Bos taurus
aaaagtaagtaaactgttattaagaaagaaagaaaatgcaattaaataactcagatttttactctccctcagggaagattaaatgcatttaattataatamctgtggtatcaatttatgctttccaaaaatgggtgggagaaattaaataatatcattatcataatgatatttttgccaaagccatagagaatagcaagca

SEQ ID NO: 29517 - DNA, 201 bp, Bos taurus
cactgtgcctccatctctcactccacatctagtcttctggaaaatctgttgtcttttaagataaatgcatcatatggccacatttcactatgtccactatrtcccaatccaactatgcagtgatcttttcgtctgcatgtgtgagtgtgaagtcccttcagttgtgtccgactctttgagactctatggacagtagctggc

SEQ ID NO: 29518 - DNA, 201 bp, Bos taurus
agcacttgaactggatattgtatacttagtacaaaagagtgctgcatgtgtctaggtgatggcagaatgtcgagagcattaaagaccaattttgagtaagygccaacccagtgcagctgtggaactgcgcttctggcccaggcagagccacttctacagctggcctagatatttactaaaatttcattaagcattaccagt

SEQ ID NO: 29519 - DNA, 201 bp, Bos taurus
tctgtgggtcagtaaggatatattgtctttaatcaaaaagaataatgaattgaggcacacacagtagcataggctgaaaatctgcagtgaaatttgtcctkccctcatactattaacctaattaccatacaatttaaagttaataataaataacaggcttaaattagaccagactaaagtatgggcaattataccaagaac

SEQ ID NO: 29520 - DNA, 201 bp, Bos taurus
actggctaagtcacaagggcaagcattcctttctgcttttcttgaagaatactttcctagagatcatagaggaactatacaccatctattctgaagaaagsgaaggagaagaatttatctgtaggtttctgtaccctattattcaaagtttacctgataaggcttcaagtctcccaagattctgaattgtaccagtttccc

SEQ ID NO: 29521 - DNA, 201 bp, Bos taurus
cactaacctcctatttacaattctttgagtaaggtgctttagttaccagcactttggaaatgacaaaactgtgactcagaaaattaaggaatttgcacaaragcacatagtggagaggaaatgaagatagaattcacactgagctagaccagacctaaagcctgcaatctaatcactgcaaagtaccagctccatagaaca

SEQ ID NO: 29522 - DNA, 201 bp, Bos taurus
attgcctgtgaggtgaaatacatctttgaaggctccataaaggcaggaatggaaatattataaagaacttcaccagggaattaaaaaggcattccacattyatttttaggtttaagagtaaatgcctaagactctattcagatagtaagtttcaacaaaacattacatgcagtggctttatatataatctgacaaggcata

SEQ ID NO: 29523 - DNA, 201 bp, Bos taurus
cttttttctaacctgatagaattgaaacagcaacctgattattgacattagtgatgaatttgagcatatgtttcttggcccctttactgatcactgccttrttgtggcaaaagggcacataactcaatgaagctatgaaccatgccatgtagggccacccaagatagatgggtcttagaggggagttctgaaaaaatgtga

SEQ ID NO: 29524 - DNA, 201 bp, Bos taurus
aaactcacacaataacaaagacaatataaaaagctgtgcacctatgaaagaaattgaatcaataattaacttttccaaaacagaaatgaaaggcccagaargttcactgattaattatatcaaatatttcaagaagaaattacaccaatgctctagtaatctctaccagaagatagaagtagagggaatacttcctaactt

SEQ ID NO: 29525 - DNA, 201 bp, Bos taurus
gtggctacttatttatatatgtaatggattctcttcaatggaatttcaagtgtaagtcaccactagaaataagtcaaggattgaagggcagaggccaagtrtatgtaggtggtcacagattttccattaagtatctcaaggcacagttcacaaaggtgaaggtagttcctctttgagggcctttatggggaggtgttgagc

SEQ ID NO: 29526 - DNA, 201 bp, Bos taurus
ttctctgacaccttagcacaggctgcatcactgtgagtacatttcttgtgaactgtgtcaaaggcagcaagtattactatgatacccacattctaggtgcygataaatataaccagtatgatgactatcacagatgagaatcaagctctagaaaaggaagatcattaggttatactctcacctctcttttcctcatatatt

SEQ ID NO: 29527 - DNA, 201 bp, Bos taurus
tagtgcatttatttatgatattcaaactgatgagttaatagaagaaacatgtactgctagttagtaggaaataaccatttagtcactaatttgcaatgagrtcttagacaatttgcaatttcctggaactcagttttctaaattgtagtgaaagtgaatatatgtttgctaacatccctcccagacgttttacccaaattc

SEQ ID NO: 29528 - DNA, 201 bp, Bos taurus
tgagatatcctaagtgtgaactgatgaactgcccaaattatgaccagcagatattataagtgcttcctgttaaaaccattacattttgttgtgatttgtcrtggagccatagataatgaaaacgctctcatccaaattaatcaaacacagggagcatttctccccacatctctgaatctaagagtgtctttaaagcctaat

SEQ ID NO: 29529 - DNA, 201 bp, Bos taurus
tactggagtagggtgccactgccttctccaacaggcctccctggccctcacccatctcccaaagtttgctcaagttcatgttcattgcatcagtgatgccrtctagctatcttgtcctttgatggcctcttctccttctgtcctcaatctttcccagcatcaggaacttttccaatgagttgtctcttcgcaacagatgac

SEQ ID NO: 29530 - DNA, 201 bp, Bos taurus
tttaaatatacaaaactagttcaaaggaaaacgtgatacttttcaagccagtgaaaatatgtcttcaggtggaatgtagcaggaatgccagtttggtccaygtgtttttcactctgtcctttcacacttgcagctgaactgtgtcctctacagtcaacattccaagcctcccctgtactgttccttctgaaagcctagatt

SEQ ID NO: 29531 - DNA, 201 bp, Bos taurus
cttcatctgggctcaggttgtctacactctgaagccctcaaaagcctggaatttctgtttttgctgtaacattcctaacaaaagccatggatgtctgttgrtcagatagaaaggaagaatacgtgaattcatagctcaaacattcccatcctaacattaggttcattggccttaccctgagtatacctgggtgagtttatc

SEQ ID NO: 29532 - DNA, 201 bp, Bos taurus
actttttaaaatctacagttattacttatatcacagtagatgatacaaatgtgatatatgtaatgtatgtgtgttcatgtgaccaagaactaacagataaygaaaaaaataaatagttgggtttgagcagatttactttcatcttcaagtttgtttaatgttgtttttatacaacattaaacattacacattactacaatg

SEQ ID NO: 29533 - DNA, 201 bp, Bos taurus
taccccaaaagaccaaggacaaagaatggcattgtataagcactgtaactcaagcaattagccaggtaatggtctgtggggttcattatagcagaatgtcrattaaaacactcggaaggagattatacaaagcccttagatttcaatcttataagcgatccagcaagactaaattatagtaaatgtcatatcactacagta

SEQ ID NO: 29534 - DNA, 201 bp, Bos taurus
atccctaaatcagcttctccaaggaacctgatggaatctgagccagtgccggccaccacccaggccactgcagtgacagccacagacagctcgataacttyactgacggtctatggcaacattctttccactgctgatgggtgggagacggcttgtcacatatggatcatctaccagaaggacatttatctggactctacc

SEQ ID NO: 29535 - DNA, 201 bp, Bos taurus
tgagcgactgaactgaactgaggactaagtcttcagttcttttatcttccaccccactctaccccaccatagatgtcatcaaggcccatgattttagatgmtatctattcactgaagacaatcatattttcattttcagccctgacttctctaactaagctctgggccataaatactattatttaaccaacattcacattt

SEQ ID NO: 29536 - DNA, 201 bp, Bos taurus
tgagaaagagtatatttgtcaataaagagtgacccttttttttttttcccccaaaataggaaacaacagatttccttgacagaatgacaacttggttattygaatttatagaacaaaacaacttagaagtaattaaaatcaataaaattcattcaggaagaacatatgaatgagaacatagtttattacataagtgaatta

SEQ ID NO: 29537 - DNA, 201 bp, Bos taurus
cttttcagatatttactggccttgtagatttcctcttctgtaaattacttcctcatatcctttgtgaatttttctacaagtctaaacagggctatttgcaygggcctggaaactgcatagtcacacagggccctgcacttaaaagggcactgtattttgtataatgttctgctgttattgttttgaaattcttagtaattt

SEQ ID NO: 29538 - DNA, 201 bp, Bos taurus
gtttgagtgggcagtcccttggcagaccctgtgcccatgggaagaggcaactcatgggtcttataaagtcaaaggagggcccaacaagaacgggtaccatygctctgtatttaaggtaaatgacaggcacagaacttgcactcggatagtctcccctcacatctaacctttcttccacgtttgcaagtccttacccctcct

SEQ ID NO: 29539 - DNA, 201 bp, Bos taurus
cccaaaagcagacacccttattacaacataagaaaaggtcaacaataaacaccagaaccagaactctgccatcacattgtaactgcttgctgctttgattytgaaaaatatggatgggttttctattttaaaaggggcataaattatttgggtcaataataaggtgaacgacctcaatatagtcctaggagcagtgcactg

SEQ ID NO: 29540 - DNA, 201 bp, Bos taurus
catataaaaacctttcatggaactttatttaaaagtcagattcccaggttctaaccccaaggtttaatttattaaatctagtgagcctggacatatttttmagttcctcagatgatttgttatagctaaggttaagaaccattcactactttagatcagcattttccaacctagttgaattaagtattttctgagcatatt

SEQ ID NO: 29541 - DNA, 201 bp, Bos taurus
gaagaatattttctgaaaaatttatcttccttgttatttacattcatgtgaatgaatgccaagtaagccatatttttcaactttatagaacagaagaaagkaaaaagaacacaagcagactggctgctgttgcacgtgcttctggaagtgtcctgacagcttgagaaagacagggtggcccatcatgcaactttctgttgt

SEQ ID NO: 29542 - DNA, 201 bp, Bos taurus
tcctgagagtgtacatgcaaaggggcaactggctcagttgggtcctctggggcctcaagcttgcacatgcttgaagtgtccagctcagtcatttgcctctrgttgtaaagttctcaaacatggtggcttttgtcccagtcccagcctctgccagggattaaggaaaatctcgatgctctgagtcaaccagacgtgcttttt

SEQ ID NO: 29543 - DNA, 201 bp, Bos taurus
tggctctgggctaaacttccaagagcacagtggccacggctctggaattcaatagtccaggagttatacaacttctccttgggccactggcaagtggatgrtttttgacctttgctctgggctgtccctggtgacttggaaaaggcgatggcaccccactccagtactcttgcctggagaatcccatggacggacgggcct

SEQ ID NO: 29544 - DNA, 201 bp, Bos taurus
gactgagcagggcagagccggggtggggatgcaaacaccaggtcaggcagtggaaggaccagttaattgaatgcgggagctgtccaggcccttcatttccyggaagtgctctatgggagggaggaggctggagaagcaggtgaggagaccttggagtgagtgggcgagcagccctctgtaggaaccaggaggagggattgg

SEQ ID NO: 29545 - DNA, 201 bp, Bos taurus
gatccgaggcctatttttagaagggccctcagtcttcctaagttaccttgttccccaccctctgctctgagaaggcagaaccctgcttgtttgccatcgtktcttggccagacagtctcctctgcttgaatgcccctagtgggcaactgccctggcaggacaaggcatcactgaggtcttcaagcaaatgatctaacaatt

SEQ ID NO: 29546 - DNA, 201 bp, Bos taurus
tctcctgtgtgtcaggaccaagacttcaagctgatggctggtgaagtgcctgccctgagcctctttgggttgtgatctgggcctgtgggcacttggtaccraaacccctccagcagctccatgatcccagggctacaaggcagagatgtgctcttgcctggctagagggcaccccttggattggtttaacagattgggaca

SEQ ID NO: 29547 - DNA, 201 bp, Bos taurus
cattgatcaccaaagagtctcttggtttccaaacttatttagaatccggacttccccagaactggtccatgcaagtccatctgcatcaagaggcactctcstgtcaaagtccagggcctgggtggactccaaaccccacttgagatgtggtgttagaggtgagaaaatgtgcttccagggggcaatatttatttcacatac

SEQ ID NO: 29548 - DNA, 201 bp, Bos taurus
ttatgcatataagatctaaactgccatattttacattattatatataaagatctattaagacagatcttctatctcaatctagggggaaaaaaagtgacayatttgatcaaattaaaaatttaggagcaagttctactgttttaggtcatctgcttctgagggaaagaggtctttctttccaggtcctgatttttcatact

SEQ ID NO: 29549 - DNA, 201 bp, Bos taurus
ataaaaagtaaggtaaagaaacatcacctgagaatcaatttccccctttttttgcattagaattttttttttctcctcattctctgggaacccaaaccttmtgcagaattataagaagtttggggaaatgctgttatgcttgtttctcccaccaatgataaaaaggaaataaagaagaaaattctcactcagctgtgcaac

SEQ ID NO: 29550 - DNA, 201 bp, Bos taurus
ttgcaagatcattggccttttttctttgtttcatcgccattcccatctctgtcccagaagagaacctggcatctagactctgacaagatgattactttgaracattaggctgccatcttctcagacagcaggctctccaaataatgtcttattccttacctcaacaccttgtctctcagattcattggcctattgtgtggc

SEQ ID NO: 29551 - DNA, 201 bp, Bos taurus
ttgcccttggactggcattcaggaactggtgacttagaaacagcacgtgcaggcttagattccccaggtgtggggagatgctcgctctctgctgatgtgcrggcggcgattctaatgaggataaataaccacctttctaaaggtagctgctgcccagtgaatttcctaaatgccagtgctgctctgtttattttgagaaga

SEQ ID NO: 29552 - DNA, 201 bp, Bos taurus
tcaagcctttaactccggggcagagtgatttctcatactcagtttccatcactcagatcaaggcttccgagtcgtttactttgtaccttctattaacattyacagcgaaggtatcctaaacactcaattttcacattctttttcactgacaaatcaagaattaaatacaaactttgctaaacgcagaccttttccaaagtg

SEQ ID NO: 29553 - DNA, 201 bp, Bos taurus
tcaatcaaatttgacagctttcaaggacacagtgtggccctgaagtagaccagaattccaggcaaatggacggagcagttaggaccagcatgaaagagaarcttgccccgcaggcctgtgtgttttgagagaagactctgaatcccatccctcgaattcctcaatcatgactgggcaatacaagtgtacaaaacagattgg

SEQ ID NO: 29554 - DNA, 201 bp, Bos taurus
tcagctagggtctgaaaagcaaaaggagttggacaagtaaatggaggaattaagggaagaggctgtgatctgggacaggcagagaaaagagaagacaagaragcagtgggaattaagcattcctgtagcaaagacagaatgtgtccagaaaggacagtatcttggtttaaaagttactctctctcaattcactggaatcca

SEQ ID NO: 29555 - DNA, 201 bp, Bos taurus
caaagcaggactggctcatctcacagccagtcccctcaacagcatcagcactctttagctatgctctgcatccatccacctttctgaggctttgcacatgyccagaatgaaaaaaataaaaggcccgttttctgtctctacgaaggattttactgccagtatccactcaccttctgactcttcttgcccactccagtcctt

SEQ ID NO: 29556 - DNA, 201 bp, Bos taurus
ttcctttcgtcccgtgttccacatttcaaggtgaagccctgccttcccaaggccaatcccgtaatgtaagtggatagtgaggagggtttctacaaacaccrtcaacctccacggctgaagggggccaatgtaactgaccctttccgatcacaatagcatgcatctccctcacatccttcttctgtccatcccacctccaca

SEQ ID NO: 29557 - DNA, 201 bp, Bos taurus
atatcttccaaattccagccaagttgctggaattcccctaaacaccccaaatcacctcattctgcctcttccataatgaaatagtttctcaactctacaarttcctacgcatccttcaaccctaaaatcaaatacaacctttctatatatacaaatcaacacttctgctattccttagctggagtactgaaattcctccag

SEQ ID NO: 29558 - DNA, 201 bp, Bos taurus
tctaatttgtagcatttctccccttcctgattatacaagatgggttcattcattattaatctggtttgtcaaacagcacggccctccaagtgtcaggcttycttgtttttagccagtgagtttgtgtagaagcagtgaaatttcagaatgtacagatcagcaagctcttgtctgcacctgattaaagttagatagactaac

SEQ ID NO: 29559 - DNA, 201 bp, Bos taurus
ttccccttgttccacctttccttttcctcacgcataagctggttctgtgtttgctcagcagccttcacctacagaggtccatctggagctctgacatatcrtttctttcctgaaagagtaccacagaataagggggaagagttttgcatatattttcagaaacatactcatcaactgttccagaaagtgcagaagagagag

SEQ ID NO: 29560 - DNA, 201 bp, Bos taurus
agccactaagatcaaatggcttcttaagcagtgatagataaatgacaaagatgcttgtttcttggttatgagataataataaaacctaatgtttattggtkccggcaacagatgacaaacttacagtactttctcatttaacccttaaaatgagcccttgaagtaggtattacttatgaatcccattttgttgatgaacaa

SEQ ID NO: 29561 - DNA, 201 bp, Bos taurus
aaatatgcaattgtttactaagtaacatagaagagaatttgaattaagtggaaattttacattgctcatgaattaaataagtcatctttgaaaagatatcratacatcccaaatatcctataattttcattacaatccatataattttaattataattctattcaaaacatcaaactggtttctaggaaaaaatattcagt

SEQ ID NO: 29562 - DNA, 201 bp, Bos taurus
gggtgccaggaagatgaagcgggctgcagccgagcaggggccacaccggcagccattccctctggaactcacactcttggcctatacgccaccatctgccrgagcctacatccagtacaagctgccggctgcgcagcgccctgctctggaagcagcgagctgaggccgcacttgacctccgggacaaggcccagcaccagc

SEQ ID NO: 29563 - DNA, 201 bp, Bos taurus
accaaagatatgcttaaaaattctttgtccaaatgcttacaagtactatgtaagccctaacagaaaatctttaaggaagagtgaattcttccaaggggccrgatggaggacatatttccactaatacacacttagaagcagactttcaaacttgaggggtgggagctcccacctctgtccatctccaggtcacatggcctg

SEQ ID NO: 29564 - DNA, 201 bp, Bos taurus
tgaatcaaagtttccaggaaaggggcctccccagcctctaccagtgtaattcttgttttggttgtgcagcacgtgggatcttagttccaatcctatatacmtgtatctatatatctatatttttggcctgccagggtaattctgatacaccttttcttggatcagtatttgagatcccttggcataatatatttaaagcaa

SEQ ID NO: 29565 - DNA, 201 bp, Bos taurus
aatatttcacttacagttagattggcggcctttatttcaataggaaaagaaaagtttaggatgttattatgcaacataaaagattgagaatacgcagagayggccacaaagaaagaaattagatctcaaactcagcattaaaaaagaggcaaaatggttaattatttgcttgcaatacgtgcatgctatttttcaaaacat

SEQ ID NO: 29566 - DNA, 201 bp, Bos taurus
attttctgaaaatagactcatttccgcagatggatgaaatgagttctcaccagcaaacaatgaaatgtgtcatgtgaaatttcaaggtcccttctaaagaycctgtgattccatgaaaacaaagtggggaaagaaagcaagttgcatgtatgaaattaggtagatggttaaaactaattcattacccttattatttctgaa

SEQ ID NO: 29567 - DNA, 201 bp, Bos taurus
gtcacagcttaggaatccttagtacataaggattctcatgtactatgggttcgttcagtgtaaacaagcatatggatcctctaggtcagcctacgtctccrggccttgtacttaggacagtgaggtggtctcaagcactgccttcccttggagcaatggctctcagaccttcatggatgtcagatcacctggaggacctgt

SEQ ID NO: 29568 - DNA, 201 bp, Bos taurus
agcaccctgcactctatactttgggggagaccctgaggtgagatgtcctaccctttctcaccaacaggtcggtggctgggagccaggcccacccctttccytgctctccctttttgctctggcaagcctgtactgtggagaagatgactttctccccattatgctcctttccagggttcctatgaccatgggcctgtatta

SEQ ID NO: 29569 - DNA, 201 bp, Bos taurus
gcacacccacagtagtcagcactgccacaacagaaggcccacacagtctacataagaatatccatacagagtatagctttcatgatcagaggagagtgtgyttgttgggccccataggacatcttctacataaggccacttctcctagatcagaagatataatcagcctacctaatacataaaaaaaacatagagaattaa

SEQ ID NO: 29570 - DNA, 201 bp, Bos taurus
ccagagtggggacgtttggaatcaagaatggagagggcttgcaggaggacctgtgcccaaagattggaacatgtgagcatttgaatcagaaaggccagaaygctggaggtcaacgaagagcctggaaagagtgttgtcagtgtccttggtgtgtttggaccaaggccaggctggagctgactgaagactgggcatgaggaa

SEQ ID NO: 29571 - DNA, 201 bp, Bos taurus
agtttgtaccaccagttaaaccctaaatgaggattaaaaagtaaaaggaaactaggggtcagtgaacaatagtgctaaattagagataaactggggtttcrttaacatgggggacagggacactggaagatggtgggacagagagcctgcatcggttcctacctcttcccaggaagcccacgctctctgtgatgtaggact

SEQ ID NO: 29572 - DNA, 201 bp, Bos taurus
gcatggagctgtgatgagagatgcctgatgaactagaaattacctttctaagcaactcttaccagccccacagccatgtgtggccattaaactagtttttracgatggacagagattagatcataaaagatcttacagagcatggtaaagagtttagattttattctgcagttggtaggcaatcattggattgttttaagc

SEQ ID NO: 29573 - DNA, 201 bp, Bos taurus
aattgtcttgctccttgttaaacagggtttcaaacctgtcaaagagactgcatccaggactgagcctcccaagccttccttccacagaagagtgggagagygctgtggggtacagccagggccctctccctgaactccctgctaatgtagcaccatctcagcatagtctcaactgcctgcagagcttcaagcacgcagcag

SEQ ID NO: 29574 - DNA, 201 bp, Bos taurus
ggggtagtgtcaggatgattctcatacattacatttggtgcagactttattctaatctaatgccaccactgatctgacaggtgccggaccttggcccagargttggggacccctgctataaaacataaaatattcaaatgataaattcttaaactctgcaaataaaattaacataatcttctcctttaattttaatttctt

SEQ ID NO: 29575 - DNA, 201 bp, Bos taurus
ctcagagttgtataagttcttgaacaactttattgttctcaaactgcattctaaacataagacctagctagactgcagttactgatcactgcccaataackgaattgaggttccagggttcctaatttctacaagtattattatagtattcaaactcctccctcctaccctattttttttaaaatcaagttataatttacc

SEQ ID NO: 29576 - DNA, 201 bp, Bos taurus
ctagttgcttaataaatatggatgttctgtccaggggattttcactctcattatggaactgatgttgcattgccattataatcggtttacagctttccctrttatctctgggagcgctatcagggtggaacatttctaagttccactgtgaaaagctgtcatgttaacctctcagctggtcctcagatctgaccaactctt

SEQ ID NO: 29577 - DNA, 201 bp, Bos taurus
aggccttacgtgctgcagtccatgggtcagaaagagtcagacacgattgagcgactgaaatgatctgaactctaacatctgtcaggtaaaatgtatcttcrgaggagaagggccacatgaactagcacaaaggagctttacaggagattgaagtagaagacagatgataagcacatgagaagagctgggaatctgaaatca

SEQ ID NO: 29578 - DNA, 201 bp, Bos taurus
ggcctctctctctctcaattcccctctcattccaatcaaggaaaaaaaaaatctctctttataacagacttcccattgtaccacaccagaactggctcacrtggcctcctgtagctataggtgagcctgacaaagtaagcatttgaagttttcagcctttcttatgagaagcaggctctgccagtgtagaaaatcgggtag

SEQ ID NO: 29579 - DNA, 201 bp, Bos taurus
tggacaaggaatcatagcatctcaggaattcaaaggaatggttttagaagggtgacataggctccaggtggcatatcacgtacctcatggactccgtgccrtggggaggagtgaggccagagaaggaccaataagcacacaacagaaacacagaacaggactcaacagggtcaaatctaagtgtaatacagactggagtgc

SEQ ID NO: 29580 - DNA, 201 bp, Bos taurus
agacatggtcctccccaccagaggggtcgagacttggctctacccatcggtaggcaggcaccagcccttctagccagaaggcctgcacaggcctctagacmagccttacctaccagcgcattgacaccagaagcaagaaaactatgatcctgcagcccacagaatgagactgccaacaataagtcagaccataccctggga

SEQ ID NO: 29581 - DNA, 201 bp, Bos taurus
acccagtaaatagtttgttgaataatgcatttttatgagttagaaccggaagaaatgtggtgactggtggccgatgagaagtaagacagaaaaatacagartatgttaatctgtataatctgttatcatggtctcttttcttttctcagtgttcactaaccccagttgctacagaatggaatcatgattacctaactctgt

SEQ ID NO: 29582 - DNA, 201 bp, Bos taurus
ccccctttaacatctccagaaaaagagttaaattgcacattttcatctgccacaggtttcttttaggtccagaacgtccaaaagctaatctggaaagcaaygtcgtatagtagacttcttgcactttttcgggagagtgtttgtctttactgaaatctcacatagatctctagtacaaaataaagaacaagtggaactatt

SEQ ID NO: 29583 - DNA, 201 bp, Bos taurus
accaaaatttgttatttcattattggcctttgttcttttccattttatgtcttgagaccctgtgtgacatttcaggttatgacatgctccatggtttgctyttccctggtttttcacatacagaaggacatttaacatcactatttccatccaaaataacagtagtgctcctttgaaaatggtgaaaatcccagaggtttt

SEQ ID NO: 29584 - DNA, 201 bp, Bos taurus
gatcacattacctagggaatcagagcagaagtcacccccattttggaggattctagataaatctttttatctcttgccctgctgttggtttcatgtctcckaaagtactgtaattgacgggctgggcattatatactccaagtatatgttttgtcttttggtttccccgcccccaacaactcttgtacttagtgattttcc

SEQ ID NO: 29585 - DNA, 201 bp, Bos taurus
gatgacccatagaatcatgatcttacaaaatggtggctcttttatgccactaagtttttggaaggtttgttgtgcagcagtacatctttagaacagttttmaatatctgtggatattttcttagttctacttatactgcattagctaatatgatctcacattacttttctatcacctaaacactgagggttcagacctcta

SEQ ID NO: 29586 - DNA, 201 bp, Bos taurus
atggggactttgaagtgtgtgctttctgaagtgccgtgtaaggtgagctgatgcctgtccctcacccgccccttttgtttggtacccagcaccatttctgygctgtgagagttctagggcattgacggtggtactttttaaagtttttattttatattggagtagatccagttaacaatgttgtgatagttccaggtggac

SEQ ID NO: 29587 - DNA, 201 bp, Bos taurus
atgcaggtaggtgcccagaagagagaaaagaatagcttggataggaaacaatgagaactatgacaaaacctagcaatttaccacttctgtacactaacttrcacatcagtgcttaaaatgacaattacagtttccacaaactcaccatgcatttccaaggggaattctatataagcagattattcaatgcctatctgccta

SEQ ID NO: 29588 - DNA, 201 bp, Bos taurus
cacatcatttattatgatacaggtatctcaacactcagtctcatctcctagctgataaatcaggtactggaatgcctctcctttctcagaatgataaaaayatgtaaactatggttaaaatgcactttaaagatatgaagcctttggtactttaacaataaaattccctcaggaaaataaaatgctgttttcttcacagta

SEQ ID NO: 29589 - DNA, 201 bp, Bos taurus
caatcagaccaacctcaggaaaaattgccaataggaatagattttctttggtgctaagcatctcctggttctgtggtcaatgccctcttctagcttgccayacctagtgtcccataaacctgtgttttgttccatgtagggcctatcaataactacattttgatctttacttcccattcaaccgtaattcagtattaagaa

SEQ ID NO: 29590 - DNA, 201 bp, Bos taurus
tatattgaaggaagttttcttaaagaagtgtcttaaagaagaaacagaaaaaataaaaacttttatggaactgggttgttaggttaaagtgtcataatttmttttccttaaaaacctaggattccttgaaaatgtgctgagactcatggatgtattaaaaagggttgcctctagatagtttagtgacagtttagatttctt

SEQ ID NO: 29591 - DNA, 201 bp, Bos taurus
tcccttcagcagaatataggtgttctaagagtcaaatttatcttttcatgttaccaggggtatatataaattgtatgacatttgaattgtatgtgcaaatrctcagttcactgtttgcagtagtgaatatctattttgaatcataagaagtaagactgaatatagaaagcattgttctgatgtcctatagctttctgataa

SEQ ID NO: 29592 - DNA, 201 bp, Bos taurus
tcctcatcacctcatgaaacccatgtgtctctaaacccacatatgtcatagtccagctgattagaatacttggcccataagctctatctaccttgcaccaragttaacagagttaaccgttaggatttccatctgtaatacttctgaactcagtttttgtatatagacttcatcaacacttgattttatctcatctgtctt

SEQ ID NO: 29593 - DNA, 201 bp, Bos taurus
cttccccatgtgattttcaggcaaattgtatgaaccaagtttgcaaatcctaatgataaggtcagaagaaggaaggtgtacaggtataagaaactggaagraaaaatggaaatgtgggacagtcaggaatgtgaagggcaatgtcagaaatctgtgaagggtagctgaagcagttacataacacatctcctcctagctgtg

SEQ ID NO: 29594 - DNA, 201 bp, Bos taurus
taaagacatacacagtgcaatttaaaaattattttccgtggacacagactatctaaataaattaagtgataagtatttataaatggaatctttttcttggmaactcttgatttcatgagaatttctctatgtatattaaatacagtcattgctctgacatgctcaacttaaactcttaagccacttacttgtaaaaagcac

SEQ ID NO: 29595 - DNA, 201 bp, Bos taurus
attttaagtgaataaataatatgtccctcaaccttaatcctgagacctaaacctcgacatcattgaactgtaatcttgttgaatttaatctcatggcctgyatccttcctttcttctgaatcccttgtccaatcatttttcaaccttttaaagccatgaaagaaattggtactgagtgcatcccaaggcagacttgggatg

SEQ ID NO: 29596 - DNA, 201 bp, Bos taurus
gtggttctgccataggaaaacataagtttgttttgatgtgtttcctgaaaaaccagttgtcatatatgccttaatttaaaaataattagtctttttttttkggggggggtaattggaaacatgaggaggaacattgtaaaacaccccaaagtaaacaaacccagttggcagagtaaattagttttgatttacatgcaattt

SEQ ID NO: 29597 - DNA, 201 bp, Bos taurus
cccaactgctgaagcgaccctggtggagcagccccacccgcggcctgtctggggagagcctgggctctgtagctccagctggtgcctcttcattctttgamataaaaataaagatttcctttgttttggaggcaacttacccttgtcctattggcttgaacaacactgggcaggaggactcctgttggagcccaacttggg

SEQ ID NO: 29598 - DNA, 201 bp, Bos taurus
acagaaccaacaagccatcaccaaccagaagaatttgggaaaggtcaaaaggagacaccagtccatatggcctaccaacctcccagaatcctcctcactgkaatccatcttgactgagaaatatatgtgctaccaggaaggaccctgagtcagaatgattggccaaagacaatccagaaactaatcccatcaccattaaac

SEQ ID NO: 29599 - DNA, 201 bp, Bos taurus
aaacatggaagataatcattaacacagtttcttaatatatgctgttttttcaggtgctatttctgtggaatttctcaaggctgtgaaagtacgttattacraattcccactataattttaggctgctaattttgtgataatttattgtataacagtagaaaactaatacaagagcttcaaaatacacaaagggaaagttca

SEQ ID NO: 29600 - DNA, 201 bp, Bos taurus
agcaaatacatctcttatgaaaaccagagccctctggacttgggggccatactctggaaaccatgtcaagtttgagcactgtggaatctcaggccagctgygagattttttttcccctcaagttggcatacaggttcaggagaaccaaaactggacagagtcatttttgccaaatctggcaaacagttggatcgattccac

SEQ ID NO: 29601 - DNA, 201 bp, Bos taurus
tgaaatagtaaatgagtattaatcacaagcaaagtataaaattaaacatagttatgaaaagtagaagaggcaaaatcagaaactatgatcctgttatttgygaaaattttgtgtgctgttctgttaattatatctgagcctttatgataacttacaaataggtttacactgcacttctgaatgtttcttagggatgtaatt

SEQ ID NO: 29602 - DNA, 201 bp, Bos taurus
aagttcctggttttcatctgttcctgaagacaagcaagaactctgtgtctaacagtctcaacttggagcgtccactgagacattctgaaatggttgttgcrtgactcacaggtgaaaaactacaaacaggtaaggaaacagcctttccatgaaataacttcagtgtgtgtgaaaggggcatgagaatggaaaaggagattt

SEQ ID NO: 29603 - DNA, 201 bp, Bos taurus
atataaaggctgactgggggaaaggcatatgcacacaaataccccccaggctggcaacatacattattctctaagagtagaaagaaagagttttcgtagaragcaactggactttataaaaaagaaaatctaaaatttatgagtgataaattacacatgaaatgaaaattaacatatcacattttatgaaaaacaaatttc

SEQ ID NO: 29604 - DNA, 201 bp, Bos taurus
aatatacactcatccctatgttcatagcagcactgttcacaagaaacaagacatggaagcaacctaacgtccaatgacagaggaatggataaagaagatayggtacgtatatacaaagaactatcactcacccataaaaaagaatgaaataatgccatctgcagcaacatggatgaacctagagattatcatactaagtga

SEQ ID NO: 29605 - DNA, 201 bp, Bos taurus
ttcctaattgcttgtccctgataatttgggaattcatcttagaatttgatgtatataataacaaggaaaactaagccaaaaataggggacttatagatttmattatccatagttttctttcaactgcacaaggtcacttcatgtccttggttaagcactctgtatctattagaacccaggaataggacaagactcagtctg

SEQ ID NO: 29606 - DNA, 201 bp, Bos taurus
tcttctcaagatagaatctgacttgctttcttagtctgatttttccatgcaagcatatctgaaaaatactcagggtttggcccagttgttcatatctttakaaaacccaagtgtatctgagctctcaacagggctctggttgcagggtgctccggtggggactttctctgaaatttctccacctgatactgcatggcccag

SEQ ID NO: 29607 - DNA, 201 bp, Bos taurus
aagtgctaagatgctagatatcatgtccttccttacagacgacagacaacttaatagacagctttaggagtatctggccggccccaaactccccttttcaraattctttccatcggacaaggatgggcaacaagtagccatgtttgcattgatcaaggcagccagcctggccttagcgtttagacaaggaacagtcagctg

SEQ ID NO: 29608 - DNA, 201 bp, Bos taurus
agaggagcctggcgggcccacagtctatggggtctctaagagttggatacaactgagcgactaaacaacaacaacaacggtttaacaattgggtcagttgmttattctgggcaaaccattgtctcaacttgagtgctacctcaaaaacgatggatgaggattaaatagaggactcttcactgttaaaggaccagatgatat

SEQ ID NO: 29609 - DNA, 201 bp, Bos taurus
ggacccagtactgtatctgaataaggtgagttaggccagtgctgggacttgtggaggttgtggatcaggagctgtctgtatacctgactggcttcctagayagtctcagtgtgtgtctggcccacaaaaaccctcctgttccagcgttgcttcctccaaggcaaaggtacagttggtgggagcagagagagtgcaaacatg

SEQ ID NO: 29610 - DNA, 201 bp, Bos taurus
tgtaggaaataaaagcagtcttcgggcaatgaatttcccattctttttattatattcatcaatagagagatgaacgcttaagtgaagagacgttattatgkccataaaactgatcgatttccagattaaagaaaaagaagaaacacattaaatatattccaaatctttgccctgtaattattttgttcgttgctgtttggt

SEQ ID NO: 29611 - DNA, 201 bp, Bos taurus
aagcaatttatcttgctcggctccaagtaaatggctgtgtctcttggggttcagtcaagggtaattaaagtaagcacttgcaattaaattattttgtagcrgaattaagcaatgttcatttaaaattcagttctcccaaaagaaggcagaaccagaggattcttcaatatatttacaacctaaataaatatgataaatatg

SEQ ID NO: 29612 - DNA, 201 bp, Bos taurus
acatgctacaacacagatgaaccttgaagacatcatgctacatgaaataagccagtcacagaaaaacaaatattatatgattctacttatatacgttaccyagtgtaaccaaactcatacaaacagaaagtagaatggcggtagtcccagaggacaggggttggggaaaggtggactgttgaggagttagtttttaacagt

SEQ ID NO: 29613 - DNA, 201 bp, Bos taurus
ccaattgttaaagcaggacttgtggcctctttctctgtacttctttattacgctcctctgaagaaggaaaaacgatttctcttattcatgagaaggtaagwgtcttgggtcccctgaacctcctagctccactgcaatgattctcaaactttaattgcaagagaataaggagggctaagtaaaacacagactcttgggccc

SEQ ID NO: 29614 - DNA, 201 bp, Bos taurus
actaggaatctttcacaggttatgttcccttgagacctaaccttttctactgatccagcttcaggagcaatgaaagtagggcgaaggctgtatctatagcrgaatgggccactggaatgactagcaatgatcactttggaatatgatttgcaggttacaaagtgcttccacctagagtgtcacaaacaagagagtattttc

SEQ ID NO: 29615 - DNA, 201 bp, Bos taurus
agaagatgcaaccaaaataaaattgataaagtcctaagtaggtaattaacagaaaaagaaatccaaatgattaataggcatatgagtagatgcttgaactygttggcaaggagacaaatgcatttatatatatacataagctcgatgttcttctctggtccctgtaaccttgcgtcaggtggtttcttggccactcctccc

SEQ ID NO: 29616 - DNA, 201 bp, Bos taurus
gctatctggcatgcccccctcccccaaaaaagaggaattgaatgaagaatttaaaaagagaaatggacaaaaaagcaaggtatgaaacaagaggtgactgractgaagaaagaaattgaagaaatgaaggttaaattataaggagcatacaggaggaatatatatgactaaaactttaggaaggagcattgaagaaaggca

SEQ ID NO: 29617 - DNA, 201 bp, Bos taurus
atatgaaaactgtataaacattctgtaatttctaaagatgctaccatactaaaagtgcaccagaatgcagaatcctgtagtttgggggaaaagcagtacgyaacatttcatgaggttttaaaacctaaacaattttaataataaatttgggggtatgttttattacagaagatttaaaataattcatagtaattacaaagc

SEQ ID NO: 29618 - DNA, 201 bp, Bos taurus
taaagaaagaaatgataatatgactcatttctattaaactgggtatcaaaaatcaaattaaaaaaatttctgaaactaactgatgaaaagtacaggtcaakacaacaattctggttattaatgtcaggcttgggtatagtcaaattttcccactgtacatactgtttgaaatgtatacttcttaggctcaatctcaaaatg

SEQ ID NO: 29619 - DNA, 201 bp, Bos taurus
tcatggcccaggtgacaaggttctaaagactagcagctaaaagttacaatttcctaatttttcaggcacctttctgatcctaaaagaggtggtaactcccrtcatggccccgatgcaatgtggcttttgtacgttatttttgaaagtttaagggcttcccagatggtgctcatggtaaagaacctacttgccaatcaggag

SEQ ID NO: 29620 - DNA, 201 bp, Bos taurus
gctggcctttttctttttgataagttacaatggtgaaaggtgaagcaatacctttaacattcagaatattttgcagaatattcaaaacgttcttttaacartttacctcaagatcaaacagggccatgacagggatgtgttaaaaaacacatgccaattttatcccaaagcctctagctcctccattaaaaatattctcgt

SEQ ID NO: 29621 - DNA, 201 bp, Bos taurus
cctggggtctggggtgggtgacactggcagagaacaggcctgagcagatcctggaaggggacagggaatcttaggtcctgcgtgttcagagtgtggtgtgsgggatggctcagactctgggctggcccatctctgctggcccttcagactctttgccctaaggggagggggcctcttgcctggtataagaacaatgctgag

SEQ ID NO: 29622 - DNA, 201 bp, Bos taurus
ctgcttctattactttgactatgattactttgcagagatccagctacagaattcctaaatcccagactttcagagtcttagctatggggccataacatatygtggaaagcagaacaaggttgttaatacttactgagaggagagatgcagaagggaatccctatctggctgccaaatgcggtgagaggccaattgctcctt

SEQ ID NO: 29623 - DNA, 201 bp, Bos taurus
actccaaggtctgaggactcctggcccagtgctcactgcaccatgtctcaactgtttcttaaactaaacaacagcaggaagggagactgtagatagcagaytggccagggctcaaatctcagtttatctgctgtgtggcctcaaacaggtgtcctcacctctctgggcctctgtcctctcaactgtgaaatggatggttct

SEQ ID NO: 29624 - DNA, 201 bp, Bos taurus
tgagcaaacatttaattcagattttaatttggcccctatttcctagacagaccctgggtcaattttctgcagagggatttttttctcttccttgtcattcycagcatctttggagattagggacagaaataaactccaagtgatctgcaatagttcagtaagacaccactcctgaacaactgagcttttgacaatacaatg

SEQ ID NO: 29625 - DNA, 201 bp, Bos taurus
gggaaatgaggagacacaaagcgtggatgtcgcacttcgtaaggagcctcagctgtttgcaaaatgtgatactcaagtgttcagaggcccaggaccccaamtcccattctcggagtcttgtctgctagacttagtcaggcatggggtctgccaggagacaggactgctgcaggattgatgatgactgggtgaaatgccctc

SEQ ID NO: 29626 - DNA, 201 bp, Bos taurus
tgagagaaagccaggtcaagccatcactgaggctggctggccttgagcacatggggattgaataactgagaatatattccacccacacaactaaaagttamccgcttcacactacctgatccattgccactggagactttttatcagctattacctgtgtggtagtcaagcagttcatctttttcattgaaccatctcatt

SEQ ID NO: 29627 - DNA, 201 bp, Bos taurus
gaagctcaggttcttgatgtctcctcacagaaaaaattcaacgagagccaaagtgataggtaagaaggctgggattcaaacctggccaaaatccagtgtgsgactctaacccatttggacccatttgatcctactcagcttatgttgtgtcctttgttgcactcaacatgccaggaaacttggaaaactcagcagcaaaac

SEQ ID NO: 29628 - DNA, 201 bp, Bos taurus
tggggcaccatgtctcagcacactgacagccggccctctgtcccctacacttggatccttcacattccccatctttcctcccagcctagctcttctccagygtggccatccaggcccggcttcatcagcatgtgacctgaacagtcacatggggcccccagcttggtttcatgctttgctgtttctgccttaaaattcttc

SEQ ID NO: 29629 - DNA, 201 bp, Bos taurus
ggccatgccacatggcatgtgggatcttatttccctgactagggatcaaacccatgccccttgcactggaccaccagggcagtccccaggcttctgtattygagcacagtggacccaggcctgcaaaagaagagagggcctcagaacaggagaatgcatggagtcctttaatcatgtcagaaaaaaaagccacttcaagtc

SEQ ID NO: 29630 - DNA, 201 bp, Bos taurus
ctcttgaaccaggttgtctgtactgcgttctctagttccttggtcctgtggtcacccaaggactgggatggaggtagatcgaaggaaccaacctcagaagrcagggcctgtttctattcccactttgagctgctcttgccattcccaaactggaagaggcaacttcccaaagggctgacgaccttaccgaggaagcagctg

SEQ ID NO: 29631 - DNA, 201 bp, Bos taurus
taatggccaggtacacatgtttcgttcattcatcctggcaggtctctggagaacaactttggagaccatcagattcacctgcagtgcttgtcagccatctrtccaaagctcagccaggcccactgaccatatctctgggaaggccagcttcaggcaagtgtggggactctgggatggaaaagatgtcagtgtgtccccatt

SEQ ID NO: 29632 - DNA, 201 bp, Bos taurus
tgcacccagccagccagctcagaagactgaggctaggtgaacaggaagtgtctaaagtggctggaggaggtaggagtggccagatctcggttcttgggaakgaacagcagaggacctactggaaggggaggagaggggcagacctctgcctggagcatgaggggaccactctgggcatgcaaagagccagcagtgacttgg

SEQ ID NO: 29633 - DNA, 201 bp, Bos taurus
agtgagggaatgggagctaagggataggaagaaccactgggaagggagaaactcactcatgaccctcaacatcaagctagcccaggctgggccctgccccytgggaggagcactgtgttaggagtcagatgagctgagttggaatgccagtaccaccactcacagggccaccatacctctctggacctcacttctgtagtc

SEQ ID NO: 29634 - DNA, 201 bp, Bos taurus
agaggtgcacaggtgtgagttctcatttcttggcttcaccagccaggccacaaatgctgctgcacagccgagagactccagctgtctgaagcctgggacckgtgacctgttgtacatgaggggtgagcactgggtatttgctggacagtgttctgtatgggtccaggggttctgtgggagcccaaccagacaaaaatgagg

SEQ ID NO: 29635 - DNA, 201 bp, Bos taurus
ttcacagcccaaggaccttgagaataaagaggcagggctgaagatagtagagttcacacacttgccaccaacagttcttccagcttgggacagggcccaaygctgatcctcagccatgtcaaaaccaaagttctggggtgggggagaccccaaagtagagggcagggcctggggctcccctaatcagagagggaaggtagc

SEQ ID NO: 29636 - DNA, 201 bp, Bos taurus
aactagtcgttacaagttccactactacaagacactcactgggatcgagggtggtcatgaatactgattgggtgtggggcccagctgagaggtgcctcacygcacccacagtgtgctgtaagttcagctggtggtgaagaatcccctgtgccctctgggccaaactgtgccaggtgatcgcttcctcttctgactggtctc

SEQ ID NO: 29637 - DNA, 201 bp, Bos taurus
ctagctcagttattagtaaatgattaatatgaaaatatcaaggtaggaatttatatacctgaacgtaacttttcactagggttcaccttcagtgtctgcaraggtttgattccaggagcctcacaagtaccaaaatctgccaatgttcaaggccctcatactatattcaatattgtatggtaaaccataaaggcaaagcat

SEQ ID NO: 29638 - DNA, 201 bp, Bos taurus
attaaacttgataagcaaaggactgattaaagagctgaaacttttaagtattttggaaagattttctagctttgagagacaattctgggtttgcatactamctggacatcaggactggacagaatatagttttatcttttatttccttactaaagtacaaaagaatgtgcgaaaaatctgttatgagagaaatagtttgga

SEQ ID NO: 29639 - DNA, 201 bp, Bos taurus
tggccacaacgtgtgtggcagtttgggcttgctgcagagccttctcttgttctggacttcattcaaaacctgcaccttttcaggtgctggatcactcaatrcataggccaaggtacaagaggaatatgttgtctccaaaatccaaagaggttcactaggttgtgccttattttgcttgtaaagagggtcctgagcaccaga

SEQ ID NO: 29640 - DNA, 201 bp, Bos taurus
ttcagtggtttttgtctgagagtactcctgacaataagaattattctgcctttgaagccagaatcagaattgatgctagacagtgatagagttggacaccyagctaaatgttttagcacagctgggagaggaaggataagtggaaagaagaccccagtgaaggcacctggtggtgaccatctatgtccagtagcagttaat

SEQ ID NO: 29641 - DNA, 201 bp, Bos taurus
tgtaattttggggttttgatggccccaccctagccctttcaatcctgagagcacagaggctctgttccaccacagagtgagcacatgtttcttgggtgctkgggccaggctatgcatgctagccttagccctgcccactgctccagatggtactctgggtacattatgaagagcacagaaagcagagcccatggtgcacaa

SEQ ID NO: 29642 - DNA, 201 bp, Bos taurus
cgaggctggcacgctggggaaaaggcctgtgctggaagaggtgggagaaagaggagacggggaggtcaacggatgggccctcggattctaaactaagatgkcagaacttggtggtactggggagctattgaagattctgagggaagagatatagtcagaggagagtgagtgaaggaagcgctggtgaagaggtggaggagg

SEQ ID NO: 29643 - DNA, 201 bp, Bos taurus
cagagaacggagggtggtaagtggccaggccagcaggtccctcccctgccccgccagtgtcctccctgttcctgaaaagcttcagtaaatgcccacctcargggaggtgcaaggcccactgggaagtctttgaggaagtcatcctcttcatccagaacacttcagtgtctcacctatttctcgctcatccccacttcatct

SEQ ID NO: 29644 - DNA, 201 bp, Bos taurus
ttgtgcagccctgccaatctcctttcctacttacaaactaaagctttttgaaagaataatctataataatatctatagtttagaataatctataataatayctatagtttaatttatccaggcctaagtggcactgcacaaagtgggcactcaaagaacgcttatgaattaagagaaataatgattttccaaaattatact

SEQ ID NO: 29645 - DNA, 201 bp, Bos taurus
gttgctttctgccagttcactttttaaaaagagctttattggatttttatttccatatcaaaaaattcacctgttttaagtgtagaattcagtgattcttrgtaaatttctggagttgtgcaaacatcatatataatccaattttagaacatttccatcaccccaaaagatcctgtgtgcctctttgatgtcagtctgtgt

SEQ ID NO: 29646 - DNA, 201 bp, Bos taurus
tcacagcagtctgtgaggcccatatccatgccctcatcttgttgataaggctcctgagaccagctctgtgtatggctggggttttctggggcacaatgcarctgatgtcaggccgtctggggcagcattaaatgttgccaatctctgccaagatctggaatccagtgggacgcaacatttttgtgacctggatccctgtgc

SEQ ID NO: 29647 - DNA, 201 bp, Bos taurus
ccatggagcaaaaggtacaaagctgtcaaccatccagacactgcagaacaggaacaagaagagggctgtcctaagcctggaggggcctcactcacacagcyctcctaaactacattctcacggagcctcggagtccccagactgctcgatcattccctcagtgacccatcaacataatgaaaacctccccttctgtggccc

SEQ ID NO: 29648 - DNA, 201 bp, Bos taurus
aggtacaaagagatggaaggatcttggatttgattgacgatgcttggcgagaagacaagctgccttatgaggatgttgcaataccactggtaggctgtaaygtgtgctgagggtgatgggttaaaggtctgatctggtagaccctagtagctgtaggttatcaatggacaaataaactgaagtcaaagaaatcaaaactat

SEQ ID NO: 29649 - DNA, 201 bp, Bos taurus
tgttccacaattatgtgtgtccatgttggtgcgtatgtctgtgtgtgtttgcagccccagaaaccccatatcctcatcctggccccctgctcatctcaggstgggtctctcctgtgctggtcctgggaaggcttagagctgcaggcgtaggtgttggcatgtgacccaaagatagggatgaggggttagtttctgtgcctg

SEQ ID NO: 29650 - DNA, 201 bp, Bos taurus
acatatatctttatacatatctttatacatacacagttcacatatgtattggtttgctctcttttctcaccaaaaagcatggtccatgaaggcaggccctrcagtttgttcaagctaagtatcccacctcagtgggcattcagcaaatatttgttgagccaatgatgaaacccaagaacaagaagcacggccaggaaagtc

SEQ ID NO: 29651 - DNA, 201 bp, Bos taurus
ttccattcacagagccccgcctcacccttccctcactgctaaggataaggcctgtccctctcttatctcctgggaaaggttaagcccatcctggcccccargggtagatgtctctttctgaaaagaccggttctcccccgctgttaacctgtgactcaatacaatctactagaagcctgcaagtcactcttgggcctgcaa

SEQ ID NO: 29652 - DNA, 201 bp, Bos taurus
ttaatggctttataatatgatattgtatggatgtatgatgtatggttaagtgcttcattgacgtatggatttttagtaacatttctcttccctgttacaartagtttcattcatttggcagaaaaattttatggtaaagggatggtaaaaacaattggtagtcatcttttgttgctgtttctagcattattattaatgaat

SEQ ID NO: 29653 - DNA, 201 bp, Bos taurus
ctctattctattaagatagaggaatccttatagatttgtacaaatatttgatggctttggattcttttgaaggtgaaaggtattaataaattgcattattrtgttttatttctaaaacattgaactaaaagccaattttagttctttttgttacctggagagaaaaccatgagttcagaagctaaaaataaaatggaataa

SEQ ID NO: 29654 - DNA, 201 bp, Bos taurus
ggtttatggtgtcagctttgctggaatgcccttcccattcctcctctctgctgtgaaatgttcttctgactcaccaaggctcaagtgcatgtctgcctgtkgttgggccgtgccatgctctgtgccccatggttgggccgtgccatgctctgtgcctgtggttgggctttccccatactctgtgccccatggttgggtcgt

SEQ ID NO: 29655 - DNA, 201 bp, Bos taurus
gggggacctgcagagtcagactcctcagaggagccgtagaagggctggggttagggctgagccttggagcaagaggcttctcacagatggccttcagcagrtcagtggacttgggtggaaacaactgcacctgtctctgcaccaccccctgagagattggcagcattttctgtggccacgagcgtagcaacaggactccgt

SEQ ID NO: 29656 - DNA, 201 bp, Bos taurus
tcaggccgactacaggataaggtcagccagacctgctcctgctcctttgctattgcaacactggcctggtattcagtaagctgaatgataggatgaggccyaggagtccaggtggggaccctatgggcacacacctcctcacaggtgaacatcccagcagtgggaaaggaggaacgcattatgctcacgtctgacacctga

SEQ ID NO: 29657 - DNA, 201 bp, Bos taurus
ttcagtcatttgccctaaaaagatgagttaagtgtgcatctttctttgatcttctgagcattggaatatggctctctgtttaaaaaatgcattcacaaatkaaggtttaattcagccttctcagatagttttctttcattccccaaagataattttcttcactactcctttagtagttcttggcctttcaaatagctgtgc

SEQ ID NO: 29658 - DNA, 201 bp, Bos taurus
tctccttagaattactgtagtattttaatctatgacatttaaattagcatttcttatatttccctgtgactcttcatgtgcattactctggcctcatcacrattcactgattcaacaaatatgactcctcagcatgtaaggtagtttgtggacttcaggagcaaaccgcttagcatacatgctccctcggagttagaggta

SEQ ID NO: 29659 - DNA, 201 bp, Bos taurus
ctggttcaatatgtgctgaacacattcccctcaaagccatatgtggacaccctggccctagcacctgagggtggaactgtgtgttagggcctttgaagagmtgattaaggcaaaatgaagcttatggggtaggtcctaacccaatctgaagggtgtccttataagaaaaggagcccaggacacagatgcaaagaaggcccg

SEQ ID NO: 29660 - DNA, 201 bp, Bos taurus
aagagggtttatattcagcagagtcaatggcctgattcttaagtgatggtaagcttgtcagtgatactttatgaaagtgtacatacagttaagcataaccrtaaattctctggtgacattagttatttaagattttttaaatattttgaagtcatataaatctagcatttgtagatatcagttgtatgaaactgaggcctg

SEQ ID NO: 29661 - DNA, 201 bp, Bos taurus
aatatctgaaaaatatagctaaacaaaatatagttaagaatgtacaagaaattacaaattacctatctcttcagcttttcctgtgtgcacttctattggtytcttttgctatacattctaatttttctccctagcagtagaaacatcttcctctgttgttattacactttactacatttttttttcttttggccgtatctc

SEQ ID NO: 29662 - DNA, 201 bp, Bos taurus
accccaggataaaataatgcccacaggctcaaggtaatggcccaagactgggcagctctacagtgttcattctgagcttcctccagggaaatttcagttcktagagaaccagagatcttgttcatcctcagctataagagttgaattatcagtacatatgcttccatttagaaaaccaggtttatccatcaacaatgttgt

SEQ ID NO: 29663 - DNA, 201 bp, Bos taurus
gagtaatcttacccaagtcagaagtaggactagtgagatctccaggttagtgctctgcttcctccacctccctacttcaggccgccctcaccattttcctyccccacttctttcaaccaggaattccaagccttcttgcaccaaaaatgtgagtttctcacggccaattatcacctaaaacgattttctaaatgggtactt

SEQ ID NO: 29664 - DNA, 201 bp, Bos taurus
tgtaaagccttttgtaattacagggctttaaacaatccataagccttgacaagactgtttttcacagaagcaaattatctcttcaatctctcctaaaagaytcgactctgaatatctgattccccatcttcatgattaatggatggcaagaaggagacaagatgcataaaaacaacaacaacaacaacaacaaaaacagcc

SEQ ID NO: 29665 - DNA, 201 bp, Bos taurus
catgaacaggacctcaacctacacagacactgcatgaaatggcaaagatttatcttcactgaaaggcggaagagagatggagggcaagagagtggccacargtaggccagcgagggagctggaaggaacactccagaccaaaaagtgctatggctgagcacaagctgtatctcagcccagggccagcatgagaagctgtga

SEQ ID NO: 29666 - DNA, 201 bp, Bos taurus
taccttgaaaaatgcttaaatgctcaccacgtcactggcctatgaatattacaaaccaaccttcagagtgtattaaggataaggtattgctacttgcatgyggtacctggaggccaaaaatgctgtgaagggcaggataggagaatcccacaagaaagacctgtcctgcccggaatgccatgaactaccctgctgagaaac

SEQ ID NO: 29667 - DNA, 201 bp, Bos taurus
caaactattaatttttgcaacacatgaaataactacaaaagatatgaagtaggaagcttagtaattccagtcctacctcctggaggaactgatttgatacyaacacaaacaaccttcaaagtgcaaatttcatttctctcctaatgctgctttctattctccctctttcctttttgtgacccagtactgacgtgaacagta

SEQ ID NO: 29668 - DNA, 201 bp, Bos taurus
gggttaggctattgtattaggatcagatgtcctgttctacaacaggtcaaatccagctgagaagaggcatcactgaaaagtcaacaccttttaacaccaakgaaaaaatttgagcagtgtcataaacttgtcaattgcaatacatattaatcaacagggcataatcagcctgcaaattacattgtattaactttaatagtg

SEQ ID NO: 29669 - DNA, 201 bp, Bos taurus
aaaaagagaggaggagaaaaagacccagggaaatggtacccacctctgttttattccaccactgctgctattgatggcctcctgcagattctccctctgtygttccttcaacagagggtctcagttgcccaccaagcacaaacaggttgttgccctgaaaccacaagcatggccatcccagaaacctcctttcttccattc

SEQ ID NO: 29670 - DNA, 201 bp, Bos taurus
cgtctggaatgacgaggaacttggcaagaagacaacgctgcataagctctgctgtggccactcaccggagggaagcaaagccggccaccctgaaggtgttyattggcacgtgggagggacggaagactcaggaagttatttttgtcgcctctcccttagctgcctaaaaggatttagacagagggcctattccaggaaaaa

SEQ ID NO: 29671 - DNA, 201 bp, Bos taurus
gtcagcaacagacttgctattcgtcatttttgcatatgtacattttacttcctcttttgaaagaatatgtatatttccaggtgtttccatcagaaaggctygcacgtaaggtaagttcataatcttgccagaaccacagtcttcatttctgcccaaaaataacataacctaaattccaatgtgatgtttttgtatattacc

SEQ ID NO: 29672 - DNA, 201 bp, Bos taurus
tgaggcctcaccatcctctggagctcacagtcctccactggaggcttggcacctcacccaccaatccgttgagaccaagagaatgtggaggctttctctgyaccactcaggggccagatctagaaacagcctagatctctgctcccctgccccggcacagccagtcagacgagtgggcccaagtgccagcagtctgggacc

SEQ ID NO: 29673 - DNA, 201 bp, Bos taurus
actcagagttttaaatatcaattcactttgtactaataatacagtaagtcccctacatatgaaccttcacgtcacaagctttcaaagatgcaaatgtgaaygctagcctctgtctagcagctgttgtactgtactcctgtgctttccaaggtactgtgctgttcgtgtttgcttgtttcttctgtgtcatgtgtgtgaagt

SEQ ID NO: 29674 - DNA, 201 bp, Bos taurus
cgtgtatcgatattattatgaaaataactccaacatcacgaacctcctgaaagacttttgagtaccccagacccctgtgggccatattttgagaactgttrttctagagaattccagtcctgttcagtgggaccagcttttaaaagcctgttaagaagggcctgatgtcttcagtttcagctaacctttcatgagctagct

SEQ ID NO: 29675 - DNA, 201 bp, Bos taurus
tgataaaactagcttattccctaagagtaaaaggtgagagagaataagaggaagcaacctgccctggagtcactgccgctgaaggtcactgcctttctaayggcctccccttggtgctttgagaaagacttctgtctttgtgagcgcctgtcactcacgcgccaacctggatccacaccttggaaagaggcaaagccggaa

SEQ ID NO: 29676 - DNA, 201 bp, Bos taurus
attggagatggctgccttcttgctgcgtcctcacatggccttttctctttgggtgcacctctgtgttgtctcttcctcttcttataagaatccaagtcctrttggattagggcccactccactgacctcagttaaccttaattatcactttaaagaccctgtctccaaatatagtcaccttgtgagcaactgagggttagg

SEQ ID NO: 29677 - DNA, 201 bp, Bos taurus
ctatataatagtttgcttctgctaactccaaacttccaatccattcctccctgctggcaaccacaagtctattttttgtttctgggcccacatgtacttcraattgttaaatgcaattcaattccatttggtttatgaacgtgtcactccttcccatgaactgacatatccttgcagaggatgtttggcctctcttgaggt

SEQ ID NO: 29678 - DNA, 201 bp, Bos taurus
gcttgatctgcttgatctcctcccactagaatacaggcacaagtcacccttaacaagaagttaatacaaaccactcaactaacctttctgtccaagggggraaaaaaaaaaaagaaagaaggaatacaaccctaaagcttgggaaaaggagacctcaagcagaacaagttagagaaaagaagatgaaaaaaaaaacagaaa

SEQ ID NO: 29679 - DNA, 201 bp, Bos taurus
aaatagtgggcagccgggcctggtcctattgatatagtatgggggagggaaagaagcagtggtgaccttaatgaaccagatcgcatctgcgtgggcccttytctcatggagatcagagaagagaagatgctgcttggtatcctttctcagctgaactcagcctccaggtggacaggcatctttcagaatcatgagctgaga

SEQ ID NO: 29680 - DNA, 201 bp, Bos taurus
ggcttttttgaccctcagtttctaagtctcctcaaacactgagtcaccatcctgtgaccctgtcttatgacccttggccatttcacaaaggaccagatatyggctaaaagttgatggtctgcctattgtttttcttttaataagaggaccaagagttaatggttgtcctgtcctggatctggtggttttgtgatctaacag

SEQ ID NO: 29681 - DNA, 201 bp, Bos taurus
tctgatcacatgatctgcatgcactcaagagtgccctctaagggcactgcacaggctcttctgttgtgacatacctgattactgtgggtgtattggtaagyagagctggcattggcctggttgacttccaggagctgcctcatgtgttagttgtcagcctgctttgggccattcattgctgggtctctgcaaggctggctg

SEQ ID NO: 29682 - DNA, 201 bp, Bos taurus
tatgaggccctttctcttgtattttgtccatttctgccttcacacaatgctgatccaagactggggcatagggtctggaccttgcttatcatccaccatgytagaaacagctggcctgtgctgtcagtctcctgttggagacagcaatattgaatgagatgaccgagagttaaccatgtgttatagcctttatgaagccca

SEQ ID NO: 29683 - DNA, 201 bp, Bos taurus
atatatatatatatatatatatgggtttctgtctgttcttctttatattcttgggggagaatggatacacttatatgcatgattgagtcccctcactgctyacgcaaaaccatcacaacagtgtcaatcagctacactccaatacacaacaatgagtccaaagaaaaaataataccttccctcagacttgcaaggctatag

SEQ ID NO: 29684 - DNA, 201 bp, Bos taurus
ctaaaagatcccacatgtcacaacttagacctagtacagccaaataaataaaatcaataaaaataaacattaatggaggccccagacctactggtacctamagattgatgatgttaactgctctgttatctcaaaatcaaccaatcaaagaatcaagcaggagctgatcacacaccctagaaccaccctctctcacttggc

SEQ ID NO: 29685 - DNA, 201 bp, Bos taurus
accagagtggcctcaaaaagcaactggtctggtgcataatcactgctgatacaatagcttgacactgcccccttgagaatgagctgcgactaaagttcaartggccaggatgacttgtcattcactgggcctctaacacccacctctgtctggaaggcacttcgatggccatctgtgccgcctgcacacacacccaggagc

SEQ ID NO: 29686 - DNA, 201 bp, Bos taurus
ctcacctgaatcagtactgagtgctccaaccctgtcctcatcaacacacccagattcacacagtcccatggggccctgtctgcccctgggccttggaaatyaagacagatcatatagagcccgtataacaaatcttagttctcctacttggtttctaagactcccttgactcttcctaggaaggcacagcctggtcagcac

SEQ ID NO: 29687 - DNA, 201 bp, Bos taurus
gtcaatggagtgagtgactgagagacaaaacaacaaaagaccctcaaaacagtcaacaggtactccctgaaaagcacagggggccaatctaagaacagcakctaaaactcataggggttctgcccaatccaaaatcagagggaatgcgagaaaccccagggtaaggcctaaagggactgcagcaggaagatcacagggcag

SEQ ID NO: 29688 - DNA, 201 bp, Bos taurus
tatcacttgggggaaacatggaatggcagggaaaactgcaaacacctgaagccatgaatcacaagtcagttaacatgaagacttttcatagggagaatgarctgtattcccacttccaagtttccactggggaaaatgaaccacagagctagaatccaggactccagcagtatccctctgctctgcccaggcctctgttat

SEQ ID NO: 29689 - DNA, 201 bp, Bos taurus
actaccttaaactgaactaaagattctttaaacatctgaaagccatgatatattcagaggtaaacctgagatctatgctgttctagaatgcaggtgtgggyctggtggacaacagtcacaggaagacatcacttcattatgtggttgactaagcttggcattacgctggtctatttgctatgaaagttgcagaagagagtc

SEQ ID NO: 29690 - DNA, 201 bp, Bos taurus
ctgtgtcagaagctttctctatcccttttttactgtaataaatcttttaccccaccaagttttgagtgactgaagccaagtctctggtcccgaagcaaaaytgtctccttcagatcatgaatctgaactgttcaccataagctatcaattcccatcccttttgtcggatccccagggtcagaagcctgatgtggggttcag

SEQ ID NO: 29691 - DNA, 201 bp, Bos taurus
ccaacaccaggaggatttacttaactagtcccgcatgaccaaactgtgaactagcagagctataattcagcccaagcctgcctctgcagtccaaggccaayatcatggtctgatacctgttttttgaaacaccactcttaattcccagattcagtggctccttttgaattcatactatgcttagtccctcagcagcatttc

SEQ ID NO: 29692 - DNA, 201 bp, Bos taurus
tggtacaatctggaaaaataataaaactgaatatgggccactcccgattaccagttcattaaataataatgtcattataacccgaaatttggtcttggttrggagattttgcttcttacctttaagttgggagattttagaaacattatacttcttcttctcctttttttcttttactgtgggcttctctaagtagttgtt

SEQ ID NO: 29693 - DNA, 201 bp, Bos taurus
ccaggcctgcagctggtctgtgtggccacgtcgcccactctgctgggggtggggaccctcctcagaacttcttaggccacagagcaaggacagtacactgkgatttctttccttgtaacttttctccctgtgcagtgacccctgctccctggagggcccaggacaggcagctgagagtcagagccccgtcccttgtccttc

SEQ ID NO: 29694 - DNA, 201 bp, Bos taurus
gattgaactgtgagttggaaagtgctttgggatttagacctcaggagagaaggctgagtgagtgtttttagtctcttgcaaagatttgtcctcttgcggtrtgtgggtcttcacatatcttccttggtgggtaccttttagaatgtgagcaggctggccatctggtgaaagtcagccttggaagagaagcaagggaaggat

SEQ ID NO: 29695 - DNA, 201 bp, Bos taurus
gccaggaagtcagtaatttaggaaaaataatgcaaaaataatacaatttctctttgaacaaaaagtgtctttgtcctgcatttagtgagtagagcagggayacagaacaccaggcccctctgctgtctgctaaggccaataatatcattcctccaacttataaacactggttttggctggagccccaggtctgcaaatgct

SEQ ID NO: 29696 - DNA, 201 bp, Bos taurus
ttccactttagcttggtggcattacaacaattctattctattatttactttactaatctctatctcccagtttttcaaaaatggtcatgtactacatatawattacatttttaaatgaataaaatacaacttaaaatccttgagttatttttgattaatgtctagactcccccaatggcatacatactctttgatgtaaga

SEQ ID NO: 29697 - DNA, 201 bp, Bos taurus
gggatgctgggtatctatgtctggatgagccatgtggccagtgaggcttgtatcacctgagagtttcctagcatcttgggccattagatgagaaggcactraaactggagaacagaacaaagagaaggttctacccttctgaagagaaacagaagtggtctgtaggtacatgataaacactctcagtggtcagagcagggt

SEQ ID NO: 29698 - DNA, 201 bp, Bos taurus
tcttatcatttgttactgaaggccctcaatcctggttatttcaagatgcttcacctcctctccaaaggagctcttaggatttcaagctgattattgcaggygcttaaagacaaagcctcatttggcctattattgaacaggtgggatatgcatgtggtctttgcaactttctatttgtctcagtagctaaaatttgtattg

SEQ ID NO: 29699 - DNA, 201 bp, Bos taurus
cgcccgccccccccgcatgccccttttttctcgtgttttttattcactgcatcaggtaatcctctagatgcaccttccaaacagactcagagtcacctatytgtcatctcttctgccacctccctggtccgaggcaccatcctctctcccctggattgctgtgatgcttccccaaggagctctccacctccaccaccgccc

SEQ ID NO: 29700 - DNA, 201 bp, Bos taurus
cagaaacgttagtctactagttttcagagaatacatctcaccctccatcctaaaacaatgaaagttctctggttgaaaataaatcccaagacagacgcatyaatttctttcagtagtttttctgcctgttatagattggaagctcccaggaggcaggacagggttgtattaactcatgtagtcagaggacaattacaaact

SEQ ID NO: 29701 - DNA, 201 bp, Bos taurus
aactgttgccatcctcagtttgcctgcaaaaatacagctctggtttttctttaacttttacaatgctgttagtttcacctggtgagtcataagaccctggmagggctgaccaggcctccaggggctcaagaaaattccaagacccactccctctcttatctaaaatgccacttgacttgctggtaacaattggtgtgtttt

SEQ ID NO: 29702 - DNA, 201 bp, Bos taurus
ctccctcctccctccccataccatccctcttcatctgttttttaattgtgctttgagattcaattccattagaacaaaggccttgcaaagtgtgaaaacaygctttaggccaagggtgtgcagggtgtgaggagttgggggcgggtagttaaatatgtggaggagagtttctgagttagaaagggaagttaaactcagggt

SEQ ID NO: 29703 - DNA, 201 bp, Bos taurus
gggggtgggcctcatgtttgctctgctgcctagcagagggtgataccagttcctaccttgtctgatgaaaggacctcagagaagcacagcctgacctcctyttaggcctggaaaagaacacctgtcccttttgccactgggacccctgacagtaaggacggtagcaggtttagggaaggggcttccagtggtgtctgtccc

SEQ ID NO: 29704 - DNA, 201 bp, Bos taurus
gcatgggaccggccctgccccggacaccatggggtgcagccaacagaccacttgtggtgccgggaagctctcaagtgggaaggaggggagctgaccacagrggccacggctctattttgcccatttatctaacactggcccaagaatgctttcctttgggacggacggagtattctccacttctataagcttcataatacc

SEQ ID NO: 29705 - DNA, 201 bp, Bos taurus
acctgttaaggatttccaacagagaggcccctagagcttccctggtgatccagtggtgaaaaatccacctgccaatgcaaagaacataagtttgatccctrgtctgggaatagcccatgtgccacagctaccaaagcccatatgtcctaaagccaatgctctgcaataagaaaagccattgccaagagaagcctgcccact

SEQ ID NO: 29706 - DNA, 201 bp, Bos taurus
ccaggcaggctacagtccacagggtcaaaaagaattggacatgactgagcgacaaacactttcgctttcattaaccattttcatctggcctccctttctgytgttgttattgttactgtgtggtcacaaacaccctcacatatctctgtgcaagcgtgtctgttgggctgtttcctaggcaaaaatatccactttttaaag

SEQ ID NO: 29707 - DNA, 201 bp, Bos taurus
gcagctgatggagaggcaatgacttgaagatgtgtttatactccccacccaggagacagagccaatgctcacatgcatgcatacacacacacacacacacmccctaagtgggcccatagagagggagggaggaccagagagagaccatgaagaggtgccacgtggaaaggaccacgggaatgacaagaccagaagagggtt

SEQ ID NO: 29708 - DNA, 201 bp, Bos taurus
tccgtgcatataaacaatccatggtgaagggacggaccgcgctgaccctttaccgggtggtgctgtgttccatgcacatcaccttactaattaccacaatyacctccaagaggagactcacacccagctggggacctactggcggaggtgagaaacggggcccccagtcctggccaaatgggtcccgggcagcccctccca

SEQ ID NO: 29709 - DNA, 201 bp, Bos taurus
tcagaatccatgggttctgcatcctcggaggcagagagctggttgtatttcatcatagcttatactcgataaagagtggtttgcaggtggccccgggagayggaaggtgatctgagtccagcttagccttgacagagtgcatgtctccactttccctgtgggcaaggtgggggacagggccccagagaacatggcaggttt

SEQ ID NO: 29710 - DNA, 201 bp, Bos taurus
cttgtcatgatcaggcccagaggctttctggaggcagaggagtaatcttcatcagtggttgcatcttgtcttcagttcagatgaaaaacaaggtctaggtmggcctcaccaacttctccacgcaggaagctttgtcctgttcaccccattgctccacggtgaccctgctcgctgcacatcttctccagctcccgtcccagt

SEQ ID NO: 29711 - DNA, 201 bp, Bos taurus
ctccggcagggccacacatggggctgggggtgaccagggggcccagaagaggggaggggagggggcagcgggagaaggaggagggggcatgctcctgatgrgttttccctaaagctggccctgggtgagaaaggacgggaagctttggggggatttacagggctgggggcagtgggtatttacagggctcacttaacagcc

SEQ ID NO: 29712 - DNA, 201 bp, Bos taurus
tgccctgcatttaaggctacactttcctgcctcacattccagtgtcagcagcttggctatgcttaatgatggaagagtggacctgatttggttttggtcayagtgatgggatgcaggcttgttactgggagggcaatgtggtgacagcctcccatagtggaaagccagcagacagaaagcaaagccatggacagagcttgg

SEQ ID NO: 29713 - DNA, 201 bp, Bos taurus
gtaaaatctgagacttcagaaataaaaaagagtgaagacactgtacagttggtggacgtcaacttagctgaacgtttcttgggtatgagggaggaacaggraaacacatggggccttcctgaggtcacgaggctgtaagtctcgagtgagagggcgagtccagccctgtgtccccgtcttgggctgtgaggacccactacc

SEQ ID NO: 29714 - DNA, 201 bp, Bos taurus
ttctaactgaaagaaaggttgggaaagtgagtctttccattgttctttatagggtgaggtcagggaagaaagagggaaataatggatagtagtcacggggmaatgggcctgctgtgtcctgggagaaagcccttctctcaggagctgggggatgtagggagcacaaggagctggggcggaccagctgggcctcaagaaggg

SEQ ID NO: 29715 - DNA, 201 bp, Bos taurus
tcaggagaggcgcaatgtgcaggatacatggccgtttgttaatcactccttgtgcatgtacgactttgacctcccgtgtaggtggtacggctggcagagcycgtgtcactctcaggccctctcagacttgcagcaatgactccaagactcctagaagacaaggctaaataagatcgcagaatcataggatgatttatggtt

SEQ ID NO: 29716 - DNA, 201 bp, Bos taurus
caatccaggaggcctctccaggagaagagaggaggaaatcagctccagcagtttcctcggctcctggcagaagccctcctatttagaagagggaggcaacrgacagtttctgtggccaactacagcattcatgctgttgaccacttttctaatactgtttgcaagctttgtataatatcactaggttttctgcaattctca

SEQ ID NO: 29717 - DNA, 201 bp, Bos taurus
gcaagtactgtggaagagataattaaattgaaaataagcacctgaaatcaattatgatacacccatacaatagaatacttgaagtttttaaaaatgatcaygaggaggtatttatgcactgatgtaaaaaaacacaaggtaaattgcagaacaatgtgtataggatagtactaactgtggggaacagatgaattaaaacat

SEQ ID NO: 29718 - DNA, 201 bp, Bos taurus
atgtttctaaatactgttaaaccctgctgcctgggcccttcccatccagacgagagcctcgggtggggacagagtgagtcagctagggttgagtcaagagkttggcagcttgcagcaccccaaggcctggccttctttttctttatttatctttgtctttgctgggtcttcgttactgctcagactttctctagctgcgga

SEQ ID NO: 29719 - DNA, 201 bp, Bos taurus
gaaaagaccagaaacctaccctcgagaaccacagtcagcagtttgttctagcaagtgaattttctgtcctaacttcgtgactatagagagtaatcaggaayaactttgacctgcagttaactttaaagttacgacccaggtcaaggagggtgagaaggaagaacagtcaggacctttcagagtcaggtgagaaaaggagag

SEQ ID NO: 29720 - DNA, 201 bp, Bos taurus
gtgtgccaaccagcctgggtgtgcggaggatggaggaatggccgtggacagtccagcgttccgtccactgttctgtgctgtccagcacggcatgaaaagarcagtacctgtccactgactggcctagctggccacggcatcgccttcagctgacctctgaagtaggaattggagggttgggctgtcttgtcgatcagttaa

SEQ ID NO: 29721 - DNA, 201 bp, Bos taurus
agggtccccttcgccctgtgtgtctaacgcacttcttcagtgctcagcaggcccacagggtttcttctcatgaccatttaaacctctgcctcctgacagcrctgtctgtctatgttttttatgtatcgtcaacatcagagagatacttgtgagctttgcagtatgtggttcataagacaaaatgtccatgtgttcaagggg

SEQ ID NO: 29722 - DNA, 201 bp, Bos taurus
gtctgtcccacatgcccaaaatatagcagcaaaaggaggaaggctaaccaggataaatgcttccatttgacaaggggaggaaagggatgcacagagcaatygctggtccgcagcagttctgaaatcaccagggaaatgaccacagggcacacagggacaggaagtgttccctgagtcagcaagttccacttactgggagtg

SEQ ID NO: 29723 - DNA, 201 bp, Bos taurus
ggtcccttccctggggagtcccgccaggcccccaagtgctgccacgatgaacgtgcacagacttccaaaggcatctaggagacccaagctggggacaagcyggccaagaacgcgtgaactccagggacacggagcggggccgcagaccccaggctccctgggccctgccgtaggatctgggggaatggccgggagcagaga

SEQ ID NO: 29724 - DNA, 201 bp, Bos taurus
caataaagctttttgggagaatcttttgggtgggaaaataaaatccaataataaaaaaaggtttacagctcaatgctatttggtgtgggtcaggtcagacygcatcctgggccccgagatgcaggggaaacgataggggttggggaagtcccaggacggactgcaccgctctgcttcctgcacgtggacctcgtgggcctg

SEQ ID NO: 29725 - DNA, 201 bp, Bos taurus
gcactccagtgggggacagtgcactccactggggggtacattctagtgggagtgcactctggtgggggtgcactctgctggggggaagtgcactccagtgkggcctcctacccatggaagagccagcatcctcctcacatggatgaaccagaatagcaccccaaccctcacccaggggactgctggcccctaattgccatt

SEQ ID NO: 29726 - DNA, 201 bp, Bos taurus
tagctcagccagaacctgctggtcaagtcagtgtcagcccagtgcccagcagctgtggccctaggctgggacgcttgtgggagaggccacgccaggcagtrctggctccgggaacccagcctgcgccctgcacccctgtcctgcctcagggacgtaaccagggcccatccagggcgccggtgtcaccaaggagaagggctg

SEQ ID NO: 29727 - DNA, 201 bp, Bos taurus
taccacaacatccagcatcctcagaaatcctggcattttgggaaaatggattctgagttgtccccacagcccccgtaaggggcccttgaggctcagggccratgagaagcgaggtaagtgctcactgccagtggactcttctctaggttcctttccaagacaggtctgaggccacaggcagcaccaacccctgggagctga

SEQ ID NO: 29728 - DNA, 201 bp, Bos taurus
ggaggccagacagagtggatgctgtgcctgtcatttctgaatctcgctggtgccccaggaggcacagcagtgggcacctctggaggagagggtcctggcarggcagaggggccacaggacactgactggttctggttccgacccaggtatatgacccaggtgcagctcatggacacgcatcagaaggtgtgcctgtgacag

SEQ ID NO: 29729 - DNA, 201 bp, Bos taurus
aggcccactgactgctctctggactggccttcggcccatggtcacacccaccacagccctggggggacgccttctggtggggacgggcctcagtgtgtccractctgcacctctggtgaactctgtgcccatttcaagccatcgctgcacaaatgagtcagggaggccctgctgtggcttcgggcagccctgcctggacgt

SEQ ID NO: 29730 - DNA, 201 bp, Bos taurus
ctttatttgttaataggcagaccccttacctaggtcaggacaaaatccatgaccaacaaggatggagagccgcatgctggctgacactcagggcctggagygaaccaggagccagcccacgctgctgacagtaaattcaggggcagaaggagaccccagacttggctctaggccacagaaatttcatatgaaagccagcgt

SEQ ID NO: 29731 - DNA, 201 bp, Bos taurus
attgaaattgtgacagattgttctccagcttctccacaccaccttcacccacgcctgtctcaggattaaatcctgatccaagacctgcctctcaggacaaytgaccatgggctctgggggacgtggtttagcactcaaagttcagtccttggatctggtcactctaatgcactagggagccccagtatcacgggaacagtc

SEQ ID NO: 29732 - DNA, 201 bp, Bos taurus
gcagcctggtggccacagtaccagagggtggggtgggggccacacccacatggacagaggtcccctgacctgaagcaagctgcagctcccagactgccaamtgatcagacggccttgccgcgtgagcccagcagggggtgttgtgcccacactgactcccaggaacccgcctgtgggcctcattcagcgccaggactcccc

SEQ ID NO: 29733 - DNA, 201 bp, Bos taurus
gcttggcctctaaacatgtcccccttttaacaactgccttctagcttcactgactccaagctccagttcagggactccccagtcctgcagcgacattgcaytcagcacaagggctcccggccagctgggagctgaggaggtgggcagggtgccagggaacatagctggcaggagtgcctgccccgcccacccagtgccatg

SEQ ID NO: 29734 - DNA, 201 bp, Bos taurus
cctgtctgtggccggccttgaccgtcatgccaggtctccagacccagaaggtcgtgtggcttaaatgcctcttgcccgaacctgccagactttcccattgygttggccaaaccctcccagagcgccagcggccgcgtgcaaggtttcaactccatttcacagctggacctccccctaagtggctgttttataagagtctgg

SEQ ID NO: 29735 - DNA, 201 bp, Bos taurus
cctccacatcctcacagctcagggccactgcacagccttcccgcaccacccctcatcacagagctctgatggctcttcctccgcctcactcaggtctccaytgcccacagagaagaaccacttggccccgggagccctctcaccacccagtctttactagaagatttccaccactctgctggtcatcaggtctcccgaact

SEQ ID NO: 29736 - DNA, 201 bp, Bos taurus
atagagactgatctgaattacaaaaaaaaagggaagttaactattttgcacacttgaatgaaatacgtttctactaaaaacattaaaaattatgatgaacrgatgggggcaaaattttaggttcaattggaggtaagggagaagaggagaaagagtaaagaaattttttattccaaagaaaatgaaaaacattacatatac

SEQ ID NO: 29737 - DNA, 201 bp, Bos taurus
tgaacaacagtgactatggataagaaaaattcactaatttcacagtttaaaccaatctctgacagccagcttttgcttaggacacagtaaactgaaaagascgacacctccattctttaaaaagaggcaggtagataattgaaaaatcacaacttatcctgaacacatcagagttgaggttgcagaatcaaccgactgaca

SEQ ID NO: 29738 - DNA, 201 bp, Bos taurus
gctgccagacctggggctgggctcggcctttctgctccccggcgctgccccctcccggcacacgcctccacgcttgcttttgttctaacttagcacagtcrtgtagaacaaaacacagctggccgtctctgctcgctaacaaagaggaactggaatgtaaggagaggtggaaacttttccatctccagtctcactgggatg

SEQ ID NO: 29739 - DNA, 201 bp, Bos taurus
aggcccaccgtgctgggggagggatctgcaggtgtgcacaccctggggcagtggggaggaggtcgcgaccagggtagcatcctgggtcgcctgagatccartgccataggccccatgtcctctttctctcctaagtcttaccctcagcctgacccaggagcagaagattcctgcccctagagagctgcttgccctgggagc

SEQ ID NO: 29740 - DNA, 201 bp, Bos taurus
cctcaaggtcactgagggtcaacgggcccctccccagaggccactgcttcttcaggactcaccctccacagtttcctctgggttcctgcagatgtacctcrctgtccctggtgttatcacccagagtgccctgcgtcctgtattgggttccttacacactccccacatccctgtaaataatctcttcttagaattatctac

SEQ ID NO: 29741 - DNA, 201 bp, Bos taurus
ttttaagagcacagctcagccgtgtgaaacatgttcacccagctgtggaccacctccagagccttttcatctcctgaactgaagctctgcccccgaaacayggactccctggcccctccccagccccggcccccaggcccaccatctaccttcggtctctatggatctgactcccccagggacctcgggtaagggaattgt

SEQ ID NO: 29742 - DNA, 201 bp, Bos taurus
ctgcactccattttacagagaagccccgcttcagctgacatattgtgtgtagtcaccagccatataacacataggacacagccctctggctgaagtggggraggccccgggcccctaaattcctgccccaggttggagaggcccagtgtgccctgtggaggtggcctggaagaccctggggcccggtggtgctccggaggg

SEQ ID NO: 29743 - DNA, 201 bp, Bos taurus
ctgcttgtggaaagtcttcagcgcctgcatcactgctgaggtgcactccacgtacgtgtagtcaatcatgatgtcccctggaaaacggaaggaaagactcrggcaatccaggccaaaccatgagacaggagagtgccgtaacacacggtgcctgactgtcctccagaggaaaggaggagatgtcaccggcgaccagcctgg

SEQ ID NO: 29744 - DNA, 201 bp, Bos taurus
tgggacctgctaccaaccaagaaaccctaggcctggattcagcactcctcctgacaccccctcctggggctgagcagacacccacagaccactcagctggyggtggaaggccaacagctcccgctccagaagaccccaaatcgtcctgacatctgaacccaaaggcaagtgcgggtggaagccatggggggccaggggcac

SEQ ID NO: 29745 - DNA, 201 bp, Bos taurus
gtttgaggtcagaagtggtcagacattgggaattcacatgaatcagtgatagttccttcccttgaggaaatcgcagggccactgtattagagaccattcaraacacacggtgagggtgtgagacgctgatggggagggcagggtggcaggcggaggacagaggggcctctgcaagcttcccatgcaggtcagacttctgac

SEQ ID NO: 29746 - DNA, 201 bp, Bos taurus
gtcctgggcctggatgtggtgggtgtagcgcctggccccagagcgtgtcatccacctgagaacgcctcttactccctgggttgtctcccctgagcttcctstctgctgtcgtcttcattcttattgaccacatgttggacctcctggacttaaaactttctctttttccacatctttgttttcttgttctcatattcaaga

SEQ ID NO: 29747 - DNA, 201 bp, Bos taurus
acagctccgctgaggaaagggccttctctgaaccgtgactgactgcatcgtggttttcaagaaaaaaacaaaacttttatagatctcagtatgttttagtrtagcctggagtgtgagcgtgctcctctcagcagctgcgtatagacgtctcagaagaaagcaaaatcttcctcaccatgaaaatcatttctgtaaatgtct

SEQ ID NO: 29748 - DNA, 201 bp, Bos taurus
ccaccaccatgagactaatgggttgattgaggtgaaggggtacagcgtctgggcctggcgccaggcatcttccacactgggtgcctgacggccttccgctyagctctcgtgtccactctgtctcatgcagggtccatatcctcctgtgatgcgttcctcaacgtcttccaggccagagggctgaggccagaggtcatctgc

SEQ ID NO: 29749 - DNA, 201 bp, Bos taurus
ctcactcaggtcccctcgtgttccagaggttgggcctgcctccatgatcgttgggaacctggtcgccgggaagagaatcgctcaggcctcagggagggagytgtcgcacctagaggacagtgagcaggctaggaaggtaagggggttggaggggagggtgaagaggtccctgggaagccatcaggcccgaccctccccaac

SEQ ID NO: 29750 - DNA, 201 bp, Bos taurus
attggtggctacaaaagcataaaggtcataaaattccctggcttcaccaacagctggaagcagaccctgtctgcacagacagatcaagaatgaccttcacygcacatcagacacatccatcataaccttcattctacagacagaacaggaggtgcaggtgcttgggtatggccatctccagggcagagctgtgacctgccc

SEQ ID NO: 29751 - DNA, 201 bp, Bos taurus
tttgaatccctggttgctgttcttgagccctatgtggggtgcctcatctatgaagtgacctcaatggtggcgaaaaatcgggagaaatagaggggctgtgkcaggcaaaaggtgtcaggagtatgaagaccctgaagaggggccgagctggtaaggctcctgtctttttccccactcatgcggcagtttgctgttttcttt

SEQ ID NO: 29752 - DNA, 201 bp, Bos taurus
cttcctgtgcctggggggctgctctccaaggacaggaaggggcttagctgcagggcctggggaccggcatctttcaggtggccgcccaggtgctgggcacytggtgttccttctctcacttgctcgcagtgttcctgggtctgcagccccatttgcacccactgatgctgcctggtgcccgggcctaggtctgccctgtaa

SEQ ID NO: 29753 - DNA, 201 bp, Bos taurus
ttctaaagtcttcgggaacgtggcaaagacgcactagcaagctcattgaaagtcctcaggaagagggctttccttttgtcacatggacttggccacagtaygccaacacaacagcttctggacatcagagcaacacggactgatacaaactcagtccatggtctgtatagaatggagctgtgtacctcatggggccgtgtt

SEQ ID NO: 29754 - DNA, 201 bp, Bos taurus
actcagacaattgattctcaatgatatcagagtattgactcactcaatctgaccacaacgtaaaaacattagtctcagaacggtgccggtgcccatactcycgggactggtggtttcctcctgttagtgttgtgatagtcgtgccattatgggaatgtttcaatatgcaggaaggcctgcattttcctggcacacagatat

SEQ ID NO: 29755 - DNA, 201 bp, Bos taurus
tatctgcattgttcatttttgagatatttctttataaattaatctgtaacctcctgcagatgcaggccaatctgggataagaaggccaggctaaataaatraaacagctcaattccagatcagttttccagtgtctcgcattaacttctaggagagctctgcagggaaggcctgctcttgaggctaaggtcagcaggaggg

SEQ ID NO: 29756 - DNA, 201 bp, Bos taurus
tccaagggcacatccagccctggcctcactgccaacaacctccagagacacagccgcgggggttccctcccgcctctgctattcctgaaggcacagaggayccatgtggtcaccgaaccaggggccaccgtcctggatagtaccagagagtgctctgagactacttagccagcttaggtgaaaatgtactctgtaccctct

SEQ ID NO: 29757 - DNA, 201 bp, Bos taurus
atgacagaggatgagacggttggatgatatcactgactcaatgcacatgagtttgggtaaactccgggagttggtgatggacagggaggcctgcagaagtrtatctgaaagtgcagattgccatactgcagttaccagaagaggtgacattcaactggaaatgggccagcagctagccattgagagccgcctgcttgcctc

SEQ ID NO: 29758 - DNA, 201 bp, Bos taurus
taaagatctcctcttccatttgcaggctggctgtgatggtgagagtattagaaattgcccattttcttagcgtctctttatgattctctggctaaagggcrttatatttaatgtgacaacaggggacttgaaaaggtaagaccaggtttctgcagtaatgaaataactatccccaattccctatacacacaggcacatgga

SEQ ID NO: 29759 - DNA, 201 bp, Bos taurus
tatgtatgaagggcgctggtatacctattgtacagatgaggagagtgaggccacacacctaagtgtgcaagcagcaagcaggccacctgctcatactttgycacactaccttccaaagagctgcagaatcggcacaaacagatgcatgtgtagttatcaggaaacggaggactatcaattgggacatgatggctgtggggg

SEQ ID NO: 29760 - DNA, 201 bp, Bos taurus
tcctctgtccatggaatttttacctgcaacctacttcctatggtcacttgcaattcaaaactgtttgaaagcttctggcctaaaatgtcttttttccttgmtacttattttgttaaagtgactcagagggggagcctgtatgagtctctgtgggtcccctaacctggctgtgcctctgttaccaccctggccaagtctaga

SEQ ID NO: 29761 - DNA, 201 bp, Bos taurus
aggctacagctctgcaaagagagggtatgagaacacatctggccaggatcatctggtgactgatgagcagacacagatggcagtctgaaatgagtttgagyggtgacatcccagctgtctccaggccctgctaatcatcttgaaagtgactggtgagccctacaggactctaacgtgtgggtatcacatgtctcctgagct

SEQ ID NO: 29762 - DNA, 201 bp, Bos taurus
gaagaaaacaagatattttccccgctcgcttggagctgcagttggggagggcacacacgctataaattacaggcgacaagaaatgaccacagtgcggggcrctgctcatggccaggctcggggaacagggtaccagctgcgaggagaatacggactttaatagagagtagggcaattcttctagcgtcgcgctctaaggca

SEQ ID NO: 29763 - DNA, 201 bp, Bos taurus
gcagggttttcttcctctcctagccccgtggcccactgccccacaccctatccctgttgattgatcgagccttccttccagcgctcagctctgtctcattyccaggcacacaggccctgtaagcacagcggactgaggatccccaggacccagctgcacaaaagacccgggcctgtgagaaggctcagagcaacatctgcc

SEQ ID NO: 29764 - DNA, 201 bp, Bos taurus
cagaaaaatctccagtgtcagcatgtcacaagtgatcctagcgcacaggacatactcagcgccccgtaactagaccatgtccaaagtcaatggaacttcamttgcaaagcggaagctgtgaatgccaaactgggcagcacagagtgccagtctcaacttccttgaagtttgtttgtgcaggtttggaaatcacagagaggt

SEQ ID NO: 29765 - DNA, 201 bp, Bos taurus
gctcagcagaggcttggacctctagagctcagaccaggagcttctcccaacagctcccactgcctcactagtgatgcattgtaactaagaagcaacatagrtgcaggttttgtctacattctaaagtagacctaaaaagaagcaagaaatagttcaaagtttacacttccccctgatgcactaactaatacaaggaaggac

SEQ ID NO: 29766 - DNA, 201 bp, Bos taurus
ggctgtgcatcagcccccagaaggaacagagtccacacatggcctgatgatagggggtggggagggaagtttgcatcacctgaggtctaattcaagagacmtcatagattgtattggctccaatttttaaactagggcttcacaattttttcacagaagaaaaagcacaagcaactcattagatcaaaacattattctaga

SEQ ID NO: 29767 - DNA, 201 bp, Bos taurus
tggtctctggagctagaccagagaataggcctcaacagcttttcctttctccatgcaaatcttctcataggtctccacatctagggactacaggaccatcygtagcaagtcttaattacaaggaggcctagccttgacctcctatgggagagacatagagttagcctgagtataaagatccatccctttaagacagcaacg

SEQ ID NO: 29768 - DNA, 201 bp, Bos taurus
tactggagtgggttgccatttctttctccaggggatctttctgacccagggatcaaaccaaggtctcccacattgcaggcagacacttttccaactgagcygcctgggaagcctcatataggccattacaaagtatcaagcagagttccctgtgctgtacagcaggtccttatcagttacctatgatatatatagtagtgt

SEQ ID NO: 29769 - DNA, 201 bp, Bos taurus
tgtatgagcagggagcagacagcagcaaagaatccttttcagttgaggacagcatgatgggacttcaggaagaaagtggcccttgaacctcttaaaggatragcaggactcagatggtgagtgacaaagaagggcaccctgatcagagcagggagacaggatggccagcatgcatggctcattccaggagaagcatgggac

SEQ ID NO: 29770 - DNA, 201 bp, Bos taurus
tttaaaaatacatactatataattaaataaaaccataaaacacaaatcaatagtgaaagtccgaagatggaagaaaggagggttcaaaaaggggccagatyaaaggattaccaagggaaatgagaaacttcttagggtgataaataccgttcacatcttgaccttggtaatggcctcctgtgtgtatacatatgtcaaatt

SEQ ID NO: 29771 - DNA, 201 bp, Bos taurus
ggctgtctgcaggaggaggaagtggcctgccacagaggagtgtgtgctgatgggaggctgtctgcaggaggaggaagtggcctgccacaccgtcctcctgkgagcggaatgaggaagcagagtccactcgcgttgatgatttgaaagtcagttgtgttggccttatcacagggggcccggagcaatcagaaagcgaagagg

SEQ ID NO: 29772 - DNA, 201 bp, Bos taurus
tgagggggagctattttgctaattaaagggtaagaaactctcactcttgaggggctggagcaagtccctgggtcccttcaggactgttaaaaaagaggccytttgctctctggtcaagaaagagtgttcagtttaatccaaggcatggacgtcactcaggagttcatggcccttgcagctcaagaccggtctggcaagggc

SEQ ID NO: 29773 - DNA, 201 bp, Bos taurus
acccacgttagaagtactgttataagtaaaccggaagtagaaatctccagtttgtttatgagtaagccttatattcatggccttcttaaggcttttgtgartacttttcagttttttttccctttggctatttagaaaaattatttttggccatgctgggtgtttgttgcagcaagggcattctctagttgcggggagcag

SEQ ID NO: 29774 - DNA, 201 bp, Bos taurus
acagcaggtcacaggcccgcagttcaggaagggaacgtcagacctaggtggagagggggtgtttgagggtgagcaaggccaggtctcccaaggatagactkggaagccccccagcatgggggcagtggtcccgagagcaggacctcagccttggctcctggccaggatgagagaaaggaaccgtgtctctgaaaataagag

SEQ ID NO: 29775 - DNA, 201 bp, Bos taurus
gccaggtgcagtgtcctggcacttctggcctgaaggctggtggggcgggtgagccctcaggcagaaggaagtcagacagagcacacagagggacaacgacraggccctgacaacacctgtcacactctcatatcatacaagtcacactgatagtgcccaaagagaatttgtgtgtgtgtgagtctgtgtgctcagctgtgt

SEQ ID NO: 29776 - DNA, 201 bp, Bos taurus
gctctgggcccagacagatcaagcttagacctatagggaaatatgattgaggttcttagaagacgtctgtaattctggtgtggctctgccgggcctggtgktgtgtgtctaacatgtctgtccctttccacaattccagagactttctgtaattatatgtagtttggggcctttccccttgatgagtaacctcttcttctc

SEQ ID NO: 29777 - DNA, 201 bp, Bos taurus
gtttgctggagacagaccagctcaggggcagctcggccctgctggctaactcggccagctctttggcactgagagatggggtgctggtctcgtaggtctcrtggaagctgttgtagtcgacttcgtagaacccatcctccagcgtcaggacaggtgtgaatcggtacccccagaggatctcactggtgatgtaggagcttc

SEQ ID NO: 29778 - DNA, 201 bp, Bos taurus
gcacttccggtgcggggtggttctgagatgggggtgctccgccgccatcccccgaaagagcccctcctctctgtccacagcagaagagccacccaagctcmgtggggatgtcagggcctcgtcccttgcttcttcttttctccttcctctaaagggaccctgtccccaggtgagggtttatcaggggaccagagtgaacca

SEQ ID NO: 29779 - DNA, 201 bp, Bos taurus
tgagaaatcaaaaagacaggatgctggccccagagagctgagatgcctgtgaaagagatgacctcaataatccgggcctgttgcatcttcccgtacctacragagcgctaaattccttaatgtgatatccatgaaagtgaaagtcactcagttgtgttctactctttgcaacctcattaactatatggtccatgggattct

SEQ ID NO: 29780 - DNA, 201 bp, Bos taurus
tggcctcacaggccacgtacagagcctggatccacttctccaccctcctctctgcctggctgatgcccgctgctgtcctaacgtggaggaaggagacgggyttcagagtgaggtcaggtgcctttgactcgcatctgctgcttgctagcagcgtgccctggacacctcgtctaatttctttcagctgtggtctcttcattt

SEQ ID NO: 29781 - DNA, 201 bp, Bos taurus
gggaccatttctctgttgggggttgataattctgagtcaagatgctaggtcttcttccctatcaatgtccagctgtttccagtatttcttttcaagtttgycttgcccgaggctgacggacgaaagtgacaaagtaaaatctgtatgctcccctctgccccccaaccaaagccactccttgagatctaagactcaaggtcc

SEQ ID NO: 29782 - DNA, 201 bp, Bos taurus
gaagtattcaccttagggattagctggtccctttttggtttctgtgagccttattctgaccctaatcaacacaccctgggctacctttacgatctaaacaygttgactcatttctacttgccaacttttgggtgggctgctcttctgaccacacagaagcctttgacactaattcttgtatctttagcttgtgtcttacct

SEQ ID NO: 29783 - DNA, 201 bp, Bos taurus
acagagaagcctggtgggctacagtccatggggtcgcaaagagtcggacacaactgagagacttaactttcactttcttttcacttaactttccaatactytggccacctgatacaaagaactgactcattggaaaagaccctgatgctgggaaagattgagggcaggaggagaaggggatgacagaggatgagatggctg

SEQ ID NO: 29784 - DNA, 201 bp, Bos taurus
cttttattgtagctgagcagatgtttcttctttattacacatttgcttatgccttcagttgtagggtctgtggtctttcttggaggaggggctacttctcrtttccaattgcctgatcagtcactggaggagtgatgggaaaacttcagataagatccacaggatgtgtgtggatgctggaggcaggggcttgggttcaca

SEQ ID NO: 29785 - DNA, 201 bp, Bos taurus
aggcagacacttctggactataaattcaagaattttcatggagctcagtctctcaaaatgcccatctcccaaaaaagattttcaacaggtggtgccagccrtgagtgctctgcttaggataaaaattgcacatgtgtattattagtgctgctgaatttaataaatgcacccaggtctgttaatttattcaaattttggata

SEQ ID NO: 29786 - DNA, 201 bp, Bos taurus
ttaccatctgaaccatctaggaagagagtggcaaaaagaaggcattcatcttagctattaatcaaattaaattgatgtgacatccatcacagtgggttctrttagtaacagaaggctatgctgtggacttcccggcactttgaacaactgaccatcagcacagcaaggctatgtgcatctaaatcaaattccagagttagt

SEQ ID NO: 29787 - DNA, 201 bp, Bos taurus
acgttacaatcccaccttacaggggaggaagcagagctcagggccctggcgcagggtcacgggactgggagggactcaaaggcaggggtgtctgtggccayaaagcatcagaaacctcaggggcaatctgacagagtccccagtgaagagaagagctgttccccatgcatttggggtccccgatgcatttgaggccgtccc

SEQ ID NO: 29788 - DNA, 201 bp, Bos taurus
tggacttgttggatctcctttctgtccaagggactctcaagagtcttctccaacaccacaattcgaaagcatccattcttcagcacacagccttctttacrattaagtaatagtgccaggcttcaaacctagaccatctggccccaacccacttctaaaaaatgggccaaaaaatatataaacgttaaaggggaaaggaac

SEQ ID NO: 29789 - DNA, 201 bp, Bos taurus
aaggcccaggtggtatggcctgcaggaggctctagaacccaggatgagctagaacgagacctcggtggagaagtagacctggagagatttggggacttgcygtcttgcagtgggactggcaaggcagctagtggcaaagaagctgatggctctgcctctgtctaaaaatgccccaagcttcctgttctccaggaaaaactc

SEQ ID NO: 29790 - DNA, 201 bp, Bos taurus
agcagagctttgacatctccagatcaaacgtgttattgcttacctggacattcattcagcacacctgcataaaaacgcctttccagaaaggttgctggccytcctgcttctgttcagagcaccaaatacccatcacgtgtgattttaggaatcagtgaggatcaacaataaaaaataaagggacccaaatgctcctctggg

SEQ ID NO: 29791 - DNA, 201 bp, Bos taurus
agataaataggtagattaattttgagaaattggctcacactattatggaagctagcaagtccaaaatctgcatgataaactagcaagttggagacccagaraagaactggggttttagttagagtctgaaggttcttctctggaggaagcctgtcttttttctattaaggaactagttggatgaatcctaccgactttatg

SEQ ID NO: 29792 - DNA, 201 bp, Bos taurus
cattctgtcggcccaggaagaagcttggggcccccggcctagccctgggcaggctgtacggtgacaggatcggtcaggctgttgggtcttctcaaaggagsgagcgtgtcacagacgcacacttcttggatttttcttttgcctttttgcagccaggaatcgcacaagagctctctttggttctgagggggaggagggggc

SEQ ID NO: 29793 - DNA, 201 bp, Bos taurus
gcatatctccccaccccctaggagaaccggactagaatcttccttggcttccacacagatttcttgtctcctcaagggcttacccaaggtggcccaggaargtaggaaaggctgacacatgacccaggacacctccacaggaggggctgccggtgggagggtcttgtatagggccaccccagtgagcctgcagagagtggc

SEQ ID NO: 29794 - DNA, 201 bp, Bos taurus
gacaagctcttgtgctgattaggccaaggcgataagacacgtgtgggtcagttcttgcagaatcctcgaaatgtccgaaacagccttcatctgatggacgygttagcatgggccaggcacgcaggcaggcagaggcggcacttccagtcttgaaggaggaagaatagataaggggctcttgcagataaaatctaactggca

SEQ ID NO: 29795 - DNA, 201 bp, Bos taurus
agtgtgtctttgagggtatggtcacatattaagcatgggagtcagaggggaagggcagaggcaggaatacacaagaatgggaggaggaggaaagcgtaagyccagagcaggtagagttagcttcaggtgagacagcaacgctaaggagcaggcgttctcacagtggccaagagtgggaaatagtcttagacgtctcatcag

SEQ ID NO: 29796 - DNA, 201 bp, Bos taurus
ctgtctatatgcacaaaccatggccccgcgatagtgaggggacattctctcaggcctgggacacacggctgagtttaccttgcctgcactgctttctctcrtccagcctcacgctctccctttgtattcgatcctttttgcagcaaatttagctgtctttgtcttcctcctccctctttgttaagaaaaagttaaattcct

SEQ ID NO: 29797 - DNA, 201 bp, Bos taurus
ctttgccagctctgccctgagtcagtttcctcagggtagtaagtcctggggaaccgccccacatcagccatttcatcaccccacttcagctcctccagagygggccacttggcctctgtgggtccttactgtcgtccttctggagccgggagttccagggggccctggctggcctcttcttccctgtcaaaggaacagaca

SEQ ID NO: 29798 - DNA, 201 bp, Bos taurus
tgctcactttcctcaagggacagatgcctctgacaaatgtgcagaaggggaagtctttgaagcagtcatgagtaggcccagtttacacaagggttgctgakaaaatggagttctgaaaagtaccatcaagtgaagaactttcctgatcctctttggcccatctcccttggccagcccatgctggagaggttggacaccatg

SEQ ID NO: 29799 - DNA, 201 bp, Bos taurus
ataaacagctcatacaactcaatattaaaaaacaactcagtgaaaaaataagcagaagacaaggagaactttgtacaaagatgacatacagatggccaacrggcactggaaagatgctaaacattgctaatcatcagagaaatatagatcaaaaccacagtgggatatcacttcacacctgtcagaatggccatcatcaaa

SEQ ID NO: 29800 - DNA, 201 bp, Bos taurus
ggcccccagggttcagaatgccctgcctgcctcacctgtctcctctctccagtggctttccttttgtgtgtgtgttggggggaggggtgcgttggtattcwctggccttccttggcactgcccaccagacttgtgctgtcaaacatggcccacctcagcagtcccccaagagatgtgataagaaccaggaacacaatccag

SEQ ID NO: 29801 - DNA, 201 bp, Bos taurus
gaatgctctcaggtaaaaaatgctcattttttaaactgagttttctatttctactaagcttgtttgttcattcagtctttaaggttttcttcttcctttcytcttaccattttaacattaatcttcatttttaaagtctcccaaagatttgcaccaatgaaataattcattgaattcacatgagtctgcctaagtcaggtt

SEQ ID NO: 29802 - DNA, 201 bp, Bos taurus
cagtggctaagattccacgctcccaacgcagggggccagggttggatccccggttagggacctagatcccacatgcagtaaagatcccacatggcacaacraagacacggcccagccgagtaaaataaacacacaaaatacgacaggaaggagcttacctacacagagaaacagactcaaaggcacggagaacagaggcat

SEQ ID NO: 29803 - DNA, 201 bp, Bos taurus
ggtaatgaaatgaatgagaaactttggaaatgaaagaattcctaaactccttgagctcttccaaaaaggtttccccttgcatttcaagtcctaactcccaytctaagcaaaggaatgagaatggctgcatctttgggtatggggacccagcctaatgtagcccatctaagagggagatttctttaaagttttagagttcat

SEQ ID NO: 29804 - DNA, 201 bp, Bos taurus
cagaccaagatgaaagggatgagactgagatataagttaagagctgaggccccagaggtgccaatggactcaaaaaaggagactgaggtggaaaaacagaratgaaagctgagtaggtatgactaatacaaaagggtgcaacggaagagctgggagacccctaaagaggccataggaaaagctgtcccgtgattcagaaaa

SEQ ID NO: 29805 - DNA, 201 bp, Bos taurus
cagccagtaaccattacttgccctccacccagatataaatgaaacagttcttttatttgttttatatattgggcttcccaagaacattgtcttaggccaarcttcctggaagcagaacctgagacagttttagatgcgtacaggttattgaggggttccctggaaagaagcctgtgagggagtaaggggagcaggccgtga

SEQ ID NO: 29806 - DNA, 201 bp, Bos taurus
tatataaacatatgtgtgcacatacttgaatgcaatgggtatcagtatataatctcccttcccctctaatgtgttatgtacagtctttccaagttggtgcrtacagaccgacgcaactccctctgaaagctgcggttccaaagtacggaagttgctttattgactcggctgtctccctcttgatcgacatggacattactc

SEQ ID NO: 29807 - DNA, 201 bp, Bos taurus
gcctggcaggctatggtccatggactcgcacagagtcggacatggctgctcctggcaggtatctgttctctgctatttctggctcagctctggagcatagyggccttctgtggtcctgggaaagcagttcctcaggcccaggatgtggattcccttctgaaaagtcacaggagccccctggaaagctcaaggaatatcagg

SEQ ID NO: 29808 - DNA, 201 bp, Bos taurus
gttcctctgagtgggtcaggggtcaggctggctcacagaacctcaggaaacttgagtgactttttgacgcttcaccatgtcaagaaggcattacaagcccygttgagagagtgtctaacacaagggaactctgctcccactccatgcccaccccttcccctcaccatggcagcacacggcctgggccgttgaccagtgagc

SEQ ID NO: 29809 - DNA, 201 bp, Bos taurus
caaaacagccacttgccccagaactctctgggctgctgctttaagatgcaagtcctgagcctcatttgtgtactggaagcaggatctctcaggccagcacyatggagaattctggtgctaatatttgggaatcattgtttaaaaatcttcgtcagagcattaggtcaccaatccaggctacaacagggcccaggacacaaa

SEQ ID NO: 29810 - DNA, 201 bp, Bos taurus
ttctgggagggtggcccgatggggctgccaaggtgccactcttgattgtcccagactgtagttctgtacaccttgtcagtgacgggtagaagacagggcaygtgacacaattctggccaacaagaagtcagccagaaagacttctaggaaggtctccctcatttcttaaagaagaagaaatcaacgaggccttctgttttt

SEQ ID NO: 29811 - DNA, 201 bp, Bos taurus
tctctccactcatgcattcaatggaggccataaaagagggaagttccaatgttattccggatcactctgggcagaattgttaaaggtcttatttgttcaaycaggcagaagccagggagggcccagccccaggggtcattctcacgcctgagggtttctggctcagccctcgtctgttcctgcttctttgactcttgggct

SEQ ID NO: 29812 - DNA, 201 bp, Bos taurus
ctaattgatttgctaatgtacacaaaagataataatttctgtctttgatcttgtatttggcatccatgctggctagcatcttcatagatctcatagtttgytggttggttctcttgcctctccatgcagacatttaaaagatctgcagataaagactgttgtgtgtcttttttcactggtgtatatcttacatgggggctc

SEQ ID NO: 29813 - DNA, 201 bp, Bos taurus
cttttcttttttttaagatgcagctatatgctgtctatacttctgattcaaatataaaaatagtttgaaagcaacaggatgggagaaaatgtattatgcargcagcaactgtaagaaagtggagagctacgctgatactgagcaagcttccctttctcgatcttaacctctcaggagcgtcattgactgttcttatacaga

SEQ ID NO: 29814 - DNA, 201 bp, Bos taurus
tcctgggacctgataacacgcccctggtggttctgaacctcagcgagcagtaccccaccatggagttgcaggggatcgtgcccgaggttctgaagaagatygtgacgacgtacgacatggtgagtggctcttcggactttcagggtgccgcgggggagagaggcgtcttgggccggtgcccctggtgtgctcggggctctg

SEQ ID NO: 29815 - DNA, 201 bp, Bos taurus
tgccacggggctgtagacttcctgcagacagcggctgagtcctttcggttaccggccccagtggcgttcaagggctgcctggagggaacctcacagataaygaatgaaggcctgagcgagcacctgctttgaccttcaaacttcacagtgtttactggcattttcttagaacagtggacgttgataaatgctgtgtgactc

SEQ ID NO: 29816 - DNA, 201 bp, Bos taurus
actcaccctacctgattgtcactggctatccactaacatctttgactgtggacaccgttgctgggtattgttgtcacctttgcttgacatggaaaggacartatttgcgtccccccttcatcagcttgcaacataattcaggtatctagaacactctcctcatattcttctttcccagaccctattacaggcatcattttt

SEQ ID NO: 29817 - DNA, 201 bp, Bos taurus
ctcaagagtgccaagtcttcaagaagtatgacctcgttccctggtgcgctcgcgggactcctggaggtggggtacaggggcgccggccttgtgcagccccrttttacagagagagaaagcaagaccagagcccaagcactttgcctgagggggtcaacgagtccctggccagcaggagaccacaacgtggggttcctgatt

SEQ ID NO: 29818 - DNA, 201 bp, Bos taurus
aatttggaactttccaactgattaaaatttttttcttgctttagttgctgggagatttacactaaacctgatgttcatttaaatttttggtaagctgattkccattcttatatatgattttaaggttcttatttgtatctcacacttctatgataagactttccaaacattttgcttgttttaatatagctggtacagaca

SEQ ID NO: 29819 - DNA, 201 bp, Bos taurus
gccagtccagccctggcctcagccctagctgtgcacacgctcccatcgtccacccctgatagtctcgcctccagggttttctcagtgacaagaatcctgamtgatctttgaaaggggccacttgctcaacctctgcactcacgcttctttttttttttttttttaagtagatttacaatgtgttaattttggatgtatagc

SEQ ID NO: 29820 - DNA, 201 bp, Bos taurus
tgtccatcttagtttgtgtcaagaaggccctctttctactctggaatgtgtccttcacgggtcatctcaagactcactttggaaaagggtgaagctgaagrgttacttcacaggccccacaatccgccccttttcttgggcatcccagggctcatctttctgagtttgcttctgaggctgccgcgccatgggcgtcacaca

SEQ ID NO: 29821 - DNA, 201 bp, Bos taurus
cagagcagctgagcctgtgcaccacatttaagcctgtgatctagcgcctgggagtggcaactaccgagcactgaggcctaggtgcctggatcccacgctcyacacaagagaacccactgcagcttgacgcctcttcttcctggactgtgtgagcctgtaatccacctcccaggatccacagtccctccttccttgacggcc

SEQ ID NO: 29822 - DNA, 201 bp, Bos taurus
gaaggacagggaggcctggcatgctgcagtccatggggtcgcaaagagtcagacaggacttagcgactgaacaacagcaaagttaatgaaaaggctgcagkgctcaatgggaggcccttttgtattgcaggtggaatatcccaaggctgtcgcagcaatgcaagaagagccatcatatcttgggacattttagtgtcctct

SEQ ID NO: 29823 - DNA, 201 bp, Bos taurus
acctaaaacaacggggttccttggaaactagctggataggaatgccaagaagacaggttagtatttgatttttagaattggccaaggggcctttttacatragttaggatgagatcagagcatggcatgactttcttttccaacgtgaaccactagagaaattctcctctcactgtaatacacagtgggaataagcaaggt

SEQ ID NO: 29824 - DNA, 201 bp, Bos taurus
caggcacccctccctacaccccagccccaaccaggcatgaagaagctcgggttccgagaaccctccgatggcgagaacccataatccgtgaatacgtcaaygaagacaggaaggcccccagtgttttgaccactgattagctcagcgtcccgaattcctctttcctggaagaggggagctagctttggtcctgctgctacc

SEQ ID NO: 29825 - DNA, 201 bp, Bos taurus
taagccaagcaaatgttgagctgccagttaaaaatgtaccacctgccttccccttctctttaatatattctttaaagtagcatggtggaaggtatccagcragactcagagcatgctttttaatttgaaattttgagcatccagattctagaagcaatcctcgttttggacatgtaaacaatgaaggtatttgaaggcttg

SEQ ID NO: 29826 - DNA, 201 bp, Bos taurus
accttaggggttaagtaggagtttgctagatatacatgtgggtgggtatctttggcagtattcacagcataaccaaaggcaggggggagcttttgtgctcmggaagtgctgttgtactcacggaacttagctcccctgctgtgatcatggtattgaaatatgtgtgtgttagggtcagggtgtgttggtgtcagctcacac

SEQ ID NO: 29827 - DNA, 201 bp, Bos taurus
gtccatctgagacaaagccagacgcggggtcacaggaagagcttcaccccgctgacaccttctcgcagaggtccccacaggctgaacccagcctgatcacrggacccgagggcccagttgaggtactccatactcgtttgccatgaaaccaaagacgtttaaacttcaacactcccaattacatcattccttttaaggcct

SEQ ID NO: 29828 - DNA, 201 bp, Bos taurus
tcttttctcaatcttgatcctaagaattaactaaaaaagaatatttaaaaggtcatgttgtcccttcctgtgcaaatctgggagataaggctgttactaaygcattttctaatttttaaagtaaatgttaaggggaacatttggttctcttatgaaaagcttttcacaaacaggtcaaatatgttacaggtggtggaaaca

SEQ ID NO: 29829 - DNA, 201 bp, Bos taurus
gagtgaggggtaaacctcaatcagagcttttatctgggtttctgtgggaacggcgaggcagcacagcatgaatattttaggattggctagcttgggcttckccagtggcccagtggtaaagaatccgcctgcgatgtagaagacacaggaggcatgggttcaatccctgggtcgggaagatcccctggagaaggacacggc

SEQ ID NO: 29830 - DNA, 201 bp, Bos taurus
ggaaaagagagtgaaagttacaggccaggctttacaaataagagtgaaaggaaaagaaagccaggggcttttatttcagggcgaaaatgagaacagcacgrgatatgggccttctggttcagcaaagcctccaagatgccttccagttgaaccttttcctgagcattgtaaggatacttcataaatggctgttcttaagct

SEQ ID NO: 29831 - DNA, 201 bp, Bos taurus
accatcatctcctgaatttttcactttcctaaactggctctctgtcaccattaaacactaactccccaacctcccaaaccaacacccgccttggccctggygtctacagatatattttctgacactatgaatttgactattctaggttcagttcagttcagtcactcagtcgtgtccgactctttgcgaccccatgaattg

SEQ ID NO: 29832 - DNA, 201 bp, Bos taurus
ggtcaggaaatgctttgttaagaggtgggattgtccacctacttaaaaaaggtaaaaaaagagtagaaggccatttcagggtagtaaagcattatgaggaragccatcataactgaaagtgatggtaaaattaatgacgtgatgtgttttcaggcaaaataccggtcatttctataatcaaatgttttccctgagcctcac

SEQ ID NO: 29833 - DNA, 201 bp, Bos taurus
gagcaggaggatcaccaggcaggccatgccaattcctcggaaggttgcagcagcccctgtgaaaacaagtgacactctagagagtagttcctggaaaggcrggtagccctcacccaggcctgtagatgttctaaagctgacaaaggcagcagagcagagaatggcaagtggccgttagcttcataccgaaggaaaaacaag

SEQ ID NO: 29834 - DNA, 201 bp, Bos taurus
tttttctgtgattgctctcaccccctcccttggctttaatcccggaatatttaaggatgcccccaacccctctctccagggcagctcctctcctggtgccrgacccatgtggccaattccacagggtgtttgtttcacaggcgcccatctaccacccctcccccactggcttttacttctgggttcccaaaccgccctggg

SEQ ID NO: 29835 - DNA, 201 bp, Bos taurus
caatttcagtgtcatgtggagttgagagtactgggagctgttacaccccaagctagggagcattctggaatgactaggccagctctactaaacgaggaagmaaagcctttggtctttcagcccttgtactcggcactcgttaacagatgaagctggaagacgtcactatcttcagggcctccaaagttttcattatctttt

SEQ ID NO: 29836 - DNA, 201 bp, Bos taurus
atgtccccggtctctccaacctgtgactaagatcacaattccccctttgtatataggctttcacgacacaaactttcaacctatgtgactggcccgagtcygatattcctctgatttctttctgcaaataccaccaggagagtcccaaagcacaacaacacatatgccgcagagtaagaatttagattctcccacttcagc

SEQ ID NO: 29837 - DNA, 201 bp, Bos taurus
cacttcctcgcccccacagccattggcggtcgatgtctgttgctgggcaaattatcctcatttccagtttgcagaagcagagagtgagacatgttcccagragcaaatcagtgtcaggccctgtcatagctgagacagcagtactcaaagaggggttctgaaggatgctggttaactcgttgagaccctgtgtcttggttg

SEQ ID NO: 29838 - DNA, 201 bp, Bos taurus
tccacagaaattgtgattatcccagaaacagtgaccactaccatgctaaattaatagttctcagtcctcatcttacttgacgtctcaaggcttgaccactygaaaccctttctcctctccaatgcctggacaccacacttcttgccaattccaccctcatttaactggagctcctttgagatctcctttgcatacatttta

SEQ ID NO: 29839 - DNA, 201 bp, Bos taurus
aatgactaaacgaattatagattagatgtatgatagaatattacatagttgctaaaagggctgttcacagacactaggaaaccagtaggacatcaagagaktgcatgtaacatgcattcgcaaatgacagaaatttgaaacaaatactgtgttaaaaattattatatcagggtttattaaatgaaatcattttctttgtac

SEQ ID NO: 29840 - DNA, 201 bp, Bos taurus
atgcacttttctttttttgtatccagggaccaaatcaggattattatagatttaggacattaatgctagattaagtgaaatctatttgggccaattataaygagtagtggttatattaatgattgatttgagaagtgaaatcaaagtactctcagattcaaggaagatgtttcaagagatgttctctctctctcatctata

SEQ ID NO: 29841 - DNA, 201 bp, Bos taurus
taaacaaatatttgctgagcactctgtgctaagctctactaaactttggccttaaccaattgaataagatgaattggaccttgccctaatttttattttartaggcgacagagagcatagaaagacagttatgacaatagcgtgttttaagtgcagtggtaatggaggcacagtgtatgtataaatctagaggatgcagat

SEQ ID NO: 29842 - DNA, 201 bp, Bos taurus
ctccacagttgagcatgttcaggtgcagagctagatgggccagctgaaggttagtgcagtggtgcaggccagtgagagaagatagggcctgatccaggccyaccaatagctgctttgtgtgtctgcatgctttcccatggctgttgccttcccctgggcatttacaaggcactggagaccagtgctcagctggagggacta

SEQ ID NO: 29843 - DNA, 201 bp, Bos taurus
ataattgttttcttgtaattacacattgaaatcttaatgctccttatttggctgaggtctgtctagtctgttcatcttaaattaagtaatatttaaacagrtagaaattaaaataagcttaaataacaatttaaatcagattaaagttttataaaaccaggataacaatccttgtggtcactgaactcgtctcctgtttat

SEQ ID NO: 29844 - DNA, 201 bp, Bos taurus
ggctcatccacatgttaaaggctgctgttctgcttatgttttctccccattgtgaaacctcatgagagatttttactaagttacagatcaaactgtccaaytcagcagccctcgcttgtattctgtggtggctcagacggtaaactgtctgcccacaatgtgggagacccaggttcgatccctgggttgggaagatcccct

SEQ ID NO: 29845 - DNA, 201 bp, Bos taurus
ggcaaaaaagaaccaggcaaaagactgaagcctcaacaatggctgttagatctgctctgaaacagcctgaagaaaatacccagaggtacccaggtgaaaasagagggacttgttatactgtgttaaggaggggtatctcaagcgggattgccttcaggcatctaagccacccctggctccaggtccggacttcaaaggagt

SEQ ID NO: 29846 - DNA, 201 bp, Bos taurus
gttgtatgcatcaataagaagagtattgattctttggttacagcttcccagattccccaaagttggtaaaattaagaagacaaaacaacaggacagaagarcaaacggctgttttacttgtgaacgctgaagaattcatgtttatggagaatttattaacaaataatttatttgctgattctagcagtgcctcccaggcca

SEQ ID NO: 29847 - DNA, 201 bp, Bos taurus
aaagcactacttgtatcttttgaaacagaagagcaacagttaattgagctgcatgctcagtgcataatagccattcagaccaacttacatttagaatagaraatagacatcaggtcttggttcccccaaaataaatggtgtcattggtaccaatcttgatagctttgacagcagacaccatgtgagaacagagcagtcatg

SEQ ID NO: 29848 - DNA, 201 bp, Bos taurus
acagcagcaaaggaaaactataaagacattatgtttgagaataactcattaaagaagtagaagttgctgatgcgttacttcaaagggaaatatgtttaatrtatttggaagatgaaagaatttgcagcagaaggagttagctataggctgtatttaagtcttacacacccaccttaatattgggtatagaactgtaatatc

SEQ ID NO: 29849 - DNA, 201 bp, Bos taurus
tactggagtgggtagcctatcccttctccagtggatcttcctgacccatgccaacatcaaaatcaagaattattgaatttcacatttttacatgtaatttyttgggtttagttgtacgaacaatcacatatacggattcatatagctgccatcacaaattgagtactgaagggttccataatctcaaagaaattcttttgt

SEQ ID NO: 29850 - DNA, 201 bp, Bos taurus
attaaattatgaagacactgtgaggatgaccagtttgcattggtcagtagcacagatacagtagcacagttacttcttagaatgggttactttgcagtatmaaatatagtcaagaagtgtgccccattttactaagccttatatataagtctcattcttcagtagtggatgaagcattttttctccagtggatagatcttt

SEQ ID NO: 29851 - DNA, 201 bp, Bos taurus
gagatggttagatagcatcactgacttaatggacatgaattggagcaaaagccaagaaacagtggaggatagaggagcctgaggtactacaggccataggrttgcaaagagttgaacatgactttgtgactgagcaaaatatagattaaaaataaatggatggcatgaattgctctagtaattatctatgctggacatctt

SEQ ID NO: 29852 - DNA, 201 bp, Bos taurus
gaaatttctagatgtctagtttgaagcctcttcagagggagtgagtgcaggcagttgaaatctgaaagatgttcttggttttcagcttaaatgtctgtggyagtctttctgagtggccacgtagcaacaggcacaaagattgtccatgagctattgtggtgatttctctgaagtttatattgttacactacttcagcttgc

SEQ ID NO: 29853 - DNA, 201 bp, Bos taurus
taagatcactcaatattacattagaaagagctagtaacaacagaattctaccagatgattcactccctagacatactttgctccttttacactaaccaccrcttcaaacaatcctaagccaaatcatatctgaacaaagagagtcaactctgtgtcatgtgcctgcctgattttgattgatgtaacttttgtgtgcttctg

SEQ ID NO: 29854 - DNA, 201 bp, Bos taurus
ctgaaaagaaaacattatttggaagattgctacaatataaagaaaagtttcttttaggtaagtcattgatgaggtcaagcagtggcatggattctgtgtgyttgttaatggtgcactctcatcgcatgcaataatacaaatgataggtaaaatgaagaaaagatttttataattcttattctaacatttgccctgtaatag

SEQ ID NO: 29855 - DNA, 201 bp, Bos taurus
aacctcaagtcccagctattagcatataatttcagtgatttcatagaatcatggacaccaaactacacctgtggatgacctaggagtacttaaccttccayatatatccttagcttacattttcagcaatgttgaatggatattatgttgcttctaaattctacttatattttcttctctcagaccccagctagcaggcat

SEQ ID NO: 29856 - DNA, 201 bp, Bos taurus
tcaaaggtggcatatattgtgggcaaatcctttgaaataacaagggacttttatccttgtaggacttaaccttataaactcactaacaggaaatacaagtrttgttagatggcatttctgtgcacaagtctatgaaaaagagaattctcaattccaccaaagaacaagacctcaaaatacttgtcactgaatttaacaatt

SEQ ID NO: 29857 - DNA, 201 bp, Bos taurus
ctagaatatatatacaccatattcataacatacctatgcaaagataaaacaaagagatttagggagatgtttctaattaacacaatgccaacttttaaatrcattttaaacacccaaattcactgtgggaattttcaggaagaattacatgctccgtgctattttcagaatatgaagtttaagctagtacatctgttaaat

SEQ ID NO: 29858 - DNA, 201 bp, Bos taurus
ggtctctgtggaagtggtgatccaactgacctctcaggcttagcgataagacatccttccgcgcacacacagaactttcttggctggcctccctcatgtcrtcagacctccaagagagcgcccctctccacctgctgttattgtctggggatgatggctgtatccacatggtgctgaggggagtctgtgtcacaaagggtg

SEQ ID NO: 29859 - DNA, 201 bp, Bos taurus
cccaagatatttgtgtgcatattctctatgtaacccccccaaaaaaactttgatatgcacagaagttcatataacaacatattcttattttctattattaytgaagtcatatttcttgattcaaaaatcttagcatacagttttgtattgcttgcttccctctggtttctgatcatataatgattatatttaagatccaaa

SEQ ID NO: 29860 - DNA, 201 bp, Bos taurus
gtcagtgtgagtcatccaacacgtctgactaattgtagggtattgacaagattgagtctctgaatctgttatgctgaaccaggatgaaatcaccaatgttktctactttgtgtaacattttggcctcttgaaatgtgaccaactggctttcccaacctcaatacttccaaatctctacaatagacttctttgtttataaga

SEQ ID NO: 29861 - DNA, 201 bp, Bos taurus
atgatatcataaacctgaaaagctcctatgttaagaagattgagtcagacccatgatgtaacacccgagtatctattcattcactaatttattcactcatygttttttgaccatctgatatatgctaccacgatggcattccactccagtactcttgcctggaaaatcccatggaaggaggagcctggtaggctgcagtcc

SEQ ID NO: 29862 - DNA, 201 bp, Bos taurus
cagtgtctaatttctaccccgatgcaagggggtgaagttggtcacttatttaggctcacttgtttgttgtattttgaactggcatgtgtggaatgtgtggygagtgttcgcagtggatggaccacagtggttttgccacagcccaaggttgcatgtgcttcctaggtctacactgctgcatgtccagggtgctctgcaagg

SEQ ID NO: 29863 - DNA, 201 bp, Bos taurus
taaacactatgttcaatgaattctgcaaattttaaattgtattctcatttaaatttagttcagaaattttgtaaaagtttctcatgagacttcttcattgrcatatattttgcttagaagtgtgttgtttaatatccaaattattggagaattttccatcttttattggttgttattggtttctaattcattttcattgtc

SEQ ID NO: 29864 - DNA, 201 bp, Bos taurus
attaattttaagaaacaaaggaagaggatgaaaagaaacctctaagccttttaaactatgagatgtagtgttaaggcctgtggtggcctctcacctatttkaatggtgggagcccatctgtggagctcacaaaaggagccctacacagtaggatgcaaagctaagtaagtaggagaagagaggcctgaattcattttctct

SEQ ID NO: 29865 - DNA, 201 bp, Bos taurus
tgagttgtaagatttgactctgaaaattactctggtaataagaagtgactggataatcaatggattgggtgtcatggagttagggagatttgcttaaaaakaggattaaattgagccaagaaacaaccacaacataagaggatttgtagcttggggactcattgaaaactttctaaagaggattaggaaggaggacacttt

SEQ ID NO: 29866 - DNA, 201 bp, Bos taurus
agtccaaaatctctaacaatatgctattagttatttgttctgctattgaagtactgtcacatgccagattaccaccacaggtcacttttgatttatattgytgtaaaacaccataataaactgagtcaacaatcctactaacggtttctttatggattggtggaaaacatagcctttcttcagaattccgtaaaacagtga

SEQ ID NO: 29867 - DNA, 201 bp, Bos taurus
attagttaatggcttctatttcttcaatggttgcttttatttaagttcagggaatttaatttttttttttttttttaacattttctgttttaggccttacrttcagccaggtatgaacaattcactggggacctttctgatttttcctgagcaggctcaaccttatgcctctgtatatccttccaaaccaccaaggaccag

SEQ ID NO: 29868 - DNA, 201 bp, Bos taurus
ggtgccaatgcttatctccaactctactttgcaggagctctatccctagtaaatgtggctaagatgactgtggttcccttaacccaccttaaagcgctcayagggccagtgaaagtgaagtcgctcagtcatttctgactcttcgtgacccgatggactgtagcctaccaggctcctctgtccatgggattttccaggtaa

SEQ ID NO: 29869 - DNA, 201 bp, Bos taurus
ggcctacagaatgccatttccatcattatggtactccacgtttatgatcattgctctcactaagaaactctcttcacagcaaagaaagaaaaagtgtggargtgggcccatgctcatagaattcagtggtcttatcatgttccccactgttttgaagtagcttgtttgaaagaagggaggaatgacctttagaaggctcag

SEQ ID NO: 29870 - DNA, 201 bp, Bos taurus
aatggggaaccttatgtagattttattgccaggctaagtcaaaatttaaataaaatagtctcacaaccaggtttgagagatatgctgatgcaagttcttayttatgacaatgctaactcaaaatgtaaaaaggtgattcagcctctcaaaacacagggtgcccctctagaaaaatatcttaaagttttccaggatattggg

SEQ ID NO: 29871 - DNA, 201 bp, Bos taurus
gtgtgagggccaggctcagtaaatctttaattttctggagatggatggggctgtgttctctccctgtagttttgcctgaggccactatagtaggggttatkggggtaatggtgtcctccttcaaaaggacttatgctagcacactgtggctcccaatactgttacagtcagcacccctgatcctatggcaggccactgttg

SEQ ID NO: 29872 - DNA, 201 bp, Bos taurus
tttgttactcatgcttttgagcataaataatattcttcaaaggattctgcttcattttataaattcttcagtttctaaacagctgtcatcgcatgtgttarattaagggtttttattttattttttcatcagttattcaaaagtgctctaatattaatcacagaaatatcagcaaggcttacattaagatagagtatgttt

SEQ ID NO: 29873 - DNA, 201 bp, Bos taurus
tcttcaaacagaactattctagattttattaaacattattttaaatttggcatttccctccataagataaatgcacacctggtctctctacattgtaccaytcattcaaaatatacagctcctgtctggaagcaattcttctactaatgcatttgtatttggtgatatgttgtttatggctgtgtttattttaattgagac

SEQ ID NO: 29874 - DNA, 201 bp, Bos taurus
ttaaatatagttaattaagtgatgttagggtcttactgtcacagttttaatgctccctatctgttacccactccctttaatgtcataagcattttgttttmaattcagtgtaaagccttttccccaactatttcaccaattaaacatttaaacacacacacagatgaatgtataaagaaatcatggtacatatatacaatg

SEQ ID NO: 29875 - DNA, 201 bp, Bos taurus
agtaaacctttaatccaattttctgttgatgggtggaggtgtgttccctgcctgctgtttacctggtgccaaactatggtggaggttatgaagataatggygacctcctttgaaatatcccatgaatgcactgctatactcactgccccaaccctgcagcaggccaccactgacccccgcctccactggaatctcctagac

SEQ ID NO: 29876 - DNA, 201 bp, Bos taurus
gctgtttgctgatcacttacatgtcatttttatagtttgtatagtttagcaatagttccgatactacacttaagaattattctatatattagtgtaaaccratatccaatgcttccaggggaaataaattagtggagaataaacagatgaacaggtaaaaaaaatacaagatagggtaaagtaaatgcatttttcaggtgg

SEQ ID NO: 29877 - DNA, 201 bp, Bos taurus
aaacttttggagtagttgatggacagggaggcctggcatgctgtagcccatggggtcacaaagagtcagacatgactgagcaactaatctgaaccaaatarcaactaaaccaaataaacaagtggccctttgaagcccatatattttgtcactgcaaataattgtttactgctgtagatagtctctcttcatgaatcattt

SEQ ID NO: 29878 - DNA, 201 bp, Bos taurus
tctgatgaaagaccacaatgtgggaagaaaaatccaagaggtggtcttctaattccccttgggaggaaggatgtctttgtttgacaaaaaaaaataatgtrtcattttatttggaaagattgttctcagggtagcacttgaataactcaaagaacaaacttttgagaaaaaaaaaataaagaataatgtaggggttagtag

SEQ ID NO: 29879 - DNA, 201 bp, Bos taurus
aaaataaagaacacatctgaatcagttctaatgaaatacatgaaactggaatctgttacagagagagaagtaaatcagaaagagaaacgccaatacagtgyattaagaaatatatatgaaacttagaaagacagtaatggcgaccctatatgcaagacagcaaaagaaatacagatgtaaagaacagacttttggactatg

SEQ ID NO: 29880 - DNA, 201 bp, Bos taurus
aagtaattttggaaaaaaataatttagaagtaataagagtgagctgagaatgggagacagagctactcttgatatgagatactgagactctactgattagygtagagattgcagggatggggagaaagaaacctatacaaagttcagtaatgttcatattgatcgatccaacaggtactattattttctcatcaacttttc

SEQ ID NO: 29881 - DNA, 201 bp, Bos taurus
cacctaggacaagccttccaaaagtccatgaacctgaagcttcagggcacacacagcaggagagagaccatcgcaggtctaaagcagatctagctagcttrgaataaatcctctgacaaagcagactattgaaagagccgttcagcattctaccagctctagaaagctcagcaggaaaagaaaaaagtgctgaaaaaggta

SEQ ID NO: 29882 - DNA, 201 bp, Bos taurus
acctcattccacttgttacctttggactttctgctgtgttctgatggaacatactttctcagatgaaaatggagtttatttccttggactgacactcatcytccctcttgccaattatttccccaagttagcaggaaaattcagccttctccctcacatccttaaaggatggctcgagtccgtctccaaatgaacaaatta

SEQ ID NO: 29883 - DNA, 201 bp, Bos taurus
atacacacatggccaagaaccaagaaatagctctccaccttgcaggtgcttggcaataaccctcaggactaaaattccctttaacagagatcaatactttrgtaacttgcagaatcctgaacttgattttatgccactggcttctccttacccagcactgttactaaaccagcactgaggaaggaattttcccctctattc

SEQ ID NO: 29884 - DNA, 201 bp, Bos taurus
aaagcttatcaagttatctggccctcaaaacttagctcaggaaaccagatttactgagacatattcacatacatcagaagcactaaacaggattttttaaygcagtattaaaaatatggcccatttagaaagaaaatatatatacatatatagttacagcaatgttgttcttgttgttcagtcgctaagtcttgtcccact

SEQ ID NO: 29885 - DNA, 201 bp, Bos taurus
tcacccaggacaggacaatataaacaaggataattaaaatattaaatactatctaaattaataaaagaccctaattcaaactgttaattataatctttgtrtcttgttagaagcagctgtacagttacccttcatgaaattcacctcaccaacttatgaagactacaaaggctcactacaaactcaattatataatttaca

SEQ ID NO: 29886 - DNA, 201 bp, Bos taurus
tcatgtcaccaccaccagtcaagataaagaacatttccaacatttaaaaattttcttgtgcacgtttgcagttgattccctctctagatcctcaacaaccygttgtctgcttttttgtcacttttgccttgaaaaaaaatttttttttcatgtgaatgaaatcatccttgtttttcatttgttttagttagcatgtttttg

SEQ ID NO: 29887 - DNA, 201 bp, Bos taurus
gactggtgtgaggtgatacctcattgtcgttttgatttgtattctctaaaaatgagtcacgttgagcatctgttaatcttagtatatacaagacatacagrtggtttattggccatctgtatgtcagagaaaagtctgttaaggtcttctgcccattttttgattgggctgtttgtttttctgatattgagctgtatgagc

SEQ ID NO: 29888 - DNA, 201 bp, Bos taurus
tggtagcaagtttgaggttctttcctgaccggtacctggggtgcagcctttctgtgctgttggttaagtacagagctttaactttagtggccaactgagcygggcaaaggatagctttgctcgtaaaagctgagggaatgtgaagagactctttgaatagagggccaccccgtctgtatgtatagcttatccctggtggct

SEQ ID NO: 29889 - DNA, 201 bp, Bos taurus
atctgtaactacaaggtttaaatccagaaccctgattgtgacagagaggggctagtgttttcccagtcaaatccccacagcacccaggccgggatgctctktctgagtctagagtctgcccttccagatgcctggggtcccagcccaggatgagctaggcagtggaggagctgcccacctactgcttcttttgtaggaatt

SEQ ID NO: 29890 - DNA, 201 bp, Bos taurus
ttaccaactcaggccactgagagccagaaggccttcacagcagtgtttaaagtgactctcatctcttagggccaaaggccggactgagactggaactgaaytgtgacggtagacaagatgcaaaagaggtggagagaatagccaagacaggtctaagttggagtcagggccctgagagtgaggacttgagaaataggatga

SEQ ID NO: 29891 - DNA, 201 bp, Bos taurus
caagattgatagcatacccaccctcctaattatacccatgttcatatattctgccttcaatcctgttaatggaggtaagcgtgcccatgagagccatcacytctatttataccttaattgtattccttctctccttctcaaagattttatccatcactccctcttttccctacatcatttgtccttttggaccagtgcttt

SEQ ID NO: 29892 - DNA, 201 bp, Bos taurus
cctttggaagaccagaattataaagttctaagaggtggcattcacaaaagccacttaaccctcgaaaagcttaaggaacagttcacacagtgagtatgtgyttttttgttactcattcattcactcactcatttattgtcaagacatgactcagttgttttcaaccctggcagcatattagcatcattaggactactttgt

SEQ ID NO: 29893 - DNA, 201 bp, Bos taurus
taagttctttgtatccataatctgtatcagctatgcccatcctcttctatcacctagcttgtaggtcatcaataaatatttcttgtactttttctcatacyaccagctaagggcttcaacgtactcgaggtagtatgtgccaggcgattgcaatgccttcattctttcttccacaggagaacagcagattcctatactgtg

SEQ ID NO: 29894 - DNA, 201 bp, Bos taurus
gcaggccttcggggtagctgaagccctcttccctctcgcccccagcaccccctctgaagctctcctaagactgagaaatgagggccagggcacatccccgygggcacggtgggctaggctgtcggggcaactgctgggagaatggcaacacttggtcgcccgcgcgtgtcctgggacctccaagttggggaccggcccctg

SEQ ID NO: 29895 - DNA, 201 bp, Bos taurus
ttaaatagattatttaactgtcgtatgttgcaaatatttcttcccagttggattttgtttatgacttctatttatgggtctttaggaccttattggcattraataacctttatgttatgcatctcagtctatgtctgcctttattgccgtactatggctttactagtttatggttatataaagttctttgtaatctagaaa

SEQ ID NO: 29896 - DNA, 201 bp, Bos taurus
ccctgagagttggtcattcttatccacacaaccaaaggggaaaccataagtttgggtttgatagttctcacttcagagggaagtaagactcaaactctctyattttctcctttgcacctgcaaagtcacatgcctactccccctactcacagagaatgaagttaaaaacaaaggctactaaaagtggcaggagtaacagag

SEQ ID NO: 29897 - DNA, 201 bp, Bos taurus
gggaccaaagtacaaaattaaccattaacacacattctgaatggtccctgagactgatgacctagagaaatagtatctgttacctgtgagtttagaaaackctttcatagtaaattacaactaataaaagggagttcttgagctgcgagtaaggcatgctccttgtgcacatgtgctcagaagcacacgtgacaatgtata

SEQ ID NO: 29898 - DNA, 201 bp, Bos taurus
tatggccgtgagacccacaaggctatactgaaatgaaaatcagggtttaaacagactcaccaaggctattccacagggcccagcacagagcagctgactgraataacctgcctttccatagaagaggtcatctgcttatcttgaaagcttctacctgagggcaagcctctaatttaaggcacatctaagggcctacagaag

SEQ ID NO: 29899 - DNA, 201 bp, Bos taurus
ttaggttctgtccatcctctgggcatatctcttacacgtactcacttcttcccacccacactgccactactattatctccctcctggaagtgatgtcaccratctctcagtgtcctctcctcctctcccttctgcagcagactgtatttttcaaaaatgactccatcggtgctgtagtccaaatactttttccagaaccct

SEQ ID NO: 29900 - DNA, 201 bp, Bos taurus
aaacatcacagagtgatgtgagtgggttaaaaaaaagtgataaatacttctcagtaagactatgtattcaatgtatggtggccataagtagaaacttggcytcgttctaagaaatgactgtttattaccaattcttaaattccaagaaaaggatattgaaaaactgaattttaatcaaggaaactgtctcagagacactta

SEQ ID NO: 29901 - DNA, 201 bp, Bos taurus
ctgaacttatgtaggcttgtttaactgttaggacaaatctgtaaaagtcccaagaggctctcaagctctttagattggtaatactcaaacattttaaaatrctgtttcttctgggaattttttccagggcatagttttaggctttgctaaggcaggtctaaagcaagccttattctgaagcatgtttttttacttctaagg

SEQ ID NO: 29902 - DNA, 201 bp, Bos taurus
cttcctgagtctagtgtcctcgccttgccgtgctccttcagtgagcacacttctggtgtctgactcctgccatgtgcagcagctcacaggaccagtggccrgaatcttcccccaagacccctgagacttatcttcacagccaagcacgatggtggaagcatctccctagggatgacttcccctggtaccttctccggcccc

SEQ ID NO: 29903 - DNA, 201 bp, Bos taurus
aaaagaagatcaaatataccaacttgtacaggtctggtcgatggagatgccatccatctgcagtgttgagtgacctaatggaggacaggccatgatctcayatgggctcaaaaatgaatatgtaagataagcaaagaataagctttagctgtgttaaggccatgggatttcagagtaaattttcattgcagcatagcatag

SEQ ID NO: 29904 - DNA, 201 bp, Bos taurus
aggaagaggactgggcagagagaactttgaagattttgcccagatatggcaaaatcttggtcagcacactagggcactgcagagcaaacactgcttgtgaraggagccctgcattggcagaaatggccaggctccagtacccctgcagagctagatcactaggtgctacctgggaaagacatggccttccttataagcgca

SEQ ID NO: 29905 - DNA, 201 bp, Bos taurus
tttttaaattaaatatttcagacacagagaagaaaagcataataaatgcctgtttacccatcatccagatttatcaaactagtaacatgtgcagcattttratgcaccattccttaagtcattacccagatatttcaagcctcctttgtaaccacccctaattccattcctttctcttttccccatgtttgtcacttcttc

SEQ ID NO: 29906 - DNA, 201 bp, Bos taurus
cccaccatatccaacgtctttacctcctcttcattacctcttttatctccctttggaagaaaagttccttgaaaccaactgaaatactactatttcattcraatttatattcacttgctaaattcacattatatccatacccaactatgtgcagttctattgcttgatcagtgccacattcattgatgatcttaaattatt

SEQ ID NO: 29907 - DNA, 201 bp, Bos taurus
gttctacttttattttataaaatttgactcattatgacacttaaaaaaaaattctagagtactgttaaagccaatttcaaattatttaaaatagaattaarctaataagtttctgctatatgtcccttttccccttacctaggaccttgatatttaaatgaaagagttttaagaattacctttttaaaataaatattttac

SEQ ID NO: 29908 - DNA, 201 bp, Bos taurus
cacatgtctcaactaagagtgcatatgttacaagtaaaaagatcccacgtgctgcagctaaggaccccacttgccattatgaacattgaagatttcatgtrctgtggctaagacccagcacagccaaataagtaaataaaaaacatacctaagggtagctgcaagtagcattttaaaaaagaaagaaacagcggtaaagga

SEQ ID NO: 29909 - DNA, 201 bp, Bos taurus
ggcttaatcgtcttgcctcattcataggttctctggctcttgtccttgttgctttcattccttaattaaggagattcccagataatgaagtcaggttaatygtgttgctatttaacaatgtctcagtttcacttgaagatttgcccaggatttagaagctgttgacacctcagatacagtactgaggacagcaaagtgcta

SEQ ID NO: 29910 - DNA, 201 bp, Bos taurus
acagctgtttgacaggtcttccgtctcttcacgttttgtctgtaccaagtaaacccaccgtgtatgctagcataggttggcaaaccctcaaattgagatcmccgctcaaaaatacccccatattgggaaatattaacctgtatggtttactttggcttgatgaaccttattttcttagttgtgagaaactttttttttttt

SEQ ID NO: 29911 - DNA, 201 bp, Bos taurus
cccttctgaaatttataatctagtagaggaagactggtaacatacaagtaacattaaaaatcaaatatggagcaacaatatagacccagatgccttggagrgtctagtatatgcttgctgtcatcaagttccatacaattttacatatttataaatttttatttttgtgtattttcaattttaaccagtttgagaaataat

SEQ ID NO: 29912 - DNA, 201 bp, Bos taurus
tctagctgagcctacattgggtaaacagggtcacccaaaattactcttaggctggaaagtgaatcgaatattggccactgagatgggttctgtggcctcarttcaatctttatcctacgaacatgatcataatgcagcaattgtacctctggaaacctgacactgatggatgcttttggtgaagtgctttggtactaaggc

SEQ ID NO: 29913 - DNA, 201 bp, Bos taurus
aaaggaatataagagagtgaagcagtcacaaaatggaaatattcagtctcttaccacatgtaatgttcagctggtagaccaaggattgtacagctgcattrtacacaatgagtatggagagaagacaatgtcagcaagatggctattggatttttagctctgacttggttcatttcatcctcatcacttcacacagctttt

SEQ ID NO: 29914 - DNA, 201 bp, Bos taurus
atgaactcccagccagcgataaatacagaatggctttcatcgattcggtggccgtcttacagatgaattatcttggtactgaggacactggggatttcatytgtgaggctcagaatcctgctggcagcacgagctgtagcaccaaggtcattgtaaaaggtagaaccctctttcttctcttcctcattacccgaagcccac

SEQ ID NO: 29915 - DNA, 201 bp, Bos taurus
tcattaggcagtgtgcctttagggtacctggactcatagaaggaaatgagtacagattccgtataaaggcagctaacattgtgggagagggagagccacgygaactagcagaatctgtaattgcaaaggacatccttcatcctccagaagtagaacttgatgtaacctgccgtgatgtcatcaccgtcagagtgggccaga

SEQ ID NO: 29916 - DNA, 201 bp, Bos taurus
aatgactgcctaaaagtcacttacacttacacaaaagtcagtgtacagaggagaggcctgggggacacatgccagaagggtggttatccctgggagagcasggggtttcaaggcaaaccttcactttattcacactgtctaaatgattactttatatacagtcacagtaactgaatatatttaaataaagtaaatatattc

SEQ ID NO: 29917 - DNA, 201 bp, Bos taurus
aagactgtctggagtggggcgagactgaaaggggaggctaattacgaggccataataaataattctaagaaaagagtatctgggtttcccgataaccccayataaagatgccaccaaggctgctattttggggaaatgggggaaggattccataatagatggaaagaatttctgctccattctgggcatcgtgtggtatga

SEQ ID NO: 29918 - DNA, 201 bp, Bos taurus
aaaatccttagatagggagatgtaggtaacaaaaccactcttccccagttaaaacgaacatgaaaatcaaagctccaaagcacataaatctaccattaaamaacactgccacaaaatcaataatcagaaaaataatctgaaataataccataacttaaagaaaacaatgtttcatattctcagaggtgaagcaatacatac

SEQ ID NO: 29919 - DNA, 201 bp, Bos taurus
gcgctgacaatctcattttacagttgagaaaactgaagttcagagacttccaaaatcaaacattcagtcagtgttcgtcttcaaagctagacactttgccrcacccctgaaatggaaacgacattgtgaatcagctatactccgataaaaagtaaaaactaggactagaacgtgggtcctgatttccaaataactgatttt

SEQ ID NO: 29920 - DNA, 201 bp, Bos taurus
agatgacagattttgctgaatatctaggccttacagctgttttccagggaaaacaaagaaaggatacaggcagacccaacactcccacatatatttcatcratcagaggaatgtcacacggccacccaacatgataacccctagtggcagggagcctgccaattgggtttttgattttcaaactctatcagtaagttatga

SEQ ID NO: 29921 - DNA, 201 bp, Bos taurus
ggtcagctgtagctctgtggctcctcccacacatcttcttcattctaggattcaagcagaagagctgtcaaaaccacaccacggccttacagatttgctgygtgtgtgtgtgtagggtgggatggtacagtcaccaccactcaccttccttggaccaaagctggtcatggccaagcctgaagtcaatgtgcagagaagtag

SEQ ID NO: 29922 - DNA, 201 bp, Bos taurus
gctttcaacaaatttgtgttggattgatttgaactgaaatacacatatagcataagaagatgggaccaaaatgtcttcacttttacactcaaggacttgtktttttttttgcggatgggtggcaggggagaagggtgtccacaactgcttaaggaccaagaaaaataatctggaaaaactggacatctcactgtaacatac

SEQ ID NO: 29923 - DNA, 201 bp, Bos taurus
tacttagcagttactaaagggatattctgaaagaggttttcttgtaaccacctgtatctggtttaatacacaaactgatagacgctcatccttcattgtakttttggtttccaaaaatacatcaacacagctatgtataccagaaggcttccagcttcataattagcttttaggtaagagtactatttaggaagaaaactc

SEQ ID NO: 29924 - DNA, 201 bp, Bos taurus
atgtatcagaactgacaccacagatgaaaccatgcaatatttaaggctactggtaaactggttagtcctgttggaaatgatatacaggcttacagctaggrgtctacattgtaaacaagaactcttttaacaaaagaattatctcttggttttaaagaatgaaacaaatacataatgcaagatagatatctccttccagtt

SEQ ID NO: 29925 - DNA, 201 bp, Bos taurus
ctgcatcagccagagggaataaaacatgtctgcagttcctacaactcctcgtattttctttcagcttcccagctcatgcgttgcctaccctgggttcagcratcagtgagacactggtttattttaaaaacatggcatgatacaagctaaacaataatcactttctatctttttaattggattgtaagtttttttcctcca

SEQ ID NO: 29926 - DNA, 201 bp, Bos taurus
taattgtacaatttttcctttagaacattggctttacaaagggtctataagcagccactggctttccacaagttcagtgttactacatcagaaatggatcytacttttcattggcttatttgctcctaagacctactcagagatgtggagtccagttattattgactcacttcctttcctatgcttagggagataaacctg

SEQ ID NO: 29927 - DNA, 201 bp, Bos taurus
ggcaaaaattctgactttgctgcaggttggaggaggagcaaagtgggagctgggtaggaaagagagtcaggcaaagtagtgcagcgacagccacgcctccmcctcaggtacccggccccgcctctgtggggctcctacctacttcatggctccaggtctctcccttctcctcccacctaaccttgctgttaggaaggtgcc

SEQ ID NO: 29928 - DNA, 201 bp, Bos taurus
atttagccataaaaaggaatgaagagctgacacatgctacaacgtgaatgactcttaaaaacattgtgctaactgaaggaagtcagatatagaaggccacrtattctatgcttctgtatataggaaatgttcagaataggcaaatagtaacataggaacagaaaagagattagtgatttccagggccttgtgggagaacgg

SEQ ID NO: 29929 - DNA, 201 bp, Bos taurus
gaggggagtagcagagcatacaggggatgtctggcttgcggtaccttaggagaagtcttcaaactgttatccatcatcattactactagtagtggagtacragtcctaatatcactactactactgcagtagtagtaatgcctggagaaatataaacatcctttaaaggcttccctgatagctcagttggtaaggagtcta

SEQ ID NO: 29930 - DNA, 201 bp, Bos taurus
ctacacagaaatgagatcacagcttttgcaggtcgggaagtctgtcttgcagccagcctttcctcctttacatacaagaaagtttggaggttgatttactygttttcttttatgagatctttctacttagacacacatatataaatatttgtaagggcaaggcaatcctgtgaacagagacaatccagcctcaacatctct

SEQ ID NO: 29931 - DNA, 201 bp, Bos taurus
gggcactgtgaaagggggggcacaaacttttggtgggtggttagacatcacagccattatgagaaaagaaagggccaaggaagaggtgggagccggactckgggctgtcatgtagagaagggtgggaattcaaaggaagcagtggggagagggcagcaaacgccgactttgccggccgtggcggggtttgtgggctttttc

SEQ ID NO: 29932 - DNA, 201 bp, Bos taurus
ttatcctgggtgggcctaacttactaacaaacaaagctcaggctctgcaagcagctgcgcctgctctcttctcctggagccccttcagggctatctacatygtggccttagcatctggttggccaacctccacaagaacatatgcctgtgtgtgtgtctatgtgtctgtctgtctgtgtgtgtttgtatgtgtgtctccct

SEQ ID NO: 29933 - DNA, 201 bp, Bos taurus
aacttagatatttactcactaaccaccctgtactccttgttaattcttgctttgttcataattttattctcatctagaatgtccttcttccttctctattmctttccaacccctgcccatttttaaagtttctgtttaaacctttcatcttgaaaagttctctcatctaccccttggaaatatcttgcccttttgagcatt

SEQ ID NO: 29934 - DNA, 201 bp, Bos taurus
ttgttttaataattggaaaatttcaactcaggaggaaaactggccaagggaaaaagcctacatctaaactcagtttgggaagctctggattttccttgatytggagaccgcagggcagctttctgtcggcctctaaccttcctttgactggctctggaattttgtttaaaatatttcaagattcgaaagacagcaacaact

SEQ ID NO: 29935 - DNA, 201 bp, Bos taurus
accatatttacaggagaacactgtttagaaaaaattcttattggtagagacagtcctctcaatcttagaacataatcaccatcagtttgataggtcctctytgaaaatgaagacaatatgtcctctcaagcttgatttggagggtcactcactatttctgattacttgcaaaattctttactatcatctgattacttcata

SEQ ID NO: 29936 - DNA, 201 bp, Bos taurus
gggaagaaaacaagtattgactaaaaggaaatttgaagggtctgcatggattgtctctccatgtattttgttagcacatataattgatagcaatattaagkcattaaaaatattatttacttcctggtttgcattattagctcacatgtatttcattaacacacatgagcaagagtgatacatagcaacaagtgagctttc

SEQ ID NO: 29937 - DNA, 201 bp, Bos taurus
cttctccaggggattttcccaacctaggaatcgaaccaggttctcctgcattgcaggtagattttttaccaactgagctatgaaggaagcccaattttatrggcaaggaaactgaaatctacggaggtgaagtgactcacctaaggtcaggtagttagcaacaaacctatttggggtttgttaacctaacccaaaccctct

SEQ ID NO: 29938 - DNA, 201 bp, Bos taurus
gaactcatctttaccatgtagttcttcatcactacccttttattattaacacttcgccctccaaacatgaatctgattatttttagtgaaattcattcaamattagtaccagtaaactattttctctattatcaaaatattttatttttgactttaaaaaaaacatattttatgtttctttcatctctctatcaggattgt

SEQ ID NO: 29939 - DNA, 201 bp, Bos taurus
aaataccaagatcatgagaatgattctttgggtagtctctgctgcagcctaatgtaatgacagtaattaacagcctgtgattagcagccactccagaaagwgtttgaatgttaatttgcttcaactaatatgcagcacttctgtgtaatgagatctaagctataggttcatggggaaagcaaattattttccagcatttaa

SEQ ID NO: 29940 - DNA, 201 bp, Bos taurus
tgtttctcctagtcctgtggaagttctgtaatcagatcccactggccttcaaagtcaagttccctgtggattcccagtccctttgccagaccctcaggttrgaaagtctgatgtggggcctagaactatctatactattggcttcataatcagtagaaagggttcagtgaccctacaaacacataggtgtcatcaactgaa

SEQ ID NO: 29941 - DNA, 201 bp, Bos taurus
cagacagttttcaactaagtggtctggtgatgaattagaagagatgagaaccagggagaggggattatttcagcatcatccactgagttggtgataggagrgtgagctgtgtcctcctagctctgagttcccagatcgtttgcaaagtagtgagagttctgccattgtgtgagaccataatccgaggtctaattgggctaa

SEQ ID NO: 29942 - DNA, 201 bp, Bos taurus
tttaaaacttatgtattcatttgctcactgtttactcagcaaataggtattatttgcctaatatgtgttagactctggatatacaatagttcaaaaagtcrcatggagttttcagacaataattttagtctaccgctaatatgaattcagttcattttatcatttttttctttcttttcctagaacaatcttcatagaaga

SEQ ID NO: 29943 - DNA, 201 bp, Bos taurus
ttaaatgaagcttagctctcatctggcatttaaccaaatgaagattaaatgccaacaaaagatcagagaggatgagaacccaagatcgaattaataacatytaactttcccggtttttggtacctcaaccccaaaactgggaaatagaaccagtgagagaatgaattcaataaaattaggggaattaaggtaaatgaaaat

SEQ ID NO: 29944 - DNA, 201 bp, Bos taurus
atactctaggaaaattcctgggatctactgttttctacaaaattgcactggctctcaccaaatgtacatatagtttaggggttttgtttgtctttaagcayattaaaccatagatatttgctacctgtgttactcttctaaaaaaacaaatttcctatgtaatatttataatcaaaaagtaactcatctgaataagaaaat

SEQ ID NO: 29945 - DNA, 201 bp, Bos taurus
ggttgggaagatcccctggagaaggaaatggcaacccattcagtatgcttgcctaagaaaacccatggcgggctacagtccatggggtcacaaaagagtcrgacacttcttagcgacagactattttgcaatctctaggagttagctaaccctaggaggggcggtctatccaggaagaaggcctcagatgcctgaacatca

SEQ ID NO: 29946 - DNA, 201 bp, Bos taurus
gttcttttcggaaactgaaagtaaaaggtaactttatatttgcaggaaaaaaatttggtttctttttcactgcatggttactctgatgtaactgatataayagagtggacattagtatataagatgatcaaatgagtcatgcgatggaacatctgcctcagaaagccctttcagacatcatatgctatgccgttgaagtgt

SEQ ID NO: 29947 - DNA, 201 bp, Bos taurus
ctttgaatgaattaacgagtaatcagtcttcaatccacttatatttgaaaatagccaagtcatttatgacatattataccaagaaataaatataatgtgcrgtgtccaataccatgtggatagtcaagtgtatctcaccaagtcaaatattttgtgtttttgtctggctcttagtaaagaggtacacaatttttaaaagtc

SEQ ID NO: 29948 - DNA, 201 bp, Bos taurus
ccctgaagaaggaagctgagatgaaactttgtgtattttcacttgttcatctttgttaaaaattgatttcacaaagagtttcttattttaatcttatagarccagtacttggcctcgttgatcgtctctctattttgtgtttgttttcatttcattcacttctgggcacttatatttttaacaacttcttgtttttttttt

SEQ ID NO: 29949 - DNA, 201 bp, Bos taurus
tttttgagttgctcgatagccgcctggccacatgcttttggtcctctgagatatattcttctccttctggggaaggtcaagaaccctgccctagacttccrtaactctctgccttccaggcagagaagacaaagttagcacattaacaaggaagcagtgatcagggtgggagctaggctccttacagcaattctcaaggag

SEQ ID NO: 29950 - DNA, 201 bp, Bos taurus
taggaaagattctagtagataagacagcagatgctagttaaatcaggccccagacagggggaaaaaaaaatgctaagcaagactgctatagggggtcctgraactagggaagcttcttcagggccttttctctgtgggtgataatcttttcacttccccacattctttcctccttagcatttattgaggataggaggagga

SEQ ID NO: 29951 - DNA, 201 bp, Bos taurus
gggtaaactcttgataaatagtcattaagacttccgtttccactgtccacacatacccattcattttccaagctctgtatattctggctctcccccgccaygaaagatgtcctaacttccacctcctaactctccctgcttactgctgctgcgttcattaaagttcagttctggtggaatcacattctttctcttaaaaaa

SEQ ID NO: 29952 - DNA, 201 bp, Bos taurus
gctcatattatgcaacagtaccacttttgttagaaaatctgaaagaacagattatttatgcttcgaattaaaagtattatagaatttactgggagttaatrtatgcacaatggatggctccttacgtttaaccctaattctgctgaagacattgctttctgctcacacaggtacacgtgatttgagagcacccatctctgg

SEQ ID NO: 29953 - DNA, 201 bp, Bos taurus
tggtactctgtctccccacaactagtcctggagaaccagaatcttgttcttggtgtccacaagagtgtctaagcactgctgtcacacctggcacctaggarctcagtgattgaataaatggtttgtgattttcaatctttcaaaaggcttctagctattattattataacataatcaaattgttttctaactcccaacttt

SEQ ID NO: 29954 - DNA, 201 bp, Bos taurus
ttgtaacatgcatcttaagtgcacagcttaaattttacacgagggcccacagggtcaccaccacccagaggaaggtttgcactgctccctgacaccccacrtgcctctcctgctttccatgcgattgctatcctgactgccaccttctctttaggaaggtaacaaaaatgaacaggggcagggtgtttgggagagaatgga

SEQ ID NO: 29955 - DNA, 201 bp, Bos taurus
gccgtttctgaagaagaaaaaaataatcacttgttgggacttaggaaagtagatctttaagagaaatatccacaagcatagtaataaggtcaaatcaccayaacaaaataagatacgatgtaatatcctgattttgttctttcacaactgtcagactgcataggaaccatacttattttcaatcaattattcataataggc

SEQ ID NO: 29956 - DNA, 201 bp, Bos taurus
ctccctccctgctcccttaagtaggcactcctgccctcaacagtttatgtctttccttctattgccccttgagacctttgcccaccttgttcttaaaggtyggccagactgctctctcctttcttctttctgccccttctgacttgactctgcccccatcctgtcagatacaggacctcagtcaattactcccagcttacc

SEQ ID NO: 29957 - DNA, 201 bp, Bos taurus
gtttatccccataacaatctatccagatgtttagaacattaatgtgatttttagattttatttaactcctacaaaaaacaagtggagagagaaaaaactayattcccttcagacagtaatcagaagaataaagaacatctcaccagggcccttgtctcaatatgatgtcagaaatgcaccctaacgagtaacatttcaaat

SEQ ID NO: 29958 - DNA, 201 bp, Bos taurus
tttctgtgttcctcctatggcaggaggcatttctgtccactgcttttctataatatcctaatcatgtaaacgttcagagtcagatacaggcattgggccaytttctaccagcaagtgttgctcttatgccctaaaatacctgaaccaatgcgctttggcaccttctgcttcttttctcaatttggcagcaaacctgggtgg

SEQ ID NO: 29959 - DNA, 201 bp, Bos taurus
cttacctgcggcttcagccaggtgaatactcctgccacactggcctggctcctgtcatttgaacacacccacctggtttccatctcagggtctctgcagcygcttccttcagctgagaacgttcttgccgcagacctttgtggattgcaccctttatatcccttagggctcaactgaaaagtcaccttctcaactcaccct

SEQ ID NO: 29960 - DNA, 201 bp, Bos taurus
gatgttgataatccgcccacggcccttcatctcagcgcctgtccttggaagtttggactcaggcaaaccagggtaatcaccttcagctccagattgtgccrgggggccagactgcatcgagtcttggggagcagcgagtccaggcggctgcagctgcatttccccccagtgccaggaaaggttctaattcaaaaacaaatg

SEQ ID NO: 29961 - DNA, 201 bp, Bos taurus
gcccaaaagagatacttacagatgactcttcaacttgtgatttaaagtattttaaagcagtattttatttcttccctttgtaccagattgtagtctgacarattttgctaataatggcccttcaaaactggaccccagctcttaacagctgagaaataaaaacaccatgctcatacacatgcagttcttgatccttgtccc

SEQ ID NO: 29962 - DNA, 201 bp, Bos taurus
acctttactaagcattctcaacttattactactactaataataacatcttccattcatcagtattatccaacagttctcagagtgtggtccagaaacctamgggggtccctagacactttcagaggctccatgaggtcaaaattgttttcacaataaagcaaaagctttatttgcctttttcactgtcagtctctcaaaaa

SEQ ID NO: 29963 - DNA, 201 bp, Bos taurus
aagcagttggaggtggtggcagcttaactcccctgggggccagtacagagaactgtcctggatgttgtccctgcatgctcaggggtagtagagagggtcartaaatccctttgatgaagctaaggcctcaagtacaagcaggacttagccagataagaactgggaaggagcagttcctgtgcaaaggtcctgaggaagaaa

SEQ ID NO: 29964 - DNA, 201 bp, Bos taurus
gaaacatcaaatcttagaatacttagttagagctcaatccttttaatgcctccatggtcctgataattttacttttaaggagagtgaatttgggtagttcrtaagaggacacacctatacttcttggagacccagttttgtatgctttcgggtcaccttgaaagataaagggaaaaaaatgttttccactgaggtagataa

SEQ ID NO: 29965 - DNA, 201 bp, Bos taurus
ttttagacttccttgtattgatccctctttccagctgcagtagtcttgccaacattgtgcctttctccactcctgcctgtcttttaccctcgtggttttcrtatcttggtaaatgtgtcagattatgttatacattgaagaattttgagaagaagaagcaattgattagaattagtacaatccactcaatatcatacagtt

SEQ ID NO: 29966 - DNA, 201 bp, Bos taurus
aagacatgaagagttttgctgtacattcaaagatgtgtattactcatttttaaagtaaatgcatgtacaggaaggatgtccctgcttttctaaaacacacwttggggtatgcttccatcagcctgaggccctgtttctgacttctccctccaggaactacagttggaacatgcaaggcaagcctttgctctcaaagacaaa

SEQ ID NO: 29967 - DNA, 201 bp, Bos taurus
aggaagattatcttgcttctttgttccctgttttgttttataagtgaaaggtgtggttgtgaaatccttcttgagtgtcctgccgctgatgaatctcagcrtggccccagggagctggggcacaggaaacggctgacaaggccttttgatgatcagttcccctactgttccctaactggttgcctggcctcctctgcttca

SEQ ID NO: 29968 - DNA, 201 bp, Bos taurus
tttatgttttaaatgagatactgtaccctcattttggctattttgcttactttctatctaacagatctaacatttctcatttaacatatctaattatatarctcccaaaagacagacatttcagtactttgaacacattagtaaaataatattttctggaaattatagaatcctatagtattagctttctccatactggta

SEQ ID NO: 29969 - DNA, 201 bp, Bos taurus
tattattctatctttaacagtaggtttccggtggcctacagttaggtgagtgcattcacctaactttctgcctccctcatccacatttaaggagtcatgtraattcattgggcccactcaaatcacatcatcataatcttcttttaagatcagctgattagcaaccttaatttcatctgcaaccttcatttccttttgcca

SEQ ID NO: 29970 - DNA, 201 bp, Bos taurus
acagaaaagcagagaaagcaacactgcagaatgagcaacggatgaaacagagacacacaaagcagagacaagaggccatgggcctccatgaagaacatagyttgtttagttcccgattctttttggattcctggttcttcttttgcatgaggcccatctgtccttcctaactttgagacttttcagatacccatggtagtg

SEQ ID NO: 29971 - DNA, 201 bp, Bos taurus
actcactcactgatctgtctagtggctaacactggctgtctgctgggagctcattgttaaccgttgctggaatacctacacttgacaacgtgtgacctgcrtgtgaactttccctgcaacagcttggctttgtcactaaatggtgaagatatccaagaacaagcattccaagagagggaggcagaggaaaactccgaagtc

SEQ ID NO: 29972 - DNA, 201 bp, Bos taurus
gagttgatgcttccttcactcactcgtgaggccacccgctgacgggcctccccttcgctcagggctttagagaaaattagagaagatgagacaagaggccrattctccccactccattcgcccccgccccaccaccgttgccttcctctcctaacccgcagtctcaaagcaagttcaacgacaggcctagactaaagagat

SEQ ID NO: 29973 - DNA, 201 bp, Bos taurus
caggatgtagctcaggataaaggacacttcaagtaggcatctctggccagcttcagttctgactcaggagaacggcactgtccttacaatttcttcctgcratggacatggaggtaaatttggaaggccttagggagtgcttcttgttagaggattcatgagggtcccaagggcagaactaggtttgatggagcttgaaaa

SEQ ID NO: 29974 - DNA, 201 bp, Bos taurus
ctgtttcattgtggcttcttcattttccttggatgtggggtatcttcttttggtgggtttcagtgtcttcatgttgatggttgttcgccagccagttgcgrttttggtgctctggcagcggaagatatgtgcatgtccttttactactctgccatctcaaataagtcttggctcattttgttgatggatgtacttgctgtt

SEQ ID NO: 29975 - DNA, 201 bp, Bos taurus
agctttctgggaaagtgatagagttgaacttgtaggttgaaccacagaagacagaaattggccaggaaggactgaataagcccagggcacagacaggcctkggtgtacgcctgtcatgaacagcctgctggggacaaaagaaatgtggtggggagagaggctatgggagaagctggaggaaaatcataaagcagagctgct

SEQ ID NO: 29976 - DNA, 201 bp, Bos taurus
tcatatcatttatctactcaaaagtatctggtggtttctctgctcactcagagagaaagctaaggtccttaagctgtggtaagatgctctgcagtctgcayggtccctgacctgtaagctctctgacctcatctcctatcacacgtcccctggcttaatctgctccggttctgctgcctttcttgctgttcccagtcaggt

SEQ ID NO: 29977 - DNA, 201 bp, Bos taurus
ttcccagcttgcatgttttgatgaaggaagtggccatgttggagggactcatgtattaagaaaccgtgggtcgtctccagaatatagccaacaaagaaccraggccctcagtccaacaccccacagagaactgagtcctgccagtagtcacttaagtctggcagtgtatcattccctgggccagccttcagatgaggccct

SEQ ID NO: 29978 - DNA, 201 bp, Bos taurus
agagatttacaactttactgggttttcacagaaatgacttcatataacataatgaatattatttccctttagtaaacatggccatgggtttcatagggctrtttcatatatcaataacatgtttaatcccaactgatatcttgtatcaaagaaccatcaagtaaaaacattctccctgggtggccaaggaaacacagagtt

SEQ ID NO: 29979 - DNA, 201 bp, Bos taurus
aggttttgtgaaagattactctctgagcataatgaaaactaaaaggaatttgaaggctttacagtactttgtttgcattggcaatataaattttctttctmctgatacgcaggaagagcacaaataataatagttgtgcctttttggctcctctaaacactacagatgaaagctgcaaccctgcccaaaagggtctctcaa

SEQ ID NO: 29980 - DNA, 201 bp, Bos taurus
agttaagaacaaaacgtgggtgaagcctggaagtcaatgtccgtatcccccagccaggaccagccatcatgcttgggatgcccatctgccctctgtgcagyggggaggccctttgggacatgggaagcagacgatgctgctcattggatcatgctccactgtgcttggcccagccaaggtagacatgtgggtcttctggga

SEQ ID NO: 29981 - DNA, 201 bp, Bos taurus
tggcggagggcagagggggctgttctgggtttgaggccagcacacaacaccaatttttgtgctgaaatcccccaaagccctggaaacatatcacttttgtkgttgtttttttgttatggactgtagcctaccagacttccctgttcatgggatttcccaggcaaggatactggagtgggttgtcatttccttctccaggac

SEQ ID NO: 29982 - DNA, 201 bp, Bos taurus
agtgccccttcattccagacatcctacaaactaatcgtcttttttctgactcaagggctcagtcaaggcctgcaggcaggttcacttttctgatctgcagytgcaccttgggtaaatgccatgagtttctgatctgaattcctaaataaaagagaagtgactcttcaaccacattcagaagcatactctgagccaagagga

SEQ ID NO: 29983 - DNA, 201 bp, Bos taurus
gcaaattaaaacacacagatataaagaagcagtaaaactttaaataaatcacacccactctaaatatcaatgaaaagcagatatgcactgttgggagaatyattttaaaatgattttgtcaacaagttgtgcttcttatcaattgtggacttaaacaaaaaaaggaccactaaagaatggtttaacttgttacttgttatg

SEQ ID NO: 29984 - DNA, 201 bp, Bos taurus
acaaaagactgtatattctgcttaaaatgtagaagtgaggaactataagcatttgctcacaatgcaaataacataatagttttagaaatgctgacgatacyataattcttcacacttctagatgcaagagagaagataaacatgtgtgccatagtttcaaattggatttaagattacttacagtattaaataatctaaaag

SEQ ID NO: 29985 - DNA, 201 bp, Bos taurus
ctgttgaaattattctctgtataactctctgaggctgcagagctatgggtacacaaacttctttaaatatatttatttggctgcggtgggcctcagttgcrgcacacaagacctttgatcttctttcagcatgcacatcttttaattgcagcgtgtgagctccaagctgcagcatatgggaactacttccctgactagggt

SEQ ID NO: 29986 - DNA, 201 bp, Bos taurus
tgacatttcataggtccaaaaaaattaaaaatgaacacatctgaaattggacaccctagtaggtctttgataggggtagcagtagtggtagtctctcaatygggtccaactctttgactccacaggctgttgcccaccaggctcctctgtccatgggattctccaggcaagaatactggagtagatttccattcctttctc

SEQ ID NO: 29987 - DNA, 201 bp, Bos taurus
cacatgagaatatctttaagtattttccacctaacatttctctgaagaattcccagattccaggacgtgatttgaagtttttcagaaaatgttatggtttytcaggacaatgatactctttcatccaatagaagtttgattgtgcccttaataggatcaggttttatgacaattacatctttgggtacagtttatatgctt

SEQ ID NO: 29988 - DNA, 201 bp, Bos taurus
tagcatctgtgtgaatctgagtgcagtgtgtgatggtgtctctgactgccccggtgggacagatgagtccccactttgcagtaagtctcctgaccacagtktactggccatgaactcatcctgagcaggggccagctgcgtgtcgtcattgtcacaatcaccatgtagttgttgaggaaggaatctcagttctctgaattt

SEQ ID NO: 29989 - DNA, 201 bp, Bos taurus
atctggagtgcgtttcaaaatggaacagataaaaaactagtaagtacataagtacatatctactggcctttgatctgactagttccccagtctcaggtctrtttgctgttaatcaccagtgagagaaggtcctaccctatcttaagtggttctcatgtctccctctgggccatccatacttaaaagccctggatgttccta

SEQ ID NO: 29990 - DNA, 201 bp, Bos taurus
tagctccaggggattactgccattatgtctaaaagaaagctcagagagcttaaataacttgcttgaggtcacacagaggggcaggggccgaattggaaccstcctgggactccagactggaagaactggctcccacttcctctgccactaactgtgccacttagagtacgtactaacatcaccaggcctcaatttcttttt

SEQ ID NO: 29991 - DNA, 201 bp, Bos taurus
actgaccaatcacagcacacggcctgggttacagccagggctcatagcaacacagctgcataactgaccaatcacagcacacggcctgggttacagccagygctcatagcaacacagctgctattactctgctgggaatatccccctccagcctgctgcttccagatcagaacgtgtgccagacactcctgtgcacactca

SEQ ID NO: 29992 - DNA, 201 bp, Bos taurus
tgtttgttttttcctttgtggattcaaatatcttcatccatgaggatatttcaaacttcattcagggaaataaaataaaaagtcttctagttcagaatgckcctatctttgcagaatctaatgcagaatgaggtccaatgactccctattctaccacaactacctaagacacatttgctcagatcgccagactattttctt

SEQ ID NO: 29993 - DNA, 201 bp, Bos taurus
acatatacagaacattttactataagagtatgatgagtgctttgaaaaaagttaagtacttagtaaattcataaaaggaaaaactaattgagttaagagayaaagaaaaaaaggagaatgaatactagaaaaacaggtctatgtccagtgcaggtaacctgcattcacagaccagagtgagacagagtgtgactctcatcc

SEQ ID NO: 29994 - DNA, 201 bp, Bos taurus
gatttggggccacaaagatatgagggagattttgctaccaccagttcagagagccgatataccaatgtgggtgataacccagtacctaaactgaatcatcrgtattaaatggtcaaggtgcccaggaaatgactagagttcactgaccactggcttaaatggcaatcagttcatgttatttctctgttatcatttcctggg

SEQ ID NO: 29995 - DNA, 201 bp, Bos taurus
ggtgattctaatgtgcggctaagtttgaaaatcaagagaagttgctctggctttaatccatagaggccatattctttgcaaacagctctcagtgttccccytataactgacccatgagaaaagcactcattcccacagtgtcctggtttgtttcaagtgtgtattgaatgacattagctgcagtgctgatttaggacccag

SEQ ID NO: 29996 - DNA, 201 bp, Bos taurus
cgggaagtatcccaagttcttaaatgcaggtgcatctagctatgtcagtgcaacagaggaagattgtgaataataaacactttacttatagcagggctctrtgtgctgttactttgcctgctattgacaaatgagtatctctgagcagaaatcattgagatcaaattaatattagtgtcagtccatgtatgccttacgtcc

SEQ ID NO: 29997 - DNA, 201 bp, Bos taurus
tggtaggcttgcatagctcacatcatctggatctgcctagataactcagctgacttcattgtttcattctcattcccttctttgtcattaatggtttttayttcctttggcccacttatcacactgtattgtaattccagaaggcctagagttcttgatagactttaaacacagctcagaagcataaggaattgcctcatc

SEQ ID NO: 29998 - DNA, 201 bp, Bos taurus
tcattggaagaaggggaattgataaaagcaaagatttttttaacatataaatactaatttactaatgtacatgtcatgtattatgctatttttattcttartgtattttaagattatactgaatacttttgttttaggctgccacccagctggaaaacttaggaaatgcgttggatgccgtggaaccacagaatgctcaac

SEQ ID NO: 29999 - DNA, 201 bp, Bos taurus
attaaaaaatagcagttatcttaattgcatgtaccaaataccctatcttgtctctgaataacttcgataaacggaaatgcttacacacttaatgaaaattkaaattcttactgtgttgttgtattgttctatgtctaagaagagtctccagttattctacagttctttaacctttctttaggccactttttaatcataaat

SEQ ID NO: 30000 - DNA, 201 bp, Bos taurus
ttgccgaacggaattctttcttaccacccccttggcctacattatgcctcttccttcaggtttcacacattgcctgacacccaccccagatctcttattayagtgctgttggcctgtgccattatttcatagcatttatctcagttttgaaatcatccatgtacttccgtaattacttaaataacatacgctctttcctaa

SEQ ID NO: 30001 - DNA, 201 bp, Bos taurus
ctaaaagatttaacttatttaaaataagggggcacatccatatttctaaagtaataaggttttaattacaatgaacatcctttacataaaggcttggtaaytaagattcttacaaatagaaaatgctaatttgtttctatattttactgtttgggataagattcttctagtgatatcatcattgtttaggatcttgaatgg

SEQ ID NO: 30002 - DNA, 201 bp, Bos taurus
atgagcacgacaatttgcacagtaccaaggtaaaagcagacaccgatagtgcagaaagcatagatgaaagtcgccgcctactaacttctggaaatattcaracaagcccacctagggaaaaaggaaagaaaaaaagaaagaaaggaataaaatgtctggtattagaagtgcaaggcttgcaaataaagattaactaattcc

SEQ ID NO: 30003 - DNA, 201 bp, Bos taurus
tttatactcccggatatatcataagtgctcagtacatacattgagttaaattcctcagtcttcttagcgatccatttcagtaacatacactgaatacttamaattactgatttatttattaagatgactgaaaactctttttttttttttgatcaactcttgatcaatgtctttcaaataaatatttttgtttatacagat

SEQ ID NO: 30004 - DNA, 201 bp, Bos taurus
gtaatatgcaaaatctcatagctaagtgacaaagctagggtttgaacgtaatccatttagttccagagtccattcttataaactgctaggtggcaagccckgtacttgcccagccttaagactaaagaaaaagcccagagtaagcgacagagacatcagtggtttaagggatagagggatcttatccaaggttgtacaccc

SEQ ID NO: 30005 - DNA, 201 bp, Bos taurus
ttttcactcataaatgtttgataggaaatatgcccaaaggggaagaggaatcttagcattaccattttctaattgttcagttgtacctgtgataagagaaytgcctttgatgactcctttgcaagagacttttttgaatttcttgttcattttgtgagggcaaatttcattaagactggacaatgtaatctgtaaatctgt

SEQ ID NO: 30006 - DNA, 201 bp, Bos taurus
aactgactgatgggggccctgtttgttactaagtttgcattttttcaattactctgcattctctaggtaggggagttcatcaaccccattgatttagacgwcagcaacttcatctgctccttttgctcattctctgaaatcttaagactaatgtctaaatatggcttcttgatccctgagcccatcacctttcttatatgc

SEQ ID NO: 30007 - DNA, 201 bp, Bos taurus
aaatggcataaggaaatttatttgttattttagcaacttccacagttatctgaaatctacctaagactggttaacttttttatgtgactaataaagagatrtcaagtatttgacttttaaatatttttaaagggttcatgagttctatcataatccattgatcaggattgatcacaatcttcttggtcaagaaggaatgga

SEQ ID NO: 30008 - DNA, 201 bp, Bos taurus
ttaagccaacaaaagaggtgatttaagatttaacatccattgataagttgagtgactttttattttcctgtgaaaggacataaaatgtctgtctctggaaygaagtggttttatatttgaaaaatattaacttttgtcacgtggagcttaattagtctatacccacttgaaaagattctcaccaattactcaaaagaagga

SEQ ID NO: 30009 - DNA, 201 bp, Bos taurus
attcatcctggaatttggcttagaagtttctggttttattgtcatctaatcaagcacctacctagaaattcccatgggttattacatcaaataagacagaytacatttgacattttctcaaagcattttgaaatttcccttcctgcctccacccatgtattttattttcacctagtgaaagggggtccatcagtttaagat

SEQ ID NO: 30010 - DNA, 201 bp, Bos taurus
tccaaggaggggcaaacaggactttcacgctttcccaccactctgagcatccactgtctctcctgttgttttggcacttgattatatttagcctattggtrtatactgactctcaaatacttttcttaaatcacaagcatgtgaggaaaggggcactgcatatgaaaatctctctcgttgagggaacgggacatcagatca

SEQ ID NO: 30011 - DNA, 201 bp, Bos taurus
gggaggggaactgggtgaattcggcttttccccccgaagttgcttcctcttttttgcagataaagtcattctctggctggtgctgggagccccagggagartgagggtgaggtcccggctctcgggggtctgggtcccgtcctgtgcgcggagtcatgggggtggggaaggtgggaagcggcgaggcagctgtcgagaggg

SEQ ID NO: 30012 - DNA, 201 bp, Bos taurus
cactcagatagtacttattattaatgttttcttgatataaagggttgtatctagtagggggcttgtatgccaaaaacaaatgaatggacaaggaaacaaayggacacatgaatgaaagagagaggcaaaatggtggttctctggtcacagaatttacaggtgatttgaaagagaatcttgtcgagtaaaacagcattttat

SEQ ID NO: 30013 - DNA, 201 bp, Bos taurus
catatagcattataaataagtatatatatagatggaaacattgttcaaagggtgattatctcgaaaaaaatcttttcaaagtgatatgaacaagttaacaytttggaactcagcgttaaaaagtataataataatacaataacagagatgcatgtagtccatacatattcatatgtacatgtgtgtatacacatacacaca

SEQ ID NO: 30014 - DNA, 201 bp, Bos taurus
gtagaaattttccttaacattagtctgatactaacactctagattcacatcagcgatttatatcttatggaacccaatatattttgaaagctttaactccytttccccctccttcacagaatcatttcaacaggggcatgaagtatcatttctattgtaagagaggtcacatcgcaccagggagtttttagagaagctggc

SEQ ID NO: 30015 - DNA, 201 bp, Bos taurus
gagaaaaaacaagtcaactaatatagactgagtggatgtgagtaattttaaagaaaagaacaaacatggaaaaactgagtgccatctttaagactttgttyagaaaatgttggaaagcagagaagacaggaaaggctacagtgggacatgaggtcatctcacatggattctatggtttttagcagtgagttcattcttgtg

SEQ ID NO: 30016 - DNA, 201 bp, Bos taurus
gccctgtggctgagggacttagatttttcataccttgaaaaacacttgaagatcctcttccctccagacccacttaagaagaatcagtgccccaaaacaaytttgggggaaaaaaaaaagaaagagaagaaaaaataccccaagagggattttaataacttgttgagcaggttttgaatttggaaggcacgtgtcagaact

SEQ ID NO: 30017 - DNA, 201 bp, Bos taurus
gcataagagactcttttccaagatatataaagaactctcaaaactcaacaatatcatcaatgaaactatgaaaaaaatgatcaaaggccttaaaagacatmttaccaaagaagatatacagatggcaaataagggagatgtaaattaaaatgttatagcactatataccttttagaatggccaaaatctggaacacagaca

SEQ ID NO: 30018 - DNA, 201 bp, Bos taurus
gagattatgatcctgtcctaacaatctcaggaatgttggtatttgatgtcttcctgaaagaccagattgttgcacatgccttcaaataactgtcatttttwaaaattaattggttgtaagtcatagagtagtgatatttgacttgaaaaaatgtgaggttatctgttaaaaggtattttttgaaggcagttttcaaatttt

SEQ ID NO: 30019 - DNA, 201 bp, Bos taurus
tccactgtggttctcagtaaaagatcaaattctttactatatctgcccccttttccataaaagtaaactgaacttttgtaaccttgtatgattctcttatwactgaggctagttacagttcagctgttaggctaaattttagataaaatgtactattctgttgtcagatttagctgttacaaattttgtaatatcaggttt

SEQ ID NO: 30020 - DNA, 201 bp, Bos taurus
tacttggcatgcaaagagttctacccacagtttttacatcacaagggcaactctaagatgctggatgtactctaacatacacttctgctaaaacaagtatkcaaattgtccaatgtggaaaattggtatcaagagcatgaaacaatcaggaagcaagctcaggatatatccatatatttaaaaataactttcttttccctt

SEQ ID NO: 30021 - DNA, 201 bp, Bos taurus
gacactggactgagaagtgaggcaactatatatatagcctatatgcctaatttttgtggatttaaattatttgacaattttaaggatctctttttctgtgrtaaaataacagaactctaagaagatatgtgaacatgaactacactgccatgtaaacctagggcatatgctaaggcaaaaagcacaaagcaagaacagtgt

SEQ ID NO: 30022 - DNA, 201 bp, Bos taurus
tgctgaaagagctggtggctaaaagcttacagctgggcccgctgcacccaagccagagatcacttgtctctcaggccaaaaccaagaatcactccattctkggagataaaaggcaaactagttggttccattcaagacagcgccaaaggccagccagctccagagctcccagtgaggttggctgaggtctctgttgtgact

SEQ ID NO: 30023 - DNA, 201 bp, Bos taurus
ctttgatgtctcactacagctactgactatttttcaagagaaaccagccctttgctaaaatagtagcttgttccacaggcctctgggtcatttatttatayggttaagatgtttctaactttcaactgtttctcatcactttggattacactgattaaagtcagtcaacatagtgaggaataaaagccttgtcaatattaa

SEQ ID NO: 30024 - DNA, 201 bp, Bos taurus
aaatttatacaaatagacatatctcaagcagtgcagcctcctccaacacatacctttaagaatttttggaattacattttgagtgatagtgagatgcatgraattcataatttacctttctgctagcctccctaaatatttgctttggataatttatgttatttcatttgcttcccacacctttgtgtgattttgtatgac

SEQ ID NO: 30025 - DNA, 201 bp, Bos taurus
atgattcccattctatatactgtggaatttctcctggtcagtaataaatatgccttcatttttttcagaggtgttctgtgtcttgaatcagacctaaactrtattggcatatggacatgcttacccagaaaggctcttgtttattttgcttgttatcccaaactgccttgtaaacatggagagggttcagcttttgtaaga

SEQ ID NO: 30026 - DNA, 201 bp, Bos taurus
atgttgcaatggttgcagatcccaaattgaaattctttgcaagtcctgaataaattctttattttgctagagaaataactggtagtctatttgttgtaggycaacaatttaatggcccttaagaggatccccagaaatcccccaagagctctgaagctggtgagccaacaggtgtggtaccaacattgaacctattgcttc

SEQ ID NO: 30027 - DNA, 201 bp, Bos taurus
tcttaataggaatataatgtggcaatctaagaatcacttcagaaatgactgttctcttgagaagcaaattcctatctgccttgaaaagcgtacctcttcaraataactgaaattctattatttttaattgccctgatatagacacaataataacatattaatagctatcttattattatttgagtaatcaaatcattacgt

SEQ ID NO: 30028 - DNA, 201 bp, Bos taurus
gccagaagtgaatatgtttcctaaaaggataacaaagaacttgctaggattttccccactccaggatgaaagagtatagagttaggatttagcattcacawacacatgtagctgctgctgctgctgctgctaacactttagtcatggccgactctgtgcgaccccatagacagcagcccaccaggctaccctgtccctggg

SEQ ID NO: 30029 - DNA, 201 bp, Bos taurus
tgttgacttcaaggagcaagggaaaactccaaggtagaagtcacctactttgtcattggaggtgtccaatggggttgtaaagttaccattcaaagcggccrcccaaccccaaatctaactttttgataaggaaaagaaagccttcctacctataacatatcctttgattctactagtagaaattaaatagagagcaagaaa

SEQ ID NO: 30030 - DNA, 201 bp, Bos taurus
cacaaacacggtcaatgagtttttccataataaggtatggattaaattattgaaaataatttctaatgcagaagtagtcactcccttttatagccttattyaaaactttagaccataaaataaaagcacattcataaaaacacacatttttaaactatgagagaaaaattatttcacaatttgcacataggtaactgatac

SEQ ID NO: 30031 - DNA, 201 bp, Bos taurus
cacattgcaccaatggaaactaattttaagattctaaaacttgtctgtcatataacaaatatagttctcagtgaggcatagttataagccaagttttgatrtttaaatattacctgggggaagaaacttttggtatagcctttttttgtgctcaagaatatcaagaaatttaaaccccaaaattacctggatagatttact

SEQ ID NO: 30032 - DNA, 201 bp, Bos taurus
taaaaaaaggtggaggataaaatgaccaggatcagtacagcagttcttcattctctacattattggtgcttcacaccccttcaattataaggatttactcyaaggagcttttgtttgccttttaaagttctggatctttctgctgaatattactgttgccttaagaacaatgtacagttgaccttgaacaacatgggtttt

SEQ ID NO: 30033 - DNA, 201 bp, Bos taurus
atgaaaacctagattaaataagttggtctctaaagaaatataaattaccaaactgacccaataaaagatttttttttaaacaagcaggccaattgccagtmaagaaattgagaaggttatcaaagattaacccctcacaaaagcaccaggctccatcaatctcactaatgactgcattcaaaacattagatgtatttcaat

SEQ ID NO: 30034 - DNA, 201 bp, Bos taurus
aagattccctgcaatatcaaacaagcatttgatttggggaggaggctggatggaaaacatttcaaaaaatggatgttgatcaggtatgagttaaagtggtygcttctatccttgactactctttgtctttttacatctcctcaaaattttcagcttcctaataaaataaaattaaataaaatctgatgggagacaattaac

SEQ ID NO: 30035 - DNA, 201 bp, Bos taurus
tttgttgtactatgacaatttcaactgtagtactatgctattctataaataagtacattgcagttactcttgggaaagttcaaacctgatggaaatccttycttattgtatatagaaacccacatggttgaatgtgacactgttcctatcaaataggattagttcattcgtgtgagccttacaggagcaaggatcttttct

SEQ ID NO: 30036 - DNA, 201 bp, Bos taurus
gaaggacctcagctagtgtcctgggcatttgtgtgctgtggccagccccacccaccctcctcctctctcaggaggaggctgaccccagagcaaatgtcccygtctttctacttctgatgggcccagcacagaaaacaaatgtggggaagcatttttgctcacaagcactgggtctcctgtcaaaacacaaagaaacccttg

SEQ ID NO: 30037 - DNA, 201 bp, Bos taurus
ggagcacatggaggccctgagtatatttttgaactaattgtatcaagacctacatatctgtcctggaaagagcttgaaggttcttcatctgaagttatgcrtgttcttgagatatttgttgaagaaaaacgatgttcacaatgtagatgtatatttatatatacatatatagtcttcccaggtggcgctagtggtaaggaa

SEQ ID NO: 30038 - DNA, 201 bp, Bos taurus
tcatatgtatagtaacaaacatgattgctgctgtttttcttaaacaacagaaatttattgtgtcacagttttggaggccagaagttcagaatcaaagtatycaaagtattcctttcaagggctgtcaagcacagtttaaagaccccctcatccaagagctgatggcagaagttgtctgatggccacagcccactgagagaa

SEQ ID NO: 30039 - DNA, 201 bp, Bos taurus
cagagtcggacacgactgaagcgacttagcagcagcagcagcaactacaccattatacaactttgaagtagatgatcaatagtagttgttaaatgaattarcagtagacgagttataagaggcagcgaatgatgaatccttcaagtaaaataatttttccttgaaattttattaggattctcgaatttctcattgtcttta

SEQ ID NO: 30040 - DNA, 201 bp, Bos taurus
aactcacttctctttggccttcaaatagaattcctcagaacttgataagactgattttcttgactactttgaacattattctagtgcatttttcccaccartattctaaaactaattagaacattggcagcactatggaataatatcaagatgagagattaatgcattctagtttattagaaatagtttcattgctttgga

SEQ ID NO: 30041 - DNA, 201 bp, Bos taurus
tggaagctcggctcgcagaatgtaaactctgacaaaaacaaaagcagctcttctgctatgcagcctctacagctgtctttggtatatgtcacggaagtgaytttgacatgttcggacctgggcggctcgtggtgaaggatttttttaacttggaatttgtctctaactgggaccaagacgatcaggttgcctggtacctcc

SEQ ID NO: 30042 - DNA, 201 bp, Bos taurus
gcacaaacaggctaagatttttcagtgtgaaaggaagaaacgtggaatggtaatcacaaaaaaaaaattatgaaaaggtgcaaattatgcaaattaaaacrtgattattttaagcagtctgctaggatgttcctttcttattttagggaaaacacgtgggactcaccccatctctctttgttcctttctgggtatcatgga

SEQ ID NO: 30043 - DNA, 201 bp, Bos taurus
cacacatccaccctgctgactgtacgtactctcgtgaacttcatgccaacaacacctatagtaggctaaataatggcctccaaatatatccaggttctaamttttagaacctgtgactgctaccttctttggcaaaagggatcttatgatgcaaagattatcgtgggtcatctgtgtgggcccaatgtaaccacaagtgtc

SEQ ID NO: 30044 - DNA, 201 bp, Bos taurus
tttttcttttagactcagcatgtaagcaataccatatgatattggtccttctctaatttacctcccttagaagaataacctccaggtctaaccatgttgcygcagatggtattatctcattctttttaatggctgagtaatattccattgtatatataccacatcttctttacccattcatctgttgatacacatttacaa

SEQ ID NO: 30045 - DNA, 201 bp, Bos taurus
ctaatccaacatggctggtgttgatatcagaagaagactatgtgaagtcagggacacagggagagcaccatgtaaagatggaggaggagaggagagtgatrggtctacaaaccaaggacggccaggatggctggctggcaccgaagccaggagggaggcatgaacagatcctccctcacaagctctcaggaggagtctacc

SEQ ID NO: 30046 - DNA, 201 bp, Bos taurus
agtggcctcagcagccagcactgtgcccagggatagcaggatctgagggttgctggaagatctgccctttgaggaaaatctcaagttgctcctgtgactgrcagatggcccagaaacagttgctgcagaagaatataatgctccaagccccagtgatgatcctaagctattcgaggactgggagggtggtttggatattgc

SEQ ID NO: 30047 - DNA, 201 bp, Bos taurus
gtattcttgtctggaaaactccatagacagaagagcctggcagcctagagtcacagggtcacaaagagtcaaacacaaccaagtaactgagcacccacagyctatggacaaatagcttgaaaaatcatactcttaagcttatcaaatgatctcatagacagtcacttatttgtgcaagcttggtgaaaagaactatttacc

SEQ ID NO: 30048 - DNA, 201 bp, Bos taurus
ataaaaaacagagagagagaatatttccagaagctagaataattctttctgtggaatttgtcttcaactgaatctctttcactttctgccagtgaaacatyatatatcaaagaaatggacacaaagagtgaaaggcagattatagaccttaagatgtgggattggatcactagcagtgatgagaagcaatgagaattctct

SEQ ID NO: 30049 - DNA, 201 bp, Bos taurus
tgctggcaagtggggtggtttctgtggccaggggcaccatttgtgtcccctcctgttccagggtaactaagcaagagctctaactaggagcattgtaggaygcaagttggggtgctcacagagttgtcagatttcataatacagtgctcagtggcttggtttgcacttttacatgcttaatttttcctacaagaaagtagg

SEQ ID NO: 30050 - DNA, 201 bp, Bos taurus
gcaatagatagaggtcttcatggcgccttgaggctaggctagacggaaagaagggggtatttacttctagggctcctataaggtccttgtttgaagactgygtgtttgtttattttttatggaaaactgattaatttttgtgatcttcaaactatccactgaaaatatgtcaaaatatagcataaaaacgttatgatttgc

SEQ ID NO: 30051 - DNA, 201 bp, Bos taurus
acaaactgtttaaaaggtgtccctctgtaggcatatcagttaccaaaaggtatttgtgtcttagtttgagtcaaagttagctaagaggggcctgggctagrtttcctactgatacggtgccctcttgggtaatgatgccttatgtagcgtgaaacagtcctactgtgcaaatgtatggtaaggaattcctgataattgggg

SEQ ID NO: 30052 - DNA, 201 bp, Bos taurus
ggaggggaggggatttcagaagtggttgaaaattgcctattttttatgtcctttagatcacaacaactaatattttcattacatagattttcacactgttyttcaagtctctaagtgaagctctcatccagactgatattttctatctatactttcagttgaaacctactataatctcccctttaaaaaactaacttccaa

SEQ ID NO: 30053 - DNA, 201 bp, Bos taurus
aactgacaaggaacacttcagcttctgcccaggagtgctatttggaactcagtatggataggatcatgggaagattaggtactagaggaaaggctgctgcytggaaggcctagcaaaggcagcctctgaggaatcaacaggaattcccagaccagaaagtcatctttatagagtaccaagaatcagagaatgtgcagcaat

SEQ ID NO: 30054 - DNA, 201 bp, Bos taurus
ggacataacaatgccggattctgaatttgtgtgtttataactgtcttttttttttttaatggcaatgataaggcagcatgtgattaattgggcccatgtarctttcatttgtggagtgctttgcagtttactaaaataccaccacatcttatatgagcctttagataacctttgtatagaaggcatggccaaaattaatat

SEQ ID NO: 30055 - DNA, 201 bp, Bos taurus
aaaaatgcactgttgaactttaagtttactgcattctggaggcaatacctattctcattcaagtacaacatgtatctcatctacccacaaagtgggtatcrgagcagcatctctcaaatccactaaatcgacctcttcacaccttcacaactggaagtcttacttcacagaggacacatctggaaattattctcggaaagc

SEQ ID NO: 30056 - DNA, 201 bp, Bos taurus
cttcaaaaagcatgagtcacaagattatagaggaaggccccaggaccacattgcaggtaggacagttcacactctctagctcttgtctttagaatataccyaacagtggccttaagtggaaactgacatttaaagactctaactttaaagatgaggcaattttgattttgacttggatagtttggtaatttttttccagac

SEQ ID NO: 30057 - DNA, 201 bp, Bos taurus
aaatgatgtcatagtgtggggccctaatccaatgactgatgaccttatagatcatcagggatacatcagggatacacatgcatagaggaaagactatgtgrggtctcagcagaaggtggccgtctgcaagccaaagagagagacctcaggagaaacaaaacttgttaacaccttgatcttggacttccagcctccagaaac

SEQ ID NO: 30058 - DNA, 201 bp, Bos taurus
atagggcctttaagaaaataattaagattaaataaaatcataaggatgtgacccttaggaataggaatagtgtccttgtaagaaaaggaagagactccagwgatatgtgtacacagtaaaaaggccatgtgaagacacagggaaaaactgctaccaaaaaaaaaggagagaagcattaaaagataccaaatgtgctgccac

SEQ ID NO: 30059 - DNA, 201 bp, Bos taurus
acttagcactaactacatgcgaaaggacttgtagaccttgagaagaagtataagctggaacaaggaactatctgaaactgaactgaccctgtaccatccgygacagctccagagaaactcctagatatattttgctattatcattttttaatcttttttattttaagtcctatattattcctttaattttcatttttataa

SEQ ID NO: 30060 - DNA, 201 bp, Bos taurus
atttcctcaatcctttactgagcttgccttaaaaattcctgatatgatcaattattaatttcccaaaagcttggtgaggtgaggtttcaatgttacatgargaagaatttcagtagtattgtatattttagtagaggattgaaccaaaagacaaatgattgataataataagtaatagaataataggtaaattaaaaatta

SEQ ID NO: 30061 - DNA, 201 bp, Bos taurus
aattgactacctcaagaagcctgagaatgagcttttctgtgtgtttaataggagaactttgggctctgagcatccctctttagctccagattgctgcatgkgtatgcaggatgaggaaagtatacttagatctatacagatgttaatccttcttccctcctctagttctggagcccttgtcagggggaaaagttcagcctg

SEQ ID NO: 30062 - DNA, 201 bp, Bos taurus
cgcaaatttagacaaactatttaaaacacattgctggtgttcattcagtagcttaaattcataccttatacctagtagtagcttgaacatagtgtgtgtcrcaccagatgtgtttgtgtgctttacagaatcagttcagttcagtcagttcagtcgctcagtcatgtccgactctttgcagtcccatgaatcgtagcacgc

SEQ ID NO: 30063 - DNA, 201 bp, Bos taurus
tatcaagttctagtgtacctaagtcccctacaatgatttatatttctaaaacaaagtacatctcagtgtagcatatgtttatgaggttaaacattacatgkatgactatccaacataatatctattctcatattttgcttttgtgaactagaaagttcaaatgaagaagtatagttatcaaaatgactaagccttagggta

SEQ ID NO: 30064 - DNA, 201 bp, Bos taurus
taatttaggacagccagcagcagcagacaggccaggaatcctctacttctgagcatcctccaacattgatcagccccaaaaactccaccagggcccctgcygaagccccaggcagcacgtggatcaacacccagtgactgatgcaggtttacacacccaagtgggacaaccagggcaccaggaatgacctctggctacatg

SEQ ID NO: 30065 - DNA, 201 bp, Bos taurus
ttccttgaatatcataattttatatccctttgtcctctgtgatgagaaggctctcctggggttgccaagcagctctctccccatgtcacttccacatcatyacttcttctagcagacaatacattttccacggactgaacaaaatagttccttttccgtacttttattgagaaaaaatggctagaaacataatctttcatt

SEQ ID NO: 30066 - DNA, 201 bp, Bos taurus
actacttggggtagtaaagcaattataattggccatgtctttaaaacactctccttcttcccaaggaaaacaccgccctctccttaccagggctctggaamctggttggcctaaaatattttaaaacatacagtttgatttgtaaagatcaacagttggtctgaggaaaacgccatacattttaatctttcaaagtttata

SEQ ID NO: 30067 - DNA, 201 bp, Bos taurus
tacaaaaaatattacattgtttaaaaaaacaaaaacaaagcacagatgtgcgtatataacatggtcccacttatttaaagaaagcagagagaagacatatwcatatgtttgtttatatatacttttttttcctggaaggataaacaaggacctgttagtactggttatctctggcaaaggaagatgaattacgaggtagaa

SEQ ID NO: 30068 - DNA, 201 bp, Bos taurus
tctataggcttctacagactacctaagggatccatggcatgaaaatggttatgtgattagagactaattagaagatagcaaagcagaaaggtacataaatmtagtccaggacaatcagtcacttccgtggaactggatcaagttattagggctatttacactagaaacacttgaattgcataaaagctcttaagaacactt

SEQ ID NO: 30069 - DNA, 201 bp, Bos taurus
gactggatctgatttaaacactggactgggtccatctttaaaaatggtttgggtccagaactaaactgaggtcagactaggtttgacttgagctgaagtgrgtccagtaagggccactgctaatgggaatctcagaagctgaaaaaaaaaggggggaggggtgcagaattgatgaaccttggttgagcatttcaaagctgt

SEQ ID NO: 30070 - DNA, 201 bp, Bos taurus
tccagactttaccctatgtacctttaccctttgcttattctgttttatatcctctagttgtaaaaaaaaaaaaaaaaatacagtcatgaaggtgactataygctgaatcctatgagtcccaatgaatcattaaacctggtggtgatgttggggacatctggcacaccagaattggattctggaaaaaaaaaaaagaggcca

SEQ ID NO: 30071 - DNA, 201 bp, Bos taurus
ctcccaacctgctgtgtcccacagcagtgccagctgcgtggagatacgtccacacagcacaggagggctcctgctgggggttctgtgggccaaattaaggmatctgggcgccccaccactgcattgtgtcctggttgcttcagacacagctgtcttgcaaacatgtcaatacgtttggcctttcttaggagctccttacct

SEQ ID NO: 30072 - DNA, 201 bp, Bos taurus
ctttgcctttggaaccaagaggaatattccccagaggcaacggaaatacttgtaacactggaagttatggtcacaaggattatttctggggccatgtgtcrtctctgcttctattaacttgtcaatatagctctctctctctctgttcctgagtgctgaccagttcctacctgtcggccccaaataggcaataccctaggt

SEQ ID NO: 30073 - DNA, 201 bp, Bos taurus
tttagactctccactattctccaagttctcaaactgcctaatagtttttgttatgatttacggttgcaccatcccttaatttgtttctacacatacctaartaattcaccagtgtattagtacaattaatctatccaattattaaactagacttacctctattttctggacttgcacataaaacctgagacaacattaaac

SEQ ID NO: 30074 - DNA, 201 bp, Bos taurus
tgacaattcatctctggggtcctgttgcagagaaccggaagtattgatgcagagtctgtatgctcactactttctaactgtggccaatggcatcattattyctaatgtcctctgggggaacccttgaaagtgaaagttgctcagtcgtgtccgactctttgtgaccccatgaactattcagttcatggaattctccaggcc

SEQ ID NO: 30075 - DNA, 201 bp, Bos taurus
tcatctacatttatctcatactttgtctccataggccctctgctctggttccatgtttctcacatctatagactcattaaacaaagtgttacctgtatgcrattttgtttggcctgcatgctgtttaaaacaattaaatttcaagtatctttaaatccatattttcttgacttgcctgatgtgattttgtcattctctcct

SEQ ID NO: 30076 - DNA, 201 bp, Bos taurus
agtattgtggcaggacccaggaaccagaatatttgataaaccagcatcccactatgtagctactgaaatgaaaggggatttcctgtctggtgatgatgagrtaaaggaaggagataggggatagccaaaaattgaataatcaagagcaacacatgagcctgaacactgttcttacaccctgcccactacaaggtcctgtaa

SEQ ID NO: 30077 - DNA, 201 bp, Bos taurus
accccattactgctttcaaggaatctatgtcatttcaggataagaaaataaagtaataaggcttgccttccaaagatggttcatggaattcaggtttgttkttctgctatcattaatcaactgtgagggcgtgtagtcaatatttctcatttttgtttaggaaatgaataatagaagctaacagaaaatataatcagaata

SEQ ID NO: 30078 - DNA, 201 bp, Bos taurus
tggctacatctgtttctggggaaaaaagtgagaaacagatgtggaagcaatggtgaaactgagacaggaagcttgtcaaatgtgaaaactgagcaagagayctgaacccagaaatcagagcaacaaaagggagataaatccagaggagctgttgataaagccatgcagtcatctgagagctgcattcagtccaaagagata

SEQ ID NO: 30079 - DNA, 201 bp, Bos taurus
gcaaagagtaggacatgactgagcaagtttcactttcaagtgatcattaataattgtggatatcacaaaggagagggcctctgttttactatttatttttmatggtcagaaattgcattgcatttttaaatttattatttatttggttgcactgtttcttcactgtggcatgcaggatctttagtgcggcaagtgggattt

SEQ ID NO: 30080 - DNA, 201 bp, Bos taurus
caccatgttcacattggcaagtataaaatatttagccattcaaatgtttggacttgttaaatgtagacagtgttgatgtaatattaaacgatgtaactatyttttaacgatttcaacattatttaaacttaagtttataatctattcaagtgtgaacaattctcaaagtcaccaataagagacagtttcttaagtgctgtc

SEQ ID NO: 30081 - DNA, 201 bp, Bos taurus
cgagaactcagaaagcaaaaaccatttaatgtactttgaagacccaggccagggtcccccagccctttactgtgcctgtggcctaagccagtgccctaccscgacccacacaggtggcagggactgtgacggggctacagcccctgcacacgctcagcaggctggcctcagaacagtgggactgatgcccgctcgagcttc

SEQ ID NO: 30082 - DNA, 201 bp, Bos taurus
acctctgcagtgcatgcttatagcacttaccaagattattaagtgctctggtgacattattacaagagggggcaggaccagtgtcagcctaatgaggcggyggatgatatctgatggtctccatctgaaaatcagcagaggccagcctgtgcactaatcaagtcaccgaaggcccttcacccgggacaagagcagcctttg

SEQ ID NO: 30083 - DNA, 201 bp, Bos taurus
tgtccactgggacatgcaattctgataccacctgctgtgcatacccacaaagatgactgctgccagcaccaccctcactggtgacctctgcctgtggcccyttgtaattggctaggaagccccttaggcacacatgtgcactcacaaagccactggcacagaaacccacagaagccatgtccccaacctgcaggtaattga

SEQ ID NO: 30084 - DNA, 201 bp, Bos taurus
ttggataagctccaaagaagagccatcaacaatgttcctcaagagatagcttcaatttacatcccactgaatttgggccaggggagtgaaatgctatctayggaaaaacaagggacattctctactctgaactgatctgccgtttgcagggccctggcctctgaatgaggccattcatttgcagaagacaccacacgctga

SEQ ID NO: 30085 - DNA, 201 bp, Bos taurus
atgagagggagagaggtaaacagtgagtttctaggtgtgagcaggaaaggtgtgctaggtgacggactgtgagagagagcacgtgagtgtaaagaagatayggaaatactgacctccggctggtgggaatataggaacattttaatggtcaatatttttctgaattgttataaactatctatgattgtgagtatcacttct

SEQ ID NO: 30086 - DNA, 201 bp, Bos taurus
tgcctggaggagcagagctcttccacatgggggagcacacacagcccaggccgcccagttcctacagacaggaactcacagcagcttgactccacaacagyaccctgttaatctctgctctgagagcttcaaccagaattccagcccagaatgaaacagaggcgggggaggtggagcccatttctccatctggggttctag

SEQ ID NO: 30087 - DNA, 201 bp, Bos taurus
gtaaataaaaggaaatattaagcatactggccatgtggaagattaagtgatttacctactaaattaatgtaatcactttcaaaatgagtagttactgataytttatatggcctgtgtgctaaaatacctgaaattaccccacaaagttctgagtgacagttcagtacgcaatgtgtagaagaaacagaaggattaaagcta

SEQ ID NO: 30088 - DNA, 201 bp, Bos taurus
cctgcgcggtgcatgccgggagtcttggtgaattcgttggcagctgcaggtgaagcagagcagagaacgctgcgagaggaacctgtgaagcgattcccacygtctccggaatctcgctctgccctggtaagagataacttttccatgagaggtaacatggagtggactagcctcaaaacgaaagccttgggcgcctgtggc

SEQ ID NO: 30089 - DNA, 201 bp, Bos taurus
aactaacctaaaggatcttcctctggagatcactgacaaccttttggtcaagaatcagagaaataaaagagccacttttttctgacaatgatgaaactgaytggcaaaaataacccaatttcctacttcattaatgtatactttcatactaactctgaaagtagaaaaattgaggaaaaatagcaaatgtgttttggtggt

SEQ ID NO: 30090 - DNA, 201 bp, Bos taurus
tcagtggtcagaatcctgcagtaattattactttgagttaagcattaatagtgtgtgattaagtgaaaaccattatctttaagagataacatgccaaattytgtgtgattattattaaagactttgctttaatgataatatttttgggcttatcacaaatgataattttaaaaataattttattttgtatttattcgtggc

SEQ ID NO: 30091 - DNA, 201 bp, Bos taurus
acaataaatagtgatatttgttgttttggatttaaagaactttaagattcatgtcaaagcaatgttgctggagagcatgccatggggacaagactaaagcrgttggctgtgtgagtgtctgcacaaagcaataagggaacacatgtgcatgccataggattctggagtgggttgcaacgacctcctccaggggttcttccc

SEQ ID NO: 30092 - DNA, 201 bp, Bos taurus
aaattagtctatttaataatgttctgtcccttttcttctctcttttgtgatatttaccaattgttctcgaatgtcaccatctggatgaaacactgaataamacccccaggttgggactctgtccactaactgaacttctgagccagttcagttcagtcgctcagtcatgtctgatctttgtgaccccatagactccaacat

SEQ ID NO: 30093 - DNA, 201 bp, Bos taurus
tacactaatgaatgaatcataataagaattttatgacatacagtattacagttgtactcataatacagtattggaaacattgttacatttttagaaactayttgtgatgatagtctgatactcagcttctccaattaggagacagagagaggtatactgcataatcacataattctttgaaagcaaagtattacacagtaa

SEQ ID NO: 30094 - DNA, 201 bp, Bos taurus
aaatctaattaaacttaaaagcttttgcacagcaaaggaaaccataaacaaagcaaaccaccaaaggggagaaaatagttacaaatgaagcaaccttcaakaattaatatccaggatttccctggtgctccagtggttaggaatctgtttgccagtgcaggggccatgggttcaacaccatggggcaactaatcccatgct

SEQ ID NO: 30095 - DNA, 201 bp, Bos taurus
tctgggccatccctacatttgcttcattgttttaaaaacttattattttttattttggttaaggtaaagaatccctctcaaaagagatcaaatgacagggrgcagacagccacttaaagttacagaaagatattatggatactgaagaaaggggaacccagaccttgttatagacccagattcttgaactctttaatcaat

SEQ ID NO: 30096 - DNA, 201 bp, Bos taurus
tagcatgtgaaattagtgcaattgtgttttgtaatgtagaagttactataaatgggtgcattttgatgatttttaatcaagatcatttgtttctgtgggtkcatgttagaaagtatttaggtctttgaaaagttttgttatgagagattagatatctcaatactttgtgtgtgtatgagtgtctttgtgtgtgtgtgtgtc

SEQ ID NO: 30097 - DNA, 201 bp, Bos taurus
cttgccacctggtcaagctctggcccctgcctttccccacctctggctccttggtgtttactgtccagccccaagtctggttgctcagagaggggccagcrgtgctttgcagtctcctgccccactgtgccagttactcgggacactgatcactaccctgtgaccgcctcctccatgatctctgcgaatctgcttcctgtg

SEQ ID NO: 30098 - DNA, 201 bp, Bos taurus
tttctttctttcaggacagcatgaggcccactgtcaggtcctagggcccattggcagaattcccggtggcttggtccatccatgcccctctgagtcagccrgatgagtcatgcccctctgtggccagctggtggaattgctagtggctgaaactgtctatgccctgctggatgagtgggggtagggctctctgacccactg

SEQ ID NO: 30099 - DNA, 201 bp, Bos taurus
gaagacattccataaatgatttggccccaaggatggtatcctcccttatggacagctgtggctgctcagctctgagtctgtgtattacatctatttactcrggccagtattctgtgcccctctggtgaaggcaaactctattccttccaatctgcactttgttcctttgcgctttatgtgacagtgagttcctaaactgaa

SEQ ID NO: 30100 - DNA, 201 bp, Bos taurus
ggacacttgaggatataagaggtttggaggaaagctgtggtgatgaatcaaagttttcttacattctttgctttctcctctttctgagaaacccggccatygtagcccagcacagagtagggaaagttttcatatgcaaaagtatcaagtaaagaaagggaccacagccctactggcctgattagtagggtggacctggga

SEQ ID NO: 30101 - DNA, 201 bp, Bos taurus
atggcaaggctccaacaaagaatgcccagaatactttttatgaggtagcaaaatgattcctgttttgatcttgacacttgtgttattttcctagttatttmttgtgccttgcctcttcttttcatgatggtacctgctcatcacacatatctcttgtttctagaaccatcatccaaattcccctaaagaatcaccagtcac

SEQ ID NO: 30102 - DNA, 201 bp, Bos taurus
tagagacatcacgctactgtcattccattcctttctataggcctgggacttattttccctgctgaagtagtcttttggatctctaatatcaagggcaaacrtgttacttgacagcattccacacttgtctgttgggaagacttacaccacctgattctctctcctgctcctggtccaatgttgacctccaccacaggccta

SEQ ID NO: 30103 - DNA, 201 bp, Bos taurus
ttcccttagtaggggtaaatctgtcttattgctttactgaaaacaaactaattaaaagtcattacatgatctacaaacatgagttctaaataagatgtacrtaccaggatcatcacttaacaaaatatgacaattcttccaactagttatcattcttcactaactttcttaaaagattatttatgcttttctcaaaagatt

SEQ ID NO: 30104 - DNA, 201 bp, Bos taurus
tgagagagagaaagagaaatattttgactaaaatctaatattaactactgttgtacaaattatcaatctaacagagaggtgatatatcatttctattaaayttataagagtataaagttaattccctccaggaaagcctttctaaaaaaatataaattgtattttgagagttaatcaatttgctttttctctttggcagtt

SEQ ID NO: 30105 - DNA, 201 bp, Bos taurus
aattatacattattaaacatctcagcaattttaattccatttttcacctagttttacttagtttttttttttttcatgtaaaatctaagtcatagtaaaaratgtgtgtattctttccattggtcacttaacatcttcaattaggctattttttacaagctgctactagtttatgaaatctaattaagtgttttaaggaaa

SEQ ID NO: 30106 - DNA, 201 bp, Bos taurus
gtcagcttttcatttgcatctgatactagaacaccctggtcacatactcattacttcctgactgttctgctcttggttctctgtcttcttagctgagttarttactggtttatttttatcagattttagtggtagctaattcttttcaagtgcttgattttctacccagatcttcttgcagttttgagctttcatttgacc

SEQ ID NO: 30107 - DNA, 201 bp, Bos taurus
gatgaatgcatagactcttcccaagagaaggaaaatcagcattaaacacttgccatcttcatataacattgggtcttgttggtacagtagcagtcaagtargaactatactgttacgcctgacccctcctcccctccctgtctttgatctgggtgggctcagaaaacttgaaagacggcagaagagaaacttgtgagaaga

SEQ ID NO: 30108 - DNA, 201 bp, Bos taurus
gggcagtggctgatggaggacaaaaataatattctcaagatgggtaatttcagcaatttaggtgatttcatcctttgactttaaacagtaagcgacatgtrgtttccctttgtgagtaggtttccagacccaaacttttagattacttatcaaggaatcctatctctattcttatattttctccagttccattcttgcatt

SEQ ID NO: 30109 - DNA, 201 bp, Bos taurus
ttaaagcagcacttgcttcctaacagctgggctctaggtcatttaacactgtttctatcactgtaaagtgacaaattcccattcccagggccagataggamacaattccagcctctagaagactgaggatgaacaatgacactaggactcaagcttgcagcattttgactcatcaaattcttcccttatgaactcttggta

SEQ ID NO: 30110 - DNA, 201 bp, Bos taurus
tacttcaactgcggagattttgcagaatcacaattagggtgaagatacctttaggttcctaagaaggaaactagtgggtttggaccccagtctatagatgygttagaggtgtgaggctatgtggagggaatacccttgtccggagctaggtctccagtatgtggtggatgggggttgggggagaagtatgtgcaggcaggg

SEQ ID NO: 30111 - DNA, 201 bp, Bos taurus
ggtttcaagaatgggtgattagaaatgtgtttctaatctcaaaaataataaggaaacaaggagaaggttgtttgggggtgaaatgcttatttattcagaarggacgaatcatcaaagtagaaatgtccggtgaacatttggaaataaatggtgagtgccaacacaagaggaaaagatttgcaatagagattttggaattat

SEQ ID NO: 30112 - DNA, 201 bp, Bos taurus
tgaaatggcaatctccttagatacagaagagaaccataaggggtataagtaatgcaatcttctctctgcttcctctgtcagttttgacctaatctagcaakaaatgctgagccattttccgcctcttgcgtacaagtatcaattaagggaaaacagggtgactatcttagggcagcggacgatgaaatgtcacttacacag

SEQ ID NO: 30113 - DNA, 201 bp, Bos taurus
gaggtttgaaagggtttcagaaccagatatttactctgtccccaaatccctggaaatagtgacagttctaaaatggaattcaactagaaactatttgcctrttataatttggctataatgtggagaactcaaaaggtagaatatgcctcctgacagggaagtgtatgagaggatcattttcatgaattcaaggcaaaaaaa

SEQ ID NO: 30114 - DNA, 201 bp, Bos taurus
ttcccaagttttcattcaggaacttggagtcaactcaggccagtttgagctcaaaccagttaaaactggttggggtcactgggcatgtgacagcatctaayaggtgaacttttgatgttagagggccaaaatgtccactctcaggtcatgctgctactgctaagtcacttcagtcgtgtccgactctgtgcgaccccatag

SEQ ID NO: 30115 - DNA, 201 bp, Bos taurus
aagaaaatattaagaactcaactcatctgatgagtaataaaattccttaagcaggagaaagatggcaataaatccaaacagatcatcagaaaaactccgcytaattttttccattacttcttgaacatgatcaactaaacattaaaccaaaacctcctgtgtggatatagttcattgcatataaatatttagagtaacata

SEQ ID NO: 30116 - DNA, 201 bp, Bos taurus
gtttaaatatcatcttaagtaaattagtgtgtataggcatgatttgtgtaattacagcagttagtaattagtataaatggagatcatatcaccactagcaracataattaaagctcataacaagtctaaaaaaaactatatattttgaaacaaaaagttaattagatgaattccagaatcatactttggaacaaacttaca

SEQ ID NO: 30117 - DNA, 201 bp, Bos taurus
tgtgattagataggcctctataaaatacttctaaaacttcctcaattgtgtaaatgtttctgaggtatatgttcaacaaaaaccactgtcagagataatgrtatatggtagagacaaaggcccaacttacacctcaacataggactggtttatctaggagactgagggattattatactcaaattaatttctttgagtaag

SEQ ID NO: 30118 - DNA, 201 bp, Bos taurus
aaacatcccagttaatgtacatagaagtaagaaagcatatgggagtaatttaaagcacatttggagagtttcatgaagtccaggatatctagagagaagaygaaataaatgtgcagagataagagcagggtgtttccccttctctctgagttgagttggtattttattctcaaggataatccattcactaattctaagcac

SEQ ID NO: 30119 - DNA, 201 bp, Bos taurus
ttatgaacataaccatttaggaatactttctagagtttacactttcctctattaaaaaaaaagaccagagataaaattccagccaagatgagtgaagaaargaagggaactcttgaacaccagtggtgtaaatgtaaagtggtacagacattacagaaaacaatatggaggtccctcaataatataaagatatagagctat

SEQ ID NO: 30120 - DNA, 201 bp, Bos taurus
atgtcgcccttcattttcttcacaggtgtacatacctcctaatactttgcaaatattggaattaaagttgcactgaactcgtgttaatctcagctcaatcyccatgtcctacctgaaactgcatgctaccaaacacagcacacttgtgaaggaaagcagttaaaaatgtgatatgcattgaaatgctacagttggagaaat

SEQ ID NO: 30121 - DNA, 201 bp, Bos taurus
atatatacagtatggaattatatgtatatatataatatatattatatatatatataatcattgtgcattgaaataaaacagtaaaaaaagccccacttttyagctttttaacattagcatctaggagtggtatcttatagcagtcgtcctttgaattaatctctgctatgctcttttattcctaatgattatctgcaagaa

SEQ ID NO: 30122 - DNA, 201 bp, Bos taurus
tgtaacttttctctctacccctaactacatcattcccaaactagtccacctacttcctttttgctgcctgttatcttactaaggacaaagctggtatcacytttcatttcaaataccagctgagtcataaagacaaaaaaaaatgctctagattagaaaatgatataacttttatctccagatttgttgttgttttgacat

SEQ ID NO: 30123 - DNA, 201 bp, Bos taurus
ctactataggctgtcttcaaattctctctgtgatacttctaatttattaggtataaaaagagtggtcagctataaagaaaatatttttccattgtattatygagatggcataggtttttaatctgtagattattttttgtccctcaaacaaaagttttatagaacatagatgagctgtaccatcatgatgttagattctta

SEQ ID NO: 30124 - DNA, 201 bp, Bos taurus
gaatagattttaacataaatttgcctttctcttggttaaatttctaggagtggaattccttggtcatttaagcaaatgaaccaatttctaagaaactgcckatctgttttccaaagtaactatcattttgcattcctcttagaaacatgtgagtgttccgattgctttgcttccttaccagaacttgatatggtccctcgt

SEQ ID NO: 30125 - DNA, 201 bp, Bos taurus
gtaatgatgatgccagcaaggatgtgtctgacattctgtgcccagaccctggttctcactcagccaattacaagcctctcccatctggagtacagactccytgttccacgtcttctcacagcgtggtgtctgagactgaggttgggctcctcaggcttcagattctgctaggaaagcccagactagccaagccacatgatg

SEQ ID NO: 30126 - DNA, 201 bp, Bos taurus
gccacaccattatctttctaccataatttaactttgaagatataaatagtaccaataggcattctctgttgaagattaatagccattagagatgtaaatayagtggagtgttacactggtgcacatagaagccactttaattgcataggtaattaacatttccattgttcttctcattatcattttgttccagttgaaatg

SEQ ID NO: 30127 - DNA, 201 bp, Bos taurus
ttagtgtgggttattttggaacttaaactgtccatctcttctccaagtaaaaataatatttttcaaagttgcgtttctaaaacgatactactagttcactkagagtatgaacttaaatcactgtattgatgcaaattttctgaaattcaagtttgcagattttattctgtatgagaaatgcacagatgggttaatatttca

SEQ ID NO: 30128 - DNA, 201 bp, Bos taurus
tgccagaggaaaaaaagtagaattctaggtatgatgcctttttcagattttatagagtatatttcatgataagttaggttatgataggctcatttcacagrgggaaaattcagattcagaaaagtaaattaacttaacaaactgtcaaagtttgtcttaggaaattgctatacatagttgaatctgtaaagtgagttttgt

SEQ ID NO: 30129 - DNA, 201 bp, Bos taurus
atggtggctacatatacaggattggacataggtattattgtccatatataccaattggacattggtttataggtatttacataaacaaaacaaatgagggragaaatctctaaaagtaataacttgtgacatctgcttaccaacttctaataacctttctctactgatacttttacttggaggcaggttagcaaaatttat

SEQ ID NO: 30130 - DNA, 201 bp, Bos taurus
aacaaaaacaggaagattaacagatgaatggacgatcagtattcttcagtccttccacagtgagtttcaaattatcttatatgccatcctttaaggatttkatttacagatcagttgacaggattcgcagatttctcagaatagctactggcttctagaggactacctatgcaaatatgaatgcacttaaataagtgtatc

SEQ ID NO: 30131 - DNA, 201 bp, Bos taurus
gagaaatagtggaacaggaaggtggagagacgttcaaaagctctgtcatctcctgtccattcttcctaacaaaaataacaacatccaagacccatgaagakaactgataccagctcaccatcccatatcagaagtacctactttgtcttttttcatagacatatatacagattgcatgtagaactttgtgactattcctat

SEQ ID NO: 30132 - DNA, 201 bp, Bos taurus
gggtgattgagcactgtacacaatgcagtgcaatgaaaacctccttagtcttataaatttgtattaattatttcaaaagttttaccaatgcattttcttayctatttcaatgaaattcaagtggatatctatatagcactagctgtatttctttttatctatctataagctgccggaatccagctctagcagccagggaat

SEQ ID NO: 30133 - DNA, 201 bp, Bos taurus
ctgtcaccaactttttctgtgtttcagcactttgtctataagagagcataattcgtctttgttatgtacttaaaactgagataaaatgacaggtttataaytctggtgaatacttgctaagcaatgtaatttatatatttttcttcctgctttatgatttcacctttgatgtcatatggcacaaagctacactaaaatttc

SEQ ID NO: 30134 - DNA, 201 bp, Bos taurus
tcttacaaatattccttccttttttaatatgccactttatctctttgatgatgtacgaaggatttcttcatcctagtctaaacaatgtaaaggttaaatgmgcttctggaatagttagataagctaaaaagaagcagagatgaatgaacgagatcataaaataaggttttaattcaatgagaagaccttggaactataaaa

SEQ ID NO: 30135 - DNA, 201 bp, Bos taurus
tagaaaaattcagtttctccattagatgaataccagcagaagcagccaaatatggtctcattttcacattccaaactcaagttagtatatcttgtactaaytcaacttggatttaggtacttaaataaaaattagagccatggctatattagtgtctgaggagtgtaatttttagttttcaattgtttataatagaagaaa

SEQ ID NO: 30136 - DNA, 201 bp, Bos taurus
tttagcccaaaatgccaggtcaagtatttttgtgtattgtttattctatttccatagcctcactgaattaataataataacaaatatatgaggtacaatgyataatttacctaaataaatatctgtagtcagtaaaggacaaactaatccattctggattataattctaaatcagactatagatgtagaaaacaatatata

SEQ ID NO: 30137 - DNA, 201 bp, Bos taurus
attatagtttgtccatattatgaattcatcaaaagctatttattttgaaggcaatgttgtgtatgtttgaggaggagagctataaaaataaattagcaagrgcctatcttcaagaagtatatgtgaaagtagtagtatgttcacatataattatcatgttacatagaaaaggattgaccagatatagtcttattgagttag

SEQ ID NO: 30138 - DNA, 201 bp, Bos taurus
tatgttcacaccactaagggaatatataatcctataactgattacactgttactcaaaatgaagggaaacagatttttttcagacatgaaatcagtaacartatatatacatatgctcactgaaaaaaaaacaaaagtacataaaaattatgccctcaaacctgacaataatccacactaagaactaaaatttgtgtttta

SEQ ID NO: 30139 - DNA, 201 bp, Bos taurus
catgcttgcctattctacacaaaaacttttcatttaaaaaaattgactcccaagtttattttgcaaatttctaccaatttcatgcttatatgaatatttayctcaaaaatgatcaaatattgaatgctgatatcagaacacaaatgcccaggtctcgatgcaactcatacttttgttagtataatggcaagatatgcattc

SEQ ID NO: 30140 - DNA, 201 bp, Bos taurus
gactggcacagtcttgattatctttagttttctttatctaaaacagaagtttgctttgcaaaaacattggtcctgtcgaataattttatgtattaatgaartgataatgaagtattatgaagttatattacccagggcttaatcatgttcatattctttgccagcctcttagtttctctatcttcaccatttaataaggtt

SEQ ID NO: 30141 - DNA, 201 bp, Bos taurus
cattttgagaacttatgagcaaatatagcattaatttagaaaccaagaactaagttagaagcaaactgcaaatgtttcagtttatgctttagaaggtaccrgttggaacaaacatttaaaacctgaaacattatttcagatgctggagtgtattaaatagcaaaacataaaaaatcaaaaccaaaaatagtgtgttgaaaa

SEQ ID NO: 30142 - DNA, 201 bp, Bos taurus
actgtcattttggtttttttttaatggcaatcgacacgctgcctcccaccttatagaattggcaaataggtacgaactgacagggaagtaccttgtcttcrttgttccagtgatgtagaactcgcaggcaatgttttggatgccaatgacaaatctaaagatagagacagaaatagtggtgatgataatgatttcctgaag

SEQ ID NO: 30143 - DNA, 201 bp, Bos taurus
tgttatgatttgtcagcttcctctcctggaatataattacatatgatttctaaagaacacatttttaggctaaagtttacaaggccatgtttacttctatyaaaaatatcctcactcaccttaaatctgtattctctacctctcttgactgtaacccctctgccactactacctgtattatttctctttttctcaggcagc

SEQ ID NO: 30144 - DNA, 201 bp, Bos taurus
agttgcaggtttagtgggattatgtgactcacccttaagacagcccatcactgtatgttttgtttgggcatgaaaaataagaaccatgcaaacctttgcaygcagacagataaagggttcccatcaatgagcattaagtctgagtaatggggttttaaagagacaacttgtagtgttactctttaggaacctcaacatcga

SEQ ID NO: 30145 - DNA, 201 bp, Bos taurus
taagaacacttagggcaggaatccagctgacctaaagtgagacacaaggggtataactcacccagaaatggaaaatcacaatctcaaaacctaaatctgaycccatctcttaattatttaaatttagacatcatcaatatttaataaatcagaaaagtatgtgtgcttcaatatgatgagaccctacctaggctaacaaag

SEQ ID NO: 30146 - DNA, 201 bp, Bos taurus
aattttctaactgggagtctaactaaacacacactcagggtccaagtattgacacacaaacatcttcaaatattttaaatgaaatctaagagacaattatytaaaaatacacagaactaattatgctctaaagccagatcattctcctgaataaatgtgtcatttactaggctgatttatgtattgttcctgtttagacgg

SEQ ID NO: 30147 - DNA, 201 bp, Bos taurus
atgcaaataatgattttaagtcttaggacaagcagaagtgggttgttgctactgcagcctttgcatgggtcctataattcaccagtcacccttggccaagrgttaggaaggatatataatccttttttgactcttcctccacagggaatggagttgtatatcccacccacagcctcagagacaacacctctcaaagtcaca

SEQ ID NO: 30148 - DNA, 201 bp, Bos taurus
gtgccatattccagagagaatccatcaatactacgatggtctcacggccatggcagaggaaagatcataatctggggcccagtataccatgtggggtccgmagcagcctttgtgattatattaaagagtttcagttggaccttcagtgttccttaagagtgatccatccagatgttgtcagagcacagccctgataaacca

SEQ ID NO: 30149 - DNA, 201 bp, Bos taurus
tcagtcaccatctaaggagtctgaattttattctcagcgcaatgaaattctctgacaagtttgagcatggcctgattgcctaaaggtcattctttaggcamacacagagagccatggaaggggcaagattggacacaaggttcctaagatgtccaggagagagatctcattgttgatggaagagacagtggaagtggagac

SEQ ID NO: 30150 - DNA, 201 bp, Bos taurus
aatttcaaacattttcaggaaaaaaaaagtaaaacctttgttcagtgtttccgttttctaagtggtttctaagtgcttttaaaatggagggccataactcrggcttttttttaatcgtacacagctaattaccagacgtacccgtcctgcaaccatttaatgcctacataaaacatggggccataatgaagataattgaaa

SEQ ID NO: 30151 - DNA, 201 bp, Bos taurus
cacggtgtgtgagacatggtgtgctctgcctggcgggagcccggcctctgaggagtgtccctggggacctgggaggcccggctccctattaatttgtgatrgaagacttctcacccttctgtgcccttgtatagggctggcaaggaagcctccatacagccatgtgctgagcccacatcagttgtggggccaaacctgagc

SEQ ID NO: 30152 - DNA, 201 bp, Bos taurus
gtcaaatggcactttctgggtgacagaacccataagtggagctcctctcagatatggtaaaagcaccatgcccaaataagctttctttaaaaagaccttcyaactgaatttaaatttaaaggtgatggccttcttaaatcagcctaattgacatcatttggagctaaaattgaaaagttaccaataatcccaattctttca

SEQ ID NO: 30153 - DNA, 201 bp, Bos taurus
gttagatacaaatttgtgttatgggttgtgtcatactaacatgggttttaatgtttggagatttcacattagtattcagtttaggacttccctgatggctyagatggtaaagaatctgcccgcaatgccagagacccaggttcgatccctgggtggggaagatcccttggagaagggaatagctacccactccagtattct

SEQ ID NO: 30154 - DNA, 201 bp, Bos taurus
ttatgatacattctgggccttgttttgtgtgaatgcatttcttttcatcatcaccttttcattataggagaaagaagtgcttgtgatgagacattgaattwcacctttaattcaggccagtgaaggggaatacattaagaatctacttcaaaacaattcttcccacttactgaacttattcacaaaagtttgacacaaata

SEQ ID NO: 30155 - DNA, 201 bp, Bos taurus
cagacatgtacaaggggctgcctgggtatgatgaggattataacaataaataagaacaacactttttttccacgtctcaggagaagaacacttaatggatracagagaaagatacataataaatataatgctttgaactggcaggtactaaaagtgaagaataaaaattaccatcagaccagggctttggcaccaactgat

SEQ ID NO: 30156 - DNA, 201 bp, Bos taurus
tgtgttaaaatggtactgatctaaatcaaaattgtaaaatgggaaagccctgattaatgatttgcctcgtatacctgtgatattatatgaaagccaaatayaaaaatgttatttcaaatgaggacaataaagataatactctcccacttaaactatttagcaattctaatgttggtgattatttgtgagtttaagggtcct

SEQ ID NO: 30157 - DNA, 201 bp, Bos taurus
actgctgtccgctctgttctttccaggctctgagagctgagttcacagaggagaccctcttccatgctgtatcctgcctcagtccctcagacaatcccaaytaaggcagagaagtattaacagtcccagcatattcacttgtgagtagcttagagatgagcccatatcgcagtggcagtggtccaatcacagagcttctaa

SEQ ID NO: 30158 - DNA, 201 bp, Bos taurus
ttctcctagtattttttctcttcctgtgcagagcacagtgggtgaaagcatggtatttggaaatcccattcttcaaaaactatatttgaataaaatgtgtrcttattattacatgctgaatgacatatatgcaacttttgagtggaacagcatgagttgtggaaattgaattaaacaataaacgtgtaattgcttgttagg

SEQ ID NO: 30159 - DNA, 201 bp, Bos taurus
ggacatcctaggccaggtatggcactgagatgtgcacatgtgtgagaaataaaagtattgagtataaagatatgcaaaattggtaacccaccacagtgctytcttggccagaattcatcccaagggttgtgaaacagtctttacactaagaaccctggtggccaggtgacagtcagcaaggatgaaccacaggaccaccac

SEQ ID NO: 30160 - DNA, 201 bp, Bos taurus
gtgttccccaagaaacacaatataatcaatccttagagtaaggggataacctgttgctaccagaaactgtctattgtacttgttcatgaacattttttatrtctaatttttagtagagaaactcttgtgataaaataaatccaatgaaaatgagtagacattttttcaatatattttctaaaattgtgttttctttatcta

SEQ ID NO: 30161 - DNA, 201 bp, Bos taurus
gacctgcaacatgagaaaaatcatttcaaatccagaattgctgtactcagtcaaactgtcatttcactttgaggagaaaataaaatcattttagaacacakaagatatcagaaaatttaccatatcagggctcccaaaaaactaagccaagaaaaattaaatatgaattcaagagaaaagaagcagaactaaatctaagtt

SEQ ID NO: 30162 - DNA, 201 bp, Bos taurus
attccactgcctgattctccaaggcaacggttactaatacccagccccttttctaggcactggtagaaagtactggagaagaggccatatcatcccatatytcgttgaccttataacctgaacaaatgaactagatttacatataaaaactaagcactcttaaacaacaggtatgtaattaggcaatcatgggcctagtac

SEQ ID NO: 30163 - DNA, 201 bp, Bos taurus
gagaaatctcttaaaggaatattaatatactatatatagaaaaccacacaggttaccaattccaagttaatactaaatccagaaataaattaactttattycaaactggccaacaagactttctctgaaaggcatattacccctcccaggaatacctatcccatttgttctaggaaacaaagcattccatgcctcccagaa

SEQ ID NO: 30164 - DNA, 201 bp, Bos taurus
gtggccaacttaatggaaatggcctctaacttcattctgagaccatgaataatgcctacctacctgttgcacagtttagagtaatgagcccactttcttgrgaggccagagaaaatcagaagcaggagtagatcctctactgtgggctgccttcaatttgagttatggaatgaggtttacctgggaagagtagaggtataa

SEQ ID NO: 30165 - DNA, 201 bp, Bos taurus
accatgcgtgtcctctcaaagggactggaggatgagtcctctttttcatcccccctcaacttaaagccgttttcacctttcaagtatcttagatgttttayactaatgttcaggcctcatcagaaacacaatgccaactttaattttggggttgttgagcccagcaccaggagttaagacaagagggtggctttgaatcat

SEQ ID NO: 30166 - DNA, 201 bp, Bos taurus
ctctgaccacttgtcaacccaggatagctcttagaggggcaatttttgagcacctggtgtgtgctggcattaatgaggcccttcacctactatggtccatwgaagaggcaaatatattgacttggagtgtgggctggtagttggctgattgggttcaaatattgggccccatgcctcacaagctgtctgctcttggatatg

SEQ ID NO: 30167 - DNA, 201 bp, Bos taurus
actgagcattcactgagagagggcaggggaaaaagaagatcaagagacgtttctctaagttcaccctctattaggcctggccttagaagagtgcagacttycaaagaagctggaggctgcatgtactgacctcggaaaaatctctcaggccccactgttgtcagcagtgatttaaattcaagtgcccaactgataaaagtt

SEQ ID NO: 30168 - DNA, 201 bp, Bos taurus
gcaggcagctcagcttctgcacatggccgctgaattccaagaaggtaagactcaaagtccctgaggtctgagcatggaagtcacacataactttcctgcaytattggctagaacatgtcagaaggccagcccagcttcaggatgtctggaaataggctccacctcctgatgaaagaaactttcactaatttctggccaagt

SEQ ID NO: 30169 - DNA, 201 bp, Bos taurus
aaaatcactgagcatgtgtcaaaggcagccaatcaatagctcaagaagaaagagcccatgtggggaaatttgtacaagagacccagcagatggtaagtaayaaaagtttacttcatgccttgtctctactggcccaaaatactcaattctgggaatcaacatgagcaagataacctggtaaatcactatagcagaaataaa

SEQ ID NO: 30170 - DNA, 201 bp, Bos taurus
caaagcttcaccttctaccctctaacccactaaaccagttctgccagtctccttctctttccctggattctacacctcaggcccccttgctttctcccctmctctgtatctcaggagaaacaatccctcctttctggggctaacagcctaataaccacactatgcctatcccggcctcctctgtactcccttcccatcttc

SEQ ID NO: 30171 - DNA, 201 bp, Bos taurus
tagataattctctaataaatatctgtattgtttatttgtacataacgagtggcttattttgttaacaaatcctttgaacaaactgtcatggcccctttggrtgtgtcatttagcttgctgattgaggatcaagtgaagtgaagtcactcagtcgtgtccgactctttgcaggcccgtggactgtagcctaccaggctcctc

SEQ ID NO: 30172 - DNA, 201 bp, Bos taurus
tacaggtatctactccaagggcatgctctagaataggccctgtccttctggaattgtgccgtgttaagcacctcaggtacatatcagcatttatccacagytctgggaaagtcccatggccccagtacatccctatacaaaaagggaaagggaaccatacctattttagagtgactacgtatttccttaaatatgttatct

SEQ ID NO: 30173 - DNA, 201 bp, Bos taurus
cagtgcaatctcaaaagtgtttgttaaaagagaggcaggagtttcagaggcagagagggcaacttgaagatggaagcagagaaagagagagtttaagatgytatgctgcaggccttgaaggtggaggaaggggccatgaaagcaggcagtttctagaagctggaaaaggcaaggaagcagattcttgcctaaaatctccag

SEQ ID NO: 30174 - DNA, 201 bp, Bos taurus
acctggcctttgcaccccaccttgctcagacatcccaacttcccaggactggagctggcatctttcagcaaaactcatcttctggtagaccttcatgcggytgaatcttttgagggcctcaccagccataaggactcatttcccagagtagttttattcgttcttcggtgtatgccagttttcccctttgtgtccctcctg

SEQ ID NO: 30175 - DNA, 201 bp, Bos taurus
ctgttggagggtctgtgggccattcaagtacaaggtgagagagagttggaaatgaaggttcttcagaggcagaccagcaagggctggtgtgaacctgtgaygtgggccttgaccttccgatcagggcttcttatcctaggttaatggaaggacaccagaagtctctcgtaccacctgacctgtgtgtgaaagttgaggtgt

SEQ ID NO: 30176 - DNA, 201 bp, Bos taurus
tcaattcagtacataaatctattcacattagattttctgacacaactaacattcaaatgcagaaactggaggacacaatttcatattaaagtgtgttttcrcctcattttcttggtgagaggcaccagattcttttttttgttgttttttttttttttttgcactctgattctatttttgctccacatcttatgcatactg

SEQ ID NO: 30177 - DNA, 201 bp, Bos taurus
ggccttgttccaagcacttcatatgtactagctcatttccacattagccgcttgaggttctagtatcatcctcattttgcaggggaggaaactaacacatycgactacggccagaaggcctcagcggaggggctggaacgccagtggatggctgcactgtagtctctctttccattaacaaacgttcagaacatcaggcct

SEQ ID NO: 30178 - DNA, 201 bp, Bos taurus
cctatctaatgaactcattaaagaacatgctttaaaaaaaaatttaaaagaaagatctctttaccccactccacgctcctcccaggcctactctccttttytaaaaatgcaaaaaggaaatgcacatggtaaaagatgtctccacatgtgagcgtttctactacctggctccatcctctccatcaaatacctgagctgatg

SEQ ID NO: 30179 - DNA, 201 bp, Bos taurus
tgccctatgagccatgagcctcaggtaactcgcctctgtttgtgagtcagggatccccaaatgtgggaaagagcagaacccctggcatcttggcctctggractcctgaaacatgaacaccctccttctgaaccaggaacaacccaactaacaggacagggtacaagttgtggacagaggcctcagcatctcagaaaaagg

SEQ ID NO: 30180 - DNA, 201 bp, Bos taurus
cttttctgattcttgcattgggaagaagataaaatgagatgaactttaagttctctccctaatctaagactttatggatacaattaaccacagtgattctyaagatttattgcctttctgatcggaaaggcaatttaaatttatatacatgccatataatgtctataagatgataattaccttgataatttcatatatctt

SEQ ID NO: 30181 - DNA, 201 bp, Bos taurus
gtgctgagccttgcatatgccaggtttttgacaagtgatttttgcacatataggattaaattatttcacaggggagaaaaaagaacaaggaatgggaacaytgaaggctccagaaaaggggagagcaaggtcacagtagctcttttttctcagatcctacaggaatctctgtaagttttctggcttagggaaatgactctg

SEQ ID NO: 30182 - DNA, 201 bp, Bos taurus
agcttcttatgcttgagtggtcttgcttttacttgtgaatggtggattttaatctgtaacaaggtattaaaagctattaagatgatacaaatgaatggcarctatgggctacagggaatggaatttttagtcaagagtggcagattctttaaggaataactttgcagtggagggacatttggggcaactctcataacctct

SEQ ID NO: 30183 - DNA, 201 bp, Bos taurus
gggctgggtgcaggggtgaatatggcagccagtggagaaaccataacttcaattaggggaatggagggcagtcccaatcctgtgaccctggggaagtaagmacggccagtgcaggtcattgccttggggcatatttcccttgggcttcccaggtggcactactactacaactaagtcatttcatttgtgtctaactctttg

SEQ ID NO: 30184 - DNA, 201 bp, Bos taurus
tttgggtggactccaggagttggtgatggacagggaggcctggcatgctgcggttcatgaggtcgcaaagagtcagactgagccactgaactgaactgagraatgatgtcagtgtggcaatgtggcctcttacatttctgacatagttattaaatatggtgatgttaggcaaggcatgtcatctctctgagatcaactgaa

SEQ ID NO: 30185 - DNA, 201 bp, Bos taurus
attgtcgaatgcaatttgagaatgggttacctagtccccccactttacagaaaaagtattgggttggtcaaaaaactcattcatatttttttcagtaaatrttatggaaaaacccaaacaaactttttggccaacctgatggttaataatcagcagggttaaatgctttccctgaggctacacaactggatacaaccaaga

SEQ ID NO: 30186 - DNA, 201 bp, Bos taurus
tcccaccccaagagtttctgattcagtaggcctgggtagggccatgaatttccatgtctaacaatttcccaggagatgctgattctggtgctgatggactrggatgtacaccttgaggcccatgaggtttgtcaatattaagttgtcacaaaagaaccacaaggctgagagagaatttctggagaagttgctatatgcttg

SEQ ID NO: 30187 - DNA, 201 bp, Bos taurus
gccaacatctggacaactcattttgagccagtttctcagcatatgttctggaaattcaatttcagttgacaatgggaagtgaatttggctagtctaaaaayggcctcgttttggcccccaagccagcgggatttctggccagagtcttctgctgcaggcatgtccctaagttttggcagtccatgtcagtcactggcaggt

SEQ ID NO: 30188 - DNA, 201 bp, Bos taurus
tggggccatctcctttgctggttcctctttatcttcttgactttttaaagttgaaatggcttatgggatttaatcttgaaacatcttctcttttctaactrtgttctcagccttaatggcccacctgatatgacgataaatttaatttaaccatctatggtgactcagaaggtaaagtatctgcctgcaatgcaggagacc

SEQ ID NO: 30189 - DNA, 201 bp, Bos taurus
cagtctgtatttgtaagtaatagtacattctgtctcaggagggtaagtaacttcccctcagtcagtgagttggttggtgagtgagcttggattctgaaccyatgcagtctggttgtagagtctgttgtgttaaccacacctctgttctgcctcttcagttgcttgactctcagagggaatgaaaatggattttgagagttt

SEQ ID NO: 30190 - DNA, 201 bp, Bos taurus
cattcatttatatatctcctctagctgctttggcctacaacagcaaaaggagtacttggtttagacacacacctacagccttcaaagactcaaatattaaytatctggccctttgcagaaaaaaatttctgacccttgacgtagagtaggagttctcaaactgtagcatgcatcagagccatcagtttgataaatttccca

SEQ ID NO: 30191 - DNA, 201 bp, Bos taurus
caactgtgcctccaagggagtgactcacaatgctgtgcaccttgggctttttgtatctcactggagaaaccacaggccccgggggcctctcagtgtgctgytgtgcttccggggaaggggtgacgggatcagtatatagccattactcttacccttctaatgagggccttatcaatctctgtggtctagaggggagcttcc

SEQ ID NO: 30192 - DNA, 201 bp, Bos taurus
attacaaaacctataaggccaaataaagtcatgagtctgagaccctgataatctacaactgaatattaactaccaaaggtcagctgagactatgggccttygagtaacattcagccagaaactgccctacttgatatgtcttcacaaatgttataaactgaatgggactccagcaatttgtcccattagagtcagggccta

SEQ ID NO: 30193 - DNA, 201 bp, Bos taurus
gcatgaactccaatgaaggaatctattctccaggaattaatagtaacagcctgaaggaatatccaccctgcaaacccacagacacaaggagcccctgcacrgatccccacaaggcatttgtttatgacacggattctcatgacgaggctgatgaggacgcttcctccttagcctctgtccaagcggttccaaaccagggct

SEQ ID NO: 30194 - DNA, 201 bp, Bos taurus
ccacagacacaaggagcccctgcacggatccccacaaggcatttgtttatgacacggattctcatgacgaggctgatgaggacgcttcctccttagcctckgtccaagcggttccaaaccagggctgcaggctgcacagttgtaaattaacccacagtgtctctgacagcctctttggctgggagctgaatggcaaacact

SEQ ID NO: 30195 - DNA, 201 bp, Bos taurus
ggtctctctgcctccaccatcctcaccccttctgccatactccaactgccccaatgtgtatctcaaaatagtgacctagcaagcgttagaggagatgggtyatgtgcccaggatggaaggtaaaaagagacccttccagcactgggtgtctcacaatgagctggcagcggtgaaggcaaacagcctcctttgagtgactca

SEQ ID NO: 30196 - DNA, 201 bp, Bos taurus
tccccaccacagctagctcctcctggcctgtgtgtcctacaggagcctcttgcaataaaaccaatggttctcagaattctctgggaagttgtcataaaggyaaattcttgggcctcaatccagacttgatgatttagaaatttagttcagtttagtcgctcagtcacgtccgactctttgcgaccccaggaatcgcagcac

SEQ ID NO: 30197 - DNA, 201 bp, Bos taurus
agagaaaagacctgagaatcttaagcagagcatgatgagcctctggagttagactgtgttggatgataaagaacttggctggcctttgcccctgagagccycaaaacccttggaattccccagagtaacagtagggtcttcattattgcaggtggggccctcagaccacacctgagtttatgctaacaagacggctcctgg

SEQ ID NO: 30198 - DNA, 201 bp, Bos taurus
aagactttgagataattcctcaagttcacaccctttgtgtaggtaacagaggaagttcattggctaaagatgatccaagtcagtggcccagcaaggatgaraacaaaagtctctcaagtcctcaaccagaattctgtaatatgacaaagtcacctttttatgaggacctccttcatgccagacactgcatggaggcctcca

SEQ ID NO: 30199 - DNA, 201 bp, Bos taurus
aatgatactatagagcagattatattgatttttgaccaatgaattttccaagacttttaaaggaagaaaacaggtacaacagacaatgataacaataataycttttattttttcaaaaccatttgcatttaattcattcaacaaattaccaaatatctggtaaaacccagacactctatcagacaccagactaggcatgga

SEQ ID NO: 30200 - DNA, 201 bp, Bos taurus
acctaataaattacttatttgtatttgttattataatttatagttccctccttcttttctcctgctaaatactattataagaagttttaaattttgttttrcattgaaaaatcacaggcctaaaaagaagacacacatttatatcagaccaaaaatctttgctatccaattttcttaagaaatgaacaaattggttaaaaa

SEQ ID NO: 30201 - DNA, 201 bp, Bos taurus
taatggttgatgttctcaaaatgctgtattctggtaagcaaaggctcctttactgctgagtgaagctgaattttttgtccgtggcctcccatatggacaamactggatagcttttgtataaatcttcatttttcttaatggaggttgaatgtgggccttagggatctctgaccaattaggcatcaactgtttatagcattc

SEQ ID NO: 30202 - DNA, 201 bp, Bos taurus
cccagaaatcccaaggggacactgccctgcagagcacagtttgaaaaacagccacctagtggcatctgcaggactaaaggagcctctgcaacattgtttcrttaagcagatccttcctgaagctcagtccagctctgatccacatacctccatagccttgtgctctttgtcaaggcaggtttagcagatggtaaatcatgg

SEQ ID NO: 30203 - DNA, 201 bp, Bos taurus
tggtaacgataaccctgtatacgagacagcatgctttgtatttttgttattaaacttctaccagataaatagtgatgcctgggttacaaccttgtgatctktaatattagtcttccaaaagcttaactaagaagataaaactcaacaatttccactcagttttattattatccttttcgatagaactttttgttaaaacat

SEQ ID NO: 30204 - DNA, 201 bp, Bos taurus
cccagcagtggttttcaaacatgagcatgcattcaaactattatacctggcaggtttgttaaaactcaggctgctgtatcctacttccagaatttgtgatycagtagtctggggtagggccagggatttacctttttaaaacattcccaaaggttgctaatgtttgggatgcacaggtggaaaccagtaccttagcctgtg

SEQ ID NO: 30205 - DNA, 201 bp, Bos taurus
gtgtgggatcttagctccccaaccagggatcgaacctgtgctccctgcattgaaaagcaatcttaacccctgaactgccagggaagtcgtgggatatcttraaataggcagaagaggccattctcagtaacttagaaaatttggcactaataaagatgaagatgattgtatataataggatttcaggattttagcaacccc

SEQ ID NO: 30206 - DNA, 201 bp, Bos taurus
tccaaatgaagcagagctctgcatgcaagtaatcctttctcacatgctgatcctataggctttatattaaaattcttttaatagtccttatggtttccctmtaaacatttagcaccattggagtttttggttgccttcacaaatagaagagcaagtttacctgtttattcattcctaaataataatgacaggtcaagttgt

SEQ ID NO: 30207 - DNA, 201 bp, Bos taurus
attctttaaaatttgcacactgaactattgcatttcagcatttcccatttttagtatttcccattcccatgcctcctgagtctgcatcttaacttgtcatygaagtctttttctactttaaagtctgagaaggattgatgtgatctctatgatttctgaagccaatcttgtgatataggtatgttatgtgaccaaagagtg

SEQ ID NO: 30208 - DNA, 201 bp, Bos taurus
gcaaaaacaagaccaggagctgactgtggctcagatcatgaactccttattgcaaaattcagactgaaattgaagaaagtagggaaaaccactagaccaakcagatatgacctaaatcaaatcaaaactgaatttgggtattggccacctggtgatatctatgtgtagagtcatctcttgtgttgtttgctatgaccagtg

SEQ ID NO: 30209 - DNA, 201 bp, Bos taurus
tgagtctgtttctgttttgtaagtaagttcacttgtatcctttctttttcgattccctttataagcagtatcatgtgatattcctttgtctgatttgcttmattgagtatgacaatctctaggttcatccatatagttgcaaatgacattattgcagtcttcttagtggctgagtaatatcacattgcatatatgtgccac

SEQ ID NO: 30210 - DNA, 201 bp, Bos taurus
tagcagtaaagagggtgatttacctcgctccagggaagtcttctcttcacacacatcaagaactggccacgagtcagacattggcctcagcatttgtggartaaaaacaaagcctctagccccttagagccgacaggagcaataggtatggtgaggactgcgtagatccagtgtgtaattgcagcaaattctatgatagta

SEQ ID NO: 30211 - DNA, 201 bp, Bos taurus
aggagaatctcccctatttttcatttcatagttaatgggaaatgaatcctatcagaaagaattttctatacttctgtttgagacaaactctgggccccaaygcttttattcaagaattagaaacatgaaataaatctagtgccagagtacacatcttcctggggccccttcctttcttcctcctcatactcctgtggcctt

SEQ ID NO: 30212 - DNA, 201 bp, Bos taurus
taaaaaacttgtacacatcaaatgttcaggtagaatggattctctgtgaatggattttgaatttactctgcatcttaccatatctttggtctgctgccggratctccaaagtgatgtgtagcaaaatttggggagcatagtcttagtggattacagatataatatatttttggttattgttttaccaaaagattgtttact

SEQ ID NO: 30213 - DNA, 201 bp, Bos taurus
gaacacagatctgaaaattataaagttttactatgcatatagtaaaagatgctcaagtttctccttctctgtcagtcataccttcttgccaatattatgcrtgctgcccagggagaagatgttgttatctattgctatggaagcaattgtttaatttagttactacatcctcttgatttttatgagtagtggtaaaagagg

SEQ ID NO: 30214 - DNA, 201 bp, Bos taurus
cctggcctctacctctccagcgcggctgcctgatcgcagtctctgcccatccatgggtgtctgcccctacatccactccctggtggtcccagcacttcccygtggagtgtgggccctgccttcatacctaccatctttagagtcagactgtctcaaccctactcttttgcttaggacagtgcagatttttttttttttttt

SEQ ID NO: 30215 - DNA, 201 bp, Bos taurus
agatcaatctgctgccaacatgtttttccccccctcagtagaatgcatcctggcaaacccattcaatcatcctggccagcttccccagtgggccacaacartcttatgctttcaggcaaaataattttcctctaaggcaagtgtgacttaggaatatggcaaggccccaagtaaattggaaaatattctcagaattttaac

SEQ ID NO: 30216 - DNA, 201 bp, Bos taurus
aaaggattaactgaattttttattccatttgtgaattgtttgtgctgattttatcaaattgtttaagtgattttgtcattaagtggaagaaacatatattytatttcttttcattatttatgacccactggtatctgcagacctcattcagagggcaaaaaattttaagaatttactggaagaacagaaatggcatctcct

SEQ ID NO: 30217 - DNA, 201 bp, Bos taurus
aatcatcaaaataaatgagttccaccaaaaaagagagtgaaagaaagagtgagggctgagaaagagccagacaaagtgagggaaaaaagttaaaatgtgcrgactctggagcagaaaaatgcaggatgcagaaggaaggaagaagagatgagagagagtggaggatcaggtcatttaacagtgcttgagccattctgaaga

SEQ ID NO: 30218 - DNA, 201 bp, Bos taurus
taaacatgaagaaaagaagaccttgtctcatcatcaaacactgcaaatttagatgtaatagctggcgtccaccatccaatttgcaacctgacttaaaaacrtgttatcttccacctttctgtcattagggggagtagattttgcttatactgatcagctctgctaacattattttcatttcatttaacaatattccaccaa

SEQ ID NO: 30219 - DNA, 201 bp, Bos taurus
aaggggaatatcttttttaaagattaaagtttattcaaagaaagcttgacagagactaagagaatctccccattcatttattgtgatcagccaatggtcarggaattttgcccatgatactctccaaacactgacttttggggtgttcccagagttctttataaaatctaaattttgcctcaatatagaagcaaataaaat

SEQ ID NO: 30220 - DNA, 201 bp, Bos taurus
tagacctgtgtgtgtatgagtgtatgtgtccccatcaataaaagctaagataaataagatatggtaaatgcatatcatagaatacttttacaagataaagraaagaaattaggttgatgcactctgccaaaatggatagtttcatccaagtgtttatttgaaaaaaaaaaaaaagtttttagtactgtgtctacaattggc

SEQ ID NO: 30221 - DNA, 201 bp, Bos taurus
gggatttggatacagtctttaagtgccaagaattcttgcaattttccttccagggccaaggaaaagtgttttggagggaccctaggatctgtctcatagarctttatttcaaacctgggcattaaaaacaaatatgtttatgtgagtagtttatactgaatatctgaattaaaaatgcttctgggtgtgggaacagaagac

SEQ ID NO: 30222 - DNA, 201 bp, Bos taurus
tttaataaatgacagtttgtgcaaaataataatagcaacaatgcatttgattatatatgcttattacatgtatcttatgtgtatgtatatatatacacatrtactgattatatgtatgcttatctataagtgaaatgaatgacatcaaaaatacagaaaaaagggaaaaaatagaactatttagttcttatattgtattca

SEQ ID NO: 30223 - DNA, 201 bp, Bos taurus
catttatcagtagtttcctcttgtattctattttcttcctctaagaattattaaaaaaaagatattcccaggtgtgtggccttcaatcctgcctcgttcakccagaggaagcataattgagctttcagtaaactgtaagatgatagattttcacccgtcaagatgtgttggagaccaaaaataaacaattatagatacttc

SEQ ID NO: 30224 - DNA, 201 bp, Bos taurus
ccaggaagacttggttagcaactggaagcctgcttgcagtttggtagaggatgctgtctttggagccgagattgcccctcgccttccagctctggttatcrcctacctgcctctctgcctccagcagggaatgggcccgtccacagccagctagctctcctctggtattcactcagtccttaggtttgtgagcaggctggc

SEQ ID NO: 30225 - DNA, 201 bp, Bos taurus
tttagtgtggacacttgaaagggtagcagtgtggtaatctaatcagaaagtgtggagaatacaaacatgttgagagtgataacaatatttaaggatgaaayaccatgaaaccaggtgcagaagaacatttttattcacaagaaaattttgaatgtttccattctctcttatttctatgaaatatgttcatcttaaagtttg

SEQ ID NO: 30226 - DNA, 201 bp, Bos taurus
agagatagttacattacaattattcagcaactctgcttttccaacatgtatctaagtataggaatttccctattagctttggtttttgttataacttgcaratttttatatatcacagcttcataatctttcatttcaaaatgttttttccttatttttttacaattctcatttttcatgggttattttttaatgtatttc

SEQ ID NO: 30227 - DNA, 201 bp, Bos taurus
atctgatctttcctcatttatttaaaattattcaccttttccccaggaacttaatctcaaatcctgaggtatcttcatagcctttttatttctactcctcrcatctaaataactcaaatgggatttctctatgtctagcatatcaatgtgactgtaacctgaactcttttctgccaactcacatagccatatatcttctaa

SEQ ID NO: 30228 - DNA, 201 bp, Bos taurus
gatacccatgatgcttaaataccagtggactttaatttttcaaagtcaaaatttcctcaactcgtccatagaaataatactgccagtttcataggattacrgtaaactataaatatgctaatggttctatagtacctagcaagtacaagagaggagcagacacttagatgataggtagtggtaacaatacctggaatgatg

SEQ ID NO: 30229 - DNA, 201 bp, Bos taurus
tacactcttagggaatccaggccctactttattgcatcaagatctgattatgagaggtgtacccacttttcccaacatattagacatgcccccttactgtrgtaggccttggcacaaacatttacagagctgatgtgttttacctggtgagtaaaagcaggagtgagttactagaagaaaaataagcacagaagttgagaa

SEQ ID NO: 30230 - DNA, 201 bp, Bos taurus
tccccaaggcctctgatcatcctatttaagacagcccccgttcccctaataaagacctctagaaacatgggaaagtctgggctgcacatgaatcatacacrtgtcagtaatgccaatgccatggccagcctgggcaagagcacagacagataacagagcaacctcatccccagggtcttgtggaaatgccagggctgttat

SEQ ID NO: 30231 - DNA, 201 bp, Bos taurus
tctctggggatgacctcaatgcctccatcccttgatcctttcatctcattaccatttcctccctaatatctttcctccttccagtcagaaactgtcatacrtaagtaatgggccatgtacacagatcctgttccttcaacgagcagggactctttcctctcccacccccatgtctccacagggtgctcaatgcctgtgtgt

SEQ ID NO: 30232 - DNA, 201 bp, Bos taurus
gagtctgagtgagctccaggagttggtgatggacagggaggccaggcgtgctgcgattcatggggtcgcaaagagttgcacaccactgagtgactgatctratctgatctgaaggaaaccaatagtactcattgaggaaaggagagtctcatcaataaacggtattgggaaaactagatatccataggtaaaagaatgaat

SEQ ID NO: 30233 - DNA, 201 bp, Bos taurus
gacttttttttacatctggcccctaaactttgtgcccaagtggagtgccttgcttacctcacctacccccagccctgggtagagccctacaaaatatctamtaatgtgctagaaagtgttgcaaggcccatggttataaaatctggctatacaagagaatcaatcaagggaatttaaaatatggtaataataaaaccgtat

SEQ ID NO: 30234 - DNA, 201 bp, Bos taurus
ctaccatccctggcctctacgcactagatgccataacatctccccaatacagttataactactaaaaatatctccagaagttgtaaaatgttcctgaggayacaactggccttggttgagaaccactgtttaaaataaagtcaagaggtcaaaggacagaaccctgaagttcaccaatatttaaaagtaaggtagaaaaag

SEQ ID NO: 30235 - DNA, 201 bp, Bos taurus
tgtaagacctctttctttctttactctctctgtttagctgcttttagatacatatttatatttgcatgatgcatacatgattaaggagaggtaatctttaygacccagataatcacgatggtgtgatcactcacctagagccagacatcttggaatgtgaagtcaagtgggctttagaaagcatcactatgaacaaagcta

SEQ ID NO: 30236 - DNA, 201 bp, Bos taurus
acagcaatgaaattacactgattggttagacctgggtcacatgctcatccctgaaccagtccctgtgactgaaggaatgcaaagaactggctggtccattrtgagtgatgttctttttatctggaatcaggcgtcacaccagacctacatggactgagccaggtatagacaaaggaactttgaggtgttattcccagaagc

SEQ ID NO: 30237 - DNA, 201 bp, Bos taurus
ggtaagcacagttcacatagaaacaaacgccttttaatcacctagtcctggtggccagaagggcttatgttcctgggccccacaggactgaataattaaaracagtgctgagtaggctgttgcacccagaacattgcagagacagcagactgaaatgcactgccagcctgcctgtgaaaaaggcccatttatttgtcttgg

SEQ ID NO: 30238 - DNA, 201 bp, Bos taurus
tctccgttcctttttcattttttacctttcataactagtattactcaaaacacaagatctttaaagatgcttctatccttaaaatcttttgatttacaaayagaaagtgcttttcccttatgaatgagggggaggaaatggccaggtcagagaactcccagcttccagtttcttaagtgatttaacacataaataaaggtg

SEQ ID NO: 30239 - DNA, 201 bp, Bos taurus
aagctcaagaacctgcaagccaggcctgggatggccacatgcacccttccctggctgcagggcgacaccacacttccatcagggatgcctgggtcctggaraaagattctttgcaagttgaagagcagagccttttaattgccatgtccccagtgacataaaatctcacaaacaacctccataaatcacaccctgacagct

SEQ ID NO: 30240 - DNA, 201 bp, Bos taurus
tttctggtagaaaatggccctaccccaggagcactgtgctggtggctcctcagcaaagtagaaaatgtcacttacgcatgagccgtgacaacagcatgtayaggcccgcacgtacgctttcctctgccgagcagctgctacagctgcaaactgcagggcaagatcaagaggactaaggaggccaacgaccccacatccaca

SEQ ID NO: 30241 - DNA, 201 bp, Bos taurus
aactgaaaagtttcacagctcagggccccagcttacatccttctggctggcagccccaggagaaagaaggctctcttcctccacagggacagaagtcgctrtccatgcagccctaacgccagaatgccacgtgtctgacagtgtttgtgaggggtgctctctgaaggacagctgaggggtggaagccaggagaacaaagat

SEQ ID NO: 30242 - DNA, 201 bp, Bos taurus
gggatcaaatctaaaaagactgggtaggattcttccccaagcctctgatgtcacatatatttatctgcctccagcaccagccaccagggccccacgtgccygggcaaaggcaggtctcatctttccgaggacaaggctttctgccctcactcttcccgcactctgccaggtctctcttctctgcccaacccttggccccac

SEQ ID NO: 30243 - DNA, 201 bp, Bos taurus
acatgtatccattaggagattgattttcatcagggctggcctggtggtctggggcaggggtcggggtgtaggtatggggtgagggcctctctcagttgttktccatcagcctcccctctccagacaagggagagaaggtgggtagcctgcctctcgcccttactcctccttttggttctccccctagagacgttccgcttt

SEQ ID NO: 30244 - DNA, 201 bp, Bos taurus
ctacccacagcaggccgagtccaattttgcagagtgaacccccctagcatctagtcaggagtgcctggagggctaagaccgtatctaagtcatctctaccrtcatctgtatccccagtggcctccagaggggccagcttggagcaggtgcttttgttaccgagtacaagttcactcttctctccacacaacatgccaatta

SEQ ID NO: 30245 - DNA, 201 bp, Bos taurus
caggccctaaggccacaggaagaaataggacagtctcatcctccccttagctggcatggggtggcgtgcaggcctgcaggccagaactctggactcttgtyctctagcatcactgatgagaacaaagagcttgaccttgagcaagtcatggcccctccttggttctcagcaccctgatgtagatggaggtcttacccagtg

SEQ ID NO: 30246 - DNA, 201 bp, Bos taurus
aaggaccagtaaagaaaatcaggatgagtggccaggggagcaccagaaagccgaatgaacacaagcaggagggtgccaagtgaatctgtaccaaatgcttstgataggcccagtaatttgaagccaaagcatcatactcctttggcaagagggaatccactggtgatcctgaccagacccaagtcagtacagtgatgggga

SEQ ID NO: 30247 - DNA, 201 bp, Bos taurus
aatacacaagtattaaaaacaaaatacctgtaatgctaataagataaaagaagatgtccaacctcaccagtaatcagagaaattcaaaataacaatgagckatatattactcatcaaactgacaaacgaaaaagcctgacaatacctactgttggcaagagtgcagaacaatgagagtttaatcagttaagatgggcatcc

SEQ ID NO: 30248 - DNA, 201 bp, Bos taurus
tccctggtccagaaagattccacctgcagaggagcagctaagcctgagagctgcagactgagcctgcgctctagaccccgagagccacagctgctgaagcytgcactctcgagggccctcaagcctagaactaatgaaactactgaagctcgtgtgcttagaacccctgctccacaacgagagacgccaccacaatgagaa

SEQ ID NO: 30249 - DNA, 201 bp, Bos taurus
attcccgggggttcatatgtgggccaggaaccaccagctgatatcagtaaacacagagactttaccagatgcacaaacagaaaatacaagggatgttggcrctatcgggccacaataatcctttaaccagataaaagaggtaacttctaagactaatgaaaaaatagcctgaagctgaagaaggaatccttggggcccagc

SEQ ID NO: 30250 - DNA, 201 bp, Bos taurus
ggcacaaagccttgcagcgattctccaccctctcagaaaacagagagctccattaaacacagaagacaaaacaacccaaaccagcacacacccgctggagyggggccattcagggagtgtgttgccaggggcacacccctctttgaacctcccatccacctgtcttctgggctccccagagagaaggctgctaaccagcat

SEQ ID NO: 30251 - DNA, 201 bp, Bos taurus
aggagcaaggcttatcaagcgctgccaaagttcctggcccacatacatcatgagcaaataaaatagctgctgtttcagccgctcagctctatggtagaggrttaggcggtgatggccccaggtggggtggggggaagatcccgctgcatgtcaggtcatggtctcgaaccatttacgaagctcagaacagccctgccagga

SEQ ID NO: 30252 - DNA, 201 bp, Bos taurus
cccgtctgggcttgaggtccaggggatggccttgacggggctctggaaaggaacagcctccaccaagcccaagtccgatggcaaatctggggcccttcacrgaggaaattcctcagcctcaccgggtggtaacagaagacctgaaaacagtccacagggtctgccgtgaggacttgactgacatggagaatcagccagaag

SEQ ID NO: 30253 - DNA, 201 bp, Bos taurus
agaccattgccaagttgctgcttgaaccctggcaccatgaatggagaagaaacacgtgaagtacactgaagctcctggtgggactcagggccgtgcagttrgctcagcacacttttacatgcatttttagattaacttgaaaatgaacacatgccgttttttaatcctcaagaagctcctgaccccagtctgagggccaac

SEQ ID NO: 30254 - DNA, 201 bp, Bos taurus
tgcccacctgcagaggttcacgtgcctggttgaacttggcccaaaccccactgaggacccagtgtttgcagtactgctgctgtagggtgttcatggccacrttgggaaggttgactgccttctcaaccaccctgggagtaaggaggatgctcagtgttacacgggaggctcagagagggaaatccacctggtcagacacac

SEQ ID NO: 30255 - DNA, 201 bp, Bos taurus
aaggacaagtgggcctcagggcaaggcccaggggatcctgtatggtcatccacacactcccttgggcaggagatgatggagtttgtggcagctgagccctrtgggggtgaaggggacagggccaaagctgcaggagaagtgaggggctttcttctctatgcatacctcgcaaggcccaccatctttgcccaaagggaagga

SEQ ID NO: 30256 - DNA, 201 bp, Bos taurus
gagtcctcccagctgtggggctgggcactccaggcgggtacaggaggccacctcaaggactgtgaccatgtataagtgagtagagttggatctcattattsgcagtagttgtggcctagacttggagaaggaaatggcaaccctctccagtattcttgcctggagaatcccagggacggaagtctagactaggggtcccca

SEQ ID NO: 30257 - DNA, 201 bp, Bos taurus
caggaccgtgctggccacaatgcagaggcagaagggaagacagacgagataggaggttagcaccacagtgggacatccaggtgggtggtctaggatgccargctgagccccggagagaggcctgggctgaacaactatctgggcatcagcaatggtggccaggagcagcccctgactgacttgggcacagggacaaagaag

SEQ ID NO: 30258 - DNA, 201 bp, Bos taurus
aatgggttatgccagcatctccctggtgcccacttgaggccttgatagtggtcttgtacagagaagatgccctggaagacagaccaggggtgcggatagtratgagtgtcagggccacatggggtagggggtggatgagaggctgctccattatcctgtccattctggcctctgtgcctccttctgcagatcgagggctca

SEQ ID NO: 30259 - DNA, 201 bp, Bos taurus
ctcccaagcctgcaggagcatctgggccctggggtggcaagctggggacccaagcacaacatctagggaggcgccaactccgaggtggcaagtgcagagtrggcctcccttgtctcattggagtcccggacctgcactggggaccagaacaagaagatgtagtcaccagcatgtagacaggcttccccagggcatgggggt

SEQ ID NO: 30260 - DNA, 201 bp, Bos taurus
caaggagcacagtggggaagaagaggaaaccctgccaaggaagtttatataaaacacaaaggcaaagccctctaagtggtgcccagcccaggcaagggccyagcaaaccgaacttcctccctcctcccacgtataacccccagtaaccaacatctcccagctcaggcatcagcaaactttatccaggaagggctgggcagt

SEQ ID NO: 30261 - DNA, 201 bp, Bos taurus
tagcattcaacaactattactgtagggtaaggaaaaaaaaacttgcatacctattgcttttcatttctatcatctattttgatgtatgccaattcagataytacaaagtgttatctctataaaaagatattataaaaactatactaatattatcaaagagtacagcttagaataaaacagactgacagctgacataattct

SEQ ID NO: 30262 - DNA, 201 bp, Bos taurus
tccatcttttctcccagagattgagtgggattccttggtttggaatgtctctgcctggtcatagggtcccaccttctctgggattctcctttctgtgtgtrtaggccacccttccactcttgttccttgtcctatctctgataatgctgaagctgaataggaccctgtggggctcctgtgtatggaagcttttcaagcagt

SEQ ID NO: 30263 - DNA, 201 bp, Bos taurus
gcctctctctctccacatggtcaaaggcactctgtcaaatgttccagcatcttaccctatacatcagaccccctccagactccattttctcccatcacccwcagcctgcttgctggggcctggggcttatattcttcatcctgggtctaggaacctggcttcctgcctctttgaccaattacttcttactcttctccctct

SEQ ID NO: 30264 - DNA, 201 bp, Bos taurus
actgattggccttgggcaaaacttgagtgaatatgcaaatatctgtttcttctgctataaaatattggcactgcctgtttatctctgctgatttctcagcrtggccattgtatttgtgaatacaaattcaaaagcttcatcatctgtgctgtgttctactaggttaagctgatcatctaaataataaaagaagaatcccaa

SEQ ID NO: 30265 - DNA, 201 bp, Bos taurus
ttgaattgaagagattgttgtgaggtagggatggtgtgatagggatccaatttcattcttttgcaggtagatatccagttatccctgaaccaattcttgargagactattctaccttttatgtaacattttatcccataaggatgcccagtatccaaggcatcttatctgtacaactgtgattcccaaaccaagtgaggat

SEQ ID NO: 30266 - DNA, 201 bp, Bos taurus
ttggtgacatcatcttgcacattatattttctaacatagatgatttaaagattgaaatcatggccctactctgtttatattcataaataaagtcatggaamatcatcaaaatggagtttatattaccagtcatttataaatgattgctgtgaaactttaagataacctgtcttctgagttatattaagaacttctcctgta

SEQ ID NO: 30267 - DNA, 201 bp, Bos taurus
tgttgtgatttcagtttcaaatctctgttttgcaggtatctaactccaaaatttcctttccttttaagaacaacaatttcttatttaaatacccatttccratgcattcccaacttcctttacattagtatggcagttgactgtgctgtcttcaagtctccttttgtctgataccaggaaattttaattatttatactcat

SEQ ID NO: 30268 - DNA, 201 bp, Bos taurus
tgaatacttttcatgggatcttgaaagtaaacatggattataaaaattattcatatggtatataggactcaaaccaagtttggactctggttagcttcacrgtttgcagttgttgtatattattctaacctcagcagatgagctgtcccagtaaagcatatagtagatttaaggaacagtggtatcttagtgaattatctc

SEQ ID NO: 30269 - DNA, 201 bp, Bos taurus
tcatgggacagattttcttgattatcctggagcatctacagagaaaaatttacaagatctcaggtcattaaactttctattcatgtcacagagaaccagakttcttctaaggaaaccttaaacactctcttctttttttccttatagccccagagataaatatttctgaaaattaaaacaaaatttaatggcttggactat

SEQ ID NO: 30270 - DNA, 201 bp, Bos taurus
ataagaaaatattatttgatgtcacttcagagttagaactaccaagataacagaaagctggaagtcaatgaattgaccattccttccaatttcttaagtckttggtaatgttatttaactcataaaatacttgtgtactttaacaaataattaataggagggaagatcaataaggtggttgtgtttcagggctggatcaag

SEQ ID NO: 30271 - DNA, 201 bp, Bos taurus
tcattgtctgcttaaatcctttaacctaggttcaccatcaataccactgaaataatattgattgagaacttttgcataagagcctttagagatcagacagyttatatataccctctgatttaatctgtaaaatgaggataatgagacctaatagagattatttggaggatatatacatttatatgtaaatgtagatttaca

SEQ ID NO: 30272 - DNA, 201 bp, Bos taurus
gcataaatatggcctgattttaacttaattccttctttaaatgccttatctccaaatacagtcctatttgaagtatgggatttaggggtccaatagaagarttctatagaaatgggcctccctgatggctcagacagtaaagagtccacctgcaatgcaggaaggagatatgggtttgatttctgggtcaggaagatcccc

SEQ ID NO: 30273 - DNA, 201 bp, Bos taurus
ccaacacccatttgtggaacacctactgtgacaaggagagtcactgagaatacagtggtactcactatccatttccaaaaatattcatcctaggaacagakaatacaatttaacctattccctcatctgacttagcatttgagagcaagagtgataccttattcatctttgtgtgcccagcatctatgactaattcagatt

SEQ ID NO: 30274 - DNA, 201 bp, Bos taurus
caaatcaagacttggttccaaaaaagtaagatttgtttcctgatacagctagttcattatttatgcgttgagtctttcctttctctctttaaaatcatgayattctagaactttgtgaaaaagcaaattttgttcctttcaactatgactttgcatgaggaaatcacctcaggaaggttgatgagtctaagctacagagtc

SEQ ID NO: 30275 - DNA, 201 bp, Bos taurus
ttctagactgtgagtcattgtcaactgggagcatccatttcgtttttaataatgtagaagataaagcaaaatgtttgttgaatgagtgaataagtgataarcctttcttatattcatagacttttccccccttcaggttaggcattcagcattgtgagttttatcttgtgaacactactatgaatatgaagctgcagaata

SEQ ID NO: 30276 - DNA, 201 bp, Bos taurus
tcacacaattatgttagttttaggtgtaaaacatagtggttcaatattctgatagattgcacttcataaattattacaaatattggctatattacttattmttacaacatatctgttttgtatatattatttattttatacatagttgtttgtatctcttaatcccataacactatctcaccccctctcagcttcaaatgt

SEQ ID NO: 30277 - DNA, 201 bp, Bos taurus
attgagataaatactgttgaaataaagtgtaaacctatgaaactgatgccaggggttagaagcaccacccagaggatgtgacaaaccaaccaagttgcccrggggctgggtcaaagctagggggcatgggtgacaatacccatgtgacaatggacacatgtgacaatggacacattccaggcagattgtattggagagaga

SEQ ID NO: 30278 - DNA, 201 bp, Bos taurus
cagttctaactgttgggatgtaaatattctacctgatcttcctagattgttttgtgtctgtgtttttgattgttcacattttaggaaacttggccttgagmgtaaactctgaatttaggttatatcctcccggactcatatatggggaagtcctttgcatcttgttggtctgaatcgctgttgtaatatatttaattggtg

SEQ ID NO: 30279 - DNA, 201 bp, Bos taurus
tgacaactcaaaatgtcagccatatgattccaaacccaaatgtgaacagctgaggccgtactggaggcttgttcaaagccaaaccaaagaagacaggtccrtttagacatgatccctattacttggcaagaatattgattataggacaaaccgaaagaacattgtctatatttctttttgtggaatcctccgaatcctagt

SEQ ID NO: 30280 - DNA, 201 bp, Bos taurus
ttctgtcactgtttccattgtgacctccatgaggtcacagagaatcgaacatgactgaataacaccaatattctggaaacatctaccataaataactgttkctttattcatcaaaataaatgcctctcaaaacactctctccagctcatggaaccaaaaggcatgaaggcaatttttttttttaagagttttaaacttcta

SEQ ID NO: 30281 - DNA, 201 bp, Bos taurus
aaatatttgttcatcccagcaatgaagaagtgctcaggtgaatcttttgtaattatttgccctaaagtacccaaaatggtacaagtttggcaggagaactytggagtaggaggtcaggacaaaataggtagtccctgtgtcaatcaagcaattctcacagctacctcccacatccagctgtacccttggcctcggccccat

SEQ ID NO: 30282 - DNA, 201 bp, Bos taurus
gacctcctccaatagggctaatgacacaacctgttctactgcacccagatcccctgcccctgggacaggccactgccaacccttacctctgcaagaaacaytcaagcattcaaggttaggtctggcacagtctctgtggggtctcctggtgcacacaagattttgtttgagcatctctggagggcatgaggtttgattctt

SEQ ID NO: 30283 - DNA, 201 bp, Bos taurus
aattactatagaccatatctcatctgagaggctgcctccaccaagtaattgactttatttagctgtggttctttgctgtggaaagtaattatatgtaatargcattccctcatcttcaagtcacccaagatatgaagccaatagcaagaagtgattgcatataatgggagtagttgtttctaacagttgatgtacagtttc

SEQ ID NO: 30284 - DNA, 201 bp, Bos taurus
ctttgaaatagtcacaaatggggagaaagattgacacttaaatttactaaaagtattaatctattaaagccattgacagtttatgcccaccagataacttkaggaaattttttaggctttttttttagctaataaatagatgtctgtaaaattttacaaataatataggatagaacatgaagatatattatcttataattt

SEQ ID NO: 30285 - DNA, 201 bp, Bos taurus
tgcataaatatgttaatatcctttggagaataaggcttatgcatatggattgagatccattattcaaaagacaggtataataatgaagtgatgtagaaagrcttagtattagaaaggtcttgaatagagtttctgtgtcctgtctcttatatgttacaaggccctttattcactgtaacaaaatttatgattctttgttgc

SEQ ID NO: 30286 - DNA, 201 bp, Bos taurus
cttctcatcatgatcaaataagtcatatttataccatatgacaaatataaggatattgatattaccaataaaatcttggacctcagcttagctacagaaaycttatagttttacactgggctctcaattagtttactcagcactttcccctcctgaatagtaaaaagcctccccttgactcagtgtatgcatgctcagtca

SEQ ID NO: 30287 - DNA, 201 bp, Bos taurus
actgggtttacttagtgatgcattttccaaaatgttatccatggagcaatccttctttagaatgttatgtatttcatggggaaaaaattagttccatattmaaagtgattttaatgctacatttttaataactttatttgtttatgtttggctgtgctgggtcttcagtgcttcaggggcttttttgctggtcgtggtgag

SEQ ID NO: 30288 - DNA, 201 bp, Bos taurus
ttggtttctgacgggaggaaagtcacatttttttgatatgatggggctggtcatgtggagaaggataagatgggtgtgggcccatgcctgttcttttcttrtgtggagggaagatgatttctgttcttgctggatgggatctgcactcaggcctccccactggtttcattgcacatggacatggggtggcagcatgagcag

SEQ ID NO: 30289 - DNA, 201 bp, Bos taurus
cttaagaaaaacacagctctccacgttgaaaccgtgcactcgcttttcctcccaaatggcttccagttttaaccatatggccatggttttctaaattacaytttgaatctgcctttgcctcggtggaaggtgctagacaagcccagagccatccctctgctttgatgaccagaacgagatgcctacccaggcctgggaccc

SEQ ID NO: 30290 - DNA, 201 bp, Bos taurus
tgtgtctatatccttcctgtctcagtttacatcactaccccacccccagaaccagatattacaatggagaggacctgctgctccctcccagccaggccccsgctatccaactgggtgcataaacccaaaggcaacaattattgcggaggagttatgtgcagaaatcaatcgccttgcccttgatggggaggatcaggctca

SEQ ID NO: 30291 - DNA, 201 bp, Bos taurus
ggctcaaacacatctttattaatcaaagtaggaaccattacaatcaacacattttttgccaatgaaaaataaatttattcctgtagtgtaaaaatccatgytttgggatttgataaacatttggagagcattttctgcttcctgctggttgtggaagtgttttccctgcaaaaagttaatgagatgcttgaagaagtggta

SEQ ID NO: 30292 - DNA, 201 bp, Bos taurus
agtcgagaagggtgactaaaatgggggagaaagaaacaggaaatgttgacatctaaattgtggaagcagtaccaccagcttggccatttcatctctggccygtgtcatcacttcagttttttatttcaagagaagtatgtgcacttgtaagatacatttgaaaaagcaaggatctcaagaggttcatgtccccagcccggc

SEQ ID NO: 30293 - DNA, 201 bp, Bos taurus
tgtgagagtacagtaagtaaaaaatacaaagctcatcaattctcagcttcttttgtaagaaaggaaaacagccttgcctgacttttaacagctttctaatyattacttcttctttctttttttctccccaggcatagaggtgaaattggtgccactcctactttagaagggagaaaaatgaaactgttggtggctgagaag

SEQ ID NO: 30294 - DNA, 201 bp, Bos taurus
accacgcggggcgccctctcctcatccccatcaatcactccagccactccctgtggcccgagggtgtcaggaagaagagggtgggtgggggccacactctmtttttcttccggtttccccagaccgagagcccctgcagacttaacttgtgccgcgcttagtcgctcagtcctgtccgactctttgcgaccccatccatgg

SEQ ID NO: 30295 - DNA, 201 bp, Bos taurus
aagtccctgcagagggcccattgtcaggcttgggggttgcagaaatttgcatatcatcaattattatctaaattatacagtattcaaagtaaccatttttkgtgacaacttctggcctatgttgaacagctatgtattaatgtgttagaagtatgtttgtgtgtgtgtgtgtgtgtgtattgggatgaatattaaaaaaaa

SEQ ID NO: 30296 - DNA, 201 bp, Bos taurus
aacacaacttgatgcagctctagggaatgagtctagtgtgctcatgaggagtagagaactgctgaaggccctcggacagccccccggccccccctcccccmgcgacatgcagggtcctcaaggagagcttatgtagcaaggacagtcactgaccttaaggggccctttggagaggaacaaggcccaaccaagtagccatct

SEQ ID NO: 30297 - DNA, 201 bp, Bos taurus
tctgaccagcgccagctctggaggataaatggagctcctgaggggttgtagaatccatgaatgtttagtgggcatagaatctggatcatattgagaaaaaycttactagtactgagatctgaaaggaaagccagtggacctaatcaaagagttcaagtatatattaaaaaataaattttattatttttaggctgagagcta

SEQ ID NO: 30298 - DNA, 201 bp, Bos taurus
aaatgcctctacatgtggtttctgtttgaaaagagaaaactgacatttgaacaggacttttaatttgttcacatctcttatcattgcttttaaaacagtargaaagagtaattcttattttagaaaaagtaacagaagcagtccagcaaagttatatattcctttttctgataagcatcatatatgatcctagatatgcta

SEQ ID NO: 30299 - DNA, 201 bp, Bos taurus
tttgaaaggcagaagagaggccatggctgtcactttctgagggtctttttggagtcccgtgtagtgaaggatgggcaaagcttatcctcactctgctctgyatccagacaactggccatgctgaccagcagccccgagccccttgccagataccaggctacagacccacagcagaaacaaaggccagagctccctgaaaac

SEQ ID NO: 30300 - DNA, 201 bp, Bos taurus
gtgtacttcctcatgtggtatcacatgaaatacatagaaccacctgtgaagtatccacgtcaaaaatgttagctctgtatttaatcaagtctttataactraattctagttacagaaagatagatgatagaaaacaaattggaaaaaaaatcagcaagttatgaactgttatggaacaactgacccaggtcactgcttgag

SEQ ID NO: 30301 - DNA, 201 bp, Bos taurus
tagcaaccgtatttatgcctgcagaaattcttcacttttgccacataatgtcactcagtcagggaagtgatagttcatcacattcactggagctgcccccmctcaagggcagctgccacaatgcagcttataattctgcctatcatacttttgtagccccaagacctctagggcatctgacactgaataggagtttagtac

SEQ ID NO: 30302 - DNA, 201 bp, Bos taurus
atgtgttggaaatattacacgtgggagctggtgaacacagcaagaaagcagcatctgtctcacacactcaagctgtgtgttctttcacctccaatctttgratgttattgtcaactcccagctcccaagactcctcctctaagtagtatcacacctgctgcaaggcttagggactctctgtaaccagcttgtagcagtact

SEQ ID NO: 30303 - DNA, 201 bp, Bos taurus
tcttttgggacaagagaggaattagacatgcatagaaaggctccttacggatcaaaaataaggggacaatgccaggccataataagcgttgttcctcccaraagccttcagttcaagatccatcttggttgaggggtgagcatgcacccaggcaaggtcctagggtagatcaggcatggaaaaagacaccaaatatctggc

SEQ ID NO: 30304 - DNA, 201 bp, Bos taurus
ctattgtcttcttaaatgaaaaaaaaaatgtagataaaaataaattttaaaacatactcaccattcagttttgagataataagagtataatagaagtgagyaagagatagaagtgagtaagaaagagtgttcctaaaggatttgtatagcttaatgaaaatttaaaaatttagcagaataagacattcattgactacttgt

SEQ ID NO: 30305 - DNA, 201 bp, Bos taurus
atagtggtgtgtatatatcaatctcaatctcctagtcattctctccccccagtcttctccttctatacatcaggaattgtgaatgatctgagatttttacyccgcttgctaactgacaagctggtctggtacaagttcaaagattttgatggaaatatggggatcctatgtagagccaagggaatccattactcgaagaac

SEQ ID NO: 30306 - DNA, 201 bp, Bos taurus
agaaagcaaccacttcaagaaagagggttcaagagtacataaatctcaaatatttggcatgcaagggcttcggggatgggggaaagaggggagaagagaayttcagagtttctgacttagacaccaaggtggattgtaatattattcacagcatgggaaatgctataaaaggagcatatttggactgtgggagaaggcagg

SEQ ID NO: 30307 - DNA, 201 bp, Bos taurus
aagcctagagaatcaaggtaccagacatgtgaaggaacatgccatcttggaattggatcctagccatcccaccaccccagccatctcatttgtgtcagagmtgaaccactgtgacaagcacatctcaaaaactatactcaaaactgtaagcaaaataaaatggttgttttagacaacttagttttgtgatactttgaaaag

SEQ ID NO: 30308 - DNA, 201 bp, Bos taurus
gaatacagaagcctggcaggttacagtccatagggtcacaagagcccaacatgactgagggagtaaatatgggggaaactggattaagcacggaaattgartccaggttctttctgtactatctttacaatttcctgtcaatctataatattttaaactaaaaacaaactaaaaacaaaaagctttcctttttccattgta

SEQ ID NO: 30309 - DNA, 201 bp, Bos taurus
acactctggcagatgatgaaggacagggaaacctggcatgctgcagtccatgggtttgcagagctggacacagcgactgatcaacaacaacagattagtaycaacgtattttttttccactgtcagtcaagaaaacttaaaagcaaccacatctcagttgcaacaagaatacctgcatccatatcttggtttctaattcca

SEQ ID NO: 30310 - DNA, 201 bp, Bos taurus
aaaaacagaggattgtgctttgtcttacaatgtcctcctattgaagagaagaatatacctgctggttctactagctgtcattctgccagcacagcagagaygcacagtatatacaacataaatttctgtctgtatgtctatatttatactccacatcattccatgaaagattccagtatggtttacaggaaaatatgcttt

SEQ ID NO: 30311 - DNA, 201 bp, Bos taurus
tcactaaactctaatctctatttttcaatagattttgccttacaaaaacagctgaggttttagcaagagaatctaaatctattacaaaggtatgaaattayctcactgaaggaagggggtaaatgtcaccgaccaaagtaatttaggaaatgagtgaagtctgctaagagaaaagtaaaaggaactatatataagcactga

SEQ ID NO: 30312 - DNA, 201 bp, Bos taurus
gataatagtttggcaatttctttaaaagttaaatacagacttaaatgattcaggtatttaggagtttacccaaatgaacagaaagcatctgtccacacaargacctatacatgaatgcctgtaacagctttctttattttattgagtacagttgatttacaatgttctgttagtttctgctgtacagcaaagtgattcagt

SEQ ID NO: 30313 - DNA, 201 bp, Bos taurus
gcttcctcaagaacaagaccatggatcagaagttggtggaccctgagtaactggacatctgaaggctatcagtgaaccacacattttgtagctggaaagtragtcctttattgaagaagaatctgagtgtggcatctctgtttgacatctaacttacacactgagaagaaaaaggcattcaatccaatagaaaattaggca

SEQ ID NO: 30314 - DNA, 201 bp, Bos taurus
tacatcaacatgaatcagccatgggtatacatatatcccctctctcttgaaacttcttcccacatcccaccccatcccatccctctaggttgtcatagagyactggatttgcgttccctacctcttaacagcacattcccattgggtatctatttaacatatggtaatgtatatgttaaaagatgcttactccttggaagg

SEQ ID NO: 30315 - DNA, 201 bp, Bos taurus
ctttgcctctcgagttctgtgtgaagagttaggcctggtgtagggggctggatttttttctagactacttaactgcccggcatgattgtgcatttgggcakaggcccattggacaggacactctagatataagtatacattacatacaatacgtacatcgaatgcatacactacccttggaatccatttcttaaactgtca

SEQ ID NO: 30316 - DNA, 201 bp, Bos taurus
gtattcactcctaagaacaacaaagcagcattattgtccattgcccatataccatccatggtatcaatttatggaacataggaaataagggtggggcagayattattttagacaaagaagagaatttagcctcgccacatggtgccttacaaaatattttttttaattatgatcagcactgtcatatcaagtgcttattta

SEQ ID NO: 30317 - DNA, 201 bp, Bos taurus
tctatcttttgccaggcctttcttctcctttcttttatggcctgcacttttaatgacaacatttcgtgatttcttgatttccgagggttctgctgtgctarccctccgctctggccaaccttccttccctagtgcccgcgcgggaaagactaggcccgactgcccgagcgcagggtgccggtgccgggcgtgggattctag

SEQ ID NO: 30318 - DNA, 201 bp, Bos taurus
ctcataaagatattaaaaggtaatctcctttctgatatggaattctagactcctgtattagagggcacaataaagatcagatacctctagaggctaaaacytggaggccataggctcttgactaaggccagtaaaaaattaacacccaagtaaggatcagaccccaagactgccgatgaacatgccctgtggcgtttcctc

SEQ ID NO: 30319 - DNA, 201 bp, Bos taurus
catggatgcctgctgcagtctaaatccggccatcgatattgggcaggtaggtgctgccccacctggatggatgcctctttttgagagtcattgtggggtcrgtaaaggccttctgaaaagcacataatatcagagcttggcattttccctcttcagattgaaggtgcgtttattcagggaatgggcctttataccactgaa

SEQ ID NO: 30320 - DNA, 201 bp, Bos taurus
agagataattaggagtaaatgaggtcatcagggagtggcctaattcaatttagctggtgtctttctaaaaagagactaggaaacacacccagaggaatgakgaggttaagaaaggagatggccatctacaagcctcaagagtaaacaactctgcccacaccttgacctcccaacttctagtctctagaactttctagaaaa

SEQ ID NO: 30321 - DNA, 201 bp, Bos taurus
cataaacctcccttgttatggtgggggccataacaagagaggtttacagggacttggagggatccatccatagtcaagtttgggcaaaggtcctggggagrtggccttaacccccaaacagagcatattgtacgtttgttgttcatcttggagcctggggttggaagactatagtcacagatgtatcagtgtcccccacca

SEQ ID NO: 30322 - DNA, 201 bp, Bos taurus
taggtgaccctctgttctaacacattgggtcctctggctggtgtctcaggaggaatggacactgccagctgggataagggttggggggccaggacttctcycctctgtgcagtcacacaacaatgtggggtgacaggaggaatgtgagaattacaatgtgaagtctctccatcgaaataatctctaaatatgtcttcagta

SEQ ID NO: 30323 - DNA, 201 bp, Bos taurus
cacagggtagtcacctcctgactatcttctctttctgtggtaagactggaattttgtctcactcatgttagaagatataggccagagaattaactgaatcrttttataccctagtctaaagttattgaggggtgagtttgtgaggagttattaaaaaaactaagatcatggcatctggccccatctcttcagcaaatagat

SEQ ID NO: 30324 - DNA, 201 bp, Bos taurus
ttcatattttgcattgtttttctagtaaggattcaatttaattcaaataagtcaaaaagttttgagcacctactatctgccaggcattgtgttatatgctkggcctgcatagatgaatttggcacattcttggatctctaagaggttgggtttgtagtcactcaaccacagtctttcaccagctcagcttatgagagggtg

SEQ ID NO: 30325 - DNA, 201 bp, Bos taurus
ttgtttccttctggccacttattctagccattccacatataaaagcaagtccaagacattttctcttgagcctgttaactaccctctctctcttcccattwtaaatggccttgccacagaaggcaatccagtttggggtaggagttcttagttaaaatagaaacttctctcattggattacatcctgagttcttgtgttta

SEQ ID NO: 30326 - DNA, 201 bp, Bos taurus
agtatggatagaggagaaagaagatattaagtatcaattgtggccctcggaaaaaccacagaggctaatttccaagttttttctcaggaagagagtaaggygggtacatagaaaaaaggcccagtaaagcccaattatcgttgtaattctcatcccaaactccccactaggttggtttaggagttatgggggctgcatcat

SEQ ID NO: 30327 - DNA, 201 bp, Bos taurus
agtttttatagctgttctacttaagatctctctataaactccagtgtcttcttgagcctttctcttcacattaacttcattgttgtgtgatgtgaacatartattacagaatctaagtgtggagatcttttgatgattatagggaaagggttgttgtgtgaggaatcaaccagagagaatggaaacaaattgatagttgct

SEQ ID NO: 30328 - DNA, 201 bp, Bos taurus
aggtcactggaataatggccaaatcatttatacctcttaaatatccatacggttgaataaaatggtcctaagtaaatggtcctaagaaacaaggaggcaayttgtgttaaattttaggccaagatgttgaaagttaaaaaaaaaatccttcccatcatggaaaactccaaaatacccctttctacctttcaaaggaacaaa

SEQ ID NO: 30329 - DNA, 201 bp, Bos taurus
gagtaaagatatccttaatctagaataagaatttgtatacatcttatacttccaaagcagcaatccacaaaatcacctctgtgatccttatatgtagttaygagatacataaggaatttaactatataattagatgccatgtagttaaactttaaacctgattttattatataaaattttatagaaatggtcaagcaaata

SEQ ID NO: 30330 - DNA, 201 bp, Bos taurus
agactgtatcttattcatatatgtgttttctccagcaccttgcatatggcatcttgtacatacagaagttcagcaatgtttgtcaaactaaaagatgagakatactactaagaaatatctggcaacactttgaaaactagattagagtaacagaaacaactaggggagcgctgtttgtattaatccatgtatgaagtgatg

SEQ ID NO: 30331 - DNA, 201 bp, Bos taurus
catttccaaccagctcccaggtgaagctgatgatgctgatgggaacttcacatttgcagaaccactgatccagaaaacagaagattgttttacttagcaamtttctttgctatgctacaggaaacaggaattggagacttgagatttaggttctgactgttagattttagttctggtacctaaaaacagtttgtattattt

SEQ ID NO: 30332 - DNA, 201 bp, Bos taurus
gataacctctattctactttctacatctttgattttgcatattttaggtaccacaggtcatacaacatttatccatttgtgactgactccatttcgcatartattttcaaagttcatccaattgcagcacgcaccattacttcactcctttctatgactgaataacattccattgtatggatatgccacattttgtttatc

SEQ ID NO: 30333 - DNA, 201 bp, Bos taurus
ataatgtagtgaagactaaaaagttaaataaaaaaacctcattggtgatacggaaatgagaaaagaagaaaaattctactgttagccaaatcaggcctaartcacctgctagatctgaaatgcacacacacaccagcacatacagtattgtcacaggtgatgatgcccttggcttctgcagtctgccaaccgcactgaggt

SEQ ID NO: 30334 - DNA, 201 bp, Bos taurus
actgctgaccccatcagactttgggactggtcaagccaccacgatcacatgagccagttcaataaactaattctctccctatattgtttctgtttctctgkagaaccctggctaatacacatctaagaaaattgttaacatttgttgactctggaattataggcctatggatagtcattatattaccttctctacttttga

SEQ ID NO: 30335 - DNA, 201 bp, Bos taurus
ctacagtgagtggagctggagatggtggaggagatgaaggaggaggtggtgatggaggaggtggaggaggtgatggaggaggaggtggaggaggtggaggkggcccctatgagaagaatgataagaaccaagacaaggtatgaatgaaccagcttttgcatactcatgaaatgttattctgatttctttccatatttttgc

SEQ ID NO: 30336 - DNA, 201 bp, Bos taurus
atgaagacagttaccagggttgccgtgctcctgccagggaagccctgagttacccacctgcccccaagaaggcatgatggccactgtgtgctgctggccgygtctgcagctgcttctcccaagtggttttgccaaaagatttttatataatacctattcatctcagtgagtgttcattgggcacctgctgttggcataata

SEQ ID NO: 30337 - DNA, 201 bp, Bos taurus
gttacataatgtcataatgcaattcagcaagagtcaactgtgtggagccagtgtaaggtcattctagggcaccattatttcatggcctgaatctagagaartgtaagcaaaacttttctagcagggaatatttagactaaatgccctctgttcatgcaatatctcataacaaactttcaacaaacttccttgttctctggc

SEQ ID NO: 30338 - DNA, 201 bp, Bos taurus
atgaattgataaagttggtgccttcgaagtggaacaggcctacagaggctctaacagcctcctgcaatgtcggcagtgttccacaactgcactgggacagyagtcacacgcggccactaagaactcacaatgcagttaatgccactaagaaacaatttttaattttagctgacttaaatagcgacatgaggctagtggcta

SEQ ID NO: 30339 - DNA, 201 bp, Bos taurus
gagtatatgagtcacttttacctgcaagcttgtcagcactgggtattatgacttttcatttggactatcttttgtactcaaaatgatatatctctagatakaatttaatttgcatttgattggtagaaagggtaaactttttcatttaaaaagctatttgcatttcttttttgatgaattgatagttcaaatcttttcccc

SEQ ID NO: 30340 - DNA, 201 bp, Bos taurus
ttattttttttgcagatgcagtcctaggagctcagggctcagtggcctatcaagataatgtagtctttgtgggaagaaaaagccttctcctctaaggacaygaagccctttaccagtgagttggcccacagcgcaagaactaacaactactcagctcttacatttgggcacaaatgtacagtcatgtagtgctccacacct

SEQ ID NO: 30341 - DNA, 201 bp, Bos taurus
cgttttgcaccccacgttcgcactcttgggatttcaagcaactgctcgtgcaaggtcccaaagccctgtacggcctctggccactcaccccgccgcctccrgacaaaaactgaagcaacgctttcactgcccacttcctgccagctggaccaatcagagccttcgccaatccggaggcccgcccctgtctcattttcagtg

SEQ ID NO: 30342 - DNA, 201 bp, Bos taurus
cgaacttaaaaaataaatgagtagccctttagagtttctgtaagaaaatgcagcaagacatttatattctctgcattttactgaacaaaatacatatgcargtttatttatggcctattttgcttttcagtacattttgatacctaggattctgattgaatgaactaaggaatggacagagacctacaagtttaatctcac

SEQ ID NO: 30343 - DNA, 201 bp, Bos taurus
aaggaacattagggtcaaccattaatgtcaaaggcaagcgaagacagttccaagtattccagctaatatgcactaatagtgggctgtagctggattcaggmtggtgcaggtcatgttagcagctgcaaacaaaacacacatacacacatattcacacagagacaagtacccagagcataatataagctagctttcttgaaa

SEQ ID NO: 30344 - DNA, 201 bp, Bos taurus
gactgagtgacttccactattggtaaaaataaaagtgatgaaactttggcaagcctcataaggaaaaaaaaaaaaaaaaagagctcaactaataaaatcakaaatgaacaacaaaaaattgcaaagaacatcatggaaatatagaggatgatattggattactatcaataaagttaacaaactggacaacctagaataaag

SEQ ID NO: 30345 - DNA, 201 bp, Bos taurus
tgtcttcaagtttccaagtcttatgaacaacatagagtcctgccatgtcagggagtgaacatatctgagagatgagcatgaatttatttgggatattagayaggaaaggaggcctggcctaaagagagcagcaaatggataagagttggcaagaaaaggtaattatagcctacaaaaaccaccaaaaaaccctttttttta

SEQ ID NO: 30346 - DNA, 201 bp, Bos taurus
tagacactggccatagaggaaaggaagaagagttctgaagccattccaagtcctgttccagaggagaacttggaaggaagaaggattttcatgagcaggaractggatggagtgggccacccaaatgatggaaggacaagatagatcagcagttgagaagcattgctggcatcaagagagttcctactggaggggaacctc

SEQ ID NO: 30347 - DNA, 201 bp, Bos taurus
ttcatattactggaatggccaccatggtatggtgttccagctgctaaagaaacaatccgtgataaggcaataacttaccctgagcttcagggtcagtatgygccatctattctcatgagtttaacatccataaaactctccagccctgacctctccctagaaatttaagttcttatgttcacaggactgctggtaaggtat

SEQ ID NO: 30348 - DNA, 201 bp, Bos taurus
aaaatcatatccattgagtcggtattttgtattttgtactctggaggttagcaaaaactttaactccttccagagatatcacagagtaggccatatcttcyatttcaaaaatttgggtggaattttcagagcagatacaactgattaggataaaggactcttctgtatgtcaattaatattatgtattattaatagctgtg

SEQ ID NO: 30349 - DNA, 201 bp, Bos taurus
ttaatgtgatttttaaataattatttttgtagcctataattcactctgtactcattcggttttttataattatatcaaaaacacagtgtctggccctgggrgcaaaagaatactgtagttttagagatagcaattgagaggctagaaagaaagaaggaaggacatggcttgaacagtgatgtctctttgggggccacttga

SEQ ID NO: 30350 - DNA, 201 bp, Bos taurus
atattttcaaatagtcttccaggatcactgggcctgttgtctttgagggcttttgagactgtgaggcacaaagtccttaggctcttccagttgatggcctytcttttgtctaatctgtttggttttattgattttacaggtttctgtgtcagtcttaaggcatgcctaccataggacagacattccttgcatgaatggcac

SEQ ID NO: 30351 - DNA, 201 bp, Bos taurus
atttccttgaaataagttagtgacagatcacctggcaaatgctaatggtatttgctactaggagagtcattatctatggaccactgtcaccggatatctasggtgcttgtggaaaacaaacatacaatctatggatttatgtggcatggccctagggtaaaatgtaaattttttaaattatccaaatagttccttttgggc

SEQ ID NO: 30352 - DNA, 201 bp, Bos taurus
attttgaccaagttgacaactttaatatttgtcctgaaagtattttctattgccattttaattttttgcatttccttctatgtaaatttctgttcttaatmttatactaaaatatattacactgttataatcatcatattatatatcatatcacatatatataatgaaagcattgcatttatcacatgcgtgaaaaaaagg

SEQ ID NO: 30353 - DNA, 201 bp, Bos taurus
aattattattgatacgatcaatgactatcaggcatcctttctcccccacacccacttcctgcttttggaaatataactagctctttccatagcgaacacarttttgtggcttagagacattctcttactctcttgtcaatagcaaaggaatcaatcaatctggccccagagattttctaacatagagaaatgcttaaagat

SEQ ID NO: 30354 - DNA, 201 bp, Bos taurus
tttgttttgttttttcgtgtattagtgtccatttctcttaaatagcagcatcttgacttcctttgggtaagttttgtacagtctcagtttttgtagtgggyactgagtcctggcctggtacatcatatctttccacctaccagccacagtagttggtccaggggtaagcacatggttatagcttgacaaggagggacagtt

SEQ ID NO: 30355 - DNA, 201 bp, Bos taurus
tgcatgggtcaaaagccttttctgaatttagcattttcactcactggctgttccctcactgacatgaaaatatttatctagttcactttggaagattaccrtaaaggtcaagtctataaaacatcaaagtactagtatttgcattcattttgcacagtctatgacaatacaaagtacatgtttatcaaacaatccaaagcg

SEQ ID NO: 30356 - DNA, 201 bp, Bos taurus
ggatttgtgtttcacttaaatgttctttaattatggagatctgttcaattatagcatatactggtacagtatcaaatttaatccaacaaagaggctcctgygtcaccattactaatggctcagaacaatttttcccttatctgttctgagaggctgggttatccacctgcttcactgaccatcatgctaaactctagggct

SEQ ID NO: 30357 - DNA, 201 bp, Bos taurus
tctaaattatgaatggttgatttgacaaagacatcctgcagacttagacaaatgaatattaaaagtctttaagactactctgttattactcagctccagtmatgggaaaattcaggcccagcactgcaattgtcttccaatctagattttcatgtgcaacttttaaaaaaattacttttaaaatcctgttgtctgaaaaaa

SEQ ID NO: 30358 - DNA, 201 bp, Bos taurus
ggaattccatcacctccactagctttgttcatagtgatgcttaccaccagggaaaaaatcactggccattagtgatttagttccccctacaacccttttcytcttcctggaggtataggggtaggaaggaaagttccaaccctttaattttgagttttctggcgaccagaatgtatctaagggttcccagctactgatacc

SEQ ID NO: 30359 - DNA, 201 bp, Bos taurus
agtaggctttgggctatgcaaacactcagaaaatgtatacaacattgagtataattccaaatactgtcttccaccccaccctcagtagaaaattgacagcyttatcagctttttacagagtttcaagacccaaatgagatctagaacttgtgctgtggtgattcaaataagctaaagtgtctcagaaaagaatgagaaagg

SEQ ID NO: 30360 - DNA, 201 bp, Bos taurus
ttgttactgatggcctgggaacttggccggctgtatctcccactcctttccgactgagaaactcccctcaagccaagagagtttgctttcagaaacatgarctgcctcccctgtggtcatgctcacaccctcacccattgtcatttcccctcatgtatatgtccctgttctctgctggtaattttaatcgaattgcatata

SEQ ID NO: 30361 - DNA, 201 bp, Bos taurus
tatacaatattaccctcagccatttctttaaatatagaataatctagaaagaaatacacccatcccttgatgtctggaggggtttggttccacatcctccyccataccctgccacccacctaccaactccccactgacaccaaagttcagatgttcaggtcccttatataaagttgttcagtacagagggccatagatact

SEQ ID NO: 30362 - DNA, 201 bp, Bos taurus
caatgcatatttccaacttgaaatttttttcacatttatgaacacttttagactacactggtaaaaagtagctataagctccacttccccagtggccacakgaagagttctgaggacccattccccagagaaacaatcataactgatggaaaatattttctaaaaatatttacatctcaagaaattgccctaaggccatat

SEQ ID NO: 30363 - DNA, 201 bp, Bos taurus
ccaggaaaatttgaatgaactttttggccaacccaatatttgagggtaaaggcaatcaaaacccatcagatttaagaaaagtcaaccacctaaatttataytggaaaggtggcctgtacccataattattttttatctaggaaacgtatctgcataacagggaaacttgtttttcaaacatctcctctgccttcccatgaa

SEQ ID NO: 30364 - DNA, 201 bp, Bos taurus
cttggccagctccctccagccgtctcatttccttttgccccacggccctatggtcactgcctccctccagagcttgctatgttggcttctctacgtgctcyatccatcccggccccgagctgccccttcacccattcctccagccctgcagtctgcttttgcctgctgggcttaatcttcacacccgcctctttgagcccc

SEQ ID NO: 30365 - DNA, 201 bp, Bos taurus
acagtgcctgcagtaatcagaaacccaggagaagcagtcaccacctggctgtatgaagtctgcagaaaagcttttccacgggtcgccctcgagtgtgcttkgctgaaaacaagcaaatccacacagctcagccgggtctttgctggtctttgctctcccggtcctactgtgtgaccatgggtttcacttcttaatagaccc

SEQ ID NO: 30366 - DNA, 201 bp, Bos taurus
cagctgtatggcagcaagtaggcatctcactcgccgctgcctgtgagctgctggatgaaggaaccatttttatgaaggacggcctgggtgctctaaaaccyacctctggtttcaaccagatgtggctgcacctgtggtctggttctccccttctgcccccaccactgtggccactgtgatggcatccaccaggttgtgctt

SEQ ID NO: 30367 - DNA, 201 bp, Bos taurus
caaatggtctacctaaattttactatcatttcctcccaaacaggaacttaagtatttttctaagagtgattaacatagagcagaggccgctgtttcatcgmatcagttcagttgctcagttatgtccgactctttgggaccccacaaaccacaatatgccaggcctccctgtccatcacccctgaagtccatccaagccca

SEQ ID NO: 30368 - DNA, 201 bp, Bos taurus
atccctccccaacaacacatgctttttgatcctaaaggggagcaagacaggcatttgaaaaagttgattattgtccaagaagaaatcaagtcagtagagaygtatttaaatctcatgcaagtggctcttttagccttttgatcaaggctcttgggaagatctttcgtgaaataatgcggctcttttctggtggatgaaatc

SEQ ID NO: 30369 - DNA, 201 bp, Bos taurus
cccctgccattacccctgggcgtatcaagtgctaccacacatgctcatttagatagctgggggccaggttaaaagctgcaggtggcagagactgagggtgyggatacagagggagatggagagagggtccttgagcctcacctgctcagatttctgtctcatctcaggcgcggagatgacccggggatgggcagtgttctc

SEQ ID NO: 30370 - DNA, 201 bp, Bos taurus
ccattggcagtcccaggccaccttgcactcaaaggactgcacctctcaggtatcatggctaacaatttgtgagactttcatcctgcctcctcagtctcctytttgcttcacagtggccctgggaagcagacatctcaaatgattatgcaaatcagcctgcaagaccggctttggatcatttagtgaaaaagaggaaatatc

SEQ ID NO: 30371 - DNA, 201 bp, Bos taurus
ctcacccagagtccttctgctgcaggttccctctgctgctctcccctgggtgcaatgaacaacccatagcaggacgcttgagtcctcaaagcggtgctctyggccaggtgtgtgagagcagagagcaggcagagtgacctcggtgcttgatgttaatggcttcacgcaggcagggagtgcttcctttggaagcaacagctg

SEQ ID NO: 30372 - DNA, 201 bp, Bos taurus
tatgctcactctttcatttgatactcaccacaaccctgtcagttgaacccatactttgagagtatgtcttaaatggcagagaagcaatcattcaggtggtyaactgattgtttagtctacccaatgcctgtgtcaaaacaaagggtcaggaagatttttcaacaccctccatatttcttaactgaatcaaccagtggtttg

SEQ ID NO: 30373 - DNA, 201 bp, Bos taurus
tcacccttccctgggaccagtttcttctcaggagtctcactctcttctcctgtgatgcatcctcagcagaggaatttccagtccattacacatgaggtggmgcaacaatcatgccccctccccattcctttgtgcacccatggctgcatggacaccaggggaaggcagatcatccaaatccacttgcaaggagcacttgga

SEQ ID NO: 30374 - DNA, 201 bp, Bos taurus
gatccccttagatcacacaaggcattagtgcagaggaagaaagatctctacatctgtgtcatcattcccaaggcaagaccatctcctctccaggaatcaayatggcaccttacacggagacactgaggaacccaatttgtaacagttgtctgtgtaattgccttcccagctggctcagtgataaagaatctgcttgcaatg

SEQ ID NO: 30375 - DNA, 201 bp, Bos taurus
atcataaaggaaattagaaaatattttgaactgaatgaaaaagaaaatacagtatgaaaatttgtaagataggactaaagtggggcttagagggaaacatrgctttaaatgcaaaagaataaaggtataaaagcaatagcctaatttactttaataagttctaaaaagaagagtgaagtaagcccatagttagtagaaaga

SEQ ID NO: 30376 - DNA, 201 bp, Bos taurus
gggatacagacattattcagcccataacaagcaccatgtcccattttgaggagaatgacctccctccctgataacactctcttacatattcatgagacaargttctagcaagcgctaacaaacttctgtctttcatgcagcctggcttgttttctcttacatgcagcccgccacaccaagctctccctggtgtggctccgt

SEQ ID NO: 30377 - DNA, 201 bp, Bos taurus
tgctatctggggctggaggggtccaggattccagctcagggctcccaggctggaaagaattttccagtctatgagaatcactcgaacaaacatgtctacgkcaaggataggtccctgcaaatgtaggtgtagggagcccctaacctgtggtagcaacctgtgatagcaacaaactgtaatagctctgggacctcagctttc

SEQ ID NO: 30378 - DNA, 201 bp, Bos taurus
aagagaagcagcgcagcttgagtgactaaaccaacccgtattacgcataaaatcatagaaggaaagggtgggaaatccacaaggcctctcctctgggctcrggcacacggcgtcccttccggggtgactcacagtgggctcaccttcacccctgcttcatgtggtaagggcctctttataaggagacatacccgcggagcc

SEQ ID NO: 30379 - DNA, 201 bp, Bos taurus
ctcaaactgaggaaggtcagagaagtcttaccaaaggacagcgaaaccaaacgtggaggagctacggctctgaagaaaaatgtgtatctcacagaaacatsggtgttttcagttcgtagagtaggtatagcagcgattgtgaactaaatggctgggggagggtgccgagaagcaggcgaaggacccagttgtgaaagaccc

SEQ ID NO: 30380 - DNA, 201 bp, Bos taurus
aacttttcattatcctctgggggctgatgagggcccctgagctttgagaagaagggggaccctactttgcctacacggtagcactaagacaaccagccccrtgcacgggccgctcacttggtgatggtgccccaggactgatccaggtaccagatggggagggagcctggcttccacagtgacgggggagagggttcagag

SEQ ID NO: 30381 - DNA, 201 bp, Bos taurus
aaggaaggactccccaagcacaccggaagcctgcagtttttccacacggccactggagggcacttcaaccttgaaatagagtctttggagagcccagattyaacaaacgtttttaaattatcacaataatgatagctctcctggttgaatatccaatgagggcctcaacgccttaaacatatagcatctcgtttaatattc

SEQ ID NO: 30382 - DNA, 201 bp, Bos taurus
gcctggccgtgggcggcaggcttagggcccttcggggctcccttgttcactatcagggccagggatgctctatttgagaatgagagttagccaggattggygcaggagtaggggcctgctgtagtgggtgtggacatattcagaaatacctgtttcttagttcaaataaagtccagtttgtacccagctggtgtgctgtgt

SEQ ID NO: 30383 - DNA, 201 bp, Bos taurus
tttccacctaagaatgttataattcttctaaagtcttgttttcgctctatgatttatttcactgcatgaaagttcctctacgcactgctgtctcttttacsatgctttctcccaatgtttggtaattattagttggaggctcctcctttacctcagattcctgtatgactatacactctttagcaaaaggggtatgagata

SEQ ID NO: 30384 - DNA, 201 bp, Bos taurus
aacctgggccacagcaatgaaagcccagaatcttaatcactatgctaaccaggaattcccattatcttaaaaaaatggttttttattaaaaaaaaaattgktctgaaacagctggggccattggcattttgttctccaccccagaaggagcgatgagtatgggtgtccaaagaccctctaaggggagatttcactccatct

SEQ ID NO: 30385 - DNA, 201 bp, Bos taurus
aacaaggtctgagcctgtaataagtacagccctaaattacacttgagcctgctaacggcgggcctggcccagtgatgggagggcttgattgctggggcccyggggtattcactcccaggaatgcttctagctggcacagtggctcaatctcgagaaactcatttgtgtcttgtatttgaaaagggagacacacacaaatgg

SEQ ID NO: 30386 - DNA, 201 bp, Bos taurus
aacactgttttgattttgtcacttgtccattcagaaatcggcaggagctcccatttgcctcccacctttaatctaaactcctcagcatgtgttttaagacytttgcaaagtcacttttaactgccctcatctttggccaccctggcttctcatctttgctctggcctgacacagaccacttaagtcgctggcttcagggca

SEQ ID NO: 30387 - DNA, 201 bp, Bos taurus
catgcaaggtgtgcctagaaaaattcttacattaatttgaaacagggctaaaccaggggcagacccttgagtagcaaggcccagtctgtgtgattactgcrggtatgtgggctataaatcctcaccagatactggctcccagggtggcaggaagcagagagatgctgggatttgttgggattcagggccctggcatctttt

SEQ ID NO: 30388 - DNA, 201 bp, Bos taurus
acccacaggcttccatgctgggtccccaggagctgtgaatatctccgaatgacctctggccttggtgctggtgccagatgagttgacacagtaggcaagargagtgttcctaagagtggtcctaccctgggacggctaacaatgacttcactatccacagaagtgactgtgagccatcgaaatgcctctcactgaactcaa

SEQ ID NO: 30389 - DNA, 201 bp, Bos taurus
tggcttggggctgagggtaagcagaggggcctgctagagcttgttgaaatgatacaacccgagtcctttctctgcaggccactgaccttctatttggataygtaaagtggtagtctggagagaaaccagcttgcatgatagcggcattttcctccaggccctaggaaataagtgaagtgataattacagggaagataaagt

SEQ ID NO: 30390 - DNA, 201 bp, Bos taurus
ctcctcagtttagtttatcaaattaactgcaagtgccttgtaaaactctcgtgggaaggagattggactgaattaaagcatgacaggggacagagaatatygataatctaaccagaaggcgaggaagacatagtagattgaccaaagtgacaacgtttctgaattttaagtaattatcagcttcaatctctgtagcgtaca

SEQ ID NO: 30391 - DNA, 201 bp, Bos taurus
gcaactataatcacttactcaaatcctcatataatgagaacagaaggatataaatccattttcgggacttttagatgtaggatctgagttgacaggatagrgtgtggacatataaggactaagtccaaagagaatctggactccggtcttctggcttaccggtcttctgagtccatgaccaggatgccatttacctttggt

SEQ ID NO: 30392 - DNA, 201 bp, Bos taurus
gcttacattttcataattattttctttttcagtggaaattttgtttccccttgtgttcaagagttctttctctcttccctttcaaaatatgacaggtcatrggagtcttccatgatcttgcttatgattataataaatgaatgatgtggattaaagcaacgatttttccctaagtatatttacagtttagatgaaacaagg

SEQ ID NO: 30393 - DNA, 201 bp, Bos taurus
cacaaaagtgcattcacacaaaaatggttgctgtttaccagagcaaggattacctcttggtcaataaattaagcatcatagttatatttccttttgtgtartatctgctaagcatttatgcaaaacacatgcctttacctaaaacattatgtttactgttacgaagaagacaattaaaatataagtatgaagccctctact

SEQ ID NO: 30394 - DNA, 201 bp, Bos taurus
atacttcccagttctaatatctatacttatggaatcctggccctataccctcatcctgaaagagagtgttaggtagctagttggatattagcagatcccamcccaagctggatggggtcatctttctctgttccctcacaatcccccaacaccagtgataagaacatacccagaaattctcctttttagtcaaggaccacc

SEQ ID NO: 30395 - DNA, 201 bp, Bos taurus
ttccaccgggatgctggcacaaccacatgcaccaaggaagggatacaagcatttcagagcatacagcaaaaaaagtgagatggacgtgaatattctctcarccttgccatttcatctaaccaagactttgtcaatggattttagacagcaatgttctatatagctttaggcacagaaatatgggaacagaagaaatcagtt

SEQ ID NO: 30396 - DNA, 201 bp, Bos taurus
tggtagattcattgcagtttatcaacacacatatatacagagacaatccaacagtttaagtaacatgctccttacgcgtttatgctggatccaaactcttygttcttcatgtttctggggtttatatttgttcagtctcaggctttattgattcccttccctaattctgttgatggtttaatgatggattaatctgcttta

SEQ ID NO: 30397 - DNA, 201 bp, Bos taurus
agggaggcctgatgtgctgcaattcatggggtcgcaaagagttggacacgactgagtgactgaactgaactgaactgatgttctcccatactacagaaatrggcctcttgagcttggtagatctcagtaatttagaaataaattatatttcgtgcacttgaattcataactgcacaatttctcttgaggtctcatgtattc

SEQ ID NO: 30398 - DNA, 201 bp, Bos taurus
aggttctgtaagaactgctcttcttccttacacgtagtaacagtgtgatataccttcaaatgtacacttatttatgttcataccctaccatacagcatatmccaactggcagaaaaacccagagaccacaagcaagcacatataagtcttgctctggagagagagaaaataaatttttatgctactctgtcagtctcattc

SEQ ID NO: 30399 - DNA, 201 bp, Bos taurus
gatgagacaggaataaattaggcagagacagaaaaacaacccctaatcaacaggataatacaaatgaaaattccaaagcaaatgatggaattaacactgaraaggacaataatgaggcactgggttagtatacccattttcctctgcaagaaatatattgatacccacccttgtggctcagctggtaaagaatctgcctgc

SEQ ID NO: 30400 - DNA, 201 bp, Bos taurus
taagagaactgcattgctcaaagtgtggtccctggaccagttgcatatctatcatctaggagctagttaaacatagggttttgttatgacttcactgagcygtaagtacttttgtcttcatggacctcttcctccataaagaaaactgaaaactatatttctatgactctgctaatataaagacagacatattaatattat

SEQ ID NO: 30401 - DNA, 201 bp, Bos taurus
tactgctggctgccattaaggaagttttagcaaaaacatccacatttttgttgcttggtcaggaaaaccttgtttcatttatacagcatttctctctcctrgggacacattctgtattcatttccctgagatggtccacttaaggaaaagtaaactgaaggaaagtcatctagaaaacaaatcggccggcagtcagcctat

SEQ ID NO: 30402 - DNA, 201 bp, Bos taurus
actcagaggtccttattctgtactgtaggtaatgatgattctcttactgaaagaaaaactggaagacttccaccagaccacctaagcgtagcagctgcagygaatgctagaagacagtcagcttcaacggtttgaacccttttacaatattggactgaatctcaaatttctatgcaatctgttctcatccataacccaaag

SEQ ID NO: 30403 - DNA, 201 bp, Bos taurus
ccagcatcacctggccttccaatcacattttgcgtagtaaggaagtagggcacgaggcacatatcagtggataactgctatcagacacagttgtttataaytgcctatgcaatatcacacaacatcagaaccttccctggcagcaagtttttatttcgtttgatgaactgcagcccggttcaatttcacctgctccctaaa

SEQ ID NO: 30404 - DNA, 201 bp, Bos taurus
caccagtccaaggtgacccagccaaaagaggtagagtggtccaactcttccattatttcaaaggtagagatacaggtagcatctccatcagaaagaccagraggaggcctgacctgtgaatctcaccatgcattattgatctgtcagctgaaataaataaagctctgcataaaacaggaggacaaagtgaaatttcactgg

SEQ ID NO: 30405 - DNA, 201 bp, Bos taurus
ctctgtgataaggaagcaatgacatccagacgaccagaagactagtaggaccttctccttatgcaaataagaaaagccctaaaaggccaaaggaatttccscaaatctcaaaacgactcagtgacaggcaggaattactccctgcttggtagcctgccacctcctgaatacgtaactttggccaaaaaactcaacttctcc

SEQ ID NO: 30406 - DNA, 201 bp, Bos taurus
tgacatagctaaatttctcaggagtatgtgtcttctctaatgcagaaaacaaaccccttagcaaaccagcgccctcagatattgcagtaatcatgtacacragtggatccacaggaattccaaagggggtcatgatctctcatagtaacattattgctggtataactgggatggcggaaaggattccagaactcgggtatg

SEQ ID NO: 30407 - DNA, 201 bp, Bos taurus
agcttatttggagaaaggatcattgcaaatttaattaaattaaggattttgagataagatcatcccaggttatctgtgtgggccctaaatccaaagacacrtgcttttataagagacactcagagaaaatgctcagaagaggaggcagtgtgaccacacagtcagtgatgtgaagtgatgtggccacaagccaagaacacc

SEQ ID NO: 30408 - DNA, 201 bp, Bos taurus
gaaaaagatgtcagaatccaagtttttctcctcttggcagtggttcactttaacttctgcctagtggtactgtttccttgatactttttgatttcccaaaycaaaatgatagtgatagagagaccataaaagtagttgaggcaagattggttatcttgaggtagtctttttctttaccttttgatagaaacatgggtagta

SEQ ID NO: 30409 - DNA, 201 bp, Bos taurus
tctttctgagctccagatcaggtgcccttggattttcaccaaatctaatgaatccatagggtcaacaccctgacttcagtagtttcttgagggaagaacaytggccatagccttcctggaagttaatgcagaactaaaatcattgccttgattttgagatttaagaaacttaattttctttctttttttttggtgagtcaa

SEQ ID NO: 30410 - DNA, 201 bp, Bos taurus
ttatggcacagagactctatttggggatattttgaggtgggcttagaggtaaggatatttggctgaagtcaacagtaagcaatgaccacagagtcaactckgattagagtacaatacacaatacgggatatccatatagatagagggagacaatgtgaaacacacgagtcaaagaaactcaaggattttgagaacatcatg

SEQ ID NO: 30411 - DNA, 201 bp, Bos taurus
tcagacaccactgaagtgactggacacgcacgcatttatttagcaagtgcaagaaccagataactgagctacatactttttattcaaacctttgaaagatraataggaagtagtgaggccaggatttgcagttagatctgtctcactctacagctcaacattgcacagagacatatctcctccaaattgccactggagata

SEQ ID NO: 30412 - DNA, 201 bp, Bos taurus
attatgctggaacatcatgcatcaataaaacaccaagatatggcacatgattgaaaacaataacattttggaataaggtatttttatgtttgttaagattyagtgatttcccaaagaacatattgccggctttcctttggttcaagatagtagtagtctgtctggtcagatttttttcccattccccacttagatgaaaat

SEQ ID NO: 30413 - DNA, 201 bp, Bos taurus
ccacatttaagcctatttcattggttttttatagattcaattgtactttagctacattcaaagagtgacattaaatctatttcacctcagattttcacttratctaatgaatttgggcctcctttggaaatgatcacatcattcacgaggtactgtaagaatctatgatatgaagctggatgatccaaaatgatgctgacc

SEQ ID NO: 30414 - DNA, 201 bp, Bos taurus
ccaaccaaatctcctttgcttttcacaatattcaagacacatttcagtgtttcagcctgttttctccttcctagtaattgtctttctctatcatatcacaygaactccttcatgagtttcaagtctgtccaaatatcatgtttactcctgaggcccacgctgaatattccacgtaaaatcacagccctccttaacacacat

SEQ ID NO: 30415 - DNA, 201 bp, Bos taurus
tgtagaattgttgaaacttggtaacccttcccatccagagtaaatctgacactttactattacattaggctgttatacagttagagtagaagctgtgactrtctcctctgctcatctcttaggtcactggcttgttgcctttctaagtatgggaccttgctcaaagtgagtatggagaggaacaaaactgggagaaaccag

SEQ ID NO: 30416 - DNA, 201 bp, Bos taurus
aagatattattaaaagctattatattttaccttccctaatagagatcatattttaaggggaatgaaaaccaagatggcaatgtggtcaacatctatttccmatttgttactgtctaccctggaaatgttttgagggaaggaggaacagtctatgtaccttacccaaattctaatagttaaatcaactgaaaattctatttt

SEQ ID NO: 30417 - DNA, 201 bp, Bos taurus
agcgtaagctcccacctcagggccttacttggcatttgctgagatgactttccttaagacatatatgatttactcactccctgagttttttcaggtttttrgtcaaaggaatcaactctaaaaggcctcccatatcctccccccacctaacagtacactcactgactgtgctgaattgtgtatagtttctgtctgttatca

SEQ ID NO: 30418 - DNA, 201 bp, Bos taurus
gtgtaggatgagcatgccttcagaatcattagatccatgtatatgttgggcaagggattgaacctcaaagccaatgatttcaaaatccaaggcagggagtrggaagggtgatgaagagtcagaatcacctagtcctcaagtgagtagggacagggaaagagtggagagttaacatggcccagggaaatgtgctaggattgt

SEQ ID NO: 30419 - DNA, 201 bp, Bos taurus
ctcaaagaaaaatttggaatggaaatagaaggatgaggctaggtgggcaggaaaatggaggaaatctgaagaaaaaaataacaaggctcatgacccattarctataggcctgtagaatactcatgcaaaaaaactcattgtttctgaatcagctcacaatactacggtgacttgggtccacttttcttgctaaggttggag

SEQ ID NO: 30420 - DNA, 201 bp, Bos taurus
ttcatctatgtattctttatgactgcttttgattctgcaatggtagagttgagaagctgccacagagactgtctggcccacaaagtctaatatttatgtcyggtcctttgtaggagaagtctgtggacccaccccacactgtggtgagcagcccagttctggagttggatgcacatggactggaattccaacctctggcct

SEQ ID NO: 30421 - DNA, 201 bp, Bos taurus
tctaccttttcaatccaaaggtcagtattaatttttagagtgtgagtcccaggaaataaaacaagtatctaagaaacaactgggcctaggggcccaaaggygtgaaaacataacttcaaaagtaacacaaaagtattagcctctttccgtctctgttttgtttgtcttattgaaggacatcatagagcaaggaaagaagat

SEQ ID NO: 30422 - DNA, 201 bp, Bos taurus
aatggaaggcctggggaaggtgaggtggtaacttactgtggttttgatttgcatttcccagatgattaatgacattaagcacttttctcatgtacctggtrgctatttgtatgtcttcagtggcctgttcaggttctgtgcccatcttttagctaggttattcgtgggttttttttttttttttttagttatatgaattac

SEQ ID NO: 30423 - DNA, 201 bp, Bos taurus
gcctaaaaggattgagttataaaacatttaagggacttctttatcatgtaaattccacctttgtaatgcaaatcccattgtacggcccctgccaggagaakgagagcaatattaatttacttactgtttaattattctcctctctccaacagcccctgggatgatgtaaggattccagggccaagaagagaatcttccact

SEQ ID NO: 30424 - DNA, 201 bp, Bos taurus
aaacaaaaacattaactttccctcttgtccttaaattcttgtgctcttaagtatttaagaacataacaaatgagtatcagtcattctgtgggttccatttracaataacttctcttattgtccatgccacacaggtggtgctcatctagaattactgcatgcacatcacagacagagattccttatcatgattgacgatgc

SEQ ID NO: 30425 - DNA, 201 bp, Bos taurus
ggcccagagattctaccctataaagagcgaaatgatgtcatctgtgttcaaattattgcataaggtttttctttccttaagtattttttaaacatcctctytttattccttttttacttcttggccatcccacgtggcatatgggatattagttccctgatcagggatcgaaccagtgccccctgttttggaagtgtagag

SEQ ID NO: 30426 - DNA, 201 bp, Bos taurus
aagctaagaggcaggccaataaataatatttaagaaaaaggaggcggtccagcctgtctacagtcagaggctgagtgggagaggaaagggagaaacaattyaaaacagaagtcggggccaattcatggaaggctttgaaagccaagaaaatgaaagtttccattgtatcatgaaagttatggaaaaccactgaaggatttt

SEQ ID NO: 30427 - DNA, 201 bp, Bos taurus
gccaagtcagatgttcaggcctgtgttctgtttatagaatgtgtgatctgaaagcccaaacagcactggtcattttgacagccttaatgagtcatttagaytggcaattactaaaataattacatgaagacaagctcactgtggtcatcacaaacggtttcacctttttcaatagactctcctctatctcctgttgttaaa

SEQ ID NO: 30428 - DNA, 201 bp, Bos taurus
agtgctccatcatcaaattgagaagtgaagaacactaggttaagaggtaggttcttctcagtgattctttttgtctcttttccttgtctatatcatgagayaggaccagctgtctccaaaacagatggctctggggaggaaatggaagtaggcttgatggagactgtgcaagggatgactgactaccccttcagtggtaga

SEQ ID NO: 30429 - DNA, 201 bp, Bos taurus
agaacctggtactattatttagcaacttgatggtgctggccatatttgataacactcatgaagttggagtgtgtgataggaaatcagaatattggttaackatagcccttagatgactggccgctagcttttcccattggcctcggtcaagtcagtgtcagtgatggctgttaagatgcttactcacatgatctctcgtgt

SEQ ID NO: 30430 - DNA, 201 bp, Bos taurus
taatcttgaatttattttttgttactatgtttgaagggagtattggtacctcacgccttaccttggtaatacatttcctggagcctcaaagttcatctgcygtagtgaaagttgctcagttgtgtctgactctttgtgaccccatgaactatacagtccatggaattctccaggccagaagactgagtgggtaacctttac

SEQ ID NO: 30431 - DNA, 201 bp, Bos taurus
tcacaggttagactgggctaaacaggtgaaagagaagaacgatgtgtgtctgtatgaacaccaccagcagcagccaaaacgacagataactggacagcgarataagagaataggacactgaaccaatctaccaaaaataaactgacagggaggaatccaaccaaacacatcgccaaaagtgtcagctaaaaatacagccag

SEQ ID NO: 30432 - DNA, 201 bp, Bos taurus
tgaacctgggaagctgtcccactctgttgccacctgaggttggccttttcagctttgctggcaaaatacaagctcacggccacggctggttagtgacggaytcagctctatagaagaaatatagagtaagaaagaattttggtaggaaaaaaagaaacaagggagacgaagaaagcaggccacgcggaggaattggcatct

SEQ ID NO: 30433 - DNA, 201 bp, Bos taurus
tgtgtgtgtgtgtgtgtgtgtgtgagtgtgtgtgtgtgtgtgtgtgtttgtatgcgtatctgtctgtccatgtgagatttatagtgtctttttctgtaaaygcaacaattatagattttttttcactttatcagtacttcctagaaaaacaatggcttgagtatttatttagttgtagaccttgagctcagtcttctttag

SEQ ID NO: 30434 - DNA, 201 bp, Bos taurus
tttcaagctgctgtatttgtgataatctgttattgtagcgatagaaaaagaatccattttactaaattattgggcagaaaaagtggggtaaaattcattgkcaaagcacatagcttacagcctggagaagagcagatcctcagcaaccttgctgtccttttcagtgtgtgcgtgctcagtctcttcagtcatgtctgactc

SEQ ID NO: 30435 - DNA, 201 bp, Bos taurus
gggagagtttcattatcattttgtatatattgaggtaatctgaaaggtgggattatcttttgaagcaagttctttgttactcctaaggcctgttctagccrtgtgggaaaactctctacccatcagtgaatgtgcttacctttaagacttgagcatccgagtaaaatcaattggccagttcttcattttgtttccttggtg

SEQ ID NO: 30436 - DNA, 201 bp, Bos taurus
catgaatgagatttttcagacgattgtccaggtgttaaaccctatagtacaaaagacaatttgaaagggaaagaacatgtgagaaggaatagtgaatcacrctgataaaataagcctctttattaaaatcaagtttgatcaggaaagtaatagactactcttctagaaatcatggaggtatctacgttaccatgttaccat

SEQ ID NO: 30437 - DNA, 201 bp, Bos taurus
cctactgtttttcaagtatgttggaagcccagcacactcagtaccccaacatgcagcagtaatattatatttgcaaagctaacttgcgggagggtgatatrtctactttgaaatgttccctctggtgattttaacatgtcatccttctttggtcaaggtttttactccttaggggtgactttatgattagcatttattgaa

SEQ ID NO: 30438 - DNA, 201 bp, Bos taurus
gattaagaggtagggcaggcctgttctatgcgatttctgaggtccaggaaagtaccatcacattcttacctgaagacactgatgcctggaaatcccataayggaaggcagggccattcatgcttcactcagagcttgggtaaaaatgcaaagacattggaaaagtacctgtaaaataaaattcacaatgagccctaaatga

SEQ ID NO: 30439 - DNA, 201 bp, Bos taurus
ttctgtgtatccttctctaccctagtttctgggaactacaaatctgttttctgtccccacagtattgatttttccaaaaagtcatataagtggaatgacgrggtatgtagctttttcagtctggattccctccctcaccataatgtgtttaaggtttgtcataagctgaattgtaaccctacaaattcacatgttggagcc

SEQ ID NO: 30440 - DNA, 201 bp, Bos taurus
tcaatccccacatttatagatggtcaagtggccatggtatttataataaaaaagtgtccactgcaagctacatgtgactttgattccacatagaaaccccsactgtaagaagaatataattatatatcatcattgttgccaatatcttctcttagcttccacttgcccgcttaaaaatctacaatggtattttaaccaatt

SEQ ID NO: 30441 - DNA, 201 bp, Bos taurus
gtctgcatttcagtcaaggtctcttctggatatactgttgcctaatcgctatcttgtaaagttaacctccaataatcctcatatgaaataatatgaagtargggagagacagaggatgaaagtaagatacacatgtaacaagtgaaaaagaaaatacccatattttctatgaccggtaccaatcatgatgtcataatggat

SEQ ID NO: 30442 - DNA, 201 bp, Bos taurus
accaggctcctccgtccatgggattttccaggcaagagtactggagtggggtgccatcgccttctccgttacataggttagtatgaactaaatactataamataacctataaaggaagagtttttaaaaagtgagtataactcatatacatctttcacttttaagagcagagatccatactgacatattcaatgagaaaag

SEQ ID NO: 30443 - DNA, 201 bp, Bos taurus
ctgtccccagactacaggtccagacaggaatgaattttgtggccgtcttgtgaaatccatgtctggtgtgaaccacgtcttgtgtgaaccacacactgcayccagaccaggcagcggtgcctggccagttccagattcctattgcagaatcgatgatgatcacgctcacatgatctggattattaacttgattctttgaga

SEQ ID NO: 30444 - DNA, 201 bp, Bos taurus
cggcacggatcactttggcactctggttgcggttgggactgaggttcacccgcgtgaaggcgctcgggccccccaggagggccgagcgggccgccagctcycctgttcccggaggaggcgcagtggaggaaacagaggctgtcgaagatgaggagggagcggccgcggtggccctgggcaagctggcatcctccacaacga

SEQ ID NO: 30445 - DNA, 201 bp, Bos taurus
ttgatggtggtaccttctttagtcgcttgattatatgactcttcactggcccaatgcaggcataatgcagttggtgatttttaacgtatgcaaatgttcayggctggtctgcttggctttgcaggcgtgctggaggccaggacagagatgcacagctcattctgtgtgaccacttaactttttttttttaagtaatttggt

SEQ ID NO: 30446 - DNA, 201 bp, Bos taurus
gtcccaggtgatgtaggcccaggccagggaaggctctaaaccggggaaggatgaaatccacttaaggactggagacctcctcactccaaacccagtagcaycaagctctcttgggtgcaggcctgggagacagaatgtcatgtcaggctccactcaggcctccccagctggattctgcagttaatgtatttagaggattcc

SEQ ID NO: 30447 - DNA, 201 bp, Bos taurus
tattttaacaagcttctccaggtgatttctgattgagaagaactgttctaggcaaacatccaagaaactattctacagacagttaccagttaaggccaacyaatattactccatccatagctctctttaaagtcgaaaatcacaagtgacctcaaggtcatctaattttactagtaagttaaagccttatattggtgctaa

SEQ ID NO: 30448 - DNA, 201 bp, Bos taurus
gctccaggggttcccccacttctgaagtggactctgctctgtgactctctgcacattctgtaaggacaaatctatacttcatcaaccacctgaatgaataytggggacattttcaccgggggaagtttggtgtctgtaactttccaggtaatttccctcatctgaataacttgagtgaaaacaggtccaagcacacagcct

SEQ ID NO: 30449 - DNA, 201 bp, Bos taurus
ctggcaaatgcatgccttcagtcaccaggacaaccagacaatagagtgtccatctaaatcagttgctatcattgagccttagatgaagctgaacaatgggygagtcgtgttcatgctggaggtagccctctggtgctggtgctgtctgtccctaaaccattgataatccgagaacagttcttacttcgtaggacaagtgaa

SEQ ID NO: 30450 - DNA, 201 bp, Bos taurus
agtttatagaatcctataacctaatagttgaaaatggaccatggaagttacctagcacccaccactgaaagattttactttttaggtgtggaatcaagcayagagatgagagttaaagccttgacttcacactgccagttcatgacagaggtggtacttgaacattataattctgacttatttgttgactaggtttcacaa

SEQ ID NO: 30451 - DNA, 201 bp, Bos taurus
gtttcattttcagcagtagagcactggtgggcagaagaatacagaagaaatggcatgtcatgtacaggcacaaagagaacaagggcgggccctgaagttaygtcaaagaatttcaggaaagcaaaagcatttgtgaccatgattcggttttcaagttttttcaatatgtggattgtctgcagtggctggggtgtcttgttg

SEQ ID NO: 30452 - DNA, 201 bp, Bos taurus
caggctacagtccattggactgcaaagagtcggccatgactgagcgactaacactttttcactggtccataatggttgcagaagtagaggcttggggttcrctggccgattctggacctctgtctgtggtctgctttgtcttaacagtcacgttcctgtctcggaaactctgaaacagacctgcccctaagtgatttacag

SEQ ID NO: 30453 - DNA, 201 bp, Bos taurus
tgtgagtgtctccttgaagcctggccctggaagtccaggaggagtgaagagataccttggtaatcctctaatccataggtgacatcttttcttaaaaaatrttttttattttatttttggccatggtgagtcttcattgttgtacatgggtattttctagttgtggtgagcaggggctactctctagttgcagtgtgaggg

SEQ ID NO: 30454 - DNA, 201 bp, Bos taurus
tagtctccatctcttggcaggcaggaagattttgttttaaaacagagatttccttcagcatccctaaggcatctttatggagaatggggccatctaaccaytaaatctgttaaagtgcctccgtcagcatcctcactagtgttttcttattctctctccctcctgaaacttcttacgtgaagattgtgatgcgtcagccaa

SEQ ID NO: 30455 - DNA, 201 bp, Bos taurus
ttcccaagccagggatcgaatccaggtctccctcattgcaggtggtttctttaccatctgagccaccagggaatcccataatgtacatccaggcctgccamtgactttggatgatttttgtgcaaagtgtacatggtgcagatttgctactcatgaaagggacagcgggtttggccatgcaacgcttgagtattggtctgt

SEQ ID NO: 30456 - DNA, 201 bp, Bos taurus
agttcttaattgtggcaggtgggatgtttagttacagcctgagaactctcagctgtggcatatgggatctagttgtcagaccagggactgaacccaggccycctgccttaggtgtgaagagtcttagccactggatcaccatggaactccccagtgctttgcattttgaaagatttttataccagtgtaagcattactatt

SEQ ID NO: 30457 - DNA, 201 bp, Bos taurus
gcatcactgattcaatggtcgtgattttgagcaaactccaggagataatgaaggacggggaagtctggcattctgctgtccgtccagagtcttaaagagtyagacatgtcttagtgactgaacagcaacatttctacaacatgctgaatgacttcctcaaaagaaagcaatttaagagaaaattgcatatgagccatccat

SEQ ID NO: 30458 - DNA, 201 bp, Bos taurus
atctggagctttctgtcctttccaaagatctttcagttcctcgtgttgtagaatgggggcttctttttttaaactgcctgtcaaccagggtacctttcaamaaccacaggccacccccaggtcctagttaactgattccctccacagatggctcaaaacatggctgtttgctttcttctaggccagcaaaagcagacttga

SEQ ID NO: 30459 - DNA, 201 bp, Bos taurus
ttgttgatttatacccatggttaattttacatttttatgttaacacagaaaagtttcttatcctttcaattgttgttgagagagctttctattgcttctcmaacagtaagatatatatatatacatatatatatatatatatgttaaataaatatatatgtgtgtgtgtgtgtgtatcagcacatatatatagttgtgttt

SEQ ID NO: 30460 - DNA, 201 bp, Bos taurus
tgtttccattaaaaaattatatccagactcaccagagtctataacctctcttgagctcccaccagtgatcagcggtgagaagcatgaacaaggctgtccasagaagccccaaagccctgcttggcctgtccccctcaagactgaagtacacatcccctgccatgtgtcactgccacatgaagagaactgtaattaaacaat

SEQ ID NO: 30461 - DNA, 201 bp, Bos taurus
cagggccctcccacagcctgtggctttaccttcctcctggaatctggagcctgtccatccagatggcaggaggagaatgaaggaacgctgcacatttcatmggccaggcttggacaaggaatacatctcttctgcccgcatttcaggggtcaggactcagttatatgggacgcctacctgccaaggagactgggaaaggtc

SEQ ID NO: 30462 - DNA, 201 bp, Bos taurus
ggggacactctaccctggccgccattttgctgggactccatgagaggtacatgaagctgcagctcaactcagcttgacttctgacacacaggaaggtcctraagatggtactaatggccctattcttatgtgggttggacaaccacattgcacagaagttctgagactgtctttctttccccactggcattactatcagaa

SEQ ID NO: 30463 - DNA, 201 bp, Bos taurus
agacctttctctctccttttatcacaacacagacaccctgggggtccttgctgggagctctgggagggcagagagggcctgagcatcttcccagtgtcctrcagagtgggcatggtatacctgaacttgcagaagtcacagggcagggccgacaccctgtctcgagagctccaaggtgccacttcatctaggacaaccccc

SEQ ID NO: 30464 - DNA, 201 bp, Bos taurus
gtgctacagggtaaccacccttcatcttcatcccagtggaaatcaccatatccctgactggaataactgtagtatatagtgcttgacaatctccttccctkgacgggaaggaagaacagttaggattaaagaactgtttttctgctcatcctgacccacagcaggttagagacactgagatcaaagcctggcacaccatgg

SEQ ID NO: 30465 - DNA, 201 bp, Bos taurus
aattcacaatctgccgttccagaaaatccttttcacctggacacattaccctttcctgccagttgcatcaagtaggcctggcagcccctctcatcaagttrgggctgaggacagtcttcagagtcaaaaaggctagtgtcctgaccacggtcctgccacaccctcgctctataatctacatggtaaaaaaaacatcacctt

SEQ ID NO: 30466 - DNA, 201 bp, Bos taurus
ctgtcatctgtgctgttatcatatattttatttaatacgttactacatttgtcttaaataattatcttttttgagaaacagcttttatatttacctacttmtttactgttttggacaatcttttttcctttgcgtttccatcttttatcaatttcctttagcctaaagaacttcctttaatatattcagtagttcaggtat

SEQ ID NO: 30467 - DNA, 201 bp, Bos taurus
ctcctggaagacaaggtctgtgtctcgctcacctctgaatccttgacctagcgcagtgctcagttctgagcttgtgaccactaagcgtgggctgaatgcakgaatgagcagaaactagtgaacatcttgatgcataaagttttcccatgctgaagatggtctcctttgaacgggttcccagaagctgcagtgattggatta

SEQ ID NO: 30468 - DNA, 201 bp, Bos taurus
cacgtgatggtgatgagtttcatcaccctttgaccttccccacctggacgccgtcctactcttgctttcgacacacatgctcgctttgcacgtgctgctckattttccctagtcaaccaccaactcttcctcgcatggggacccacccaagaagtcttccctcacccttcaatccccacacaagtctggttagggttctcc

SEQ ID NO: 30469 - DNA, 201 bp, Bos taurus
ttagtaagatgaagtgtatgctgaatgataggctggtactagttaggctggattagcagagaggaaaggcggggaaggagaaagtcagagctggaagagaycgggactctaactcactggaatttgaagaaaccttgaggacatcattggatttctaccaagtgtgaggtaggaaatgccagtcaatttttatttagatct

SEQ ID NO: 30470 - DNA, 201 bp, Bos taurus
gcacctaacaaggccattagctctgggtctttctctctggggtggcagcaggaatagaaaacaacagagataaggtctcctagcagcacagtctcagctcrgggctctggggatgggcctcccctcctgccggagaggccatcccaggaggctgactgctcacacctgggcagcattcctggcttcatcccctcctgtctg

SEQ ID NO: 30471 - DNA, 201 bp, Bos taurus
ggtgtggtctgggcagggtgaccagtgtgggaggacgaggttggagggaggcaggcagagccaacggggagaacaagaaggccgatgtggatttatattcracgctgcaggttgtgggagatggtttgatggaatcgcaagagggaaaaggacatggtcagatgtgcatcttgaaggcaaggcctaagtgcttgtcactcc

SEQ ID NO: 30472 - DNA, 201 bp, Bos taurus
ctccttgaggccaattccaaggagcttttctcagtcttcattttgattccttcaggaagcagattatattattgttcatgaatgttcactgctcctcctamcggggccctcccagtgagagaaatatatcccagtctccttggctgctgtatggccgggagacttgcttttgcaaataaaatgtgagtgcatgtgacctgt

SEQ ID NO: 30473 - DNA, 201 bp, Bos taurus
ctcagccaaggcagcagtggctgtagcattccagcctggtccccccacatcttcacctccaggccaggctcagtgggtctaagagctgttttggtactttkgtccttgagaccagtcccattttaagaacttggagattgatttcttttcccttctaaaaaatgagtcttgcattcttcttaaaatgatatttgagggtgg

SEQ ID NO: 30474 - DNA, 201 bp, Bos taurus
gtttaatacccctgctctgaagaaactgtccagcgctgcctacccagatccctcaaagcagagtaaggccagctggggaggggcccgggaaggggggtctrtgggggctgcctacatgagagagcatgagagacatgtagagagcctgtcagtgcctcagaaaagggtttgtcttcagttcaggcccaagaagccaggagg

SEQ ID NO: 30475 - DNA, 201 bp, Bos taurus
cccagttgctctgggaacggccgggcctgtccaggtggggccggcgggtcgctcgctttcccaagccagggactgcctctgaggattgcagtggaaccaaragaactaggggcccaggctccagataggcggggtccggaaccttgctgctgctagggacaatcaaccactaccccgtgagtgtcacgtgtctgcgtatct

SEQ ID NO: 30476 - DNA, 201 bp, Bos taurus
accccctacctcattcctcagcatctcccatcctctctgcactttgccacgctgagaggaatagcaggggccttggcaggccatgcctgccatcctgcacyctgccagggcacagtgttcccattgtcttgagcagcgagaggtgtccaggtcctggcaaggggtgggggatcatgccaggcttctcctgtctccaggggc

SEQ ID NO: 30477 - DNA, 201 bp, Bos taurus
ccttaaatgtgctctgacctagttccctgtgaaaattcaatagtggtagtttacatgtttttgaaacactttgaaattattttatataaagtttggttgtsgtgaatttattgaaaatattttctttgaaaaaagttccctaagtagatttttcaatatttttttaaaaaaggtatttctgtaacacaataaaagtaagag

SEQ ID NO: 30478 - DNA, 201 bp, Bos taurus
cctcagatagaaagatggtggcatagaggtcaagagtcaatccatgtatctgtcacttcatcccacaggcagtcatgctggaggccccatatgggcagaayacaaaacatggaaaacagcaggtgccaaagggtgtgagatgaatccagtgaaaatataatagcctgacaccacgttaaaatcctagagcatatggcctga

SEQ ID NO: 30479 - DNA, 201 bp, Bos taurus
tgtcaatcccactgtgcagaggaacaaacagatgtgaagttaactgacttgcccaaggctatataaccaggcagtggtagaaccagagtccaggtgtcttractcccacagttcagtgctctttctactacaacaaatgacaactggaggaaagttatttcaggcctaaaagggtaaaagtacaaactaacacataatgtg

SEQ ID NO: 30480 - DNA, 201 bp, Bos taurus
cagccacatacagccctccgttctgcaggtctgccaggtcggtgacagggtggccataaggggtgtagagagcacgcacggccactggggcccgcacagcygatgtcacctcacagaggaaggtctccagggtggggaagcggcgttgagtcaccaccagctggcggcctggggagaaggggtccccgttctggtacacca

SEQ ID NO: 30481 - DNA, 201 bp, Bos taurus
gccccctctgatgtccaggaggctcatgtcatgcccaatgctgctgcccatctcaaacacgcgccggcagtcgacgatggccttcatgaagttacggggtrtctggcatcttgagcccacatggaagctgaacacacatcaagtgacatgtagagaaacacccgtgaaaaagcaaaggtcagtaggaggacagacatggcc

SEQ ID NO: 30482 - DNA, 201 bp, Bos taurus
accctgggctccctcagcccaggctgggtggagtgggcgcaggggcctcaaatgtcctgacctctcaatggcgatgtggtttctgggccgggaatgggcaycctgaagtgaagaaaaataaaacaaacgtaaacaaccccaatgtcacccttctgtgaggcctccccagagtgtgacggggcatgcgatacagcctgagac

SEQ ID NO: 30483 - DNA, 201 bp, Bos taurus
atgtccccgttaatgatggaacagtccagaaagggttagaaacctgcccaggatctcccagctggggagcaccagggcctgggtttggctccagagtctgrgctcttagcatgcagctgtgctcaccttctcagggaccacgacctcctctcctgccccctccctcggagttgccctccccgagctggggcggcctgtccc

SEQ ID NO: 30484 - DNA, 201 bp, Bos taurus
ctcaactcccagactctggtaagaggttgaaaactgggtgctggcccccgaaatcagtggcagagccaaggcttaaatccaggcccatccccttggcattmcaatgttgcgcgtttatttatgtccaacgactttaactgatcatttcactttaatatagtctgatgtaacattcaatggcagcctctgggactatgaaat

SEQ ID NO: 30485 - DNA, 201 bp, Bos taurus
aaccatgccatccatgtctgtgactccagcgcccacctcagctgtcggtaagtgacagtgaatcagaaacccagacaggaacagattttggaggagggccrtggggtttggtgtcaggatgcctgaacctcagttcccccacctgtcaggtggaaacaataacccccaccctggggaatcatgaagtgaaggggcccagca

SEQ ID NO: 30486 - DNA, 201 bp, Bos taurus
cagctcagacttttccatgccaaccccttggctgggctgcttcttttaagctaacttgatgtctgtcctgatcacggggccccatcctggccctctgtccmagcccccctctcatgccacaattcaacacactgacaacctctttgacttccagttcatcccaccctccactctgccctgctgctgctaagtcgtgtcagt

SEQ ID NO: 30487 - DNA, 201 bp, Bos taurus
gctgcacttacagtgggaaccagccaggccgctgctgactggcacagggctgtgtcttttggactgtggtcctcatgtccacagttcctaatcaggccagygtctgttctttctcatctcgtgcagagatactgtcatgccagaatgtgtgccctttccccatgaaggtctgaccgaggcctccctgcccagaatcatcta

SEQ ID NO: 30488 - DNA, 201 bp, Bos taurus
gaatttgagaaacatcatttcattttccgagcctcacatgataggatatttgtctgactgagtgagtagtcattcacagtcaggctgagccagtaaattcrtctttcccattactctaacatttgtacccattgttttgcaattgttcatgggataatgattcactcataattctccatttaagtctcttcttgattgatc

SEQ ID NO: 30489 - DNA, 201 bp, Bos taurus
gccaggtcacacagaagcagggtggggtggacctgggagagccaccaaataaaagcaggaatccccccgtatgggggacatggcactgggttcacatgcakggcccataactgagcccagaggctgtggccagaccagaccacttcccttccctccctggcactgtgcccactgtcacatatgagaggcctggggggcaag

SEQ ID NO: 30490 - DNA, 201 bp, Bos taurus
atctgcacctgaagcctcgcagaggcctccaaaatgatgtcttcgctgccagagtccctctccctgtttcatcagcacccaggtacctttcccaaacgcayggccctgttgaaacaagaaaaggcactgaggtcctgtggtccacatgttgaaatgaaaactctgtccccagcattccagacccctcctactctgaatcct

SEQ ID NO: 30491 - DNA, 201 bp, Bos taurus
ctggggagggcgggcaggcagcagccagggccagacccacggagggagccaggatgcctggctgatgactctgaggatgtctgccaaggccggacagccaygtggagaatgcccaccatcctgggtgggtagacgctccaataactgcaagttccaatgccagtttcccagtttcatctcaggagagatgtgtcgagttgg

SEQ ID NO: 30492 - DNA, 201 bp, Bos taurus
gggagatggggcctccgatgacctggaagagatgagattggaagaaagcaggggtaggtgggggaacagttggagactgaaccattcccaaatctgggacrtgggtggattagggacacagctggcctgaagccccagtgatagggctcatggaaagcatttgttggttatgggggtagcaagagatgaagaaggctttga

SEQ ID NO: 30493 - DNA, 201 bp, Bos taurus
agcttctcataaccaccctgtgagggttgggatctcacaggggtctatttctactcccattttacagatgagaaaactgaggccaagaaaggtcatgcatscatctcccaagctccctctcttagtaaatgcgattcccagatcagtctggctctgacatccaggctctcaagtgctgttacctcatgcagaggcctaaga

SEQ ID NO: 30494 - DNA, 201 bp, Bos taurus
agaattccatggactgtatagtccatggggttgtaaagagttggacacaactgagtgactttcattttcattttcactttcctcaacaatagggacaagargctcaccctacagtaaggcccaaaggcaactagcctatgcacttagagctattaaagctcactgaccactcttaatcataagctcagctattattactag

SEQ ID NO: 30495 - DNA, 201 bp, Bos taurus
gcccagctggtgcaacaacacttagttccacgagataggacagtgacaaggcctcagtgttgtccgtgttccctggcaccaggatgcggaagatcttgtayaccacgatcttcatgatgcctttccggaacaagtgtcccctggcaacaaactcgtggtccatgcgaaatcccatttccatgaggaagtcagtgaggttct

SEQ ID NO: 30496 - DNA, 201 bp, Bos taurus
ctcattggcccagcttgggttatatgtccatctttgtaccagtcactgttgtgctctgattggttagatagaccagacctccttgtgtgctctcatctagmgaaataaagatggagttgggccccccagggctttatagaatgagaataggacaagtgaatctgtaaattactacaggagcatgcagtttccaaaaggtgt

SEQ ID NO: 30497 - DNA, 201 bp, Bos taurus
attcaaatgtagacaggaatgactccaaagcagaaactccactgcatcactgatgaaagacctgaatatgtaagaagcaggctggcacaaggaactgatgygtaaagcagaattccaatatattaattgggagtgagaaacgtaattgttaagtggcccatgattgataggccagaacctctttataccgtgaaaagccaa

SEQ ID NO: 30498 - DNA, 201 bp, Bos taurus
gtttcccaaggtcactgaaagtgatacagggtctcagttgtagttacacagtatgagggagggaattccagctgtgacagacgtcgctgccgtattcactkccatattcatctatactctggctcctcccctcctgagagacagaaggcccatgcctagaactgtttctctcggaaatgtagggttggaaggaaatgcctg

SEQ ID NO: 30499 - DNA, 201 bp, Bos taurus
cccctggtttcggcatttttcgccatggtgccatgatgccacatgttttgtcctttaatgtcttcagtaggtaaactgaaattacacaggggcctcagtgrgaacccgcatggctaaccccacttcaactcctgggctatttttcagaagagatgatctgggtctgtgtggggcccattcccgtataaaatctcagaatga

SEQ ID NO: 30500 - DNA, 201 bp, Bos taurus
aggagatctcacagacagttttcattacggagtgcaatgtttttactatatacaccaaagaaaaataactgcactcaacaatagggccttgaacttaaaaygttatctgagcaagcaaacctaaaattggttgaagacatggagactcacaactggatggccacagtgggcttaatccccatttcttggtaaataaatggc

SEQ ID NO: 30501 - DNA, 201 bp, Bos taurus
tgtggtataataaaaagtatatttggtctttttcctcaggtcctggcaaagagttcctaaaagccttagaatttcctgagtgataggagtgtcttttgttrttcataaagggctcctttggagcatacagagtttacctattgaggtgacctaagccctgatggccttagggtgggcagggtttgtcaccggaaagaccaa

SEQ ID NO: 30502 - DNA, 201 bp, Bos taurus
ggcgggggcagcgggaagacagcctgagccatacccccagcggtgggagaggaagggtgtgggcaagccgagcagcagtgctgtgctgtgagatggccgtyctctcacatgtcacaggattgtgacaggttgtcctgtcacacatggcgggggaagcttgacatatctcacttgcaaaccaccagcacccactgaggcctc

SEQ ID NO: 30503 - DNA, 201 bp, Bos taurus
tcccatgatcattgtaaaatagggagggaaggaaggcgttgcaagtcttggctgctctctgtggatcatttcttgggttgagggggtggtaaaactgtgcrcccccgttccctgcaaagcctcgctgtgaagcaaagaggccttctcggaagtggtggcattcggaaacacgggagggacctgggctcccttcggaatgcc

SEQ ID NO: 30504 - DNA, 201 bp, Bos taurus
acacacaggggctagttgaatctggccttggaaaagtccatctctggatgctgatccatgaacctgcagagacaaagcgggaaggtgggacaggccatccrtcccccaactttgcccctttctctcagcctccaacatgaggtctcatctgtttacaactctcagcaacctggagccatgccaggcaggagtggggccccc

SEQ ID NO: 30505 - DNA, 201 bp, Bos taurus
cgaggcactctgggaagctactacaaaggtatggccccactggggtcacacagggttcccagacacttgaactgagacttaagaacaaacagcacatggcrtggaagaccaggacgtgtcccggccgcgatcccaggaggaaaaacacagggtttgggagccgaggctccggggccatgggaccctctgcctcagtttccg

SEQ ID NO: 30506 - DNA, 201 bp, Bos taurus
tgtgtccccaggccaggagccagacactaggaggcgcacgtgttaaggaagcctccagccttgtcctcaggcagctcccccaaatacacaataacgaaacrgaagcgtggcgtgcaacagtgcaggccaagtgctggaggtgcccatagggtctcactctctgcccggggtaagatctgggaagatgcgacagtctagctg

SEQ ID NO: 30507 - DNA, 201 bp, Bos taurus
tcacagccctgtccacagaccagtgagtcggatccacatgcctgtctcttttcttcctctctctccttctaggcttaggcctcagcttcaccccttgaagrgctgtggcataggagaacgcctgaaagtagggagaggggtgggagctctgagggcatcgtgcccgttttactgatgaagaaacaaaggccctgaaattca

SEQ ID NO: 30508 - DNA, 201 bp, Bos taurus
aacttgtctgtcttccttctccttcctgcccgttcccaggaggcgggggataaaaatctacggaaatggtaagtgtgggctctggcccacgggccctcctygcctccttgtgtttgggcggatggagagaaagagcacggtgaactgccttgtcagtcggggtggctggcctgcgacagtgctgcccgcagccctcgggtt

SEQ ID NO: 30509 - DNA, 201 bp, Bos taurus
cagcagccgcttgctgaccgggcaactgtcgggagaggcagcgtcccccatggttaggagcccaggcaaacactgattccccctttctggcttgtccagtrtgggtgtacatgctgggtctcatgatgaaaattcacgtgcattatttcattgtattctcacatcagtcataggaggacaatacttttgcccccctcctct

SEQ ID NO: 30510 - DNA, 201 bp, Bos taurus
gtcctcctctagtcactgcctgccaatgcatctctcatcagcttcaggaaccctgtctgctaaaatggaaaaggcagggccttagtcaagtctctggagcrggctgcttggtttgcgagccagctggagaaggacccgagcacctgcagacacaggtagctgtgttctgacacgcaggcctgcagaggaatggctgcctct

SEQ ID NO: 30511 - DNA, 201 bp, Bos taurus
aaaaaaatggaattagtggccaagggatggagggacgggctagccctggttggggacatctcagggtctttagcaacgtgctgtgctcgggggtaggcctyacctggggagttgcccaggactccagaggaggggatggatttattttggtcagtgagagggcactggttgttaaccccacacatcccagtggccccctca

SEQ ID NO: 30512 - DNA, 201 bp, Bos taurus
gaattcaggcaggaggaaaggatcagctggatcccaggccttcaaaggtggaagcccaaagagtagcttcagggaggctgtggatttaccacacctccccmaaatccaaaccctgtccatggcctctgcatggctctacttaaaataccactagctgcctttggttgactatctgtgtgcgaaggacgtcatgtacttttc

SEQ ID NO: 30513 - DNA, 201 bp, Bos taurus
ctgtagtgaaaaggacctgagggcatctgagtcatgcatggtatagtaagtacaaacctcggcaccaagcaaaggagctgtcaagggcctggaagattcaytcttcatttctctttcctgctcggcttaaagtccatggaagagaaagagctttcaatcagtggaaccaatgaggcatcagggccttggagggtagatttg

SEQ ID NO: 30514 - DNA, 201 bp, Bos taurus
cacggacatgggtggcatctttggagaggacgacgtggccggtgaactggccgggggagaaccagaaggggaagtcggggggctcgctgagctggaactcrgcatggatgctggagggaaaagacctggctgggagtgggtcccctggcggagcagagcttgcctgcccacccccttctgccccaaagcctggaacccacg

SEQ ID NO: 30515 - DNA, 201 bp, Bos taurus
aggcactttttttttcattttcaccaagaactttattgaacaccttattcattaaccagatgaaacttttggccaacccaatagacgtgaggcggccagargcttcattccctgcctgtgtgacgctgcctctctgagcctgagtttcctaacctgtgagtacaacaaccaacctctcggggttgttggaacacataaggg

SEQ ID NO: 30516 - DNA, 201 bp, Bos taurus
actatgctccagtataaaataaaaattaaaaaatcaaatagattcaataaaactaaattaaggggaaaagataaacttaagcagcctagtttgaatttccrtgcacttaaccatgatgcttcacagccccattttacagtcaggttgagtctcttgtcatataatcagtaggcataggagccaatatttcaactttgtagt

SEQ ID NO: 30517 - DNA, 201 bp, Bos taurus
cagattttttggcaagtgggtcaggctgggggcgggtggctgtctctggaatgcatcgggggctacctccaagcagacgcgggagagacaggcatcttccrtgaggccgtcccaccaggctgggctgagggagcccagggacagcaggacgcaggggtcttgcagggctgtctggctgaaagggggcagccgagcccccca

SEQ ID NO: 30518 - DNA, 201 bp, Bos taurus
gctctgtgcacctggaggcggccatctgtgacctacctgcttggtctttgggctccctgacccccctgctgggttcagccagagggaggcgctgctggagrggctccttgctcacctggcctgccatggtttgggcagtgtctgcattccttctgtgaggcacctcccttcccagagctattggcttcccgaaccatctcc

SEQ ID NO: 30519 - DNA, 201 bp, Bos taurus
tgctcaggaaatgctagtggcctgtaccgtggtcccagtctgaaaacaggttccctgggaagggctggtttccctggattctcccatgcccagtgcccagkacctgggtgcgatgtgggccagctggtgctgttcagtggacatttgctgagtaccatctgcacgccaaacactgtgctgggcactgaggattcaagagcg

SEQ ID NO: 30520 - DNA, 201 bp, Bos taurus
aagtgggcagtgcccagggctgccaatactgggtttggccatgcagagaccctcatcttcctggaggggtgtcatggccaggttataacccagcatcttgkggttctgggttggaggattcaggcctctggctccctggcccagccttattccagtgagtgcccaagaaaggaaggatgaatttaatgtgctgctcgccct

SEQ ID NO: 30521 - DNA, 201 bp, Bos taurus
acggaggagcctgtaggctacagtccatggggtcacaaagagtcggacacgaccgagcgacttcactttcactttggtgattcagaggtaaagaatacctytgagtcttttactgtctcttgcattgacaggattctttacactagcgccacctgggaaacacaaaagtttccttcttcccacaccgggagtcgaacccgg

SEQ ID NO: 30522 - DNA, 201 bp, Bos taurus
gctccaaaatgaaatcaactcaacaaatatttgatttaaacattttttatttttagacatttaagcatttaatatctttcattgattcagtggccaaatarggcaccatctgctcagtgcggaaaggcacctgtcagaaacaaaatacaactgtgttgcaagacacctgtctcaggaggccagctgcagactccctgagag

SEQ ID NO: 30523 - DNA, 201 bp, Bos taurus
gtgctgggcctatgctgctgcacgtggactttctctagctgtggcatggggtgggagggcgctccctggcggtagtgcccagcttctcattgcagtggctyctcttctcccagcacgcaggccctgggacacacaggctcaatagtggcggggtcccagcttagttgcctcacggcgtgtgagatcttcctggaccagcga

SEQ ID NO: 30524 - DNA, 201 bp, Bos taurus
gtctgtaagcggagttagtgaatttacacagaaaagaaatagcctagaaaatttgaaaaggtttttaaagatgacatattttatgtggcccttgtaaggamtatgcctatgggacagttctttcttcaggggaccatggtggtaataggctctacctactcatcacagttgatggcctccctagtcatcgatttggcagcg

SEQ ID NO: 30525 - DNA, 201 bp, Bos taurus
atcaacttgactttgtcagaacatgaaggctcaagtcctggcttggcctgccacttgctataaactgggggcaaaggccttgccctttctgaacccatttrctcgaggaatgccacctgcctcatataatggctatgagccctcccctgctgtgcaaactgtcaaataaaatatactctgaatgtgggcctgatgggtcca

SEQ ID NO: 30526 - DNA, 201 bp, Bos taurus
tctgtgaagagagacaaggcagttgtttcagatccacagcagtttggacaccagacaccagtggtttaggcaaacccaaggcctgctactcttggctctaygcagccagatgaaccgatgcaagtagcagcccaaagcgaatgctttccaagcacccgccagggccccgacaatcactccctctaagtctctcgggctggc

SEQ ID NO: 30527 - DNA, 201 bp, Bos taurus
ctctaaagcctgcagaaaggagtacagccctgcagacacctggattgtagctcaatgagacccatttccggattctggcctccagaaatgtgagaggataygtttgtgacaactttttacagcagcaacaggaaactactcaacggtctaggcgctgccatgatccaggaggcctcacgttcacctgcgggccacaccagt

SEQ ID NO: 30528 - DNA, 201 bp, Bos taurus
caggtagagaatgacaatgactggatataccgggggcccaggaagccatggctgtcgctgccatcattgttattagttttagagtcacagacaagagccarcctagaggatgctgagggcccggcccagctctgaaaatctaaatcctgtggttgcagctgggggagtgactccaggaggcacctggtaagaggtggctcc

SEQ ID NO: 30529 - DNA, 201 bp, Bos taurus
tgtatcatcccgggagggggtggagagacggatgcagaagtgaccttggggcttcttattaaggaaccctgcattagaacccacactggctttgtagcctygagggcctgggcctcggaagatgggagcgtggtgggcccctcagcaataggacttccttcccctgaaagcttacttttcaagtcactgatatttccttac

SEQ ID NO: 30530 - DNA, 201 bp, Bos taurus
aataggcctgtctagggactggaagcagatgagtagctgcttaaggctttgaaggaagggagaagaggagggactgctaatgggaacagggctttattgaragggggccatggaaatattctaaaattggtgtggtaatggctgtacaactccatgaatatcctaaatagtatacttcaagtagttgaattgtgtgctata

SEQ ID NO: 30531 - DNA, 201 bp, Bos taurus
agaacttacttgctctttctccaccatgtgagggcttagcaagaaggtggctgtataaagcctagaagagagctctggccagaaaccagattaacggacamcttgatcttagacttcccagtctccagaattgtgagaaatgaattgctgctaagtaacgtagtctatagtattttattatggcagcctgagctgactagg

SEQ ID NO: 30532 - DNA, 201 bp, Bos taurus
tcctcaaggtgcatctgtgttgcatgctgtagcatgtgtcagaattttcttcatttttaagactgaataacccttcatggtatgtatgtacgtttgtgtaygcattcatccactggtacacacttaggttgcttccaccttttggcttttgtgaaaaatgctgctatgatcacaggtatggggaattcccttgtggtccag

SEQ ID NO: 30533 - DNA, 201 bp, Bos taurus
gttgctgagccattctgagccttggcatgtctgtctactataatagaattacgctgtgcagttagagtctagccagggccccagcatataacaggtgctcmgtaaaactcatttctccctttttctttcttcttaagggagtactcagggccagcctctgtgatcagacacaggtcagacacagagttctgggagaaaaca

SEQ ID NO: 30534 - DNA, 201 bp, Bos taurus
ctcattaatgacccccttcaccacatgcagtcactgttctgacttccaccatcgttgacgagttctgcctggttttgaagttttggaaagagaacctttcyatacagattctctggtgcctggccacttgctcagagccatgattttgagattcactcatcatgctttgtgttatcagcaatttgtgtgtgtgtttttttt

SEQ ID NO: 30535 - DNA, 201 bp, Bos taurus
ccaaaccatggatcagcgtggacgccaccatggatgccggagtccagacccggggcaggggcaggcagccgggaggcaggcgagaggcccccctcccttcrtgggaggttccagggcaccacggctctgcggtggggctccaggcttgggtgggatgagttcacagctggccgcagctcctcctgagccgctgggaacaga

SEQ ID NO: 30536 - DNA, 201 bp, Bos taurus
gctcagcgtctggtgcaggacggtgcttccaggatagccacaggcgaaataaatgagtgcctgctctcaggcaacggcagctcaggacgtggctacaaccrtgatacaaaagaaaggaaaggccccacctgcggctgactggcttggaaccattgctcaaggctcacagactcagaggaacactgtcacgtggtcaactcc

SEQ ID NO: 30537 - DNA, 201 bp, Bos taurus
ccatggcctgtggcctgtccctgcccctcttctcccctctacttctccatctgtgcaatgggtgagttaggctaattagttcgtccagcactcaggtcacygagtccagtacagggcccccagcacagcccagtgattcttccctcccttcacccagcaccttctctcaccgcaggtgtgcgccaggttactacggcaacc

SEQ ID NO: 30538 - DNA, 201 bp, Bos taurus
ggccgagaagggcccttccccctgatcctgctgccccagtttgggggctactggattgaaggcaccaatcacgaaatcaccagcatcccagagacagagcygctgcagtcgcccacgaccaaggtgaagctggagtgcaaccacactgcccgcctctaccggaagcactttctcggcaaggtggggtggccctctgggctg

SEQ ID NO: 30539 - DNA, 201 bp, Bos taurus
cctcaagctgaacctacgaggggctacgttttcaagcacaaacaaatagactcagggaaatgagttgggagcaaacccacacagagcaatcccctaaaccrcgagactttgctgtcatgcaagagagtcccggaagagtttgcggagtcccagaacatgggagctggaagggccctggcgagcctctttttctgctctctc

SEQ ID NO: 30540 - DNA, 201 bp, Bos taurus
taaggaggagtcagtacggagactaagcagggaggggagacagctaagggttgcatggacgggcaaaccccaatctcagcaactccactggttcaccagcygaggaaacgcaggcatggtgtttcacttttgagtcatttccctcccttgaaaagtgggctgttagaaggattaaaagcacgaatgtatagaagcatttag

SEQ ID NO: 30541 - DNA, 201 bp, Bos taurus
ccagatggagtgctcccccagcatcctgggccgcccgtcctttacactcatcagagcctgagaggaaagcggtattctcctcctgtcacaggcaggcgtgyggattccggcccactgagagcctgtggctcacccaaagaggcttctctctctctcctctttctgtcacaacaaactgcagcccacacatttttgctgggt

SEQ ID NO: 30542 - DNA, 201 bp, Bos taurus
tgcagagagaggcagatctaacggccactgcctctggccttcctggtaaccctgcaggtcctgaacgtctctaaacatcattcctctcagctgtcatatgygtattatttttccctggcctgttttggaggaggaaataaggcttagagatgctgagtgacctgctcaaggtcacacagctggccgtcagtggtgaggctg

SEQ ID NO: 30543 - DNA, 201 bp, Bos taurus
ttcaggttctttggggcgagcgtgtgttcaccccagaggcttaaatgaagcacattagcagccactcgggcggatggcctctgcaacaggaaggggagccrgagcttagaacacctgtgacagtcttcacccacagcccgctttgttagcacagcctgtctcagggtcttcccttctttggccctgagcatactcttcacc

SEQ ID NO: 30544 - DNA, 201 bp, Bos taurus
cccggaaggcagtctgtgcgagaatgtgtctagggcctgggatggggtttgtatcacatcccctggtgagtgcggagagatacttatttaatctgaccctkgtcccctacctgcagggccttgggagaggcagatgtggcgtcagacgagtcccctgcccaagccgctgtgccgtcaggttccttgctcgaggtgccaatc

SEQ ID NO: 30545 - DNA, 201 bp, Bos taurus
gcctgggagtggggaggaagcgggctcgtgggccttctccagacaaccatgagccagctgggttggcaggaggcggggagactatgggaaatgttggatgyggccagctacctgagggtcttgagtgttaaggtgggatgcttgtgccagatgtgtgatgtgtgggggtccgccctgaggtcctgagaggggtggtggaat

SEQ ID NO: 30546 - DNA, 201 bp, Bos taurus
attcactgtgcagcctgatggcgatacatttgctgctgtggctagctcggatatgtggacccaggactctaatggagcacggccccgaccctccagcaagrtgttcacacttggctgagaagacaagtcgcacagccataaggagttacaaatcagatccttctcagcacagtctgagtcaaggctggaagagcagtgcag

SEQ ID NO: 30547 - DNA, 201 bp, Bos taurus
gggaaaccgacacccctcacaggcaaggggtcaagccaggacccaggacctggcaccctgctgggctctcagtcacttgtcccactggccccagcggcccragtcctcgttaagaaggtgcaaagaggtgacatgaaaagtcagaggctgaggattcagagcccagcaccatcactaatggcctggctgactttgggcaag

SEQ ID NO: 30548 - DNA, 201 bp, Bos taurus
gaagtccttgaatggccactgaatgaaacatagctctccactttcacgttctgctttttttctttttccagttgacagttgtcactgtggcttgggggacmagggcctgtgtgtggatgacaccagtgggtaactctccgctcctatgacagcaggttgacactgaaaccgctaacttaagcaagacactgttccctctgt

SEQ ID NO: 30549 - DNA, 201 bp, Bos taurus
cctggatttggtgatggacagggaggcctggagtgctgcagtccatggcgtcgcaaagagtcagacatgactgagcaactgaactgaactgaactgtcccmaaaatccctggccgcgaagcatctggcactaactctcacacaacagtaatcctgctgctaagtcacttcagtcgtgtccgactctgtgcaaccccataga

SEQ ID NO: 30550 - DNA, 201 bp, Bos taurus
aagaaacagatccctcaaataggctgatatttattaaagaaattgagttgataactaataaccttccaaaacaaaaaccacctggcccagatgatttcagyggtgaattctatcaaatatttaaggaagaaattacaccacttttctacaatctcttccagaaaattcttacaaaaactccctaactcattctacaaggcc

SEQ ID NO: 30551 - DNA, 201 bp, Bos taurus
tgaattcatagggaaaatcctgaaagatgaaaaaggagaggcagtctgtgacatcaccagagtccttgaatgcggggacctggacatgataccaggggccmccaggatacacgggggtggggcagtttgcctgccatagagacaacagtattcccaagttgaagtgcttagtaaaaggcgaaggcctagcccatcacctct

SEQ ID NO: 30552 - DNA, 201 bp, Bos taurus
ctgtggccttagaggccccattaatgggtgttgagtggaatggacaagtgcaggaagtgaatgagtaaggaccgctcttctagaaaatttagcctggattyctctgctgggtacccaaggcagagcgcaccgctgataagaaggatctcgtgtctgggagaggtggacatcaagactgcacgtttcatggtaatgtcacat

SEQ ID NO: 30553 - DNA, 201 bp, Bos taurus
tcccttgggagagtaactgcccgctggacttgccagccaaagccagaacggctgtcttgggtcaagaactgtgcttttggacaatagactcacccctgccrtggatatagcatagctattaataaactctttggggctggggaacgaactacttgaacgggacaaaggaagggggtctcctgttccttttagtccaatgcc

SEQ ID NO: 30554 - DNA, 201 bp, Bos taurus
acaaagagcccacaggctgcacagtgaggccaaaaaaaaaaaaaaaaaggcaacgggggggctcataggattagaacaccacacacaggtgaccttaaccraggccccagttgggaaaaatcggcctcccatcagagtgggggcccccaggttctgttcctctctgctcctgcactcgccttcccccaccaccctgtcttt

SEQ ID NO: 30555 - DNA, 201 bp, Bos taurus
ttgcatgtttgttaaactgaggcctgaagagagcacgggggtttctagcacaaaaatgtaaaactggaacattatcaggcactgccagccccggagctcakgggccgtgaccttgccctgaggacccctgggtctctcacccggcctgccaccatctcgcgggggccaacttgtcctggctcatatctttactcccccaga

SEQ ID NO: 30556 - DNA, 201 bp, Bos taurus
cttttgaaatgggcaaggggatgacaatccaggagatagctcaagagagtgtgttccgaggccacttctcagaacaaagacagacttctgtacaaggccamtgcagcctgataaaggttcccccagtgggtccccaaacaccaaagacattcacgtaaatgagttcaaaatacatattgctctgggccaaatcacacagtg

SEQ ID NO: 30557 - DNA, 201 bp, Bos taurus
ccactgctgggaaacgaggggtgcccagggagtgtgggtcagggctgggggcgagcgcctcaggcctcgtgtgcagtccctggggccttcagtccatctcygtgccatctcccacctgcggctgctccgtgtgcccagctgaaatctgatcacattacagtgtggccttggagagaggtcgctcagtcgtgtctgactctg

SEQ ID NO: 30558 - DNA, 201 bp, Bos taurus
ggctgtcctcagtgcgccggcctgggccgcgggcctgtgtgggctgccttgcgctctcggctctaatgaggagactcaggcttctgtcatccttgcggccrgtcacataactcatccgaggcacggtaaagccggggctggtttccaatgtaagtaactgcaggaggcgggcccgggaagccacgagggtgacaggtctaa

SEQ ID NO: 30559 - DNA, 201 bp, Bos taurus
aaagacacacatcggacttggtgtcagacttggagagatctatataaaactcttagaagaaaagataagggtgagtcttttttaccaggattaggccgtcmttttttagaaactagaccaaaagcaccgtggcgctaatggatgcgaatccgcctgagcgcaggaaacagaagaggtgtgggtccagtcctgggtggggga

SEQ ID NO: 30560 - DNA, 201 bp, Bos taurus
aatggattggccttggtagcaatttttactttgggatgagaaaaatagaagttcaggtcaacttaccaatcattggagaggatctagggttaatggttaaraggcaggcctgggttcatacctcagctctgccaataccagctctatgaccttgaccaaattattcaacctctctgagccccacgccagtattcttgcccg

SEQ ID NO: 30561 - DNA, 201 bp, Bos taurus
actgcagcctctatgtaaccgagcactcagcatgcatcaggcatgtgttccagacgctttataggcatgactgtctctggtgtctctgcctggcaatatgytgggtttctcttttaaccctcacacgagccctgtggggtatattgccctccaatttaaaggtgagacagcggagacctggagagagaatagctgctgttg

SEQ ID NO: 30562 - DNA, 201 bp, Bos taurus
gccccggggtgggttgcagccttgattctcgctctgagcctcagtttcctgtctgtaaagtcagaggtttgccttcccctgagggaagggcctgtgcttcycggcaccagggtaattaagagtctggttgctgggatttccttgatggtccagtcagtggttaagaatcaacgcgggttcgatctccggtctgggaaataa

SEQ ID NO: 30563 - DNA, 201 bp, Bos taurus
tcaatcctggccaaagtaaagtaaaagtgagtggaagtctgttgggcagagaagaggctgccaggaaaagtcttcattcttcaagaaggacgtccaggcgrcggtggcccttttccttcctccgagtgttgtgtccaggtgtgatgccttggacaaagcgagtaatctctaagatccctccctgtggtgagaatagagatg

SEQ ID NO: 30564 - DNA, 201 bp, Bos taurus
tagaaaccagttcaggaaaagtgaagagaaaggacacgtattggaagggttgactggtagagataggctgggctgggggctgaagggggctggccaggggrgcaagctggtggtgtattgtcgtcagtcagtcagttccgtcgctcagtcatgcctgattctttgagaccccctggactgcagcacgccaggcctccctgt

SEQ ID NO: 30565 - DNA, 201 bp, Bos taurus
acgggtctggatagatgctagggactcgcacatctgtgcacagcagcatgccctgaccaggtgggagcaaggtctgaacgtttccgttttcctgaaagccygtcacagaggccttcgctgcctcccagagcttcctcaaactcatgtcccttgggtcagtgacggtgtcgaaccgtctcatcctctgccgccccttctcct

SEQ ID NO: 30566 - DNA, 201 bp, Bos taurus
ccttggagcagagtggctgacaaggggcagacagacagggacaggtcctggaggcagtgggggcaggaagccccagtgcaaccccacagaagggctgcccrtctccactgaaggcctggagtcaagttccttctcgggcgacatttttttcctctatgcctgtatgactatcagacaaggagatggtgccatgaaatgaac

SEQ ID NO: 30567 - DNA, 201 bp, Bos taurus
ctcacgagtgcacacggtgctcccaaggcgtgcctttgcgtgtgcccacgtgtgtatgttcctgcgcgcgttcttgcctccgctctacccaaatgcaagamtgtacttgtgcgtccaggcctccaggtgcctagtccttccctcctggggtgcgggcaccctgcctctctctttggtagcttgaaggacccccgtcccctg

SEQ ID NO: 30568 - DNA, 201 bp, Bos taurus
tggtctgtgatgccctagtgagccacctgccaacctctgcctccctccacctggtcccaccccgccctcctcctggtgtcccccacccagtggcagaccckctgaaacctgggcccccagatgcaaaggactagagggtgcctagacccttctcgtgccaaggctcagggcctgccactgccacggccgcacctgccctgc

SEQ ID NO: 30569 - DNA, 201 bp, Bos taurus
agtcctatctgtgctgcagggccatgcggggcaggggctactgttattcagtttacagaggtccagagcatcacctctcagaaactgcctccagcctgctrgagaccggagggtgcgtggcgtggccgtgttggtgatgctgggtggggaaagaggatgacgacttcacatcgtcagccactgaggctgctgaaatgaaag

SEQ ID NO: 30570 - DNA, 201 bp, Bos taurus
gggccccaagcacgtttgcccgtcttccctccagatcacgatgctcaccctcagagcccggggagggtggcagacagcttccgtgccttgtgaatttcagytggtctgcttttggccacgtgacaccccagaagagctttcactggggcagagtcaccggctgcagatggaattcagcagctagacagagttacagggagt

SEQ ID NO: 30571 - DNA, 201 bp, Bos taurus
gacccagaaatagtttccctcttccccacccaagttctgagcacactggaaaataagacaaaggagcagcagggggaggccagcacgtcacctctggtgcmgctaaaggctaatttggagagcagaacacagctttctgtgagagccaaacaggcccgctcaatgaaccccggaattaagcagaccggcccaccttgtcac

SEQ ID NO: 30572 - DNA, 201 bp, Bos taurus
gcagacggtgatggtccacgggactccagcgagcccctctctgcgagttactcaccacctgcttccacccttgagactctggctgtttcacttgaggaacyagtacctgccacgctgtgtggcctcaggccagttgcttaacctctctgcgtctcaggaacctcttcagtcaagagaaatgagcagagtttgggaagcacg

SEQ ID NO: 30573 - DNA, 201 bp, Bos taurus
gcatttagaggaactgacagagatgcccttagcttcccttcatttttgaatggggaaactgaggctcggggcagagccgtaactggcctgaggtcattgtygagttggtgcagaacccagacaggagtctgccttcttggctccccgtgagcagtctccatctcccggcaggggcccggggcagcgttcacagctttggtt

SEQ ID NO: 30574 - DNA, 201 bp, Bos taurus
tgcggcccgaggcatctcgcctcactgagagttccttcttcactgacagggcattgtcaggaagatgaaatgatgctgggcatggcctgcagggagtgctygataaaccacacaagtcattatccatttgccaaatctggtccagctcaaatgccccctccaggcagtccgcactgatctccttcacagacaagggtgatt

SEQ ID NO: 30575 - DNA, 201 bp, Bos taurus
tctgatgcttccaaactctccaacccaatgggaaacccacctctcacgtcctctgctgccatccctggccccttagagtcctagacagcttccttggcccrcctgcacgtgctccagtctgttccccaacgaacagagcatgctcttcctgtgctcagaagcgctggtcccagccacacgcagcatcgtctcggacggcac

SEQ ID NO: 30576 - DNA, 201 bp, Bos taurus
gcaggagaagggcacagattccctgtggtgtccctggccccgcctaaggagggctgaccgacctctgccagtaagcagatgggcccccagcttccccagcrtggctcaggtctgtgtcaacccgtccataatctccagatttggtgaatccctacccaggcccggctccttcatggatcacagccttgtcgtgacaaacct

SEQ ID NO: 30577 - DNA, 201 bp, Bos taurus
tagataagcaaaaattcaaaagcttgacaacatactgtataagtgagtgtggtggggagagggacaccaggctctttaaacaattctggtgggatgctaartggtgcgagaccaatagaaaggaaattagcaatccctcacaaaactacgtatgcattaactctttgatcagacaagtctatttctaagaatttactctga

SEQ ID NO: 30578 - DNA, 201 bp, Bos taurus
tcaccctacctggccagcagctacacaatttgcagggcccaagactggggtggagagggcgtggtacttggatcaggagggtaagatggccctgctgagtygcccacctaaccctctcagttcagttcagttcagtcgctcagtcgtgtctgactctttgcagccccatgaatcacagcacgccaggcctccctaaccctc

SEQ ID NO: 30579 - DNA, 201 bp, Bos taurus
aaaaaatattagccacatacaaaaggaccttccccctgctagatgaggctctttgaaactttggtggaagagaatattataacaacatttacctgggcgartgctatcaaattattattaatggaagaattcatgttctaattcaactgttttcatgagtgtgagttttcacttagtggattttcgtagcatacatgtgtg

SEQ ID NO: 30580 - DNA, 201 bp, Bos taurus
ttcttgagtctccaacaatctaaggccggggctgagctgttaatcagtctactagctgtggggcttctactctgaaacgtctggtgaggagtggcaggcgrgaaggggcagggccacgaataccctcctgggctcctgacctccgctgtcctgtgccccaggccatctgcagatctgctcaggcagggatgtcctctcctc

SEQ ID NO: 30581 - DNA, 201 bp, Bos taurus
gaatactggaagaggttgccatatcctcctccagaggatcctcccaacctagggattgatcccactcattagcctatgaaattacccagcccattaaaaastacctacctcatattttggggcctctgaccttctgagatgcccatgctctgtgcagtgtttttctaagtaaatttacttcttatctattgctttgtcctt

SEQ ID NO: 30582 - DNA, 201 bp, Bos taurus
aatatgcaactgatatctctagtcaaagtgggaacaaaagggaacttctttatcctgataaacagtatataccaaaactaaaaaagagagagaaaaacgayagcaaacagaacactcactggtgaaagattagaaactagagttcacagccaacacactaggacaaacaggttttaaacgttttaaataaaagatacagac

SEQ ID NO: 30583 - DNA, 201 bp, Bos taurus
aaggaagaggagtgagaggtagagcagtcataatcataacaactctggaagcccactaggtgaatgttgtcccttggttaggccctggatctgctcctggragtaactcccaagtttatgttctttaccattatggctccacactctaggaggcccttcacttttcatcattctccttagcctcttccaaggccaaagggg

SEQ ID NO: 30584 - DNA, 201 bp, Bos taurus
tgttttgtcagaactcttcatgttttggctggccctgcacgacaaggtcatagcttcactgagttttgtaaatctcttcaccatgacaaagttgtgatctrtgaaggggacattatatacaaacctgtattatgtgcttagtcactcagttgtgtctgattgacacaaccccatggattgtagcccaccaagctcctctgt

SEQ ID NO: 30585 - DNA, 201 bp, Bos taurus
catgcatttgggtgttctcttctaaaacagtggtctcattaatgaattgttctggtgtatggaaacacttctgccaaattctcattaaccacagtggagtmtatagcatagcagaaatgagtttaagcagataagtcttcatcagttttcaattttatgtcggctaaagttacaaaatatgacaagatcacagaaaacact

SEQ ID NO: 30586 - DNA, 201 bp, Bos taurus
gacaggaagacagggtggtaggcaaatctaagaaggagataatggatttagtttgtatttcatgacatttgtaatgcccatggtaaattcagattttgatrtccaatgtgctgttggaatgtggagcccaggagagggatcaaactgaaaggttgcggcctcgagctgtgtgctctgctgggactcgacctccagaggaga

SEQ ID NO: 30587 - DNA, 201 bp, Bos taurus
ttgacttgctgcactgttactcagtgcatctctggggcattaaaataaatgttacatcatgatagcatgcagtattctgaaacataagggattcatggccytggaagtttcagagactatcatttagcaattacataacataagcctcattctgagtcttcccaatcatggagaccaggaggcctgtgttaatgaatgttt

SEQ ID NO: 30588 - DNA, 201 bp, Bos taurus
actgggccagcccagattcaatgagtaggggaaccacagaagaatatgaacaagagatgtgattcactggggcattttcatagactagccaccccagtttrccttcactttgggcccttaacttccaaagagataggaaacaggtttagagttatgcagctacaaacatagcccattttaatgaaaatggaagaatgactc

SEQ ID NO: 30589 - DNA, 201 bp, Bos taurus
gggagcaggtagctcactccatgagtcaaggctggtgcaccccggtctgtaatgcagtcatcaggggtcagcgccacctatttctcgtttgttgagggtcygagtctgtgggccgcccaagggaggccaaagcacagcccttctgcacagagaggaagtcagatgggccctggggaacagctacccaggtgccaggagcac

SEQ ID NO: 30590 - DNA, 201 bp, Bos taurus
gggcctttcctagacccaagaagtgtttgattccccaagtgctgttttcctgttttttccataagccttcccatgaatgccgcttctcagttctttcctcrttgggaagggctcgctggccttctcagccccctgcctgcctttttgcagcaagtcagcttagcctcagctggggctccttattaggcaagggttccagct

SEQ ID NO: 30591 - DNA, 201 bp, Bos taurus
gctcagtgggcatgattacaaatattttcacaattagacattttctcagctcacaccttaagtaaagatcctctggcagggtagaaggggtgcttaatacytgtggcccctcactcatgtagtaggaacaggatacttatagtttagataaagactcaaaaagaattaaatgatagagtcagggttaggtatgaggctcac

SEQ ID NO: 30592 - DNA, 201 bp, Bos taurus
gggtgttttagtaatttgtcgtattcacgtacctcgaagtattttgagaccccatggactcatgtccatcgagtcagtgatgccatccaaccattcatgarggtgggccctgcacaaatgggataaatgtccctgtaaaagagaccccagagcgctcccttggcccttctgttgtgggaggacacagccaagacagccgtc

SEQ ID NO: 30593 - DNA, 201 bp, Bos taurus
gacatagacttgatggggcctcttaaaagtaggtgacttggacagttcttttagtgggggaaaatgaaaataatatgatctggctttggaacctaatttcrcattgttcctcagcacaaggcctttatactagccaaaaagtctatttattattgtctaaatcgaaatagtgcagattccacctctgtgcctgcatttatg

SEQ ID NO: 30594 - DNA, 201 bp, Bos taurus
gagacagagggacgttgggtcaataacttgatttgttcaggatctgagtgggcagcagtagaaaagaggaaggaaactcatattggtaagacttctctttrggccttcattactttggaccatcattactttaggccccatgacttacttgtatctctctaaggtatgttattcttattttagaaaggggaaaactgaggt

SEQ ID NO: 30595 - DNA, 201 bp, Bos taurus
catacatggctggtttaaccctcacaacaaacctatgtggtaatggaggctcagggagatttagtaacttgccaatatcttgaggttataagcaatggacytgggatttatacccagcaagactggctcctgaattggtactttctttttaggcatggcttctccaggccataaaactagcaagtgacagaacaaagggtc

SEQ ID NO: 30596 - DNA, 201 bp, Bos taurus
ctgttcagttccactctctttactttgtgcatgaactagcctttgcaggcccatgtcatgcttatgctggccttcactgaatggccttcgtgttgctgaaytgttttagggaaggagaaacctagtcttgcttggaaatcaagccaggtctttgcacatctgcaaaggtgtgggtgggaggcctctccagccctcaacttg

SEQ ID NO: 30597 - DNA, 201 bp, Bos taurus
gagaggctgctggctctgctctgaatgggctttagaaccaccttgcctgtctaacctgtcgtcttcttccttttctgctatttggtgtataaaactaaatyctatccccgggatgggcttccagcttttaacacagacctctcattgtggttctcagagcttttaaaatgaaaacagtgtttccagaattaggcaagtatg

SEQ ID NO: 30598 - DNA, 201 bp, Bos taurus
tcataagtagtatgtagcttcctgggaaggagctgaagttgtcagttctcaagacaaaagtacttccaaatacacagaattactctccctcaaaaagtcarccagacagtgtacctgaagtgggggctctgagacctcctctggagccatggatgggttttgtcatcagacacacttctggggattcatttttgagagatt

SEQ ID NO: 30599 - DNA, 201 bp, Bos taurus
aagtgttgctcactttttttgcttaggttctggctgctttctgaatgcttactcatttgaggaatgaaaaccatttaaattaagtttctccagataacatygctttcttttctcccctaacttaacaaaaacattccgaatcaagccagtttgacaatctgctttaagcagctgcctaaatcagaagttagcgagaggtgc

SEQ ID NO: 30600 - DNA, 201 bp, Bos taurus
ctttgaataaaagcatttttatgccttaaaaaaaagtgctaattgaactaatttaaagtgagaatcactttatggcctcttcccagctaaggcctggggaragctggggtttgcttagggatgctggactccttgcagatgtctgctgccctcctcgagggggcagggcctctatctttaaattagcttcatgagcacttt

SEQ ID NO: 30601 - DNA, 201 bp, Bos taurus
ggttaagtgtgtgaacacaggggtagacagcagcctctctgtgagagacaaataagcattcggaagactcaagaagctaaagtcagtggaggctcacttcrgcacaaaccttgggggaatttatgcattattagtcaatatcagagcctccaagcatgtgtccctttagaacaagaactctcaaaggcctgacaaggagga

SEQ ID NO: 30602 - DNA, 201 bp, Bos taurus
ctgcgattagacaccgcacagaaatattctaggaagggcatccctgggagttgatgatgaagtttacctctagcaaggccatgaggccatgccaggtcttyccaggttctgggtaccccatgggagcaccaccctaggctccaggagaagagaaagaactccaaggggccctctagctgcagccccccagtaaacagccca

SEQ ID NO: 30603 - DNA, 201 bp, Bos taurus
tctaagtcaatgctatctgacttactatttgcagtcccagattccttggttaatcctgctcctatacaggggaacttgaaggtggctgagtcctgtagctkgataggcttgatctctttcatggaccttgatctggcttaccaagctctgaattcccatgtagtgtacacagtgaccagctcttctgttaatacctgagaa

SEQ ID NO: 30604 - DNA, 201 bp, Bos taurus
tgaagaccagtataatccaggctgccttcatgattccatttccattaggatttcttctgattctaaaagaaattaccatgccagctttctcgtgggccccyccaaaagcaggcactatgtcaaatgtcccagtgggcgagcggtcgcggaggagcccagcactttgctgaacgccctggactggagacaaaggggcgggcc

SEQ ID NO: 30605 - DNA, 201 bp, Bos taurus
cagtagcaaagagttggacacgattgggcaactgaacaacaacaattccagctgcaccctctgctgaatcagggggagggtgggggagggagtgccactaygtaccagcctcacaagatgtcagtggtaaactacttttcataaatataaggtcattggtaggacttcgagagaacagttttatctttcagggtaaagaga

SEQ ID NO: 30606 - DNA, 201 bp, Bos taurus
tgagagcttggaggtaacaaggggggtgatttggataataattaataacccgagttccaggcgccactgaagcagcatgcaaattcaatgaccccgcagtkgtacctcttgaagaagaaggtgctttattgcctctgtcaggcgttcccttctcagctgtgattccttccagcctcggtggtttgcatactgcggctaaac

SEQ ID NO: 30607 - DNA, 201 bp, Bos taurus
atcccttaaaaatcttccatctgaaatcattcttgctaacatcaataactgccaagtgtaacagtcatggtgcagttcttatcatagttaatttcttcttrgcaaccaatgcttttgagcacttgtttttcctcaaactatccgacttacttgtatgttattacattctccttagtttcatattatggttcctttttcaac

SEQ ID NO: 30608 - DNA, 201 bp, Bos taurus
tgacaccccatgacagccctcattttctaagctgaccttcagtctttgcccttggacccttttgttcacattctgttgttgcaaagggacagaaacacaayccactactgccttattatgttttaatttcctgagtagttctagcatctcataggcatcttcactgtctctctcttttcagttgctcccctttgttctggg

SEQ ID NO: 30609 - DNA, 201 bp, Bos taurus
taagtttctaggtcagtaacaaagcactattactgacacgtgtctaagcacatataattaggcttcctaattgttaaatacccttgaacaaagacaacatrccataattttactaaaccactcattgaagtaccttccaaaggttattcgtaatgatctcaaaagagttcatttctgctaatactcaaactactcccaact

SEQ ID NO: 30610 - DNA, 201 bp, Bos taurus
aaggttctaggcaccacatcaggcttcccagtctggggactcaacagagggactgggaatctccagggaatctgacttagaagtccagaggatttgattgyagaactttcacaggcctgggggaaacagagactccactcttggaaggtacaaacaaaactgtttgtttgtgcatgccagggcccaggagaaaggagcagc

SEQ ID NO: 30611 - DNA, 201 bp, Bos taurus
aaaatactattagcttatttgagtttttccagttgtcctaactaatgctgtttttcttatctaggatctaagccaggaccccacatggcctgtctcttttmgtatgtgatggtagtcagttttctttcttttcatgactttaatacttttgaaaaataaaggccaatatgtcttttcctcttttttctattttgttttggt

SEQ ID NO: 30612 - DNA, 201 bp, Bos taurus
attttgctttccagtgaccatgacgtgccatgcatctcctgttcaactataacttgaaggcaacttcaaaggctctgcatatgggaaggccagtaaacgcktactaagcagcagtgcaagcaatccattctcttcctcggtcctgacaggagacatccttcttaggaccaccaattctttgtcttactctcattccctact

SEQ ID NO: 30613 - DNA, 201 bp, Bos taurus
gtacaccctgagcagtgattgggaaaatctcctgttaagactgaggctcatctggaccctaggctggtacagtaagtaggaacacgtacctgtcacattakggaactgcaaccctgaggccgctgaacacagtttatccagtcctggtttgttactggtaaatagtacattcctagaaaaagaggttttttatttaatact

SEQ ID NO: 30614 - DNA, 201 bp, Bos taurus
gtctgagccaataatatatatatatggcttatcacctgtggatccaaatgtaccacttatacctacctttaaactttgggaataggtattgagaatagaaytgtacctctttgagcatctctgctattcccgtttattttttatctcctccacctccaaccctactgtcattacatatatacttgaactcctggcctttaa

SEQ ID NO: 30615 - DNA, 201 bp, Bos taurus
acacatgggggttgcggccagggaagtgccctttctacaccgtgccaaccccagactccgaacctctaatgcataatgttcccaccagagacaggagtgaygaggggagtggccagtgatctgtgtttgacagcaaacacacgtgggcacctctttcctaagccttgggttctttcaggctgaggatgttgagttattgag

SEQ ID NO: 30616 - DNA, 201 bp, Bos taurus
tatatcatatttattctttgggagagaaatggatgcagagtgagagttagcagtttgaagtttctttatttcttcccccgccccttggttaatctggaacygtattataacatgaaacacattgatgagatattggcaaagaaatctaattggtgtctagtgggaaaagatagattctattctattaatatctacacccat

SEQ ID NO: 30617 - DNA, 201 bp, Bos taurus
cagccagaccaaacagctttctggccaattaattcctccctctaatttaatgagctgctcattaagtactggaagcaggtcatagggaacagagctgctgrcacatggcccgctgggctgacaggtgctgagggagaggagacagggccacactccagccccaagggctccagatcccgtgtatggccagcgccaccagac

SEQ ID NO: 30618 - DNA, 201 bp, Bos taurus
actatcaagtggagacaatacctagcagagggtttcatggaaaaattaaataacatgtaaagcacacagactgcacctcactaagtggaagctctcctacraaaagctaaaaatgctcaagataccatagctcttgatccctccttggaccaccgcccagctgccccatcagaggcagcccagtggtgctgggtatgaaaa

SEQ ID NO: 30619 - DNA, 201 bp, Bos taurus
agtatccagtcatccaatcaaaaactaatccaggtgttgctgtaaacacattctgtagatatgattaagatccataatcagttgactttaagattatcctmagtaatctaaatgggcctgagaattccatgaagaaaaattctgccaggggacagcagctttagtccatgcccaagagctcgtctgagagctcgccctaaa

SEQ ID NO: 30620 - DNA, 201 bp, Bos taurus
ttattaaactgtcttctaggccagtgctacaaacttagtgcacgtaagaatcgtcctgggagtggggaagagagtgtattaaagtgcaaagtccctgggtsctaactagaaaagaggcctgggagagaagcagaagtctgcatttttaatgagcagaaccaggtaattctcatatagatgctagaggcatagcggaaaata

SEQ ID NO: 30621 - DNA, 201 bp, Bos taurus
tgcatccaagtgagatttaaagtctacaatggatttaccagacccacagctggccctctccccagaatgtgttggcataagcattgctgagggcttcgccyccagacgtaaggatgtggtggcctttgtgtttctggtctggaaggcaagatcaaaagatcattcctgacactgggggatacatctctttaccaactaatg

SEQ ID NO: 30622 - DNA, 201 bp, Bos taurus
atgctgcctgggccctcctaaacccaatgaattatcaataaatgtttgtcagttatgtccttaatggaacttaagatctatgacagttatggagatacacrtgaaatgtactttaaggcctccaaattaaaatgttgaacaaaaatgtaaatggtgacaacaacattattctgtctgtgttcgtgagtagaaggtggacac

SEQ ID NO: 30623 - DNA, 201 bp, Bos taurus
gcctcgcttggcagagcattttcttacccacgcccccgccttctgtcatccgaactccctgctccgccgcttggcgccgccctaggactagatccacaggrtgttgcattcagtaagggcgatttgaagcgaaagggccgagggagagcagccaacaagggagtccactctggtgtggctaggtctccggagaaaaggagc

SEQ ID NO: 30624 - DNA, 201 bp, Bos taurus
atttgtgtggcctctgaggctatctagacgtgaggggttagaggtaggcaggttagcaaagccccaagaatcctttacatagtacacctttaccagcagtracttgtatctttaaggacctcctcctccttcatttttctttccctcctgaaccttcccatttccctgcctgtggccccttgaacctcttccatgtctgcc

SEQ ID NO: 30625 - DNA, 201 bp, Bos taurus
cacagacacagcagtgatggtgctcagggcacgggccagaggtgtggcctcagcagggagcagcttgctgagcactggaggagagagcagcctgcctcagkaggcgttcccagtgcagttttggccaccctccttaggataagatccccacagggatgagcagttcaagggcatggtatggtcctgttggcccaggaagaa

SEQ ID NO: 30626 - DNA, 201 bp, Bos taurus
ttgaattgaggcaaggatttcagagcttcatagaaaagaactagtcctgggaagaggtagagaagctgtcaggtgttgttcccaactgtgctactctgccrttcttttcaacttttcaaaacttgggtgtagactcagctctcactgcaatctcttctgtgtgtcttcttttccccacagacatcagactgcgggttcggg

SEQ ID NO: 30627 - DNA, 201 bp, Bos taurus
agggggtctctgggctcattccctctgcagatggcctgtatcacctccgcactgagaatggtgtcgtctaccagaccttctgtgacatgacctcttggggyggtggctggaccctggtggccagtgtccatgaaaacaacatgcttgggaaatgcacgttgggcgatcgctggtccagtcagcagggcaacagggctgact

SEQ ID NO: 30628 - DNA, 201 bp, Bos taurus
gtttaatttgaggggacactaatgcaaatggggtatattgtagctgtggttgctggggctttctccttaaggacagatggggttggcgggcctgtcatgayggttacccttcttggaaagtgggttgacagcgtcttgtgttccctcttcagggacttattgagaaggagccaagtggccaaatcacccttagtgtgttat

SEQ ID NO: 30629 - DNA, 201 bp, Bos taurus
ttacttgaagtaaggccagctttgttgttgttgtccagtggctaagtcatgtgcaactcttttgccaccccatggagttgctggcttccctgtgcttcatratgaaaaggccagcatgctgctgctgctgctgctaagtcgcttcagtcatgtccgactctgtgcgaccccatagatggcagcccatgaggcttccctgcc

SEQ ID NO: 30630 - DNA, 201 bp, Bos taurus
cactttagacatgttgagctgagatcatgagtgtatatttaggtgaaatgtccagtaaggagttgcaggtgtttggccagagcagggtgtaggtatgtgcrtgtcatcaaaatggaacaggcaccagggactgggaggagaagagctcactcgggtgcattaggagatgaacagagcactgaggcctgatgaccagtgaag

SEQ ID NO: 30631 - DNA, 201 bp, Bos taurus
aggggagcctgcttggaactgacaagagggccacctgaacctggcaatgtaccatctgttccagggaaggcagaccctgattataaaacatgacacagacraaggggaagtgtggcctccaataggaccgtaggtatttcccgcctttctctgatcttgctgaggaattgttatggactaatgctctcaaaccggagaagg

SEQ ID NO: 30632 - DNA, 201 bp, Bos taurus
tactgtaaagataggtgttgttgaaataaccagcagagggctgataactgcctctggaggtgagggaggccccagtgaaggagatggggaagtatgggacrtgggagtaaatcacattgcattcttacctggagtcaattcagtgaacaatccccagtgtttgctttgggaggggagaagttgcagagggcgccatggtgc

SEQ ID NO: 30633 - DNA, 201 bp, Bos taurus
tttggaaaatcccacacaccaaggcactctttgacttcagggtcattctcagctgggttctccttcttccttacaggaggccccaaggactcagcctcttkaaagcttctctgaaccacagagccctacactccttcagaaggatacttttgtccctaaaagtgacatgattttctttaataatgataataatcatggcca

SEQ ID NO: 30634 - DNA, 201 bp, Bos taurus
gggccctaccatgcagggattgtgtgggccccaccatagacatacagatggtgcatctcgacttagacagacttaggaagttgtgaaatggatatgtacayacagggaggatggaggccccaacacacacacacacattcgaacacaagtgtacacagagtatctatcattcccttctcttcttctacaccgtggcttatg

SEQ ID NO: 30635 - DNA, 201 bp, Bos taurus
ctacagtttaaaaagtttgatgtaaaaataaatgatgagattgtcactgctcttctcaataagaaaataaaagtccctaaataaaatgttcatattgtttyaaatgagaatttaatgcccagtgacatgctgatgtctttagtctcagacacatcgtggaatcttctattaaactttctggtgaaatttgccaaaattacc

SEQ ID NO: 30636 - DNA, 201 bp, Bos taurus
agctcaaaaagatcttagaaaaagtggagtccagaatcaggtctttcctaaaaatggacattgagacttggaataaagaaaggcctagaataggtcaattragttactcagttttcttttgctccactctgttgctgacttcaccagtcacaggccatattctctgtagaggaaaaggatgaagacatcacatgcactggt

SEQ ID NO: 30637 - DNA, 201 bp, Bos taurus
aaaggaaggtctgactacaagagtcttgtagtcccattgaatcacacttgtgtaacaattcagtattaattttaacccctctctaggccacagtctccttrtctctacctcatggggctgcagtcagaatagagaagtgggagtaggggtagcacttggcctagagttaaacagtaagttgtctgtcttctgctacttaat

SEQ ID NO: 30638 - DNA, 201 bp, Bos taurus
aatctgcctctgaaaccaggcagatgcctccaccggtgacctgtgtccttggacaagacactccacttccttattcttcagtttcctcatattaaaatgarattaatttattttctcataagattttgtgatgattaaatgagttaacatattcaaagggcttggaactatgtctgaaatttactaaacattcaaatagca

SEQ ID NO: 30639 - DNA, 201 bp, Bos taurus
agatcttattataaattctcctgctatgccatggtctagtgagcaatgccctcatcactttcatcatcttactaagtaaatctctctaatctcaacacatrtgtagaggcctcttcttcctcttgagcgatatgtggtcagaaacctaataggcaagtctttctgactgtcaacattaccaaacatctgtgaaaatccttt

SEQ ID NO: 30640 - DNA, 201 bp, Bos taurus
attctgtgctcaaacctttataaaggcctttattttagaaaggaggcctcagcagccatgccaaacatgcaggtggtatttgcatgacataaggaataatraactgctaggtgtgaaggataggcctggaacctgtgagagtctgtttttccaggaagccttgggatgcaagcagcaattgccatatattgctctaatggc

SEQ ID NO: 30641 - DNA, 201 bp, Bos taurus
aaccccaaggccaagcctatacccaccttccccttccccagagataattgttttgagcagcaaaataaaggaggaaggcagccaaaggttcagtgggggarggatgggatgtggggccagaaggaaaagtgaaacctgcctcttccagtctctatcttcctcttcttccctcgtgtcttccaaaggaacagtccaactcca

SEQ ID NO: 30642 - DNA, 201 bp, Bos taurus
aggcctggtgggctgccgtctatggggttgcacagagtcgggcatgactgaagcgacttagcagcagcagggaacccaagcctgaattttgcccgtcccckctgctgctattctaatggctttgtccttgggcccttgatgaggaaccacatttgagacaacacaatgttttacctgcaagtccattcattattatcctat

SEQ ID NO: 30643 - DNA, 201 bp, Bos taurus
gtcgccggccctaccggtctcactccctacctcatggaggttcagagtcccgctcctttccctcatgggtataacccccgtgccggtccatttcctcaccragtcacaaaccagctcccccggcccggcaaacggcagacactgtcaagcgctgtctccacgccgcgcgtcccgcagcggagaagtaagctcgggtcgtaa

SEQ ID NO: 30644 - DNA, 201 bp, Bos taurus
agctggccaggcattcctaagccattgcaggtccacatgaaataaggtcgttgaggagaaattccctagaatgcactttgtagcaggtggagctcctagamggccaggaggaagatggctagaaagttgatatcaatgccaaaggggaggggactgggaagggatggagtgaggggttagcagatgtaagctattatataa

SEQ ID NO: 30645 - DNA, 201 bp, Bos taurus
ggacagaggtgatgtcaccttcctccaggacgagggcttcggctgggcccgttgctgtaggttgagttactgcctgtggaggggctcagagctggatggcrttgacgggttgacccggagaggcctcctctgaggacagccgctggcgtatctgaggtggtgtggtaccatagctcccgcaagggccaagctccacggacc

SEQ ID NO: 30646 - DNA, 201 bp, Bos taurus
acataacaacagagattaactttgcctgctgaattttatataaatagaatcataatcttttgtattttttttcaatagtgagaatcaagggcattgttgamtgcagttgtagctcatcatcttcattgctgtagagtgttccattgcataaatgcaccactgtttatccatttcaccacggatagatatttgggttgtttt

SEQ ID NO: 30647 - DNA, 201 bp, Bos taurus
tgcacagctacagttggaaactgagaagggaaaaattttcggcccatattatgtttctcggcaaccagttgcagatttgaactggtgcaggtcaggcctcsgtccagcccttggtgaaatgggtgtttatctgtagcccgttggctgcattctgttgtctgccgtggtaaatggcctctatcggcagagccagggtgtagc

SEQ ID NO: 30648 - DNA, 201 bp, Bos taurus
gttaatttcaccggaaaaagtaaaaagaaagggagcagtgaccttggacaggctctgccacacccaatttcctaacataatcacagccttgtatcaacatyggttgtctaattcagaaggggtaaagtagcccatgacactgagtaatctggatgtgatttcaaaatagagttgtgacatgatttgctcagttcaggatga

SEQ ID NO: 30649 - DNA, 201 bp, Bos taurus
aataaacatttgcggcatgattaatgaactaaaagcattgttggtcgacttgattgtattcccactggaagttgaacttagaaagggctaagacctgtgcrccattcatttctgtgtcttccgtgtctagctgagttcctgaatgtcatagttgcttattagcttgtgtgagtgagtgggaaaatgagagctgaatgtcac

SEQ ID NO: 30650 - DNA, 201 bp, Bos taurus
gaagcagtacttttcacattaaggttgtgataatcttatagtttgcagcgtagttagcctatgtctttcctgtattagatttttgctttggcatcttaagytgtctcctctttgcactcctcaccctccccttctgttcctctgtcttctttgtctcttcttcctgttcctctttccctcattcttttgggaatttacagt

SEQ ID NO: 30651 - DNA, 201 bp, Bos taurus
agactcattctctcacctacagtctgtctgtctcacccccttttcttctctttgagaaagacacaggcagagacaggccaaagttagttgcacaaaaaagygttgggaaaggctctgaaagagttttgaggcagggctctgttggctcagccagttctggggaatgctacatctgggtggccatttttcacagatatcaag

SEQ ID NO: 30652 - DNA, 201 bp, Bos taurus
ttggaatcatataatttatcatttcccaatagttgctaccactccttcccaattcctgatgatcatattgtataagttgtaagcctatgtgacttcacccrgcttcagtgagacttgtgctatacatttacaacagatggtgtgtagagcaaggtcctcaaggacgacccctaacatatgattcagtttatatccatgtga

SEQ ID NO: 30653 - DNA, 201 bp, Bos taurus
agacccatacctaggaaggccccctgtgcaaggcttcaggccatctgaccagtgagaaccatggtcaggggacacagcagctattgaggcacctgcactgygtctgctgtggctgtgggtggccctcagcaaacctccttgacacctgccacaccccttgccacatacctgagctctgttgttacaaggccctataagggg

SEQ ID NO: 30654 - DNA, 201 bp, Bos taurus
tgtcagacatagcatagcaggcaaggttagaatgggacctagggtctcaggaggcatttagagacctcagtggcagggggcatgaccatatcgccataagkttgtcacaggaagagctatgcttacattggaccatggactctgggtcaaaaaatgttgtctccatagaggcagggtggggtagaatggaggagcacggac

SEQ ID NO: 30655 - DNA, 201 bp, Bos taurus
gaagagaattgctcattctgcagaaaccagagttccacggaagcagccaatcagcgtaagaagagaggaagtgacagagccaggtggagccagagagccarctttatggaaaaacactggcactagcttaaaacaggctgcacctctggcagttcctccccacaaaggagatggtgacgtggctgctgtgggaccagaaga

SEQ ID NO: 30656 - DNA, 201 bp, Bos taurus
tccttcaagtcaggatccggggccagaagcaaggagcctagggaatgatcagctcacgagacagcgagtgctgtagccaagtgaagcttgtcattcactcracaatcatttcacaaaaccaaggccaggccagggttgaagagctcgctgcctcgtccctgagggtctcacgtgtgggggacaggtgtggcacccacaacc

SEQ ID NO: 30657 - DNA, 201 bp, Bos taurus
gaattctatttttgtaaacagtgacgtattaaagatctatgttgtttatttttaatactagttaattaattccattttcatttattgaatattctcatctrtctctgttggtttaaaaggacacctccatcatatactatattcctaaataatcacgactcatgacccctttttacgaaagttgaaactgatggttaggga

SEQ ID NO: 30658 - DNA, 201 bp, Bos taurus
agcactacaaagggctgcccagcaatgccctgcacgcgcacagcaaccccgtaagtactggctcttgcatccttagctggccgtcgcccaccacgacgtarggtgcctatctctgcctcacccactggctctgtgatgaagcgaatctggactccatggtcaacagggccccggggctcggccatggtggacgcctgctcc

SEQ ID NO: 30659 - DNA, 201 bp, Bos taurus
gaatcaggtaaagcactttacctgttaaaatgggcccttgactagctatggaatattttaaattttcaagtagacaacgccatctgttgggcatcttgcaractatcaaattgtatggccctataacacaatggttaaattggttgttttgtttgttttgccttagggtgtggtggaaaaaattctgagattcggaggcac

SEQ ID NO: 30660 - DNA, 201 bp, Bos taurus
tgctgttggccttctggtaggaagggctaactcctgatgtgggtggctgaagggtctggggtaacctggagctggttatggcttattagtgggtgaggccrggtcctagggctggtgccagcctactggcggtcagggctgggtctaatggctggctctggggggattgaggtcccaaggctagtgctggtgcactagtgg

SEQ ID NO: 30661 - DNA, 201 bp, Bos taurus
cttccacaatgtcaagaatctaggcaagtggcatttgtgggctgactttctttcattaaagcagaagggtagagctgcataagagaaatagttatgatccrggttggagctaaattctatgcctttgtctctctcccttccctccctgcccctttcttctcccccttgccctccggccctttcccaggagctctcctccag

SEQ ID NO: 30662 - DNA, 201 bp, Bos taurus
ggttccagccttggtcggggaactaagagcccacatgtctcgcaacatggccaaaataaatacataagaaaagcattcctgggaggagtaaaaaggcccaraattctagctctatcagtagcttgctaggcaagtcacttaacctctctgagcctcagttctttcacctttatggtagttttcaaagtatcatatatgggg

SEQ ID NO: 30663 - DNA, 201 bp, Bos taurus
gctgacttccgcaatccgggtggaataaatccagcacccctagtcatccggccacattatccacacttctctgctgagacgagcccagagaacagatgccyatcaacaggtaacattttcagcttcctggatcctttaacctctcattcctgtcagttttccatttttaggaatattaggaacatagtgacttgtatatca

SEQ ID NO: 30664 - DNA, 201 bp, Bos taurus
gaatcatcctagttcctctcaaaaatccctttcctgttggcatctgtctcccctattatggggtgaaaatagctggtatttggtacattttcagtaaatamtgtttcttaacatgtttgaatatggcatttatgccgtgaggtcagccattcataaatattcattaaagttagacttgttccagagaacaatcattgccat

SEQ ID NO: 30665 - DNA, 201 bp, Bos taurus
aagacatgacagaggtggccgcaggaggaagctattgaaaggtctgaatttttccccagcaggagagcagcttggtggtttaactggcctgcgcaaagccrccctgatatcttccctgagtggggatgaggaggctgtggctgctctgcacccttccagggacctgtcatcagtagctgattctgctccccgacttgtggg

SEQ ID NO: 30666 - DNA, 201 bp, Bos taurus
gtcctggattaggggtcgagaggatggacagcaggagcaactgcaggatggcctctcatctgttccaggtgtcctgtggtcctctctctggtcgaggcagrtagaccaagaggggaaagggcacagctacagtttgatggcagagttactggaaaattgtaataatgagacccctctgcagatagtttctgatgattacca

SEQ ID NO: 30667 - DNA, 201 bp, Bos taurus
cagttattcaactctgcttttggataaggggtcctggagttgattgcaggtgtttcatgaatccaaatggactccagacattatcagagactgaataaatyttaatgtttcttacatgtgtgttttcaaatgtgtgtatatgctattgttattaataaatttaccagttaattaaaaagcttggctgcattcttttatctg

SEQ ID NO: 30668 - DNA, 201 bp, Bos taurus
aatcttcctacctaccttgagtgcatctctgttccttgcaactaaaataaaatgggtgaagtagattcccactatggcatggccttgacgttagctcctgraattagtgatggggcactgtggtataccggaaagagcaatggacagggacccagaagacctcagttctgctcccaacccagccactggtcattgtgtggc

SEQ ID NO: 30669 - DNA, 201 bp, Bos taurus
gggaaaaaagagacctatttccgcctggtttcgaaccggagacttttcacatgtgaggcaaacgtgataaccactacaccacggaaaggcgacagtcgctrccactgagccctgtatccaggaaaacccaaggttcagccgccactatccaagccaccaacttttaacattcatgcagaaaccttggagccccacgctctc

SEQ ID NO: 30670 - DNA, 201 bp, Bos taurus
atccccgggggcctcgcttcaggagaagcgaggagccctaaagcagagcctttcagaagccacagtctccttatctaagggatagcctcttccaggatccycttcctttgaaaatttctgatggcccttgtggtcaaacatagaattcttgggtatgtcattagaactatatagccgtgtggtttccgtagtgtagtggtt

SEQ ID NO: 30671 - DNA, 201 bp, Bos taurus
ttcttctctttggataagttgctcggcagaaagaggccatcctggccatcttctctggacccggttgaccaggtcaccggacaaaacaatggacagttacyggaggactttaaaagtggtcagtgactaactctccaccataagcagtagagcacctctgtgtaatgccacagcgtccctctattgtctttccccttagtt

SEQ ID NO: 30672 - DNA, 201 bp, Bos taurus
gtttcgtcttctgaggtggaacgctttaagcctgcccgccgagagccggagctttcctccagctgttagaaagaaagagcttatttttctcttgcaatctyttgatataactcgcgacttacatttttgggtggacgtgttttcgaaaatttagtagagaattgagaagtgaaaaagttttaacttacagcaaagggtcct

SEQ ID NO: 30673 - DNA, 201 bp, Bos taurus
agcctggagtgggggttaagcttcccacacaaccccgattcacctgacatcggtctctcaagtaccctgctgcccgggcgtctcggcccaggctccgcaaytctcgctcggatgttccacctgcccctcactttctctcccctcttgaccagctcctcccatccccctccccccgcggtccatttttaatttttttggcct

SEQ ID NO: 30674 - DNA, 201 bp, Bos taurus
gcgcctggcaggaatcttacacttaatgactgggtgacggggctccaagcttttacacttttcctttcctcatcctgtggcccaggacctcgatcctacaygggtgaaagaagtagcaggatgggtggaaaagtaaggggcttcaggagggataaacctgacctggcagcgggagccctctctctgtgggggaatccctat

SEQ ID NO: 30675 - DNA, 201 bp, Bos taurus
ccttataaattaaaccagtacatttaataaagtgtgaattctcatacttatcattaatgttttttccactttattttcaaaaggctggcttttctccattyttctactatcaaagccaagagctgcctaatggttctgtcaaggaggttccagctcctactcctgctcctctggaggtctcaagcccagaaactacagagg

SEQ ID NO: 30676 - DNA, 201 bp, Bos taurus
tattgatccctgtatagtattgtcttcatggaaatgtgctttggtgagatgctatcattctgtgtcaagggaacaataagaaacaatcccacaaaactcaytgctgtgactactgaaaagatgttcattatattactctatcctctttatgaggacccttgggaggaatttgtctgttcacttgagaaatggtgtgcttct

SEQ ID NO: 30677 - DNA, 201 bp, Bos taurus
agtaactcaagagtgcctgttcttttttttaattctgctgtatatgcagggtctgaattcagaatttcccagagagggccacattaaggaaatcctaagayagccgtatgtctcctttttattttgcacctcttctcttctagtaattcatcaatatatcagcatgctaccagaaaaggccagagtgatgtgcctaaaact

SEQ ID NO: 30678 - DNA, 201 bp, Bos taurus
tgagtgtaaagaggaagtgaggccaatctcaaggaatttgatctgatctggggaatttattcaaattctcaaccacagaatactctggctctcaaggcagycagccttctagggcccttgtaagtcaacagaagcagtggtggaagggtgaggtgtgcccgccagctttgaccatgtcttcagtgtgacttagggagggct

SEQ ID NO: 30679 - DNA, 201 bp, Bos taurus
acaaaattagaattcagaaaacagagcctctcagaggcccaccagatcctgattccttgaatactctattacagtggctttgaccaactagcttttttttyccagctttttcagctggttgctgaaggctggatctgatgctgagctgattgttaagatactagctgtcctgaggatgaagatgaggcctgtagatgaagg

SEQ ID NO: 30680 - DNA, 201 bp, Bos taurus
gatcaaagggtctggggttaagatggaggtacaagataaatcattattatgctgagttgtttattttacctaattctcttaaggccccctgatggaacctrtggtatcctcattttcagaaagcaaaggttaagctatctgctcaaagcaacacagccagtaagagacaaggcttggatctgaatccaagtaaaagggatc

SEQ ID NO: 30681 - DNA, 201 bp, Bos taurus
tgtttttctattgcaggatcccactttctaagtgggatcacatgccctttattattagtctgctttagactgtgacagtctcttacactttccttgttttygatgacttgacagttttgaggagtactagttaagtattttgtagactatcccttaatttgtgattgtctgatattttcccctcatgattaggctagggtt

SEQ ID NO: 30682 - DNA, 201 bp, Bos taurus
aagcgtatttttcatataatttatatttctagtcaattcacttgattcccactaagattatttttgcctcttaacacaaaccttccatatgtgttgtgggyaaggtctattcaaaagaggatgaatagattctgaagcttagagtttctgccctggactcagaatttttgtgattttctgtgatgagaatgtattattgat

SEQ ID NO: 30683 - DNA, 201 bp, Bos taurus
agtaaagctgggcatgctgctgaggccatgcccttcaaggtcttgaggacaataattactagaacaaaagttaaagcagtactttattcagtgctggcacyatgcaggcctccatatgctgtatttcttgtcctccaagagccctgcaagtcaggtgtggtcaccttctattttactcagtgtttttctcctcaatttcaa

SEQ ID NO: 30684 - DNA, 201 bp, Bos taurus
ttcacagaccagctccctcccctccattcctactgccacggccttcatctaggcccacatcatctcttggttggtctctctgttctcctgacttcctgccwtatcatccttgaatccatcttcctctcccaccagaaggatctagcatgtttcctgcttaagtatggagtcctgccccaaggccacaggtgcgaggccttg

SEQ ID NO: 30685 - DNA, 201 bp, Bos taurus
cattctagctccagattctatcctcttaacctgtgtgtcagcccccagcttggacccatcttagttcaacctaacactgttggactggtgctgttaacatyggtgcttctgatctagcagggccctgttctgtcctccattatccccaaggagaatggcttgctgtgaagatgtcttcaaggctttgggggtctaatgcat

SEQ ID NO: 30686 - DNA, 201 bp, Bos taurus
ctgctcaagggcctcctccccaacccccatgacagtcatcttcccctggtcaggtggtcacagtctctacttcctgacattccttctgatcccaggcccckttcacctatcttcctgccacacttcgtggtctgattacttgtgcacccagtaggtcctcactgaacacctgggttttctgtgttcaagggtgggaactag

SEQ ID NO: 30687 - DNA, 201 bp, Bos taurus
ggggagttctaggcagcagggaaagcagaacaagtcaaggaactggcccaccagtatttcaataacacttactgtgtgccaggcatgcgataaccatgctraacaagtcatgtgaggccactgccctcagggaactcacagccagtgagtgagcacatgtgctgtgtgtttcatctgtactggacagtgaggaaagcctct

SEQ ID NO: 30688 - DNA, 201 bp, Bos taurus
aggagtattttggcttcaggcataatcaacaatagcataaggatttgcttgtgatagtattccgccccccccacacatcttttctcagttctgcttcttcygttagcttatcccttgcacagcaacagaatctatcctgttggtacatgttgatcttgtatccaccatgatctgccactctctaaaccacaatgactaagg

SEQ ID NO: 30689 - DNA, 201 bp, Bos taurus
aggagattaccttgtggcccacactcttattgtgacaggcttcctctgggtttctcttgaacgtcaagcctagtcatccccatggcctccttttctgttgyagaggggctgctgagcgaggaagacggggttgcaagccgtgaggaagaggatgaccaatctggcgtagttgagatggccatgttcccagggctgtctgag

SEQ ID NO: 30690 - DNA, 201 bp, Bos taurus
tttgaactggccctctacagtgagggcatgtctgggctgcctggctccctgaagaaggagaacatccagcaagttccagaggtgtgagcctcagggaagaygggctcccagaagatgagcccaagcagagtaagttttggttgagaaaggtcattcaggagcaaactgagaggtcaaattacatctttggcgatgaccacc

SEQ ID NO: 30691 - DNA, 201 bp, Bos taurus
tctaggatggtatcctaagagaaaccaggatatctgacaaattatcataagctttcacatgtaatcaggaagaacaaggtgaatgtcactggatatttcgrgtgcattttagtgcccagctttgaatgagagtaatttcacagactgttgaggggagaagcaaaaaaatcaaaccaacttaaaagctaaatgacagaagga

SEQ ID NO: 30692 - DNA, 201 bp, Bos taurus
ctacttctttatatattcaggtgaatctggcaaggaatcatctagaagaaccttagaatataatcctagggaacaaatgataaacaggaaaaaaaaaaagygcctctgtattataccaagcaacaagataaaacctgaaaatgttggatgtttataaacttcctgcaagtatacagtaaatatctgctactctatagatac

SEQ ID NO: 30693 - DNA, 201 bp, Bos taurus
ggatggaagccctctagatctggctggtgaggcccccgcccaccttggtggcatgctgccagactccaagcaggggcagtggtttgggggtggggagcccyggggaagcacaggcccaccctgtgtttagtgctttaagagaaacacaaacaaactggagcacattctgggtagaacctcagccctcatgataggaggggc

SEQ ID NO: 30694 - DNA, 201 bp, Bos taurus
gaggaagtcagcgaggacagagggagagcttcagagcctcagaggagaatacagcaactggtttgcagcagctagaacagagagaggcctgcagacagtcygtgccacccctctacactcccagcccgagacgtgtgtccactggtgcatgtgagggctagatgtggaagctcgggcctcagggtgggctgtgcaaaaaca

SEQ ID NO: 30695 - DNA, 201 bp, Bos taurus
gccaagtcaaatggggactggttatgtcaatcctcagtaatcctgaattcttatgtcaggacaagtctcgccatcttcagcatgatagtgctggcctcagraaacatctccaagagcattcccaatttagttcttactcctccacaccaatttctttataagtctgacagcagctcagaattagtagattcttctctgctg

SEQ ID NO: 30696 - DNA, 201 bp, Bos taurus
ctttgtccttgccctgcctaaaccctctctggctacagtcttcagaaaggtgactctaaaatttgaggcagtgaggcctctgaatcaatcttagggccaaytgtttgctaggaaggttaagggaatggaatcttgactctgaagggggttccttgctttgggtcttgagaggcctgggaccctactacctgttgtcagaaa

SEQ ID NO: 30697 - DNA, 201 bp, Bos taurus
agcaccagaagatccatcaggaagagataggtggagacagcagaaaacaggcatggccagggaaggaggtcacagcaacgctcaggacctagggcctcctygctgttgtgtggtgttccctccaatccctatgagcagtcactgctcagctgggctcagatcagaggagtcacttgccagggcattggccacagtggtctt

SEQ ID NO: 30698 - DNA, 201 bp, Bos taurus
gaaagccaaggagagctcaaaggaccagggtcaagtcgctccccgcagatcctagtgcaaaccaaccgtggcgctattctgcgcccaagaaacaggaagtyagatgccaaaaaggactttgaggtcagccaaggagagcttggtgacaaattcttcagatcctgatagaatctgtttggctaaatctttctttttttcttg

SEQ ID NO: 30699 - DNA, 201 bp, Bos taurus
aacaggtttcatttcgtgtctggtctcttgggccaaaagcccatttggcttcctgaaactctgctccaaggaacagggggcaaggagtaggagcttcagcyactccagaaggcccacccgtggaaatggggtgatctgagccccagccttccctgcaacagccctgaagccaggttagaggcacagctatctacagaaagg

SEQ ID NO: 30700 - DNA, 201 bp, Bos taurus
cgcagttaggggagcctcattcaaatgccaggcagacgcaaatagcacgctctgctctcctatgaatagcctgcccagctgttctgcaggaggccaagccrgttctcatccaaagtacatgtgttcttatttatgagctgcatcagatgccgtcggcagcctacctttggcccttcaaggccagcttcgtgcgtgttcttt

SEQ ID NO: 30701 - DNA, 201 bp, Bos taurus
gcagcttaacactgcttggctgtccccagggctgttatgctgtccacttatttcagaagtgaccgtcatactgtgaccaggtcacagaggggccagagttmagccaagtgagagtggtgccctcaaagaagaaggggagaaggtccaagaggagcttgaaagcccactctcaggagcaatgtggagtgagaaggaaacagt

SEQ ID NO: 30702 - DNA, 201 bp, Bos taurus
gtgctggagagaggcataggcagcgcctgcgggctccagtgggttaaataaggctcacattggggctccattgggccatggttactctttcctttccatcrcctcaattctcaggctccgctttttgcctggggccagctgtgaccacactgacagctacctaaattaattatgagagaatgcaccttttccatcctcaaa

SEQ ID NO: 30703 - DNA, 201 bp, Bos taurus
aacccaatcattcattgttagaagtacggaaaagtaaaacatataccaaagttacatttgacaggaaccaacactggctaagttattgcaggttaccaggyagtctgtcaagtgctttcacatagttgttctcacaacagtgctgtcagatatttatttcacaaagaacagcttaagtcagattaagcaggaggtcatgca

SEQ ID NO: 30704 - DNA, 201 bp, Bos taurus
aggcacacagactgtgtaatcaggctcagctggtaatcagggagctgccaaacagacgcgagacgaaattacctccctgtcccagacaaagtggccttctygatgagggttaaaaccagcgatggtgggaaaaacaaaggaaggtatgcggcagctgctaccaaacacttggccagtggacggctcccaatccgtccctat

SEQ ID NO: 30705 - DNA, 201 bp, Bos taurus
gagccagtactgttgttaagaagaggcagtcatctaagtccaggcgaagggagactgggggtggggggcagtattagtagagaaggggaggcccagagaarcataaaggaaattcatcactctcgtttggttataatgggctgggagggaatacggcagctcctgggtaagaactcatctgaaggaagacagagtcagaca

SEQ ID NO: 30706 - DNA, 201 bp, Bos taurus
ttctttatttggatccagctctgagattccaggcacactcagggaaatcactgacagccaactgaacaggctgtggctcagctgcagactagaaagagggraaggggcccgtgactactggggaagggggaggcaaaggccagcccaccagcccccaggtccacccacatgtctcccactgcccatgccctcgcttccctc

SEQ ID NO: 30707 - DNA, 201 bp, Bos taurus
ttctctgtatagtactgtacgataaggtacacaaaagcataaccactggtagaggatgcacgcaagtgacaatgtaagccagatacatgaaccaacttacrtgactggacatgcaaacacatgcgtacatctttgaaagtccacagcttgaaggttcatactataatggggtataaaatagatactggttaaattagtgag

SEQ ID NO: 30708 - DNA, 201 bp, Bos taurus
tctttctatcctcttgaagaaaactcaatctctcggccttagaaattcataggctcttctgggaatggtctggttgtcaaataagttgcttctcacaaatrtccacatgcggagagaagggcccagggccggtgggaaggcgtgcgtaagctctccaaattgcctcagtctctgggtcgtgtttttctgcagtctgagagg

SEQ ID NO: 30709 - DNA, 201 bp, Bos taurus
attacataatgtttggggataattggccagaaaatatgtgaaagtacttagagaaggtgactcaggcaagacctatagttcctacatacacacttgacttracactgtggccaatcatacgagattgacctgaaaaatttgtcttgggttcatagctgtctgtctcaatttaaggaaggaggaaacagattaaatgtcatt

SEQ ID NO: 30710 - DNA, 201 bp, Bos taurus
ccatcaggacacaactgtttgctttttccacatcctcactacttgttatcttttttttgtttttttccgaccagggacaggtcatgatagaaaaaaatcaraataagagcaaatattctattttgagaacagctgagaaagcatttttgactattacaattatttaacaaaaaagttcagtaagaaaatgtacacaaccca

SEQ ID NO: 30711 - DNA, 201 bp, Bos taurus
atatctggtgactaaaagcccttggtgcctgaccaaggtgaaacacagcagagctggtcggaatcttccatctgagtagggccagtgatggacaggctgcygtcagaatggaaacaaaccctggcttatgtggaaaagtgacttactgaacagacactgggtagctcacgggaccaaccagaggccgagagccaggcttgt

SEQ ID NO: 30712 - DNA, 201 bp, Bos taurus
atgaggcccacctgcattgtggaaggtagcctgctttactcaaagtccacttatttaaatgttgatctcatccaaaaacacccccatagaaataatctttractaaatgtctgggcactaaggccagtcaagttgacacataacactaactatcacaaccactttcaactctattaggcgtttaatctggtactcacgtcc

SEQ ID NO: 30713 - DNA, 201 bp, Bos taurus
aagtcagataatcgatactctgtttagaaccacctaatgacttcttgctactcttagaatataattcagacttctaaacagggcctagcaagccctacatrttccagctctgaccatctcggacccaaactcacccacccttccccctctcaaactatgttctgcccacaagtccatctttctcatctctaataggccaaa

SEQ ID NO: 30714 - DNA, 201 bp, Bos taurus
gtatgactaaagcaaagtaagtgaggaagaaacaatggaagactagtcatggagctggaaggagccagggcatggaaggcactacaaacaaaggtatcccrctcagcactggccgcacacttttatctgtcttcaagcccagaaaaccatcagtcattgtctctgcaaacacgtctcatctgcccccgctccttctctttt

SEQ ID NO: 30715 - DNA, 201 bp, Bos taurus
tataaatattcttataaattatataaaatttctaaaattggatatgttctggtataatgctaccagtcataattctaattatgatcttaaaatgttgtacrttatagcaataactaagtttttttgtcaattgcattgtaatcagatctctgctgctgctgctaagtcacttcagtcgtgtctgactctgtgggaccccat

SEQ ID NO: 30716 - DNA, 201 bp, Bos taurus
gtagattctttaccatcagagccactagggaagcccaagaatgctggagtgggtatcctaagccttctccaagggatcttcctgacccaggaatgaaaccrgggtctgcttttgtgttaggccttatttatatatacttttcagcatgggaactttagaggctttttggtaacaaccttttaaattcccagcgctatcttg

SEQ ID NO: 30717 - DNA, 201 bp, Bos taurus
tttccttttctgttttacagtacttagattaaggctctactatcatttctttatgtctttatgtttgctggcattaatctaccttcgttgttgttcttgaycagaataattttgtatggtctattacaattttcataggaattgtatagaatctatttgaaaaagcttcccatattatttttcttattcagacaaactttt

SEQ ID NO: 30718 - DNA, 201 bp, Bos taurus
tcaaaagacgcaagggacggagtcactgcgggggccgtatacatacaaccaaaggaatgttacagagaaaagcgtgttcagattctgaggccaatgtctcygaggcttacacatttattaccgcgagttagtttagccggtagtatgtggaaaaagaggtgtaggaggataggtggccaagatattagagacctctccctg

SEQ ID NO: 30719 - DNA, 201 bp, Bos taurus
gatagtatataatacataaaaaatatcctggctactgaaggaaacttaggtgtaatcttctctgtgaatcattatgttttaaaatgttaaatttatagttraccttgattcagcactgaattagtcattccttacttatgcagggtattacatcaggaattcctcggtctgtgtccaaccctgtgagcagccaactgaagt

SEQ ID NO: 30720 - DNA, 201 bp, Bos taurus
tggctgataagatcaaagcattccctctgccaaatcattaccttattttcgaggcaattatagaacttattgtatcaattagtctggtctccagctgcagmcgtttatctctgtctctcctggtgcgcttgccgaagaaaggggtctgcccagccccgcgcagccagccaggccggcgaggggagggcggccagtagggcc

SEQ ID NO: 30721 - DNA, 201 bp, Bos taurus
gtattataagacggtttcagctaagatcaaaataaataacatgatctgactcaacggtttgactcttgagctcctggacgaaatctgatggaatgtcaaaygcagagactccctcctaggcactagctgctggtaggcaaaagtatctcaacatccttgccattggcaacaacagcattagaagagcagctgctgccaagg

SEQ ID NO: 30722 - DNA, 201 bp, Bos taurus
tggatcagtcttctagacagcaaagtggcagagcactagaatcaggagatgaaacggccacagccggagaaaggccacattcagatgtgcaggagcaaacrgtggaggccaggcctccacaggggacaccactgaggaactgcgcagcccctccagacttggagtacatcctgtctcaccctggctgtgctctacagtgaa

SEQ ID NO: 30723 - DNA, 201 bp, Bos taurus
aacgaagataatgcacacgacaaaattatgaaacacactgtaagacacacacactgtcctaaaaattcttctgtcagatgtctgagatcatgacctacacmagctctgtttccctctactttggaaacgtagctatgtagtcaaacatttgaaaccaaaccaacccatagctaaaataagatactaattcttcacctatgt

SEQ ID NO: 30724 - DNA, 201 bp, Bos taurus
gcgtggtgaggactacaggcacctcactaggcacagagggaatttatgaatatataaaacattttcttctggccagtttaagttctgcctgggaaattaawggctgctttcactgcaaaatctatttactgtcactggggagaccagtgatttcctttagccttcgctgtgtagatcaaggtcaagtctagcgtcaggggg

SEQ ID NO: 30725 - DNA, 201 bp, Bos taurus
tagttaatgtgggcaggttcctggggggagccaggcctgttgacttgtggtccctatttcattcggggatgatcagacctgagtgtgtgcctatctaagayataagccttaaagataaggccattacctctgtctctgtttcttacagaggagacactgaataagcattgattgaatactttacatcactatctcattgaa

SEQ ID NO: 30726 - DNA, 201 bp, Bos taurus
ctcaccatctcccagagtttgcccaagctcatgtactagtcatcattgttcatgttttgcttgaatatgatatcaattacaaataaccctgttgcttaacratcaacttaaaagacatatcagaaatcaatggcttttcccctggagccttcactctgtcactctgagccttgaagagaagggccttcagaggcatgaatc

SEQ ID NO: 30727 - DNA, 201 bp, Bos taurus
cctggcagaccccaggctgtcaggcctgaccaccacttcttgctctttcttgggcaaggtgctgagtgtgggaagttctttactcagccaaggcctccttrgcttcagggacggtcggtcagtcttccactgtccgttagcactgctggctctggagagcctggccaccagggaagcctggccagggccccaaacccctac

SEQ ID NO: 30728 - DNA, 201 bp, Bos taurus
aacttcatggcaaactttattccctgatcctttattcctaaacacatggtcctcagggtatctgatccaaatggcttactctgatgactggcaggccaagrtagtaaacacaggagacctagaacctcttcagattatctagttatctaattgaccctgataggagcatctccatcatggccagcttggggtctctgtcag

SEQ ID NO: 30729 - DNA, 201 bp, Bos taurus
agatgctttgagcattctgaaacatagcttgggagacacaggagaaactaatgattgtccgagagggctgggctacaagatgagagaaaccatacatcctytcatggtgtgcacatgcctcagtgttcattcatacagctacaagtttcacagcaatcccctcaggctgcaataagactaaactgaatccaccctgcaatt

SEQ ID NO: 30730 - DNA, 201 bp, Bos taurus
cactttcagatcctgtgcagcccttttccctgttcacctatcctgagtgtggaccacaaggctggtgtgaacacccttgccagaggatctgtgtatgcgcrtgcgtgtgtgtgtgcacgcgcactggggtggagtgaagacaaactttggatgcaaaagccgagatgtctgtgttgcaggaagggggagcccttccagggc

SEQ ID NO: 30731 - DNA, 201 bp, Bos taurus
tgaaataatcactagacaggtcacctccaagagatgcattgaaagaatatcatcctttgcccacaaatctgatggccaaggaaaccactggcccacccaaratgtgtgcagccaatacccaaatctctgaaattgggaatttctgcaaactcttccaaagggatttggccattcctgggccttgtcacatcaccttggggc

SEQ ID NO: 30732 - DNA, 201 bp, Bos taurus
tgggctcatttcaccatctctggagcccattgctccaaacaaaaattacctgagagcagacttgattaagcaggataaggaactcagaacaatcagaaagrgggttgctgaccagggaaccccaggtaacagtatagaaatgtggactataacgaaagcattaagacatggtcctgggttctggcccatggggaactgcag

SEQ ID NO: 30733 - DNA, 201 bp, Bos taurus
tctagccctatcctatacctgtgttcctcccctcattctattgtattccaacaaccctgatcttccagttatagaataagctctcgttttaccttaagcartagggatctttgcaaatgttcccactgctagccccttccttccctcctcaccccattcacttctatctttacttcaatacttcctccaagttatctctca

SEQ ID NO: 30734 - DNA, 201 bp, Bos taurus
atcacacaacttgtaattgtgagtcactggctgatccatcttataaagtcgttaaacccctcgtcttataacacgggcctctaatccctccactggtaatkcaggtgtgagcttgcagctgttatatgtcaccactgctcttagttgttaaaaacatgtcaagagttttgttttgaggtgttgggggttttttgtttgttt

SEQ ID NO: 30735 - DNA, 201 bp, Bos taurus
gcatcccggatgccttctggtgggcagtcgtctccatgacaactgtaggctatggagacatggttccgactaccattgggggaaagatcgtgggttccctrtgtgcaattgcaggtgttttaaccattgccttaccggtccctgtcatagtgtccaatttcaactacttctaccaccgggagacagagggagaggagcagg

SEQ ID NO: 30736 - DNA, 201 bp, Bos taurus
ctctttgcaatccaagggactctcaaaagtcttctccagcaccacaatatgaaaatttcccagtcctgcagggcaccaaatccagcctgtggagtggcccygaagggcagacctcttttgcttacaagcatctctactgggctgcagcacaacctttgcagaacttgccctaggaaaaaggcctgtgggtgaccactccct

SEQ ID NO: 30737 - DNA, 201 bp, Bos taurus
cagctgggggcaaccggcccctggccctgctccagcaggtggtggtaatagagccagaggtcagagtagagagcaaggagatcaggttcttggcaagaacmaaactggactgcatcactgggcctgcacacagggagaaaagggtcacagacacatccaggtgggggaggggcagggtgactggggcatcaaacctcaaga

SEQ ID NO: 30738 - DNA, 201 bp, Bos taurus
gaagaagatgggaggagtccaggggtctttaatgcaggacagaggaactgcaacggctcaccggagagagatctcagaaggccggaaacctggaaaacacrttggaaaatactgctggcacatgtggaagtccccacccttgtcccctcctgaccacaaagggatccctgtgagtgacatactggccagtcctccagtctt

SEQ ID NO: 30739 - DNA, 201 bp, Bos taurus
tggtaaagggtgccttcactgggggctggggggacttgccaggaaatgtgggctctttccccagggctgccccaaagctgacctgggcctcaggctgcccrggcacagctcaccccctaagaactttagctcctcattcagggggtcatcagacacccacctaggccctgcccagaccccagtcctaccgcaccaacccct

SEQ ID NO: 30740 - DNA, 201 bp, Bos taurus
actctatccctaggaagcagcagggccagttggacaattcagatggtcaggaggaaaaaagataagacatagcaggtgtggttaaagcttaattggtgatyggcaatgctgggcagggcccacgctgggagagcaaggcctgcacactaggcctattctggtcttcagggcagtgctgggggctcaggcttgagctctcca

SEQ ID NO: 30741 - DNA, 201 bp, Bos taurus
gacaaagcagtaaactaaagtgttttcagtcccactctttttgtgtgtttacttcagaaaagagggtgagcactgtagctcagggcccaggaagaagtgasggacgtgtgactggctgtcacctgctgcccacagtgcttgctaaggaaaccaacagtcctccgcctctgtgagctgcccagggtgtcctgcggaggcctg

SEQ ID NO: 30742 - DNA, 201 bp, Bos taurus
tgatgctcttggcatttggggccagatgccctatctgatgccagatgcttgtggccctctctttttttgggacactgtcccatgtattgtaggatgtttgrcagcacccctgacttctacctactacaatgccaatacaatgtcagtagcacccaaccctgacttgtgataatgaacaatgtctccagatattaccaaatg

SEQ ID NO: 30743 - DNA, 201 bp, Bos taurus
gcaaggccaacaagatgaggttttgagcctccttttcaattgccaccctcttttttcagaaaaccctaaagtcatatccgcctgttctcaactccttggtygcttgccaagatggccacaggagaggaacacatcacacaacacttcttctgttcttcatgcccctcctccacccaaaccgccaaagttgaacagagggca

SEQ ID NO: 30744 - DNA, 201 bp, Bos taurus
ggcagcaccacccactgccctgatgttgtggggttctgggggccagagatggaaaagcctgggtagctctccaccctgagccccagacagagccccactgrgctgacatctcctttgggcctagacttccagctactcatcacccacttggctcatggcattaaatccagtgcctgccacacccccgggccacacactcac

SEQ ID NO: 30745 - DNA, 201 bp, Bos taurus
tggtgtctgtgggatgcaggagagggaggcggatacctgagacgatattcacgatgtggtaagggatccccagagactggtagaactcctccgcggtggcratcatctcctcaaacatctcccaggacttgttgtcgtgtggcgaggagtagacaaactgctctatctgcaaggacagatccgaggagacagggatgatgg

SEQ ID NO: 30746 - DNA, 201 bp, Bos taurus
agactggcttctaggtcatccctttcttttcttccacgggcctggtctgctttcttcttagttctgcctgcttttgcttctcctaagtaggaattactctyttcttttttaggacttattcttaatgtactccttcctacttttagaagtgttctaggagtcccttccctttttttttctttcttttgttgtttacatatt

SEQ ID NO: 30747 - DNA, 201 bp, Bos taurus
ctgtttttatattaaaaaaaaaaaaaagaaaatgtgtgttaccctccctttgtgactagcaaactgctgccagtcttaaaggaaattacaacctaggatgwcaatggcattatgaggaatgttccaattagataagatcatttaaaaagtgtacttaaaagcaagggcttccaaatcaaacaaatagaattggatacctat

SEQ ID NO: 30748 - DNA, 201 bp, Bos taurus
gtgaaggggttgctgagaaataacattttgagagtattcatattaatggttcactggtgatcttggtgcatgaattggagctgtgtcactactctctgaaycctgtggttagttagctaagatatttaatatctttactcctttggactgtgcatcaatacatttgttttctgctttggaaccagatatccttccctaact

SEQ ID NO: 30749 - DNA, 201 bp, Bos taurus
tgtctagtttggatatcaaggttatactgtttttagaaagactaacagtgttctacttttccagttacctatataattttacagaaggttggaatcagttytttttaaatgtttgggagatcacactgtaaaatccccttggccaggtattttctcagtggaaggattttaaataatggaccaaatttctctatggtttta

SEQ ID NO: 30750 - DNA, 201 bp, Bos taurus
aacactgtttaaaggagatactaactatggctagtatattttcatatttaaatttcaaatgatcagagttaaacacatgtttaaataaatattaaaattayccactaagaaagcagcagtcttacctgtaacgaacatgaaaagaatggtcttctctcatgtttatcaaattttcctccatcgagtcatattataagctgg

SEQ ID NO: 30751 - DNA, 201 bp, Bos taurus
cagggaatagatgtcagcatggtgagcactttgctgttcatccctattaggggatgactgagctgtttcctcagggccaggtgaggtgctggctgcgtttrctcaaagtgttcactcggagggtgatttgtgagctattgctgagcacataatggttaggatagctgcaaaagcagccatggccccacacaggttcacctg

SEQ ID NO: 30752 - DNA, 201 bp, Bos taurus
ctcttagctcatccgtgtgcacaaggaaagcaacccaactccagatgatagttcaattgtgattagtctaagctgaccatggccatccattcctactgccyatgactagtttgggagggggcatatgatccagctgtcgccaatcagaggtacagggaaatcctctggcggccatctaggaagttttctcacttaaaaaag

SEQ ID NO: 30753 - DNA, 201 bp, Bos taurus
ccagttcctatgctcagttattccttctctttgtcatttttttatagtatgctatgttgatattaactgaaataatagcctgacagatgacagcaccctcratgtgatttttgtagataagttctttaggacaatgtcattaccagcttctgtgctggtaactttccctacttggaaactccacatttcttgactgttgag

SEQ ID NO: 30754 - DNA, 201 bp, Bos taurus
gcctgtgatgagagagaggcatttttggcttcttgttttttcccatctaggattcattttctctagcttgccaactccatcagagtcccagtagaatagaraggcaaggaaagggccagcaggccagttcttacctaagaccacggtgagcagcacttgagttttctgccctgacatcttgtgaagctctttctttctctt

SEQ ID NO: 30755 - DNA, 201 bp, Bos taurus
ctgataaatatctcaatgtttttataatacatacaataagtgtgaaagtctgtcttcagggtgtttgtacttttgagtaacgcataaatgacaatattaakgtactagattaactcttttttcactcataaaattatgggatgagtaaaatttcaggctactgaaaaaattcattgttcattatgaatttaaattgttttc

SEQ ID NO: 30756 - DNA, 201 bp, Bos taurus
tttcattataacttctttcaaacaatgagttgccattgagctataaaaatgttctctgttcagtctttgcattgaagggatccattttcacagccttttckttgttgttgttttttcctctttttcttgccttgaaagttctataaaattatcttcaagtgaaatgaatataaagtaggaagttggtcatttagggtctgt

SEQ ID NO: 30757 - DNA, 201 bp, Bos taurus
ctcgtgggctaggacttctcaaataggatagattcaggacctttacctcagaattatgtaaactgtgattgtgttttagaaaagttacttgctaaaaccarttaagtttttgtatatgtgtaaatgatcatgaaattgagttttataagatgttctgtatagtgaagttacacactcaaggtgtctcttggagtggattct

SEQ ID NO: 30758 - DNA, 201 bp, Bos taurus
gtaaaacactgcatgctttttgccttttttcccctgttgtttaacttcaaaaggccatcaggctatttttctgtgactgtttcatgaggactgttaacatrtgaattaactgaatttgtaggtctttataaagaggaagctgtagacactgctcatttctgcccatgtcacaaatgatacctattttttagttttaagcca

SEQ ID NO: 30759 - DNA, 201 bp, Bos taurus
aactcccagagttcactcaaactcatgtccattgagtcggtgatgccatccagccatctcatcctctgtcgtccggttctcctcctgcccccattaatttyggggccaagtgaggaaagcttattcaaagtcagagctggtgaaaattaattttagtcactcaaaaagagaggatatggggaaaagactttagataaacgg

SEQ ID NO: 30760 - DNA, 201 bp, Bos taurus
aggcctgacgtgctgcaattcatggagtcgcaaagagtaggacacgactgagcgactgaactgaactgagggcaggggatgcagctcagaatgaaggcctygcattttaattgcagattcatctcttccaagatctctgatcttaagctggtttattttggcttctgtagaaaatggagataatgttaatacttacctgag

SEQ ID NO: 30761 - DNA, 201 bp, Bos taurus
ccattctggggagagaactggaaggccataaaacagtacataaggtagaacaagctaggacgagtactcttaattcatctggcattaccaatacgtgatcygaagacctggcctgtggcacggatatcaacaactctgggcatgggtattctttttctcagtcaaactacacaggcaacccatcaaactgctgaccagaag

SEQ ID NO: 30762 - DNA, 201 bp, Bos taurus
cctgcttgcagtagggcttaagcagagatcccagccagcagttctgcaaaattgcagaaccaagccaatgacccaatcaggtcagggagctcagcttgccrtttggcctgatttggatcgccaccaccaggccatgctggccatggagcacatactattccctggtaggagagcagattcacagcccaacttctgattata

SEQ ID NO: 30763 - DNA, 201 bp, Bos taurus
ggcagctgcctttgcttataacacctttctaaaaggacaggccacgtaaggtttgctgctcccagaaacttctttgtcatcgatgtttgtcaacttctttkatttcatagatgtttgcctggcctactggataaaagatattcaaaatttgctttaagaaatttaaaaatttgaggtgaaatatggtcataagttagactg

SEQ ID NO: 30764 - DNA, 201 bp, Bos taurus
aatgaagactacaaaacggtttattaaatatgtttcatttgcttcagttttcttttcaaaaagtaaaacccagttgtctgctttgtattgattaaggaaartaaatttcctgtcaaatgttaaatatgtttatataaattaactcttcctataagataatattcagaaaagtttacaaggaaccaaacttctatattcaga

SEQ ID NO: 30765 - DNA, 201 bp, Bos taurus
tcctctcatatcccttttctcctccttccccttaaggaaattatcctaaaaatgtttggtaactgtttcctcctcacaactcagtcaccctggtttagtcyttggagaagaggacatgttattgaacatatgattacaaaatcttaacacagaagctgaaagaattcaatctgattcacagtttccaaattaaatattgca

SEQ ID NO: 30766 - DNA, 201 bp, Bos taurus
acaatgtgttcaatccctggccaaccctactctttgaaaagcagttacattaacagttactgcagggcatctaagtggatgctgtgcagtaaatagaagasggatggaccacagcaaacatggccttaaagtgaaactggatcagaacactttgacaagtcacttctaagaatgatgcatcactgtttttataagtctgga

SEQ ID NO: 30767 - DNA, 201 bp, Bos taurus
taatgaaaaagtatttacatctcaacttggtctttggcagagtacactcctttagtggaaaaaggagttatgtcaggcctctttctttccaaaatttgttmttctatactctgtcattcacattgcaaactctggtttctacttcttcataattcagagagaaaaaaatgaggatgcttactgggggccagaaaagttctt

SEQ ID NO: 30768 - DNA, 201 bp, Bos taurus
tctatcttcaggacaataatagccagtgagtacttaagtgtaagtgatttttgccttcttgacacagaatgatataagtgaaaaaataatgcaaactaggratagtataattttctatgtaaaaagtttataatatatatgcactacagaaatgtctcctctcatatctcagcaaatatataaattaaaatgttacgatat

SEQ ID NO: 30769 - DNA, 201 bp, Bos taurus
caataacagaagattaagtggataccaacaatagaaatttatttctcatagttttggagtccaagaagtccaagaacaagatataggtagatactcataaytgaatcaattcccacaggcctaccacaaatatcatcatagtctgcaggttgtctcagtatatgaatttggggtgaacacaaacattcaatgtatagaaac

SEQ ID NO: 30770 - DNA, 201 bp, Bos taurus
ctttatccctgttggttttggaccaaggcttggccccaatcatgttgcttcttggtgacacagtaaccaaaactctaatatagaaccaattttctagccargaaaagtgaaaagatggcccctgcatggcaaggaatgtgggtaaaactctgagagagatagcaagctgaaaaagatcttttaaatatgtatataaatcta

SEQ ID NO: 30771 - DNA, 201 bp, Bos taurus
atatcccaaatcacacccaacctttattctctgctgatggcctagcctcatgcttcgttcaaaaaccaatagccattttattggtttctcaagaaagaaasaaagtaaaagcaatcataggccatcaccataggccatctgatggcctgtatgctagcacagtcaatggttacataattattactatcttactcaacttca

SEQ ID NO: 30772 - DNA, 201 bp, Bos taurus
atgcaaatcattctgaaccattcaaaaatagagaacaaatttttgtgacatcagtgaaatgatcctatccttgctttatgtacagaactctgtgtgcgtgrtggggggtgtttgagtgtgtgtgtgttacgtattccagttgaggcagttttagcataaggttaagaataaagttcaagcgtcagactgcatgggttttaa

SEQ ID NO: 30773 - DNA, 201 bp, Bos taurus
gtagttttaattcaaaattttccattttaagggaagataatattatacaataagcaggacctgtatttgactaatggaatggtagtcattcttctggacaytcatataccacatttcaggagtccattaagtagaagagaactgtcactcatcatagtctttcaggtttccaagtttgataacattattaaaagcgtccat

SEQ ID NO: 30774 - DNA, 201 bp, Bos taurus
taagcaataaaatgtttaaatcagtctgtttctcctttaagatccatgaaggtcaacccatggggactgcaccttgtgtttctaaaacaactctgcttcarttaatcaggcctagaagaatgttcctgacttactacaagctgtctgtgcttcttaacttttgccagtttctgctggaatctgcctctgaaccatgacaca

SEQ ID NO: 30775 - DNA, 201 bp, Bos taurus
ttgttcatgggattattcagtgctatgcttttacagcatatagagaaaggggctgtcatctcctttaatatctttaaaatccagaagcttcttagtccatmctcaaatgaagcaaggagggatatcagtcctttgatgaggagctatgtgaatgcaacattaaaaatttattttcggagtcttggactgccttatgaagtc

SEQ ID NO: 30776 - DNA, 201 bp, Bos taurus
tagctcgagtcccatgagcataattcacgtaagataatcaataatgattgcttagccacaatttcattgattagaatattctgataatggtctactcaagsgtaaaaaactgtatgctatagttttaaaacatattatattatagccttctgattggaaagtttgagctttaattatgctttgatttgaagcctttgaggg

SEQ ID NO: 30777 - DNA, 201 bp, Bos taurus
cctaggttggccatgactaaagtgacttagaacacaggcaccatagttgatttacattacattagtttcagctgtatgcaaagtgattcagttctacataygtgtgtgtgtctacatacatatattcctcagtttcttttccatacttttttattcttggtttgcaatttaatacagtttccaaagagaattcctttagat

SEQ ID NO: 30778 - DNA, 201 bp, Bos taurus
ttgcaagaagtaaactaagattaggagagaagaaatactatatgatataaccataattgggttgtttgtgatatttacagaggagtttcactgcaatggcraagactataatcattccgtaaaaggttgaagtatgaatgaaacactctattagattgttttttccaaaagtgagcacagcaatatttctgatattaagtt

SEQ ID NO: 30779 - DNA, 201 bp, Bos taurus
ggtggggtcctaatgactacatctgattaatttggccactttacttttccagaaacctgtattgtagatagctgagtctggggaccaagttgtagcaaggrtttgtgcagcaaagctgcatatattttagatgaaatttattagaaattgatgccaaatgtgggtgatggaccttgtaaactccagtttgaaacgctggat

SEQ ID NO: 30780 - DNA, 201 bp, Bos taurus
taaattgcccaccagttgcctggaaggactttgaagggtaaatgtctgatatgaagtagcctcagaaaggtgatagcattatcatcctagtatcttgccaycagtaaaccagcaacatcaatagttgaccatttacttagtgaataaacttagtgggttaaagaaataaaaagctggggacattggagacagatacttatt

SEQ ID NO: 30781 - DNA, 201 bp, Bos taurus
tggcaagcggcttgtttcttcctaataaagaccagatttttgaagcttgagttctgatgtctaatgatatatgggtgagtacagggagagagatttgaagratgtcagagaaattagaagatgaagtttgaaaggtttgtcttctaaatcataaacatctttgttcctttttcctctcacatctaaagcaagggtcataga

SEQ ID NO: 30782 - DNA, 201 bp, Bos taurus
atgtaataaacacaatgatagacatatgaagaaagtacaaaagacacacagaagggaagcacctaattttgtcctgagcatgtagcaggtgctgtcattgycccttagccctcatcattcctttatctgctgacaggttcttactgcaagtacttgtgattttctgcctctggtctttctctgatcatctttctttgagca

SEQ ID NO: 30783 - DNA, 201 bp, Bos taurus
ctccaaatagttttgttattggtagcacctctgcttgaactgggaggaagtgttgcattctctaattcagttcaattctctaaatattgattgagcatctmacatgggctcaggcaaggttgacctgacttgaaactggagaaaaggactgcttacgcgcttctttcaagtagagcaaggaaggttactggatcctaaata

SEQ ID NO: 30784 - DNA, 201 bp, Bos taurus
taaaccctttgttgggaggagacaagaaccaagggagagaaataaaccaacctgacatcttgaaaggcgttaagaatatcagtagatattctgggcccatytcttccttttacagggtaaacttgatataatcaggagtcttgatatttttgcttgatggatttacaggcccacttctgactgttaattctagagactgat

SEQ ID NO: 30785 - DNA, 201 bp, Bos taurus
attgaatgtgggaggcaaagaaagggaattgagaaagaatgttcacctttcagacacagataactagagtacctggaggataagcatattttgaagtaaarataatgagttgatttttgatcatgttagttggccctgactcaactattcaagtgatgtctacagattagttggatggttaagactgactcacagggaatg

SEQ ID NO: 30786 - DNA, 201 bp, Bos taurus
acagagggagcatacggaaatatattacccagtgaatattaggtttattctagaaccaccctgctctaagctcactcttcacattgcctatctactatgtrcttgacatgagatgatgaaatgggcctctaatgctatataatagtttataaagttttttttacttgtgtttctcacattcacaaaatatgcttgagaagt

SEQ ID NO: 30787 - DNA, 201 bp, Bos taurus
tggggaaggctgagcctgagataattacatcccagctcccccggccaaaagaaattattgcacatagccaacagtgactgagagttgggatcaaaagctcrttgaagttcctgacctgaaggccagctagacttagcatgcgccgtaggtcctgaatatcgctgttgaatacaagagaggtgaatgtggatgtggagaaaa

SEQ ID NO: 30788 - DNA, 201 bp, Bos taurus
tcagagtgtggacttccatcatgccttctgaatgggcacctgaccacataatcagtccctcagtcatagctgattggattaggatgggcccttgccccaakggggaacaatcagattctgtcttatacgaaattggggttcactatttctaggctcaccttcattggcatttaaactgaaaagtcctgagggctgcctggg

SEQ ID NO: 30789 - DNA, 201 bp, Bos taurus
gtcatttactctgtgcctgtggttatagtaaaaaccaagattgaaacggggctcaaagaaaagtacttccaagtgtgcctagtaggtagtaaaatgttcartaaatgttacccattgttattgttgtttttgatggaagtgcacccaaattcagaaattcttgaacaaaccagagttagccggaggaagggtatagaaatc

SEQ ID NO: 30790 - DNA, 201 bp, Bos taurus
gttaataatgggtgttgtcagcctgggctgggaggctttgcagcgagaaggaaggaaactcagaccagaccagaaaatgggccaattgcagtcccagtcarcacagcgccggctcggctcagccgtgcggtgggtggctttggagcctgtgcagttacaagtggcgctgttttgcttttcctttcccacgccttccctccg

SEQ ID NO: 30791 - DNA, 201 bp, Bos taurus
gaaaaataggccactcaaacattaaatgtaagtaacagagcatttaaaaatttggtttttagaagcaggacaaagaattcattcattcatttgttgagttyctactaggagtatggtagctcctactaacactgtgctaagtatgtcctagaataaacccagaaaagactaggatcccccaagatagggagggtaggggta

SEQ ID NO: 30792 - DNA, 201 bp, Bos taurus
aataactcacccatggatacaaaaaacaactgcgaatttgaatgattcagtaaagtatttttctctgaaaacaaacaacaaaaaaacaattgataaaaagmgctactcagcttatgaatgaatgtaactccaataaaaatttacttttatgtttaataatgatgtatcataatgaatttgtaatacatgcctgttgtttgt

SEQ ID NO: 30793 - DNA, 201 bp, Bos taurus
ggccttccttctgctggaaatgcacctgaggatctgaagttagtcttctttgaattttctttcttaacgattgccttttcttcatgaggctaccattactrctttggccaaagaggacatctttggcactaaagaaatgtgtgtggcttcaaagtgtattggtttctacatgggctttcctgagagctcatgggatgaagt

SEQ ID NO: 30794 - DNA, 201 bp, Bos taurus
agggttttttaaattttcttgaaattgaactatccgtgtgttcctacaaaacatgaaagttccattctccaagtgataggatttttaaggaaactaaaatrtccacttgcaattattaagaaacgatcagtgactcaatcactaatgaatacaatcatctttaattctaaaagaaataaaatgttaaaatgatttacatat

SEQ ID NO: 30795 - DNA, 201 bp, Bos taurus
cttatcccaaccttagggatcagggaagtatctattagaggtcacctggtatgaatcttgaaggatgtaagagaaaactagggtggagaatccttggtaakgggtataggctgcacaaacaatgggttaataaataggatttgccagacatctttgtccatcctggctcataggttttaaagctcatacaatcagtgattt

SEQ ID NO: 30796 - DNA, 201 bp, Bos taurus
atgcttgaaggccttcatatttaacttgaaagcaataccccagaacaagaaaatcatccccataaggactggtcatgactctctttaagaactgatttccrgttttatcttattacatcctctgtgttgtttaaaatcctgtattaaatattaccttattaaaatattcagtatttttgcagccataaaaagctaccatag

SEQ ID NO: 30797 - DNA, 201 bp, Bos taurus
ggaatgaggaggccagagctgagacaaaattttctttggaggagtatctggatggcatatcaccatgttcaccatagtacataaataatattaatctacakataaacattttccaggatatatatcaaattttataaaaatatcacccttgcattctattcagggcatgaataaacactttaaattttattttgacaatct

SEQ ID NO: 30798 - DNA, 201 bp, Bos taurus
aaagtatcaattcttcagcgctctgctttctttatagtccaactcgcaaagactatatctgtatatatatcctttataaggtatttttgtaaatatacccyttacagataaagaaactgaattaaagaattaaggatgaactatccaagatgatccagtctgtaaggatttgaacccaaagtcactgaaattcaaaactca

SEQ ID NO: 30799 - DNA, 201 bp, Bos taurus
aaccattagcaatcatggacaatctacttcagcaatttgttcttgcaacaaaaaagattcttgtggacatgttttctcttcttcaaaggttaagatgccayctttcatatctgccactggcaggtaatgcagatagtaacccgccgtctttgccttgagctcctcagaggaaaatgtgttatgtgaatgcactgtgctacc

SEQ ID NO: 30800 - DNA, 201 bp, Bos taurus
ctccttttataggggcaataattttaagagacagctgggaatatctgtgatagcattgtgttccctaatagcaataggatctggaaatggcagaggccagktggcagcacataaccagtagaagggaggtagaagggaggtaaaaaaagtagcaggttcagaatatcagcaaggcctaacccacatgaatatatggaaata

SEQ ID NO: 30801 - DNA, 201 bp, Bos taurus
catgatacaaaatttgcatgatatttttctccaacctctccaagctacaacagctagtacttttgattttatcactttagcaacttacaaacttttcaagytccataattaatcatccgtatcccaaatctacatcaccagattactgctattctcttatctccttcaaaagctttgacaaaataagaatgatctctgtac

SEQ ID NO: 30802 - DNA, 201 bp, Bos taurus
cttacaactgtatgtgatacataagaaaaagattatgtctattttgcaaatagagctattgattgaaaaaaggtcaattcattgtccatgtcactctccarattaatagtaagacctgattagaaatggagctattgtctccgcatgcaaaagataccatactgaacacataagaaatttaatagcaaactctgttctata

SEQ ID NO: 30803 - DNA, 201 bp, Bos taurus
gtcatatgggatgcaggggtagaagggtagggggagagtgggtgaattcatatgaaaaaaaaaaacaatgttaccgctgaaaccaggaaaggccagggatygtggtagcatacctagcagatgaatggatttatccaaatgtaggaaaatgaagaaaataatgtgagatgaccctggaaagaagactagggccacacactc

SEQ ID NO: 30804 - DNA, 201 bp, Bos taurus
gagatgtaaaacatatcattacaggccttttagaaaattcaaatgtaaccatcccttctatgaaaaatatattattttccacttgctatcaagaaccccayttgaaaaaagaaagaatcccatccagagttatcctccagccttagcttttgggccactttgtgttcttttaactttcttctcagaagagagggaaaaacc

SEQ ID NO: 30805 - DNA, 201 bp, Bos taurus
accaagggcccaaacagaacaaaaaggcaaaggaaggaagaattttctttgtcgtcttaagctgggacctccatcttctgttcttggacatcggaactctyggtttttgagccaacaccagtggcctcctcggttttcgggtctttggacatagactaaatgttactactccctttcttgatccaccatcttccagcaggt

SEQ ID NO: 30806 - DNA, 201 bp, Bos taurus
agttccatgagctgcggccttgtctatttggttctctcccggccctgacacactggagagctcaataaacattttggaatgaatgaaagcagtaagtcagkgattgaatacatgtgagtgaaggcctagttgaggacaaggtagaatgtgtttgggaaataggtaatcgttactagagtgtacatgataacaggttggaaa

SEQ ID NO: 30807 - DNA, 201 bp, Bos taurus
gggggctaatttttgtgagttaaatatttagagtctggagaaattaacataactggagaagcataggtaaggtactgatagccaagaaactccaaaagctrggaaggcaatcatagagaaccccaggtctatagtgcctaacatcagtcaacactcctgtcaattttttttccctcatcaaggcaatctttcaggaatgat

SEQ ID NO: 30808 - DNA, 201 bp, Bos taurus
ggggcctggattcaatccctggtcaaggaactagatcccacatggcacaacttacagatcccatatgccacaactaagatcgaagctcccacatgtcccartaagacctggtgtggccaaaaataaataaatattctttaaaaagatgtcactgaaacatgattacaatctctacttggacgcctccagtaatgggacgct

SEQ ID NO: 30809 - DNA, 201 bp, Bos taurus
ggccatcccacccactcacaaggctctgaacagagtatcaatgcctttgcctgtatagagcagtcctgaaggttttacagcagcatggtagctccctggamtctgacaggccacagtaactttctcaaagaaggagttagtcgtatctggaggatgatgcagataaaaatggtggcaagtgaattattttgttatggaagg

SEQ ID NO: 30810 - DNA, 201 bp, Bos taurus
aggaacttcagaggactgacagttgtagatgcagcttcattaagatgacagataatcaagctaaacagacacctacaacttctagaagaggagaccaaagracatgctaaaagagaaatggcactcaattactacagcattctaactgcttaatagctggctctggttttgctgctagaggtaacctcaactctcagaaat

SEQ ID NO: 30811 - DNA, 201 bp, Bos taurus
acaacactaaaaagtttctaagtgttgaacatatctgaatcatcttaaacacatttgtatctagtgataaatgtgataaaatttggctttgtatgtctccraaatacagaaatagttcaatagaaatatctacaaaacttctgtttggacttgggatctcataaattggtatacaattcaatcatttcttagtcatttttt

SEQ ID NO: 30812 - DNA, 201 bp, Bos taurus
aagatttgttgttgttttaataggagagtgacatggtcagatttgtgctttgggtcgctctctcagggaagtggaacaggatgggctaaaatatagaagayagcacagtaatgagagtaggcaacaaacagaaaagttgcaaatttgtgcaagaaatgaaacggatatgaaccagagttgaagctatgagaacacagaggg

SEQ ID NO: 30813 - DNA, 201 bp, Bos taurus
ctccatttcacaaccagcctcgcatcttcacaaatgtggtgttgcggctgtttcacttgtttggacacatgttaacaggcaggaagatgagttcaatgackccggacaaagcacggacacaagtggatttgatgctggctcttcttccctccagcacactcggcagctgccagatcccgccttctgatggaggcgaggggg

SEQ ID NO: 30814 - DNA, 201 bp, Bos taurus
ttgcaaaatcacatgcgaatgtgggcccagtaggtaatgattgttaggggaatgggttgggtgtgaagcaatagggagtagtggagactgtggtgaagggragaatacaggccctgtcttcaaagggagctgctctacacaggagctgactattgccagggcaggaggagaatgggacgacagaggatgagatggcatcac

SEQ ID NO: 30815 - DNA, 201 bp, Bos taurus
tagattaacatctataacatagagagcaaagagggcactgtaagcaacagatgaattctattaggctctaacagacctcagaaggatccagaaagcctctrcagtttgcttctgagaagtgtgcattccagtaattgcttctaagtgctcctccatactggtgtaggccagggcatgcaaagtcagaagtcctacttctac

SEQ ID NO: 30816 - DNA, 201 bp, Bos taurus
taaggccaccattcttccaagccaggttcctgcttgtaggttcctagagtccagagtcatgcctgagaaggtgaaggctgtctagcagaggccttagcagraccagaacctggatttggtgctctcttcactttacagcaaaaccttctgttttacttgttcacggtattgtattaaaaacgcaagctttccctggcccat

SEQ ID NO: 30817 - DNA, 201 bp, Bos taurus
attaactaagtcattgacttcctctgagcatcaatctgcaaagtgaacaataatccctgccttgcctactctatagggaagattccatgagattcccttawtcataaccagcacgattggcaactagtttgtagtggggacaagcctggactagggccagactccctggcttcaaatctagtcaaatgcttaccgactagc

SEQ ID NO: 30818 - DNA, 201 bp, Bos taurus
tctgttttaaattcccagctctggaggaagaagcaaattttcagttacaataggttattaacattaatttttataggtaaatcataggtgcttaagttttygactcaattttgaaagtaatagggcaatacctgaatgtactaattcattcatttatttaaataataattatggacatctaaaatttaaggctaacatttt

SEQ ID NO: 30819 - DNA, 201 bp, Bos taurus
agtcattaagctctgccaaatgaacgaaagctatgaaagcatacctttggtgatggggagattaccacctgtcaacactgtcttgcccgttcgtaagtgayttgaatggttagaaaatctttccttgtgtttggtcggctgggacctgctggatggactttcccctgaggcatgccgcaaatgcaacatctaggaagatca

SEQ ID NO: 30820 - DNA, 201 bp, Bos taurus
ttgactactctaggtttctcatatgagggcttccctggtagctcagctggtaaagaatatacctgcaatgcaggtatctcatataagtggaaaaatacaaratattgctttttcaataaatcccgtatttattttcttacttttcccatctttgtctttaaaggttgagtgcagaatacaatgtcagttaattgcagattt

SEQ ID NO: 30821 - DNA, 201 bp, Bos taurus
acacaacattcttggccttgattccttcctcccaccagcacctcagtggagaagcccacagccaggtgtgtcagctccaccaaagcaaagtcacactctgytctccttagatgggcaggcaggccacatctcccaacagctccggggttagtcagcctgagcattactccagccctcagttcacaatcatcccacatctag

SEQ ID NO: 30822 - DNA, 201 bp, Bos taurus
aaaggccactttaactttcttagccattgcttccagaagggtcttccttcttgttgcccatttctcagcagtgtgagaagagaggttaggacactgcacartctttttctccaatctcagtatcaaccaatatcatcaataccaagcagaggacttgctaccagctgccaggtgttgatagtctggggaagtggtaaagaa

SEQ ID NO: 30823 - DNA, 201 bp, Bos taurus
aacatcttttgtcaacgactgctttagacattaagtgagaataacacacgttaatatgctcgattatatgttgaaaagtttgaatgcatttgattttgtgmtattgtcaaacaaagtctgaggcaatataacacaaattaagcagagcacccccagccactccccaaaaaggtaaacagacactgggaaaaagaactggga

SEQ ID NO: 30824 - DNA, 201 bp, Bos taurus
ctttaacttcaatgtgagttaggagttataaactgagatactgggccttgaggatccaatttcctagatttctgcaggtgcataagaatctaatgataatracaatgaaaatcaaggtaaggcctctgctaggatatgtgggcccaacccagacttgctgccccttctggtgtgaaagtgacatgttcttgcctttacttt

SEQ ID NO: 30825 - DNA, 201 bp, Bos taurus
aaattcatctatgttaattatacttcaataggaatgataaaagtaaacaataaaaactctaccttatgtatacaaagctttggttccctgtcatggcctcmagcctactctcctcttcctccttttgcgtattagttacagaagaaaggaaagcacctcagagtggacaggtatggcctgccaccttctccactctcacac

SEQ ID NO: 30826 - DNA, 201 bp, Bos taurus
tcctgccaccacacctaactccccctctcactgcaaaaagaaaacaaagtgcctgggtgaggtgggagtgggagcttcctttagttgcccagagcttaaamcacaggttctataagaaaaacgaaacgtctacatggagatatattgatacttatttttgaaagcatatgtgaataacataatgatgtgtgtggaggaggg

SEQ ID NO: 30827 - DNA, 201 bp, Bos taurus
caccttacaaacttactgactggggcatgccagcaagccaggaaatggcaaggtctggctccaagtccaagtctagatgataccaaaacactgtatgctayagacgccccttgggttagacccctcctgactccagatccattgtgcttcccaacacatcactgctgtctagaggaaagggagagatatccttaccttaaa

SEQ ID NO: 30828 - DNA, 201 bp, Bos taurus
cgacccctggactgcagcatgccaggcttccctgtccatcaccaactcccggagcttgctcaaactcatgtccatcgagctggtgatgccatccaatcatytcattcctacattgacccatcatcatcagccaaagtccatggtttacattagggttcactcttggtgtacattctattggtttggacaaatatactgacg

SEQ ID NO: 30829 - DNA, 201 bp, Bos taurus
caagatatccacttcatccaaaggcctgtggttacaagatagctatcaaaccttctaaggtgattcctccttcgcactaagggatagagaatcctccattrttccaggattccaagcaaaagttctgacactcattctggttggaatggtttaggtcatgtgcctgcactaaacctcccttggggccacctggaccataac

SEQ ID NO: 30830 - DNA, 201 bp, Bos taurus
aactgggaccaaaaaaaaaaaaaaggtggcatggcatgataggcaagatctagaataccatgaacattgttggtggcccacccagcattcctcctccccayctgtcttcctttccagcagaacctgattttgttcaggaatccatctctctatgcactcccaagcacctcaggagaatctggcccatctgcttctaagatg

SEQ ID NO: 30831 - DNA, 201 bp, Bos taurus
caagttataactatgatatttagagatatcctccataaaaagtatggcaaaaagattggtcagattgaatttagccagaaagttaatcacagtatcacctrtggaaatatatttgtcagagaatcctgataaattaaacagatttcaatgagctaccagtagatggctctcttaatttgctattttatttcagttcagctt

SEQ ID NO: 30832 - DNA, 201 bp, Bos taurus
ataatcgtgttcaccactactttttctttgtttattgagttttaaaaggtaactggaatagctttaaatggtaatacacaggattataagctgttactgcygtttgttctcttgtcttctcactctttcctacacccagtccattagcaagtgctttaggaccacctctaaaatatattccaagtccagctacttcccttc

SEQ ID NO: 30833 - DNA, 201 bp, Bos taurus
gagtcggacacgactgagcaactttcaccttcactttcacttttcatgaaggccaggctgcaccatgcagagaactctcaaaagcagaaaggccattgttyggaaatgtattaccaaagtttgcctgtcttcttcttgaggcaacctgcagactccaggctgattaggcctcattacgcatccatatacagcaaccacaat

SEQ ID NO: 30834 - DNA, 201 bp, Bos taurus
agcaaccatgctggccgctgtccaatctgatcactcactacagttcaactacagtttagagtcccctccaaagccccccgtggcttcccactgccgtaagyggagagaccatctcatcagagtggcctggttcttgtcatccgctccggtttagttcccacctcaccagttctggcaaccgtgaatgttgagaatgtcagt

SEQ ID NO: 30835 - DNA, 201 bp, Bos taurus
tatgaataactattatatcctgtaggctgtaaaaataaaagtgaaataagaacagaatcaatagaaagagtatagaagataacaccatcagcagagataaycaagaaaggtttccctgcaagaagaaaagacggcagggttggagctttggtatgaaagtctgcttgctgtctaactaaacagaggctgctatgttcatat

SEQ ID NO: 30836 - DNA, 201 bp, Bos taurus
aaagtagaggctatatgagaaccacatcctcttcaataataatcagcttttttcccctgacagagattatacagtgttaaatgggaatcactaaagctgakaagtgagaaaaaagttagaattctgtcatattacaacagaaaaataatcttagtctttctcaactttaaaattataacctaaaaaatgtctatgtacata

SEQ ID NO: 30837 - DNA, 201 bp, Bos taurus
tcttcaggactcctttacatgaaagaaatcaagccccagttgactaaagccacactaacagctgtggggggaggcgtgtgggaataaagagggaggttcartttataagcagctgaatgcaatcactgaatgatatacccatgattccaccaatttaagtcttcattttatcatgtcatattattattttttgcacatgta

SEQ ID NO: 30838 - DNA, 201 bp, Bos taurus
atatgtatatcacatgtacaggttttagcactttaaatatatcaatttatttaatatatttattaatatattaatatatattctaagaagtaggtggcctyaataaccctattttacagataagtaacagatgcacggtaatttgctcaaagttacataactagtcagttacagacccagaatttgagtcctggccatctg

SEQ ID NO: 30839 - DNA, 201 bp, Bos taurus
acagacaccagtttcttatgtggtaggctaatttaaaaaaatttgtaatgtgttggttgacctgtaagcttaaaaacatgatatctaaagaaattttataygcatgtataagatgtttatttcacctacaattcttttgagtttatttttacctcagtcatacaatgaaatcacagtcctgagttttaaagcagagaacaa

SEQ ID NO: 30840 - DNA, 201 bp, Bos taurus
gtaatggcaccatccgtgaacaccaataaccctttcctagaaaaatcaaagttggctgaacaatctgagggtatatggctgagctgttggagaaaaaaagrgagaattatcaacagaaacctacagacaagaagtatttctatttactaaatattatattttatctctcacatgtataatggcatgctaaatatatacctg

SEQ ID NO: 30841 - DNA, 201 bp, Bos taurus
agattaaagtacagttagaagagagagtagcctgtaatcaaatcaagaaagttaagaaagtattttactttcatgggaagttttgtttttttcagtttgtrtattttgggggagaacaaagataatcattagaatcataaaaatagattttgtaataggattaacaaagcacacgcatttttaaacagttaattgttcaaa

SEQ ID NO: 30842 - DNA, 201 bp, Bos taurus
attctccttgttttccctttttgtaattaaaaaaaagaaaaccctccagaatttcaggtggtcatatggctatccagccctgatttggctgtggccctctyccttatgaaaagaatagtatataaaagggggaaggagagaggagtaaagtgtcagagggaaagatgaaagcctggatctagacctaggggctccagcggc

SEQ ID NO: 30843 - DNA, 201 bp, Bos taurus
taggcttggactaatttgccagaggctgacacttcatgtagaacaaggatgagccatcgcaaatttaaagccaacataggccccctagtccctggctgacrctgcctctaactgcgcattcgtgagtgagcccagtcaagaccacaggagccccaaccccaaattctgacccacagaacaatgagctaaatatgtggccag

SEQ ID NO: 30844 - DNA, 201 bp, Bos taurus
tggtagttgaaggcctgatggagcttgggctcacatctcccaaagcgccatgggatggatggagccccactcctctacacgactccactaagtcaactctygccaactcttcttcttggcctttggtttctactgctaaagggaccctgaatcatttctggacagtgtggccttctccacagtactctcttaccccctgga

SEQ ID NO: 30845 - DNA, 201 bp, Bos taurus
atgcattcatattgtggatgacccataactttaatgagggcaggacatgatttatttgtgaactgatcaaactgttaagtgttcatctatttatctgttaytttcttcttttatttttgattcactcatttgcttgcttacctaacaagtaccagaatggtaactgtgggcctggtagagtcagggctataaacatgaaca

SEQ ID NO: 30846 - DNA, 201 bp, Bos taurus
atattgcctccccacagcctcctccatagccaacaattgattaaaatattccttcttgccacatatttcactctttgtgaaagaggttctggaaagtacayttttctcttacctcatttcaccttcattaatgttttgatgtagtatcatggctatctgcctagagggattaagagattttacctggctctgggtgtagtc

SEQ ID NO: 30847 - DNA, 201 bp, Bos taurus
gaactttctcatggctaagtagttatgccttgattgttggaagagtaagcacaccttgattgcttacataattttgaattaattatattacttccagattygtttgttattaaggagggtgcttatcaactgattctaattaatgtataacaactttgtgatataatagaggctttaaacatttaagatattacagtcccc

SEQ ID NO: 30848 - DNA, 201 bp, Bos taurus
aatagattggagggacttagggccaaaagcagagatatgagttatttgctgataagatattataataatctaaggggtaatggtggcctaaactaggctakagttagtggaaacataaaatattttaaaagtatatggtcaggctcttcaagatggctattctctctctctctctctctctctgtacatcggttgcttcac

SEQ ID NO: 30849 - DNA, 201 bp, Bos taurus
agccccaggaactgcagctgaaattccctagggagaaactcacagttgctatcaggaaggattttgaccagcatctggaggcatccttctggctgatccakccacttgtccccctcctccagctctcaagttagatctattcaggtatcctcctttcttatacacagaaactaacacttatcattagctgctataaataat

SEQ ID NO: 30850 - DNA, 201 bp, Bos taurus
agaacctttaagagcgtgatttatcctttcccttttcacttctgttatggtccataataggacttatctagatgaactttcagtcagtgtggatccctgcmtgactgggtgattaatatccctgctgacctacactttccatgtggcatgagcaagccatacactttcataataatgtaaagccactgagatttcggtggg

SEQ ID NO: 30851 - DNA, 201 bp, Bos taurus
gggccccaggttctccagatatttctctttcccaacaactgctacaaatagcacctaagatgagcagcacctggagcccacgtagatcttttttggtacayggccaccttttgcctgcctcaaaaaaaagtaccacatcactttccaggaacacagctctcagagatcagggcaatcatatagctgctgatttttcaccca

SEQ ID NO: 30852 - DNA, 201 bp, Bos taurus
acatggaataatattctctacctgacaaagtattctcagatgactgtggctcacacatttatatccatgtaaagcaattggcccagtgactggcatgacaygcttaagaattggtagacattaccatcatcaataccagggcttcaggactcatctgacctatccatgtttacacagtaccattacagtgtttgatccagt

SEQ ID NO: 30853 - DNA, 201 bp, Bos taurus
atacaagtttcttaagacattaaactgcctttgccaaaaaaacaacaaagccccttatatttctatcccattacccactggagtcacctcctgggtaaacytctctcacctaaaacgggtcacttctgatcctgtgctgccctccttaactgacccctctcaggtctctctcactggacctacctccttaaaaatcacccg

SEQ ID NO: 30854 - DNA, 201 bp, Bos taurus
aaaagcatggaatgaaggcattgctcaaccctgaaccagctgatgcctctggttaatgcagggaaggaagaagtacaataagcagaatggggcctgtaggmaataaaagttgtaggagtttgtaggtttagaaatacggagtttacttttgggttggacttccaggccttttacataaaacaaagaaaataacaactatgt

SEQ ID NO: 30855 - DNA, 201 bp, Bos taurus
tgagcctgcctgtggtgtctcagggccagccgagcagtgcctctcccgccccatgccccactgccatggagtgttgcacagacacctgggaagctggaaayccctggggctggcctgtcagccagtggcaggtgcccctcatcagtttcttgactttcaacaagttctattaaggttagattttatctgcaatggattagc

SEQ ID NO: 30856 - DNA, 201 bp, Bos taurus
tccatctgtgtcatgatctctggttctgatgagttgagaaggaatcacaggatcttgacatttcaatcagggctcaaattcccaccagcagccagacaccygcagctcccaccatagccaggctcggcaatctttcttcaagatggtttgcttatcacttccgccagtcacttgccctgcactgttacagatccaaaccag

SEQ ID NO: 30857 - DNA, 201 bp, Bos taurus
ccctgtggctcaagtttataaagttaaattctgactccaagcaattcaatgttaatttccaccaagccctggtgtcccagaaagccagtgcaccacaggcrcagcttaggaatctgtcctagtctcttttacccagtgcctgccccaataaaaatgacttcaagtaagatagagaagacagcttggagagaaggatggctg

SEQ ID NO: 30858 - DNA, 201 bp, Bos taurus
gcatgataatcttgttctcccctttccctgcctctcttatagctacaagtgatgatgcaacctaattctacccagtgatacctaagcagaagtcaagtagragagctcttggaaaagcttttactctgctcattaaaaaaaaaaaagaagaaaaaaaaaggagacactgctttcttcatttcttccccattcttctaccat

SEQ ID NO: 30859 - DNA, 201 bp, Bos taurus
cctctgcagatacaaagtagaaagtgattaaatgtgaaagaaaagtacacatataatacaatggcagctcagagaatggggtgaattctttggcctgagawggtaagagaagacttgatggaagagatggaatttcagccagatattgattgatgagtaagagatgatgggaaaaggccatatgtaaggaataaagaatat

SEQ ID NO: 30860 - DNA, 201 bp, Bos taurus
acacacccacgcgtgtggggtcttggttcaccgaccagggatcaaacccacgccccccccccaccaaccccgccttctttggaaggtgaattctgaaccaytggctcaccatgaaagtccccaggctaagctctttaaatacattgtttcatataattctcctcacaattctaagagataaatattaagatcagtccatat

SEQ ID NO: 30861 - DNA, 201 bp, Bos taurus
gtggccatgggcaagtaacttcccctccctggacctcagcctccttccacaaaaagaggagatcatactgcctgcctcatagacctgaagtgagactagayaccaagcactggccatccctgtgcccctgttagagagttaatgaaaaatccccctggggaccatgagtatacccagcatgcttttgaaactagccagtag

SEQ ID NO: 30862 - DNA, 201 bp, Bos taurus
aggaagacatggacagtgaggtatgggaggccgtatctccagagatctctcccaacctcccttcccaacagttgaccagacattaccagcccatcttcaartatgtgaaactgaggcccagagagccgaagctggtgaaatatcatcacaggccagaggggactgcgctctaacacagcagttgttcagaacgtacactgc

SEQ ID NO: 30863 - DNA, 201 bp, Bos taurus
gccaaacaatcagcagacgagacgtctgagggtctgaggctgcagagcaagctaaagagcataaagagtcaagggcaaccagaaactctacccctggccaytctgctcctacccatggattgcagaggaagcccagccccttcccccattctcccccacctcctccaccctggcttccgctgcccagccaacattattttc

SEQ ID NO: 30864 - DNA, 201 bp, Bos taurus
ggagcccctgctttgctccacaccaactgaatgatcttggggagatggccccaacttcctgaatctgtctcctgggccacacagggcaccaatggaggccyctggcagggtttgtgggagtccaatgatatcacagatgtaaagtgcccagtaccatgcctagcccataaatgttaagtgttagttgctcagtcatgtcca

SEQ ID NO: 30865 - DNA, 201 bp, Bos taurus
accgtctgtgactcattgtggttaactggtttctagcaaatatttgctgaattgatggataaaatccaatcattcaagacccagactagatgctacatctrctaaggagtcatgtctaatgtgtaccagtctccagaagtaatctctctgttccctatatgttcagagcatttcatcattcccctctgatgatagttttta

SEQ ID NO: 30866 - DNA, 201 bp, Bos taurus
caaggtctgccagtgcatggcttgttacatgagaaagaaagatacttctgcagtatttaagcctttttatttatgtctctgcaggagatgtcaaatgtctrtcacacctaacaaaatggccatatgctctttatcccacaggttccaatgtgattttatcctgcaatcagtctaggtcaacccaaggagatatgttaatgg

SEQ ID NO: 30867 - DNA, 201 bp, Bos taurus
cactttctctgcaatggcattcaaatgaataaaaagataaaaagaacagtgaccaccctaccacatgctctccatgacctcccagcttaggctcaacggtrcttatttttatatctatctcaagaaagaatttgggttggtttagcccatcatgactcagttcctttgggacttatgtcccctgctgttccaatcagctct

SEQ ID NO: 30868 - DNA, 201 bp, Bos taurus
ccacacttctccagtgagatagcatccctgtcttcttacttctgaaggactaataacagtgattcacaggaccttttgcttttccaaagttttgggccatyattatttagatatacatcatcacacacccacagcctcaatagcccatttgcttctggggaggaagctgagatcaggcagcagcaaagctgggaagagaaa

SEQ ID NO: 30869 - DNA, 201 bp, Bos taurus
ggcccccgcgacctcaacttgcgcgtgggcggacagcccctggtcctggagcagatgctcatctactacctggacgagaagcccccccagttctccatgargcgcctcaccagcggcctcatcgccgtcgtcgtggtggtcgtggtggcggtggtcgccggcgcggccgtcctggtgatcaccaatcgcagaaagtcggga

SEQ ID NO: 30870 - DNA, 201 bp, Bos taurus
gactgctgatcatcatgtgatctctggtgttaccaaattccagccaaaagaaagatttgtgattttaattagtctgtgtggcctaattatatgagagaaartataaaatttttagttaagttctttgaaagattccagtaacatctttacaggccacaaggggcctgggacctcttcccaggaggtttacagtcagattca

SEQ ID NO: 30871 - DNA, 201 bp, Bos taurus
tttgaaatgagaagtggtctttacattgtagtcacaatttaaaaaaaattgttgtaccaaaacatgtaacaaatgtacccttttgataattaacaagggtrcatttacagtattgttaactacatgcacgttgttggacagcagatccatggaactctttcttcttgcatgactgatactctatacctgttgaacataact

SEQ ID NO: 30872 - DNA, 201 bp, Bos taurus
gttgactgtaggcgacagcctggtgaacatgctggagagttcaaagggtgacctagaaagtttgagactgcacagcaggaggccaggatatgttacctgayagtgagttaagaataagtgctttctcatggctactgttttaacatctgaaaaaaagaagggagctgggccagttgatctcttaggttctctccacctctg

SEQ ID NO: 30873 - DNA, 201 bp, Bos taurus
cctggaggcttgcgtctgagttgggaggccctaaggagttcaggagcagagttctttaaatgacaggctcacatttgcatatagaatgatggctcgggcgrcagtgggatctcaggtctgtctttctctcaagtggcccccatgtcctcactctaacagaggggagctcaagtgttctgtcatgtagcctgaactctgttt

SEQ ID NO: 30874 - DNA, 201 bp, Bos taurus
ccctccaaagccatcctgtacacaaccaccagggcaatcacccacacccttaaagctgattgtgtcagaactctacagtggttcctcagcacctgcggatygagctgggcctgaggaacttgctttacgagggtctttagtatttttttaatcacacaggcacacatatattctttctcactatggtttatcacagggtat

SEQ ID NO: 30875 - DNA, 201 bp, Bos taurus
ccaccaaagaagataaattcagtgattgcttgttcaatataataatacaatgctcaaatattattaaagaacaagttactttgaatctaactttcaagttrctgtagggttttttcccctataactagtttattgcccagtagagtagaacggttgtaaatctcttaactggtttgatttgtgtgtatgtattttgtattt

SEQ ID NO: 30876 - DNA, 201 bp, Bos taurus
ctgcttctgctcccctctgccctcttaagacatgtttcttaaatggtgagtgtctggcttcgtccctgacagtaccctcttaaaaatgacctttggtggayttctggtgcctggagccaccctgaaggcaggggaagaatcttaattgaggctgcattatttttgataattcacttaagtcaaacattttgtttttgctgg

SEQ ID NO: 30877 - DNA, 201 bp, Bos taurus
aaagaagataatatagcttctaaccgcttagagtttataaactacctgcaaataaacatctcattcacccttttcaataaactcatcaagtgagaattttygagttttgtgtttgagacaacagaactagaatgtccttgtccaaggacccttaaacctgttggggtgaggctgtgactagtacatgggaccctggacctc

SEQ ID NO: 30878 - DNA, 201 bp, Bos taurus
ccactgctctccagataagctgttcctggggaaggagagtggcatctacagtagtaacaggtctagtaattagcagccgccccggggccttacaacatttytaaagaagacgaggtgattcagtaagatctgtcaccactgctgagagtctcccagatggagagacaggtggggatccccaatgctaatgacagggaggcc

SEQ ID NO: 30879 - DNA, 201 bp, Bos taurus
gaggttgttaatttatcaactttgtggccttcagagttttaatcccaggatatgttctgtcagtgtaggtatctttctggatgggtttggtctaagcaaaygatggctgtgaggatggtgctattttatcagtagagagatgtactaccttcagatatcctactacagttttatagcctttgcatttctgatatccctggc

SEQ ID NO: 30880 - DNA, 201 bp, Bos taurus
agacgatggacatgggaatgatgctgtgatggatagccgtgagtgctggagtcaggctggacttaggaaaggtagcttgatgcttgatggcagacgggaartgtgtaactgtctcaggtcgcttttagcccttgcttcctaagctctgcaagacttgtccctgctgtcttagttgagtatccaatggcttttggtcaggct

SEQ ID NO: 30881 - DNA, 201 bp, Bos taurus
ccttagcactctagatctgctattaatatgctgggccttcagccacacagttcacccagcgcttggactcatctcccacctgctgactctgtaccctcccrttctctgttgtggccagcccctacccatccctattcctgccacttttcactggccagactaggtcctcgggttcccagtgctgccttttctgtagctcag

SEQ ID NO: 30882 - DNA, 201 bp, Bos taurus
catacaatgtttgtaatagatttgttaaatgaacacctggcagaaataaaacaagcactagtagacctttgtcaggaaaatgaaagaagggccaattatcygagagtaagaattggctcacatacgtttcactaaaggacctgccttgttcttgtgtggctcctaatctgactctgcctaggaatcattggccaagctttg

SEQ ID NO: 30883 - DNA, 201 bp, Bos taurus
gttatacccaggatccgggtgagaaagctgagtcacagaaaaggtttgtgcctaacccaggggtcagagcccatgaatagagaggccaggccttgaactckggctccagagcctgggctcttaaccttaaccactgagtcatcccctccctttgctctgtgcagactgccttgcattcctgggccatagtgaatgaggtca

SEQ ID NO: 30884 - DNA, 201 bp, Bos taurus
aaggaagtccaagaaatgactagtatcaaacaggaatgtaaccatatatgccaggtacaaagggtatggatgggaagatgcctccagcaagactgtgtcartaggagagaaaagagggaaaagatgggatcaagagtggactgggcattcagaactaagagcaggaagtgtttggcatccttttacacaggacctagtcca

SEQ ID NO: 30885 - DNA, 201 bp, Bos taurus
accaggtcagcagccccctgctgggccagctcagatgcttcgccttttctctctgagcttcagttcttcgtatgtaaaatgggtggttgcttcctccagamacagcggtgaggccaacctacgctgtatagtagaggcagtgcagatatgtagtagcataattataccaacgacaataacaaaaactgccataaagagaca

SEQ ID NO: 30886 - DNA, 201 bp, Bos taurus
aagtttgacaacaaagaataacaaagtagacttttcctcaaagactatacaagccaaagataatggagtgatatattcaaagtaatgtggaagggaaagayggaacttttcatgtagaatttcatatttgtcaaagatatccttcaaaaaaggcaagataaagagctcttctgactaataaaaacgggtcattctctcacc

SEQ ID NO: 30887 - DNA, 201 bp, Bos taurus
gttttcccaccccttccatacacacaaaaaaaggtactttgttactctttctctctttttttgatcttgagaaaaacatttggccagtaggaggcatgacyggagataggatgggaggaagggagacaccaggctaattgcctcttttctgtagaagccctaggaggttaatgtgccaatggccatttctctctcaccctc

SEQ ID NO: 30888 - DNA, 201 bp, Bos taurus
gcagtcttattaggaccccatgggactctgtggactgcttttaaaggcaacagtgggcagtgtcatggctgaaggaggagaggttttacaggtagcctgcrggagctcaagatgcctcctttttaacatgcagcatatggggttgcaaccagaggaggggcagtcttaccaaagcaccggcttggggtagacacttaccag

SEQ ID NO: 30889 - DNA, 201 bp, Bos taurus
ttagcttccagcctttcactccctctgacagctacagggcctcaaggtttccaatggcaaccatttccctttctctagctgattgctaggtctctgaccaygaaaccagaccaccccctaccaccacagacttgtcagagtggggacttttctgcatagtgttacctcctcctcttggcagtgggaaggtaagctcctggg

SEQ ID NO: 30890 - DNA, 201 bp, Bos taurus
gtgatgtaaaaattaaaatcaaagttttgctttttgaatgcatggtctgtaacccacagaaaatgagcaaattgtttggtcaggatcttgtttaagaagcmaaaaatttaagaatcaaaatatgtacaccattaaaaatactaattctgagtattatatatctaaaaattaaatcaccctgtccagcaagtttcaaaaaat

SEQ ID NO: 30891 - DNA, 201 bp, Bos taurus
tatgtttgagtctctttggatttattatactttccattcattaagtttcttgtatttatatatccatgtcattgcaaagattttggacttttgggccatcrtttcttcagatacactctcttccccttcctctctccccttcttctgggactcccattatgcatgttttggcctacttaatggtttcctataagtctctta

SEQ ID NO: 30892 - DNA, 201 bp, Bos taurus
cagggcaggtctgggtgcccttggagcctgcttgtgctatgctgctctatggaaaatctttgcaaagcctcagggagggcctccaccctcaaagggtggargaagtgggacacttagatccaggacaccagcgactctcattttccactcttgactcagagtgccctgcccagaaaggccattggaccccaggctgcccac

SEQ ID NO: 30893 - DNA, 201 bp, Bos taurus
taatgtgcagcccaagggcaggaactgagttttattcaacctcaaacctgctgtgcccagaataggactggctcgtggtagagaattgatgagcatgaacygaccgattaaacgaatgaaagacccttttcttcaaagagcttctgtgactcgatatgatatttttcctagaacttgtggttttcaggccagaaggtgact

SEQ ID NO: 30894 - DNA, 201 bp, Bos taurus
ccctttcagttggcaggcataggcaaacctagaaataagagggtagcagcactccatggaagcaatagacaaatgcttccttttttttcatcacttgggtrgacaattctgaagttcttagagggtcccaatggaaaagccccaatcacccaccatggtgatcagctcaataacacaacctgacattgaccttcctttcat

SEQ ID NO: 30895 - DNA, 201 bp, Bos taurus
tcacccaccaaggggcaggcataagaagcaagaaagctgtaataccataactcaggccagactctgccctgggaccagctggaccctggccttgcccactracatgccaacacaaaatttgggacactgcaaaccccatacccaactgtggcagaaaccgtccccccacccccactgagcaatgaacaatctgaaatgagc

SEQ ID NO: 30896 - DNA, 201 bp, Bos taurus
tatagcagagagggctagacatggattagtggaacacctctactctcagagttcagggtgggcaaatggttacccagcctttctcaggcttctttgcagcytggtatggctattttctcaccaagacattataaaggggaattgcttgccctccgttccctcttttccccctcttccatggactggaactcgtgtgtggtg

SEQ ID NO: 30897 - DNA, 201 bp, Bos taurus
ccattaggctgcagtgcttccagctacactatgatgtttctcgccaaatattagcgactattctaatatgtctgcagtctgacaggcccctgcaaccctgyctagtctttgcttttggaccaacaccttccctgaatccaagcccacaagcaggagctcagagctcttgctcggcctcccagagagccctgcctgctccct

SEQ ID NO: 30898 - DNA, 201 bp, Bos taurus
tcagacccagcatatgaagtaaataaaatccatttaccatctctgagctagatcaagtagatcagacccagcacatgaagtaaataaaatctgtttaccawctctgagctagatgatttttatccgttttgacactgtacaacccatgaaagatagaagcatgaaaacagagactaggaaacctgaggcctagagaccacc

SEQ ID NO: 30899 - DNA, 201 bp, Bos taurus
caattactctaaacaggaagagatttctgcctacatctctgacaggcaggtgttctctacaattcaccaggaagaagaaaactctgtgagaggacaacccmgtcaatcagaaactgtagcagttcaaccaatgaacaatctccatgctttggactcccagctttctccagtgaactttttggttattacagcccttccaaa

SEQ ID NO: 30900 - DNA, 201 bp, Bos taurus
ttgcagcgttggcttccccttgccttggatcagacctctggtcctaagccctcctcctctttccctgtagcaaacattgaacgaagcaggagagtagtackttggccatttgctcctcagcacttgctaaggagtatgttttgttgaggtacttgaaagattccattaatgaggaagtccaaggtgatatttttatcttct

SEQ ID NO: 30901 - DNA, 201 bp, Bos taurus
gtaagaactgtataaaaagttctaagggagaaaacccagataaatgtcagaatcttatctcatgggtccagaactactgttgccagcctcttgtggacatmgctgtgtccagaacttctgacacagcgacagcctagcacagtgtcctctgacccaccttgtcacagaagtggctatagacttggggttgacgagcactgt

SEQ ID NO: 30902 - DNA, 201 bp, Bos taurus
cactcacactcgcaagagttgcccaaagcagctgtgtcagctcctccctcttctcagacgcaccccgcctttgatctggccagctgacaaccagccaacaytcacagtgctcctctccaacccccatccccaccccagagattcagggatcaggggaaggcagagcctcttgcacctctttcccttcatctgagtgcttcc

SEQ ID NO: 30903 - DNA, 201 bp, Bos taurus
gctggccccctccttccagctccctcctattccaatccatgcacccaagttcctgccacctggggtcctgtacacctgctgctccctccacctggagagcyctctgtccccattcagggccctcatttcacaaccccctttgagacccatgccaaataccacatcctcgaagaagcctttctgctgctaccacccacacct

SEQ ID NO: 30904 - DNA, 201 bp, Bos taurus
cttgaggttgtggactgcctccaccaccagcagcccatccacactcttcagacccttcaccatggagggcaggagggcctgcaccttggcagcctgcagaraaggagtatttgggatgggggctcctatctgatctaacaggtgaggggcccagcctctgagtcacagagatgaacttggtcaagcaagtcctacctccag

SEQ ID NO: 30905 - DNA, 201 bp, Bos taurus
gctcgcatccttattagcgccttcaaggccctgccgggtcagtctcccctgcccacctccgcagctcattttcccttactctcccctcactcaccatgctyccaccacgctggcctccttccaggcccagcaggctttgctctcaggcctttgcacaagctcttttcctctacctgggcctctgctctcacacccccttgc

SEQ ID NO: 30906 - DNA, 201 bp, Bos taurus
tataaagcatttggaatcatgtgggcaggctgtgaacgctgcaaaaatctctttgaaggggtaggcccaacgcctgtgggaggttttgcgggtctttaatragaaacccctcagggatggagttgcccctgtggaggctgtcctgcttctcgtcactgcacctaaacagctgcaagtaacaacagacattttgataaagcc

SEQ ID NO: 30907 - DNA, 201 bp, Bos taurus
agttggccatgaggcacgttggctttcatggagctgatcactagatcatcaaaagtcagcaaattggcatggttctgtcacaggagttggcatgaggtagmctcacagtaaacatgagctgattctcattgcttttatcatcagtggtcacttagtgaatgtttgctgaataaaccaaggtcatttctgcactgcagttta

SEQ ID NO: 30908 - DNA, 201 bp, Bos taurus
agaaacaggatttgcttctcagtttggggccccaggtctcttaaatgcttagattgtagtcttcccacaggattaagtagtgatttctgttttcataggcrgtttcataggcctcttgacactgtgaggggcctcttgaatctctcgttgctctaccacgtctggctgtgtggtgtctttgtcctgatgacttggtacgtc

SEQ ID NO: 30909 - DNA, 201 bp, Bos taurus
gctaaatctgaccttgactgctatgaggctatttgtagacttcatttactccttgtactatgaccgtgtttccattcactgtggtgtgatgatgtaggtgytgtcccagaccctatgggagtgttatgtaatatgcatctttattacctttctaaagtcctttaatcaaagcttcgggccttaggagtttaagacaaagca

SEQ ID NO: 30910 - DNA, 201 bp, Bos taurus
tggcctttgtgtttgaagacagttctgcagcaaggttcctgatgacaaggcaggctccttgggggtgtggtgctacacgtggtgtgaatccccaggaaagrgtgcagactgtctccagggcctgatctgctggggagcatagttgggaatgctggaggtacttataacccccagaagtttgggaggacaggcttgactgaa

SEQ ID NO: 30911 - DNA, 201 bp, Bos taurus
gggcacacgatggtggagggtggacgtggacactgggctccttgctctcaggctcggtgctgcctcagaagcccactagggttgggatgcggccatgctgyggaaaaaagggagggtgatcacgttcagaattggcatggctacttacagactccatgatctgcagtgacccctgttagcctgagggacagacctgggctc

SEQ ID NO: 30912 - DNA, 201 bp, Bos taurus
ttcaaagaatcgaatgttcctggtaatcaagtgggaaggcttgatgaataggacctgatgcatgctgggctgctgggcaccttctggggccctgccttctstctctccacatatcttcctgtgggaaggaggagcagataacccggagcgggtaggttacccaacgggcctgttggggaaagaacctcagaaccacatcct

SEQ ID NO: 30913 - DNA, 201 bp, Bos taurus
ggcccttccctcatcaactacttcttatttctgtccgacccttcagagctcagttttcaaaacagcagttcacactcatctactgtctttcccttcctgcytcaccatcactccagagccctcttgttcttaaatccacttgactttcatgtgcgttctaagtcacttcagtcgtgtccaactgtttgcgaccctatggac

SEQ ID NO: 30914 - DNA, 201 bp, Bos taurus
gctcccctgttctcttatccccatccctggccgacagctctattctcaaggctcccagatgctacctctgtgactactacagtgcctgctcagacccacayggccagcatcccactggacgagtgcccgaatgccacaggcagctaaaccacacttttccaaagctggaagccggtgtctgcacacaccctctctttctcc

SEQ ID NO: 30915 - DNA, 201 bp, Bos taurus
tgaaggggaggttcagggctcctgcgccggcccaccccgcgccccctgcaggctgtttcgagtccgcattagcgtgttaattacaccagctgcccgggcgrggctggggaggcggcggcctggggatggtgtcactcttgggttcaaagaaccacggaagaaccgtggggcagggagaacaggctggggtcacggctgaaa

SEQ ID NO: 30916 - DNA, 201 bp, Bos taurus
accacagggcctggcccagagccaaggcatttgagtggtatgtgaatgaatgaatggactgaggaaatgtcccccacttttgagagtgggaatctagtatyagtcagatatgggggacccaggggcctctgagaagcccctgaggggtccttgaggctggaaaagggagctgggtgtcctttagggaccatagtaaggtcc

SEQ ID NO: 30917 - DNA, 201 bp, Bos taurus
ccgttgagcagccacaggtcatggtgggccagcaacaggtctgggacaccacaggtctgaggtgtcccagcacctcagattgccattccaggatcttcagracatggccctgcctctcctgcagctcccacattcacctgccctgcttattgtctgtttcgtgttcctccctccaggccttgggatgtgctgttccttctg

SEQ ID NO: 30918 - DNA, 201 bp, Bos taurus
cacagttgtttgcaactcagcaaagcagtagtaaaccatcaggttctattcacccagcacttagaaaaaacagaattgatcacacccatttaaaaacaaayctcatgctatttcccaatgtatagtttcaatctaagttctgacaatgaaatatatggatatatatctatatatctcatcttgattttcaaaggaggcaaa

SEQ ID NO: 30919 - DNA, 201 bp, Bos taurus
ggactgacaaatgacgatggactcctgatggattcaagtactgagaatactgtactcaaaactgataagcctcaatttatagtccatggttgaagatttaygttatttttcctactttagtgtcttgttttggaacatccaaggtatttccaatatgatgtcatttgtataaatacaactaaattcaacaaaggctatttc

SEQ ID NO: 30920 - DNA, 201 bp, Bos taurus
gtacagggctctatgggacagtcaggagaatcagaacttctcctagaagatctgaattgatcttttaaaaaatgcaaacaagggggtggtcctaagatggyggaggaataggacagggagaccactttctcccccacaaattcatcaaaagaacatttaaacgcccagtaaattccacaacttctgaatgctggtagagga

SEQ ID NO: 30921 - DNA, 201 bp, Bos taurus
acctggccgctttctgatgtcgcactgttctgctcagagtgttgtggcagcaaggcaggggcaagctatagcaaccccgctcagccatcagttggcacaaygtgggcccctctcctgaagcgagcaactgtcaacatgcaaccattagtgatcctgctcagccactggtcagtgccaagtgagcccctctcccctcctgta

SEQ ID NO: 30922 - DNA, 201 bp, Bos taurus
ccgagggcctcagttccatccctggtcagaaactaagatctcatgaagggcagaacacagaccaaaaaaaaaaaaaaaaaatctgttttaaaaacctcaamtataggcctgactcaaaaagacaacaaaaatctaaacacactaggacccatgatgtttagcttacaataaaatataagaaatggtaagaagcaggaaaga

SEQ ID NO: 30923 - DNA, 201 bp, Bos taurus
gaaactggaaaaattagtagccacaggcctgaaggaatcaccatcatcaccattatttttagttgggagagcttaaaaaaatcaaagtatcttgatttacrtaatagcgggtttaaggagctaagaacagttaaatagtcaggactgccacctgctgacttatgcagtcattggtgtgggctgctttttttgtttttagag

SEQ ID NO: 30924 - DNA, 201 bp, Bos taurus
tgagtaggagttagctggatgatgaactggaaaaatgaacgcgaagagacagtgggagtggcattggcatgtggggaggcccataggccttaagagcccartgttattcagagaactgagaggtatatcttgactggagcatgtcgtatgggacatgagacaaagctgagagactgctggaggccagctcatctaagactt

SEQ ID NO: 30925 - DNA, 201 bp, Bos taurus
cggcctgtgtagatttagggatgattcaggcacatcacattcattgtgcactttatttctattattattatgtaagctccacctccagtcgtgaggaggtygggggcctctccaatagatcacctttggagaccaggcaatcttatataagggaatagctctggtttgattccattttctgagtcccattcagaagaatgg

SEQ ID NO: 30926 - DNA, 201 bp, Bos taurus
tccatggacttcccatctatgggacttaggacactaaaacagaaacaaaggagagagatggaagcagctcttagaagaactacttctctcttatcatacaytgggtgccttgctgaaaagacctatgcaaaacatcacaaagaagaagccactgccccaaaatgtacacgaacagagctctcagggaggggcctgtgcact

SEQ ID NO: 30927 - DNA, 201 bp, Bos taurus
aagaaccaaaattaagtaataccaagagggagccatatatacaaacagaaaatagaattgagattcaaaattacttattcgaagatccctccttaaaagtrtaattcggtactctggtactcaataaaacctaaccaattctaaaatctctgtagttacaccagtttcttccccaaagattttaacagaagagagctatta

SEQ ID NO: 30928 - DNA, 201 bp, Bos taurus
ttacaatatagtaaatgagaagaaaaagactcagctggccatttgtttttctctataagcagtaaaaggaaataggtccttaatctaactctcttgagcaytgttctagctagctttgactgacattatacaactagttgaaaatctaatcctataacaactgccacatataacagtggcatatttaagaatatgctctgc

SEQ ID NO: 30929 - DNA, 201 bp, Bos taurus
tggtggtggattatgctgaggccggagttaatatttatttgtcttctcccagcttctacttccttcctgtctctgtctttttagcaagaacatcaggaagkaaaagctacatcctgtcaggccagtttgttatcctgatcttgggccagtaaacaggatagatgattacaatagtggttattaagaattgtgctatgcctg

SEQ ID NO: 30930 - DNA, 201 bp, Bos taurus
ctctaaaatgctctttttagagaggcaagtttattcctaagagattctgtttgaaatgacagacataaaaaagtattttaaatgtattttgtaatcttatytttgtgatgctatatcttggaatctttctgggctacagatcataaccattgtgggttgtgagatcagttttagagggtcaaagctaggactttttagaaa

SEQ ID NO: 30931 - DNA, 201 bp, Bos taurus
ttcttaagattcagcaaaccttaattttggaataagtcagcaacacatattattttataccctgaaattttacacttcatttcaattacagcccctgcaamagtaaggtcatacacaaaggagaggttattgatcattacttcaattagcacgtgctaggaaattagtttcttgccagagtgttcaggcacacatcagtca

SEQ ID NO: 30932 - DNA, 201 bp, Bos taurus
agtgcaaaggcaggttcccttcattatcctcgatgttaacatcagcttgaaactccagcaaagtctgtaaagtgtccaggaaacctgctctggccgcatcrtgaatgacagcgaaaccagttcggtctttcaaatcgggattagcacctctaagtagtagtctcctggcaatctccggatttccaagtttcataacctaga

SEQ ID NO: 30933 - DNA, 201 bp, Bos taurus
ttacactgtgtgttttttttttttttttgcattgtatttttaaaaaagaaaaacattacttagtgattattttgggataatgtagtaagatattttgccayggttgactgaatatttgaggaaattaaatacttagggttttgaaatatgataaaatatattaggttatgttaaaaaatgttcttatcctttagaactata

SEQ ID NO: 30934 - DNA, 201 bp, Bos taurus
attgactgaatggtgtttatcaactattttatgttgtgatccacacatatgtactgtatgtgtctttgtttattaatttattgaggaagcctagagaagaraggtttgttttcacatcttgagcattattataaataactttcagaataggtagatactgaagttttctaatttagaaaatgtccatttgggctaattagt

SEQ ID NO: 30935 - DNA, 201 bp, Bos taurus
gcaaaacatcttcaaaatgtttgtgaaacatctttaagattgtttgcttttagtagatggacattgaataaatcaggcagatttggatttgaacctggaayctgaaactgactatataagccaaaattttctctgaaatggagattaaagtaccttggcaattaacccaccttggaataatgaatccttaccttcacagta

SEQ ID NO: 30936 - DNA, 201 bp, Bos taurus
gggaagtcagagagggtgacttgaattcactgtgtatctgtatttcagtaaggcttttgatagtctctcacaatattcaggagaaaagtagatataaattracagttaagtagattctttactgattaaatagatgtgtccagaaactgctggctaagagactgtcctctccctggaaggaaacaaaaggctctatattta

SEQ ID NO: 30937 - DNA, 201 bp, Bos taurus
aggatcagagtagtgggagcctgggaagggaaaccaggtacttgttttgaagtacacaagacgacaggtttatgggagttagaactaagatgacagtggtrgagatgaggagacagaatcaggaagaagcacaaatcgctgagatttggtgattgtctaactatgtcaggatagggatgataggaagaaggagttgtcaaa

SEQ ID NO: 30938 - DNA, 201 bp, Bos taurus
gttggcgcctcttgagcgatgagcggctgccaagagcggaacacagctcggctgggtgcgcgaaggacccttggaggtcatgcgcccttcgaggccccccrggaggaggaggtcccgcccaaggtcacccaggggtgcgtgttaacagtgcgggaacccaaatcccttcgtccttggctcttccctaaagcccaagaggcc

SEQ ID NO: 30939 - DNA, 201 bp, Bos taurus
ccaaggtgacaaccttaccattttgtttcctcacatttatttattgagccaatgtttattgaacacatgtcatgtggtgctggtgctggggtggtctacarccccaccctcagtgtggaaaagcacctccacatccacaggcccccctccacctcggaccagccccacccagcagctgcccaattggaagatggggaacag

SEQ ID NO: 30940 - DNA, 201 bp, Bos taurus
caggtgaaagaatttgcctgaggcccctggtgagcagctgagctggaatttgaattgccttctctctggcctcttcgtttaaactctttctctcactcttyttgccacatcccagctgcctctggccagacccgaaaaacaaatcctgtaattgagttggaatgtgggtgctggggcccaggagacaatgtttcctgcttt

SEQ ID NO: 30941 - DNA, 201 bp, Bos taurus
gaacatcctcacctgaaattgaaaggtaaatatttcagttgtgagtctctctgtcatgactcaaataattttaaaattgcttagatgtctttgcctaacartgttcagattgttctaatgcaggggaaaacggtagtttcagacacagtaatattgatagcagctagtaatttccatgtatttctcatggttactggcgct

SEQ ID NO: 30942 - DNA, 201 bp, Bos taurus
ccccccactcccctgccgccaacgcacagaaaacagcaaatgtggcaccacctttatgcgtcacatgggctcccagccactcccagacctgcagactgctrtagggccctgtaatttgtcctgacttcctctactcattggccgtgctagcagcaacatgcgggcacaaactacgtcttattctctttagcttcctcacag

SEQ ID NO: 30943 - DNA, 201 bp, Bos taurus
tataaaaccaatattctttagtggctcacactgaagtatcaagtagcatcaattatttacaattccagttagtataggggccttttgaccaatgaaaacamacatttttaagtactcaaacttaaaagtagaactgaacttaggatttcagattccaaagcccttttaccaagtacctttcttctcagagcctcaggcctc

SEQ ID NO: 30944 - DNA, 201 bp, Bos taurus
tatttttgtaagaaggaggaaccagagggagacagagctggatggtaatgcggtggtacaccggataaacacggtgggtggggtggggtgtgtcggagctygcggccgtggaagacagaaatgcgctctccctcagcttgagagtcagtgccaccagtctctctcttcacttactccgagggacaaagttgtttccctgat

SEQ ID NO: 30945 - DNA, 201 bp, Bos taurus
ctgctgcctttttcttacctggtgagggaagaagaagagacagacacataagctgggctatacgtggagagaaacgccacgtcccaatcctccaccccaarcctctgctgcctcctagggcttcttggcctggaggaagggtgagcctgagggtctcagagcccatgaacattattccgctttgcagctccagaggctgtg

SEQ ID NO: 30946 - DNA, 201 bp, Bos taurus
ggggtggggagctctgcccggggaggctttctccaggggacagcgatggggcagctttggcacacttccctgtacaggcccagtcttcctgacaaagcacrtcaccctcttgccttcacagttggcaaatgaacagagccagagtgcttcagaaactgggcccctgggcaaagagagtgacacttgatgcagagaaacagg

SEQ ID NO: 30947 - DNA, 201 bp, Bos taurus
aaatagaattctgcaggcctgtgatcctcttcccccttcttcccttcgactctgcctccattctagagtcagccaaatggcaaaggaagaaggaatctgtyccaggggcctgggctcagagagactccggaattaagaagctaggtaaggttaaaactcaagccccatgagtatatcagaaaggagtggtcatcagctcct

SEQ ID NO: 30948 - DNA, 201 bp, Bos taurus
gcagacagagggcttggtgactgaaattgggctcagaagacggttcctggttgagtgggaggctgtcaaagccatcagtggcttggccaaggctgggattscacagctcagaacctggtactcttgaattcccagagaggcataaccaagatgaagaaatacatctctggctttggccagagtttcttgcagttgactgaa

SEQ ID NO: 30949 - DNA, 201 bp, Bos taurus
ctggaaatgggatggccttctcgcagtagtctctcctggagtgatcattagcttcatgctatggttatctcctaggtggtcctgaaagctctgcatctctrtgaatcacagttgcttggcctctgccccctgagggtcctggatctcagtgatacttgtaaatatgtggtttcaattgagggagaaagttctcccgctttg

SEQ ID NO: 30950 - DNA, 201 bp, Bos taurus
gtgacgcccactggccacccactcattctgagaacccctcagagcgatgatcccgtttcgggcgctagagggggtggggcccgtgcatgcacgtgcgtgtkctcactagcagggccagctggagctctcctggtcagtccagcctcttaccgaattgggcgtgaggggtgcgcccaccacatcgatgatggcgtccttgct

SEQ ID NO: 30951 - DNA, 201 bp, Bos taurus
gcttactactcctgaaccacattccagtaaataggaggcccagctgaaaggttgtttcccaagagattctcaagtctctcttatatccttgaaataactcrcaaccactcaaggccacctgaataaagccccaaagcctaaaacaatatagatgggaacagagccctggatgggggtgtgaatctgctgggcaatgtgcgg

SEQ ID NO: 30952 - DNA, 201 bp, Bos taurus
ggcagccctggagatggccagcacctggtcactttctgggtgtggacctctgctcagggccttcctggctgagaatgaaggtgtacaggcctaggcctccrtggctgtctctgtaacagcctgagtcactctactgagaaactgaagactggaggaaggggctctcctggcccagaagttagaactcacccctcccagcga

SEQ ID NO: 30953 - DNA, 201 bp, Bos taurus
cggaacatcagaagacttggactatttttaagattattatattaataagattaggattataaggtgctctccaataggaactcctcttataagtgttctcrgatacctagtatggcgctaggcacatgggctttcagtaagtacataacaactgatatccaaagacatgtcaaaatagttatttttcgttggtaactctct

SEQ ID NO: 30954 - DNA, 201 bp, Bos taurus
gggctaggccccctgctggatagggtatctccagcatgtatcactttgccaacatcttttgatttagaaagagctgggtttcccaacatttaacactgaakttggccttgggccccaattgtatgggaagtagagaaatgcccaatttctcaacccaggttctttctagcttttgattctccctgtttgacttctccagga

SEQ ID NO: 30955 - DNA, 201 bp, Bos taurus
caccagggtcttgtggcctttttcctcacactgaagaggtcagcaataatctgtcactgtggacccaggctccccacttctccaccccacaatgaagtagragcttcttggccaaaggtcagggtgggtgaggggcctgggaatacagcctgtggaggctgctcactcctttatgtctttattaaaagtgacagaggaaag

SEQ ID NO: 30956 - DNA, 201 bp, Bos taurus
tatttgcagtggcatcctgggtcctatggtaccaagtggacatgtgagctcttctgctggggaggatacccttggggcctgcccttagcccaggacctggyatgcagtatggaatcaaagtattggtgttggatttgcaagcttgtattaggagacagggaaggcctgcatgctgcatgcagtccatgggatcgcaaagag

SEQ ID NO: 30957 - DNA, 201 bp, Bos taurus
ggggtgctttcaagcagaactttacaatatagcttgcctcttggtccttgtggctccttggtgttttgcctgaccctcatatggaatcagagacacagggkcaaagctgacaggatgactgcccagtcctgagtgcctaatgactaggtttggactttcctgttcactgcccaaggcacctaactccgtgtcaggtgattt

SEQ ID NO: 30958 - DNA, 201 bp, Bos taurus
ttggggcacagagagctcattagtaaggcactgggttttcctcataggaattaaggcccccaggaggagcgcttcaaaggaaatatcctcagactcctgayccatcccttacacagagcccaacagcaggtaaagaatggcgggggtgcaacagcggggcccaaggtttggggcatcccgtcttctgcctgccctagtttt

SEQ ID NO: 30959 - DNA, 201 bp, Bos taurus
gggttagatggagggaggcttggcccatccatccttctctcaatggaccaagctgttgaggctttatgtcctgcctccttaccaggcttttctgggagacrgaggggagggccatcttcctgcttcctgccactgtctctgtccctggtggggatgccaagatggaattctccaaatgttgtcaacaagaatcccacaaga

SEQ ID NO: 30960 - DNA, 201 bp, Bos taurus
ggggctcatgctctaaaaagccctgaactctccaaagggtttcaacaaaatattttttaaagccacatgcggggcagagcacagggccagttgggttgccrggtctgtgatcagcttgtgcacagttctctgattgggtgatggtgaggtaacacggtggtgttacaggggttaacattaacagtccttaggcttcaggag

SEQ ID NO: 30961 - DNA, 201 bp, Bos taurus
tgaaaatagcttcccaggtgctggccactcagttagaaccacaaatgcacagcctggactctgcctctcctccttcctggccacacagagttgtccccagktcttggtcaactcacctcttaaggacttctccaacctaccctcctcccaagccctgatgaaggccccaccacccactcccacaacagtgaagccatcctc

SEQ ID NO: 30962 - DNA, 201 bp, Bos taurus
tgtgagaccaactgacacagcaggactgttagaggaaatgcctatcatatgctcagtgtgaagtgtggcatgtactagtcattcagtacatgacagctgcrattaactgctgaagacactatatgctagccctgtaaagaaggcaagaatgaaaaagattccttatatgatcttgttaaaaattcaattaaaaaaatggta

SEQ ID NO: 30963 - DNA, 201 bp, Bos taurus
tgcactctgattttgtggagtacaaattaagagagtgaaatctatccctactgattgatagagctttaatatattcatccaacactgtggtgtgtgtgtgkggggggtgtgtgtgtgtggtcagtcgtgtctgattctttgcaatcccatggactgtaacctgccaggctcttctgttcgtggaattttccaggcaagaat

SEQ ID NO: 30964 - DNA, 201 bp, Bos taurus
ctctgcactttgacggccgtctcatggtatgccaccctggtgacccaggagttcttcaaccccagcacacctgtcaacgccaggtgagtgccaggacatgrcttgagccatggctgggcctctcgctccaccttctctgaggccactggccttcgtccagcagggtgcccggaggggaaacaagggacaggccccaggagc

SEQ ID NO: 30965 - DNA, 201 bp, Bos taurus
tattttttatacatatttctggttaaaagtgtaatcccctcctacccattagactagctatcaccaaaaagacaagagataacaaatgctggagaaaataygggaaaaagggaacgcttctggactgttggtgggaatgtaaattggtacagccactgtggaagacagtatggaggttcctaaaaaaattaaaaagagaac

SEQ ID NO: 30966 - DNA, 201 bp, Bos taurus
tcttaggatttgggaggagagtcatctctcctctcaatcacctctcatggttggccacaagaaagaaagggtcgagtaacctgagctgcccttcctgaaaygaggtgttctattatctactgagcattgagttgggcatgggcagtagtactctgtcctcaaaccgaaatgctatggaaaatactgagcaagctgcatgag

SEQ ID NO: 30967 - DNA, 201 bp, Bos taurus
ggaagatagtgaagaacaggggagcctggcgtgctatagtccatggggtcacagagctggacacgacttagcgactgaacaacaattcacctttgaagccmcaaaatcctgagggcctaccacacagtaggtatcaacaaaataagcattgccattcaggcatccatcatcctttttatagtgtgaagaaggctgatattc

SEQ ID NO: 30968 - DNA, 201 bp, Bos taurus
tttttagagtttaaaaaaatgtttatattctctgacctagtcatcacaccatgaagggaataaccttatataatagggaaaaaagctttatgcacaaataygctgacggcacaattattcaaaatactggaaaatcaaaatactggtatacagtagtcatttgatatttgttgatgagtaaataaaatattatcatctaag

SEQ ID NO: 30969 - DNA, 201 bp, Bos taurus
gtgtattctttttttggtccatgttagtactgtattgtatttatttgtaaattgtctcttatttattggaattctgtttgggtcatttcatttgtaaagcrttgtagaaaaactggaaaggtttgagaaaacataagatacagcattgagtgataaacagtgttgcgagaattatagatatgtaccttgaagaaggaagat

SEQ ID NO: 30970 - DNA, 201 bp, Bos taurus
ttattcccttgaacagaaattacaaaaatctgtggccttctgcttccagttttgctgcctgtcttttggacatgtgggcctttttaagttcttgtaagacrgctgttactctccagagctgagcccatcacttcttacctcctcagctgcaacctgtttctttgcctttgacaaggccacctctacttcacagctaccaag

SEQ ID NO: 30971 - DNA, 201 bp, Bos taurus
taaagcagtgggaaaaagcactccagagagtagccacaggaaggtagggtgaggggcagaaagagccaggggtgttttctggccctgtgtggtcagagggygatgctggatcagggctcagcttacccatgctgcccagcattgagctctgggggccttgcacctgtttataatgtgttgtaaaaacttagggctggctgc

SEQ ID NO: 30972 - DNA, 201 bp, Bos taurus
aaaagaaaagccaggcctcttcccttggcccagagtcttatgtggatgaacatacctcagcttccactgctttctctgagctctccaagtcccattaacaytggccaagatcattgctgcctcagggattttgtgcttactgttccttctgcctgcaactttctttcacctgatttttatagggtttgcttcttcttcatt

SEQ ID NO: 30973 - DNA, 201 bp, Bos taurus
agggggaaggggagccagttccactgccttacttctcaccgaggacagactgaggtcttcatggccagttcagggccctgtttcctcagcaaacatgccaycttgtgaagtccttgatttctaaccccaaaatggtgttgatgagaggttggtgtgaaaaataactggataatggatgtgaggagattagcagaggcccag

SEQ ID NO: 30974 - DNA, 201 bp, Bos taurus
taagctctaggagtgtgcctgcatcctcccgaaactcaagagtctagctgatccaaccactccctagccacgtggccacagacaagttgcatttcctctcyagatctcagtttcctcatctccagaatgggattgttctggcttcttcaccaggggcatagtttggtattttgaggccctgcccctcactggagtgctgtt

SEQ ID NO: 30975 - DNA, 201 bp, Bos taurus
gcctggtctgctgaatgttctagaaaggccacctggctacgtgtgaagaccacactgcaggaagccaggttagcatggcaggctggtgctctcatcaagargtgatagtgcggccagggtggcagccttgggaagtggttggattctgcgtgcagtctgaaggcagagccgacgtgatccaccaacagatgggaggtgtag

SEQ ID NO: 30976 - DNA, 201 bp, Bos taurus
aggttaggacataagttgaaagggccctttgactgttaagcctccggacactgtggtcactcctcgccagggatacagccacctcctgtggggccaagccrgtgccttcacagaacagggagccatagactatggtgcccaatgtgccacagagccataggctatggtgcccagttattcacggaggtggggatgaactct

SEQ ID NO: 30977 - DNA, 201 bp, Bos taurus
agtcaaataaggatgggggcgactgaggagggagcagcccagggctgccctgcgtgggactcatcactgccatctggcccggggagagacttatcacctcrtcactttgtagaggaggaaggctggggcttggacaggtgatgctgctcataaggccacagtggtcaggggcagagcagagacttaaaaccaggcccacac

SEQ ID NO: 30978 - DNA, 201 bp, Bos taurus
ttgacatacatgaagagccccaagaaagcccaggccctacgggagctctgaaggttttagccatcccgaacctctgtccctgagggttcctcagggctgcmcagggccggggtgcagcctagcccctcaagggtccacatctctgtgaggaggcggaaacataggcaaaaagacaggatggccggctaggcaggacccagg

SEQ ID NO: 30979 - DNA, 201 bp, Bos taurus
cagctgaaagggagcttatttacacagagcagctcaatctttctccccccatcgagactcctgacttcttttcaagggatctcatgttttgaaaggtattrtatccaaataactaataactcattaatttcctactatttattaatcaatatctatagtccagtcagagtttctgattagcatgagatgtttatattcacc

SEQ ID NO: 30980 - DNA, 201 bp, Bos taurus
gcctttccagagagaccgtcggtctatacctgtcaggccatctgatgacaactgcccaggcctcctgaaaaggcctgggagtccccagcacaggcccagayacccacacagtggctggagacaggtccaagagaggatgagacagagaatggaagaggaggaggagaagcaagaggaggtggcagccccggggggccccta

SEQ ID NO: 30981 - DNA, 201 bp, Bos taurus
gccagggtcttggatttgtgaggttagaggctgaggaaatatgaaaagaaccaaaataagaacactgtccaagaaattcaagcttggttgaagagactggkcctctttaactctgctgagtacattagatgcaggaaacatccaagttcttgaaggcacatcttctgttcatttggcctttttgacttgtggctctagcgt

SEQ ID NO: 30982 - DNA, 201 bp, Bos taurus
gacagcccccacagcaaggccgtctctacaggggctcaaccggagaaccccctgaccactccttaaaattagaaggcacacatcactactcaactctgaaygcataaataacccatcagtctaacagcaacaccaaaattcacattgtctcgttataaaaaattttataaccctgaaaatttaagacccaaatgcccaaca

SEQ ID NO: 30983 - DNA, 201 bp, Bos taurus
tgacttcacccccagtgctttcgcaaactctgaatcacagcatcccaggcccctcagaaggccctgctgctgccgtaggccgctggggggacacttggaaygcagaaagaatcgagcgttcagcgcaggggaagtggatgagggctgcagagggcagtgaagaccggcccgagccggctcccaggtcatcacacctgatgg

SEQ ID NO: 30984 - DNA, 201 bp, Bos taurus
attagtgcatttccaaatatgagggtgaaagtgactaccagaagatgtgaaataaatgtaaaggataacaaactcacacctatttggttcatactgccatratttcatcttcaaagaagaagatttatattgaagttaacagataaccctccatgaaataatcaagaggagctcagacttttcactctttctttatttttg

SEQ ID NO: 30985 - DNA, 201 bp, Bos taurus
aatacaatatataatgaacttgtttttgttctaagtttccaatttcagtttgctgggagaaattaactaggtgtcttagatatccaaacagagaccttttytgaggccaaatcaacccacctgtaaagactgaaggaagagtacccaggcttcacatggcagttcactttcagacactgaaagcagtaattcaaaacaact

SEQ ID NO: 30986 - DNA, 201 bp, Bos taurus
aggccttgcctcttatgggtcaggtcctagggtagagacagtcccccttctttatcagcactagctccggaggatgagcatccttgtccaaagaatgattrggcttgtcatcaagataggtgggatcctctttcactaagtggaatcatttggttgtgtcttacccactgtcaaatctccatggatctagttactcccaca

SEQ ID NO: 30987 - DNA, 201 bp, Bos taurus
atataccataaatagtacaataggtagccactgccttcagcaaataaggtgagtttaattctgggattgatttatatatgtgtgtttgttaaaattggccrttttaaggggctccagaaaatatacctaaaagcagaatataggatgaaaatgtatctacaaatttatctacatatctgatagaatgtgctggtagagact

SEQ ID NO: 30988 - DNA, 201 bp, Bos taurus
agggccaggtcttgcctccagggaggcctggctccaaacatagtctcctgccaagctgtccctctgtgggggcctcaaccatgaaccaggggactgatatytgttgccatgatcatgaggccagtcctcaatggggctgttccatccttgcccagaaggtgactgagagagggcaggagtggagaggcagtgagaatgtga

SEQ ID NO: 30989 - DNA, 201 bp, Bos taurus
gtaagagatttctgtgagtctctgaggtttttttgatagtgtatttattgtgttggcgctttgcttttcaggattcaaaagccaaataaaccctcatggarttcagctcaaggtttgaagacttcctagcttgtcctatggacctcaacaccaagaaccacaattgcaaatttaataggtcattttgtatcaaaaggtcaa

SEQ ID NO: 30990 - DNA, 201 bp, Bos taurus
aagcaactgttagtggtcccagtaagccattggttggcactgcagtagtcccctccccctcctctgcataaaaggggcccaaattgggactgggacaagayggtttttttgagacgctagtctgccatcttctcggcctgctagctttcttattaaagtcattcttccttgcccctaaaagttgtctccggattggttgat

SEQ ID NO: 30991 - DNA, 201 bp, Bos taurus
tcacacgcccccatggcagagcggagcggggctgccctgggcctcagcttggaggagagagccgcatgggcggactaagaatggggggcaggagggccggyaaacagcagcaagtggaagccaaagccctaggttcccaggaggaacgtccacaagtgagcagacgtgatcctcccctgactctcagctccgagccaacat

SEQ ID NO: 30992 - DNA, 201 bp, Bos taurus
gaagtttcagagctgtttctggcttcctgtgtgtgcagatgaggcaggagatatggaaacccttagcgtacaggtgctggctgaagccaaaagctagatayggccttgggtgtgaggagagggttaagaatggaactttagggaacagcaacattaacaagtgaataaaggaagaagagggcttccctggtggctcagtgg

SEQ ID NO: 30993 - DNA, 201 bp, Bos taurus
tgacctgggttcactctcaggcctcttcagagattcgagggtaagagttgattatgtcttaattcgtcttgtctggctgtctcctggatttagctgaacayggcccaggagacatctgccagttgactgctattttctgaaccagacctcttttctgaccaagacccgtttgtgaggactaaggctgtgctctgtgcggca

SEQ ID NO: 30994 - DNA, 201 bp, Bos taurus
cagctggggcatcgtcactgtagcaagctggcctcagtgtagtcagacatctcactcggtgacgggcatcctcctgagcacccccaaacagaagctgccgrgacttcttaaggcctaggttctgaatttgtgcttcaaccacattctactcgtttaaataaatcttggggccagcccagaatcaagaggaggtaggttcac

SEQ ID NO: 30995 - DNA, 201 bp, Bos taurus
ggagttgctgccacccacatgcaggccttcaacgcggagactccaaaattgtttttcctaccgtgcactcccatgggacaagagttatcaggaccatgccygctggccttttgttggtctgggaggggtggggctcccttcacagctggattcctattatgagcggaatggcatctgtatccagaggtaacatgtgattaa

SEQ ID NO: 30996 - DNA, 201 bp, Bos taurus
ttaagaatcttaagcaatgacagttccactagggactagactcacagatcagagcaaagcttttccagacattttgtctggaagtgacggttagttttgcrctggtcttagttggcaaagtcatcagcattgtcagtctcagaaagcagagacacccaggaaaaaggagagctgtggagtcagaagacctgagttccactc

SEQ ID NO: 30997 - DNA, 201 bp, Bos taurus
atgaaaggcctgtcagtgaatcgctgggaaaacattcccaaacaaatgccctctaacgaggggtgctgagagcagaggggcctcgggaacgggtaaggtcktggttttgttgtgagcggtttggtcgaagggaaacgccagaccccgtgcctttgtgtgcaaatttcccacccgggccaagcgactttccccaatttaatt

SEQ ID NO: 30998 - DNA, 201 bp, Bos taurus
ttgaatctctgcctcacttctgcaagactgcctgtgatcacaggtcactagtggccgccatgttgctaaatccagtgaccacttctccaagcttattttayttgaccatcagcaatatttagtacagttgaccacatattttaaatatttattttgaaacttttcaaacccatagaaatttacaatgttaatctagcagac

SEQ ID NO: 30999 - DNA, 201 bp, Bos taurus
caaggccagcatttgatgccaaacccagcctctgtaccctgacaccgaattaagtcttgaagacaagagttttgagtgaagtagaaataaatgaatggctktcttgctttgccaggcaaagcgggccacagggggctaatgccctcaaatctgtgtgtcccgacctggtgggagtagtgaggcatttgatagtaatggttc

SEQ ID NO: 31000 - DNA, 201 bp, Bos taurus
cttttgcaacacatcacttaatggccattaatgtaatatatatactgcatcctggaaaacagaatcttaaccttgcagggtgctatttttcaagctgccaygttgctgagtttttaaggggctattacaacattctatcagccagaatcttccaggtgatatgatatacaatagggccaatgaatcccaatgtcaagtatc

SEQ ID NO: 31001 - DNA, 201 bp, Bos taurus
tggaaataataacttagtttgtagcatcaccttgaagcatagaaataacatctgtcgaatgctgagtgcaaagcctagagcttagtgggtgctcaaaacayggccttatctatgttacatgttctgtgcatatgtatgggctgcgggacaatggcagagagaactaggtggtgcctgggaaagcgcccaaggtccatgggg

SEQ ID NO: 31002 - DNA, 201 bp, Bos taurus
gccccatgggccgcactttctcttacttgtcattgaagcctctgcagagaaatgcacacagagatttgctgttggttaagtgagaggcagacagcaggacrcttagaaggccctttgcaaatgtgcccttcactaaagtgataaggaaggaatatatgagttatgggaatggaaccatagacgcctacaaacgggacacct

SEQ ID NO: 31003 - DNA, 201 bp, Bos taurus
tgacttccagcgtttgattggttttttcccctcttggtgtgtgtgccattttttacagaggaggcgagaagcacggcagcagcgatctagaaaagtcggcrtacgctactatgaaacacacaatgtgaagaataggaacaggaacaaaaagaagaccaccgactcagaagggcagaaacacagacacaagaaagccaaaca

SEQ ID NO: 31004 - DNA, 201 bp, Bos taurus
ccccaaggtaaggcgttcagagcgggtggcagcgtgtatgtccatgaacgtgcacaagcatccctgtgtgtgtgcaggccccttctgtgtgaagcgtcgcrtacctgcgtgcttggaggtgtctctcccctgggcagctgccggtacctctgggcctgttctgcctgcgcggacatgcgtgctcttgcttttgtgctacat

SEQ ID NO: 31005 - DNA, 201 bp, Bos taurus
tggctcagagccctgtgttttggaaggtgccagttaaagtacaaattgattacttgatgtgtaccacacttagagaatgtgaagcttcactcagtccttcmgggggtgtctatgaagcatgtgtgctggcctcagcttttgaatgcattgggggctacagacaagtttcaaagataagggaacataagagggacaactatc

SEQ ID NO: 31006 - DNA, 201 bp, Bos taurus
aggtggccaaagtattggagcttcagctacagcatcagtccttccaatgaatattcagggttgatgtcctttcggattgactggtttgatctcagttggtkttggtggagtgcaagaaggcctgaatgaatgtgtgaataatgagtctcttcttcagcttccttgctgacccctcaaagcatttcagaccccatctccttt

SEQ ID NO: 31007 - DNA, 201 bp, Bos taurus
gctcagcttctcctgtccacaaggttggccggtatgggctgagcttggccaggcagattggctctgcttctcatgttctcatcctcctggggccagccacrtctcctcccagtgatggctgagattcaagtcagcacgcctaatctgtcaggcaccctacaagcctttggacatgttaaggcctccataatgaccaaaccc

SEQ ID NO: 31008 - DNA, 201 bp, Bos taurus
taagaaatattttaggttttatgggacacttgcagatatctgttgcatagtctttgctttaaaaaaaaaaaaaaacttctttataaatgcaaaaaccattmttggcccttaggccatacaaaaacagactctagaccagatttggcccaggggctgtagttggctgacccctggcctggaacattctgactcccatgaggc

SEQ ID NO: 31009 - DNA, 201 bp, Bos taurus
aagcaacagaaaagagccgaagtcaatgctgagccccaacgaggtgctcaaagaataatggttccatctaaccttgtcttccgtgggccgccctttcccakgaaagcagcaataacagacagcatgtttactgcattcttgccacgtgccaggaccgtgcaaagggctgtgtgcgtgtatcatcctatcagagtctcacaa

SEQ ID NO: 31010 - DNA, 201 bp, Bos taurus
gttctgtgatccatctccattgagcctatagatcaggccctcctggttgccatcccaactttgctgcccattttagtaatcaccccagcctttctcctgaytgctcagtgcttccacctggcctctgcatttagactcctctccttcccatcaatactgggaagcccagctctgagacagcatctcctcccatcagtttct

SEQ ID NO: 31011 - DNA, 201 bp, Bos taurus
cttgtaaaagaggttgatgggggctggggggcaggtggcaggcaacaggtatgcctcgcgtgcttctcacatgacacctggggatgactcgtgcctgtgcrcaggcctggctgtgtctgagcagcttgacctcatggagaaggccccgcagtgacagggattgacagaccgggctcccagtccaagtgctgcatttgcctg

SEQ ID NO: 31012 - DNA, 201 bp, Bos taurus
agcctccgcagaggtacagggccctcttattttgggatgcttggaagcgtgagggactctctcgtggttgctatggccatgtggatgtgtgaagagtctcraactcgccacctgtttggtgaaccacctgatgtgtgtggtttacctgctgcaggcccagcaggaccctgggtcgggaggggccttgctgctggggcccgt

SEQ ID NO: 31013 - DNA, 201 bp, Bos taurus
gttcatgacgcacacacagacgagaggagggtttctgacggcggttctgacgccgtctgggggggagggcagaggaaggaaaggcggcatttcactcctcygtcccgtcagcgtctggaagagcagctggggcgcagcgacagcccctcaattcctcaggccgggggcgcaggcgaagaccccagtccacacgtgtcattt

SEQ ID NO: 31014 - DNA, 201 bp, Bos taurus
gttaaaatgaggccttaagggtgggcccttatccaatcaagcatccttataagaaaggaaatttggacccacagagacaccagggatgcacatgaacacargaaaggccatatgaggacacagcaagagccaagcagagaagcctcagaagaaaccagatctgcagacaccttgtccagcctgagaactatgagaaagcaa

SEQ ID NO: 31015 - DNA, 201 bp, Bos taurus
gaagagggtgctcagtgagaaagctgggcagcccagaaagtcctaccccatcttccccagggcagattagacgtggagatgtcaccttctgttgagcacaygtgaccatcagtctctgtagtaggatcacctcatgggtctgagacacaatcattgcacaggccccacctcagaagggtctcacaaattctggagctactc

SEQ ID NO: 31016 - DNA, 201 bp, Bos taurus
gacatataagacaacctcaagaggaacccattttgcaaagcaggaaactggactcctagagcccagctctcctgacccctggcatccagggccaggacctrgaggcacagatgactgttgggaaacagtcatccagtcagggactacgtttcccaggattccttgcagctaggtggagccatgtgaccaagttctggccaa

SEQ ID NO: 31017 - DNA, 201 bp, Bos taurus
ctttcccctcttatgtggtggtcagggatgctggatcccaccccccagacaagagggcgcacccagaggggccctgcccacaagggaagggccagggaaarcatacggagggactgaactcaggctgggtcctggaggagagatgaagcgaggagagcagaggcggggggacaactaccccgttaggggggccagggtggg

SEQ ID NO: 31018 - DNA, 201 bp, Bos taurus
ttgtgaatgaaccttagttttaaattctcatgtgtgaactttgcttcctgagaatcccatccaggtggaattacctgacaaagactgtgcggagttgaacygcctgattaatatctgtaaggtatgcagagcagcgcaaggcacctcggaagtgcatttttagcattaactatttattagaaacattcttgtcgtacttgt

SEQ ID NO: 31019 - DNA, 201 bp, Bos taurus
ttcagccactcagtttcaaggtcagaccagggaacccacgacggttgaactgcactagcttcaatgccttgctcaggctgcatagaggataccaacaatgkggggagggaggcttgaggagtcagtagtgccatcaacagcaagacggcagagccctggtcgtccctgtactgaataacacctatgcccttactcttagcg

SEQ ID NO: 31020 - DNA, 201 bp, Bos taurus
agtttccatggttcttcctccagttctctggtagcatccatacctgaacgtgacctactttgtttctcgtcatagagagaggcctgacagataccagctcyggagctgctgccaagatgaagcgaaataaaagcacaaagtgtttagtgagttcctgacataataaggccataataagaggtggctgttgttactacccca

SEQ ID NO: 31021 - DNA, 201 bp, Bos taurus
accccttggagccatacttagctgctgggggaccacagtggtggttacccatagatggcagggacacagcagactctgctcctaagggcccatgagagagytggagatgcttgggtccctgcctgcatctgggaagtagcaccttgttcctcctctgcaaggttgatgctctcttgttctcagaggtaggccactgggctc

SEQ ID NO: 31022 - DNA, 201 bp, Bos taurus
gtatttaatgggttgtctttctgctcttgctaaaatataggctctttgagaccaaggaaagattattttccccccactgatggactcaagaacacttgatyggggcctgggaccaagaggaaagctgataaatatttggtgatttatggataggagtggcggcaggccaggaaatgttagttttcatgaacttccactccc

SEQ ID NO: 31023 - DNA, 201 bp, Bos taurus
ttgacttcactgcttaatggtttcggaagcgactcaattctaaaagcatgcccacccactgttacgacaaataaatgagaggccatccttagagcaactcrtataaagcccaaccaggaaagactcatgtcggtttcaccctcgcagtacattccaccctgctctgccctctctggggacttgaatctagaccctacttgt

SEQ ID NO: 31024 - DNA, 201 bp, Bos taurus
cccttcctccaggcacgatggttccagggctgctgtggcaaaacggcggcccctgtcaatcacccagaggacccagagctggctcccacaccactggccaraaccttcaatgctcacaaggttccccccctttcttgtgccagattctctcccaggaaccctggggtatgaaatggaacttggggtggtccgttttcagga

SEQ ID NO: 31025 - DNA, 201 bp, Bos taurus
tggggctcctggcaagcaggtatgctcagcagagccaaacaactcctatgtccttgtcctgagagacagtggagagctgagggcatcagaggctgcactgyggccccagatcccagctcagggctccagtccagtttttccagtacaaaaggctgattcattacatccggatgtccaaattctatgtgtgactttcaactg

SEQ ID NO: 31026 - DNA, 201 bp, Bos taurus
atttgcctgctctcagaatctcattattccttgtgatgtattcggtcttactgccaccttttaatacatccattctgcctgggcttttaagaccttcattrcttcaatacatttagtttcaaatgttccgcctggaagggctccagccttcttgttctcacaaatatgaattcaattctggtaattgctaaatggatacac

SEQ ID NO: 31027 - DNA, 201 bp, Bos taurus
ctcccccctcaaataaaatataactctcaacttataggttgtgactattttttttcaaagtcgacaccagcctcctcccaagtggtcctgcgtctcagagragcaaggtcatggaggccacctctgagttggcggttcttacaccctagagaagaagtgttcccactcttgcctcccctccacatgtgcccttggtcccct

SEQ ID NO: 31028 - DNA, 201 bp, Bos taurus
tatagagcttatgcaaatataaatgaagattccttaggtaaaggaataaaatgaatctgagatgccagtgtttgaacaaacaagcagagagtgagcacagkgatgaaaatgagatagaaacgtccatttctatgaccgtgtcgtgggggtggtttagactgtgactagaagaagcctgtgtggtggtgtccgtggggcaac

SEQ ID NO: 31029 - DNA, 201 bp, Bos taurus
agcctggtgggctgccgtctatggggtcgcacagagtcggacacgactgaagcgacttagcagcagcagcagcagcatagagacagaaggccatgaaaackgaaacccaagaacagggactagaacattttgactaaaagaaacgtcaagatggacacaaggcaagctggaaacccgggaagaaaaggcccatgcgatgac

SEQ ID NO: 31030 - DNA, 201 bp, Bos taurus
agtgaatcccctgacagacgaaagactttcctaatgcagaggcggacagaataaatgtgcaatttgtccacgacaaagactgtgccaccaaaggccttcaycttctacaggaacgagactagtcagggaccatacttgtggggaccacagcctgtgtgcggggtgagcaagaaaagggccgcttcaggggaggcttctggg

SEQ ID NO: 31031 - DNA, 201 bp, Bos taurus
ttggcctctgtcatctgacggtatatggtggcttccggtatttgctgtagagtttccacatggaggggaaatgctgacccagcaaactgtggaaagttccrgagtcttaatgacaaccacagtccagcaccgtaggttgctctgttaatcctcataacagccctgcaagatgcgtgtgcttatcaccttcatagatgcgtg

SEQ ID NO: 31032 - DNA, 201 bp, Bos taurus
cctatgctaatgacagttacccagttcctctcagccctggggttctgtcctgtctccttcacagatccagccactggggcaggacagctggccaggagacytcccgaagagttgtattctcaagcagatgctaggctgtgcatcccagggagtgtgggcagggcccctcgggttgctggccgcctctcaacaaaccatcta

SEQ ID NO: 31033 - DNA, 201 bp, Bos taurus
acttcctgcttccagagaagagaatcgtgtggtcagcttgcatcatgttgaataaatgcctttcgggtcactgaccagtgtgccactgaaggccatttcgyactaaattccttacaagggtcttgaccgtgaagcttgggagtgctcagaaggtgaccaaggatccaaagagggtccccaaagtccctgcgggaaactccc

SEQ ID NO: 31034 - DNA, 201 bp, Bos taurus
actggggtgaggaggtcgatcatgaatgtgggaagccacagctcagctcaaaacaacccagaaggtcaggagggaccttctctgggcttggccccagcgcygcacaagaattccaagtgtttcctcacataatcccagcgtgctccgtatgccagcgagtcatcagtcctgagctgaaggcccagaggaatgtgccagagg

SEQ ID NO: 31035 - DNA, 201 bp, Bos taurus
aaaaggttcacaacattacacacgattttttctttttttgaggagggcatctctctgtattcccttttgttataaaatggtcatgttagctgtccatcgckgcatttgttagactgtccgtctacttgagaggacgacagggtgagtgccacccacctgtgaccctgactggagaagctatcgtccctgtgattccctctc

SEQ ID NO: 31036 - DNA, 201 bp, Bos taurus
gtggccaaagtattggagcttcatctcaggtgaccttcagacagctgtataatgtaagcatgtgcttctttacccctgatctatcatctacatcccttgcmtcagcgcccagccaatggccaggtgggtccggtgtgtcctggggagaggaagggctgagtcttctgaatgaccacacattctatctgtgatcgtggtgcc

SEQ ID NO: 31037 - DNA, 201 bp, Bos taurus
gttcagacagactaaatggaaacctgccattaggcagggtgggaggcttgttctgtggagagagagggctttgggctgtggggacctcaggtgcctctgcygtcaaatacagccatgtcaaccctggtgatcagtgttttgcgtcctggtttatatagtgagagaacagagagcttgattccgattgcagtcttcagaatt

SEQ ID NO: 31038 - DNA, 201 bp, Bos taurus
gacgaagagggtcaggtccacagacacatgtagcaccatattgataggttacgcggcagaggcttcctcccaagtccgggtgtaaatcaaagcatgagacrgtacagtgcgagggaatctacacccagagctcctacaaagacaacggcgatggctgactccttcttcttcaagaggtatgtgtcgctggtcggccacgcc

SEQ ID NO: 31039 - DNA, 201 bp, Bos taurus
tgggggccggcccgcccagcagggtcagcccacggatggctccgaccacactctgctggtccatgtaggaattcaggtagaactcaggtctggtccggtcrctgtactgcaccacggccacacgcacccggtctggtcccacgtccaggctctccaccactctctggacgaactccttcagcagtgggaagccgctcctga

SEQ ID NO: 31040 - DNA, 201 bp, Bos taurus
ctcctttccccggggtgccctcttcaccaccagagattaggagagtcccagcccagccctcaaagggacttgcctgcccagctaccccaagagacagggayattaaagggccctcccgtgggacccaccttccacgctgatcttcctgaagtcatggacgagacagccatcccgccttgcttgtccggtccacttcaaatc

SEQ ID NO: 31041 - DNA, 201 bp, Bos taurus
ggtggaccgaggttacaggactggccaaggcgggcaccacgttcttggcagagcgcagctccccgcacgggcagtgtcggtcccagacctgatcgttcctyctcggtgcctctccctgcagaaaaaaatcagacggtgacgctgacaataataattagcttttcactgacttcagtgctaatcctccttcaagtcgctttg

SEQ ID NO: 31042 - DNA, 201 bp, Bos taurus
agaagaggagctgatggaaacaggcagtggccctgaccaccaggaacaaggaagctcagagcttcagcagagtcacagaggggcacttgcacctccccagyttttggccctctctgagaaagtgatgtctaagcttaaaaaaaaattagggtaaagaaggaggaaactgtccccaaacagaagtaacaccatgaatttttt

SEQ ID NO: 31043 - DNA, 201 bp, Bos taurus
ctctttttgagagctgctggaggctggagacctccatcagccagggcagtggcccgacgcccacccacactgccgcagcccatctcccaggcccccagatmaatgtggttccacctgtttctgtttcaagccaaactggggtctgagtccctccacagactcctgggccagtgggagggctggctcagcacacagtccacc

SEQ ID NO: 31044 - DNA, 201 bp, Bos taurus
ccacggtgggcccgccgcacagcccctgctcccctccgcacggcctcctctaaaccaggctcttacggccatcaaggactcttcactaaagccagtgacgyctcacttatcagcacaaagagccaaccccaaggtgaacatgaaccgattgagctctgagcctcacctttaggaaatttcctgattaagttctgatgcaaa

SEQ ID NO: 31045 - DNA, 201 bp, Bos taurus
ttccgttcctggtcaaggaactaaggtcccacgtgcctggcacacaatacagccaaagcaaagtgggaggggggcagagaactgagaacaccacgtgcctrtctgggaccaggcactgggctctcaacagctttgtaagcaaagtcatattggcggtggacagggcgcacaaggtgtccctcgagtcttcaggtgagagcc

SEQ ID NO: 31046 - DNA, 201 bp, Bos taurus
caggggaactaagatcccacttgctgcaccgtgcggccaaaataaaaaagttttatctgaaagaataaatacatggtcatagcctttcataaaaatgctcraaaggaccagttttaggccagtaatgtattcttcacttcattcctttaaatagagaaagaacccctctagctgggcgtctgagtccgcgtttccctgttg

SEQ ID NO: 31047 - DNA, 201 bp, Bos taurus
ggcctctgtgatcaccgtgcctcagcctcatatgtgcccacaggcagtggacatcctcccaccaaagagccacgcaggcaaacccagaggacagcccaggkagtctgggccctcggctggccgcggggagaactcagcaaagaagggaagggcagagctggttctgaagccgtaccctgcagaactcctggtgcaggcacc

SEQ ID NO: 31048 - DNA, 201 bp, Bos taurus
acacggcctccttccaggccttaatgctgcccccccaccccgcaaaaaaaactccacaatcaaaactgttgataacacacgttcgtctggccacagatttrtttttatcctttataggagtggaagcacggagcatatatgttttgtgtctggcttcactcactcactttgtatatgtgcggtttgtatgtgtagacgtag

SEQ ID NO: 31049 - DNA, 201 bp, Bos taurus
tgcgaggctggcgggctgccagggaagagtggccagtccagaacccccagttctcagtgtctgcactgctctggctctctgcatttgccctgagacacatraacacctgtcctgcaggcccatcaggtaggtgtctttcggtcagagttagtgaccacggggggcaggggaccgggctctgcaggggcggctgtcaccatg

SEQ ID NO: 31050 - DNA, 201 bp, Bos taurus
gcaaccagcccaggccacgcccagcaggtgcccccggcctgagcaagggtcggtgcccagaggctctgcccctctgcaagccaggacagtttcccggcctkaggtaaggacagaaaactcgaagtccagctctgccccagagaaccttccagatcacccagcaccagcccctcagtcgtaacttcctgggggctttgaccc

SEQ ID NO: 31051 - DNA, 201 bp, Bos taurus
cacccatgtcattggctgaggtgcatcgctggctttctctggttggtcgtgatttgcagggcaagcgtgagggaggctgtcagttactaatcccatcccartcatttggggccagttgttacaggcgtggatgtttcactttctgaactgtctctagagacagaggtctgccttcctaaaacaatagcgggcagcaaccgg

SEQ ID NO: 31052 - DNA, 201 bp, Bos taurus
ggctcgggcgcccggaggcgcagctggaaggcccggagggcagggggacacgaggtccgcggcatcacggggtttcctgcaaaggggtataaagtgctcayttgctgacccccggccagcgcccccaaggcctctaaaaaggaacaaaaaggctagaggtccagggaccacagcgggaaggtgtgggtgccctccctgagg

SEQ ID NO: 31053 - DNA, 201 bp, Bos taurus
caggtgaggcccgttcccctccgtgtcgcctgaccccccagcacaggtgctccggttgcttttggtaacagccttgcttgtgcgaatggagccctttgcamacctgcagtgctctggcctctgcacccggagcccagaccacaccctggaccaatccagtcccacgtcagcgtggctgccttgggaagggggcatcctcac

SEQ ID NO: 31054 - DNA, 201 bp, Bos taurus
gtaaggaaataactgtcccacctgtctgtcgagggtcatctgaggctccactggagaaaagaccaggtgtcctttgggagccagggaaggtcctggacccrtcagtctctgatcctctcggccatcactggcttgggggccctgagtcccccttgggactggggaatgcgctgcttccagtggccccagaaaccaagcaga

SEQ ID NO: 31055 - DNA, 201 bp, Bos taurus
gggtaagacccgctggaggaggggcagagggggtcttggagagtgtgagtccaggtcaggggcccctcttctctggtcaaagagaaggaccaaaaagcccrggcaggaaaagccttgaccagaaggagactccaaagacaaagaggaaagggtgtgaatggatttgttgttgttgttcagtcactcagtcatgtctgactc

SEQ ID NO: 31056 - DNA, 201 bp, Bos taurus
gctctgcctctgctgatacagaggaccaggaagagccaggaagagccccccgtcctgatcagagaagtggtgtgcacggctgggaagaacaaggctctgtycgggccagaggactcgagggccgcggagtgcgatggaggtgggacgcagtggatgggaggacttccggttccatgacttcacctggttggtgaagcagag

SEQ ID NO: 31057 - DNA, 201 bp, Bos taurus
ctgcaaaacccagctgggcctgcagcaggccaggcgggtgctggtgcctctggagtgggaaaggtgcccacccgtccagggtttccattcagattggactygggccctggtctcagtcctgatccagaactgaccctcgaggaagcgcagggcacacaccctccccgggagaggccacgcctggccgttcagcgtgggggt

SEQ ID NO: 31058 - DNA, 201 bp, Bos taurus
gccctgcaccccactcttctttgcaggagccaagcgtcctcctgccggcccagcccatccacaccatatccgggccaggccccctcagagggaaacctctrtgtttccacctgacacgtgaagccggtccgcctagtcgcacagggttaagtggtggaggtttagtccctaagtcgtgccaactcttgcgaccccatggac

SEQ ID NO: 31059 - DNA, 201 bp, Bos taurus
ctcagaaggagtgtcgcttttggacttccagcctgcagatggtgagggaatgtgctcagaggaggtaggcctccgctggggcccttgctacctcagccctkgggaactaaagcaaaaatatccctccacggggagtgctcccgtcagaaggagtgtgatgtccagatgggcgtgtgtgcgcggcaatggggagccggggag

SEQ ID NO: 31060 - DNA, 201 bp, Bos taurus
agccttcttaaggaaagacataaatgatccctgttacacgtgtggtcagggctgtccctggctccatcatgtcctcccatttcctgcagtttcctctcccrccgtctagctgctccgagagccggtctcgtccctgctcacagatggccgcactagccccgctgaaacagaaccgctggggcagcaggggccagggagatc

SEQ ID NO: 31061 - DNA, 201 bp, Bos taurus
acgacgggcctggccaccatgcacctcaccggtaggaccaatttcaaatcgcagggcttccaagaccgactgcctcagcaccactaaggcggtgaatggaygtgtgtggagatccctctctggggtcacagagtcactgagcaggagaaagaggacaaggggcccaaacccgttaggtgtgagaggtaaactcaaagggtg

SEQ ID NO: 31062 - DNA, 201 bp, Bos taurus
accatggccatggggaaacaaggctcagatttttcacgtgaaaatctgaggttcacggtgaaaaattcaggaactcacgaagacacacgggtcctcagacrctgaggccacgactcttcccaagggacgtcaacaagagaaacagtgagcccatttgggtgcaggctagagactcggaattattaagatggactgttagag

SEQ ID NO: 31063 - DNA, 201 bp, Bos taurus
gaccctgggccggtacgtttcccgaccagaccctcagcccgggcaaccctgcgcggtcctgggcgaccctcgggcacagagtctgaagaggggacgagacrggtattgtcacaagaggccagaaccagacccggcgacaccctcggacacacgaaaaggcgcctggaagacgggtgacccagcgctggcactggccacccg

SEQ ID NO: 31064 - DNA, 201 bp, Bos taurus
tgtcaggtcccaggccgggcgagtcctcacctaggttttcccggaggagccacgtcagcaccgagtctctgtagggaatgaagtctgtcttcttcttcttyttgttctgtgggggacgggcgtccaaggtcagccccgagcccacctgaggtggggtcaggggggcacagacggggagcgcgggctggctgcccagggctc

SEQ ID NO: 31065 - DNA, 201 bp, Bos taurus
agccaccgagagttctctctgctgcaaaacagcacccctccccttgcccagggcctccctcaccaagtaagaacgctcatcagggcctccctccatccccrtgggtgtctgcccgtcctgtccaggtcagcacctttctagaaaacaggaggaaaaccccgtgtgcggaggccaagtccagggacagtgggccctcctgca

SEQ ID NO: 31066 - DNA, 201 bp, Bos taurus
tacagccgacagactgcacgggaacgagtgtctgtgaacagagagagtcagggtgacatgttgcgtctacaccaaaactttaacaccggaggtggagtggrtgaacgcagggtggctcctgagtttccagggaccacgggctctggcttccccgaggaacttggcctcctgcaacaggtaggggttgattacaccggcctg

SEQ ID NO: 31067 - DNA, 201 bp, Bos taurus
ggacgacagtgccacagcggcccagaatccaacctgtcaacccagggcttccatgggtcagaaaagctgatctgataggagtggctggggtgacctgaagkggacttgtggcagaacaaacgggccagggtacacaggccggcacgcctgggcaaggctggagctgaggaggggagtggtcctgttcctcattctgaactg

SEQ ID NO: 31068 - DNA, 201 bp, Bos taurus
tgagcacctctggggcgtcctttacctccttaggctggcttctgggcagcatgaatgtcttgcactctcttcccaacactgggggtgtccaggagacctcrgagcagcagagggcccaagggtccccagggaactcaggacagccagtctcttgggagccaggaggcgcccccccccattgctgccttcactgtcagcccc

SEQ ID NO: 31069 - DNA, 201 bp, Bos taurus
gtcggacacgactgacgtgacttagcagcagcagcagcgagggtcggtagctgtcattctagctgtctggtgactccaccagctgctgtgggcggtgcttrccggggccccgcccaccgtctgctccgaaagagcgtagccccccaggggcgtccctagggccctctgaaagggcgcctcctccttgtccaattcggcagc

SEQ ID NO: 31070 - DNA, 201 bp, Bos taurus
gctattcctgagttgcgtcctttatattaaactggtcatctagttggtgaatgtgtctgggttctgtgagatgctctaacaaattaactgaacctgaggakgtggttgtgggacacttcagcccagtccatcagtcagaattataggaaaaagattggatttacaactggtatgtgaagtgctgggggtgcagtcttgaac

SEQ ID NO: 31071 - DNA, 201 bp, Bos taurus
taggatcattgcaaggactcacaaggcttcatagggtgagctcatgtaaagtttaagtaaagataaagaatacagacaaaaattacccagtcaggcattgrgtacctaagagaattataaacatcctcctcactcctgggtcctttctcagatgcacagaatttaccttgcattaatcaacctactattcctggcagtttc

SEQ ID NO: 31072 - DNA, 201 bp, Bos taurus
cctcctggtgtggcctcagagctgggtcgcccctttcctctgcccgtttgcgctccggttgtgccattgtcatcttgagctgaacccatcgaaagtctgtytctggccatctccaatggcgagtcctctgctggcccatgtagagctccatgctggagtctggttgccgagcagtgcccccaccccagagcccgctgcctc

SEQ ID NO: 31073 - DNA, 201 bp, Bos taurus
tctcctgcatctcagcagagctgggttcccactctgttcttccaagcctgtgccttctgtgaaagcaataagtacagtgtttcatgtgtggttgtgtttgkgagtgtgtgtttatgcagctatgcacagcatgcatgaacatgcacagaagtacctccctagagactgacaactgccagcatcttaaatagaaagaaatgt

SEQ ID NO: 31074 - DNA, 201 bp, Bos taurus
gagtagcaaatgacctccacccatggccgcttcttactatggctccccatggggaaagaggtagcaatggagccacttgataaatgctggtctggaggttygtgcaagtgggaatcaggcccggaggcgtagctgccatgtccgtgtaggagtgttgcctgctcttcctagagactgaggtccttctcccatcttgagaaa

SEQ ID NO: 31075 - DNA, 201 bp, Bos taurus
acctgacccggacctcagtccctgactgtcggggtctgtcccctctcagttcccacagcagcatcgccagacgaggccacgtttttcaaacctgtctttcytcaaccttccttcttctccagctgagagcacccctccgacttaacaagacaccagcggccacttctgcgaagctctggaccctctccctccaccctctct

SEQ ID NO: 31076 - DNA, 201 bp, Bos taurus
cttagggtataataggcagcaactagacgtggtggcaataaggatatccttcttcccttagagccatcatgaccgctgctcttctggttgaggccacagaraaatcactgtgggaccccctttactgatccttgtacctcattccgtagaaactcttctgaattgtcatcacactcaacaattctgtcatcggcctcaatc

SEQ ID NO: 31077 - DNA, 201 bp, Bos taurus
ccacatccgagtttagtgttctaagggccatggacagctcccagtccttcctaccacatgctctggtagggagcacttgcttggacacctcatgcaagtcrcttactctcggccttcgtcatcctttgtttcagggctgtgtttgcatttgtgtgtgtatggttatatgtgtggaatgtgtggaatgtatatgaagtgatt

SEQ ID NO: 31078 - DNA, 201 bp, Bos taurus
agacattatttaaaaaggaataataattgtaaaacaaagagatgagcctggtggttctcaatatcagaaatactctggcagcttaaaacagggcccctccyctgctgtgaagtcgtgctttctctggtcaggggtgcagcccagtcctggagtttcaggagctccctgaaggggtttgcggcacagcccagtggtggggcc

SEQ ID NO: 31079 - DNA, 201 bp, Bos taurus
aacctctttcggaaaaagcaaaaaggagatgcagaaggacatgatactaaggcgtcatgttccatgggtaacaggcagtgatgtggccctacttctgaccrgtctctcacgtgaggagagtgggcgtctctgtgctgtcgtaaccaggtgcagggagggagcggccgagctcacagaggccgtgatgcctggctgttattc

SEQ ID NO: 31080 - DNA, 201 bp, Bos taurus
ggagaacgaatccgaaaggctctgccagccctcccctccctcggcccgatagtgacttttcccggcagtgtgcagaatttgacttagaataattttcttcytttggaacctgtggcctgtcggtgccggatgcacgcagtttctggccctgagaggagggcatttcaccccagggtcatggtcagggccacagtgcagggg

SEQ ID NO: 31081 - DNA, 201 bp, Bos taurus
gagaccttgggcgacactcctacccggaggcccagggaggagacaagccttcaccctacttttcccacttcttcctgttctccacccaaaagcactggcakcggaggccaggatgggggaggacccggcagaaagtaggaggcaacctgggtctggggacgggcagggctgaggttggaggccgggatacacatgcagggg

SEQ ID NO: 31082 - DNA, 201 bp, Bos taurus
gagcatttcctgacctaaacacacaaaagtaggtgatccagggagtgtcattcatatcctgggtcaaacgggaggtccactgctacaggccagtctggctycacgttgggaaggaagatggatcatgagccctgccaggaggaagcaaagtgaaaatttcctttttccttggggccccaggcccccagcagcagagcagta

SEQ ID NO: 31083 - DNA, 201 bp, Bos taurus
gtaaataaaagcacacaggtaaaggaatataagatttacttgatttttcaaaatatatcaacttactttccagacttggagaaatcacgatgtcattgccragctgagaggggaaaagtcccatttgttactgcttcaaggttaagagatcccctctgtggctagcgctgaacagaacgcaccactcagtagttcaccaag

SEQ ID NO: 31084 - DNA, 201 bp, Bos taurus
gccattataaggttaataaaaactggcaaatattctaccaagcagactagactttgatgacttatttgagtcactatagatcactacagattttatggctwtgtatggggcctttctgatgcctgtaaaatgtgtaaactaattaactgtaaaaaaaaaattaataactgagatgaggcattaagctgccttcaaaatgac

SEQ ID NO: 31085 - DNA, 201 bp, Bos taurus
gcctctttaccgcactcctcctcctttggggagcttaggggagatacccacgccgtttctcttcgcatgtgcagctctgccttctgtcaactaaacagagyttctctatgtgcgctcccacttgttctcgtactctgtctttaataataagctttgtacttgcatttaccatttctgcctccatgataaacgtctttttca

SEQ ID NO: 31086 - DNA, 201 bp, Bos taurus
atatatatatatatatatatatatatatatataaacccacaggttccatgagatggaaataagctggatttctgagctggcccccagtgtatagctacccrgtacatttgcccatatccactgggttttgacatagagataaatcaatgtttgtgtccagcactggccctggggttatttgttattgtgatatcatacatt

SEQ ID NO: 31087 - DNA, 201 bp, Bos taurus
ctttctgtacacctaacactaccacaacactgaatatcaactatatttccattaaaaaaattttaaatccaaggactaggcccaaaatcagtacgagcgargtgcaaaagcatgtgcctggagacagggagatgcgaggacaggagtctgtgggtgactgctcaggggaggggacaggccacgtgcagaggagagagggtg

SEQ ID NO: 31088 - DNA, 201 bp, Bos taurus
gcctcaaacagcaggactgtggtcactcagggggcaggatccaggaggcccaggggccagcagggggagggttcacatgtcggtgtcctgtttgtcccccrgcctttgtgcagctttagccaagcccagctcatcagatgcacacctggacatatactgtttcctgggaataaactgcacttcagtaacgttgactgacag

SEQ ID NO: 31089 - DNA, 201 bp, Bos taurus
ataaaccagctttcggaccatgctggccacagacaccatccacgtgagcatcattatcagggggaagaagaagccgacgttgtttaagaacctgtggggaygggccagtcagcatccaggctgccccaagatgctctcagtgagttcagctcccacacttcatcctgcagtccttacagccctggggttcacccaggaaca

SEQ ID NO: 31090 - DNA, 201 bp, Bos taurus
gggaagagtatttcaggcagagggaacataagggaggccgttgtgggtgcacagagtgaacaagcgggagaatggcaggaacgaaaaataagctacaccaragagagcttattggcctctgtaaccctgacttttgttctctatgaaatgagaagccatggagagggcggccatatttgtttttggccgccccgggtcttg

SEQ ID NO: 31091 - DNA, 201 bp, Bos taurus
tatttatgtaaaaaccttatatgttttagtacaaacacaagtcttatgtgacagggattagaaaaggagaagcaaagactgagatgcaaataggttgttcrgttcagttcagtcactcagtcctgtcagactctttgcaaccccatgaatcacagcacgctaggcctccctgtccgtcaccaactcccagagttcactcaa

SEQ ID NO: 31092 - DNA, 201 bp, Bos taurus
tctaaaagcgttgcccagaagaacagcagcagttgtagagtgaatgagagggagatgcaggaagatgaagtggagcataatgtagtgcaggccagaagagmtgctagccacgagccaagatagagactggggggcggaagagtgactgggtttggtctatagttaccaggcacctagtctaaagatattccttttattttt

SEQ ID NO: 31093 - DNA, 201 bp, Bos taurus
gcttcacgttttttacattctccagctctctgattggttcagccttatgcaaaatagggcttgtacccaccaccaattagggaagggaatgcaaacggtckcactcttaaggctaatcagtgaagagggttgtctcggggcggagggggggcctgttttcctgccagaaggtctcactcccgccctccgcttcctttttgt

SEQ ID NO: 31094 - DNA, 201 bp, Bos taurus
cttgctgtgtgacctcagtcagagaaactcatctctgtgccttgatttcttcctatgtaaagagttctaatcatatgaagcaattaaggcagtgctgggcrcatcacagctggcattattgagttgccgttagcattattatggtaatcagttaggtttgaagtgctaagagtctagatcgaattgaaaggaaaactacag

SEQ ID NO: 31095 - DNA, 201 bp, Bos taurus
gactcactttagaggcccagaaagcctcctctaattgaagcaccaagactcacttgaacagtaagtgctctgtttctagggatgcatcagctaacttgggragaagagaggccaccctcatctacctcattaagagatatgtttccaataaaagtttaatgttcaatacttactttctgttttgtagtattttgacccttt

SEQ ID NO: 31096 - DNA, 201 bp, Bos taurus
ttatgatagctttttttctgtaaagaataaatttacataactttctataatatggaggttgatttttaaatcatcagccatcatctttgtcacaatttttmtgaggtgttatcttatatttggatattccaaaaccataaacaggcaatcaataaatggttacctgtgtgtttataagcattttaagcagcagttaggtgg

SEQ ID NO: 31097 - DNA, 201 bp, Bos taurus
tttttcccccctaaatattaggctacttaattcatttcagttaagatatatcttttttttgtgtgtgtcattttatggccccttgacagatttgcttcttraattctatgttctattggattgcacattgtatgtaagaaagctgtgaacatttttacaaatcttataatttgtcattttactgaattttcttgttttata

SEQ ID NO: 31098 - DNA, 201 bp, Bos taurus
ccactgcagtactctggcctaggaaatcccatggacagaggattctggtgggctatagtccatgggattgcaaagaatcggtcacaactgagtgactaacmcttcactgagtctagagggcccaaagtatcaggtaaaggaatgagtgaaataaaaagagacaggtgaacttgaggatgggtgagtataaaaacaaagtct

SEQ ID NO: 31099 - DNA, 201 bp, Bos taurus
aacattcataggctggcctgatgcccaacaaagatgaatccaatccataagcaactagagaaaccttcctctttctacacgaacagctgggtctctcatcytgtagcacaggcttaaggcccaaaaacactttatcacattctcatggaagaggaatacctctcccaagggatttgaattttgaataggctgaatttctca

SEQ ID NO: 31100 - DNA, 201 bp, Bos taurus
accaggctcctccatccatgggattttccaggcaagagtacaggagtggagtgccattgctttctctgaaggctctactaaaatgatgtaattaagaaaakaaagtgtgttggaatcactaggaactgtgtgtgggacaccagtggcagggagtaagcaatgatgaaggaacagagaggaaagggaatgaggtgaagtagt

SEQ ID NO: 31101 - DNA, 201 bp, Bos taurus
ggatgagaaaggtggctgagttctgaagggaaagtagacattactgagaatgggagagggagaggaacagatggaaagatgggccagaggaataaatgagyatcatgcattttcaggaactgtgagtaatatatgataaacacagcacagtagcttatgtgtgaatctgagattagaaaaggggacagtaagtgaatcctg

SEQ ID NO: 31102 - DNA, 201 bp, Bos taurus
acttcctaggctataaagagctccttcaaaggttatatataacctcctctgaaaactctaaccaagtaccttctcatgataagcaaacagaggcctcaaamtgggaactttagagaaacataaaatcctcacatttacccctccaacttatctgactgactggtgggaaaacatagtatgattattgcaaagctggccaag

SEQ ID NO: 31103 - DNA, 201 bp, Bos taurus
agaggacccagggttcttttctcacgacaatccaactgtatttcctctgggagaaggatgctccctacgaatatgtggggttggaaccggaggccgtttaragctaaggaggggatgtttttgatgtctggagagttccaaccatgattagatttttgggtgcaaagactgcactgcgcattctcttcacggagcaatgtg

SEQ ID NO: 31104 - DNA, 201 bp, Bos taurus
ccgttgatgagcactggcaatctacctgtctccctcacctcctcgtgggaaaaccttcctgctttccctgcagtgttcctcttcctcctatgctctgaatygcctgcattccagcttcctcaagtcctgccctcactctaccattgcccttcctactgtatctgggacttccccttctcttgtcccttgaccatgaacaac

SEQ ID NO: 31105 - DNA, 201 bp, Bos taurus
atgacccgcacagactcataaacctcgaggtctttcggccttctcgagcccggtagaatttgtctgttacagagatacatgcacaaaatataatttttatyccaagactgagtcatccaaagaggccatgtggtcttgagctgaaagaaccgtgctctgttttggagagtcagctggtgttctgtgtgatctctcagtgcc

SEQ ID NO: 31106 - DNA, 201 bp, Bos taurus
aaagaatttaagtttgttgaatacagatgtatttaagaattgcctttctttagaagtgggtttgttccccagctgagagggttgcatctaaaaatcaggcygaaaagatggatctatgcctggaaatcactgtttggctaaccccaaagttgccttttagataataattgtagccactttagcaacagcccattgctgctt

SEQ ID NO: 31107 - DNA, 201 bp, Bos taurus
ttaaaaaatttcagcctactgccccatttaaaaatatatctattgtaatcaaattttggtgccaatccaatttggatgtccccttacaagagtggtgtgtkgagtagactgacgcttgttggagtgtggcatttttgtgaccgaagctccagaatcatatcagcagttccagagactctgtacatcatctataaaacgtgt

SEQ ID NO: 31108 - DNA, 201 bp, Bos taurus
caagttaattgttcttaataatatgccatggggaaccattgactttatctgtgaagtttagtaagcaagaattaaagtgatgagtataaaatttctatttkgacaagcagtgattacaaagtcagtccatgaactattgtaggagagcataagtaacacaaagagggtaacccatgatattagtaagtttactcatgacat

SEQ ID NO: 31109 - DNA, 201 bp, Bos taurus
aaatgtccttaaatgatttggcccctgcctgcctgtctaaccacatttctctctcctgtcattctaagtccctaccactggtcttaggtctttaagcataytgagctccttctggccctaaactttaactcttaatggcctttcagcctggaatattttccctctcagtaactcctacttaagtcctgtttatctttatac

SEQ ID NO: 31110 - DNA, 201 bp, Bos taurus
gtaagccattcattccattcccaaatttctgtcttcctaagtttttccattttaatcttctgtatttagaaagaatttctgtcatatgaactttatttagyatacacagtcactgaggtattaggtaatcatctgagcaaatcatctgtcctatttgagatgatttgttgaatccaagatctcaggttaataaatttggct

SEQ ID NO: 31111 - DNA, 201 bp, Bos taurus
atatcttccttaaaagccaagttttagaacagaggcaaatggttagtgattcattattgaaaactgtagtgcttttggcattttatttcaaaaactatttyacatctaggccacatgaaggacatattttaaaagccattagctactttctttaactttaaaaaaatcttaagtaggcctattggcttattgagtcactct

SEQ ID NO: 31112 - DNA, 201 bp, Bos taurus
cctaccttgttgagtttctttttacagtgaattgacattgaattttatcaaatgccttttgtgcatcttttaaaatgatcacgtgctttgtcatttatttygctaatgtgatcaattacaatgattgattgccttatgttacaactgttgcacaccgccagtaggatatacgtcagttactcatgatgtgttgtatattac

SEQ ID NO: 31113 - DNA, 201 bp, Bos taurus
aaaacgtggccactttgggtgaatcaaaacagacatctctatgcaccccagtcatttagcaaatcataccagtgcttggctagacaaatcctgcttgtccrtagtaagactgtttgcagggtggggctcagaagttggagcatctagggatcccataggcatatttgcatttgtcagtgaggaaaggaagcaatgctacct

SEQ ID NO: 31114 - DNA, 201 bp, Bos taurus
gaccccatgaatcgcagcacgccaggcctccccgtccatcaccaactcacggaggtcactcagactcatgtccatagtgatatgctttaatcgagtaactrctaggtgctacgtgccttgtatatcatttctgattcagtcctcaaaataatcttcacaggtggaaatatcactgtcctcattttacagaagaatacactg

SEQ ID NO: 31115 - DNA, 201 bp, Bos taurus
aataaaatggcctggctctgaatgttagaccagcttgtaatgacattgtggtctacctgtaaaatcagtccctgatatcaagggcttccttctttgttttwcttctctgctggcctagccagggactctcctccccactggggacaggaccccatcactctgttccttggccctgctttgcttagggtggttccctttcca

SEQ ID NO: 31116 - DNA, 201 bp, Bos taurus
ctgccactccagtcttgtccatttgaccccaagtcttgcttgccacccacagggccaccccttcatcactgaggggccgtttgtcctgctaaggaaggcgkatcatcaggtgatcatctcttcttgattagaaccttccccgcaaggccaaagtcacaatggggcggagcccccggcactgggagctggttcctgttgccc

SEQ ID NO: 31117 - DNA, 201 bp, Bos taurus
gactacaagcatgaaactgcctatctcaaagataatgattttttaaaagcactgctttaaaatattactcattttgattactgagtttaggcatccacttygattttgcactggaagagtctactccgttctggagattatcctgttagagactaagagctttagcagcccaagaacaacccactgcagcccatgattcta

SEQ ID NO: 31118 - DNA, 201 bp, Bos taurus
gtttacatttatttcctctgctcagtgatccaatggggaagtcaagtagccatttctttaccattctggcatacttttcaatgggattctaccatagaggrctcatctgaagagagggaaagttgcatgccaaagactagaggggagagaaaatttcactttcactaaattttgctgattttcattgattcttccctgagc

SEQ ID NO: 31119 - DNA, 201 bp, Bos taurus
gctcagctgttacactgttaacctggagccttactggtggcagctgaaaaagccctgggtggaccacatgcactcctgtgcccaaaccctacagcctgatygctgcgctcaccggaggggcagggctctgcctgtcaggcatggcgttcacctaagtgagaaggtggtaaggtgttcttttgattttatgcccagccaagg

SEQ ID NO: 31120 - DNA, 201 bp, Bos taurus
agtcttttaagagcaatagttagagaaacaagaaggggaataatgtttgcaataatagaataaaataagttataggcagcattctatgtgattttccattkgggtcactgctacttcagcaaacaaaatatctgttgcattgcacttcaaaatcactaagtgatttccactacatgcaatcttcagaatttccaccccaaa

SEQ ID NO: 31121 - DNA, 201 bp, Bos taurus
tgaggcaatgagaggttaggtgcctgaccatggccactaagcaagctgagagcaggacagaagcttcctgtgcaaatctaaggttcgtgttacccactccrtaaggccaaattgctacctcagaaactgcctttgccttagtttcctcagctgtaaatatatggtcatctcctttaaaaggcatttactcttagagctaag

SEQ ID NO: 31122 - DNA, 201 bp, Bos taurus
cacccatcatcttcatctctcctgggtgactaaggaagttgtagagaaaacctggtttggattcatgaaaagccccacagaaggcccctctacaggggaargagagcctgccggggtcttctgcccacaggaagccaggctgcttcccctgctctagggctcggaacagccacaccttgctcacccgcctgagatctgcag

SEQ ID NO: 31123 - DNA, 201 bp, Bos taurus
cagattccagtgagactcctgccctgggatccctacgagtgcttggttttccttctccctcacgtgaactcttatggaaagttcccctatgctcttgctarcttgagtatggccatgctctttttaatctaaatgaaccgaaacagcacagaaaatgtgaatatggaaccatctgggcaaagcaagcactcttaagtcaaa

SEQ ID NO: 31124 - DNA, 201 bp, Bos taurus
aaaggcaaatgctcccctggtggcctgctctgcagtgaggctctgcaagtcactcctaagaactcaacctgaagttcctttcttcacctttccaacaaatkccatatgccatttaacaccctgtaataaatttccctctgcttaaaccagctagagtggattctgttctctgcaagtggaccttgactgatacaatcagta

SEQ ID NO: 31125 - DNA, 201 bp, Bos taurus
agaggatgaagtgtaagttgaccggtcaccagctgctttgtcttgtcctgacagccgccctccccataagtgattcaggccattcttgtccctatccccasaccaccctctccccgaccacttaaaagtagctggtgctgaattttgactgaaggggccctgttatgggttgtgtctccctccagtcctaatcaccctgac

SEQ ID NO: 31126 - DNA, 201 bp, Bos taurus
acatatgtcccctacttcctggccctccccctcacctctgatcccatcccacccctctaggttgtcacagagcaccagcttgagctccctgagtcgcacakcgaactcccccggctacctgttttccatatggtagtgtacatgcttccatgctacgatattacttagtagcactcagtttcatttgttgaccattttatt

SEQ ID NO: 31127 - DNA, 201 bp, Bos taurus
cccaagtgaaatcagaggatgggttgtatgattcgatggcttgcatctcttccagcttcagggcccaaggattaccatgttagtattttgctaatatttcycttgtactctcgtagtacagtgcttgggacctggccagtcctttgcagtgttagtgcccagtgaaaagtggctgagtataaatctcaatgcctctctttt

SEQ ID NO: 31128 - DNA, 201 bp, Bos taurus
cacgctctgtggccaggagggcaggcagttttcaacaggaaatgcgtccctgagcagtatccctgcacgctgcgatggagtccaggtgaggccccgggccyggggaacagcagctgggtctaaaggtcaggaaggaggctcagtgaccatggcgtgcgtggtttggtgggcaggggattccaggaagctctgttgataaca

SEQ ID NO: 31129 - DNA, 201 bp, Bos taurus
atgttgtatttaaattccctgtggggtaatgtaatgctgatccaaagacataagagcaatttgattaggcaactgcaggcctctgtgaatactttgagccygaagtacttaagacttaatctcccccgtaccctataccccataccaaggttacccacggaggctgggccagccccacccctgacggcagtacctctgagg

SEQ ID NO: 31130 - DNA, 201 bp, Bos taurus
atctcataagtttgttcttaaggtatttcatagaaagtgcataagtagctctgtgcaaagcacacgttgcaatgtgtttaataagcattattgatgttatwattatttctgtatgatcaaccgttgtagcagaaattcatgtttctgtctccaatatctattatcctattcttatttttaaatgagccccacttttgtgta

SEQ ID NO: 31131 - DNA, 201 bp, Bos taurus
aatggaactatacttctatattctgcagtttgctttttgacttctaaattttttctgaaatgtttatgttgatgcatatagctgtagttcatttttactayagcacagtatttcactgtatgattatataatgattttatccattctaactttaatggacaattgagctgtttctagtgtttgctgctattatggacagtg

SEQ ID NO: 31132 - DNA, 201 bp, Bos taurus
tgacatttgccacgatagtaaatcttaagcgttttcaccacacacatacatcaaaggctatgaggtggtggatatctcagctaacatgactgtagatgtcrtttcacaaaggaaacataaatcaaatcatcgcattacacagtttaaatatatacacttttatttgtcaattataccccaacaaaggtaattcttccattt

SEQ ID NO: 31133 - DNA, 201 bp, Bos taurus
aataaactgacatgaggcagagctcgctagtgtggatgatcatacaaatgatggtttgtgtacatctgattgctcaaaaggcagataaaagcagatagggkttgtccacgttctttcttacctttggatatgagagatcttaccttttaagaacacactttgtacaggtgtgtttaggatggtggatcaaagaggagggag

SEQ ID NO: 31134 - DNA, 201 bp, Bos taurus
caccaggctcccccgtccctgggattctccaagcaagaacactggagtgggctgccatttccttctccaggggatcttcctgacccagggattgaacccaygtcacctgcattagcggcagattctataccacctaggtatactctaaagtgattaagcccagaactgaacgtctgtgtagtacggacagagagatgaagc

SEQ ID NO: 31135 - DNA, 201 bp, Bos taurus
gaagaaatgtcaaaggaggcataaaacttctagggcccttctcatgtggttcctgcctggtgaagccacccctctgcccccaagagtgaccccaggaacayagggaagggcaggcctcctcatctggccaccacatggggtgtgaaacaatactctctcacaaaaggtgttctcaatgtgcatttcctgggcctcaactaa

SEQ ID NO: 31136 - DNA, 201 bp, Bos taurus
cctcaagtctgtggctcctccttgagggccatgacctggatgtaatatgtcattgtaatcgcagtgcctgggatagagtcagtgtttcttttctttaaaaraaaaaaaacatatttatttacttggccacactggcccttggttgcagcatgcaggatctagttgcctgaccagggatcgaacccaggccacctgcattgg

SEQ ID NO: 31137 - DNA, 201 bp, Bos taurus
gggggcataagagaagtccttgtgattgaaacagcaaaacagaaatggggagaaaagatgtaagccactggttctggaaatagagaaaggggccataaaayaaggaatacaaagaaggtggctccagattctggaaaagccaaagtaatagaatcccctccccaccacacctcacctcccggcctctggactccctgtcag

SEQ ID NO: 31138 - DNA, 201 bp, Bos taurus
cactcaggagggactttgaccatggcctaacctggagggcgcaaggaagggcgcggcaccaggtaactcagaactgatgaggattagttaagcacaactcragaggcccctttgttaataaggaaatagttcccagataacaaagggggaaagctggcagagaatttaacacggcagtgataacgaactgatagcacacgt

SEQ ID NO: 31139 - DNA, 201 bp, Bos taurus
acgatttgagctgctgttagtcaggatatttgttactagatagcagaagcagttcagttaatacggtctacgaggtggcaggcccatcatggagcttgggygttatacaactgaacgtgaccacggcactcaaactcctgcttttcaccagtgaggaaacggagtcccagagggattatctggcctgcacaaactcacacc

SEQ ID NO: 31140 - DNA, 201 bp, Bos taurus
cggagttgtgctttcaaagttggacttcttttgaagtgtctcattgaatttataagtatacatatttagttatgcttacaaattatgaactaatatttagyattaaaaattataaacattatctatttaacagtgttttagtgcctgttttttctaagtactagaaatgttacagtaaacaaaacagacaaaaatccctgc

SEQ ID NO: 31141 - DNA, 201 bp, Bos taurus
ctatatatacttttgtttccatggaaaatcttcatgggaacaggagtcgaaatttacagcaattaatttgtccaaagttactaacaagttagcttggcctmacactagccctggctcccttagggtctccatgagggtgggggaggaggtggacattcccctgagagccatccagcaggggcctttggagatgtgcaaaga

SEQ ID NO: 31142 - DNA, 201 bp, Bos taurus
ctcaagattgttttttctattcagggtcttttgtgtctccaccaatactcacagcaactgtcagtttcacagttataattcaatgatatcttatgaatacrtgatttagtaaatgcaatatacatcagtgttatctgttatttagcaatagttatgaatatttaaacatttaaaaacattatatataattgttaattgaaa

SEQ ID NO: 31143 - DNA, 201 bp, Bos taurus
aattattttgttaactagcattttcacttatttatacttactattaaataaagcaaccccatcagcattgtagtgatataaatctcgctattccccaatgygtgcagaaagttcactgcttgcaatagcatgactctccaagtccaattatccaggctgtttgatgcaacattcatctgactagtattaaagacaatgatt

SEQ ID NO: 31144 - DNA, 201 bp, Bos taurus
tctaattcatcattgtttaaaagacacctgtgagttctaactggaaaagacaagacagagaaacgcagatggtcacattttgcattatatctatcacattkttttgtactctaattagaggaggaactcattctccacaggaaaaagatactgcttaattgaatatttgaataaaagccagtagatacagtattcaaaaca

SEQ ID NO: 31145 - DNA, 201 bp, Bos taurus
gtctacatatagaaacaaggatgtacgtgaatgaggtcaggaaaagggacagactgtggctaattcatcattttatagcacacccatatagattttccttrcttttcctttgcctggaagaacagaacatgatggctgtgctgtctgtatatattagtctatgctctgaccttgagttcagaagtcagcctagcagagaga

SEQ ID NO: 31146 - DNA, 201 bp, Bos taurus
caccatgtagttaacctggcaagggtttaattatttacaaaacagctgagaggacatgcctcagtatactatgtataggccttgtgaagtgagtgaaagtygttcagtcatgtccaaccctttgtgactccatggactctacatccatggaattctccaggccagaatactggagtgggtagcctttcccttctccagggg

SEQ ID NO: 31147 - DNA, 201 bp, Bos taurus
gtagacttgctaatgatggccattctgactggtgagatgtggtacctcactgtagttttgaattgcatttccttcattagtgatgttgtgcatttttccaygtgcctgttggccatctgaatgtcttatttgaagaaatgtctataaaagtcttctgcctgtttttcaattggagtgtttgtttttggtgttgccaatttg

SEQ ID NO: 31148 - DNA, 201 bp, Bos taurus
ctactgcatcttgtagtaggtttgagctactttcatttatttattcactcaacaaaattactgaggatttgctgtgtattgattagcctacaacacaatayttctgaaaaataaccaaaaaaataaaaataaaaaatgaagagacagagccaaagccaaaaaataacacccaactgtggatgtgactggccatagaagaaa

SEQ ID NO: 31149 - DNA, 201 bp, Bos taurus
cccctgccccttgccgaccaactgctcatctgggttttgagatcatagataagtttacacctttgaaaggaaggattcatacaaagttgacagtgttgagracttcattaatattgacctccagcaaattagcccaaaggttaacaagttgaagaagccttcagaatcaaagagcaaagaggagttgatgaagaatccata

SEQ ID NO: 31150 - DNA, 201 bp, Bos taurus
agggagattcttgctaaagtgacctgacagagttcttgccaaagagaggccaaggacttctatatcacaggtggggcctgaggaatttgatcagatattartgtgatcagtcatcaatggtgggggaatcctctctacactgactttgccagattcctgctaaaactaggccatacatgtctgacaaagatagaatgatac

SEQ ID NO: 31151 - DNA, 201 bp, Bos taurus
ctaatatgatctattattttagaaaaatgcagcatcttaagttcagtaaaacttttgtcagtttatatatagttcattgttcatgttcatatttcgtcacrtttgactctttgtgatccattggactgtagccctctacagtcaggctcctctgtccgtgggattttccaggcaagaatactggagtgggttgccatttcc

SEQ ID NO: 31152 - DNA, 201 bp, Bos taurus
aaaactgaacgtaaagtgcttcttttctacttttctaaactactttttctagggacttttatttctgagagcattaagcaagtcttcaatttactggactmatttaaaattctaaccccccccctttttctctcctcacacacatccgtatttttctctctgttccccgctttgctctctgagcttcgtacttgtgtaaga

SEQ ID NO: 31153 - DNA, 201 bp, Bos taurus
gttgttgtcttctcatcagagagtagaagacgtgcaaacacttttaaaggcaaagctggttttttcagcagagaattaaaattaaaagcagacacaggccyggataataagtagcaataaaagctttcgctgacatagcttcaatttacaaatcactggcttttcctggcagcgcttggggaaggagggtgaggaagtatc

SEQ ID NO: 31154 - DNA, 201 bp, Bos taurus
ttttttacaagccacccagggtctgttacagcatcccaagtagactaaggtggcttgtgaagcatgcgcatactccaggcctttggggcctttccaaaccyatggaatcagaaagttctgcagaagacgctcagaatctgtatttttaacacccaactgagttgattcttatggccagagaaatttggaaactctgttata

SEQ ID NO: 31155 - DNA, 201 bp, Bos taurus
gattcatgggcctaacattccaggttcctatgcaatattgttctttacagcaatggattttactttcactaccagtgaaattttacatccacagctgagcrtcatttccactttgcctcggccactttcttctttctggagctattagcaaatgccctctgctcttccccattagcatactggacactttctgacctggag

SEQ ID NO: 31156 - DNA, 201 bp, Bos taurus
agtcattgttagtcagtagacagttacctggggcagatactaacatgctatgctttctggaagaggaggcaagttgccaaaccccaggaatgacagacttkccatttagttaacttctcagacctacttgactagtctgtgtgtatctacccccaaagagcagaggttttcagcttgggcagaatgccatttcccctttat

SEQ ID NO: 31157 - DNA, 201 bp, Bos taurus
ctgacttagtgactcgacaaaaaacaaacaacaaaaacacaacattctatcacaaccagggaagatggtgtagagatcattcacagagtggttgcctataygattttgtagatcagaatggatattcatgaataagttagaagttaacctgcctgcaatgtgggagacctaggttcaatcgctggttcaggaagatccttt

SEQ ID NO: 31158 - DNA, 201 bp, Bos taurus
atataagtacaaaatactggcaaactgaatgcaatagcacattaaaaagatgacatagtatgaccaagtgggatttatcccagaattaaagtgattcaacrtaagaaaatcacatcaatgtaatatatcacattactagtatgaagaaaaaaaaaacacattatctcaattgatgaaaaagaaaaaaggcacttaagatag

SEQ ID NO: 31159 - DNA, 201 bp, Bos taurus
ttgatgttgagttcttcagcatcttttcctgtagttttaagaggatcggcttctatgatgctctcaattggtcgttgtgaacttcggatggccagtcattmtgctcctcatctttgcaaaatttcttgaagcaccactgcactgcatgttcattagcagtttctgggccaaatgcattgttgatgttgagagctgcctcca

SEQ ID NO: 31160 - DNA, 201 bp, Bos taurus
tatatgtgaaaagcagttttccagtaccgcaacagataactgtttcaaaggatgcatgagtgctaatgtgctatgggagctgatgttttaattggccctcrattctctgaaagatattctttcttgagaagggctggaacctctgaaaagctgctgggtagctacggcctgaaatcacctcaacctcactgccatcataga

SEQ ID NO: 31161 - DNA, 201 bp, Bos taurus
aataagaactgatgtgtttcagtccatcctcatggattccagctcatccttgcaggttttcgctcactcttgatatctccacttcatgcccatcttccctyatatctgcctgctttgtgaaatttaagctccagatcacacaaggaccttaaagacaaagaccttaaagaaactgcttgttgttcagtggcccagtcatgt

SEQ ID NO: 31162 - DNA, 201 bp, Bos taurus
atccaaggagctttttcttgaatccaacaaaatagttttttttcatttacgatctaatgtgtctggagtgagcattgactttgtgtcctttctaacagatraccatgaagtctgacacaggttgcttagcaactccttatgcccagaagtagaaataactctttgatatactcactatgtgtatttctactgatttatttc

SEQ ID NO: 31163 - DNA, 201 bp, Bos taurus
gttaaaagtgactaactcaatgaactgttgagtttattgagttaaagacttaatgttacaatggttagagtggtgggcctcagttttttaattggattctrtgcctcaatttcttctggtattgactacaaaactttgtgtttctgtctggctttaagaataaatattgaaatttctgaaaactgactacccttgcagata

SEQ ID NO: 31164 - DNA, 201 bp, Bos taurus
tctagaaatttcaagtactagattcaagaaattaagaaatcttgcttagatttattgtttttatcctttggtcttcatcttctgggagtttcagacttgartacaagactccttaaaaagtaaactaaaactgtgtgttaaatagttaatcatatagtgtttgcaaaggcatcacagttgagggctgaattatataactca

SEQ ID NO: 31165 - DNA, 201 bp, Bos taurus
cagtgggttgctatttccttctccaggagatcttcccgacccagggattgaatctgcatctcctgcattggcaggcaggctcttcaccactgagccacctrggaagcccaccttaacaaaatcacatcccaaattccttttgaatttaaaaattttaaaataggcaatgtattcacattgtttaacaatcaaaacaacata

SEQ ID NO: 31166 - DNA, 201 bp, Bos taurus
tgttaatgatatagctggatttctactattcattcagtgagcatatgaagttaagggttcagggaagaaacatctgttattttcctatgtacaaggccatkacagagattatagatactacttcacaacactgtgttcaattatctgatgcaccaagaaacacaaattccacttctcccaaggccaagatacttgtgctat

SEQ ID NO: 31167 - DNA, 201 bp, Bos taurus
agcacagcatttagatgcttttaaaagttgactaaaaagtgacctataaaacagtattggattgatagttgttgggcattatattctaagtgatttcatcyaattctacataccaaatagcatctatggttcatgacaattttatcagttatctactactgcataataagttaccacaaacctagtagcttagcagtttct

SEQ ID NO: 31168 - DNA, 201 bp, Bos taurus
atatcgattagacctatccttattcttccagtttataaacctcctggtcagcttcttcctagctgtacatcctggtgagacactttgttgtctcacttacygacaccctcaacctccatgtcttttcatggcagctaattacaaaaccctggccatgaatcaatactctcatgtgttttctttgctcatgtaaccagattt

SEQ ID NO: 31169 - DNA, 201 bp, Bos taurus
tcagatgattcttaatattacatgtcaaatatgtaagaattgatacggaagttttgaagaaaatagtgaggacctaccatagcagaaattaaaggaaaatrtaattattgtgataaaagaagcatgccacaatgaatacataaatcagtagatggaatagaaagcttagaaataagaatttcatatatgatatatattatc

SEQ ID NO: 31170 - DNA, 201 bp, Bos taurus
ccccaactgtggttgtaagtagcaacaattagacatctgtcagccagtaaaactgtatttatggtgcccttggtttagaagatcatccaccttgctttcaytctataaagtaggtagaaggagactgggagtttctagggttcattcaagcaatgctcacagaagaattactttctgatatggatatatatggaactttag

SEQ ID NO: 31171 - DNA, 201 bp, Bos taurus
cgtgatacgctattctcctaggaccatgacttagaaaactctgatacatcctcttacctaatctgagctttatcagagatgttattaaatctaacacacaygctcacacatacagcttagagatgcaagcttttaaaaacccacacaactcataatacctttgtaagctctgatggttcactcccttcttctaccacaatc

SEQ ID NO: 31172 - DNA, 201 bp, Bos taurus
ttatgttaaaagtatcaggatacatttcatggaattgaaaagggtaatttctgcctgtccctgactcatgataataatggttctcatttcttatccaagcrgaacagtgtgataatataaccatgtacactctgataataattgccccatcacaccccaccacaggatcaccaccactataataaaacaaagaagaaaata

SEQ ID NO: 31173 - DNA, 201 bp, Bos taurus
gccagtgacaatggtgtcattggtatgtgtcatttggtatagcctgttgtgttttgaaatatacacagtaagtgtttaaataatatagtatggctataatkagactccatttttagacaaagatatgaaaaagatcacagagtgagacagatttcaagaagatgacaaagcaacaattgtttttgtttttgtttttgtttt

SEQ ID NO: 31174 - DNA, 201 bp, Bos taurus
tgtggaggaaaaaagaaagaattggaaataagaacagaagagggtgccttgggtttgaagatacacagggggagtcatgctggttaatactctctgttgartccaaaaagagtctgtagagactgtagcctcctttttatgtttcctcatcttggtttgctctgcttcagggtgtttctagtggtctcaaaaatatcacaa

SEQ ID NO: 31175 - DNA, 201 bp, Bos taurus
tcaacccactaaaccttgcatttgcagagcaaagaaatgcagttacagcacatttgttaacacaggataggattagcagtcctactgcgtgacaagtaatrcaaaataatcccaacagaaaatactagtttctagccggcccttcagaaatgtttgttttacaagacagcataatacttgttaaaacaagatgatgtcagc

SEQ ID NO: 31176 - DNA, 201 bp, Bos taurus
gttaagtggcagcaactactctctttcacttctttctccaaatcaatttttatgtgatttctgagcaaagcccttgttattttgtgtattactccaatttkcacataggaaaagttgtttgcatcacttttcaacattgtaaagcttttaattttaaacatccaaagagttttttttttttttttctttaatacactttgg

SEQ ID NO: 31177 - DNA, 201 bp, Bos taurus
acccagctgtctccatttccttcaccttgccctgcacactggcatcttgaaaacaccaaatatactcttcaatcacttctttttttttttttggccttttytctcccactgtctgagttaacactctcaagatggcaccatggcttgctcactcatttctgtcaggtttctatggaaaaattaggtaattcacagggcctc

SEQ ID NO: 31178 - DNA, 201 bp, Bos taurus
tgtgtataaaatgtacaagtagctcagaagagaagtggttaaccgtgttttcaggggtagggtatagagtatggggtttctcttaggcaataatggttatkcagagttttgaaaatgaacatgaatttccaggtattgtgggaagctgggtagaaaggtcattccaggaagagactatagcaaatggaaaggaacagagca

SEQ ID NO: 31179 - DNA, 201 bp, Bos taurus
ttagtccttgattattagtattttatcatgatgtttaaggttatatgaactttcactacaactgaaaattgttacaatggccaatatagatggaagggtasgtcatattcttgttcaaccacaaaatctcacaccagtggataagcagtattaggccttggatatcaaatgatgcctaacaatattatcattagtatatag

SEQ ID NO: 31180 - DNA, 201 bp, Bos taurus
gaagcttaaaacccatccactgggactcactgacctacttcccacacagttgtctgatcaaagctctctggcttgttcctctgtggctgaatgtctgtctygataaactttcaaactccacattccttctgggtcaggtttttaccttgcttatccagctccccttctagtctttgcttttgagtagagttctgactggca

SEQ ID NO: 31181 - DNA, 201 bp, Bos taurus
cttgagaaaagcccagtggtctggtactatattcattttaagagtttgaggtcagcttttatttttctgagctctgtggaatttgtctgcgacaagctagrtatgacaaccggatctgactttcccagactcctttttcctggttatccttgtgcttcaaatattctctaagttggcaaagattagaatatacaggttcat

SEQ ID NO: 31182 - DNA, 201 bp, Bos taurus
tttaggtcatacctgaatggtctagttgttttccctatcttcttcaatttaagtctgaatttggctctaagacctactgagtcagaaaatctgggcctggytcccctcccagctacccgtgttgagcaagtcctcctggtgactctggagcagactaatggttgagaaatgtggcttttccctttcttttctattttgtgt

SEQ ID NO: 31183 - DNA, 201 bp, Bos taurus
catgttcctttgtgaaagctatagtatccagtcagataaatcctatcaataaaactgataaacagcaagagatagcaagacacagcaatctttgttttctrgcaaatgacataaataacacacaaatgttttcatgacatgatgtcaaaatttagtcacgagaagtctcaaagatgcagatcaaactgaccatctgcacag

SEQ ID NO: 31184 - DNA, 201 bp, Bos taurus
ctgcccagcttccttccagttgagatttaaaatgaactaaattatttgacaaactgtttttactatcttagtgagaaatacagaaaattgaagttttaatraagctaacttctatataagcacttcacaattaaaaagaacaacatgcctaataaatttagtccataagaaaaggtagggggaggagctaagatggcggag

SEQ ID NO: 31185 - DNA, 201 bp, Bos taurus
gcagttaattcattaaggaaaactgagctggataaaatattaggtaatatttgaaattttttcagggaattaaggtcatgcctaaatactgttctactttkatgtttaaacagacatcagtattagtagtcaggacatatataagtatatatatgtataaatttatatatgtataaacatatataagtatgtatatgtata

SEQ ID NO: 31186 - DNA, 201 bp, Bos taurus
caaaggagatatgccaaaacagactgaatcaacttctttagtcatagtggttaaagatcatcatcactttctaagtggtaaattcagaatgaaatcagaayacatcacgtattttaatttcacatagataatatagtgcattaatttaatgtcagtttggttagtacttttgaagttgtctatgtttccatatgtactaga

SEQ ID NO: 31187 - DNA, 201 bp, Bos taurus
gtgaaatcttagaaaattaccttacttcttctttaatgaatgataatgaatattttacttgggagattcttggtggggaattgaaataatagcaaaaaatkgaataactcagaggtacctaaatgattggagctataaaataatgaagaaagaaagaaaagaaacatggatcctctacttgattacatggatcttcaggaa

SEQ ID NO: 31188 - DNA, 201 bp, Bos taurus
tggatacaatatctctagagtcagtactttccctcagatgtaccagcatattttaaattttattagctgatggataacaggtgagctaaaagaggcttaamatgttactgatctgtgtggatgagtttgatgctacttttgaagtgaagtaattgttttagagaaggatgattggtgaacattatctgcaagagtgctttg

SEQ ID NO: 31189 - DNA, 201 bp, Bos taurus
tgtgtagcagtccatggggtcacaaagagtaggacacaactgaatgactaaactgaactgaaaaatgagatctaattactggggaagatacagctaatttrgctatatcttgttactggcccagagtgagagcacccacaggctctgttcaacccaccttaaacttctgggaaagcactaaagctataaaaagtatgttac

SEQ ID NO: 31190 - DNA, 201 bp, Bos taurus
gaaattttcctggagctaaacatccattctcccccagtccttatagtctgaggaaatctgaatgcttgaactggaaagttgggtgagtcaggccactgatycaacttttttcttctacattccacctctattctatgggtttctccggtggctcagtggtaaagaataggcctgcaatgcaggagatgtaggtttgatccc

SEQ ID NO: 31191 - DNA, 201 bp, Bos taurus
tgggtgggtggcaatttcaatgtgtgcaactcaccatagtgaaggttccagaataggaaaaggagtcaggttaaatatatgctaagtttaagttttcatcyggctgcaatcttcctttgacttgggaaattcttgtttagaaatagaatccagtatgtctttcacattgtaaaatattggcaaggtatcttaatttccccc

SEQ ID NO: 31192 - DNA, 201 bp, Bos taurus
agtcacagattttgtaggaatatttctttttttggcactgaggtagtagatgtcctcctcagtttctttctgtatttagacatggcctaatcataaacctyggagaaggcaatggcaccccactccagtactgttgcctggaaaatcccatggacggaagagcctggtaggccgaagtccatggggtcgctcagagttgga

SEQ ID NO: 31193 - DNA, 201 bp, Bos taurus
aaaaatactgcctatcccttatataagaagatgggaaacagacaaaagttgtatactactgatcaagaccacacttaaaggccctatctggctgactcccrgaaagatggctctgtatggaaaatggaaataaattttgatggtgaccttgatttctttagaaggaaaacaagcttaagggtgcatagaactggcccactt

SEQ ID NO: 31194 - DNA, 201 bp, Bos taurus
atcttcctgacccaggaattgaacctgggtctcctgcatttcaggaagattctctaccaactgagctgtaagggaagccccttattaatacggtagtatcwaattattagtccggaacactaatttttcagttttgtttcttctcacatatttagaaggcaaggctctctgtcatatcttatatcattacctagattctta

SEQ ID NO: 31195 - DNA, 201 bp, Bos taurus
agcacagcaaaatatccaagaacagatccactgaagggggttagaacacttttcctttactggcatggccactcccccagcgtggcccagctcagttgcaraaaaggctccattcagtcccagatttccctcagcatcgggatggagtgtttagcttcctgtgcctcgcaggatgctgccgcagaggccacttctttctca

SEQ ID NO: 31196 - DNA, 201 bp, Bos taurus
ctttcccaactttctttcatgcctcaacacgtgctctgatatctatttggagtttctctgttttttgaaaaactctattcaatactttcaattaaaattcytctcccttttcaacacctatccatgtgaagaagagttaaaagctctcagagtcttgctagattttggttcaagatggtgacacaggaagctcctgaactc

SEQ ID NO: 31197 - DNA, 201 bp, Bos taurus
tttttcttactatattatttctgaagctttctggaaatgtcccaagaagaactgtgtgaaagatgctttgacccacttaaagagttatttaccctgtgatmcttttgggatggataaaataaatagtatagcctagtactggagatattttcttatattacaaattgaaatataaaatagaatatgttaaaagtagggatt

SEQ ID NO: 31198 - DNA, 201 bp, Bos taurus
aattttaaagttacaaactctaaatgatactgatattactacttccctattctgttttattctttctcctatttatactgagggaggaaaggaacaggccraaggaaaagaaggaaactccatcttgcactttcagtgagctttggactatgcgcctggtagccatggggataacataccatggccgaactggcctcccag

SEQ ID NO: 31199 - DNA, 201 bp, Bos taurus
acagcatttttgttttggatgatggaaaagtttggaaatagtgggaatagatatgtaacattgtgagtatacccaatgccactgaaccatacaactgaaaygttgacttaaaacatgctgaattgtagaattagaaatggtcaaattaatcaactttctgttgtgaaaattttaccacagttgaaaataaaagaatgaaag

SEQ ID NO: 31200 - DNA, 201 bp, Bos taurus
tgtgggcactttatctctaggtacagaactgtttcaggcccaagatctattctttttgtggctgcagaatggggagggcagggataaagactgcccatgcraatgctacctttccccaaaaatatccaaaaacctttttcattagtcatatccctaggcaaagggtatctcaatttagtaaacatatttttttgctgtaag

SEQ ID NO: 31201 - DNA, 201 bp, Bos taurus
aaaggggacacaataacatcctccccactgcttacctctacatgtcagagatcttccaaactgagcaaaggattttggaaaaggggacagatggagagacygattaaatccacccttacctgcaagacaggcagcctctccccagagaagagctctctgtaattctgccaggggatatggagggtcaggtgcaacccacct

SEQ ID NO: 31202 - DNA, 201 bp, Bos taurus
aattcatattgatgtatggcaaaacccgttacaatagtgtaaagtaattatcctccaattaaaattaattaataaaaaataaaacaggaaaaaattctttrtctttaagaaatctaggcccacctttcttttcttatttctgtgctcttagccatttccccctttcctcattccacctttttatatatcctatattctcac

SEQ ID NO: 31203 - DNA, 201 bp, Bos taurus
ttatctagccaatgctaaaagagattcaaaatttcctctgtcattaaatttttcaccaaaatatcatcctcagggtaacctgggagaatctggatctattwaaggatgccttgacccttttcttccagacataagggtgtagtgatcaattgtgttaataatagcaattgtcagagtgctttttagaatttccacagtata

SEQ ID NO: 31204 - DNA, 201 bp, Bos taurus
tagatagataaatattaaacactaaatattgtgagccaactatattagtgagaaaaatcaacacaaggtatttcatactaaattcaaagtagaaagtggargaaatcttaattgtaagagttccaataattcattatctttgagactgggacagttactggtggtattttagaaagtgtgacttaaactgtgtcttgaagt

SEQ ID NO: 31205 - DNA, 201 bp, Bos taurus
gcagtcctgtaaatcagcagttctacttctggaaacttgccttaaagaaacactcagatgttatcagtgttaatgtagtgtgctcataataataaagagakagaaacaaacagaacaagcacccatccagagttggttgaagaaattagcagttcatccatgtaatgaaacagtagttacaaataatgatatgacttcatt

SEQ ID NO: 31206 - DNA, 201 bp, Bos taurus
atttccatactatttttaacttgtatatggaaatgattatctgtttacctctgaagcatgaaaactcttacagcaccctttataatgtatttatgtaccaytttccttctcatgtccttgtcagaagtattcacatctacctcccagaacaaaagttgagaagcaggctgatttcttttttgtattttattattaattttt

SEQ ID NO: 31207 - DNA, 201 bp, Bos taurus
actttgcttcacaccaatgttgggtggttcttttagtttgggctgactggcaatcagatgcatctgtctagtttctgctggaaagtcattgataaaactgragaaaaacttcctaagggttggagacatgagaggacagtgcctgggacccaaagttagcctaagatagtggcagccagactggagcaatttttgagagaa

SEQ ID NO: 31208 - DNA, 201 bp, Bos taurus
aatgctggaaatgagatgaacaaaatagtccctgactgcctggatttcagagtatagaagaaaatccaaaattataatcacaatgtgtctgtgtattcatycactcagtcatgtctgattctttgcgacgccatggactgtagcctggcaggctccactgcctatggtattttctaggcaagaatactgcagtgggttgcc

SEQ ID NO: 31209 - DNA, 201 bp, Bos taurus
agacccttaacttagtgacatcttttgccatacgatataatattcattcttttgcttcatatggtagtattcagttggggtcattttttttttggcctacyatctgctgccttactctttctttgcaatctttggcttattctatctatctggatttttttgttgtttgttgattattctatattctggcccaccttgtaa

SEQ ID NO: 31210 - DNA, 201 bp, Bos taurus
aacacataccacttccctctgtcataaaggctggtagtccggaaatagaagaccatagaagccccccgaacgtacaagtctcttggtggaagtttagacgytggtccaaagagttaaatgcttcgagatgaacatgaaaggggctaagagtgggcagaaaaagtctacgctgtacattcagaaaggtagaagttcaccagt

SEQ ID NO: 31211 - DNA, 201 bp, Bos taurus
atgacatgttggccgttagccttttttttaataaaagagtcgagaagttactctcctgtggcttttgctggtactttttatagccgaagtgtggtaggaartaggccccaagttcccttggcaacaagtagagtagaagcgatacacagaaatctgaatcatcggtgaatcatctgaggatttctgtttctaatccttgga

SEQ ID NO: 31212 - DNA, 201 bp, Bos taurus
ttcttcctgaattatacttaaataaaatactgaaaggtaaataaatattctctcacctgggaaatacttttttccccctcttttctttaacatttaatcartttctcagtggtctcaagaacctgctgcctgttttgttttggtccagttttcactctgatacctgtgtcttcctgatttcttagccccctggctttaagc

SEQ ID NO: 31213 - DNA, 201 bp, Bos taurus
gtcttaacatattttatcactgtgtctttttaagaaagcaaattaatcagaccactaataactttaccatccttgggtgacttaaaagtgccaccatctgmctttcttttacttaaataggacagctgaaaggcatagacatgttttgcatgtattatataaaaacaatgaaatcccaaactgaaatgtagtattaaaata

SEQ ID NO: 31214 - DNA, 201 bp, Bos taurus
agaagaaacaaagttcataaccagtaggggttatatctttatgcagttaccacttcagtgaattagaagccaaacatgtcgagaagaaacaaaagcacacrtgaagcaatatacttgcaatcagatctcaaatcatctattaaatttaggatcatgacttcaaagtcaaaaatcacaatgcatgcaaagaaataggacagc

SEQ ID NO: 31215 - DNA, 201 bp, Bos taurus
tacctggtagatacccaccccaaatgggtgtatgaagcagaggagcagaaagagactctggagtgggattataactgaactacatttctgaagtaggcacraaatgattctctgacccccaagattctgtgtcctcccactccagagacccccaagaacttccactctcactctgctccagactacagccctgacttaaca

SEQ ID NO: 31216 - DNA, 201 bp, Bos taurus
gccatccttacttctctagcctcagttattgagttctaggtcaaaatccatatggctttatcctaggttgcttctaaacactgccatactctgtagaaacrtgctacagaaggaatcagtttctgcttccacctccacagaaatgaaacacacatggaaagacagaagggctctatcctttgcccagcactgctcaaatcc

SEQ ID NO: 31217 - DNA, 201 bp, Bos taurus
atgcctgtgttaggcttttctagaggaagttaatacatatataggccctttctaaaaagtctgtatggcatcagagaagacgaagcatgttgacacatagytacacaagtagccacaaggcaagcttgcagtgaaagttataaaggagatacagagtgagatgaaattttggaaggtgaagcagtgtttttaaactcaaga

SEQ ID NO: 31218 - DNA, 201 bp, Bos taurus
taaactctcagctccagagttgccttgcaatgcatctctattccagttagccagaaaagggaaaggaaaaagatgagcattcataggattaggccgcatayggaacattactttccactgtaaatgcattcaatacactcagtcatacagagggtctgggcaacacagtccacctgcatccttaaaaaaggacaatgtggc

SEQ ID NO: 31219 - DNA, 201 bp, Bos taurus
atagagtaactttcaggagtactttttttaaatttccatattttaagaagtatttggcagttccttcaacaaattctagcccctattatataatcagtaayctcttaaagaaagctgtaataacttcaaaacttaagagccaccatatgcttctttttgcacacagaatgccaaaataaaacttaattatgagtaccataa

SEQ ID NO: 31220 - DNA, 201 bp, Bos taurus
tcggagacccatgcagaacaaactgtacaacactttcatcacattaaaaaaccaccatcactcaacagtgtcagcatgccaacaagggaatggctttacaygctgtgttcaggaaaggtttgggaaaggataatagaaatcaggggccacttaggcagcaaaccataaccaattatgagttaataaaaacaaggaaactag

SEQ ID NO: 31221 - DNA, 201 bp, Bos taurus
aaggtttacttaagtagtaaataaaaattttaaaacattaataagtataagagtaacaaggtggaggtgatgagggcagacacactgctgcaagccactgygaagaggcagctggaccacagtcagaaataatcctcaagataatcatgactgagctgcgactcctggacatggagtgctgctcaaagaataagccagcct

SEQ ID NO: 31222 - DNA, 201 bp, Bos taurus
aagtaaaaaaaaaaaaaaaacaactatatgttttattttagttttctttcttgcattactaggaagcttaaattccatcccattctcaatttattttgccyttgttttccttctgtgaattattcacacttgtttatgttcatttttttctgagatgatcatttctctgattcatttatttctctttacacagtaaagcta

SEQ ID NO: 31223 - DNA, 201 bp, Bos taurus
ttctaaggatgaattgtgaaattcaaagattttataatttgtaaatgtataaaattaatacttaaaaaactctagaaatgttttctccttttcttttacakctcattattatgcttcttttgattcagatgataagttaaactgttttctacctttaagataactggactatttgtgaaaacacataggataaatacaaat

SEQ ID NO: 31224 - DNA, 201 bp, Bos taurus
ttccttatagtttgtaggataaaatccagatatctttgcaggggcccacaaggctcttgccccctcattgaccctatctcccaactcccttcctgtacccrctgagctcccaccacattggcctcctgtctggtgtgtgggcagtcagtctccttccatctcatgaaacgaactgctagtcacagttctggtggaatgttc

SEQ ID NO: 31225 - DNA, 201 bp, Bos taurus
tagctggtttctctttctgattgttaagcccaaagtgaaagtccaagacagcagtaccataacaaacacactagtgctgacagactaagagaatgaatccktttgttgctaataatttggagaggcctgtagcaatgccaccgtagatagccaagaactgtggtagatagctgtgttcagggactccatttaacccacagt

SEQ ID NO: 31226 - DNA, 201 bp, Bos taurus
caagcccctaaatactttattgtatacactacatttttttcatagttacatgtttgtgagactagtagattattgaggtctttgaaaatacaaagcttacrggaaatactgaaaaatactcactgaagatatatgttcatttttgttgaaatatagttgatttgcaatgttgttttaatttcaggtgtacagcaaagttaa

SEQ ID NO: 31227 - DNA, 201 bp, Bos taurus
aacttttgtttgttaactctcatatgaaaagataagtcaaaatagcaagttcttttgtttgttctaaaaatctaattaaagttgattcttggctagaactrttattcttccttcctgttttctcctctcgtctctttatgtattaagtgttctttgttgtgagactacaatacagatattcatatttgtttgtgctgaagt

SEQ ID NO: 31228 - DNA, 201 bp, Bos taurus
ttggaagaaaatgggtagttctagtattcaggccaattctggagtttactaacctgtgaaaatcctaaaatcatgcctccaagtaaagaaaaaaaagcacygaactaggcccaattagtcttgggcaaatatcctaaacactgtggacctcagagtcctttgccgtaaattaaatggctgaattcaatgaatctaaacctt

SEQ ID NO: 31229 - DNA, 201 bp, Bos taurus
tttatttattgatgataaaaacaatgtaattaaataagctactaaaggtcacatggttcatgaattgcagacccagaatatagacccagagtctttctggscccagagcgtgtgtgttttcccatagcatcatgttagtaagcaaaatgacatttatataaaaaattcagagtaagacatgtctatttatgatgtacacct

SEQ ID NO: 31230 - DNA, 201 bp, Bos taurus
ccagagtacattattacatacactaaaaatactccaaatgaaatcaggcactctgaggacatctatatgatgagaaaatactttttcccttgatttttcartttaacctggtgacttttcttttagctgaatgacatgaaaacaagtgttggaaaaagcgatattataaggttagtatgttaaaaaaaattaacaatagag

SEQ ID NO: 31231 - DNA, 201 bp, Bos taurus
ttatctcatcaattaacaccccagccacagatgcagaagcagaagggtggaatatcaccctgaaatactaacaaaaggggagatggaattgagacagagargaggaaagtgctttatgtctactaggtggccacagttagcctcccaacccacgtactggatgagtccttaggacacgtgctcacatctctacaaagagtt

SEQ ID NO: 31232 - DNA, 201 bp, Bos taurus
attttgcatcaagcctactttgggatatatagcattttcatcttataccacatctatgtgcctcagtcaatgaacatcataaatgtcagaatacatatgayattgtatattatgaaatccccatcttttctctgaagcccaacagaaatccatacctggatcattaataaggaaatttgctctcaacacagaccatctagc

SEQ ID NO: 31233 - DNA, 201 bp, Bos taurus
cttttaaaggtgtaaaatgtagtacaaactttttctctcatcattgttctccccatacttaggtctctctgttatcatacaatggggaagaaagggggaaraggaggtagtttgaagcaaagttgttgtattttcaaattactgaagaaatgtaacccattcacatccagatgagggtagttacaagtctagatatttccc

SEQ ID NO: 31234 - DNA, 201 bp, Bos taurus
cacactcgtagagccctcatccctttcatctgggctgcacctgcagcttgcaaactgaaagagcatggtagaagcgataactgccagtttcaggcccaagscttgacggtacctgcagcttctgcttttgtggtttgtggtgctaagccatcatataagaactccagccaccctgatgagattacatagaagttcacttag

SEQ ID NO: 31235 - DNA, 201 bp, Bos taurus
tgctttctattgattaaaaagtcattttaaaaatctgtgatctataaatacctattctctattcttttcaaacatttgattttaaaaagcaaggatttatrtgtgatggccttatcagtggcaaacaaaacctatttccaggtaaataatttagccttgatggtattctgaatttctgttgggtcatactgactggattaa

SEQ ID NO: 31236 - DNA, 201 bp, Bos taurus
cacccaccagcaggccagctgccataggaacccctaagcacccagccacctgatcaagctccacctgtcagagggcttaggactaagccccacctaccagygagtaggcctagccccaggacttctggggatccatcagctagctagctatcagacatgtcctgcccactattggaatggtactagtcctggtacctggct

SEQ ID NO: 31237 - DNA, 201 bp, Bos taurus
agatgggctaacttctttagattccattatgctctcaaactggttataaccaaagtatttcattttatctatagacaaatcttcctgaagtttctctattraaaatttttaaattatataagtctgaatggccttctgtggttctggggacactggcttctgttctaaatggaactgttcatccaatattttccatcatct

SEQ ID NO: 31238 - DNA, 201 bp, Bos taurus
cctgttgtgtgacaactaccttggtatcttgtaagaaagatcactggctcagaactcagcaagtgttcaccatgggcctactgggttgccgttactaaatyatgctttaaataatcttttgaacaggtattatgtttacagaattgtgacataggccttagatggaaaatataggtaagggcatacagaaatggtagagat

SEQ ID NO: 31239 - DNA, 201 bp, Bos taurus
cttatatctgcttgtgaatccatcttcataatttttgcttcctgccattgtactaaaacccagatgctcactcacaagctgaactccacatctgctaattrctttgttggttctgagagggaaatttacttatttttgcactgtcttgattctcatagtttgtgccagccagtgagagagtgggcatattttctttctgtg

SEQ ID NO: 31240 - DNA, 201 bp, Bos taurus
tcccactgacatggcaaaccctcggccaattgtccttattatagcccctgtgtatttctccccagcgcacttgcacagggggaagacgtgagcgtggagcrtacttaactgccaagctgaatggctctgtaatgtagcttcagtatggcataaattaagctgtcatttttttggcagcaagtgcagagaggcgattttcct

SEQ ID NO: 31241 - DNA, 201 bp, Bos taurus
tctatctaaatatatttgaaatatttaggagagtttttttaaaaagctgctcaagccatcttcctgatttctgatcaaaagaatttaatcctgatttgatytgaatcttccaaagagtttatactacactgttacatgatctacatgtgtaacggcaactttgacaactccctgttgaaataaactcaaagcaataataca

SEQ ID NO: 31242 - DNA, 201 bp, Bos taurus
atctggcctgcctacctttccgctttgagtccctgtcttaccactgaactatttgttcccagccacaccggcttcttgactgtgcccaacatgacctaacwtgtccctgcatctgggcctttgcactttgctttgctgtgcctggagagctcttccccctgtggcctccctcatcttcttccaatctctgcttaaccttcc

SEQ ID NO: 31243 - DNA, 201 bp, Bos taurus
tgtttctcaagccagaatgaaaagtatgatttggtacttgcaatcagtatctggaccacattcctatatatttcaatttaagaagtctagcagaggcctaracttctgtattttgaaattgttgaccaggtaatactctctactgatttaagaactgttgttaaaaagaagatgccatgtttcaaaaaaggacaaagtgag

SEQ ID NO: 31244 - DNA, 201 bp, Bos taurus
cggcattagtcagtcacatatatgatggcattttcccaagtatattctgtgtattcacactttcctttctaccagtcactttgaatttggggcccactctkcttgtatcagtgtgcttaagacaccctaacaaactgccatagaatgagtggcttaaacgtcagagatgcatttttctcaggctaagatttggttttccct

SEQ ID NO: 31245 - DNA, 201 bp, Bos taurus
gaggaacaagagagtgaccgtcagccttttaagaaggacctcaagcctaactgaagagttagggcatccaacaaaaaggagatgttaaagatctaatgtcrcattaccataaacttcactgacgggagaatgagagcgccttcgtaataatgggttcacgtgactgagtggtcagcatcgttatgccccccagtcatgttc

SEQ ID NO: 31246 - DNA, 201 bp, Bos taurus
attcccaagccaacttttacagccagcgcccaagaaatcctgctcaaagcataacttgcccagttccttaaaaagaactagatgagctgctgttaataccmcagctcttctctttaaaaggagggacaaaggtatgagaaaaccccacaccgctgacacctccttctatttacacagtttaaactccgtgtgtccttgatc

SEQ ID NO: 31247 - DNA, 201 bp, Bos taurus
tctgagcaacaggatagaccttggccaaggtcagtggcagggacaaagtcccaaattgattcttcacaacatgctggagaatacaggtgtgatttttaacytctggccactacaaaagtccacagctgcttctcctgagaaagatatggttttcccaccccaacatcaaccttactttcgggtaaggccactccgacatag

SEQ ID NO: 31248 - DNA, 201 bp, Bos taurus
agatggaaaaaaaaaaaaggatagtgagaaagacaagaacttcacagttaaaaatgaacctaagctttttcttttttccataaaataaatgagaatactckactgtaccacaccacatcccctgaacatctgcagtcagggaggacggacaagtgttatgtgcggtggcatgtagaacagcttccacatttctgcccccga

SEQ ID NO: 31249 - DNA, 201 bp, Bos taurus
gcgggaactgattcagacagacaggcgccctgctggaccgggcagtacattaggactgtcttccccccaccacctcatccctcctcctgggcctggagccrtctcagcactgcctccagattgctctgcaccatcctgtgctctgggggaatcccaccctccaggggcagggatttctgagttctgggcctagcgctctca

SEQ ID NO: 31250 - DNA, 201 bp, Bos taurus
gtctgctccaggccggccccactagctcccagctactagcatgaacttgttgggagctgacctctcacgtgggtcttccatctggcccagccaggggatarggtctagctaggggtatattacctgccactggctgatctcacttcaaatgcatatcactaattgtccttggggccttcgggtgtcctaccctcgtactgt

SEQ ID NO: 31251 - DNA, 201 bp, Bos taurus
agtatggcacagtaatagctggtattacaaggctataatgaaaagaatttttatatactagaacattcttagtctttacaaatataaacataagctttctyaaaaaataaagccctctggttaagaactttccatttgcctgccagatgatttcttatatctataattaaatggctggtttcaatttgttaatcaaataaa

SEQ ID NO: 31252 - DNA, 201 bp, Bos taurus
caactccaaagattctgcttggccatgaaaatttttcactcagaagacctgagtgatggtctttgatggatttcaggcaagtacctgtgcgaattataagyatttgaaggtggtcaggccgagtcatattgggtgcacatccagttagtgtttatagcagagaaagtttattcatgaggcaaccaagcaaggagatgggag

SEQ ID NO: 31253 - DNA, 201 bp, Bos taurus
ggggagcagtttgatctttttcctacaatgaacacaaaatttattattataattttaactgcagcgggtcctcgtcgcaagcgtctgggcccctctggctrtggtgggcagtctctagaacacgcagctcagtggttgcagtgtgtaggaccttagttcccacaccagggactgaacctgggccccctgcaccacgagcac

SEQ ID NO: 31254 - DNA, 201 bp, Bos taurus
ccttacaaatacgagtcaccacaagcttccagcctcaaaacatctcaactgccgaaataaactttgatgttgctctttcattctaacagttaggcctcttkaacattttaggaataaccaaaggttatactgaaggctgttcgttttctcaggcaagacttggagtcaccatgtagggttcactttggtttgaggaactga

SEQ ID NO: 31255 - DNA, 201 bp, Bos taurus
ttgattgattgaatcaggattgcctgtgtcttcgtatcactgaacagctgagattcacattgtagaaacttgctgccataagagatgtgaccttagtcacygtaatctgagacctgtaaaatgtagacattccctttctttgcttagtctgtgactagttgacctcattttccacagggcctatccatagcctgtcagtga

SEQ ID NO: 31256 - DNA, 201 bp, Bos taurus
gaaagtctgggagttttacaataaacataggctttaactagacagtcgtaaaaacttttgagtgaacatgtccttctctgctgctgtaatagacccattaycatctttccttcttgtaacacctttctctaatcatctttttgttgtggacctgatatcctgatatcctcccttgtatctccatcttgttagattttgcct

SEQ ID NO: 31257 - DNA, 201 bp, Bos taurus
gtgtgttactctgaaagcatcccatttcatttggagaattggcatctgcccttctccccagtactgactcacacatttgaccttctcaaatccatggctcrgtggggttgtgattcatcaaggggtttccagcaggtctgggtgtttgggaagaagcctcacccagagtcaagtacctagttcctttgagaagattctgaa

SEQ ID NO: 31258 - DNA, 201 bp, Bos taurus
tactttctttcacttaatacctagagcttccacaagagggcaccacaactctagccagacacattttctaggcaagaataaaggaggggcatgggggcagrggaaggacacgaccaaggagaccagcagtgaccacctggctcgaggacagccagtctcttgaccactgactcacctcaagtcctgagacggaagtcctgc

SEQ ID NO: 31259 - DNA, 201 bp, Bos taurus
gtatgcaggaaggctagaggaggaggaatatttgaaattcaagattcctatatgttgtgaatacttagcagggaggtgagctcccttccttctccatgagrctttagattgtttgttgggaattaaagttttaaaaggatcataggatagaatagcaaactcttctctaaaaaggaagaatggttgcccaccaggtgacat

SEQ ID NO: 31260 - DNA, 201 bp, Bos taurus
tctccatcactgcatcactgcttcccatcatgccaggtgaggctgtatgtggcactccatctaggggcataaagtctctaagctatgcttatgtgttgcakataaggttatcaggagacaggttgagataagatttattgcatgcagaagtttattgagaaggttccccagaatctattcttggaggcagggaatgacaac

SEQ ID NO: 31261 - DNA, 201 bp, Bos taurus
gaaagagaacaaggaatccttttagccaacgggaaagaaatatgcctacatgtaaataagaacatcaacaagaaatggcctgttttaatgcactgttttgrtatcttcctgtctcactttaattttgtaaaatgagataaattatttttcttctctaagaatttcacaattaagaacctgaaaaagagagtatccaagcat

SEQ ID NO: 31262 - DNA, 201 bp, Bos taurus
taaattttttcaggaatattagtatcaggagagcacagccttaaaatatgttctgtgactcacagaatgaagataatgtttgacttctcttcaattatttkgttactcagtaggttcagtcaataaaagccatgcagccataggctgatgcagttatggcagattgttgtgtaattgcatttagaaaatgcaaattaatta

SEQ ID NO: 31263 - DNA, 201 bp, Bos taurus
ttatttgtaattcacacatcaaaacatcagcctaagtcactatgacctctaataccttaaaaaattcttttgattataattttgattataattacaatagytctattaatcctttgatgatagcatatcactttacctgtggagcaggcagcttttcatagtcagtgaaagtaaatgaactaagtctgtattaaaattctg

SEQ ID NO: 31264 - DNA, 201 bp, Bos taurus
tcctaaacattgttcttgggactttggaaaagaagatatcctgcattttcattgcctcattcagctgtgaaccaccagagtgattttccaatggaataagrtgcttttccaggctccttgctaaaaatttaggtggttttgggaaatgagagccatcaaaccttccctgacaggtcagttttggtattcagaggaatacag

SEQ ID NO: 31265 - DNA, 201 bp, Bos taurus
gaataccatgagtagtcattccctattattaaaaatatactttttcatttgtcagttctgtactttgagataactctgtagatgtttgtttactgcctgamcatctacagaggtaaaaacagtggtctgagaaaccagggtcatttcagctgggagtttgaaagcttcaagttatacgtatcattaccaagtttggcttta

SEQ ID NO: 31266 - DNA, 201 bp, Bos taurus
tgtgtagtgtccacactcgacctaaactgtttggaagtttcagggccactttgagaatagctgagcaaacaataaggtgagccacggtaaacttttgaatrgatgcaaagattgcaaacttatataaatgcatttgatttagtaggttaattacttagcagccttgcatagtggttaaaaggatatgccccgaacatagat

SEQ ID NO: 31267 - DNA, 201 bp, Bos taurus
tccattcctggaagagtttaacaccatttcctaattctttcaaaatgttgaggtatttgaccaaagcgtctgtttcacaaaagggcatagtatacatctaygggaaggaacaaggtcaagtcttctgaaatcctcagaatgacttctccttttatatatgcaaattccgctctttaagcttctcacccaagccttcttgtt

SEQ ID NO: 31268 - DNA, 201 bp, Bos taurus
gtattttctggcatatttttctcattgctggtaatgtgctggcatgttcagtgatatgttttaaaaagtttagaaagatccagaaaatttaagatctgcartaaagtgaaaacaatggtattttcttgaacatttagggttctgtttgatgctctcataaaaattcctgaaactaaagcaggaattgcagttactactttg

SEQ ID NO: 31269 - DNA, 201 bp, Bos taurus
gagtcaaggccttcttactcctgtcactatgagaacgctgaagaaacgggcatgtcatgaggttgtcaattggtttgtcatgaattgcagaacacaatgayggcatttgagaggccgaacattaatataaaagtgactatatcattactccaggcttttatatttgtagagactgtggagtcacataaagctatattttat

SEQ ID NO: 31270 - DNA, 201 bp, Bos taurus
cctgacgcgccaaataacagagaaggatcccaggcaattgagccctttaagtgcctgaacaggtggagctacagagaaagactggtcaaaaagaccttccratcgccagctataagaggcttgaaaaaagactctgatggggccataactcctgtggcagaggcagtccatgtccctgccgcttccagggtccccgcaagc

SEQ ID NO: 31271 - DNA, 201 bp, Bos taurus
agatgctgttaggatgacatttgcattcccattgattacattcaataaaatctgacatttttaaaggaggagacaaaaaaaaagcagcttgcctattaatyatggctgttgccaaattatattatgaaaccttggttttccaacaattgttctgaacctgcagctttaacaatattaaagacttttagtgaatagttttaa

SEQ ID NO: 31272 - DNA, 201 bp, Bos taurus
ttcatataagcatggaaaatgtattaaataattcctaaaatctttgtcattactcacagtcctttcagtgatccactaagtcattcagaaacaacataccrtctcttctgagagggcatcatgctgtctagtaaagtgagatggtgtatttcaagagtaaagcatcttgattttaatcagggccgctagccgctgactgtg

SEQ ID NO: 31273 - DNA, 201 bp, Bos taurus
agaatactggagtgtatagcctttcccttctccaggggatcttcccaacccagggatcgaaccagggtctcctgcattgcaggcggattctttaacaactragctatcagggaagcctggccactagatgacttatctgtaaaaaagtaaattttctataaaatccatatattatttcttgttttttttttcccccccaaa

SEQ ID NO: 31274 - DNA, 201 bp, Bos taurus
atatttaagcaagaaaaattacttgccagtaatgggagacaagatacaaaaggaagaagtagtgaaatctctgaacaagtaagtaggcaatggccaagagstaagttaaatctttatttactcactcattcaacaagttctgctgacctaattccatgtgctaagaactatggctaacatcaggccagttagaaaggtaag

SEQ ID NO: 31275 - DNA, 201 bp, Bos taurus
tgtgtcaacagtgaagacttacactaatcttaactggacaactgtatacagatgtgtcatccaaaatggttagcccaggggggtaaaaatgtatcttggtytcactattcatccagcaacagctgacaatttggcagcaatctatgttatgctaagatttcctaatactcctgcttgtattgtttcataggaggctgcttg

SEQ ID NO: 31276 - DNA, 201 bp, Bos taurus
gacaaaaagtaaattaaaaaaataaaagtactgcttttattattaaaattggaagcaaacaaatatatttgagggggagtttattgataatttcctaatgrcatagtagataacacatctaaaccttgatgatttgaaattacctgttgacaaaattgggataatattgatgaaaaattttatgagccagttgtgggggac

SEQ ID NO: 31277 - DNA, 201 bp, Bos taurus
cctttcattttggtcattctggtggatgtgtaatggaatcacattgtggttttaatttgtatttccgtggtagctgccgacattattggccctttaaatamcctcttttacgaaaagtctgctcaagtctttagaccattttatattactttgccatctggcctttggttagatttagtcaagacaaaagtttgcagatga

SEQ ID NO: 31278 - DNA, 201 bp, Bos taurus
cagacatgctacttttcactaatgcgacagatgatttagaaaaatttaatgcatgctgtgagaaatgttgacacttatacccaggcaaagtgatggctgcwagtaacataatgatgaccatttctgaaataatacattatttttctcatctgataatcaaaaactctgctctggttatgatcatcgatgctacacagctgc

SEQ ID NO: 31279 - DNA, 201 bp, Bos taurus
accttcaccaaacaaggactgttgttgaagttctgtgaccccattgccatggaagtctggaaactgacccagtattacttcagtgagggtgttgggtaatrtgtattggacaataacaagtaaagaaaataattaacattgacattttaaatatgttatttttccatttaggtatatgttttctgaaagtaaacctgtggg

SEQ ID NO: 31280 - DNA, 201 bp, Bos taurus
tgtgagtcagggttcaggcctacagtttaaatcagaatggcacatgattctatgaatgtttctgaaggcctcactaccttgggtttattcatatatgttcyttatgtaaataaataaaaatttcatatgtatatgttatgtaatctgctttcgtcattttattatgcattgtggtattttcaatgccaattataaaattta

SEQ ID NO: 31281 - DNA, 201 bp, Bos taurus
tatctactttattattttatggagttgtaaataattgaaaataaattaaatacctcaatatttctaaagggcctccatagcataaggacttagctaaggtrtaaaatgattatactgagctcagggacagctttcagtcttgtttgcatggttctttgcagttaatttacatttaaaaatctcaactgtaaatttctaaga

SEQ ID NO: 31282 - DNA, 201 bp, Bos taurus
cttctgattgtgaatcttgacctttataatcctgtgtgtctaccacacaaagaaacatttttgaccctgccatggagatcctctgtagtccccatgcaaaygtatctgtaaccatctctggttcttttttttttttttttttgcaaacatgtacagatttgctcaagtcttttctgttttattttctaggaaacatttgat

SEQ ID NO: 31283 - DNA, 201 bp, Bos taurus
gagttggtgatggacagggaggcctggcatgcctggttcatggggtcacaaacagtcagacatgactgaccgactgaactgaattgataagtcgtatttayagatttttagagaagtggcccaaatattagtttttgagtacacttatatacatatacatttgttatatatattatataacctttctgtttaactaaaatc

SEQ ID NO: 31284 - DNA, 201 bp, Bos taurus
tcttttccaatgagttggctgttcgcatcaggtggccaaagttttggaacttcagcctcagaatcagtccctccaataaatgttccggattgatttccttwaggtggtggttggccatctctacgcacttccccagcttcatacatcctgaatcccaagacagcaatcaactacaactcaactcatgatccttccttttct

SEQ ID NO: 31285 - DNA, 201 bp, Bos taurus
actgtacctaatttataaattaaagcttatcatatgcatgtataggaaaatacataggatatataagtttcactactatccactccttcaagcatcccctrggggtcttggagtatatcccctgaaaataaaggggaactactgcatttcattttttataagaatagaggatgtttttaaaacaaacacttcataataaat

SEQ ID NO: 31286 - DNA, 201 bp, Bos taurus
cctccgaagcagggaaagttatatactatacagtgaaatcatttcacacatcacttcaaaccacctatttcatgagcttgccaactactttttatagtttmgtggagtaaaaaccttcagtgattggctttccctgtgtattggacctgggactctcagagtcccatgagtatgctcggtatgatgtgttctgtacgccgt

SEQ ID NO: 31287 - DNA, 201 bp, Bos taurus
ggtctacagatagaatatatggaaaaatataaatagctctatcatacttattaggtgacatttggataatgaaatggaaggaatgtctaaacttctatacrtaataagatatgactataatcccctcttataaagtagctgttctttacctggaggatccatgactcattggtaagggtatccatgtattggtttaagatg

SEQ ID NO: 31288 - DNA, 201 bp, Bos taurus
tagaaataataaagaataattctagataagttaatggaaaaagcaaaacatatttaccacaaatgttttgctcatttctaaaaagtttgcaactttcctcrtgtcatatacaattttaaaaatagtcaaatctgctaccctatttgcaattacctttatggtgtccaagaatagcaaatcttgccctctccatgtttgaaa

SEQ ID NO: 31289 - DNA, 201 bp, Bos taurus
ataggagaagaatcacctcaaaagttaattattccaaaatttgagatgaaatttatgacctgcttataaaaaagaatttgcttttgatttgaagaatttgyacatttgaagaatggcacaagacactttgttagttttaacacatcgacaaaacaatcacagacacattttttcaggttcttgaaatgctttccttatagc

SEQ ID NO: 31290 - DNA, 201 bp, Bos taurus
tgctgtggtcaggaagatggcgatcagttttctgagttttcttcctgaggtcaggaaggtggtggttaggcctctgagtccttattgctgctgctaagtckcgtcagttgtgtcggactgtgtgcgacctcatagatggcagcccaccaggctcccctccctgggattctccaggcaagaacaacggagtgggttgccatt

SEQ ID NO: 31291 - DNA, 201 bp, Bos taurus
tcatgcttgcttcctctctatccaaatccttattaaacttacctaaaaaggggaataacttttggatttatctttactggtaacccctattgccttgcacrtttgtacactatgaactaattagtatgttctcatttttcacatgttctgagcactcagaaatgtttggaatgattaagatataggcctttgcccttttga

SEQ ID NO: 31292 - DNA, 201 bp, Bos taurus
gagaattatgtaactccagcattctgaaatctacacatttattttagaggccattttcttttcctgcttttactttcaaaatttactacttatctagcttrgcaaagacatttcttttttttcctcccttttgttctttttaaattgcttcttcatgaatcattcaaattcattctctacatgaaaacagcagaaaatttg

SEQ ID NO: 31293 - DNA, 201 bp, Bos taurus
cagagtgtatgatcacactgaggaatgaggattttgaaagcccactagcaaaaaaccccaaaaacatgaaacagagtttatcccccaaatattttgtgcayagaaataattggcttaagcaatatccattttgtaagattgttcaagatgttaagtaagtttgttgtttaattaatgaaccagtcctaacaggaaacatga

SEQ ID NO: 31294 - DNA, 201 bp, Bos taurus
agccctatacgtgaagtagtatagttttaatgtagatgctgtcttagattcaatgaaataaaccattacagtggtattgtagcttagggaatgcttattakattgaaaagaacagttattgaaaactcagaatgactgggtaggtttaaaaggaattcccagacttaaatattcagaaaactctaaaacttagctcaatgt

SEQ ID NO: 31295 - DNA, 201 bp, Bos taurus
tataatctgggttcttgagttgaaaataagtcaaattcacctgcaaaaataagataatgctactaatgtgttttggcaatttactgagacaaatccaaatrctttatctaaataacctagacatttttatgacctatgaatttcatgtgttaaagagtatatatagattctgctttgtacttttaataatgggagggggta

SEQ ID NO: 31296 - DNA, 201 bp, Bos taurus
tataggagtgaaattgctggattatatggtaactctatttgtttaacattttgaggaactactaaattgttttccaaagtagcttcagtattttatcctcmcacctgcagtggttgaagactgatttctctacaacttcatcaacactgatttcctgtatttttgtttatagtcattctactagatgtgaagtggtctctc

SEQ ID NO: 31297 - DNA, 201 bp, Bos taurus
ttatttgaattcctctttgtaacttaaatcagtgaagaaaatggcttccttggagtcaatttttctgatatacaattggttagtgtagagattaaattatragtgtcacatttaatttaaaaccaaagagagaaatagcattatcacggagagtgtgctcttttgtgaatgtcaagtgcaacttgttgaaggtcttttgaa

SEQ ID NO: 31298 - DNA, 201 bp, Bos taurus
tccatatataattcttcaggataaagaggtccagttatttgaaggccacaatgtaatatctcttaatgctgaggacagcgcatactggaaaatgaagaggyacagttttataattaaatagtatggccaaggaatctgtgataaagtaaaaaaaataatgtattaagcaaaaaaaaaaaaaaaccctcaatttgaggtaaa

SEQ ID NO: 31299 - DNA, 201 bp, Bos taurus
gtacattcaaactgtttttctttcatcttaggcgtgctacagttaattctgtgatccaaaaatttcattgtagtcttacgtattcttgaaatcctgctaamttcatcaggtttgctggagatgggccatttcatgtaaaatttttaagaatttgtaaacaattgtaagataatacattttaaaattcattataactttgtt

SEQ ID NO: 31300 - DNA, 201 bp, Bos taurus
aagactgatgggacatggtactacattttagtttaaagttttgttttttctgtgagtacaaactgcatatatatccatacaggggtgacacaaagattatkctttacaaagaagttcttttatattttatagtttatctatatctttattgatagttatagtagagaaaatatattaaacatttctttcctctaagtgaac

SEQ ID NO: 31301 - DNA, 201 bp, Bos taurus
atgcacaaaaaaatagtagggaaaatcttatccaaagatatttttgagtttcctccaaaattaagtttgtgttttaactgtttttagcaaaacaagcatcmgttgttaatacatatggaagagtaagtattttcagcaaaggaattttattttcagatgctgtttttgaatgactcctgttttaaatttttcttttattga

SEQ ID NO: 31302 - DNA, 201 bp, Bos taurus
acttatttaaacaagaaaacactgccatcatctggacaggatatgagcaaaaagctattccagggacagttgcttttcagctggccttccccaaagttctrtgagtcatcatcagctaaaagagcatgcccttctcacctttaaataaatgactaaaagatgagttccttgtattgctacttatggtggagttgaaggcca

SEQ ID NO: 31303 - DNA, 201 bp, Bos taurus
ttgaagggacggggaaataaagctgcattagggattaaggactagagtctcctcataggaactaaacccactgcaggtatgtctgacaggaaggagccagrtccatgtggaggaagtagttactgactgcaagcctgcagagaaagagctaagaagtactgtggcttctaccatcctgtggactccatcctctcttccaaa

SEQ ID NO: 31304 - DNA, 201 bp, Bos taurus
ctgaatttaacatcgtcagtcaatttctaattaacaatgtacaatactgtgtttctttacctttcttatcttttgttagattccttgtcatacttttcatygccttctttaatccatctactcagacctgttctcctcaacccctacaagcttacatcctatttttcttcaagaaattatgaacaatcacaaagaaccgaa

SEQ ID NO: 31305 - DNA, 201 bp, Bos taurus
ggtcaacatttatattcaaacagtaaattatttaaatgaagaagtcagtttactatgctttaaacttattatctattttgccttccatattatgtcatacrctccttgaggatggggagaatctgagcagatttcaatttttaaaatatccttcttacattttgcacagcaaggtactcaataaacatttgtcaaatggaa

SEQ ID NO: 31306 - DNA, 201 bp, Bos taurus
agtcagacataaggggtggagccatcaccatagcctccctctccccacatgcctgcatcagcagctgaacaatacagaggctggcccatcaaacgcacaayagccgactacagagcaggaccccaatccagggtgcccctggatgggcgaagctacgagaaggactggccaaagaggccttctgatcgccagctacaagag

SEQ ID NO: 31307 - DNA, 201 bp, Bos taurus
gttaatagcctccttatctagctcctgtatctattttcaaattgttacagaatctaaacgcaagaactgatgagaaataaggatatttcaagctattatgygttatttatgtagggtttgatactctttccttgtgggattatgaaaggtatttatttaactggattcttgtttggttaaacaaagaattgaaaattgaca

SEQ ID NO: 31308 - DNA, 201 bp, Bos taurus
tttccccagctgactcagcctcccctccaagttagtctggattcctcctgatcttcatcctaccatcttgtagcagaggccactgtaactacactgcctgrtgttcacccagcctttcacacaaggtctctggtacctccagcaggtgcctacataggccagggaaagtaagacggtaatccccatgtggcagaacctaat

SEQ ID NO: 31309 - DNA, 201 bp, Bos taurus
tcaagattgtgatgcaataaacataatcaataaatgtgagaaaatggagagaatttaatttttctttcattaaaaaataatgttaaaccaaacaggtcaayaatgtagttgcttacaggttcaacatctaagtacgtgctatgttcttcttcatttggacttacgccttcaataggttctgcaatttctggacttgcatat

SEQ ID NO: 31310 - DNA, 201 bp, Bos taurus
acttgattttccatacatggtatggcaagagtccaatttctttcttttttttttcttttttgcatgtggcttttctaggtgccatttgttgaacaggccaycctctctctcacggaatgatcttggcactcttgttgagtgtcagctgaccataaacatatggattgacttctggactgtcggttatattctgttgatttc

SEQ ID NO: 31311 - DNA, 201 bp, Bos taurus
ctggcaaagcttttccctgatggggagaaattacctagaaagcaagcagttgtgagcccctcagagatggagtggatactgtggttccacccaggtccccmctgtagggccagtcactccatcctcagccaagagtaatcattcccttaggcagctgtcctcagttgcaggacaccacccagctaaggcagcccagcccag

SEQ ID NO: 31312 - DNA, 201 bp, Bos taurus
caaaaggctatgttattttaaatctgcacttagaagctttaggggcaagagatcagaggtggagtctcagggagaagaaagggtgccctatactgcttccrtgctttctttcctctctaccttcagccagaagaactctttaatcattagacattaggatgagtttctttctgaagaaacagatacatagttaaaactagt

SEQ ID NO: 31313 - DNA, 201 bp, Bos taurus
tggaaggatcatgataacagacaacctacctggtgctgaaatgacaacttcgggaaatctaggctggcagtgatgagtatggtctggaagtaaatgtttayagtgcatcgacccaagaacgtgactgaatttgacacagattgcctgaagcaccaaacaactggtgtaatatttacctttgccatttcccatcatttacag

SEQ ID NO: 31314 - DNA, 201 bp, Bos taurus
atctcagtttaatacctattcccctattttacttgtgagtttgatttcttaagaaacaatcatggtaaaatatggcaatatctcagagagctgtccaaacyctcaccacatgggttatcactgatctactatgtatttgatattaaagtcacctttattattcagaaatttggagctttaacttttttaaactggaaacta

SEQ ID NO: 31315 - DNA, 201 bp, Bos taurus
tcagggcactggatctcgcatgccacaactaagtcacatttcaaaagatcccacatgccacaaccaggacctggcacaccagataaatacgtatttaaaamagaaaatgtgctcaacagagaagtttgcctaaaagataacttatttgcctgacccaacccatacgtgtagataaatccctcctctgagagtttatattcg

SEQ ID NO: 31316 - DNA, 201 bp, Bos taurus
ggaaccagtggaactgagtaaaggctgttaggtaactaaatagcaatagctattatgcaaataaataaacaaatcatagtcatcacttggtcactccaagkatgctttctgctttgttgttgtttgagaaagttataatttaaggatttatggttttaaaaatggctataatatttaatgcatttatgtgtatctctttga

SEQ ID NO: 31317 - DNA, 201 bp, Bos taurus
tgcagagaaaatgtctcttattacttcattctgttctaacatttttcccttgaataccgcaatagtctaacacagaggaaagaacatgcttccaaaggagmagggtgaaagttattaacatatgtacatatatataaacataactgagtaaatatatacacacagagaaagagaggtacaactctttatgagcctaatgca

SEQ ID NO: 31318 - DNA, 201 bp, Bos taurus
aagtattcacagtaaaataccaaggtaaggtaaattcatccactccatattcccaaacaaggtgaggttaagtttttgcctttggaaggacaggtggaaayggaagagaggacgagatgtaagtctacacatagggcgttgacaggcaaccctaaaacacaaaatgtttgtcctccaacctgttctccttggaccatccca

SEQ ID NO: 31319 - DNA, 201 bp, Bos taurus
aaaaggcaaaggccaatttgtcactatagttttagcatcacattttctgccactgtaaatagatctctgacttaaatttgccattgtatattaaagccacyatatgtatgaaaacactgggtgtaattctgaatatctaaatcaatgttagactcaaatacactgtcacaagtgcaaatatttcactgtgactttgaatat

SEQ ID NO: 31320 - DNA, 201 bp, Bos taurus
cacagtatatgggatgttttaaatagtctctaatgcatgagtgggaagtggggaggtgtagaaagtgagagaagagcatgaacaaaggtgggagagggtgmaaatgacactcctatgcagagaagtaaatacagatcagtgaggctagtgaaaggggtagctgagtaaacttgttattaaccgaggatttttccagaaatt

SEQ ID NO: 31321 - DNA, 201 bp, Bos taurus
tcctgtgatacaaaaatcccacttgactatttcatataggagcaaccaaacattttgttgttgtattcagtctccaaatcatgtctgactctttgccaccycatctattccagcacaccaatccttcaccaatccctgtccttcaccatctcctggagtttgcccaagtttatgtccatttaatcaatgatgctatcccat

SEQ ID NO: 31322 - DNA, 201 bp, Bos taurus
tcaaatgtattatcagagaggagtcatcaatggagaggatctggtgcagtatggataaaagtaaaaatgtaaacagaacatacagattctatgttctcctyctttgttaatataacactggtttaggcaataatataattgctgagtaacaggtaatgtcaaatgttagttttttaaacattaagtccagatctttcttcc

SEQ ID NO: 31323 - DNA, 201 bp, Bos taurus
gactaagcacaaactagtactagtctacaccttatttagctttttctagttggttcactaatgtccactttctggtccaggcccaatccatatcctattcyacatttagtctttgtgtctccatagtctctgtacattgtgatgggacctcaatcagtgtttctatttcatgaccttgacacttttgaagagtattggcca

SEQ ID NO: 31324 - DNA, 201 bp, Bos taurus
ctctgaaaggatattttaaatttcagattgcatggaagagaatagctatgaaatcttgagttttactcagataaacaattaaatcatggattggagtcttytatagtatgcacgactattccaaaatggttattgctatagtttgtagtatctgtaattggcctaaaaacaataaatttgttccagcaaagtaactccaaa

SEQ ID NO: 31325 - DNA, 201 bp, Bos taurus
tcaaagccaggaagacattaagtggaataagaagttggggtaagagtctaggtggttcatgaatattgagaggaactagtgagtacaaggtaacccagctrgaaggcaaaagtgcagagaccaaggtatctaagaaaatattaggaagtcaatagagttgctcagtcatgtcggactctttgcgaccccgtggactgtagg

SEQ ID NO: 31326 - DNA, 201 bp, Bos taurus
attagctttgcaagactatctctcagttggccccttagagagcagactggaggctgatcaagatgaacatggttagatgtggctaccaagtccaccaagtyactgatggcccagagaataacggtggcatggaggaggaaatgctgaagaatttgtgagcacgaatataagttagtcttttcactgcattttaccttatgt

SEQ ID NO: 31327 - DNA, 201 bp, Bos taurus
ttttaaacagcactagcaatatttctcagagaagcagagggctgtgtgtgcaattgcataatacacttccttgacagttcaaaaaatcataggccttctcrgataacttagaagctgtctgcatctgtgtatcatattacgttggggaagagcaattagtcaaggggaggcccaggcccagggcaccactgacattcctct

SEQ ID NO: 31328 - DNA, 201 bp, Bos taurus
ccgggagctggtgatggacagggaggcctggcatgctgcgattcatggggtcgcaaagagtctgacacgactgagcgactgaactgaagtgaatatacgaytgactacctagggcctatttatctattgggtttttttttttcccccacatttttcttctcatttagaaatgctctttgtatattatctttagtctgtcac

SEQ ID NO: 31329 - DNA, 201 bp, Bos taurus
caaagcaatttatcttataattctacaattaaacagacccttctcttttaaaccagttaactacttagactcagctaatcacagacgaactaaagaaaaakcattttaattaagcaggttgctaactgattcccacgtctatatcagcaggtcacctttctggttcataaagaaaaagtagccctttcacttcactaatac

SEQ ID NO: 31330 - DNA, 201 bp, Bos taurus
taggcatttaaaattccaatacttttaatgatcatcaaaagaagccttgagggttcctgtgaagtcacatttttctgtgataaaaataaaaccaataaaarataaaaccaacttatgtttccaatacggttctatataaatattaaatgaaacaaaagtaggcagcaaacagtgggactcaaacccacatctgattttttt

SEQ ID NO: 31331 - DNA, 201 bp, Bos taurus
gtgtgtcagtggccctcaggcacaccgccagctttcagcgtttcagactccacaagaaggatcaagcttcctttcaccatagtttaagacaatcgtgagcrtaggccagtcaccctgagttggccatcaggagagacagctggccactggggaccaaaggtcactactgaagctgatcttcctctgcctcttctttgtgta

SEQ ID NO: 31332 - DNA, 201 bp, Bos taurus
actctaaaagtggctattttcagagttagcgaagggagaggccaatgccatggcattaagggagggagttgaggggtgcaaaagaccttagtgtgcttacygaccccctctccaaggccaaacatactgtcttggcccaaggctggctctggtttgaactactttgcagcttgaagctccacgaagtgagaaatgggcctg

SEQ ID NO: 31333 - DNA, 201 bp, Bos taurus
ccagtgggttcctgtgtagatttcccgccccccccccccccacccccgtccctccaatggctaatgggcttgagggaaaagcgcaggccttccgagttccktccaacacctgccctacttagcatcctgcacattgccttctgggaaatgtagtttcttagttgcccgagcccttcaacatctggccaccattggaactac

SEQ ID NO: 31334 - DNA, 201 bp, Bos taurus
cactttaccaacaaaacttagtctttcaaagggaataaatgtgagattagttaaaaggcatatttataccttattgagatggatggatttggcaaaaacaygtgaaagtaggttttaaaaactgctttttagcttcacacttaccagaataatttgctatttttaaggattcattttcctcctaagattagggctggggag

SEQ ID NO: 31335 - DNA, 201 bp, Bos taurus
ctgttgagcagcagcatcttgccagtccactgtgcgatagatcatcaaagtagggagtaaatgcctttagctccaggatgcttttaccacttatttgattycctgggtcttattcactaaactgtagtatttctaagttattgctagatcatgcatcaacaaacattttctaaaaaggggcaaaaaagtatatattttgac

SEQ ID NO: 31336 - DNA, 201 bp, Bos taurus
agtagggctgactagcaaccttccaaaaggacttatgccgacacgcacctccgtggactgctgccaccagtgaccctatccctggcggaggctacttccamctgaggccacttctgagccacgcctctgcaggagaccctcagacactcacaggcaggtctgacacagtctcttgtggggtcaccacttctttctggcgtg

SEQ ID NO: 31337 - DNA, 201 bp, Bos taurus
aggagcctggtggcctacagtccatttggtcacaaagagtcggacacgactgaagcgacttagcatacagcatgcacaatgcttagcataaaatccaaaayttctctattgctctatgaggccctaacataatctagttccttgcctgcctcgggacctttgatcttgctgttctttctacctgtcatggtttgcttgcac

SEQ ID NO: 31338 - DNA, 201 bp, Bos taurus
ctaaatgaagttccctgaatgcattatattgtatactattcctcagtcttccatatataatttcttctttaaaaaaatgtttctttctcctctctcttctrtcctttatatttgtcattcaaaactcagttcaagtatcaccttatgctccagcccttgcagttaaggcaacatgtttgtgaatgaaaaagtcaacttgga

SEQ ID NO: 31339 - DNA, 201 bp, Bos taurus
ttccaaaagaggaaagaatagcttaaggcttaaggcttataacatctggaaatcagaattctagcacagggattaagacacatatgttaaaatggcctcaycctaagaggctcaaaaccacaggttatttgtccatactatataaaacacagcacaatctgccagtctcaatagtctctgctcagtaacaaggcccagaat

SEQ ID NO: 31340 - DNA, 201 bp, Bos taurus
ttaaaaaatcttaatcagaacaataattccatttgaatttttctttcaaaataaatccagccaagttctaatatatagcaaattatttgcatattaataarccatatttagaaaacctaatcaaggagttcatctttatatgcaaattttcctacgtaattacttaaaatttccataaaactttcaggttaattgacaatt

SEQ ID NO: 31341 - DNA, 201 bp, Bos taurus
tccaggatgcttcagtcacgtctggatccttcactatttatcaatgtctttcttaaaatgtgccactaaaaaatactccataagttaagaaatcactagtytaatggtcttgacacttctttttttaagatagaatgatgttctatgagatgttttcatgaaaaacaacctgtctccaaaccacactttttttgatgaaaa

SEQ ID NO: 31342 - DNA, 201 bp, Bos taurus
atggtgaggaagctactttctcacatatactttaacttttaggatttcgtccttttctggccagggagcctgtgaaaggaaattcaagggttgtaggttcygaatatatgatgtctatgtgggcccaacaggagtagtaaatttggtacttgaatctgagtattagcatagttcttgattcatcattggcttcaatgtttc

SEQ ID NO: 31343 - DNA, 201 bp, Bos taurus
cctgaaataataataaactgccgacatttctcccacaaaacagagtttatttgggatcagcagagaagtgcagtcaggctctgcaattatgatgagccacrtgcaagtctcccaagggcaagggaaggagcctctcttttagaggggaaaagaaagttgggagggctcagtaaacaaagagcccatggtttttcattggtg

SEQ ID NO: 31344 - DNA, 201 bp, Bos taurus
tttcctagcgggcgagttaagcttctgctgattaacacactcaggatcccgattaactttgtggcatgaagctaacataattacataattggccttaaaakgaaactcttactttcagagatgctccaaaggtaagtgttttacttttttctggagcctgagaccttcacaaagacaacctggcccacctgttgtgtgaaa

SEQ ID NO: 31345 - DNA, 201 bp, Bos taurus
gagggggattctttccttataatttgtatcatgaatgcgcctcaaggatctagtgcatccttccacatgcgcctatggatcctggctttgtagaggccttrccttcagtacaaacagatgaaccctgctattgaactaattgttatgccagctgcattgtcctgtggaccctcccacccctttcacacctatgacactttt

SEQ ID NO: 31346 - DNA, 201 bp, Bos taurus
actatcctctgcaattatcctctaactctcctgtgttcaaatcagtatgtcagatggaaatgaaattagaaagagacagaaagaaaaagagcaagaaaggyagagaatataaaggctaaaaagtaggagaagggaaaaaaagacgagggaaaatgaactgggcctgtctcagaaattttgcatttcctagatacctctgta

SEQ ID NO: 31347 - DNA, 201 bp, Bos taurus
aaatagtggcaatggtcatgaagaggaggtgaacctccccttcatcaaggggaggtgaaccaaaagataacggacatacttatggacataacagacaccarctgttgaaatgagatggttcctgggttttgacaaggtgtagatcatactgtttgcatcatatttttaaagataaaatacaagcattttgccttgtcacta

SEQ ID NO: 31348 - DNA, 201 bp, Bos taurus
aaagaaccctgggttttaccactaagagcaatccagagctttattacagcttggtgtcacgaatttaatacactgctatgtatttaaactttaacagaagkggggtgggtgacgactgcctcactttcaccagtttctctacggagaacaagactggacctctcagtcatgacctccagggacgaatgggatgggaatgaa

SEQ ID NO: 31349 - DNA, 201 bp, Bos taurus
ttttgccatctgtattcggaaaaatgtcatttcaaattccctgtccatttttcaattgggttgtctttgttgttgagttgtgagagttctttatatgttcyggataacagacccttatcagatgtatgatttacaaacattttatgggttgtcgtttcactatctttatagtgccctttaacacaaaaaagttttaaatct

SEQ ID NO: 31350 - DNA, 201 bp, Bos taurus
tcgaatgcaatgttctgaccttgtctgtatcatgatttaaacgagtcctctgtatgcaaaaggcatttctgaaacaatgaggggaaaactgaacatgcacygggtatgagatattaagaaattattattgattttgtcaggaggtgataatggtttagggctttagtccttttctatcagatatatgctgaagtagttaca

SEQ ID NO: 31351 - DNA, 201 bp, Bos taurus
tctcacccgcgtcatcccgctgctgcttcttggacctggggaggcatcgcgctcgcatcttttggcctcgcctggagctcactgtggtcctttcactctargagcgcacaggctgccgcgcttggactttggtggggctataaacccagagagaaattgcagtgtcatatggtaattatgtccatgggggccatggggccg

SEQ ID NO: 31352 - DNA, 201 bp, Bos taurus
accattgccagattgtgccaagcctgacatatccagcccattcagaattaggagtttttcagtcataggtggcaagaacccagattaatgctggcctgatktggggagtggggtggcatgaggtgaggaacttgtttgtgtaactggaaggattaggcatggctgctctcaagttattcatttctggcttcactcataggc

SEQ ID NO: 31353 - DNA, 201 bp, Bos taurus
gaactctggaaagaggccccgctgaggaggacacgcctctcctagctctgctctctccgaggattccgttttctgcctgcaatttggtaaggcccatggcrtctatctctagggtggaatccagggggatccttgaatacacaagtgcagtgtcctcgaaatcatcagactgagatccaatataggagaaaaatgttgcca

SEQ ID NO: 31354 - DNA, 201 bp, Bos taurus
cttggttccctgcagggcagtttcaattgtgtctgcttagagtatgtctcccgtggaaactgagaggacctgctggcctgtttgtatattccttagtgatyggacctcagaatctcaacaggcttcctgggttctgagagtctgccagatgggagcttctcagaagaccaccacttccagaggccaggccattttgatcag

SEQ ID NO: 31355 - DNA, 201 bp, Bos taurus
ctgaccacagattccaacccactttatgcataactctcctgggaagatggggaggggaagcgagggtgggtgatgccagggggcctaattcctctaagagkaagtcagtaagcaacacgcaaaacctatacatcaggaaatccggcatcagcatctaatttatggaggtcaagagaattcccttatgatctagtggttagg

SEQ ID NO: 31356 - DNA, 201 bp, Bos taurus
cttgttaaaatgcacactcctgtgctctaggccgagtgcttctgattcagtgtcactgcaacctgggatgctaagttaagtacctaggtggtttcaacacwgggtccccgaaatggccacactggaaaactgaaactgactcagccttgaaaactcatagccaggaacatgggtccaactcttcttgtgtttattcctggc

SEQ ID NO: 31357 - DNA, 201 bp, Bos taurus
ataggagtgaatttttaatattttggataatttcttattgaactaataagaaaaaaatttactctccctaatctaatctgctggggaactagaactctgtygactagtactggctataaaaatctaagtaacacttttttaaagtatgtatttggatagtataaagtataagtttccatctcctttgatcttcctttgaat

SEQ ID NO: 31358 - DNA, 201 bp, Bos taurus
ggcaaagtcattctgagaaagtgttttctggagacatggtatttaaacacaatttaaaaaaaaaccacaggatctatcagaaagggactgtttcagaacaygtatttttgtgccttagataaaaatacataccaaggactgaaattatttaaataatatatattagaaggtaaacttgataagcagatgaaaatagggaac

SEQ ID NO: 31359 - DNA, 201 bp, Bos taurus
agattttttttttttttttcatgtggatcatttttaaagtctttattaaacttgctacaatatcgtttctgttgtttctattctgggttttgggccctgargcacatgagatcttaactctccaaccagggatttaaccgccccctacttcccccaaatatgaaggcaaagtcttaaccactggactgccaagaaagttcc

SEQ ID NO: 31360 - DNA, 201 bp, Bos taurus
taaaatctgcagtttgagggtcaggcttctaatttaacacaaatctgggggctgactacatctctcctgagattggaaagcaccaccttcatgccaccccycaacaagtcaccagtatttccctaaaaaatcttgtgtaagtatctggtgccatggcctctgcagctgttacccagggtacaatagcccttgactgcctgg

SEQ ID NO: 31361 - DNA, 201 bp, Bos taurus
aagctggaggccacggtggtaagtaagcccaatggttttagttgccctgggatgtaggctgtttttcccaaccaaggagtttggattttaatagtcatttrggaaaggaaggccaaggcttgaactaactccagataaaaagctggaacttaaatgcctgtattaggggaaaagagcagaggggagcagaaaaaaactgat

SEQ ID NO: 31362 - DNA, 201 bp, Bos taurus
attggttcatggcacttgtggaaaagaggctttgagttcaaggctctgttgggactgagaggccatgggaaggaggtggttgcccgtgggcctgatggctrttggaaaaagcaagatcaagaacaatagtataagagacatcagaacatctcaagaacccctcaactatagggataatttgagggctgaggttgcagctgc

SEQ ID NO: 31363 - DNA, 201 bp, Bos taurus
ataacaatggctggattttttttagtaggctttgaagatgcaaggcaatcaaaattctcattgctggtaggaatgcaagatggtacctttgaaaaagagaytggcaatttcttaagcatacactcatcatatacctcagtaatccttctctgaaagtgtttacctaagagaagtaaaaacattatgtcctgtaaacaaatg

SEQ ID NO: 31364 - DNA, 201 bp, Bos taurus
tgagacgttcatgccttcctcacctccatttcaacacgtagttattaatctttttctctgacgacaaaccagaaagtaagatggagctgtctatcactgakcttagagcctagcagcggggacaaacaattaaacaagcaattataataaactgtgtgtggtggtgcaaagacaggcaagcgcacgtggaagatcctcaca

SEQ ID NO: 31365 - DNA, 201 bp, Bos taurus
gtagacatgagcacttgagtacctcgggaaaacaattctagacacaattaaaaataattcagctaaaattgttaataaattcctaaaggctgagtgtgtgycagcaagaaaacacagaacccatgaaggccacaacccgttcacgggttcttcagagcctctccaggtttgcatcaaagaaaataaaaggccaggtgcaga

SEQ ID NO: 31366 - DNA, 201 bp, Bos taurus
ccaccctcgaccggctccttcctctcccctttcccctccccaccccgggtcactgccgggcgcctcccatttaggggagtgtcggaccccggaaacctccrggccggaaacctcgcggcccaagggcctctccttaaaccgaattttctttgacaggcaactgagtgaaataagtgtttatctatttaggtgtgaagaaaa

SEQ ID NO: 31367 - DNA, 201 bp, Bos taurus
gttcctataaataaagtgcatgatcttttggtttgatattttgatagtctggtgaattaaaagagtaaggaactaagagtctttgtcctctgtcatcatcyatttctgtggccctggggcagaggggggttctcctatagtgtaagtgttagctgttcagttgtgtctgactctttgtgaccccgtgattgtagtccacca

SEQ ID NO: 31368 - DNA, 201 bp, Bos taurus
atcacaattgtccttagttgtgaatgcacctaaaaacttgtttataaagctgcacaaacggtaagtcttttaaaagatcccaccaaaacattcaccaaatracacagaacacttacagtattactcatcattattcttccaagctctcactggttaactatacagatagagcacatcgctacacataacttgactccgaat

SEQ ID NO: 31369 - DNA, 201 bp, Bos taurus
catttcctactccagggtatcttcccaacacagggatcagtcctgtgtctcttgtgtctcctgcacccagttacatatgacttattaataagaattcactratttcatttgatcaacagtatattgtaggcaactgcagtgtttttttttgaattgtggaatgacatatgacataatattagtttcaagtgtactacataa

SEQ ID NO: 31370 - DNA, 201 bp, Bos taurus
atagccaggcgctggctcagtgcagctgcgacctgtgacgtgggggcgacagtcacactgcccgttcttgggtgagcacctgtggggaaacaaacccaccycgtgaaataaaagtggaggtggggggcaagtgtaagataagggcttaggggtgctggggtaagtgccctctggatttgagtccattctttgagtccatca

SEQ ID NO: 31371 - DNA, 201 bp, Bos taurus
tttagagatggaacaaactgacacttggattaaatgccgtatctaaagaaatcaaaggtaagggctaagttgacagcaaaactaagtctcttgattccagrtgagttcacattcaacctagatttcaatcatgttttaatggagtaggcagaagagggaccctgagaaagccttactacaatcgatcatggtttcacataa

SEQ ID NO: 31372 - DNA, 201 bp, Bos taurus
caacactaatcaaagaaaatgaactgtaatcgtttcgaggaagctgaattgcatcaacatttgagtatccattattcctttcatcatttcagcattgtacrctatcattatctattctttcagggttctgaaaaggctttagaatctgctgattgtcagtcactagctaccggatgccacaaagctctgcaattctactgg

SEQ ID NO: 31373 - DNA, 201 bp, Bos taurus
aggcctagtaacactgttcttaacaacttgatacactgaaataaaaacaaattgactctctaaaggtgtgtgtgcttaatcactcagtcatgtctgactgygtgcgaccctttgggccaaagcctgccaggttcctctgtccacaggatttttcaggcaagagtactggagtggattaccattttcctcctccatgggatt

SEQ ID NO: 31374 - DNA, 201 bp, Bos taurus
cttgctttaccagggaacttcaggaacgcaaacatgaactattttgactgataaggttccaaaataaaatctaagggtaccttggccattgcatgagtcartattccagataaacacatttagcattttaggctctgaactttatttttggtggtgattttgctaaaatgtgtcacacttcatggccttcagggtcatcac

SEQ ID NO: 31375 - DNA, 201 bp, Bos taurus
gagcatagttatcttagtctgatccttgaaaattgtctaaaaatataaatcaggtattaaaagtgatgtacgagaataaaatacatgaagggatagtaagrtgtttgttattttagataaataatttaagaaagacagctatccacccatgtccacattatgatcgataacttcccacttataatgaaaaggttctttgtt

SEQ ID NO: 31376 - DNA, 201 bp, Bos taurus
gaaatggagcaatcccttcacacccaaccagttcctcagggagagatgagcaagcacattgattcctaatattattgataagctatgatttctctagatakaagaatgttttattaatagattatgcatagaaataaaggtaaattatggcatagtgcagctcatttcattagtctagctcagttatagaccaaagcatga

SEQ ID NO: 31377 - DNA, 201 bp, Bos taurus
tgactaaggtcttgctgagttaagtgtttttagtgtctgttatcctcacattctctctcagagtagaacatacattgtcttgctgtggccggaagtaatayagagaagaaggctgggaccctgggttgagagacttgatttgactgccaccactaggtgcccagaggccctttccttttctcccaggagactgtgggactt

SEQ ID NO: 31378 - DNA, 201 bp, Bos taurus
taaaacacacagagtactaactattcagtgctccgcctgcctaatcagaatggatcacttgttcccctctagtctcatagcatttttgtttccaatcactwtcaacatgttctaattctatatggaccttttttaactagtctgagattctttaaagtggagctatttcacctttatcttctcctttttgctcttcaatta

SEQ ID NO: 31379 - DNA, 201 bp, Bos taurus
ataaatcaaatttaaaaattgtgatcaattaattttcttattaaaggagaccttgaaaaatatttctttgtaaccaccctacactgccattttaatatatytctcagcagtttacctaaaaataaaatcaaatatctggatcattggttttcaaagttatttattttgaccaattattttcataattatttcagaatcacc

SEQ ID NO: 31380 - DNA, 201 bp, Bos taurus
aatctacagaatttgtaaagtgttcataaacagtagctttcttttagtctgtgtcttccctttccattactatgtagtaaggacttatttagtttttttarttatatatcattatgtagaaattattaagttgagaatattttagagaatgcagagtatagataaaatgtgaaaatttttaatcatttattaaaaacagga

SEQ ID NO: 31381 - DNA, 201 bp, Bos taurus
cctggggggccaggacaggggccacacgctgcacactaagtcttccctattttctctgacttctggcattctgggacatgtctcttcctggtcacaacagsttgttagaggagcggaggggccaggtcactgtttccacccccctcaacatttcctctttctagagcagatgactagagagaaaaagtgtctcaaatgagc

SEQ ID NO: 31382 - DNA, 201 bp, Bos taurus
taacgtaaaatataatttgttagatataagacctataggccatggggttgctgaaaaatcgcacttggtgggaaccgcaagagagtgacagttactgactrgtcaccatggccaaaaaaccaattcttaacaggctctctcactgggtttttctcagataactggagagaaaacagaacccttgaattacgacatctaacc

SEQ ID NO: 31383 - DNA, 201 bp, Bos taurus
ttgacctcaataattcttttttcatggaaaggcattttattttaaatatagcagtgtgaacatgtcaataattctttaaatgtactaaaaatgcttacttrataaagaatattttataaagtaaaaaaaaatcatgtaacataaacaatcacttcctaacatccattttataagcaaatatatttattttggggagagagt

SEQ ID NO: 31384 - DNA, 201 bp, Bos taurus
tgtacttcctaaatcaccttcactgaagatactttgtttataacaagaaaagttatttattattaaaagaataagaacagataagaataattactttcccyggaaatgtaactatattacatccaatgtcaggtggaaggttacaaaggttacctccaaaagtctttctggtgatttacatgggaaaaaaaatcaactgaa

SEQ ID NO: 31385 - DNA, 201 bp, Bos taurus
atattacagaacttcttaagtcctacagacagaagtgatgaagtcaccttcccatccactgctcctctaactgtaactggatccttgggaggaaaattaargtaatacaatagatgaagtgtatacaaactcttggacttccctagtggctcagacagtaaagtgtctgtttacaatgtgatagacctgggttggaaagat

SEQ ID NO: 31386 - DNA, 201 bp, Bos taurus
agttattttacttataactgagaaagttcactaagagaatgcctgtaatgggttgatattttaatatttcatctcttgccaactgttttaaaagtaatgartaatttgtgtctttcaatcccctggggacaagtgaggactcttaaccatactaccttatccttgagttattcttccaaaagaatcctagtcaacacgctt

SEQ ID NO: 31387 - DNA, 201 bp, Bos taurus
tgatttcttgttatcatatgagcatttttcaaaactataatccttgacatatctatcactaccacattggatccctttctgttgtataatcaaaggaatayagatattcttggacacagaataaaagttctcatccacatttgtcccttacagttcatggggacaaagcagaagccaaatttgcaacattagcttcctggg

SEQ ID NO: 31388 - DNA, 201 bp, Bos taurus
gctgataacagtggctgagtcttgataaactgtttacaaaaacaggcagcaggccatagttttccagtccctggactaggaggatttgaagaccaaatgtygcctatgctatctaagtagactcttttgttataatagtttccaaatagagatcccaagggcctgatattagtcagcactaatgaagagttaacatccttt

SEQ ID NO: 31389 - DNA, 201 bp, Bos taurus
agtgggagagccatttgtacaagagagagtatgtgacacagtcaggagaaaaacaagtagttgaacctagagaagtagggaaaacaagaagggcaaatgarggagataaaagtacttgatcaacattccaagagagcaaaacgaggcatttccaagagccctgaaatgtaagagaagactctctttctgagacagcaggag

SEQ ID NO: 31390 - DNA, 201 bp, Bos taurus
tcatttaggttacctgtttacaaatctttatacaggatatagacaaaacataagtggggaagaagaaaagaagaagaaaattcaatatactgatttaacaytggaaagggaaaaggaaggacagagaaggcaagaaaagaagtacattgcagacagaagttgtaaaccatcagcaactgcctcctttgctgcgtccagatt

SEQ ID NO: 31391 - DNA, 201 bp, Bos taurus
aagaaaaatgtattttttaaactctgcctaatatattctatgatttttttagtaaaggggtttaagagctttgtgtaattaacaaatcatttcaaattaaygaacatccacatcaatataaattaggagaaatgaatgtccttatttattttgttccagactgcagactgaagtctgaagaatacataaataagtaagcaa

SEQ ID NO: 31392 - DNA, 201 bp, Bos taurus
taaatacttttgcttgatacccaaactgcttgtggaatagcaaagaaagctgtttaaataccttgtgacctgtgagaaaatgtcaagccaattcttatagmggcatcttgctgattggggcattgcttaggataattaaatgtgaaatagaatagcatgagtaagtgttttctctctgcttttaagttcgagtaaatgaat

SEQ ID NO: 31393 - DNA, 201 bp, Bos taurus
aaagtaaagccaggggcctttagtttcttccttcagtgctatagatagtatcctgagccatatccttgtactggttttatagaaaccagcccccaccccartcagatgaaccaccaacatgtaggccccagaccagttgcaattaagaaggttgatgattgggattcctgaaatagcatgctgttacttcaccaccgacaa

SEQ ID NO: 31394 - DNA, 201 bp, Bos taurus
ttatttgttgacctttttggatgaaaatttctaaaatccagaggaacaaagccagataatgatgacaaaggaataatttatcttttcctaggagacttcaygtaatggtggcaatattatcctcttattacacattgaaatttgtgcttacttctcagttttatattaatcacttctaacttttatttgtatgtagagcat

SEQ ID NO: 31395 - DNA, 201 bp, Bos taurus
ctttttattattttttcctaaattttgaagcatataaatgcatttagtcaataatttaagacatgtggtatgtttatattaaaagtttattggcccagctstctctattttcattctcttcattcacccatagtactgtcggcagtcttggttttcaaatccctttggccagtgacagtccttactttcctgtttgaagac

SEQ ID NO: 31396 - DNA, 201 bp, Bos taurus
taaatagaattaaaatgcattattcttgctgaaattgcaaatttaaagataaataatatacaatgttctgtctatcaaattcagaaaggtgaaaataaatrttaagatggcattctgttactacttggaggctttaaattgtatgtactcagcagcatgacattatatgccagaaaccttaaggttgctaacatttttgat

SEQ ID NO: 31397 - DNA, 201 bp, Bos taurus
gtgaagagtttggccttgctcaaagagaggtttggcctttccttcagcttctgacaggaaagtctttgtttgggtgagccctggctgtttctgaccatttyagctgggggatggccatgtcagaaatatcaaccatgtgatttgtgtgaacattgggccatgcagttattagttgtcctggggactgaattcatccatttg

SEQ ID NO: 31398 - DNA, 201 bp, Bos taurus
agtgattaaaaataacacaggtataacataggtatgatcagataagagaatgggctaaactcagtggtgattcaaacaagaagtaaatttagtattctccrgtaaatccctatgatcatgctgttaaattccctttctgcactaatgacttacaccttgaacagacatcatagacttctcttacctataaaggaccagtct

SEQ ID NO: 31399 - DNA, 201 bp, Bos taurus
gcatctgtagattttttttcctgtctttgtccaacataaataattttctcttactgatagtctgagagtactacaatataagttttaagtaatcctagttytacttcctatatccatgattctgtggcataacaattgtattttattaaaaaaatcagctttctgggaaactgaaaacacttatgaatgataatacacttt

SEQ ID NO: 31400 - DNA, 201 bp, Bos taurus
ctaatttaaatctctaatatataggatggataaagaccttttcaaaagcctataatttcttagaaaataatataggaagctatgttgtgaacttggagtgrtaagtctcatagacacaaaaggcaaaaagaaaaatagtcacacatatgactatacctcccaataaaaataccatacaagtagcagatgagacagaatatt

SEQ ID NO: 31401 - DNA, 201 bp, Bos taurus
taagcatactattaaaaagtagagtaggacagagtggaagatcaagttcaaagtttagaaagttttacttagaatgttttataatggaatacattattaartgataaaaccacatgctatactgactcatgattttctaaaaatctattacatttgtctaaaaattaggaaaatgtcatttgcaaggtgactctcagctca

SEQ ID NO: 31402 - DNA, 201 bp, Bos taurus
tttcaattatctgcacatctcccccaaactcttggatttctcaatctttaggagacaactactatttatttgtatgaattttccccttcaaaataggaacktggattagtttccctgagcaaactgtttattacttattcttttattttcttctaattggttcctatatccatttgatagatgtctaccaccttccatttt

SEQ ID NO: 31403 - DNA, 201 bp, Bos taurus
caaacttcagtggttggaaatatctttttaatttaaatttcataagaaacagagctacaatgcacattccctgaccagattgtgtgtggcctatttattcraaatgtttgattccatatggatttctgctctttatttataacttcaagaaaggattctaataagttagcaactcaaggacaactgacttgaaatccaggc

SEQ ID NO: 31404 - DNA, 201 bp, Bos taurus
tttgcacctacagtggaaaaaatgacattccaatagcatgaatgtgtatgtttgaaataatataaactaaaatccacatgtaacattcaattgcgggcatrtagcacccgcgtaccgatggagggaattactgtcagggtgtgtttcttattcctctaaagatccagggagtcgactcaactggcctggaggagaggggtc

SEQ ID NO: 31405 - DNA, 201 bp, Bos taurus
aggaaatggattgattctatcagtgtgagttcaccttccaggtctactccaaatgttttcttctcttttcattcatttaagtctaacacaagggagaagaragtaagttcaaattatttctgcctgaacacagcatcaatcttaactcttcatgtagtttttatgagaggcaaacactgatataaaataggaaaaagtgaa

SEQ ID NO: 31406 - DNA, 201 bp, Bos taurus
cagtgcttttaggtggaaagttttgagatcaatattatttcaatggacccacaggtctgtgctcaggtacgtgtttagtactattctctttctgttcacayaatgaaaaggtttgtgggtccaagaaaatagaaaaattaatatagcgatgtagtggttaattacagtatagaaagttaatattgcaaagcctgaataagt

SEQ ID NO: 31407 - DNA, 201 bp, Bos taurus
agccactaggctggacgttcctgcaactctgctcaatcctctttataagtctcattagagactaaagatctgtccaaaatggtacagggggttacacccaytgttctgccacccttcctcaaaaacacacatggtgaaggttctgatgatgatcagtgtggcctccaaaactgggcctacattattggctattaaaattgt

SEQ ID NO: 31408 - DNA, 201 bp, Bos taurus
aaggatttttacatatatgttcatgagaaatatttctctgcattttttgctttccctgcaatgtcttagtctggttttcatattaggtagtggtggcccartagaataatttgggaagtattccttatgctcttatcttgtgaataaattatagagaattggtataatttctttcttaaatttctgatggaattcactaat

SEQ ID NO: 31409 - DNA, 201 bp, Bos taurus
tcctaacagcattcactattataatcatgtaacaacaaataagggactatagggctatgcaaaacagaatcatttgttatatcaaagtaaaaattttctcrtgaaacatcaaaatcattttcaactgccaggtttagagagttatttagacacaggctcttactaaagattctgcaatcaactctgaatacttgccatgta

SEQ ID NO: 31410 - DNA, 201 bp, Bos taurus
tagtggtcaagggcttttaaaatcagtttaagttaacctctgctttcagaaaatttgtaatgaaaaataatttacagatggctggattgtctcctaaaagrgataaaaattgagacaaaatacatttggcattcagagatattaacttcgattatctttcaccctcatcactgaagagacatttggtttgactgatacaga

SEQ ID NO: 31411 - DNA, 201 bp, Bos taurus
atataattgagtcattatttgtagtacttatatcaacattaaaattccccaacaacctatgaaaggtatgaacaatttttagagctacactttttttttcrccttaagagttatcttttttaaaaatgtgctttggaatttactattgtgtagttttgtcttttatattctccattacctcatgtaaaatgcagaagaatg

SEQ ID NO: 31412 - DNA, 201 bp, Bos taurus
caagacagaagccttgatcagatttcttcctcccaacgctcagaaaaaacagatcctgctgacaactggatttcagaagtctagcctcccaaacttgagaygataagtactgttgtttaagtcactcagtttgcagtactctgttacagcagccctagcaaactaatacagtctcttaggccaaaaggtgataatgaaatc

SEQ ID NO: 31413 - DNA, 201 bp, Bos taurus
agttattggaagttcccatacagagctggcatcatatataatatattgaaaagtcaatctatcccctaagaaatacgtgataaagatttggaagcgagtaycctgtagtgaaaagatggtgggagttaaccatcagggagctgaatcttgactgagatatttctgcaagtccataagcaactacataaaatctgagactat

SEQ ID NO: 31414 - DNA, 201 bp, Bos taurus
cagagaaaattactccatatgtagttgtagattcactgtgtatgtgggaagaggagagttcaacatcttcctatgctaccatcttgaacccctttctcttrtggtgtgattttaaccagacagtatagaacttagcaggaaatcatacagagggttttctgttataagaatattcttctaatattttatgatcctttatgt

SEQ ID NO: 31415 - DNA, 201 bp, Bos taurus
ggagctgaggtctgtccagcagtcagctgtattccaggttggaaagaaacgaagacaaaaaaccatttgcacctcagaggcaccgtactcaccctcataaytgacacctccggctccaccacggttgccatcactgtcctccccttgggtagcagccccctgggtcttgggagcagccattactcggctgaggaaaaaaaa

SEQ ID NO: 31416 - DNA, 201 bp, Bos taurus
ggtgctaaaatgtcaaactgttcccaagtgtgggccacgactgaggaggctagatagagaaaacacccttcagataaaggatctgctgagcttgtttattmctcagccactggcttcatcgcttggatgcttgaatgagcatttattaagtaatctttggttgatagtgagctacttatatttggggagggagcaaagtaa

SEQ ID NO: 31417 - DNA, 201 bp, Bos taurus
gccctgtcttcctctgactttttttctcctctgcttttctgcaatggtttccacttcttgtcttgaagtggatattcctgtctcctgtactggggccttgrtggactgacattaactccttgtctgttgtctatggatgtttctatattggaatggttggaaacaggcagctaataagagtgactagctctggccccaacc

SEQ ID NO: 31418 - DNA, 201 bp, Bos taurus
ctctccatggaaggatctaggtgtgaaagggttaagaccgatctctgtgacctttatagaaaggatgcataaaatgtatttttagggattgtgcttacttygctttcttccaaattgagaatttgcccacttaacttcgttatacagtttttaaaatactctgtaacatgtgttcactaacatttggagggaacacggttg

SEQ ID NO: 31419 - DNA, 201 bp, Bos taurus
acccacaataaaagtcttggccaagaattcacacttattttgcagaattattctagagacaaatttgagtgttatagaattattttttaaaagtatcccarctagtcctagtttcagttcaatctcctgcagcacaggttgtagctatgagtaactgtcctaggcagtacctatgtgacaatacctatttcatgcaaagcg

SEQ ID NO: 31420 - DNA, 201 bp, Bos taurus
tattactgtgagatttagtgttcttaacacaataactggtacagaataggttcctcagtaaagagcagttccttttcattcctttaggtcctggccatgakaacaaagactccccctcttatatctaggcttatggctccagctgaagggaattacctttggaagctgggccttagtgggatggagaaaggggtatagaga

SEQ ID NO: 31421 - DNA, 201 bp, Bos taurus
ttgcatttgtgtttatttcttatatttaatctttgaattatctggaatttatctttttatgatgagtaaaatgaatatccgccttttttttctccctccamaccctgattatttaacatcattggttaatttaagctcctctctatcagtgtgaaagtctttatcatatacccaatttctttgtgtctttgtatttatttc

SEQ ID NO: 31422 - DNA, 201 bp, Bos taurus
ctcatgacctgtaatatgaaaaatgctgttttactgcaagagggaggattgaaaaggtgaagctgctcaaactgagctattagctaagggcatggaacackttagcccttgattctgaaattttaaaggtgggcttgtcataagaacttcaagcagtaaatgtaacacacaaaggataaggaggcccatgatctgagaaag

SEQ ID NO: 31423 - DNA, 201 bp, Bos taurus
tacatataaaaatgcttagtgattggtatcatattatttaacaacaaataatcatcaagcagtaactgttgctttcttttggtgaacaaccaggcttatayttgtttagtatgatgcaatactaataaaagacactgtttaaagtatctttttagtttcatgagcaaaaatgctttctggacacatgtccttacattagaa

SEQ ID NO: 31424 - DNA, 201 bp, Bos taurus
aaacatgcagattgtgttaaaacataagagaaagtgatagcttacagtgaaccatgtcagatttgtcatctccaaagacttagcttcgggaccagagaccrggcttgatcacttaaaggtttctgtgtagcagcattttattaaagtataaaaagggacaagagggctggagggctgcagtctgtggggtcccaaacagtg

SEQ ID NO: 31425 - DNA, 201 bp, Bos taurus
gccgtaccagtgtcctacaatgaatattttggttgaggtttagtcctgttgaaggctgctgttgtttcatgtctgatctaaggcttcttggcgataacttktgtaatgaaatgttttcattaagagtgtgttcacagatctccctttctctgcttccttcagagatctgtctatagctgctatctgttactaccagatttc

SEQ ID NO: 31426 - DNA, 201 bp, Bos taurus
tagacatgacttagccactaaacagcaaaacaaactagttggaaattttcactctttgccttcagctccttcccctgatgcttccctatgccacacaagcrtcccagtcagaattcccactcaaggaaaagacttaggaaaaagtccttttcaaacaacagtgaatgaaacctatattagcaactccactttctgacccaa

SEQ ID NO: 31427 - DNA, 201 bp, Bos taurus
gtcagctgtgtctaggcaggtaatttacctggttctcatgctgcagttatgaggaacctcttggaatgagcttgtatagcagatgccctgaagcctcccayattctggcagtgagattaggagtcactttccttggcattgcccttcacaatctcatttttgattagactatacctgctctccatggtatttgctctgacc

SEQ ID NO: 31428 - DNA, 201 bp, Bos taurus
aagaaaaatgtaggtgacatatcctcccttttttgctacagtagacataccaaatattttctctactatcatcagcgagtgtaaaaaagtatttagcccaygtaaaaagtaaattcttaagcagcagtttcagagagggcttaaacacagaagacttttcctgtgtgtgtgtgtgtgtgggcgtgggtgtgtgtgcgtggg

SEQ ID NO: 31429 - DNA, 201 bp, Bos taurus
ttttaattctcatagaaacacatatgtatgtaactggatatgtatttctttaatccagaactttggttttctgtaactccatattttcaatctgagatgcrtcataaactttatattatcacaaatctaactcatttgtaatctatacacagcatttgtcagtttaaatgcattgtaatttctaagccatttatttattgt

SEQ ID NO: 31430 - DNA, 201 bp, Bos taurus
tggtggcttattagttctgtgttccttaccaggacctcctgtggtaaaacaactcatgcaaatgattactatggtgcctggccagggtgggcagtttgtcrgtgtgcttcccctaacagtcccatggaaatcttattttgctgataccagtgtagagaaaggagttgttgttcccagtttctgcagggtgcgaataggcca

SEQ ID NO: 31431 - DNA, 201 bp, Bos taurus
ttctatcaaacatcaacaaaaatcaaccataggtttacccatgcccctgccctcttgaacatcactccccatcccaccaacaacactaggttattcccgarccctagtttgagttctctgagtcatacagcaaattcccaatggctatctattttacatatgataatatatgtttccatgttactctgtccatacatccca

SEQ ID NO: 31432 - DNA, 201 bp, Bos taurus
tctcaccatctggcaggaaagacagagtttaccatggccgagagtggctgcatctaccatggcagcagggctggcagtagctattgaaaccttcttgtccygaatcctctcctaccaatggccctctaggttgtctcagtgctgtctgcccaatggtctaagcatggtttaaaacaatgtcaacaacagtaaagactttta

SEQ ID NO: 31433 - DNA, 201 bp, Bos taurus
ccactgtctttgatattctgcatagctcataccacatttatatcacactcatactacatgccaaatgtaaggctctattccacacagtcattcagggatcytggctggggaagtttctattatattgaaagtatttcatttacagtcttgctgcgcaatgtatgatctgcaaaccagcatcactggtatcattaggaattt

SEQ ID NO: 31434 - DNA, 201 bp, Bos taurus
atatatgaaactacagccgaccatggaaaacatcactcacccttagacggacactgctataagcactctgaggcctgagattaggaagagaggggaggccyaagcccctcgccatcccagttcagcaggaagtagccagaatgacctcgacacccctattcccaaagaattgggcctcatatctcttgagaagggaatgtc

SEQ ID NO: 31435 - DNA, 201 bp, Bos taurus
cacttatcagactgacaaaaattgatacttgcaataatacccagatttgaaaagacatagagaaattaacagaatcaaatattgttgagagtgatgtaaaytttacataaaaaaaatttgaaaatgcacatatctatttcaaatcctaaaatatgatgctattaaagtgctatactcaatatgccagcaaatttgaaaaac

SEQ ID NO: 31436 - DNA, 201 bp, Bos taurus
ctgaagtaaaaatgggttttgtttttaatttagaaaatataaattcagtacaattaaaggttttttccatcaatttcattgtacttttaatctctaagatyaatctctaaattttgtgttagagtcagataaaacaaactactaactctgtccattcctcttttcttagatatgtggtaacacactgtacatactattttc

SEQ ID NO: 31437 - DNA, 201 bp, Bos taurus
cacaacgtgcatctttataagtggccttttaaagactgcacttaacctgatagagaatgttgggaaaaaacaccctttgtaaatgcatatttgtggtaatrtaatgtcttctgaagggcaagaggccatctctttggggtttcccagatggcacagtggtaaagaatccacctgccaatgcaggagacacaggaaatctgg

SEQ ID NO: 31438 - DNA, 201 bp, Bos taurus
attacttgtcagttctatgggtgtgtgtgtctgtgtgaagagcagcggtgtggtaaaaatgacttttggagaaatacattatagcccccaaagaagaataygtatttttcaagcaccatttgacattgggtatttcctacccttatgtgagtgtgcatgttaagtcacttcaatcgtatccaactctttgcgaccctatgg

SEQ ID NO: 31439 - DNA, 201 bp, Bos taurus
gttcctattatcagagaatcttgaaaatacagtttgcaatgctcaactctggagtcaaagagcaaagtatataaagttgcctttcagtatataatcagtcygccataaaattttttatttttttcagataattctgtttcccagtcatatagataaagaggctatatttaaaaactctgtatctctgatcatttataataa

SEQ ID NO: 31440 - DNA, 201 bp, Bos taurus
atttctaggctagctatgctattgtacaattttttactgtgaaattttcacataaagtatttctggatgaataattcttatatgtcaaattagcattatcrctcattttctggaaaagtaaggtataagggagtcaattgataaataataaataagaaagggaactttggatcactttggtttgttttgtaatccttacaa

SEQ ID NO: 31441 - DNA, 201 bp, Bos taurus
gccatattttcctgaagagtaggcatgtatgcatttattcaataaattatgcattgaagataccatatatgctggaaatacagtggttcaaagcccatacmtggactttatgttgggagtggtagacaatgtttaattcaatgaataaatcaataggtaagtgtaattaacatttactgagaaattaatatgtctcagtaa

SEQ ID NO: 31442 - DNA, 201 bp, Bos taurus
tagggaggcctggtatgctgcagttcatgggatggcaaagagttggacacaactgagtgactgaactgaactaaagcaaatagatgaatgaatcaaaataycaagtccaaggataggcccaaggatatgaggaaaccacatataaccaaaggagtgatggataatgaatgtttcacaaccagctctctggagcagagatgg

SEQ ID NO: 31443 - DNA, 201 bp, Bos taurus
aatacagctgttaaaatttgtaattttggcttctcttcatctttccttctattcatgaacaatttggactcaaaatcatgagacagggaagagaaaggtargcattttaatatctgtatattgaaaactaaaattttgttccagtatcttcaaatctagtctaataccacagagtctattttactttatccctttccagtt

SEQ ID NO: 31444 - DNA, 201 bp, Bos taurus
cacattccacatatttcttgagactacagcataatgttctgaatcagttttgttttagcttgagtgaccacataatttgtcatccaaaccagcgtattttkggggttaggaggtattcataatcatgacaaggcaactgatatagctggctgttttagattaggctcctcagaaacagttcctaatttatattaaagtgat

SEQ ID NO: 31445 - DNA, 201 bp, Bos taurus
cacaatctgactaaagctttccatcacttcaattcttggcatttcttactgtttctcaattgtttcttaaatctcttaattatttccatactttggtttcygacttttcccttccaaaccaatgtcttcttcatgatttacttatcccataatactcttaataccaaggtttgatatatgtaccaaactctacataccaaa

SEQ ID NO: 31446 - DNA, 201 bp, Bos taurus
cagaaacatgtacacaatgctcatgataaagtgaaatggcatgctttaactgagattattatacaactccatcagctgaaaataaaggatattaaatgacraacaggattgcttttcttacaaaactgcccagtcatcttggtaacaggtacattacctgttattattgttgcttagcatccatgcttataattctcttat

SEQ ID NO: 31447 - DNA, 201 bp, Bos taurus
tactgaagatatgaaaagagtcatttttcagaatactattacagatttgcttcttagcttgagccaagttataaagggaccaggtaagcaatgggagaagraagggtatataagcaggaagggagaggaaaactctcggaagatgttctgcagctttctaagatagacaaagaatttagggggattctagatgacagaaca

SEQ ID NO: 31448 - DNA, 201 bp, Bos taurus
tcttgagctcaagcactggaagacatccatataaattctgcaagatgatagctatgatgtcacccaaaagtgttccttctcatgtctccccacttcatctrgctcatcggaagctttgaggcctcagtagtcttgtgatgctgttttgaggagggtgaaaaattcttttctggttggaataaagaagcatccgggttgggg

SEQ ID NO: 31449 - DNA, 201 bp, Bos taurus
tactgagaactcatagtcaggttaaagagccacccttaatagggccttttagataccatggtttaaatggacaatttctcccctcaaaagtatataatacrtgaagtatttaggccaccttaaaccatcaaggaattctccataggatatatcacaaactaaaaaatacatctctattggtggaagaccagtagcaagaaa

SEQ ID NO: 31450 - DNA, 201 bp, Bos taurus
cctgcctttcccatggttcccaattaaaaaaaaaaaaaagcagtgtgtgaataatatggggtagtataagaacacgtctttagattctgaccagtcttgaktcttcttttttgaagttatatgatttggtggaagtttttctataaaattcatgtaatcatacttatagtttaccaggtatctacaaggtactgaactgta

SEQ ID NO: 31451 - DNA, 201 bp, Bos taurus
accgaatctgcacctctgaggatttcctgagtgcccgaacctgagcagcttagaactgggaggtgcatgcagcccaggtctggcctcagatggttctgagyagagcaacatagagcctgagcagtgtgggcagggagggcacacacgccgtgagtgagggcaggcccagtgtggctgagacactgcgagcacatgccagtg

SEQ ID NO: 31452 - DNA, 201 bp, Bos taurus
gccaagttaaaggggatacaaagggcttctgcccttgaaagctatttcccagctaaggaggatatgaggaagaattttatagcaataatttaagggcaagkttgcagataagattagggtgtgagtagggccagccctcctataatctggcttcagttaatcttattaatgagcttctgtggttccattagtctggcctca

SEQ ID NO: 31453 - DNA, 201 bp, Bos taurus
gggtagagatttctaggaattgggccactgcccactgcttggtcttttgacagtgccttggaactgtcatggaacctttggtgctttagtaactaagtcaygtctgactcttgtgactccatggccctagcctgctggtctcctctgtctgtggaattctccaggcaagaatactggagtgggttgccatttgcttctcca

SEQ ID NO: 31454 - DNA, 201 bp, Bos taurus
aaatgcccaggtgacaaagctgtcagtagtgatgccgaggtttggatcagtcccatctgataccagtgttagggtggctcacatcacagcaggttgtgttygagatgccagacaccacactgtctctttgaaaccagcagcaagctcagttactcttccttttctggtgtttccatcccattttattcagtagctctcctc

SEQ ID NO: 31455 - DNA, 201 bp, Bos taurus
aggacgttgtctgtggcccagctgcttatcccagtgatcttgtccagttctgcttgtactcatccctctaaagctctctcactcccgtctctccttgtgckgaactcctggcctatcacgctcacgcctccttgtgttttccagctttggagacatgctgtccttcaccctgacggcctttgtggagctgatggaccatgg

SEQ ID NO: 31456 - DNA, 201 bp, Bos taurus
aaataacaaagagaaatggaaatctcttaagacttttctgacttcttgagaagagtctcaggattctgtctagtactgctctgttcaatctaatgctgtaratacaataagataaacagagaagtgtgggagagatggggagggagatgaaatgtcttcttgcatttcataacagattagtgaaacaccagctaccagagc

SEQ ID NO: 31457 - DNA, 201 bp, Bos taurus
aattcccattcctagtaagtggtcaagagggagttcacccaaatctttaaaacttgcgtttatgcagtatactttcctgcttctagtttggacaagtttaktttatagacattccggctctttgcttcttatcattttctctatttattcactggccacagaagccatttttctcatattcattttaatgttcagtgttta

SEQ ID NO: 31458 - DNA, 201 bp, Bos taurus
tctgtgtttttgccttttattaccaatatttcagagcatacattattcattgtcatgggtattagagaagagctaaagcacagctggatcccccgaaatgyaagtggccccatagtcatttcattgaagcctttacttttgagttgggggttaagaaggaggatgcaagtgacttggatatttcaggtatgggaatctcat

SEQ ID NO: 31459 - DNA, 201 bp, Bos taurus
tcctggaaatttctggccattacctgccaggaatagcatccttttataaattaaggtcttatcttttgcagcagcagcatctagcccagagagggctggcrcggcccagctcagagaggatccaagagcctgggagctatgtatagaaggcagggttgctcttccagcctttggaaatgttcaagcactgagagagtcacg

SEQ ID NO: 31460 - DNA, 201 bp, Bos taurus
ccatggtggctgacaggttctcctttaaagataataaatagctcacaattgctttactttggaaagtgctcttctgccctgggactctgtaataaccaacygtggaaaaggaaaggcctggggatttatgagatgtcccaatttacaaccatctgggagaaatacagcagggcgttggtacatcagtgttttaaccagagt

SEQ ID NO: 31461 - DNA, 201 bp, Bos taurus
gtttttttggccacgaggcatgtgggatcttagctcctcaaccagggattgaacgtgcattggaagtcttaaccactggaccacgagggaagtccctagawtataggtttttaaacataggccatggactggtagtgactgtcatatatctgcttcactctgtcccgcactcactgtggagtgtgaaaggcttttgtccac

SEQ ID NO: 31462 - DNA, 201 bp, Bos taurus
gaaaaaagcatgcagaaacattcttgagaataatcactcagtaaatcatgttggcctttcctgtgcctgggaagacagttttttcgaattgtgcaaaatayttctgaccttcagtttcacccactgcttttgcctctggctctcattagtaaacaccttggaagaatctcagaattgttaatggaaaaatgattaatagaa

SEQ ID NO: 31463 - DNA, 201 bp, Bos taurus
ccatataggccaagtaaaatgtcagagagaaaatcattctgttgagtggcgagtaggaataagcaaagttgggctggtactcaattttatctttacttttwaaatttttatttaggcccttaattttatttttagaatggggttttgttaagtaaactcagcacagtcatatctaaacatgtctgtatttattttcacaaa

SEQ ID NO: 31464 - DNA, 201 bp, Bos taurus
ttaactataatagaaatttttgaaagagtgatttcaaaagtttctattttagtgttacatatgtcatatagagggatacatttccctccttttattagagracatcattccaatttttaatactttctggaatttcaaagaatcattaaagaatggagatattgtgattccattgggactatttcttaggatttatctaca

SEQ ID NO: 31465 - DNA, 201 bp, Bos taurus
ataatcccccttttccttttcctttgggttcttgcttgcaggtggttttacagctgttggcagatcacttctggaagaagatgcagcaccagtggccccaygtcctgggaaaggagaatccattcaatccgcagattgagcaggtgtttggagaccaaggggggcactgaggccccaaggacatgtgcttctggggaggca

SEQ ID NO: 31466 - DNA, 201 bp, Bos taurus
atttcaaatcattttattttgatagtgattttcaaaacttgcatgtgtgcaaagattgtgtgcacactttccaggaaggagacgctcccacaggtaaagartggaggtagtgagtaatacttagatattgttggtagccagtgtgttggatacctgagatttggaggatatggccatgggtgttattttaacttttaaccc

SEQ ID NO: 31467 - DNA, 201 bp, Bos taurus
catacccacccttgacaactgccttctggaggtaactacagctactagctttcagcgatatttgatgtctttcttgtatttatacacatacatagagcatkttaatagagaaggtaattttcaggctctcgtgatgagtaagaagaggctccatcattcaaaagcacatattttggaagtacattaaatttgtataattta

SEQ ID NO: 31468 - DNA, 201 bp, Bos taurus
ccttgatcattgacagcaaaagaagcatttcacatttatctcctgcaatactgaaggacattttcacaactggaaccagtagttacaatgtcttactacaragcaaagaggagaaaaagcatcattcacaaaaacagccttcctccaccggctccaaaagatgtagaaaacccagcaaatctcctagctcttcgcgtagta

SEQ ID NO: 31469 - DNA, 201 bp, Bos taurus
ctggatgtggacacccaaaagagcacctagagatgtgaagcaaacctttaaaagggtagaaaggtacaagacgctggatttaacttcaagggcctgttttrgcgcctgcccctgcgtgttggtcctgcaacacaggagcctctttgtttctgttgtacaatggcacagatggggccccaggctggggtttcaagagttcta

SEQ ID NO: 31470 - DNA, 201 bp, Bos taurus
ttgcaaagagcacaggtctaaagtcagaaggttctgggtcctagtcccagctgacatactaatgagctgtgggatacaggcaagtcacttaacttcttcgrttttagtttccttactcaaaggtggagactcaataataaaagcatgcattacctacttcccagagttactgagaaagctgtgaaaatacaaaggcacatt

SEQ ID NO: 31471 - DNA, 201 bp, Bos taurus
agacaaggcccagatccaaactattcatgagtcttaattttagaatgctcctctgctgaccttttgctcacttccaaagctcatcaacagaaatggattgmattgaccacattcctcccatagtgcctgtctcttttgcaatggcctctggaaacactcttactaatgctgcaacactgccatttaagacataagtcatgc

SEQ ID NO: 31472 - DNA, 201 bp, Bos taurus
ttgaagatacacttcatgaggctgcctaataaatcacagttttaacttcctctttgatccagaagttctaggcgaggtgtgcatataagtaagtacatgcrtgctcagtcatgtccaactctttgtgaccccatggactatagcctgccaggctcctctgtctatgggatttcccaggcaagaacactggaacaagctgcc

SEQ ID NO: 31473 - DNA, 201 bp, Bos taurus
ggatactctggagaatataaatctgtgaggaataatgagttgattaatgttgactttcccagtccagattcacctaaaagaaacaaagggggaaatctctyaaaactcagtcaacttatcaagcttaaatattcaaccagtgttataatcaaacttgctttcatccaattacttcttggaggacaagcaagtgacattaca

SEQ ID NO: 31474 - DNA, 201 bp, Bos taurus
ctctttttgctgccttgggaagctggagatcatctgatattaatgctacataaatttcattctgttcaaattatcacccattccttttgtcttctttccarcctctgaagacttttcccaatttccttctgaggctagtgtttccatctctcctatcctctcctccctccctaggtccttcttgactttgagccccttcca

SEQ ID NO: 31475 - DNA, 201 bp, Bos taurus
tgcatccagagggagcatgtggattttaacctgggaactaaataaataaactgtcagagctgaaagaaatgttccataggtcagatcctaaaaatagagtygatgggtagagtatgaaagcagatgtaattatgagattgagcagtctcaatctcgtcttttcatttaggagttggacaggggagaactggagccacagaa

SEQ ID NO: 31476 - DNA, 201 bp, Bos taurus
cataactgtttaacactgaactctgggttcacaggggcaaaaatgttgtgaaacattctgagcctttaatattctctttgaacatataagaggcacttttrgaagagaatgacgagtaataatttacattcaccatttcccaaagggataacacagatccagcttcctcaacttcattgtctactcctcaggaatttcaaa

SEQ ID NO: 31477 - DNA, 201 bp, Bos taurus
tagtttattggtacaacggaaactgaaacagagccctgtagatcttaggctggtttctttccactacactaagcatgaactgtggcatttgggttggcacyacactccatgggcctactttccaaggacaaccgccacagtattccatctcactgctcttctccaatgtgaccttggttaattaccctcctcttgcatctg

SEQ ID NO: 31478 - DNA, 201 bp, Bos taurus
agccctgattaaatggcggggcagccaagggaaggcccccgccgccgccagagccaccgtcaccgcgccgactaggcagggactggcagtggcgggggctstaactttaatgtctgcgtcccggccgcagggactgcggcggttggagctgagggtactgtcttgggcctcgggtcctgggttggagccgcgtgtgcggga

SEQ ID NO: 31479 - DNA, 201 bp, Bos taurus
actgccagataatttcttcagcaaaattaggtttactggggatcagcagaggattgcactttgaagtttaccaccatggtgagccacatgcaagtccctgyacagcaaggagaagagaacacttttatggaagggaaaacaaagttgtgagagctatagtaaacaaaaaagttcatggcttttcattggctgactacttgc

SEQ ID NO: 31480 - DNA, 201 bp, Bos taurus
tattctaaaaaggcaacactatagtgtggaaggaagatcagtacttacctaggctgatgtttcagggaggggattgactataaaagagtacaagggaactygttgagatgatggaaattttctgtcttatgattatgatggtgttcacacacatacacgtttacccatgcttatgaaaatttacacataaactgggtgaat

SEQ ID NO: 31481 - DNA, 201 bp, Bos taurus
cacattttgcattctcagatattcagaaacttctgaaaagatttaatttgggttcatgtatttatgtttcgatctctaactatatttttgccaagttggargtagatttagatctttatagatactatgctttggaagtttgttatgtatctggaaagaaatcagatttggttgagaagtatttagttggttcatcaaaaa

SEQ ID NO: 31482 - DNA, 201 bp, Bos taurus
ttgcttaactctctgagcttggtttcttcattttaaaaaggaagaagtttcactaggtgacctttaaaaaaatttctccactctaactttgtgtgatttgycagggctaattacaaaacatttaggccagcagcacaacctttattaaaataaagatgtaaacagcaatgtgagagagaaggttagtgtgtgcagaagtca

SEQ ID NO: 31483 - DNA, 201 bp, Bos taurus
taaatgaaaaacattaggttcaaataatttcacaagggaattcgaacaaaacatcaaggaagtgattatttaaagccatagaaaatgttttaatacagaaygtgaaaattcttaagcacacatgaatactgcttcaggaatcctacaaaggtatcagttacaagtttattgtaattatacatatcattgtaacatcaatga

SEQ ID NO: 31484 - DNA, 201 bp, Bos taurus
ttgcagacatttattttaaaatatgtcctcatctcaccaaatctcatcaaataaaccaaataaagaaggcaaggaaatttcaaagcgagagaacattaacycaaaaccagaggaggggagggaatgaaactgtaggataagagctaacaaataaatagctgttggggtgggataccataatcactgatttgaaacataaat

SEQ ID NO: 31485 - DNA, 201 bp, Bos taurus
ttatcatttaccattttttaaagaggtggtggctaccctcatcttctctcaccccagagtgagcaaaacggtgatgggggcccaataaggagcaaagaacyaacaaaagaacgaggactggcaggggcgccctcggcgctgagctccaggaagcccctctggccgcagcacaaagggctgggaggcagagatgctgagaca

SEQ ID NO: 31486 - DNA, 201 bp, Bos taurus
ttggttctcccttgagctggcccactgttctaatcgcgtttcccactctaatacactttatttatttctaaaaaaaaaaaaaagaggcaggacctggctgygggccctagagaaagaggacgacctgggtagagtatggcagccttgctggggctagaagactagagaaagtttcaggaagaaaggcagaatgcaggaaaa

SEQ ID NO: 31487 - DNA, 201 bp, Bos taurus
gcagcacttaatctcccgaagttcctggccccccgctgtggcccaactctaggagtcaccacctctccctgtcctctctctcctacaaagtccagggagcygcagggtgggggtgacgtcccaggacaaaagagggagaccactgagtgcaggaccacgtgtgggtggagcccctggagaagaggagcagttcctgaccat

SEQ ID NO: 31488 - DNA, 201 bp, Bos taurus
tggagacctacaagtggccctttactctcttccagttgacattcactatggctcccacgcgcctccttcacataagtccctggtctggaccttcagttccyacctttgctctggcctgagggcctatcttcacctgacactgcaggtggtggtgccaggaggctctttctcaacaccaagaagtggaacttactacctatg

SEQ ID NO: 31489 - DNA, 201 bp, Bos taurus
gatgggggaaacgaactaaagcagagagggcgtgcgtggccgtggcaccatcctgctgaccctgcaggatctggagtgggaaatcagggtctgactcttcrgcagtgatgctatactgggccccgggcaggtggttctccaccaggggtccctgccgcctcagcctatcctgacgggctggcagtggagccctcagccctc

SEQ ID NO: 31490 - DNA, 201 bp, Bos taurus
gcagctgtctccctgcagcgcggaagcaggagatcatcaagatcacggagcagctcatcgaggctgtcaacaatggcgacttcgaggcctacgcgtgagtyggggcgcctggcctgttctggggtgtggggggtggacctggagggcttccccacagggagggggctggatggaagcacccggttctgaggggcccctcct

SEQ ID NO: 31491 - DNA, 201 bp, Bos taurus
aagctatagtgccaccttctggaagacaaaaagaggtttcctgcagccggcgcggtgagctatgagaacaagaggagacactcagaaggaagaattccacmccaggagagaacgagagtggagcaagtctaccccttataaacctaggatccctggagaagcaacaccgaagaacagtacctcatcaaagataaccagtaa

SEQ ID NO: 31492 - DNA, 201 bp, Bos taurus
ggggggaggcggggttgcagagagaaggagctgcagccagccaacattggagttgaggtctcagagttgtcaaagtgtggcccaagaatccacacttcgartcacctaagtttcatgttaaaggcagattcctgtgtcccatgtgacatttacaaagcagaatctttgaaggttagtgtggtctgaccttgagggccggag

SEQ ID NO: 31493 - DNA, 201 bp, Bos taurus
acaatgtcatattcacatgtactttttatataaaacttgagatgaatgaactcaagctatgtgtaataacatgcattgtcatagtcttttatatccatctraatttagaatataataatgggaatagttcaaatgacagggaaaggagttatttgaacaataaattgtttaaaattggttttaaatttaaaaaaaaagaaa

SEQ ID NO: 31494 - DNA, 201 bp, Bos taurus
gccaggatactggagtgggtagccattcccttctccaggggatcttcccagcccagggatcgaacccaggtctcccatattgcaggtggtttctttaccarctccaggggacatcagtcaggccctacccattgacttgtgcaccatggcaaccttcagaaaagaaggcctatagtctttcactattgtgatctgttgggc

SEQ ID NO: 31495 - DNA, 201 bp, Bos taurus
ggagaaaagatctacgtatgtatatattttcccagagtattttttttttaaaggaagaaattttcacgaatgcaattacagtgtttggtgctttttttttraagtcatcagcaaattcctcaagagcacttcattctcttaagaggactggattcctaaactatgctggtgcagaaaacaatctggcactgcccacttgtc

SEQ ID NO: 31496 - DNA, 201 bp, Bos taurus
aaagggaaaattcccaagatgctaacctttttgaaactgaggttgcttccacggtcccaaggaacttctcctctgttcctctccagatgagagaaggccgkgtattgtggttactgatgggcactggattcccaccactgggatttttcagacattgtccagaggtcaaggctgatgcaacttggccaggtattaatctga

SEQ ID NO: 31497 - DNA, 201 bp, Bos taurus
ttgagaatctgggccacatgctcatttaattacttgtgctttctcctcatccctgtttgttctggtcttggacataccacatctaaatagttgttgagccygcttgaccttatggcctgatgagtctaacacagctaatgatgcgcagttctggctctgtggtaggtcacttactgtcctatagtcctgcccgctcagaaa

SEQ ID NO: 31498 - DNA, 201 bp, Bos taurus
ctctttatttggagatcttagataggaaattaagtttcatttgataagcttcaaaaactccctctaattaggcagtatgatttccatcaattctattaatytttcatggcacatagacaaaaaccctaaacatagaaggaaataaaaccatattagagcaacagaaggggttgactaggtgcagaaggtcattagagaaaa

SEQ ID NO: 31499 - DNA, 201 bp, Bos taurus
aacttaaatttcatataattttcacatgtcacagcatcttatttttcttcagccatttagagatgtccaaactgtccttaagatacataggccttcattcrcagagcctggttagagatgatttgtaacagaggctgccatgcttgccagaaattaggaggtggccttgaacttgacactaacatatccctgctctctttt

SEQ ID NO: 31500 - DNA, 201 bp, Bos taurus
tatagtaatctttgatggcaatcactgtactgttcagtaacgttctggatctggcaattttcgtcagtggcatttttaggcctctgtcatatcccatgtgygtgatacccctgtttttacagtaagagccagcagtgcttctagatggcaaccaactttcccatcacattttcactctcaagtaaagtgtgtgtgcatgtg

SEQ ID NO: 31501 - DNA, 201 bp, Bos taurus
taggagtcaattactttggtatctgcacggaaacagtaatatgggcagctctctccctccactggacttcagtctagactgccaagaaaatcccatggccytagagatgaaaggaacacagaaatggcaattaacaatgtcgctaaatatataacattccattccaagcacaataggcaactggaacatttcttgtactct

SEQ ID NO: 31502 - DNA, 201 bp, Bos taurus
tctcatgacacctaagaaggagacagtgagggcagagaaaccatcaacaccaccaagcagatcaaccaaactaactcttacagaagcttactatgagctgrgaactctactaagcacttttttaagttgcctttgaatatttatgaaaaaaaacaaaaaacaaaaaacatagccaatgtttactgaatgcatgctgtatgt

SEQ ID NO: 31503 - DNA, 201 bp, Bos taurus
aaaaatctttcttctaaggtagaatgatgacagctgaagctgtgatgaacacgaggggttctttcaatttttatgtatatttgaaaatttgcataacacamaggtgaacaaattagaagaatacaatagtaaaatatcctttgaatatatcatattttgttttatttttttaaatatccagtttatgctgaagatttctaa

SEQ ID NO: 31504 - DNA, 201 bp, Bos taurus
aaaaacatcaggcttgaagaaactccccccggaatgattttttccaacatttgtgtttgcttctaattattttcaacacttctgaaaacgctaggaagggwgaagaaacaccttgctgacaatgtgctctttgccaaaataatcaatcctccagcttctctcgccttctaaaattctaatattcaatacaagctttttggg

SEQ ID NO: 31505 - DNA, 201 bp, Bos taurus
tcccaagaatttttgttttctcaaatttttcacaagattttgttggatttggttgcagaggttagagtcttaaatatccataagacagaaataggaacttracttgctattaatctaagtagcaataaaacagggagaaactagtttttatgctagagtactcactactttgcacacaatacaattttatacaaatgacca

SEQ ID NO: 31506 - DNA, 201 bp, Bos taurus
tttgacatggataccataccacaagcctggtatcttaggatggccctagtatgaagatgaatgtagtattcttaagccaatggactttaatgatttctggmcccactgacaaaatcaaagtcatcatcttatggagtagacatagcaagatatcttggtttggcactccattgaatgtttaatgcatccaacatggttttt

SEQ ID NO: 31507 - DNA, 201 bp, Bos taurus
tatagaataaactcttaagcaactcagcgttgggctgctacccacccatagtgggaactccacatataacaacattataatcggccctccatacttggggytccacatccacaggttcaaccagctatggattgtgtagtaccacagtacatatttattaaaaaaaactttacacacgttgacttgtgtagttcaaacctg

SEQ ID NO: 31508 - DNA, 201 bp, Bos taurus
aacaaaaaatattaaagaattcaggaaaaaaaatattaaattgagttaaaaagaataatttaaaaaagaaaaagaaaaaattggagaatatcattatatakcccaagaaatgaattagaattaactagaaataatgaagcattttggtgacattgccaattatgagccatatataacataaggagttaccattggggaaac

SEQ ID NO: 31509 - DNA, 201 bp, Bos taurus
agcaagatgtaagaggacaagaaagaaaatacaagttaagggattatggcttaaaaatcccatctctcagtgaagtcttccctaactcattcagaagaggycatttcccctctatctctgtccattagtagcatggaaggttgtggaaggaaagaacttgtccaatttgttcagtgctctctccctaggagctggaacatt

SEQ ID NO: 31510 - DNA, 201 bp, Bos taurus
ccagggaaaaagaaatggggttcttgtgaaggaagctggacttgattaaaattgaaaacttcagctctgcaaaagacaattaggagaataaaaagacaagmcagactggggatgatctttttaaaatgtatctgataaggtctggtatacaacacatgtgctttcctggtggctcaaacggtaaagaatctgcctgcaatg

SEQ ID NO: 31511 - DNA, 201 bp, Bos taurus
tactactagactacatcctcttttaaggagcaaacaccaaatgtaattcatttcagtgtccttccatagcccttagcaaaacacacaggtagtggcctttyattaaataaacaagcacaccatacctttataggcatttttcatttgacttgctctttatattaaccaaggcacagagaaagcagatggaagatgaagagg

SEQ ID NO: 31512 - DNA, 201 bp, Bos taurus
actctaagatttgtttagctcacagctcctagtttttgttctttacccagcctcgtatagtttcattttacatacgtttagatgattattctgccaaatamtcaaggaaatccctaggcagagtttctgatctccttctttacatatctcccttctcttttgtgtttcaccccagatggcagccacctcagtcttccaagt

SEQ ID NO: 31513 - DNA, 201 bp, Bos taurus
ttacgttcccttataaaattttgaaaatgacattctgattcactttgagacaacttagtctaacctttgtttagtatataatgttcaacatcatgcccccrattggtgttaagaatgggtccatacagcaagattaaaattatgccaattataaatgtgctcactgcttatgaattaagaaattaaagtgaatcggatctt

SEQ ID NO: 31514 - DNA, 201 bp, Bos taurus
taaattaaacatgaccttattcatgaatattattgaatattttctaaggcactgctatctgttaattttaaaaacaggtaaaaatggggactgtcctgacygcaatgatggaaggtccatcaataacatgaaaaaaggagattttgtggatcatactgtcatgagtttgttaactaaggatgcttgaaaaatagaggagaa

SEQ ID NO: 31515 - DNA, 201 bp, Bos taurus
tccaggttctgtaggatgattgatgtgtctgtgctgaggaaacagggaacactcaatggaggggaaagaaataaacaagtctggccagcacactgtgattyggcagaaaactagtagaaagctctctgaagggatgcatttaagttttattttaaaatttactgataaaattttcaggcccagagctgaggggaaaaactt

SEQ ID NO: 31516 - DNA, 201 bp, Bos taurus
ggccatttagtgtccctgagtttcaatttcctcatctgagaagtggaaatcattaaatttaatcatcaactcaagatgtatgagatgctaatcaccagagrtgttgccagctctgtggccatgtgggtggacttataatcaatgaattgtactgagctttcacttcggccctttcactggaagcatcagtgaccagaccca

SEQ ID NO: 31517 - DNA, 201 bp, Bos taurus
ggagctaaatatttttggaggataaattgtctctggttctttatttcaaaaactgctttgtattcatataatatactttttttttttttttaagcaaggamacttttagatgaagcaggatttggtaatcacagagtctttagcatcagacaaagccaaatccgaactctagttctttccttgactgtgtgaccttcgagc

SEQ ID NO: 31518 - DNA, 201 bp, Bos taurus
tgagaaagctaaaaacgcaagatatatttccccttaatttcaaaacatgaatagatgtcatgtaacttctgtgacattctctcttataacttagattttcrttaattcatcaagaagaagagagaaagtttacttaacagagttaatttttttgcttcaaatttattcatacatgtagacaccccatatgtacttttaaaa

SEQ ID NO: 31519 - DNA, 201 bp, Bos taurus
agaagcaatattgtttaaaaaaatttcaataaggacttaaaaagagataggaggggaataacacaagggtttgaatcccaggaggtagcttgtctcagagkatgtccatcacagctcatttgcccctcacaaacttctcatccaaaaagtaatcactgttaatagtttcttatgagtctttacagaggaaaaaaattggat

SEQ ID NO: 31520 - DNA, 201 bp, Bos taurus
ggtaaccaggtaaaaggtggagtctgtgatgcctgcaaatgaagagttaaatgtttaaaattcatattatattggtgttaataatggagctagagagactyatgtttcatgattattagtggttttcagtctgggtgatggagtaagggttatactgacactggaggatgagatttttaattaccaattgtgaatgagtta

SEQ ID NO: 31521 - DNA, 201 bp, Bos taurus
atgaagcatgaaaatgcattttccaataagttccatagcttattcttattcaagttgatttatatcaatgtatatcaactgctatgctagcagtatcagayaaagtgacatgtctccctctgaaatggactggttcctggcctcaaacaggagtggattctagaacagtgttcatgggcttatccccagcccagaagtcct

SEQ ID NO: 31522 - DNA, 201 bp, Bos taurus
taaagcattttagaaaaggatttactcttcacatgtccaaatttttgctttatgtctgaacactgttgtggaaacaagaggcccaagtttgttgagaaccmcagatgcagggcagggtctctgtttgctgtgactgtggctgcctctgctggcctgcctgtccctatatcagctgcccagctactccatccagtcctctgc

SEQ ID NO: 31523 - DNA, 201 bp, Bos taurus
aatggtgtcatgatggaaaaataagaaccagccaacatagaggaaataagtaaattagaggtattagtaagctgattgacttctgtggggaggcaaacttkttgaaagaattgatattatttcctgaaggaaatataaatatgttaggaattttgcagataatacgagcagagtaagttatatcatttgacttttagcaca

SEQ ID NO: 31524 - DNA, 201 bp, Bos taurus
atctcaaaataataaaagccatatatgacaaactcacagcaaacattatcctcaacggcaaaaaattgaaagcattgggcttcccttgtagctcggaccaygcggcagaagcgcgccagctgcaacggacctcgcagaagcatggtatagaggagctaccccatgtccaaggtaggggcagtggccgagaatgccaggctg

SEQ ID NO: 31525 - DNA, 201 bp, Bos taurus
ggcctttgtctctctgttacatagaaaagaatagccattaaaattttagtttagccttgtttctaagtctcaggtaaattttaggttatgcttcagttctyctcttgtgtatagaatgtggccaggaaccgaagcaaacattctgaccctaaaagatgaaatgtgtatcttaaaaatgacagggaaacaagttaggagtaa

SEQ ID NO: 31526 - DNA, 201 bp, Bos taurus
tagaaagactcagaagaggcagatgcatgcaggatctaaagaaactaaaccaagggcaacagagttcccaggtttgtcaaatgtcctgcactcatgagcaygatcttgaagctgcaaaatcactcactgagagattgctttaggcagctttgatggcagaatctagcctttgtagataaagtaacagagtttaagccgagc

SEQ ID NO: 31527 - DNA, 201 bp, Bos taurus
ttaaagcaatgacttaattttatctatttctccatgaacatataaaaataactgaacatttcccctaactttctatttctatttgttatctaatgcttgaytaggaagaaagccaaaggggatagtctgtcctcttatcatgatatatttttgcttgtgtgtgtataaatatatatatggaattccttacatatattattt

SEQ ID NO: 31528 - DNA, 201 bp, Bos taurus
ttacactagatttcctacctactagagtctttttctgggatattgtgagtcagagtataatacattcttttgcaggctagtgcaagactattttaatcatytaaaataaggtagaaaaaaattcctttttctctttaaaaaagaaaaaaatgatacttattttagctttatctacctatgagttcctccaaattcgttttt

SEQ ID NO: 31529 - DNA, 201 bp, Bos taurus
atgttaggatatcttgttaatcactcatctatccccatgaaagaatagtttaagatgatctttattgctatactcaaagaacaagaggtgcattttcagtmcatgataattgccctgtaacttccctaggcacagagcaggcctaacgacagtatctatttcctcatgttggcctcatctcacagcagttagcctgataat

SEQ ID NO: 31530 - DNA, 201 bp, Bos taurus
tcctctaaaaagacaaaataaaatatgattcacgttcaatgcagttgtcagctgctgagcttgaggctagaatgcctttaaccttgagaagtgagccatcyttgtacttgtgtgagtccatagagtctcatctcaggaagcagaaccttgcttagtgaatgtgtaaggttgatagtctgagctcaagtctttgatatgtgt

SEQ ID NO: 31531 - DNA, 201 bp, Bos taurus
tgaaatcttacttaaagaaaggattttgctaagcagtccattgaatttctataaataagaatttggccaatgaagatttgtggttcagagtcatagacacrtagattcctccacctatctctcaaagggagagaaaaaaagtacagttgaaaaaattaaagcagagattataacaaagtaaaacaaaagtattttcaaggt

SEQ ID NO: 31532 - DNA, 201 bp, Bos taurus
tttcctggaagtttcattgatcaaaattatcttggtagcttaaaactgagcaaaagattatcaataacagcctgaagagttaaatgaaaaaataagacaamgaggccctctgtgagtacaaaatgtagtattatgcaatattaaattgacaacagatagctactaacatatgtacaaaattaaaattaatagactgatgct

SEQ ID NO: 31533 - DNA, 201 bp, Bos taurus
tgatgagtaagatttctcatatactgttaataatttaatggtggcataagcatctaagacttaatggacttgtgtgagattgaaaaatagttattctgaartggtactttaagaacatattgtcaaactttgccattacagcaaatattatttttttaatgtgaaacttattaatcaattttaaaacctcctctaagtctt

SEQ ID NO: 31534 - DNA, 201 bp, Bos taurus
gtgaatggacattagttaagcatgatgagggaatgtgaatgtataagcccagtaaaactggttgtgaaggagaagtttataaaacttaatagagaggttgrtattttagttatatgttgataaataatgaaaagtgtgtttgtaatgaatggctgcttatgagagaacatgttaggcatttttcagaattgttactgaaat

SEQ ID NO: 31535 - DNA, 201 bp, Bos taurus
ttggtgtttatggcccaaccctcacatccatacatgactactggaaaagccaaatcccattattcaagagtgctagttatttacctatttttaaatctccyggccccctctccctttcccaggggaagttggtagatggcctaaagttccaactctcatcacttgttttttcaggtgaccagccccatctggagcctatct

SEQ ID NO: 31536 - DNA, 201 bp, Bos taurus
agccatttgtttacgttccaggggttgtaaacctagagaccttctcctttctccagactatttatttatattccataacagacatcaatttctttccatcyctagagagttagatgtaccaaccacccagtttcacagtttagtggttactctcctgtgacacataccctgcatctgttttcatcccatcatcaccctatg

SEQ ID NO: 31537 - DNA, 201 bp, Bos taurus
gatgtaacagaggccagatgtgaaggtttaaaacagcctagtagcaatggggagacagcaaagaggcatcttaagatgacttaatgtttgccctttagatrtacaactccatatgcaggggccacttaggaatctcttaattataaaattgtcaatgatgcttactagtgtagggattgtagaaagtatagagtgttgaaa

SEQ ID NO: 31538 - DNA, 201 bp, Bos taurus
ttttataggtatgtgtctgtaatttctatgtatatatataaataattataactaaaaaatttggttgcttgattcaaggcctatatctatgtgtgtgtgtrtatatgtgtgtgtgttcatatgggaaacaactggcaaataaaattataaatcaatttcatttatcagttcagtcacttagttgtgtccaactctttgcgg

SEQ ID NO: 31539 - DNA, 201 bp, Bos taurus
aaggtcttctttaggaaacaaatacctgaatacatatagaatggcttgagtgaaaagtcaggatgctacaaaagaaaggaatgaatgtgtagtattttctyccagtcggcacctctcctgagattagatttatgtcattccatttgccacttaagaggtattttagtcataagaatggacgaatattgtgtctttttcagt

SEQ ID NO: 31540 - DNA, 201 bp, Bos taurus
taagaaatacaccacctctaattatacactatttctcttttataatgtagtatataaagtttaggaacatatacatccaaattgtatgcaaatccaaaaaygtagctttacaggcgttattatgtatttgtatgtctagtagaaatgattcctggaatgtagttaatcttgtttatatgaccatgattttgtatttgtttt

SEQ ID NO: 31541 - DNA, 201 bp, Bos taurus
tttgttttacctttatttcaaaatcattgacctaatatcatgatatgttgacctgttctgctagcactattaaaattttacctcattagcattttatgatrattaatagtattgaggcaggatatagaagagccccaagttaagcagccagaattagtcccctgtggacaggtatccccaaaataacaggagcgagagagg

SEQ ID NO: 31542 - DNA, 201 bp, Bos taurus
aaggcatcctggcaggagcaaagccacgtcacactccctggtctcaccctcctccttctctctaacttccttctttgcttgcccatgatcaacatccaatmtgatacagaaggtaagaaagcttatagatacaatctataaagttcaacttgccaagacagagagatgaggaagagcctgatatgtgtacctggaggtcag

SEQ ID NO: 31543 - DNA, 201 bp, Bos taurus
taaaggtgatgggagggcactggctcttctggtctaacatagctttatcctgtttactgaaatagttccaagcagtaccatgccgggatgatacattaccrtccttattgctgtcagcacgagagctcttttggtttgtcttttgagggcttagtaggaatgtacaattattttttaacagtaagtgagcaaaaactcaaa

SEQ ID NO: 31544 - DNA, 201 bp, Bos taurus
tcagatctcatggagcacatcctaagatctgtcactaataatcacccactaacacatatatcttcatgtttctcaattacgtcctctaatttttctttccrctacagttcgtatactttatttggatttcatgatttaatctcatggcatttccaactggacctcatggtaacatcttgcaatagctcagtctttattgat

SEQ ID NO: 31545 - DNA, 201 bp, Bos taurus
tagttatattttttaaaatttactcattggtttaagtgggaccacctaaaaaaatctgagagaatgcacacacacacacacaaaatccaagattatgatcrtcaaggactctttctaggtgcccagcagtgttggcaacaagcaaacacaaagtatactgtaaagaaaaattgacaatgtgatttcatgtttttatttatt

SEQ ID NO: 31546 - DNA, 201 bp, Bos taurus
atctaagtttcaattaagtctcttgcccctgaccctgtgtcagcgcacatcctctccagctatgaccgttcctccaccaggtcaacctaaacccagggagytgtttgcatgatgtatgaacagccagcagagtggtaagcattctggactcagtcagtgtaatagataaatgagaaaagcatactgatgaagcagggtcgt

SEQ ID NO: 31547 - DNA, 201 bp, Bos taurus
tgtccaaacatatgaactttaaaaaccaaagatagttgtctagtatacaggatgcatcctttatatgtgcttcctactgattctcaaaaatctgccagttycttttattttatctctctttctaagccaaggttgcatagtccatttaagtgtctaatttgaaaagaagcctgggaattttttctcacccagcctgccttc

SEQ ID NO: 31548 - DNA, 201 bp, Bos taurus
agactctttctgcctaggtgtgaagtcatggatcattttctagacaagaatgagagttcctgagattccataatttttaagatgaaatgcatgcttgtctrttaaatcagggggaaaaagaggcctgggattctcttcttatagtgttccttctttgaataataaaaatatgactctgtattcttacagaatacctgagaa

SEQ ID NO: 31549 - DNA, 201 bp, Bos taurus
acattgaaataggtgttttgttttgtctctggactaaaatagcctcagctcaataatctcattttgtagtttgctctatttttgtttataaagagtgtgartctaaaatcaccatctgtataatttggacctaatacttacctgaaatatatgtaataaatattcagtcatcaaatttatgatgcaggttgcccctcattt

SEQ ID NO: 31550 - DNA, 201 bp, Bos taurus
aagattttctaacaaggccatatcagcacagcaaacacactgagttaattttccaggaacagagagaattatgtgttggagcgtgcatcatctctcactcrtccccctttttgaacaaggcctgccaacattctcaaggttgctgatcagggctgtagtcacatgtacagcaactaattggcccatagtccacatcctaga

SEQ ID NO: 31551 - DNA, 201 bp, Bos taurus
atcaccatttcacctctgtttctctgagtttatcttttttccacatgtaagtgatatcatatagtatttcaaagttccctttatatggccttattaaaaaktgttgctgctgtatggtgttgtatacatatgcatatgaagtcctggataatatacatgaatctatctcagaggttaggctgagagatttggtgggaagat

SEQ ID NO: 31552 - DNA, 201 bp, Bos taurus
gcccagggagtcttcatcacttgacagggagcttgtgctttcctttagttctatggtattccttagaatcctagctgctttggcttttaattcatttaatmtgatattagcaattattgacacctaatcttgccttccacccaatcgagcattagaatagagaaacagaaaactggaaaattcttcctctcatggaattag

SEQ ID NO: 31553 - DNA, 201 bp, Bos taurus
aatgcaagggcccaagtcttcttgttggcaaaggtgaatgaagaaaaactgagactgtgagaaactgtgtgcctggtatgagcctggaaggctgtatggayaagcagggccagtgaagcaagatcttgtggagtgggagtgggtgtgtctggctggggctgagtggagttcagtggctacgtttgcagtttgaaggcgaaa

SEQ ID NO: 31554 - DNA, 201 bp, Bos taurus
cttaagagaaaaatatgtaaaagtataaaatttcttcaattccttcttagttaagttctgtcacaaaccagagtcaacatataagtgaccctgagctgttrgaacagcagggaattgtctgagcatcagaattcctgcctctgttccatctccctgagtatgctgccaagggaagtgctggcttatgcatcaaggcattga

SEQ ID NO: 31555 - DNA, 201 bp, Bos taurus
ataattttaaaaaaatctggacttccctggcagtgcagttgataagaatctgcctgccaatgcaggggacatgggttcgattcctggtctgggaagatttyacttactgcgtagctactgaagcccgagcacctagagcctatgttctgcaacaaaagaagtcattgcaatgaaaagtctgagcactacaacaaagagaac

SEQ ID NO: 31556 - DNA, 201 bp, Bos taurus
taaatagagaacactggagggacacggtcacaagaaaggggcttcctgtcccagatatgatgtgcttctgccttcagcatcattcagtgtgcagctgcaartggtatcaacctctcagtgaatcttgccaccaccccagccagtggctgtccagtaagtcatgaaggcatcccagtgcttggtttcccactggaaagcttc

SEQ ID NO: 31557 - DNA, 201 bp, Bos taurus
aggaaatactaatagaccttgaatttcattaaaagagttttgattgtgggcattgaactgggtgggcttcctggtggcttgcatggtaaagaacatacctrcaatgcaggtgatctggatttaatccctggatcaggaagatcccctggagaagggaatggcaacccactctggtattcttgcctggaggattccgtgggc

SEQ ID NO: 31558 - DNA, 201 bp, Bos taurus
agattggaatacatgttgagggagataatccataggatctaatactacttttaggaaattaatagtttattttatctacataattttaacaattgaatagrtggggagaagccaaggagacatggtatacaatcagtgaatatttttaggaagcataatttctagaaataggcctgttcaggagaaaacatttattgtttt

SEQ ID NO: 31559 - DNA, 201 bp, Bos taurus
gggatggtggagtctatagtggtggcagttgaaattgtgaagatgacatagaaaagaataattgaggaccgttattgtatgaatggtgctttgggcttctyatgttttttaaaatttgtacatatacatttttctacacattgatcaattggttttttttcttggttgtagattggatttatggatactacagacaacaga

SEQ ID NO: 31560 - DNA, 201 bp, Bos taurus
ttttttggagtccagagataaacaagaggtagaagtgcaaaattagttttattttgaaaagcatattcacttgcaagagtttcattttttccccttcttaycatatcttaaaatggccatgaaactcactgacatttttgaagtcagttttacttaaaatgcttagagtttctttaccaaaaagaatccttttcaaggaaa

SEQ ID NO: 31561 - DNA, 201 bp, Bos taurus
cctgaaagggactcctagggcttccggctgaaaatggcttctaggccacagtatcacaggaaccttttagtcaaactcaataaaatatattctgtccaaakatctcaaaatatcaccagatttctaactaccactaatatacacagattttaaccttctgatacataaacatgggtggggtcttgagaaggctcagtaatt

SEQ ID NO: 31562 - DNA, 201 bp, Bos taurus
atttcaagaccactctaaactcctcagggcaaaggagttcagaaagaaatggtctttgaaattacagatagcatgctcaaaaagcaaaaccaattattggragtagcaaatgtatacctcgtgttttaatattttcattgcaaagcagtattaaaggaaatcaactcaattagagatgggatagatggatgaccgcacatc

SEQ ID NO: 31563 - DNA, 201 bp, Bos taurus
aaactgcaaaatggggggtgggggggggggtaggctctgaaaataactgcagtataaaaagggattaacagtcatcttaatgtatgaagaacacttgtaartcagtatttaaaagatgaacgtccaaatggacaaaaaggacttgaacagataattcagaaagatataaatacgaatgactggtatggaaatgctgaactt

SEQ ID NO: 31564 - DNA, 201 bp, Bos taurus
tttataattctagataatcctgacatacatgccccaagaaatcggctgaaatttcaaaggattcaacagttctcttattaatactctttttttggacattyaatctctagttgcatgttttaaaagtaactaacaactactaagtacttgcatgtgtatgtgctgagtggcttcagccgtgtctgattctctgtgacccta

SEQ ID NO: 31565 - DNA, 201 bp, Bos taurus
ctaacacttgacacaacctaatactgaaggcttagacaagtttagttaaatgaacttaatttctcattagttagttaaggatcatggtgtgttacctcccrgtatgaaccctcatttccagctatcatttagttgtgctttgcgttattttccatgctaccatctgtcactgggctacgatctcatcaagtttccaagtcc

SEQ ID NO: 31566 - DNA, 201 bp, Bos taurus
tcttgtgtgaagttaaaaagagtccattatccactacattttgttttgccaaaaattatatggtggagacattctagttcagtagtacctaaaatggcctrggcgctgagtcgcttcagtcctatctgactctttgtgaccctatggatgaaagcctgccagactcctctgtccatgggatgccaggcaagaatattggag

SEQ ID NO: 31567 - DNA, 201 bp, Bos taurus
taacatcatatataatactattcattcattcattcattcattacactaacatctttgcctaccgtgagtaacaagtgcattgggctatctgcaatccaccrttgattcaacagcatctgtggaacattatcattcactcatatttatttgaatattttatttttctcaaatcatgaggagggtcatgatagattcaccaga

SEQ ID NO: 31568 - DNA, 201 bp, Bos taurus
ctttcaccctctaccctttgctctttcattcctggcccatgtcttctttatccttccaaccccccactactcctttgttcctttacaacagatcacacacyacaatggctgttacattttaggccctaaggaatgttttggaagaggtcatttggtaggcatttttcttagtaagtagaaataaaaactagaggaagcttg

SEQ ID NO: 31569 - DNA, 201 bp, Bos taurus
aagcagagagagcaaagacagaaaaaaacaaaacaaaacaaaacaaaacacaacagaacagaatatctaagaactgtgagagagctaaggtgtaacatacmcattacaggaaatcatgggagactgttaggggattttgcccctctaatcatgatatgtgactatgacatctctatattcaagaaagtttcaaagtgagtg

SEQ ID NO: 31570 - DNA, 201 bp, Bos taurus
gattccctggggccagtggcacagactctgcaggtgttaaccagttaagtggggagaaacggacctgaacagcgtttcaacaatctcaaccacagctcaaytcggccaccccagtaagatgcaggctgacatcttactggttgtgcccacagagcacaacctccccaaccccagaagcaccagcagccaatgtaatgaatg

SEQ ID NO: 31571 - DNA, 201 bp, Bos taurus
agtccctcttccagtgacctgtttgtttgcaggctgagcatagcctgggggcctctttctggtgatcttgggctcaatggccagttgacttgcatctgtartatttccccttgttggtcttatccccagatgaatagttggattttcttggccccgttgggttgtcctgaagtcacaaagcatggcggatagcaatggcta

SEQ ID NO: 31572 - DNA, 201 bp, Bos taurus
tgtaccttgcctactcttacacattttaatttaacaatcagagctaaaaacattaactaagctccagacaagctcttcttccatttcttcattctttcctkctgctaaggaattctaggggatcatctagagggtgatctaggagatcatcgcttccttgcattagtatcaagctttacaaatccttctataatgtaacta

SEQ ID NO: 31573 - DNA, 201 bp, Bos taurus
ccatgggttaatatcagtgaacataacacacaaattttaaaggcctctggcagtacatttaaaagttacttcaaattaatatatgcacatggttaaaaaarttaaaaagtactgatgggtttatctctccaccctcacccctaacttccattgcctagaagataccaccattataacttcaacttttaggtattctggtgg

SEQ ID NO: 31574 - DNA, 201 bp, Bos taurus
cagaacgagaaaaaaatactgtatattaacacacatatgtggattctagaaaaattgttcagatgaacctattttcaggccagaaatagagacgtagatgragggaacaagagaccaaacatatggacacaaggaagggtgggataaattggggtattaggattgacatataaaatagatagctagtgggaagctgctctg

SEQ ID NO: 31575 - DNA, 201 bp, Bos taurus
cttagagtctgcctacttccttagcttgtggcccctttttcatcttcaaagtcagcaatgttacatcatcaaacctctcagattctggactccttctgccmcatataagggcctttctgattatattggagccacttagataatacaagataactttccatttcaagatccttaatcacatctgcaaattctgttatctga

SEQ ID NO: 31576 - DNA, 201 bp, Bos taurus
tcttcttgagcttgtgtacctctatagttaatttttcactatgaatgcttagaggcagtataagtgcctctaacagatggaaagaaaaaagtcctaagaaygagactaagaataaggagcctcctggttttgctcccacctcatcctgggtatttcaaaacatcacatttgtaaggtgagcaagttgaattaccaacatat

SEQ ID NO: 31577 - DNA, 201 bp, Bos taurus
tacctaaattgtattatttacttctcacaagaactcaatgtgctaaaaaattatttccattcgatagactagaataataaaactgggaaacattaaaaaawttttttaagttatccttggtcacaaagctaggaagaggatttcattcagtactcatgttctctttatttcaacattatgttctgatggcacagaggagat

SEQ ID NO: 31578 - DNA, 201 bp, Bos taurus
ctccaggggatcttcccaaccaagggatcaaattcacctctcgtatgtctcctgcattggcaggtgggttcttaaccattagcaccacctgggaagccccmaaaataggatacttggggttatatggagccattataaatagctctgtcaaagatggaactggtctttaataatttatagtatttatcttagcacaaacca

SEQ ID NO: 31579 - DNA, 201 bp, Bos taurus
tgaatagttatacataggcgcacactctatttttttttttttttccttttctggttaactctttggagttatcagccaaatatttctcttgcatgggaatrtgaaaattattataaaggattaataggaagtcatacaatatttgttaagtaccattctcattcagtgtgtttattttccctgagaacattattagtaact

SEQ ID NO: 31580 - DNA, 201 bp, Bos taurus
gaaggcagattctcagccactggaccaccagggaagtccctggtggggacttttcttttttcttttttttttttctgctgagtgcttactgatctcccttrttttgtttttcttggttgactgtgaagaaaaccagctcccctttacatctgtctagctgaaagccctgtcaggtaccaggtactctgtccaggcaatacg

SEQ ID NO: 31581 - DNA, 201 bp, Bos taurus
gaacaaatatagagaaactaataaatgtgagaagttatgagattatttactgctaagggtggggagagtgtgaatggcaaccctaggtgagggtataatgraagtttctacagtgctagatacatgagcatgctaatactgtggaaagagagatgtatattccacttcaattaaacaacagacaagaattgtaaatagttt

SEQ ID NO: 31582 - DNA, 201 bp, Bos taurus
gaacttctggtaatatataattattagaactttaagttttaacctaaacaagtgagttctctgtagcacccatacattgaagagtaaaagagcagtgtgtrtgtaaaaactgagctttttgtgattttgacaataagaattatttggaaaagaagaaacagatatgctacgaagaatctcatttggaaattcttggctttg

SEQ ID NO: 31583 - DNA, 201 bp, Bos taurus
atcttggttcctttgtgtctgatgacacagtggtcagaggagtgaatcccggctgccatttcggaatatactttggccaagctactgaactgcttggactyccccatagttagaaagcccactaactcaattggagcatcacctctcttggccacaccaaaacctggctcacaccaccaccaccttttggagaaacgagtt

SEQ ID NO: 31584 - DNA, 201 bp, Bos taurus
attgatttaaaatttatactatcaagcaaaaggcaatttttgtattatccccaggcagttacacattggtgagaaacacagccacataccaaatcctctcyattatacatactaactttcaatttgttagttcatttcatcatcggtcatctactctttcattcaggaaacgtaagctagcagtgcagttcgtttatggaa

SEQ ID NO: 31585 - DNA, 201 bp, Bos taurus
ggtttataatgccttgtatttcattctttcaccacttcagttactttagctatatgcatagggtaaagaatctgaaaactgccaaggcccaaagcaagggytgagtgaggttgggactgtaaatagtaaagccatagagaaaataaatgaatcgaaatttaaaggaaggcaaggccatggatatggactagatttcaaatt

SEQ ID NO: 31586 - DNA, 201 bp, Bos taurus
ttccccacaatagaaatttccagctgcactctcatggtatggttcactgttttcctgtgtcatctgtacgacccacaaattggcaggtggatcagaaagcytgaacatactcagattcaataccgtaaatttggacttggagccctcagaacagtgagaccaaaaaaagaaaaaagtatgttgtcttaagttacccaattt

SEQ ID NO: 31587 - DNA, 201 bp, Bos taurus
ggttgtttctattttgtaacagttcttatgttcagaaggattatgcagatatttcctggatgaattatttaattcagttaaccagttttgctgaatttccyaaggaagacatttccaactttggaacaattgtgcagaaatcgtatataggtcagataggctcttaacatactatgttgagctacacacaaatgaaaaaaa

SEQ ID NO: 31588 - DNA, 201 bp, Bos taurus
atgtatatattatctaacttaacccttaaaatagcttatagccttgtgaggttgtctttattattgttattgtgagaaagagtatttaatatctctgaaamcttagatgattctatgatggtcaaaatattactaggagacagagctagggtataaatttaagattttaaattccgaaatccatgcctttggggaaacatt

SEQ ID NO: 31589 - DNA, 201 bp, Bos taurus
ccctataaggaaaatgcccaccccacctccccccttctgtttcacctctcctttgatgacatattcacatcagcatttctttggtgcttttgctcttatartaggtaaaggcccaagaccttggaaagtttataatccttttcagaattagacattcaagtactcataaaatatactggcagacacaatctttctcaggtt

SEQ ID NO: 31590 - DNA, 201 bp, Bos taurus
cttacacctgaaacatggagataagcctgaaactttaaaaaaaaaagtgctttaaatgaagggaaaatgagccttttcttttgtggattaaaatagaaccyttcctcctccaccttcaattctaacacttcatccctgttatctcagggcagaaaatatgtagcatttcttcttttaatctattcctttatctttatttgt

SEQ ID NO: 31591 - DNA, 201 bp, Bos taurus
agatgaaagaggagggcagtgagttagtttgtcagagaaaccctgagaaaagactttgaaggagagtgaaggttgttagctctaattcataaggacctggkaatccagagagttctaaagactggcttggtgtggtgtttaatcaagaggaaaatgccatgataagaggcaggaaggacagactacaggaggtggtgccga

SEQ ID NO: 31592 - DNA, 201 bp, Bos taurus
cagaagaccaacttccctggaccacaagcttctgagcataagaaccatgacttctatggttctggggctggattcatttcccagcacgggccaggcatcartatattagtgcttgaataaatgaccccacataacctctttcaaacctatgaaattatttcccatttataaaaatttccagagacaccagacatgaagacg

SEQ ID NO: 31593 - DNA, 201 bp, Bos taurus
tttggagatctttaaagacatcaaaggattttaaagagattaaagggtctcttagttaaaatgaggtcattagggtgggccttaatcctgtagacctagtrtcctcataggaagaagacacagacacagaaggaagcagaaggaggaccacgtgaagatataagaagaagaaggcatctcccagccaaggagagaggcctc

SEQ ID NO: 31594 - DNA, 201 bp, Bos taurus
tagaaagtatgatctttgtaatgggccttattacatgttatcaggacaccaagacatagggcaaacagcataggatttggaatgaaaagatccagatttgygtcttgagtttctggtttactaactagattattattaaacttctcaaaaccatgctcttgtcagtatgatggtactgtaaagtggtctcctataagggtt

SEQ ID NO: 31595 - DNA, 201 bp, Bos taurus
aatactagattctctaactttttcccagacaagagtaaatataaacaacataaaatcaattctaccatttttgtgcctagcattgcatattatccctgatycttaaaaagtccacatagcctttgggttataacaactttaatacagtagtgcctgttaggggaaagttatgcccctaaaacaccattatttttaaaatat

SEQ ID NO: 31596 - DNA, 201 bp, Bos taurus
tagttagtgaaggctcttttactgttttaggatacttagcagtgtgatacccaccatagcgaaggagactctagctccttttgtttcacgtataaaagacraggggacttttgcaagtcttccctcagggtggcagctgaccctgtagtttgttcagctgccggtttactcctgatggggtctgattgaaggtggggagag

SEQ ID NO: 31597 - DNA, 201 bp, Bos taurus
aggctcaccttgggtggtctgttgtccacccccttgcggtgctgtgtgtaggcatccggagcttttgcacctccagtggtggcaagtctgtggcctctttktatcttgtccatacatgcagttacttggagtcccttatagtttctttgtattctattgtttagaggccgtttgtccacctgcgagcactcagatagaggg

SEQ ID NO: 31598 - DNA, 201 bp, Bos taurus
ttcccctgggttttgtgtgttcaggttattcttaactggcttactcttgggaggaaactgaggcaagccgggagctgctggtgcagagtcattgttgagarcctgggcttctattcattctctgggtgacagcgagctgcccacttaactcttgatcatttgttgccatcagatgctggagggatgtttgatttcaagtcc

SEQ ID NO: 31599 - DNA, 201 bp, Bos taurus
tcacggccatcttcctagcctgttggcattttccaccagccctatagtagtgatggtggccagcagcagtgcccaggactgggctgcccaccactctcccygccctgagagggagcgttctctatttggccagcctaagagtaggaaatgacaggaccttggatgcaggagagggagtgtaaatggtgtggtaatttgaaa

SEQ ID NO: 31600 - DNA, 201 bp, Bos taurus
ctcttgctttcctccccttcccttcctccctcccctcgcactcactcagcccaggtcatttttccagactgactcccagatcaccagccttctccagctcyctggggcctgcccagccccctcttcctcctcagcctcaagtcagggcactgctcttagatctgtagtttcttagatctgtgggtggatgttttttcacca

SEQ ID NO: 31601 - DNA, 201 bp, Bos taurus
actgaaaatctcaggccatggccaggcccctccctggtagtgacactgaagtgaaccaaaaaagacttgatgtctgtgtccaggtgaataaattaattagygttaagtttggccacgtttagcagagatccaaaataacagtggcttcaccaagacagagccgacgtctctcacacactcagcacaagtccagggataggt

SEQ ID NO: 31602 - DNA, 201 bp, Bos taurus
ctccccatgagtcagctgcttccaccatgccgaatttcttgtggtttccataaggcaccacgtgtttagatgctgcaaggatgttgcacatccttcactcrattcaaatatcttttcttgtgttttctacctgttgttctcacattgctctcaagatacttgtccttattgatggagctcttccaggctaccagtgtgccc

SEQ ID NO: 31603 - DNA, 201 bp, Bos taurus
tctttgcctgattgtcctccacaagcactgtgggcttgacttcagaggaggatattcataaaaaatgaaaagtaacctcttcaatattaagaataaattaktgacacagtggaaaagtaaaacctaatttctaatctagttcctagatttcctactgagaaataatcaaaacattgttgaaaacatcctctatcactgagt

SEQ ID NO: 31604 - DNA, 201 bp, Bos taurus
tgggtctcagcccctcggttctgacttcctgctgtacccattagggcaacatggcagtgacagtgacctatggtggcgaccctgtccccaagagccccttygtggtgaacgtggcaccgcctctggacctcagcaaggtcaaggttcaaggcctcaacagcagtaagtggggaggagctgcccatgcagtgaggagggttg

SEQ ID NO: 31605 - DNA, 201 bp, Bos taurus
ttggcactagacacacgagacacatggacactccttttgggggcgtccattctagtggagaaacataagagcaagagagggccaagttccagaatgaaacrgcatgatgggcgaggaggcaggggcgtgtggcgctttgggatggattgtcaggaaaggcctcaggacctaaaggccgagtgagctaactgacaaggggga

SEQ ID NO: 31606 - DNA, 201 bp, Bos taurus
atgtcatagtctctgtgccgctggcaccacgctgactcctccaccgatggggaggactcaggctggccggagaggcgaacacactgcaaggcagggccccrggaggcagcccccctcccagcccagctgttccctcagactgggctgagcaagaggtaaggtcccacctggctgtccccaaacccttagcaccccaactta

SEQ ID NO: 31607 - DNA, 201 bp, Bos taurus
tttagtaacaggttcaccatgccctcaatgtttaccacggagggaaaaacacaacaaacaaaaatcaccaatcagaatttttaacaagagaagggccagcmgcaatagactctatcacaaagagaaaacaatgatgaagctatttcccaaacagcctgaaagatttttctctcccagaaatagcagcctaaacaatttttg

SEQ ID NO: 31608 - DNA, 201 bp, Bos taurus
aggccaaacttcttgatatgagctcccaaagtagagattctgatttaatatgttagctcaagttgctagaaatggctcttagagtttgtttggttacttarctgaaatacagaacttaagatggcccaggactgaagttcctgaatggactgactgaattttcccttgtgaactatagagcagggcttctccaccttggcg

SEQ ID NO: 31609 - DNA, 201 bp, Bos taurus
attgccagtgactggctgcatgtgtatgtgggtggacattgctaagggacaagcttgccaaaggtgagagagagacaaacctccagacagactcacaagtrggaactctggaggtttccctagcacagcccaggtttctcaggttctggctcactggtgtgtactgtatgtgtcccaaacacctgggtccttgtaggcctc

SEQ ID NO: 31610 - DNA, 201 bp, Bos taurus
gtaaaagccctgttgcttgtttattaagttatgcaacaaatggctaagactgttagatataaagtatgaggtaagaattccatccaggtcttttgagattkcaagattcagaacaagggatccaaggggttggggaaaaagagatctggactgaggcaggagaggaaagaggctgacattgggactggagagagaagagga

SEQ ID NO: 31611 - DNA, 201 bp, Bos taurus
agacttcctgctgctgccctttctggtggccctttttgcccaatgcttttgaaaagttctgtgtcattgtcagacctctgtatagcaaattgcctgttgcraatggatgctgaacaggccacaggggcttcatctttgtggaaagaaggaagtggctggagggtagacttaagaggctacccttccaggcactgcagccta

SEQ ID NO: 31612 - DNA, 201 bp, Bos taurus
agcttaaaactcatttcaagtctcctccgtgtaaccctgttacaacttgtccccacagaagcagtcagtagggctccaatagccagcagtggccaggatgrtaagattgcatctcctacactgctgtcattcccttgggattctctgcacactccctctgacagcaggccccctggggaaacaccaacacgcccccacctg

SEQ ID NO: 31613 - DNA, 201 bp, Bos taurus
caattctgacctggagccacctcctcctccccagcccagttcctcaggagctttgtttatctactgcagagctgtctgccaaagacagccgagggcttctrctatgactctggccctttgcactttccccctgcagagcaggaccctgggggacaatcctggttacccaagtgggcaactctggaatatgtgggggcttga

SEQ ID NO: 31614 - DNA, 201 bp, Bos taurus
ttctgttatttcctttgtttgaagtggtgtttttttttaaatttttattgaaactgagttttcctctgctctctttttgagatgtggcaaatttataaacycaggcctcagaattagaagaaaaaaatcataaagcaatagtacctaaactttagtgagtgtcagggtctagagaatttgttaggccaaggactactgggc

SEQ ID NO: 31615 - DNA, 201 bp, Bos taurus
attttctcaggttctagaggctggaagtctgagaacagagtgccagcatggtcaggctctggtgacctctcttgctggcttgtggatggccaacttctcaytgcatcctctcatgttggagagagagatagaaaggaaggggcaagctctctggttttctggtttctctttttaagggtactaatcccattatgagggccc

SEQ ID NO: 31616 - DNA, 201 bp, Bos taurus
cttctgacgtagatgcatgtgtgtctggaaagtatggaaaagcatgcccttgggacccctccctaactcctgaaagaaagagggccaaacacactgcacayagactaattcaaggagtcttggactccctgatcgtggaactcagaaccaacaccctacacggaggccagtcttgattaacagggctttctttgtggctca

SEQ ID NO: 31617 - DNA, 201 bp, Bos taurus
gcctcttagtttcgtcatgagagatgatacgtcttagccagctccatgcgtgaagcaatattaagcatgttgcacctcttgcacatcctccgttgtgggtrggaggtagataactctggttttacagtgagacagatgaagatcagccttcaaattgacttgacatactttctagttcagagctccataccaggcaccaga

SEQ ID NO: 31618 - DNA, 201 bp, Bos taurus
acgtggtccagatgcctcaaggtgtcccgggaagcctccaggattcacctgaagcccttggagccctgctggcgagactgccctccttccaggggcctccygtctcttctaacaggcatgggttttcctgtctctgggtccccgttcaggcagcttcctctctgtggaagggccggcccatcctctccatctcagaaagca

SEQ ID NO: 31619 - DNA, 201 bp, Bos taurus
aagtgaaactaacgcattctcctgcctgaggcttgccaggtctaggggacattttcaaggactgaacagtctttttactttgtttccttaccctctgcccrcatctctgatccaaccaggcccctacaagatggttgttctgaggagctagcctgccagcttctcggtcagccggcttcagaatcaagtctcttcctagtc

SEQ ID NO: 31620 - DNA, 201 bp, Bos taurus
cttctccaggccaagttcaaacccacgtggggactatggaaagacggaaggtggggtaacagcatagaagcacccccatccatggctcctcattcgtatcygggccctgctgctgctgctcagggtcagctgggaaagagggcccctctgctgtcttcaggtcaggccccttggcggggtgaggacaggccatcctggact

SEQ ID NO: 31621 - DNA, 201 bp, Bos taurus
gcacctcatttcaccccctaaggctctgcagccaccaaactctgcctgccccggcccctagtccaatctttgcatcagcctctctcctcagacccatcacrggaagctttaggagggggtgagctagagggatgaaggaggtgcccaccaggctggttagaactggctgagtcaacccttctgatccacagggaaccaact

SEQ ID NO: 31622 - DNA, 201 bp, Bos taurus
tagtgtggctgattgcacttcatggtgttgttggtaatttttaaaaaaaatataagctgtgaaatactctttcctctaaatctcagatcggccctccagcyttatgttccttctgaaggaagagagctgaagattacttgaatgtgtcatggcaagacacctccgcgtctccctgagaagagagtgccaaagccaccctgg

SEQ ID NO: 31623 - DNA, 201 bp, Bos taurus
tggaagacagtcttggcctgggccggagtgaggcccagggtcaggtgtgttttccatgcctagattcctcccagtgtgatactcttttggggcaggccctmcagacagatggctctgggcaggtcaatggtcaaagcaaggctcacacatccttcataaggatgctgcctcatgggctcactgcagactctcagatcccca

SEQ ID NO: 31624 - DNA, 201 bp, Bos taurus
cccagacccaaggggccagcgatgcccattcctccagcaaagtggaccgtgccacacgtcacaggctcacctccctgccttgaatcccagggcttcgaatkcgagcagggcccctgcttctgcattcaccctgcttaagccgccccagaatagcacagtgagggtgctttgttttgatttcctgattctagccaggagaaa

SEQ ID NO: 31625 - DNA, 201 bp, Bos taurus
ggccgggttgtgagaatatttttcaagaaagagtgacccaacatattcagaatttggtaagttctttcaggctaactttattttgaatgtttctcagggtmcctaaattgagattatataaaggccactaaggcattacttcagccttagtgaagtaattatttattatacttatttattactctaacctcatattaaaag

SEQ ID NO: 31626 - DNA, 201 bp, Bos taurus
ggcctgagcatcggcatcacacaggcataaaggaaccctccgtgagcacgtgtgacatgaatgaatgaatccatccaccacagatttttcctttggcttcsatgtggctttgaggagaccagctcgtcttgctctgcctcttactatccctcttccccataacatcagaaaaatcattcctgccgttaaggaatttatgag

SEQ ID NO: 31627 - DNA, 201 bp, Bos taurus
ctaagtgcccatgacctggaagatacaggaagacccagaggtggggaccacgatgatgagggcacgtactgtcaccagagcagggccagcaggcttaggaygggagtcgaaggagagggcgggagggcaaagtggggttagcaagagccaggagaaagccaagggctctgtgggcggaaggctggaggccagcccacggga

SEQ ID NO: 31628 - DNA, 201 bp, Bos taurus
tctggagggaactgtcaacagtccctgttttggaacctgccgagcaccaggaaagcgtgcctgccacagccctgccttactgtacccactcacgggcccayaagccaatcaacagctctctggtttgcaagaggcgagatgaggaagcctgtaattataaatttactgagcagaaaggtgccaggcctcattccccatctt

SEQ ID NO: 31629 - DNA, 201 bp, Bos taurus
cctgatcctgaccctccctgcactgccaggcagcggggaggcccaaggtctcaagagaagacacaggaggaagagaccggaaacagaagacggccatttcycctccactcggtgccgtaaggacgtccgcccatcaccagcttcgaggaatctcctcagccctctgcagcttctggagaacaagacagcgcctgagggtcg

SEQ ID NO: 31630 - DNA, 201 bp, Bos taurus
aagattctttaccatctgggccacctgggaagccctacaatccacatataaggataacctattcagaatatagataaattcagtgtatctattcacattcmgaaaacaatgtattggccagtgcattgttttcagtttcagaaaagttagtaaaatagcacataaaagtaaaatacaagtaggctacaaaagtcactatct

SEQ ID NO: 31631 - DNA, 201 bp, Bos taurus
tgtgctacagcttaatttttaaaatagtctacctgggaaatgctttcccgaaacaaacaagcaaacaatcccccaaactacaggtgtgggccatcattacrttttctgacttttgtgcctttaatgtgtttcaagtctctctgaggtgcatgatacgtgtgatttgtttgagtttcagccattatggcctttacatataat

SEQ ID NO: 31632 - DNA, 201 bp, Bos taurus
gatattaataatgatgaatcattaatttgtaatgaatcattatggagttacattaagacctgcggagtcttctccaacaagtggaaatgtatgaatagatktttcaaaaagcatcacagatgggcatataggaaattatattaagtatatggttgtatgggacctttgtcttattaaatattattttgaaataactaaatc

SEQ ID NO: 31633 - DNA, 201 bp, Bos taurus
atgaaatgactatggcttcctttttgcttgtttcaaacctgactgctctccaatcattacacgtctctcatgattcccaagagatttcagctgctaatgtrttgtgttggccaaaaagttcattagaatttttccataaggtgctatagaaaatcccaaaggaactttttggccagcccagtgattgcacacttcaattca

SEQ ID NO: 31634 - DNA, 201 bp, Bos taurus
ttttttgttttttttcagtgcagattgagtgacacaatgcgtggttaaaaaaaaaaaagaaagagaaaggacaaatagcaaatgtaggccatctctgaccrggcacattgttgttcagtacacaggcacccaggaagccagccagccagaaaaactgttgagagtctctgtggtgtaattgaaaagttccaggccttgggc

SEQ ID NO: 31635 - DNA, 201 bp, Bos taurus
ccaggcaagaatactggagtgggttggaacgacagcattaggtaccaattacatggggaactgcctatggatgctgtgttcctggaggcagggcccaggtragacagaagagtcctgttctcagggtgtggggacaccagagcggggaccccactctggctgggcagagactaaacaggcctggaaagcacttctgttact

SEQ ID NO: 31636 - DNA, 201 bp, Bos taurus
gaataagatgggtcatcaatggtgtgaggccatatccaggaaccaggaaatctgaagatcctgttgaatagaagactagtgacaaggtgctgacaacagaraggcctcggtaaatgaggcagtgtctctgccctcagccaaaagtgtggagcgaatcccagcatgtcaggcctgggtctgtgaggaggctgaggtaatcga

SEQ ID NO: 31637 - DNA, 201 bp, Bos taurus
tagatttgcccccttcggattcaaatagcctaaaaacataataaggacaatttttatttttgtctctgagcttttccttttgagatacatcaggaaatgamagggctcagagagagatagaggaaaaaacactacctgagtagcttaagtatctatgcagcctcaatgccatttaaatcctggctaaatttaatgttttcc

SEQ ID NO: 31638 - DNA, 201 bp, Bos taurus
ttggctgacctgccccctgaaatagctatgattatccccataatggagtcaagccactgaggcccaaagggctactgaggggcagggttggacttggcccyagttttccttatgcctcacttgctgctctgtggacagcgttgcggtagtgtggtcatacctgatgacaatggcagtgctgctatgatgaagccagttacc

SEQ ID NO: 31639 - DNA, 201 bp, Bos taurus
atttgtctttctctttttgatttacttcacttagtatgacaatctttaggcccatccatgttgctgcaaatggcatactttcattcctttttatgactcargagtattccaccgtaatatatgcaccacatctttattcatctgttggtggacatttcggctgtttccatgtcttggctactgtaaacagtgaacagaggg

SEQ ID NO: 31640 - DNA, 201 bp, Bos taurus
agctgattctcatatctgcttccacattcaatttattttgacatactcttttggctgaaatatatgaagaaaaatttggcctcctgaagatatgtagtttyaacaagtaaaaaaaattttaagtctttttagttgattatggatattcttcttgacattataataaatatccatgcagcatgattctgtaatctcctgaac

SEQ ID NO: 31641 - DNA, 201 bp, Bos taurus
aactctgccttgacacacaggtaaaaagatgaacacatggctggtttctgactaacaaaattcaaaggacaaatcacgtaagttgtgaggggctagtgtgraatttgaacacttgtcgatactgatttgctggccttaagctggactattctgagtaactactgattcgctcaatcataaagagcccgaggacaatggatt

SEQ ID NO: 31642 - DNA, 201 bp, Bos taurus
ctccaatattcttgcctggagaatcccatggactgagaagcctggcgggctaccgtccgtagggtggaaaaagttggacacgactgaagtgactgagcatkcaaacacgcacgcaggcatcgtgttggcaacttaccttaaatgtttctggaaaaatcatactgtattttcaacttctctttaagtttaagatagtttcaa

SEQ ID NO: 31643 - DNA, 201 bp, Bos taurus
gcttatattcggttgaagaagatacacaaactggccaaaatttaaataaaaatcagtcagatatatttttgaggatgcacagaaccctttgggagcacagmagagtggcctttcaactgtcctcctggaatactccaggggtgggctgtgttgttggtgatgagaggttatgctggggagaaaaagctatagattgaattg

SEQ ID NO: 31644 - DNA, 201 bp, Bos taurus
gatggacccagaagagaacccccctccctcccctccgctgggttgctcacctctccagccaaatgtcccacttctgtctcaggctctctgcctcggtgggyggcggtcccctccctgcagttccacagtttctctttgcctttgtgcttttgcacaggtggctctctccttcttgcaagcattcctttgtactgtctggct

SEQ ID NO: 31645 - DNA, 201 bp, Bos taurus
agggccccaaacagcaaggtgacatgaacgcaggccgtaacaagtggccagggcgcaggaaaacagaacagacaaatcccaggctcttaattggcactgtragcagggggctcacttcacaacgcagcacaccctatgccgtgtttaatcatttgttcagctggctgtggaggtggcctgtatccagcacagcacccatga

SEQ ID NO: 31646 - DNA, 201 bp, Bos taurus
cccaaaatgaatttttaaaaggcccctcgtgatctctcaacctggtttcatcctctcattcaagctttcttcattccacatctaccggctaagtttctctsttgtgtacaggccatgctctatcctcaggtttttgaccaagactaaacaactctctccaggttttcctttgttaatttctatttatctgttgaataaatc

SEQ ID NO: 31647 - DNA, 201 bp, Bos taurus
acccccttttctctgccagaggaactgattatcttttcctttctgctaaaacaatgtgactatatgacataatcgactcttcacccgtctacagcaaattrtggatcatttaatggcaaatttagaaccaggtcctggacctcagatatgagtgtcaaaatcttcaagttccaactaagtatttgaaataaatgaaaccat

SEQ ID NO: 31648 - DNA, 201 bp, Bos taurus
tagcatggtcctagcagtacgacctcaaggcctctcaagtatgtacatttgcccctgctctgcacagagaccacaactgtgccaatgggctgaggtagggmaagtgtataaactgtacccaggtaagggtgaatcagttacgggtgccaatgactatttccaggagaccaacctcaaaatttgcatccctccagtcataac

SEQ ID NO: 31649 - DNA, 201 bp, Bos taurus
gtagaaataccagcatcaacttacaaaaacagtttggcatccattcttggtattactgctagttcccatatctaccgtgcaattgcgatatatgaatactyaagtctatttgtagaacaatcacatttggcttttttttttttccttgaaattaaccagtggatttttttaaggggtttaagataacattcatttcatcta

SEQ ID NO: 31650 - DNA, 201 bp, Bos taurus
atatcaataaggcactgtttctatgggccagctgcatgagacatggaaatagctttgtttcataacactctctttgtattttttggttgttgttataatgraattttgttgtatatggccctgaattctactaagtgcttcagacttgaagagtttggttgcaagacttattcctttactttccctgtgctatgacaatag

SEQ ID NO: 31651 - DNA, 201 bp, Bos taurus
caccggcattcaggtggcctgtcacacgtccgggttctttgactccacctctcaaatcagaatctctggagatgggccccaggcatctggatgctaaaacrtgactctagtcattctgataaacactgaggatcggaaatcactaccctgggtgatctggccattcactgcatagacactggagattaggtttgatgtgag

SEQ ID NO: 31652 - DNA, 201 bp, Bos taurus
attcatatattctaaagacagagagctaagagtaactataaagggacatgtacactgacacagacatagggagccctgcttgctaaagtagcatgatgtayggaacaatttcctagggaatttgttagaaattgtttcaaaaggggagatttgcactggcaaaaaatgatgggaggaaagttttatttagagaagacacac

SEQ ID NO: 31653 - DNA, 201 bp, Bos taurus
ggctacgtctgttttcaattagtttcaaactggtttttacttttgtgtttaggccctagaatcatatgaatcatcatggccgttcaaacaggcagagtaarctgaagccagaagtagagtttagtcagcttaccagagacagagttagatcttggccagtatcaagttattctaaataccaacctatatgccatgtgtcaa

SEQ ID NO: 31654 - DNA, 201 bp, Bos taurus
aagtgtcttctagaaaacttaaaattaaagactgcagcttacataatagttctcctgaacaccaatggtctctactaatacagtgctacagctgtgaagamccttagggatccaaatgtgtctgttttcagacttagaacatctcagaaggggttaaggaacttgccaaaaccacagcaacggtggcacaagcatctcttc

SEQ ID NO: 31655 - DNA, 201 bp, Bos taurus
ttccaaagaagagcttggtgaccaacggctgcagcatattttctttccaggcactgggcaaacaacaaaattaatcaaacttttttcccggtctcaccctycacacaacctaggtggccaaaacttccctgcctccctctattgtcaaaaatgcatactggtcagctcatcccagtgcttgacccaaaggagtcacatgaa

SEQ ID NO: 31656 - DNA, 201 bp, Bos taurus
tgttctctttgagtcatctgcattcatgagctccccagcatcctcgtggtgggaggcgtctctggcagagagcggaggcctcagaggctccacagagatgrcatcttcgcatcagcacccaaacagcttgcaaggctggcttgggcttctgagcctcgctaccacactcccagctctctctctgtgagcgcgcacccgccc

SEQ ID NO: 31657 - DNA, 201 bp, Bos taurus
cccaaagagtcggacacaactgagcgactgaactgaactgactgacaggcattttaccacaaaactagtctggcacgttcctaaagggtcacgggcctccrgcaggaggaactgtgtgaacccaactgcatgcattctctccaggttcctgacaactgacaacacataatcacgaaacattgggtagggaaaggaggacag

SEQ ID NO: 31658 - DNA, 201 bp, Bos taurus
catatttgggtaaatctactttggactttctactttgtttcattgatttatgtatcttttccttcactgacacgacattgtctagatacttttaactttayaaaaggccttaaaatcatatggtgtaatttctccaaccttattcttttccaaaagtgccttagttattcttatttatttaattcctaccataaatgttag

SEQ ID NO: 31659 - DNA, 201 bp, Bos taurus
gctactcttgctgttcccacagacccatccaaacctttcaagggtgatgtgtgtatctaacttagagggcttaatgggatctataacctgaaatgcttcarcctgctgcagtgtccacttagtagctcagaatgcttgttctatggtatccaaccattcggggccacccactttcttgtaagtgagtatataaggggcaca

SEQ ID NO: 31660 - DNA, 201 bp, Bos taurus
gggcaagccagctctctaaggttctttttaaaggggcattaatcccatgcaggagaaccccaatctcatgaactaatcacctcccaaaggccccatctccyaataccatcatccagggcattaggtttttgtggggttttgttgcctttttttcttttttgctgcactgggccttcgttgtagcacacaggctttttattg

SEQ ID NO: 31661 - DNA, 201 bp, Bos taurus
tggaagagtaagcaaatatttctgttttcactggttgagcaactagcttttttctcaaattttgtactgttataagcaatatatgcaatatagggaataawtatactttggagatgatgaaatcaaatattcttttaaaaactgacaagttatcaagtcatgcaaagacatagaggaaccttaaatgcacattagcaagtg

SEQ ID NO: 31662 - DNA, 201 bp, Bos taurus
cccacaggtgatcgccaggcggggtcgcccccttcctgccgcccggagtcttccacagggttccccgccaccggcagcacgcccacctcttcctgggctcratgaacacggagggcacgctggccgtggggtccaggatcttgtcgatctgcatctgcgccctgcggtacacgcggtgccgctcccgcgtgtcgcccgatg

SEQ ID NO: 31663 - DNA, 201 bp, Bos taurus
gaccagagtgggctgcaggacagccagtggggtcactaggtaaagactgggtgattcaggtatctcccacccctctcccttcccatgtcacacccaggccragtcagaagggctagcagccccagcttcaccccaggaagctgaagaactgctccctgaggaagatgagctcctggtctgagagggcccaagacctgttgt

SEQ ID NO: 31664 - DNA, 201 bp, Bos taurus
ttgcagcccatctagattctctgagatctggagttgaacagtggacactgcacccaacgctggcctccagattctcgctctcatcagcagctgaccccagkaaaatgctgaaactattttgagggccattttcagcatctttgagcagctcagctgctctcttaactttgaaagctgactagggcctcactgttctttttg

SEQ ID NO: 31665 - DNA, 201 bp, Bos taurus
aacagttatggctttatatgaggctcagtccacattcatgttccaaccaagctatatacactccactaaaaaaaaccctttgacttcctggtaaccgtaawacttgctcttactatctgttgagctttaattgtgtactgggcaacatgaagagtactttgtatcagagaattgtgtgtcatattaagaaacattgtaaga

SEQ ID NO: 31666 - DNA, 201 bp, Bos taurus
ctttgccacaagaaagtggcagagctggaatgtgaacccaggtgaagtggtttacaatgcggactgagaggtgtttatggacggaaaaagaaggattcacmcagcgtacttgccatgggcgccaccatgcagctcaagggcatcaaccttacaacacgcagcccctggggacggcagagctgacccagatggggttcagcc

SEQ ID NO: 31667 - DNA, 201 bp, Bos taurus
tcgctgagtggtggggggctgggcatggcctggcgtctcccttcattagcctcagtgaagcctgtcattccaggccttatttcacccacctggggcctggyagtttctgggtttggtgggcggtgtgtgggcacctcaagctgatttagaaagcccatggcacccagcatggtggcctaaagggcacagtcagagcccagt

SEQ ID NO: 31668 - DNA, 201 bp, Bos taurus
ccgtagcccgccaggctcctctggccatgggattctccaggcaagaatactggaatgggttgccatgtccttctccaggggatcttcccaaaccaaggatygaacccaggtaggccacatgctactctttttaatttaaaaagccctctacaaagcaggggagtctggtactggccagcctggccgccctctgggtcagcg

SEQ ID NO: 31669 - DNA, 201 bp, Bos taurus
gaaaagttttcattggttaacacttagcttccactggcccgtagtgagttctcagaaatgcttctcagggctggactgaaccagcacgaggctggagagcmagtatgctgtactgcgtggggccccctgatgcccagctcttggcaagtgaatggtaccaaagtcaaggctcgtccttgggttatttcccttcttatggca

SEQ ID NO: 31670 - DNA, 201 bp, Bos taurus
caaggcagggttgtcacaaactttcaatttgtaaaaaccacactatctgtgaagtacaatcaatcatggtatgttggtatttacagtcttagttgaaaatracacatttgtgatttaacattatgatatactgttctgcatttttgtaaaaagatttttattaattcttataatttgtctatagctcacttattcattcat

SEQ ID NO: 31671 - DNA, 201 bp, Bos taurus
ccctagcctgcccaatactcagtgcgtgttatctccaaggcctgaaatgaaccagtgctcaggctgggcctatgcgtccctgtcctgtgatgctggcctcrgctgaagctgggacgctcttagtccttaaactcgaagacttacaatcccgagggatgacacacagaaacccttacagaaacacacggatcaatcagaaca

SEQ ID NO: 31672 - DNA, 201 bp, Bos taurus
gccctgggaccagggttagagtctcagatgttgcccaggcaacaggaaggaagctggggaaagtcagcccttgtggatgctgtttgggaagcagattgagyagggccagggtggaaagaggggggcaagggccatcctctcagccaatcctatgcaagcaggctggcagtatgtggggctttgcctccctgagtctcaaga

SEQ ID NO: 31673 - DNA, 201 bp, Bos taurus
tccccacctggtctacagctgaggtcttggccccagggccctctgcacctatgatcccacaaaaccactccagccagttggtcccgtcgctttgggggcckcctagtgtgacactggcacctggagggaccccagcctgtccccaccctaaggttaagtcccccttgagaagcctcactgctgtgcagggggaaaggcagt

SEQ ID NO: 31674 - DNA, 201 bp, Bos taurus
gctactgtgtcattctgacaaaaacaaatccaggtgccacaaagaccctgaaatgtcaaaccactgaagagacagaaattgttgcaaattaaaactaatcyataaaatagtgtctgggaactctgtgcctgatgccaatctgcagcaaagtcaacaacgagtaaaaaataaaactttaacacccaagtaaaaagcaataat

SEQ ID NO: 31675 - DNA, 201 bp, Bos taurus
atccaatcttgccataaatacagaggaatgtgctgaggctgtgagtagttactcacactgctgggcaggcaaggtcaccattaaaacagagaggaacccakaggcccctagcatggtcaacaccgtcagaatggctgagcctgatgggatccagttcctggatggcaccgtcattggcaacaggacatcagtatgagaact

SEQ ID NO: 31676 - DNA, 201 bp, Bos taurus
gaaattctctcagccaaaggtcaccaagaggctaaataaccaaaatgggcttcatccacagatgcttcttaaactacaactaggccactcatccaaactcrgcacagtcctgcacaaaggaggaggggaggctttctcagaaggcagcagacacaggcctgtgcaatccggcagcccggcggggtcagtggctggtcagcc

SEQ ID NO: 31677 - DNA, 201 bp, Bos taurus
cagtatctatttccaagtctctggtgcacctggccccattgtggttggtgagcaacattgctcatagaaagcatgcatcctctacagaacagtttggggayggaaagacatcacggccaaccaacccatctttgcttgtgaagaccaccgcgtcccagctcgacaatggatgagagacacgtttactctccacgtcactgg

SEQ ID NO: 31678 - DNA, 201 bp, Bos taurus
gttggtgtgcctgggagtctgagtgggctgagaacaatgaatctagtcctgtccacagagaccccagaccaacttcagggcctcatgcacacacctgagcrggcattagcccctgatgctgctttgctggtggctcccaggtgtgcctacagggaggaggccagcatgaacttgaagccaactacttacttcatcatgtag

SEQ ID NO: 31679 - DNA, 201 bp, Bos taurus
gtgagacagaaaaagggctccactgtgagcctgttggtctgtcggcccctctccctgctgggctgagcgggtcaagactggaaagatgtggaggaacgggkacttatgcaggaggagcagctggcctgcacttccgcgtgaagtccggacttctgtctccttccccttttgggtgtctgggccctctctcctgcatagcag

SEQ ID NO: 31680 - DNA, 201 bp, Bos taurus
attcctgaccatgctccaggtggggctggtcatccagggaagcagatactgtgtgtgaatcaagagcaagcatttatgtttacagaggtcaccgttacacmccttggtcctgccttcctgctcgaaggtggagtttgcaaggagggactctagaggggtctggaggacccatctgtgtcagcgagtcttgttagcaccaac

SEQ ID NO: 31681 - DNA, 201 bp, Bos taurus
aataaatacaatttaaggggaaaatatataaataaagaatgccagtggaaaagggttttctgcagggtgtctctatgacttgatggtggttccggtggtcyggaggcagcagaagacctgtctccatgagcatcactgactgcaggctgacacttgctgcgtcaagggtgttgcaccaccgattgggctgcggcccctaga

SEQ ID NO: 31682 - DNA, 201 bp, Bos taurus
tgtgtgagagagagacagagaggacggagcgagagtgcgtgtcagagagagggaggctgtacctctcttgaccctgaagccctggtcctcacatcatctayggagccaacaaccataatcttcaaaccgtagctccaatgaaaataacattctttatgcccctacagtcttctctgattcttcctacagatgctcaacccc

SEQ ID NO: 31683 - DNA, 201 bp, Bos taurus
ccagaattagagaagctgcctgtgcaatagaggttctgagagaaaatatctacatacctctgatttcctcatgtgccagaggccttacttcatattcaatraacagtcatgataggaactgacaattggagctcagaggctaataggcagtaactgggtcagtggtggcctgggcagctggcagcacagttctcatggaga

SEQ ID NO: 31684 - DNA, 201 bp, Bos taurus
ggacatggcatggggtaccaagaaggaggtggccaggtcctggggcagggagagaggaaggaggcagctgctggcacagaatgaccatcagagaagcatcyttgaggccacttgctcaccgtactcatagtatccctaggaatcccaaactcctttgaaaggaatagaaatgaacctcgctttgcacacagcgagtgtaac

SEQ ID NO: 31685 - DNA, 201 bp, Bos taurus
gagtggtgacttagacgaatgtgaggctctgctgagggctgtggagacatgaagctgcatggagattgaggaacacagagagggcaattggtctgtggccygcagaagggaatagaagctttcagccgaggtctcttcccggggcatcatttcaccccttgtgtctctgaatatgtcagtgacttcattaggcttcttggg

SEQ ID NO: 31686 - DNA, 201 bp, Bos taurus
tggcccctctgtgattcctatatcacttacagttggagggctgggaacctaagacctggttctgaacaatgggaggcgtgtaagccaattatgtaagtcamtttccagccttggcccttataattttctatggcattgtgatgggattccccaagtatcctcccatttggagatttcctataaaggctcgtcagatatgac

SEQ ID NO: 31687 - DNA, 201 bp, Bos taurus
cagaaagaccgctgtgtttgcttggaagggcacacagacttcctcgatgtggggtgtgggttccttagaggttgtttctatgctgtgtgagccccagtctraacttagggccaccttgggtcagtgtccccaggccatggggtgactcctaaaccccagcctagactgatcctacctcccctgcctactgaacctcttttt

SEQ ID NO: 31688 - DNA, 201 bp, Bos taurus
aggattcagaagaatgaaaaatctgcctagccatgtggactgccatggagaagagcactacagaacgtgagtttaggcaatgtaaggccactagaaatgarccaagtcattctaacaggggacagaggctcttacctctctacctgagcagatggtggcccaaaacatgagccggccccctctgccccctaccttcacccc

SEQ ID NO: 31689 - DNA, 201 bp, Bos taurus
agcacattcttctaaagagggcagattaggaggctttgcccaagtggtgaccaagagcatgcggtcgctcacaaaacctctgggtgatcctagagcaggtrctcctgaaggccagggcagaacccacagcaacagactggggacaccttgaatcctcagcatgtatattccttagcactgctaagaaccacacacctgatg

SEQ ID NO: 31690 - DNA, 201 bp, Bos taurus
ttgatccctggtctgggaagatcccacacgctgtggagcaactaagtccttgggccacaactattaagcctgtgctctagagcctgcgagtgatgacttcygaagcccatgtacccttgagcttgtgctctgaaacaagagaagcccctcacaaagagaaacacgtgcactgcagctagagagaagcccagcccaacacaa

SEQ ID NO: 31691 - DNA, 201 bp, Bos taurus
ttatcctttctctgccctcctccagttagcttctagtttttgttgttgttgctttgttttgctactagttctgtgccctgtttggccaagggttaatggcraagctagaaatgggtccaaaggggcttctaacccgagtgcagtccactccctgcttcctaggacataagtggggaggccagtcagtggcagccccaaaga

SEQ ID NO: 31692 - DNA, 201 bp, Bos taurus
cagggagagagtcaccccccgtggtagtttgaatcacttttatgaggcatttcttccaggtttcctttggtcaatcatcttgctggcctggtcctgagttygtatttgatgtctctgtggatcctcatccacatcttttagccaagacggattgtagtgaagaggcctatgggtagttgacatcacttactatgaggtgac

SEQ ID NO: 31693 - DNA, 201 bp, Bos taurus
taagtcagtcacacagtaaatcactgtgacttgaaggtgtctgtcgcttggaaatgaggctctttttcggaaacatagtctggccaggaaaagatatcctrcaggttcaagagcttcaggctgctctgctgaggtgaccttttggggttaagaggatacagtgggctaggaccctttgggggcagtgacagaggagtcccc

SEQ ID NO: 31694 - DNA, 201 bp, Bos taurus
ggaagcagtatcttcctgcgttgggatcttttccatgccccagttaaggaaaccaagtctctcactcaaaaggagcagagaaaagttctggccggatgttycctgctactcttagatacaactggctgctgggctgctagatgaggaagctgaaatgcctttttctctagagtcttctcacctccaggcctcaacatttgc

SEQ ID NO: 31695 - DNA, 201 bp, Bos taurus
acttgtggatccttgttacaaataagtttattaatatctgttcagatattttatctgcctgcaatgcaggagacctgagttcaattattttcagaactacytggggactcatattcatgttgattatcttcagtaatttggcaggttacttatttcacgtagatagtcaagtttcaaaattctgaaatcttcttaatctgg

SEQ ID NO: 31696 - DNA, 201 bp, Bos taurus
acaaagcaattaattcaccccaggacatggcactttaaaagcatgaagatgatgcagaaacatgacatgctaacaatgagtgtttctatttgtatcaatarcttgctgagcctttaaggggaattactgacccaagaacagggattactatattttctttgtcaagcccttaactattatttgtttttaagagatgaaagc

SEQ ID NO: 31697 - DNA, 201 bp, Bos taurus
ttctacaaacatccactcaggccccagggtctaggtatcaggtaatgcatcctgaaagccaagacacagaccagcccatactcctttggtgctgatcatcytgagggccttttactgacttctcttcctagaactcagcatttccttacatggttatgacgactgaagcatgccaaccccaggtgttccagaacttattta

SEQ ID NO: 31698 - DNA, 201 bp, Bos taurus
accatgtaggaagtaaaacatttgagtgaataggttatagatagatatatattcccataccacgtaagtatcccttaggccagttaaacacacattcactyatttttgtacctgattttgccttgaggacagtgtttatataccaatcaccatctaccctaaagcactggccttacagtatgaatgaatgtgttatgtatt

SEQ ID NO: 31699 - DNA, 201 bp, Bos taurus
gtgctgttacttttagtatttattgtgttagaaaagaagtatttgatttttctctagcttctaaagggaataaaatggatatttgtcattgtttaggaaartcccatggatggaggagcctggtaggctgcagtccatgaggtcgctaagagtcagacatgactgagtgacttcactttaacttttcacttttcatgcatt

SEQ ID NO: 31700 - DNA, 201 bp, Bos taurus
gattaagtttatgatgagctactgtccaaaatccattgggtccctatattagccaaagagttgagttattcaactccaatataataggaactaacacccckgcatctttcaggtatttactcttggtattaatctttggaattcctctagaaatgtgtatatttatttattattatttattctggaagaagtagttatctt

SEQ ID NO: 31701 - DNA, 201 bp, Bos taurus
tagatagcaatagtttattatgattgttctagtgttaggggtgctgaagggatgagaaggaagggatagtacaagttttatgctcaactgtagaatctttytaaaatgtccttccaagaagtgagcttattatcagttggcttccacatgataaacaaaatcttcccaattattctgagctaaagtaatctttgccttcat

SEQ ID NO: 31702 - DNA, 201 bp, Bos taurus
aaattatgaataaaacccatttatctcaacctgatatatgatgtatgagaaatagaatattgagctattgatataaaatctttcttttccctttttaatcmtcacaaaagcccatgacatggccagacacctctgtatctggagaagggaagaagctgcaggtagtagataaatggctcaggaaagttattataaaaataa

SEQ ID NO: 31703 - DNA, 201 bp, Bos taurus
ctcacacacacacacaaacacaaatttacttaagacgcacaaattcaaagtgttttccccaaaatttatttaatctattaggcaggccatactcttgaaascagtgaaaacagcactttataaaatgccgcacaaacctaaaactcagtattggagattctagcaggcctttattccttacttctgctttgttcaccttcc

SEQ ID NO: 31704 - DNA, 201 bp, Bos taurus
atatctccaattttcataaatagatctctaatctttcccactctattgttttcctgtttctttgcattgttcacttaagaaggccttcttagcgttccttracattctctgtaactctgcactcagattaggtatatctttccttttctccttgcctttcacttctcttctttcctcagctatttgtcaggccttctcaga

SEQ ID NO: 31705 - DNA, 201 bp, Bos taurus
ctagggtgataatgaagaagcttttgaggttattagatatcagcatagttgaaccattataataaccacatgccaaatgctaccaacctatggggtgtgcytgctatgttgacagatgttctctgtcacacaaaactaacaaaaatggatatgaaattctatttttagaaacataacaaatcaagaacatctttctaattc

SEQ ID NO: 31706 - DNA, 201 bp, Bos taurus
gtgaggatcagtgagtacactgagtgtgtgtagtctgaagaagcagcagcagctaaggggaaacgtgatctcgaataacacaaaaaatatgcaaccttccrtttacaatcaaatgctaggtgtcatcctcatgactgatggagtgaggaggtaaggcgtgaacaaagaaatctgtaccacggtgctgaatatggtgttata

SEQ ID NO: 31707 - DNA, 201 bp, Bos taurus
ttacattctggtggacagctctgttttctacaagagagaggaatatgtaatcattacatccaagagtctgaattgcagcaatgctatgcctgcttcatagrtgtattgttttatggccagatgcgttttaatatttcttatcattggcttataaaggattcccattttgaaaagtgttgatacctagcctaattaaatgac

SEQ ID NO: 31708 - DNA, 201 bp, Bos taurus
aaataggaatgaaatgacttcagatcattaagcaacttatttgaaattgatttctgatgcttattcagcatgtttaacaaataaatgatactaaatagaaracacatttcaggcagcaacccaagagccaaatattaacacgcacaatcttcatttgctgtgggcgcttccaacttcaggtgttcttttaatattccatat

SEQ ID NO: 31709 - DNA, 201 bp, Bos taurus
attccatgaggacttggtgccattaatgcctcctgctgctgcttgggtgctctctccaacctctgatccattcctcagttctccattgcccaggcctggcygtcagtatccaccagatcaggtagtgtactcaatctatatgagaaagctcttcccttagactacagcatccaggcttagtatgaggtagactaaagtttc

SEQ ID NO: 31710 - DNA, 201 bp, Bos taurus
tgtgtttatttaccaagcctctgacattaattgaaggtagtaatacattaagtgctcagaacagctggctcttgtggttggccttttgattcaaattcttrgttgctaactaagcaatctttcagcatactcaattgttaaataaccaacaatggactcttgtatttctgattaggccatttcaagctgtatattaaaatt

SEQ ID NO: 31711 - DNA, 201 bp, Bos taurus
aggggtataatcacaggcataatgaagttattacaattgagtgaagggaatgaaaagcatagtatattatgaggcaccctgcagaatggcgggtaattgargatcagaggatgtattgtactgactgtcagaaagtgctatgtaagctgagttctgcaggattggtagtacagcctgatcaagatgacggcaagagcattc

SEQ ID NO: 31712 - DNA, 201 bp, Bos taurus
gccatcattcatttaacaaatatctgctgtccatatacaggaaagtaacacttaagctgagatctgaaaaatgagtaagaatgggacatttttttaaaaargggggccataggtggttaggactgagatagaataaataagcttgtcagttgatgaatgactgaagaatcttggaacaagcaatagtaaacagaggattaa

SEQ ID NO: 31713 - DNA, 201 bp, Bos taurus
attgggagatatggagagaactctgagcagagaagcagtaaagtacatacaatgccccaagcccttagctttgactgggcatagatggttggctgacaccrtagccaagtttccagtagagcggagcctgcacttttaagctttatgtcatgatgtggttggctgacaccatagccaagtttccagtagagcagagcctgc

SEQ ID NO: 31714 - DNA, 201 bp, Bos taurus
gacaaagcctccattggttcacattctaccttatatacattaatatattcagtcacaatattccactctaattgataggagaggactcactgagaaaagaytaaggatgtcctaactgtggagaaggcaatggcaatgcagtccagtactcttgcctggaaaaccccatggacagaggagcctggtaggctgccgtctatg

SEQ ID NO: 31715 - DNA, 201 bp, Bos taurus
ttaatgctagtggagggaggtcattgatcagaccttatgctgtcctaagactacgttcctctcttttgctctcaaagacagagctctttcaaccccaattyacaaaattgaatccacaaaattgaatctgctagtttttgtttttgctttttcccctattccagtgtccagaggtaacttttcctagcccggcctctttgt

SEQ ID NO: 31716 - DNA, 201 bp, Bos taurus
ctcctatttctgcaagatgtcgaggttgttgaacaccccaggtaggctgaaaatggagtgttacttttaattactatctcggctggtgtttggaattacckaaacaatccaacaggtgtggcttattatctgaacagtccagtcttcaaagtgcaggcagctgtgaaagaataaacccacttggtttgttttctggagaag

SEQ ID NO: 31717 - DNA, 201 bp, Bos taurus
actaaaacatcttgaggcccccaaatttctgagatgtgaggacattgaggagggcatctgtggggggatcccaggacagtgggtacagtgcatattgggaytagattcaggggccttattcagtagctctttaccagttgaacaaagctattctatattttatccattcatctcaccccctcttcccctctccccatgttc

SEQ ID NO: 31718 - DNA, 201 bp, Bos taurus
aagcttgcaactcatcataaattttccagaaatctatccttctcacctggtttccttacctgggaattttacaaagtgaacagaaaaacatcacactttayatttgagaagtttgacggatccttgaaaacataatttgtcctcttttaacaatacatatctcactataatgcagtgtgagactacctagagtggttccgg

SEQ ID NO: 31719 - DNA, 201 bp, Bos taurus
acaggcttcttaactcctggagcttgaatgtaaaatctttcagagggagaggtacttaccctggtgggaaagcttgagcttaccattccctctgaagtttyttattgcatttccctattattgaaaggccctgacttctaagagggctgagtggtgttcagggtatcagagagccgcggctcctggcttggggggatgtga

SEQ ID NO: 31720 - DNA, 201 bp, Bos taurus
tcacatatgacacaaattttaaaatcaataaaaagatgttaacacaaaatataatcatataattaaatatgtatcaggaaccagaaaaagtgaagagggaraaatcagataatattttacttgtgtttaactaaaaagccatgtacttaaagtctatgagataaaaacagtcataaatctatctgaatcctctagcaacta

SEQ ID NO: 31721 - DNA, 201 bp, Bos taurus
caaaaaagaaaagaacacctttttagttaaaccatttattaaagcattctttattaaataacctaacaccttggaattggatatgtgaagagaacatgtcygaagaattaaagcagacaagatactctgatcattttatttcttgacttatgtgtttttattttttacttctgtatttcaagaaaacataatctctgcctt

SEQ ID NO: 31722 - DNA, 201 bp, Bos taurus
cctctctaacaatctttaatgagctcccattttactggccccaaagtttgactcttggttccttcccatcatttgctttggtttagttcatgagcttatgrcaggcacacggtggcccagcaaaggatgttggccaagctccttgctccaggagctactgggactactgaatcccaatcccttagcgaccctccccttgac

SEQ ID NO: 31723 - DNA, 201 bp, Bos taurus
ctgagcttcttccagggacccccagagcagcccagtctggctcccagtgtgcagatctctctggcgaaggaagcaacatgcttgtgcatcaaagctgatgracctgcgctctcagggtctgggaggtttccaggctgttcctgctggctgaagcctgagtcaggagtgaaggcgatttcttggcagactttcctcatgtcc

SEQ ID NO: 31724 - DNA, 201 bp, Bos taurus
cgtgtgctgattggctgaagcatggctgtaccccttacatcagcagaggaaaggcctagagattcagggacccttagctgagcaggccagtgctgccgggrtatcctggaccttccttctctgggcgagctgagcccagaagctcagttaagtgctggtttgctgacctaggggttagcaagagtgactccatcttgggcc

SEQ ID NO: 31725 - DNA, 201 bp, Bos taurus
tatctgtgggcatccttctgggtcaagacaagtattctcttgacctggggaggatgaaggtggtgctgattgagaggaatcagaaaagcttcacctgcacrtaggcaggctcattcccagatggggtcttccagccgaggcctgcggccaggtggtgcctctgatctgggtttcacctcccagagcatcagctcctgtgac

SEQ ID NO: 31726 - DNA, 201 bp, Bos taurus
aagcctattgagatttgctggatgtcaaaatcacttagaatcacttttctaagtgaaaaagaagtaagtggccctactctcaggcctgtgtgtgtgccacytggaaagttccccatcagttcttcaggaagcatggacataacctccggtactttcgtttgagtgtccttctttcctgtgctactgtggagcctggcctga

SEQ ID NO: 31727 - DNA, 201 bp, Bos taurus
gtggcctattaattggtccatcttcccgtatgggcagctccacagaatacagacagtatgaactcagcatcagaagactttaattagagttcatggtttaycactggccatatcattcaccttaaaacctaaataaagaaacaaacaatcggccaaccagaagtatagaaatggtatagaatttaaagactcaagagacag

SEQ ID NO: 31728 - DNA, 201 bp, Bos taurus
agtggaaccgacaactgacagtcctgctcaggttgttctaaactttttaatattcctcccaaggagatatagtgctcgtctgggccgtgtacaaaggaaarcagcaggcattgaggtggctgtgattcttgtgggcaacaatggcaaaatgggtttaaatgaaacagaggtctcatttgggaaaacaggcagtgttgaagg

SEQ ID NO: 31729 - DNA, 201 bp, Bos taurus
aatttaacctccacgtggaggaggcccccagcagctccaggcctgcccatcctggttttaagaggatgactttttctcagtagtcctggtgagttcgaggrctggctctgattggcccagcttggatcatatgctcatccatgagccaatcactgtggccaggggtgcccagcgcgcccattggtcagctctgtgtcacat

SEQ ID NO: 31730 - DNA, 201 bp, Bos taurus
agagttctctggcccccagagcatgtccactaggtgctcctggattttacttgggttcaccttaaagggcacaagcaagagattacatatgaaaaagcagrgacatcatttttatgacaatggtctgtatagtcaaggctatggtttttctagtagtcatatatgcatgtgatagttggaccataaaaaaaattgagtgct

SEQ ID NO: 31731 - DNA, 201 bp, Bos taurus
aagctacccaagtggcccctgaacgaagagttgggaagagagatacaggagcacccaggacataatatttccaccctacagagaaaataaatgtaagtgayctcaaggccatcaataataacaacatgtagtaaaataatcaggaagtgacgtgtcttgagtgtacatgacctttgtttttaatagaatgtatttaatcag

SEQ ID NO: 31732 - DNA, 201 bp, Bos taurus
aagtagtctggttgttcccgtcacgtttctgagggctgtatctagtgggacttagagctacatccgttcgcaggaaatctcctgtcattttggcaggcctyggcaccagggacgcgccccgtgcaccctggtctcggacgcgagcagtgaccactactgtgtcccgtctcctgggccagtatgtgcggtatatggtaacat

SEQ ID NO: 31733 - DNA, 201 bp, Bos taurus
caagtgtgagccacacaagaagatggaccgcgttcctataattgcaccttgtttttgccaagatcatccgtcccagcttgttctcatcacattcaccatcmttgactctgacagacttggggctgttttcaaaagcaaatctgccttccaaagagagagtcactgccccaaggaacactgaaaacgaagatgctgtggttt

SEQ ID NO: 31734 - DNA, 201 bp, Bos taurus
gatctgattccccaggccagaattgaggtccagaaatctgtgtattatacaaacacagacacacgccctccatctcgggtttatcagtgtctgaacaattrccaggtcaatggctccatcctggcccatcagaacaggtgggagagggacttctctggcaatccagtggttaagactctgcacctccaaggcagtggacac

SEQ ID NO: 31735 - DNA, 201 bp, Bos taurus
taaatgagagaatcttcgtggtttctcctattcctaactcgcattccattcttgctctcttaccagatgtggggttcggctgtggcttcccaggcaacacygattctgctgactgctttgggtgccctcaactccagtcggcctcgatcatctcaaacagctggctgagccttttcttaacgtcaggctctctgcggacac

SEQ ID NO: 31736 - DNA, 201 bp, Bos taurus
caggcttccctgtccttcaccatctcccggagcttgctcaaactcatgtccattgagtctgtgatgccgtccacctgtctcatcctctgtcgtcccctcgwccttagactgttagtaacgggtggtcttggtcaatcagtgaggctggaggaaccagaagtggctctgtgtctgtctatctgggaagcattccatgttcaa

SEQ ID NO: 31737 - DNA, 201 bp, Bos taurus
accagggaagcccatttagaaaaattggtattattctggatgaacactagacttcattttaaatgaattctggacattttaaataatcaatccacacttaygtgttgaagggctgcccgctgggaagattcaagaaaacatagtgcagtcatcgccagcctgcagcacatcttctgcataaagggtttctatgccctggtg

SEQ ID NO: 31738 - DNA, 201 bp, Bos taurus
gatggaggaggtttgcatcttggagccgggcactgctgagttaggctcctacctcccattggaggggacactggctgctgttcctctgatgtttgcgcttygaagagatggctcccagatcctcaagaaacacagtcctggatgtaaatctggcaagaggcttagtgagtttttcaaaatatttacatacacctcaaaggc

SEQ ID NO: 31739 - DNA, 201 bp, Bos taurus
atggtccaccaataccttttataacagagaacaggagaaggaggccaagacccaggagagggagagaaggaaagagacaaggcatgcccagatgctggccrccctacacggaagccctatttcaaaccctgagtccttaaaggacaaggcacgaagcaaatgcctagtctgtaggcagatggggcattaggccaaagagtg

SEQ ID NO: 31740 - DNA, 201 bp, Bos taurus
tcaactttgtggctcaaagttacatttacttcttagaattttaaggtttaccttattttcctatattctggagtaatgtaagtaaaattgggattctcagraataaagtccccatgattcttgagggtttcatggaattctcctgtgaaaccatgtgagagctgatgctatcttccgaggagcttttccactactttctct

SEQ ID NO: 31741 - DNA, 201 bp, Bos taurus
agaaataatatagatcatcagtgtcatgacttaggaacaaaagagcatcaaaaaggaatagaaagatttgaaaaagaaggaaacaccatacctagaaactytttattgaaacttcaaatttaatagaatagggaaagcagattgtacacaactgagacagaaactgggtaaccagttggataattatgttggataattatg

SEQ ID NO: 31742 - DNA, 201 bp, Bos taurus
cggcagggaatcaggccccagcctcgtgcaaggtccacgtggcgattagcccagaggagacctccatgggcacaatggaaactcaggaggagcccagagcygacctgggggctcttgacccccaggccccagctgagtcatgaggcacatgcttttgcttgatgaggacacggaaagagcttaaatcttgtcactccactc

SEQ ID NO: 31743 - DNA, 201 bp, Bos taurus
agagacaagccgaccggaaaggccaccctggggcttaaccaaagcctccgggacaaccctgcaaagtgccaagcatgaaagtcatggatcgagtggagagycagacccgggggtgtcagcagggccgtgggactctgtcccaagggcgcactggcacccagcacccaccaccagcccccccagggctcaacagtctcctcc

SEQ ID NO: 31744 - DNA, 201 bp, Bos taurus
acatgagtccaaaaggggccacgcgtgaggatgtccactttaacatcctttatcgggacaaccgcagagccctccccaagaggggacaggtaaaaggagckgggagcacaccagagaatatggggccctagacttagtgtcaagcaacaagctggctggactcagaggcggactcccgggcagcaaaagtgaacaccagaa

SEQ ID NO: 31745 - DNA, 201 bp, Bos taurus
ggcgccattgtgggtgaaccagggagaacctcatcaaggagagttccgtcttcccatcctcagcgcgctgagacagtgaggcctcggtctgtccctcggaragccactaaaaggaacgatggtccttcacgtgctgccaagatcgtgcagtacagcttgcaggatctcagatccccggccagggattgaaccgggggccct

SEQ ID NO: 31746 - DNA, 201 bp, Bos taurus
tcggggatggccacggccaggggaaccgctccttggtccagccctggagtaggcgctggggggaggtctcaccaatgtagtctttcaagggcactgtctcrctcttctttagaaggcctaagacgacgagctcttcaaacagggagtccataggcctggcagagggtggcacaggggggcgcccaggacaaagggaaaggg

SEQ ID NO: 31747 - DNA, 201 bp, Bos taurus
gaatggaaggaccaacagtctcatccgagcgagaagtttctggggtctgccgtgggctctatcttgtcttcccattcttcggtccggtcttaccaaacacrgatctaagcatctctggaagctatgctatgacctgtgctcaaccagcgggctctgcgctccattcgttctagacacccctgtcttatgtcctcacctaga

SEQ ID NO: 31748 - DNA, 201 bp, Bos taurus
tgcatacttcatcctgcccagtggggtcccggcctgggtgcctggagataggggttctgtttgggacaattagtgccgttgtcccctgcgagctttacttytgcatcatcagcagggaagatagaaacagtttagtcacgccatttgcccctgtagagaggaagggaattataaatgtattatagacctataatgaaaaat

SEQ ID NO: 31749 - DNA, 201 bp, Bos taurus
gaggagcctgcacctcgatcctggacttccggcctccagagctatgagagagcagtttccattatcctagccccgaacctactgattttgctcccagttcrcaccaggccccgcttcttcctgaaccctttcctcacgggtcactgggagtttgaatgaggtgacgcagggactatggttctgcgtgtgtgattgctgctg

SEQ ID NO: 31750 - DNA, 201 bp, Bos taurus
ttgatattatgacccaattctagggccatcaagtgtgtgtaacaaacacatgaactggtatttggggatccccaaaaccagtcttcattgccagacatagyaaacgtggaaggccaggctcaggaacacggaatgagagcagatcttaaggcagaaacgtgttcctttcattcccctgaccacctgaccctcaaactagct

SEQ ID NO: 31751 - DNA, 201 bp, Bos taurus
ctggtctgcagtcactcacgggcattttctgaggcctgaagatgggatggaggacccggaggagacccaccaggcacagacagcccttaacctgttcctcyggggcctgagctgctggatgtatcagactaggagccatgtgatctggactaggggacaccagcccctcctcccctctgagctggaggctggggtctcagg

SEQ ID NO: 31752 - DNA, 201 bp, Bos taurus
cgtgggtgctgcggggatggggggcagccaggagcaggggccgcccttgcaggctctgtgacatgaaccacgaagcccagtctggcctccgtctgcaatcrcctcccccaccatgtgccaggtgcatggtgaacacagacccctccacgtagacaggaaagcagagcccaaggcgacggagcctcagcctccagaccatca

SEQ ID NO: 31753 - DNA, 201 bp, Bos taurus
ataaattgaaaaatggacaaaggatgtggatatgcaacgcagttcagcaagaaacacaaatggaaaacccgaaaggctgcagccgaggcgacagcatcagyctgtgcttaacaggcggcaagagtataaaaggtcctaacacttcaagtgggaaacaagaaaaaggctcacactctgctggagaagagcacacagttatag

SEQ ID NO: 31754 - DNA, 201 bp, Bos taurus
gaatcccccatccttcagacccctctggttctgtccccagcgtgagcccttccccaggtactccatcagctctaagtccatagtcacttcccttagcattyggtgaccgtctccggtgtgagctttggctccgtgcctatgttctaggcttcttgagagcaggggtgatgtttatgccactctgcatctccacggtgttgt

SEQ ID NO: 31755 - DNA, 201 bp, Bos taurus
gtaccaatggtgtgacaggtactatgcccccaggagagagacggagaccgaggcttacagtatccacccagcggggagacagggctgttactgcacgtgtrtgttatgtgcgagtcagcccgccttctgagaaccggtggttctgtgtaactgtaactcttcctgcactagagaaactgaagaagtagagctggtggtggt

SEQ ID NO: 31756 - DNA, 201 bp, Bos taurus
gatcagatccccttaagtaacttgcttaaggtgtcactgccgagccggatttgaacctgggcagtctagccccagggcctggactctgatctgctgccccytgatgtatgatcaccgtaagctaacaataataacaagctagacaagggtcatgacatcacatgggcaaacgcaggtcacgacggcatacgggaaccggcc

SEQ ID NO: 31757 - DNA, 201 bp, Bos taurus
ttggaggttcttcatcacggcccagtacctgaaagatgacacttcggtgttctcactctctcgcccttggcaacaaacccactcacacagcatcagtggtygctgtcaggactctcgaatggcctcgtggcatttccccttggagatcctaaaggcagctcagagctgccgcacccacacttacactcctcactttattgc

SEQ ID NO: 31758 - DNA, 201 bp, Bos taurus
aaagttcactgagggtagacatacccccccagttgaaatgtgtgatcatttagatgtggtcacagtagcttgtccatggtacgaatgaagagcaggttcaygaagagggtcagttgtataaaactattgtaaactgagttcttgtttgactccaaggttctctctggccctaaaattctggggatgcggacttccctggtg

SEQ ID NO: 31759 - DNA, 201 bp, Bos taurus
tatgtagtcgctccaggaattcaaggcaactctctgcctggaagagccaaagtgtgatttttatatggagacagcacacgctttctgatccttgaatccayttttcattaactgttcacattaagcggccctacctccttggaaaacaaagcaggagtatgttagagaaagggctattttgtaatctagataaatacttgc

SEQ ID NO: 31760 - DNA, 201 bp, Bos taurus
ctctgtccgctggtttaatagttgaactcatttagtcctggccatgtgctgtgagccgtctactgtgtgttcattcaacagccggaacctggaatcggcarcttacatatggccagcaagtgaaacagacctgggatttgcgcacaagaaattattctgaccttgaagctcattcctctaactgatatgtagctcttcatt

SEQ ID NO: 31761 - DNA, 201 bp, Bos taurus
aaccacacgctctcctgtgctttttacacccctgccagcatgcacagctctgactcctggaccaaaaagctaggggtctcctcactgatggcccctgtgcrctgataaaacttgctggaaagataaatcgcttggttgggttttgttgagtaggtcgaggtggccccagctgaagcccattgcagcaaaagcagaaaccac

SEQ ID NO: 31762 - DNA, 201 bp, Bos taurus
gctttccccacgcgggcagccttcccaggcgcccacctggctccgccctgcacacccttcagctctcaaatgtctcttcctcggagagcccttgcctgccrcctggccctgcctcccgtcattaggccactcatagcccttggctttctgtccgtcgtctgtgtccccagggtcatttccttggcctgatgtcccttccta

SEQ ID NO: 31763 - DNA, 201 bp, Bos taurus
tgaaaatgtccattatgtaaaagttttcattttctccatctgaatcctttggaacaactggtcatctatctatttgattagggaagtcagtgaacttgacrtactagctttgggactccatgcatcctacacccaaccctacacacctctgagcgtgatggtcatggcttatagtattccagcccctttcaccacccttgg

SEQ ID NO: 31764 - DNA, 201 bp, Bos taurus
tcccacagcctcacctgcagactgacccgctgacctgagaacagggtctgcgttattccactactttctggatgaggggagccccagtcagcagccttccyggggcagacggcccagcccatgctccttaccacacagcagggatgcagcaaaagtggggtagagaccccagaaacctgtgcaccattctgctgaaaacac

SEQ ID NO: 31765 - DNA, 201 bp, Bos taurus
ccatctccatggaataaccatgactttttctttctctaaaccactgtgatattgtcagccccacttagcgtagcagttaatcagcctcctcctttcattgytcatctgtttcacttttgagtaactttatttcccagaccaaacataagctgttcaaggacagagtgtttttcatctcactttgattttccccggcccacg

SEQ ID NO: 31766 - DNA, 201 bp, Bos taurus
ttagctccacttccctctgggtgtttgtttcactctctctcaccgtgaaaagacatattctatgggaccaggtagatcagtaatccctgggccttccagcrccagaacccagtggcaggaaaccattaacttcataactctgtcagggagacgctgagggatgacctggaccgaacccacaccgagtgtcgccgaggccag

SEQ ID NO: 31767 - DNA, 201 bp, Bos taurus
gcatcacccacctggccaagggaccctggggagcccgatgccaacctcagcccacggaagagctgctttttaattggcctcgagtcacttcatctgtttgycttctggggctgtctgccttacagcacggatatttgcatttcaccccatcagctggccctaaaatcacaggctttccgaaggctgcagacctgcagttgt

SEQ ID NO: 31768 - DNA, 201 bp, Bos taurus
tccaggcctggctgcctaacttccaaaagtggggggctgacccggcaggagggcttgtaaaagcaagcccaccgagacaaaatgtccttgactgacagtayatcgaaggctggttccgggccgcagaacacatggactcgccccaagtttgaggagcacgtggttctcaccctccagctcttggtcctcactctggagaga

SEQ ID NO: 31769 - DNA, 201 bp, Bos taurus
cagggcccgatggggcggcaccagcttcttcttcttcaggaccgtgttcagccagtgtgccgtgatgcacctcttcctctccttcatcgcctgtgaacatratagagcgggccggtcgctgggggctttaccgcaggcaacacacagagctgtgaggctgtaaactacaaggtcacttctgctggaagtcctatcaataca

SEQ ID NO: 31770 - DNA, 201 bp, Bos taurus
tcccctcggtggagtggtcctggctgggccggactgggcaggcgagttgtagagccgcatgaaaataaagatatactttgtcccaaactcctcccgtcccyaccccggaggctgaggccctctcactgtctggctgagcagctgatttcatttcgggagggagtaccccggcactgttctcaaacctctcatgcttcagtg

SEQ ID NO: 31771 - DNA, 201 bp, Bos taurus
tctgagcgctcgagctgctgagctgggaaagtccgtctcgtgcggtctccactgaaacagcgggcttgctctccctgtttcagggaaaaggccagcaggaycatctccttggctctgaaaccgctctgtgacttgccccctttcttccctctatgcccggcaccttccttgcctcctggatttctgtcctgtggggccctt

SEQ ID NO: 31772 - DNA, 201 bp, Bos taurus
cttgtccgtcatcagcatctttgagctgagtacctcatctgtatcgagcacagtgacgggtactggctgcagagcggtgaactgggaggcaagtggccacrttccctgattcccgcacaggactgagttgctctggttatggaaacaggagcagaagatccgtgtgaatttctggccggggacatgaaagccggtgaacat

SEQ ID NO: 31773 - DNA, 201 bp, Bos taurus
aatttttgtcacactaaatatttacctatgagtagataaaaggtatttttcatcatgataatattgtaactatcctaggatataatggtgtaacactaggrtacgtacccaaaggacaattttaataaacatttctgatgttcaattattttaaaagaacatttttttcaaaatttaatattgaaaactttaatagtaacc

SEQ ID NO: 31774 - DNA, 201 bp, Bos taurus
gcaaagcagaaaagctaagtgtgccccaaaccaggcacaccagatgtccccatctccagcttccctgtgcccacggcctcccgcagggcacactgagcctktcccctttcactcctgcccgtcttcgaggctctgctgaacaggagtgctggtggccaaggcccccttgatagaaaacccttaatcaatagcacgtcttcc

SEQ ID NO: 31775 - DNA, 201 bp, Bos taurus
tggttggacagcatcactgactcgatggacgtgagtctgagcaggctccaggacatggtgaagcacgagagaagcctggtgtgctgcagcccgtggggccrcaaagagggagacacggtcgagcgactggacagcagcagcaaacgccattgtgagacggctgagcaaggctggctcccatacacccctccctgcctcccg

SEQ ID NO: 31776 - DNA, 201 bp, Bos taurus
caacccaggccgaccttgcatttcacctaaagccgccaggcctcaaaaacccggcaccaagcgttttcagagccaggagaactgcccggcgaaggaagctrggagccactctgggcttggcctttggcttcaggggctcagaagcccagaatgctatgaaaacccactcagccatgccgtagtcccgtggcgctttctgac

SEQ ID NO: 31777 - DNA, 201 bp, Bos taurus
ccccaccccgagccctcctttcctgtccaccttctgcagttaaaacaggcacaacttttgcaaagatgctcttctccacagtgtcaccacgtcacacagcyctccagtcggcctctctccgctagacttcgttgacacccgtaccttgcagagccaaaaaggaggtttccttctgaaatgagaggcctgtcgccatgccta

SEQ ID NO: 31778 - DNA, 201 bp, Bos taurus
ctggaggaaaaccgttcggtccctcggacctcccacagccctcccctcgggtccctccttgtccatcctaagagcggtgactgatgggtgctgaggagctyaagttcttcagttaaatcaagccccactgcttggaaaagaaagtacactgccccagtgaagacttcatagtagaatatactttcagaaagtgggaaatag

SEQ ID NO: 31779 - DNA, 201 bp, Bos taurus
aggaggttggacgtctcacatgtccagtggtccagcttccaggaagggagtgaacaggaggcagaagctggacctgggtggctgaactgtgcagacggtcrgcatgggccccagcccgccaagcagcccctctgctctggagggctctggagtgttgtgccctcagccccgggccctgactccagaggctctggccctgca

SEQ ID NO: 31780 - DNA, 201 bp, Bos taurus
aaacacaaagcccgaacttcctggactcctgcagctgacagctccctgggtcctgaatgtcagagacgcctcatagctcacattcgactcggcctctgagrgcaaaggcagtctggagtggctccactgtgtgcaggggcgtttcaggttcatatttaatattcagacaataaaaaacggccacgtcaagtggaaacaaac

SEQ ID NO: 31781 - DNA, 201 bp, Bos taurus
cactgcaagcagattctttatcatcagagcccccgggaagcccctcactcactattcatctcaaattagccatgagaggctggcattccaggcccagcccycatcccgacagcccctgacactgtctgggactcagagggtcctgagatgcatggttccgcccatgatcaggccgggcgggtggcaggggccggccacacc

SEQ ID NO: 31782 - DNA, 201 bp, Bos taurus
ctgctgaatgcctcggggctgcagggaatgaccctgagtggacattcgccacagccgctcaggctctgtgaagctccgcggaagacacagcacacgtcccrcaggccggcccccactcaaggactgagaactgctttcaagacctggcccattctggccaaccatcagcatttctctgcgagaaagaaaacacaagcatat

SEQ ID NO: 31783 - DNA, 201 bp, Bos taurus
catggtctcactgcagggacgcagcagaggagagcctttcacatgcagcccgtttaattatcaggagcacgttgccgggccgggctggtgggcaattgccrgtcgggcactacacgtgcttacgccgagatgccccactggagcggcagaaagtcatctcaagtattgcaagcgtctcctggatttctggggcctctgcca

SEQ ID NO: 31784 - DNA, 201 bp, Bos taurus
cactctaggagccattcgcaaaagttaagtctttttactttgttttctcacctcccaccatgtctgacacataaaagaacctggcatccaggcctggtccrgatgattattttcagacaggagcctgccatccctctaggtccgccagctctccgagtacagtcgatgatgccgcacccctcgcctcagcgcgcttaccgg

SEQ ID NO: 31785 - DNA, 201 bp, Bos taurus
agatgagagcacactacagctagacttcaggttctccagacacgaaccctccaagttgtgtcttcggggtcctccaggggctgggagcttgttatgggttrtaagtcctgcttggccttgtacacacttgctgctgtggcctcaggacgccagccctccccgggcaccggtctccgggagtctccactctgcgggggaggg

SEQ ID NO: 31786 - DNA, 201 bp, Bos taurus
caatggcaacgttgaagtaaacacatgagcgccgggaaggcacgggggtggggactgcccacgccttcctcctggagggcccctccctgttcacactgccrcaccgtgcagtaagaggagtagaaacaggaacggttgcacgctaaccacacgcatagcagaggctgctcggaggtcggtaatgggccgccagtcttcagt

SEQ ID NO: 31787 - DNA, 201 bp, Bos taurus
gtggccccggctcacactcgtgagctgttggccagggaccagggacagactcgagtctttggaacgagaagcacgaaaggacaagccttcacactgcttayggccacactccatccacctgggccgaccagaggtgaagagtctccttatgaaagagagccgactgaggaccgtgcctcctgccccacagtggacgcgctc

SEQ ID NO: 31788 - DNA, 201 bp, Bos taurus
cggtctctgctgcagggcaactgtctcggctttcaggcctgttggccgagttgcgcttgtggaatgcagtgccctccggcttctcatctatcagataaaaygaccagagctggacaggcccgcacgcctggaggatcacagaaaattatttcacctctctgggcctcgtcaacagagcaagggacttggctctgctgggtt

SEQ ID NO: 31789 - DNA, 201 bp, Bos taurus
ccaacctgactgggaccaaatttcagtgtcctcagcatctctgaacactggagtctgctctgtgctggcctcccatggctgttctctcagggccccgtgcrtctgctgctctgagtaagccaagggcacatgaaaaccacacagacttttggactcccttccctgcagctctgtgctctcccttccctaaatcacagccac

SEQ ID NO: 31790 - DNA, 201 bp, Bos taurus
ttgacccatgcctccactggagacttgtggatacttacaggcaagtctgactcagtcccttgtggggacactgctcctttctcctggatcctggcacataygaggttttgtttgtgctcacctagtctgtttccccagacctgtgaaagttctgcagtcaatcccactggccccctaagtcaaattttctgggagttctca

SEQ ID NO: 31791 - DNA, 201 bp, Bos taurus
tatctatcattcatcttctatgctgcaaattattgtaattttcaagcattataatcatttcatcttatgtattatgactgtttgtcttccctgtggcttartgatactgaatttgcctaccaaggcaaaagacatgagttaagtccctgaattgagaagattccctggagaaggaaataacaaccgaccccagtattcctg

SEQ ID NO: 31792 - DNA, 201 bp, Bos taurus
caaggtgagaccggcctccttttgaggggcaatggcagggtggggattcctttcccgaagaagcaggggaaccgaccctcatcttgaatagaggagggggraaacggggcccttcttgagttgtggcatgaaactcggcattcctctctagtggggacgtgtatctcggggaccttcctgagttgcataaagggtgtcaag

SEQ ID NO: 31793 - DNA, 201 bp, Bos taurus
ttaatctgtgccagcgcccactccacattgaactggacccaccaagtatgagcctgagtatccccagcctgggacagaccgtagcatgttcaaattaaatmtttttagtcttggtcttgtggtttgccattttgtgggatttttgcttcatgtactaaatccttggtaatagtacattgatgtcaagagatcagatattga

SEQ ID NO: 31794 - DNA, 201 bp, Bos taurus
ctggggctgagggagctggggacatgtggcaggcagtgtgactccacgatgaacctggagggcctgttgccctccagacacaggctggataattgaagggrttggaattaacatatacacattaatatatatcaaatagatgatcaaaaagtacttactgaataacatagggaagtttattgaacaccatagaaaagaaat

SEQ ID NO: 31795 - DNA, 201 bp, Bos taurus
agaaaaggacaagttatcaagaatgtcaatgatagtaagaatctactttgaagatactctttgggaggtagtgttttagctgatgtgaagaaataaggagycagtcatacaaagagttgacggggggattattcaggaaaaggaaaggtattttacttctttcacaagatagctacatataaagcactcagcacaagactg

SEQ ID NO: 31796 - DNA, 201 bp, Bos taurus
atttaagagatatttcagcaacagcacctccaacatgcggttgtcattctaattaggttaggattgagaggaaaggaataggcccatgaggaaaaccacaytgattgtaagcattattcagacttagaactgggggaggggaaaagtgaatgaccttcctgagcacattctccaaaagtaactctcatgcaagggcaggta

SEQ ID NO: 31797 - DNA, 201 bp, Bos taurus
acaggatagatcaaataattttttttgagaaatgtttcattgtgggctacagttaggcaataagaatccagccagtcacccacattcattggcatgcgctrtgccctttccaaagccatttgtttgcttttatgaaagcagactgaaaattaaacacaaggaatattaaattattattaatgaggacatttgcgggacact

SEQ ID NO: 31798 - DNA, 201 bp, Bos taurus
tttacaactttctaacattattattaaatggtagaaactttttgagacctcttgttgacactttaatttttcattcaagggtgttttcatcaagtctgaaytcacatatggcattttcttcctaaataattttgaaaatgacatgtttaccttctcttttgacttgtagtaaaggcctaaaatgtccataaatgagggata

SEQ ID NO: 31799 - DNA, 201 bp, Bos taurus
tttgcttggaagatcaaactatattgtaaacccacctttgattttggctgaaatgataatcaatcttgaagctttcaaattacccggtaaagggcaaatgyagtatattctcttttagaacagctgtgcaaatagccttcatgtttggagttaggcttttactttattgaagatggcctttaagagtcatatttgtttcta

SEQ ID NO: 31800 - DNA, 201 bp, Bos taurus
ttcctcttccaggggatcttcccgacccaggggtcaaacctatgtctcttacatctcttgcactggcattctttactgctgagccaccaggggaggcccgmtgtgttgttaccttgcattaaactctcgcattgtcatatgagttttcttattctatctctgtgtcgtgctctgtattttctccctttttctcttctggcc

SEQ ID NO: 31801 - DNA, 201 bp, Bos taurus
caggtaaatttaagatttcagtgcacagggagagaccctggtgtgtaatctgggttttaccttgtccagtttcctctgcttcaggtgtcgccacacctggmtccatccagaggccagcccagcacctttgtatgtaattacctagcccacagggtgaggaagaggagaggaggggatattcagtggccagtcctgctaggt

SEQ ID NO: 31802 - DNA, 201 bp, Bos taurus
gtcagttatacattgcctgctggtagctgacagctcttctgggacatgccagactgttctacatgcagttgtcacttgggatcccagctcaggaggcagcygcactgggggacgtgccttttttttggtgcagtagagagtaacagtcagctggtggaagtatatgctgactcttgatgctttggctctgcactggggcct

SEQ ID NO: 31803 - DNA, 201 bp, Bos taurus
ctttaagattcctggcattcagagcaacttgaacccacaattcctacttctctcattcctttatgaaatatgtgccttgcatataaaaagcctgctttttmatggacaatgcaggatccattttagtgatatttttgtaagcttgacaatttacgttgattgatttgttgtgtcatgaaacaaatatcgtttctatatttt

SEQ ID NO: 31804 - DNA, 201 bp, Bos taurus
gatatctttacatgaacaaatcagaatacatggctttttgcccctctatagagggctctgcactgaaaaatctaggagaaccatttgtttctgtgaaaacyttttgtatgattccttagcggacttgtttagctcactgttttcctgtcaaggcacacacagccgtgtgggcaatctgagtccagtgttggattttggtta

SEQ ID NO: 31805 - DNA, 201 bp, Bos taurus
ccctgtaattataactctctttggatcattgtccaaataaattaattacgttactttctgcacatctttttttttttttttttttacttgtgagattgcamgactgtgagggtaagaattgttgccagcgaaaaatacattcatatactatattattcatataatcatacaacacacacacatatcctggggcagcttaca

SEQ ID NO: 31806 - DNA, 201 bp, Bos taurus
tcatgggtagaagtgcataaacaacaattttatatggagggtaacttcctcctgaaagagtacatgttttcccctgtgagtctctgcagaccttcatttayatctctgagatttttgtatttgaaggaggcctctttcttacatgatcatcaatattattttacaaaactccttaatgggtcatgctatttaagtgatatt

SEQ ID NO: 31807 - DNA, 201 bp, Bos taurus
tgagttcgatcactgatcagggaactagatcctatatgccacaactaagagtttgcatgctgcaactagagatactgcgtgctgtaactaagacacggcayggccaaataaacatcttttaaagttaattaggaaatggttagggatgtggtggagggtagaggttgagggctatatcaagatgaaatgaacagtttatgc

SEQ ID NO: 31808 - DNA, 201 bp, Bos taurus
tgggagagcaggttgatgtttttcattaacaccaggtactatgccataataaggaatgccaactctcagctgacaacaaaattatgtttaaaatagagacstaactgtatctttccacaaacttgttggcatgtaagcaaaggcatttagctcaggtttacttagagtcctatgactatacagttctatgagggggtcaaa

SEQ ID NO: 31809 - DNA, 201 bp, Bos taurus
atctgtaacatgaacataaccaaaaaggaaaactgggaaccaagaggacaaccaaagactaattcattaattttccaattattaatcatccttaaccaggycactatatgcattaaaagacattagaacacaacttatttctaaaccaggaatgactgtttcagtccataacactttatgggactttttttttttttttcc

SEQ ID NO: 31810 - DNA, 201 bp, Bos taurus
tctgcaagcttccccagctcttcctcttttaaatagatccctcttttcagcctccactttctctgtttactgtctactacatacaggctatcaaatgaatrtagcattgctattttgtcctcttcggcacatttgtgcatactggatggtttctggtgtgggatatgtattgattcactagcacttgcagtcatttctgta

SEQ ID NO: 31811 - DNA, 201 bp, Bos taurus
ttaattcaccactttaacccagagccctggagcctctcttcagttgccttcagcgcactgtgttctgaggatcttagttcacctcatgctcagcctctatkactgcaagaatcactgaatctttctgaaatgctcacatctttaagttcctagttttcttaaagtttaagtacacatagtaatttgtacccatttgtacaa

SEQ ID NO: 31812 - DNA, 201 bp, Bos taurus
aagaggccttcactattttggatgtgagcaaacatcagattaggaaacttgacttgttgtaactgtgccaaagcctctttaatgttctttaaagatatgastacaggccaactcagaagctaagaagtagcaccgggccctgtggaatcagaccacatttgaatcacagattgcgttctgccttcctagactgaatggcct

SEQ ID NO: 31813 - DNA, 201 bp, Bos taurus
atcattgttagtaaggtattgaaatagacactactcctgtaaacagtgttcaaacctgacgccatgctctggaatgcagctcctgccacgtaaatcatagrtgccataaaaatcaatagacaggagaggtgacattgataggtgattactattgaaagagtgattgacagtaagacaatacaaaacatctctgacggggaa

SEQ ID NO: 31814 - DNA, 201 bp, Bos taurus
gggtcacacaatttgggaacatggtaatagtgagctggaattacaggggatagcttatacctggcaagtgaggaagggttagctagatttcaaggcctccmgaccctttagctaatctgaataactttttaggctctgagccatagagtctgtccctatttgtctgatactgggcccactggcaactggaaatggtgtatg

SEQ ID NO: 31815 - DNA, 201 bp, Bos taurus
aatcaactttctataatttaaagggctatgcaaatgcaaaataaaattatagcaataatattgtcattgatctcatagagttctaaaatcataagcataaytgtatattcaaaatatacttgtcagtgacataaccatttatatacaaagtacatttaataagattttttgtagcactttcttatatctcccatccctgca

SEQ ID NO: 31816 - DNA, 201 bp, Bos taurus
ttcctgccttatttctaaaagatataagggatttggctttatttttacttttgtgagatattcatagcttcaggattgcaataatgtaatcagaataaaartgtaaaaatcacaatttaagaaaaattattgtttggattattgtttctttcacttttaaaattcattagtctcatcaagaccgtaaaagcaaaacagata

SEQ ID NO: 31817 - DNA, 201 bp, Bos taurus
aaaccttcctgaataaacttataaacaacctcaaactgtgaaagaatatacatgaagactagacaagtcaatgatttcaaagggcatatactaacctaatrtcatcttatttttatatatccgaggaaattattccttatttgattagaaatgcaatttcttttatgtatgaacatagtggagagaatgtagaaagaattc

SEQ ID NO: 31818 - DNA, 201 bp, Bos taurus
gctgtttagaaagctctcaggttactaagtttctattttggggggcataaactaatttataaattaaaatataatgatgctatataatgcacatttgaaartatgtggttttcattttcttttggccaacgcgtctccacttacaaattaacttcctattaaatctgcttttgctaatggtttattttattaatcagtatt

SEQ ID NO: 31819 - DNA, 201 bp, Bos taurus
atatttgacccatgatatgttaaataatacagacattgaactttgtttaaactgtgttattttttattgtaattcctgatgaattttgattttacatttaytttgttcttctttaaaatgaagtttggcaggattactcaagtcaatgagcaattgctctcaagtatatactgacctgatttttagctttgtattcattct

SEQ ID NO: 31820 - DNA, 201 bp, Bos taurus
gttccttaggtagtgtataaaatggtcctaatatgtctttttgcatttatccatccttttttcaagtatccttgagacatcacagtgtaatgcaagttttmtttaacttacatttatatgctatcaccccccaaaaaaaatcacaaaaaatcatattctattatctttaattatgatgacaatccaaaagaaaatgtttta

SEQ ID NO: 31821 - DNA, 201 bp, Bos taurus
aatttctagtgagactgaggcaacccctcctcgaagggtgtcctgatcctcagtgtgttcatttggaagccccatacaggggaaagtacaagagggagctrtagttttcacacccaaatctgcacccttaggacataagtctggcatgtgtctcagacagataaagagcaacacatatgaaacatcaacccatttcccttg

SEQ ID NO: 31822 - DNA, 201 bp, Bos taurus
tgcaatatgccatctttgctttaaaacaactttttttttttttcctgaagagtatgattcagagaatggtactcagtgccagaaatcatttgaggggatayttattattaatattggcaggtactattgcccagttaaaaaaatttcttacaaactactcattaattaaaacttatacagaatttccttttcataaaaagt

SEQ ID NO: 31823 - DNA, 201 bp, Bos taurus
tatgtttgaccagaagagaatctcactgcacagaattatttcaagggtacatgccacttgcacgttttaaaagaaagctttattataaaagccaataaatktatttatagttgaatgcttgagacttgcttgggatgcagacaggctatcttccagagaaagacaaatgcttaaagtgcagaattatcacactaattttaa

SEQ ID NO: 31824 - DNA, 201 bp, Bos taurus
tccactcactgtttcatatggcctccacttcctactcctctgatcaaaaagaaagtgcttctttagagactgctcctttctcgaactgatatgcacttccrggcttcaggccatctttgatttgaggcttggagaaaaagaaaacaagactgaaacagaaaattcacccttgttgctggctaaaatcttggctttctctgc

SEQ ID NO: 31825 - DNA, 201 bp, Bos taurus
ctaatataattatatttaaggccaattacacacagcaataatacctggagagaatgcacagagcagctactttaagaccctgaaaagaaaataacaaggarctttggaaaaaaggccagaatttgaaagccagtttaccaccaaactggtagtgagtttaacatatcttttttcctcacatcttcataccacttaaccctg

SEQ ID NO: 31826 - DNA, 201 bp, Bos taurus
ctgctccttttgttccatatctgcttgctcagtaatcctttctaaaaatatgacctatgccaaggtaactgatcctgagagtcttccaatcctagccattsctccaatgtatctgggccttccccgtacatactaacatatttgttggggttttagtatccccctctcctcaagatcatttcgtttagtagataccttgat

SEQ ID NO: 31827 - DNA, 201 bp, Bos taurus
ctacatgagaagggccatgtgaaagaatgttcagtgccgaaccacttatcttcacaaaaacctctggttaaacttaatgtttgcatccccatactaaaggyagcattggcctctggaggtatagcaggatttttccaaggcctgagaactaaagcagaatcataagacttttcatccataacattcagcttagcattagta

SEQ ID NO: 31828 - DNA, 201 bp, Bos taurus
atgggggctctctgtacaccacctgtttgtctaattctctacttaccaatctggagtagtttcccaaaactttttcagctgtagaatcttttaagaaatcrtatctgaaaatgtaacatgaaacaaagacactctggccgtgactggggagaaacctactcggggcgggttctgtcccactgtttggacagaggatggtgg

SEQ ID NO: 31829 - DNA, 201 bp, Bos taurus
ttaatagggttgtgaaaattaattaagatgctccatattaattattgaggaaaagaaattgatttttttggaatcaaaatacccgccacctagagagtagmactcaacatattaaaatttcccaatttgaagattgcattcataagacacactaaacaccccaggatgatattttgatcagtcctttttcaccagtcatgt

SEQ ID NO: 31830 - DNA, 201 bp, Bos taurus
cccagcctgtactgcggaagttccactctagacagctgagatctctcagctccagttttgctcaactggactccagccctcacccaggggccctcaccccygtctccagcactgggttccatcctgcccaagagaaggcatctctaacaagtgcttcagcccacttcctggtcaggccggctcagccgcgcttctgggatt

SEQ ID NO: 31831 - DNA, 201 bp, Bos taurus
aagcaggaattctgccttcaggctgtcttctgatttatgactccaacatcaactctgccctggtccctatcctgctagccttctctgaagacctcaaaacytgctcccacaactgcatgaaccaatttcttaaaagtttaatagacagataggtacacaaacactcagaggacacaaacaaaaccttgtgtgcaccaggat

SEQ ID NO: 31832 - DNA, 201 bp, Bos taurus
agtaggtgcggccttggggaggtgcttccgtcctaaaggaaggctcagaaggggattactgccccaccataacagacccacagagatcccttgccccttcyggcgtgtgaaggcccggtaagaaggcaccagcttcaaaccaggaagaggaccttcagaaagtcactctatgcagcagcttgatctttgacttcccagctc

SEQ ID NO: 31833 - DNA, 201 bp, Bos taurus
tgaaatataagacatatattcaggaacacacttgttatgtgtgtctggtctcatatagtttcagaactgatcctagaaacgtcttaccaaggacagaggarctgcttcggttcatggaggaaactgatctaggtctccttttgtctgagccactctaatgaagctactctgtgttagtcacctgaggttatcccagcagtg

SEQ ID NO: 31834 - DNA, 201 bp, Bos taurus
gcaaagagtcggacacaactgagcgacttcacttcactttgcactcatttgttaaaattataacatgcctttggtgagtagtaagttggatgatagagttrctatatatgctaaagtgggttttttatttaaaagaataggaatacaatgaaattctaaagttggaaagtatatagaataaaattctaattcttgatgaat

SEQ ID NO: 31835 - DNA, 201 bp, Bos taurus
ccacctgagtactaatggtctaagaaatatcacttgggaaagattcacctacatggtttctatggagtttattacctggatttaccagataaaagggcacraacaggtttgtagttcttgtacatgtcttccaatggattcaaacaacactatataaggaccttgactgcatttctgtgactgacaggttttgtcttgatt

SEQ ID NO: 31836 - DNA, 201 bp, Bos taurus
ttccctggcagtccagtagttaagattctgtgcttctactgcagcagcacgggtccaatccctggtcatggaaataagatcccacatgccgcatgatgtgrccaaaaggggctacggagatttttttaaaaagaaaatgctaatggtcacattagtttggcttttcaacaaagtccaaaatagcaacgacctataaaaaga

SEQ ID NO: 31837 - DNA, 201 bp, Bos taurus
taggtgcttggagaccagtaatcaagacttgcaaatagatgggactctgcatgtcatgcgccaaagaactgtcgtgtccatcaacgtgaatcagtcaatamctgttcgatcaattcatgccttaaatttttgatgatcttctttttactgaactttcttgtggcttggaaccttttgtttactgtgatagaattaaatgat

SEQ ID NO: 31838 - DNA, 201 bp, Bos taurus
ggacatgactgagcaactaacactttcgctttcaaacaggtaagagactgctcatgccttcctttgtcaaatgctctagatggctttcagtgcttgttttytttgtgttttttcctttgctctgagtagttggttgtcagtgtgttagctttgaatccctttcatgccagaagccctggacaagaggagactctacttctt

SEQ ID NO: 31839 - DNA, 201 bp, Bos taurus
ctgaggcttgatcccacctttgcgtatgtcgagcctccttcctcataacctttgccgtgggtggagtgcctcacgctggcccccaacagtacagggtgttwtgagtgttagaaaggagaactaatatgtctgagattgagtagtgatcagctaaatgaaacaggtgggatgggctgagcattccaggcctaacgtgcagat

SEQ ID NO: 31840 - DNA, 201 bp, Bos taurus
ctaacctagaaaactgtgatttgtaatgccagcgactgtgatggccataaattggatgatgcctctccatccttttcaacgcctgcactatctccaggacrtgaacatgatgaatacatttgggcctgacaaagtgatatatatgtatatcacttctccatatatatatatgtgtgtgtgtgtgcgtgtgtgtgtgtgtga

SEQ ID NO: 31841 - DNA, 201 bp, Bos taurus
ttggagtgctgttaaaatatttttttattgttacctgtctttgcttgatttttggatgtttttacatgtaattttatgtttaactacattttcctactctmtgggttgcatttatattttcttctttgtacaatctgatgattttggtcatctcatgtgcacagatgactcattggaaaagtccctgattctgggaaagat

SEQ ID NO: 31842 - DNA, 201 bp, Bos taurus
tgtagtttatgcatgccatgctcacttaactgtcagatttatttttaaactttcaatttcctctcctatctccaggaagcatgtatttttatttttccacrcagtgtgttgtcctatttattattctggacatgggaataaaggcattcttggaaatgtctcgattatctttgccattctcttgttacatcctgtgatatc

SEQ ID NO: 31843 - DNA, 201 bp, Bos taurus
ttttaaatatgaaatgaatatatgtagttatgatgttttatattatctgtacttagttttaatgctattataatttgattcttccagtatctcaactgttrtctcagtgaatattcagaatcagtgatataaaaaatcaacggcacaagtagaataatgtgttaaaaggcatcagtctcaccatgacatgcccttgctttc

SEQ ID NO: 31844 - DNA, 201 bp, Bos taurus
ttttttgtaccttgataaaatcaagacccagtgaattgaaatggcctatcttaaagccatatcatcttaaaaagtgaatatacaaatctttgacctgagtrccccagttgttgttaacgtttatttaggttgccctaagaatcctgcttgagaaaaatgaatatgactctaacatcaaatccaagactcattgtttcatag

SEQ ID NO: 31845 - DNA, 201 bp, Bos taurus
gtatatgcaaactacttaattttgcaaaaaactctcatgatcacttaactgcggaccccagggcctttgatgtttggcttatccttccttctgtgtggccyacattgccccatcaatgggatggcagctcagtaccagtttacccctaaggcaatatgagagagagattaggaagttcaagcttatcaagttcattaacat

SEQ ID NO: 31846 - DNA, 201 bp, Bos taurus
gcttaacaaaattaccaccttcaaagagaagaatagttcttgatagcattcatagtaatgcttccatttctctgtggaaacataagcgggaagcatgaagwagacaggggagagagtctcaggaaaagcaactggcttgctttcattcctgtgttcactctgccttatttctcatgtattctatcttaaaatagcaacaca

SEQ ID NO: 31847 - DNA, 201 bp, Bos taurus
ttctaaaactgtcaaatcatttattcacgatttgcttttgaacaagatttctttatccatctctaccactgaatctgcagatctctcaaaatgcaagcaamgtggcctccttttattttctaatacccggaaacactagctgcctttctccccagctgctttcctgcccatgtcccttttatgagaacaaacgttgccatt

SEQ ID NO: 31848 - DNA, 201 bp, Bos taurus
cagcagcagcagtaaagatgttgaacgtcttttcatgtgaggctccatctttcttgattatttcatttcaaaggaatgagtctttatagatacccgagggraaaaaaaatctggtttgtagaagatttacatctccaagtgccagagaaagtataaagtaaatgccctaagaaaggcaatataataagccaatagttaaga

SEQ ID NO: 31849 - DNA, 201 bp, Bos taurus
aatataaaacagcaaagaaaacttgaggctgagacttcaccttcaaatgacaaaagacatgtgggttacttcttagcaggagtgaaacatacacatttcartgagaaaacgggaagccagaggtcacatttgctgtggaacatgtttcaaggtggaatcaatatcaaaatgatcattaaaggtaccatggagggtgcagag

SEQ ID NO: 31850 - DNA, 201 bp, Bos taurus
gcataaccaagtaggaacatttgagctaggctgctgagattctctggccaaattgaattggaaaggactgaatcataccctgaagttgaaagaatttctaygagtattttacaaaaagtccctatctccgtatctactcatccgcttccatctgtgcccataaaccctgcctccctacgtttaccacaggtgtactaactg

SEQ ID NO: 31851 - DNA, 201 bp, Bos taurus
ggcttagttttgtggtccttcttttataagaaaaggaaaagtataaaatattaaattacatgctatttagaatattgtttatcacttatttttgctttctwattcctaggtggcttcacttgtagaaaaactcccgttaaatattagatgatttatcaaattcaaaaccagctggtcctactacctttaataattgtgtat

SEQ ID NO: 31852 - DNA, 201 bp, Bos taurus
actgtcagctttcagaagttgttttgtggaatttgctcagcattcaaatgatctttcaataaatttgtgggggagaaagtggtctcccccttctattcctyggccatcttaggaccactcctctctttaaaaagacaaccagtatcttgttaataagttagcaaataacctcacatgacattttttcaataaatttcattg

SEQ ID NO: 31853 - DNA, 201 bp, Bos taurus
cttataaaagtacatggcacatctcatgttcagtaagtattaataaccactgctgtgatggtggtcagcgttgttactactgagtcatgctgccatctctyggaccagtttctcatgatgcataaagttacacttagcagctttaagaatgtgtaagtaactgttagacaatctattttgacagatggacatctgaaataa

SEQ ID NO: 31854 - DNA, 201 bp, Bos taurus
ggaaaatctgttgaccatgaaagggtcattccagaggcaaaagggaagaattagaagggaacagtgagaaaaatggagtagggagagaaagcacagaaaayatgggaataagtttacaagaaaagacaggtgtcaagaatagaggaatttaaggtggtatctgaggatggggtatgaaggaaggcttgatctctaagatcc

SEQ ID NO: 31855 - DNA, 201 bp, Bos taurus
atggtcactcagtcaggtctgtgtcaaaggcctgcaccatgaatcagagcctccagttatttgatgtgctcacttccctttattatatgtgaaatcttacrtacaaaaagaggggccacaactgtccaggaatggacagttaaatataaacatagaaaaatggttatcaatttgaacatacacctaattcttccaggaatt

SEQ ID NO: 31856 - DNA, 201 bp, Bos taurus
tagccatctaggcctagcatctatgacctagcatagccatctaggtcatctttttagaccaaaatttcattaaattttatttttgtgatgccctattaacrattcagtaacagcacaaatagtcctaaatcctgggtgatagcatgttcttcttctagttttagaaatccaactgaagcaacacaggtataaaaataccta

SEQ ID NO: 31857 - DNA, 201 bp, Bos taurus
ccccattctcactgttcaaatactatgtcatctctgctaatcccgattctcttcaaaactgaacttaagctgatctaacatgcaaaacttagaaatgcatycagagcctactcatgacacctactcaggaaaagtcatgaagaatcacaagcaaattcacctattgtacctatttatatgttttactccctcatgccagga

SEQ ID NO: 31858 - DNA, 201 bp, Bos taurus
ttcttgcttggagaattctatggacagaggagcacccatggggtctcaaaaagttgcatatgactgagcaactaacacttttacttttactatatttcctyttggggagtacctatgtgaggaactgctgagtagtaatgtaatatttgttttctttgtataaaaaagattgtcaaacttttcctaaaaatgaccgtggta

SEQ ID NO: 31859 - DNA, 201 bp, Bos taurus
agtgtataacatctagtcgtctttcataagctagaataatatgtagagtaagtcttttccactatgaagctaagtgcaaaaggagccaagtgagtgaattytctcagttttgaagagaagttaatttttaagtgcttttacattatcagagtactcctgacttgtgttcaacaatcattaatactaatgatgtttatgtaa

SEQ ID NO: 31860 - DNA, 201 bp, Bos taurus
taatgacaaagtgaaggacaacctacaaggctgttatttcttacggggaatacagtgtactagtttggaaacaatttgacctctggatatttgattcttamactattcactgagtgctgacactgggagtcatgattgtttcagatttgccaggaaagactaagtggtaataaactcttaggaggagaaggggacgacaga

SEQ ID NO: 31861 - DNA, 201 bp, Bos taurus
aagtaaatatgaaaacaattctaagtcaacctctgtgaaagtttctaaagttctctaatcagaaataatttttgccccctcagtgctcctgtaacacctgrtttaaacatgcctgtgtctcccattagacacactcttgaaaatcaagaattttaattacttcatttttctagtgcttaaaacaaaaattttgcttaaaag

SEQ ID NO: 31862 - DNA, 201 bp, Bos taurus
tatatttaggaggctccttttataaattgttcaactctactgatagatagagagagatgcccctatcttttttcctttggaataaagttatattatataartcatgtattcccatttattattcccatgaataaatgaacatcaggaaatatttctaggagacattcctaacagagtgcagtgtggtactgtgatgaagag

SEQ ID NO: 31863 - DNA, 201 bp, Bos taurus
aattttctcactacttttttcttcagtttctaaaaggggtttgtgatgactgggaaattacaattccccatccaattgcaaacatgacattttcactaaayccatcttggtctttcctcatttgttgctcacaggtaactctgttatatttggcaccaacaccaacacaaatgcaaatgtcttcaactgaaaccaagaacc

SEQ ID NO: 31864 - DNA, 201 bp, Bos taurus
gggcaaaacatataaattccaagtaaaatctcgaagacacaatctgaacaatataatttcatgagtaagatatacatagtataatatctaccattatcacragaaattgaaagtatactattcatcatcagacaactaggaaaatcaactttaggaatgtgcatgtgtattcacacagtggacctaatattcattatccca

SEQ ID NO: 31865 - DNA, 201 bp, Bos taurus
ccgaaatcctgaaatagatatggaaagaaatggtgtcgagggttcacactgagcgaaagcacgcagggggctttccagaaccttggaggtggagcttctcrggcctggagagtctcctgaggggtcgagaggagaccgccaggctcgcatgcgcgtgggtctcaggttggacacgggtgctgtgtccagaactgcccgggc

SEQ ID NO: 31866 - DNA, 201 bp, Bos taurus
agtttttcctatattatcaatatctaatcgcttatttttattccttgaatttcacttttagcatcattttttttgtttgtttcataaatggcattttctcrcttttctccctgaagataccaattatggatttttggaagtttatttttctgaattgtttttgactcctttagtctccttattttggtttatttggcatcc

SEQ ID NO: 31867 - DNA, 201 bp, Bos taurus
ttaaaaaagcacttctgtgtatttttcctgctttgggttcttttcccttcctaatcttcctccttaactcctatttatttttcaaaccaacacagtcattrtttgcttcaaaaagtgagtttatatcccatcaaagttaattttgactttattatctatgaacatcagtcattgatttgtctgatttccacttaaaactgc

SEQ ID NO: 31868 - DNA, 201 bp, Bos taurus
ggtggtgtttggaatttatttctgtaatatctgctccaggacgtttcctgagggcagctgtccttagcagccacccaggccccgtagattggaagtagaartgttagtctcttcagttcagttcatttcagtcactcagtcgtgtcccactctttgtgaccccatgaattgcagcacgccaggcctccctgttcatcacca

SEQ ID NO: 31869 - DNA, 201 bp, Bos taurus
tgtgtcatggaccactggagcagaattctttgatctagagcaaagtagctcagtcattctgctggtgaatggatgtaacaccatcaatttctggcctcacrtcattattatttttacctagctattggatattgtggttctgggtctgtccggttcactctgatgagtcaggcactaaagtgcaccctccagaaaagatgc

SEQ ID NO: 31870 - DNA, 201 bp, Bos taurus
gaggttgatacaactgcaaactaatcaaatatgaggcccttccagagtgcctagttcccccagttaacatataggtcttctgtccagactaggaagcacaytgactccctgaggcctccagaatgtgcagagccacctacaaattaccacatgcagaccatcaggtgagccttgcaataagaccaggagacaaatctgctg

SEQ ID NO: 31871 - DNA, 201 bp, Bos taurus
agaaaaccagaaccttctagctgtaaaggcccttagaaaccacctcatttgtctccttgcatcttaatacatatgaaaataaagacttaagagtggccgtkacctggtccattttataaatttgttagttgcaatgctggattagaactcattatctttgatgacagctcttttaacaatctcattctgcttttcaagatt

SEQ ID NO: 31872 - DNA, 201 bp, Bos taurus
cagaatctcttatcagtaggtttctagtttagagtccaccaggcagaggccacaaagtttgaaatgccaagggaaacagaaatcattgctcttcatccaakcaggagacctcctgggcttcaacaagagatgctttgcagctccactgcttcctcctggaagttattcctctggtgtagcagtgacctgagatcatcactg

SEQ ID NO: 31873 - DNA, 201 bp, Bos taurus
ccatgccacaagtattttgttgagagcttatgttacgacaagcgttgtaccaggcataggagacagggaggtactggggcccagacttgtccgtggagagytccctgtgcagagatgggaacgaaggagcaccttgactctacatggatgtctgaggcctgctcagaatctaccaaggagggaagactcaccttgactctt

SEQ ID NO: 31874 - DNA, 201 bp, Bos taurus
tttaatgttaatagatgttgttaaaacttcacattttatatatttatcaattttttatcttctgaagaagataaattatatccaggactgcttgactttgwaacataaaatttacactataggttgttatcaatatgtaaagaaaacagcaagaattgattttttcagtggttctcattccaaccaaacataatcagagaa

SEQ ID NO: 31875 - DNA, 201 bp, Bos taurus
aaaatgtaataaggaaatgaagtggaactctgttgtgttttaccagctaaggattattataactttttaaaaagtgagagagaattagaatatttactttyctttaaataataacaatattaattcatgactcctatagccttagttaggaattatgaggttggtcattaaactaatgttacaataggtactatgatttat

SEQ ID NO: 31876 - DNA, 201 bp, Bos taurus
tataagaaaagaaagataaatattgctatagtgcaataatcctggtgggtatgattatctgaattgaggtttttggataaaagataaggcatgaatatgtrgcctacaagtcacctgaatgttggttcccagaataagactcaagtttttttaactgacccattaatagtttgccattgctgtatatgaagacagagaggc

SEQ ID NO: 31877 - DNA, 201 bp, Bos taurus
ttagggacaactgcagctctttcttatcagttgtatggctttggttccagggttactaatcatgatcttttcaaaagaagctagaattgtagatttttaartaaaatctctcgggatgttaacgtttgcagcttttaatttttaaaccagccccctctccttccaaataaaaaaagaaaaaagaaaacaaacagtctgctc

SEQ ID NO: 31878 - DNA, 201 bp, Bos taurus
agggtgtgatagttatgttttagaagaatttcactatagtctaaactttcttttcccaaactacagcatttttgttgttgctacctagctttgagccatarggctctgaaaataaatatccagggcaagtaaaatagtgtgaatttcaatatctttgttattgaatctagattttctcttcaaagatgaacaagaaacaaa

SEQ ID NO: 31879 - DNA, 201 bp, Bos taurus
acacagaagctactgtttcaaacagaagacaattataggaaaatctcttaagactctgagataatttaaatattttggtttgtattatcgaaaactgaatrttaaaattatattgggattaaaactgggagtttgtttttctaatatgggaaaatgtaatttaatttaatttctccattaactgtaagaaaagactctatt

SEQ ID NO: 31880 - DNA, 201 bp, Bos taurus
ggtccaacagatcttattgctatctccagctcctttggtttcattattgtccttcttagtgtgtggaacatgaatcactgggaactggcacctttggcctratcttcttttcattgcctatgttagtaataaatagtctaaatctacaagtgactcattgtatctttatgaattggatcaatcaagccttgggcttggcct

SEQ ID NO: 31881 - DNA, 201 bp, Bos taurus
ttaaccgtctgagccaccaatcaaagagtttagtttactcaaaatctgcacccctcttgttataagaaacagaaataatggccaggtaaataggagatacygttattctctctactgtacagctctagagtacagttagctacttggcatttcactttttccttcattcacaggtctgtgccatgcctaccctctactcaa

SEQ ID NO: 31882 - DNA, 201 bp, Bos taurus
agttccaaagagagctaaatgaaaaatcaaattgatttggtcttataaaatactattgactttgatttttgtgtccaatttatgcttctgtgcattttcarggacatcatttctaacaagattgcatgatttggacatgtgcaagctgaagtacttaattaccccctggaatgaaccaattagatttttgactagacttct

SEQ ID NO: 31883 - DNA, 201 bp, Bos taurus
ctttcaaatacatgtaggccaatattagaacttttgatttgaaatgcaatgggtaaatgttaaaggatttttacaaagaggcctgacctgatctggttcaygtgtaaccttggcggctgtgtaacaataggatggacgaagaccacaggcaaagccgagacaccagtaatgaggctatttcagtggccctggaaggagttt

SEQ ID NO: 31884 - DNA, 201 bp, Bos taurus
ttttaaaactaacagtttacttatcataattttgaaaaagaacttaaagaatggttaacttctagaaaattagtactggagaaatactttttttcccctcwcaagtttagtttgtaacataaatcagagtatgtgcattttcataatttagttttaaacaaatttattaccacttcctggaagatcccctggagaaggaaa

SEQ ID NO: 31885 - DNA, 201 bp, Bos taurus
taaaacattttaagcctgttggactagatacacaatttatccccaatatattagagcttgatgtggggtggagagaggccttcctaggcaatggttcttcratgctctgccctatgactttgaattgcctagccagcttcaaaggaatggcctacacttgctctcattctctttgtattaatttaaatttcccctatggtt

SEQ ID NO: 31886 - DNA, 201 bp, Bos taurus
tatcagcaatgttcctgcagtagcttcttagtgaatattctgtgcttcatgttgacatgaatatggtcatactaaagtacagatttgtacatcctaaagtmgaggccctgatgctgggaaagatttaaggcaggagaagaaggagacaacagaggacaagatggttggatggcatcaccaactcgatggatgagtttgagc

SEQ ID NO: 31887 - DNA, 201 bp, Bos taurus
tttttgaataaaagtatctttgtagaaattaaattcacctcagtaaccgcttattgaatcctactgtattcagacagagtgctgtggatacttagcagaamgaaatataacctgatctcaaagtattcaaaatcaagcatagaaaacacatagaagtgatcaacagtttcttcttctgcaccctctcatcctcttcatttt

SEQ ID NO: 31888 - DNA, 201 bp, Bos taurus
tattttcctgtactaattattttcccatcacagttggtttaatgttttctcatacagggaaaggagacaatagcagtctgctatcctcctgcttcatatayaggtgttatggacacaatgttcgtgtcccactaaaactatatgttcaagtcccaacccacaatgtgattagtacagtctttggggggtgattaggtcttg

SEQ ID NO: 31889 - DNA, 201 bp, Bos taurus
ttaccaactgagctatgagagaagctacttaagccctaattcctggcttctgtttctctataaaccagaaagagaaagaaaactaataagtgagaactctytacagggactctggtgtggaatgttgaacaagaggcttgcctgttgatttgatagtagttagcaggttagagtcaaggttaaaatgttttatgaaaggat

SEQ ID NO: 31890 - DNA, 201 bp, Bos taurus
aagaaagatttgcaagctctttggaacatgggtaaaaacagataatgacaggaaccatagagataatccggctaacatataggtggcctcagtcagccatrtgacttgaaaatagatatctaaactgttttcattaagttcagttcagttcagtcgctcagtcatgtccaactctttgcgatcacatgaattgcagcacgc

SEQ ID NO: 31891 - DNA, 201 bp, Bos taurus
ggtgaggactaagcatatatgatggagaatttttaaaagaattttatcagttacaaatgccattctttctttttcctactataagctagttaatatgtgamaacttgaactatattaaattttgtaacatttaatcatgaatcatcattggctcatttatgttaaatatttctcaaatatgcatcagttatttgatcatct

SEQ ID NO: 31892 - DNA, 201 bp, Bos taurus
gctccagccttgtccctttctgtttctgtccaaagaggaacccagaactaacacactcagtagtgcatatccaacccttgggcccagactctacctctaaycaaggtacacaaacccaaaagaagaaccaactcaatcgtacagctccaaaaccagaggccctggccatgctccaaccaaggcagaaactaccatcatgct

SEQ ID NO: 31893 - DNA, 201 bp, Bos taurus
gttacctgtgtcaggggagtttgtaattccctcggttctgtgtcctagcaacaaaaatttgaattgacagatggaccagtattaaaggcctcagacagacyggtgttacagctctgtattacagctcagtttcatttagaaagtaaaggaaaatacatccttgaggtgtgagggcatgtggacccaaaggatgtgaaaaga

SEQ ID NO: 31894 - DNA, 201 bp, Bos taurus
attatggagactaatctcttccattaaatttcctactggttctgtttctctagtgatagtcagacagatatacctcctatatagccaattcccttaaataygtattgaggccactgttgaatcagggaaaagatcaaacttttctttttaatcaactaggtgttgtggttttattttactcacactcacaggttatcaata

SEQ ID NO: 31895 - DNA, 201 bp, Bos taurus
tttaaaaagactagaagagattgaacgtattttaaatggtgaatagcattactctttatcatgtgacagggtttcaaagaacttcagtctatatcatgtgrttacttatactgagagctttgaaaatagtgagcatactaagagtctctcatgagctgcctctacgtagtatcaaaataagattttcattgaagacccttt

SEQ ID NO: 31896 - DNA, 201 bp, Bos taurus
ggaaaatctattgccctgtctccgaatagacaaaagaaggtttctctatgcccagaagaaattctcaggctataaatctggatattaattgaaggtgtcaraataaatatggatgaatcaaactattgaaagttgttaaaataggacaaaaaatgcttgtgtttgtatgcaagattattgattcaggtagcatttcatgca

SEQ ID NO: 31897 - DNA, 201 bp, Bos taurus
tactggccctgagataacacaggtccctatccttgaggaattcagctttacagtaatacaattttagttgctaacttttattgatctcttattatgtatcrgccactttgccaagggtattgcatatgttttcttttctttttttgattggtaagaagtggatttattcagatacagagagaagcacacttcacagacata

SEQ ID NO: 31898 - DNA, 201 bp, Bos taurus
taatacagggcaaaatgtgttagctgttgaatagaactgacatccttgattccaccaccaatcacctatctgatctcaagcaatttattaaacagtcaacytcattttcttcatcagaaaaacaaagttaatgtaaacataccttgaagttttttatggagagctaaaaaagatatgtaacattttcaacaaaatggcttt

SEQ ID NO: 31899 - DNA, 201 bp, Bos taurus
ctgcgcccaccgcggatatctccgggggcacctgaggtcgcggggtctccccaagctagacgccctgcacccacgggcctgcctgctgacgcccccgctcyaatttgcatctttagtcacccgcctcttccctggtttggagaatgtaggcttaaaaaaaaaaaaaaaaaggcggctgctaggcccaggttgccaattttg

SEQ ID NO: 31900 - DNA, 201 bp, Bos taurus
gaaaacatttagtgccttcatctacggaagatacgtgcacgtcacatatttctaactcttcattttctttcaggttggtcaaagaataagcaatatatgcygtaaattaaatcaaaatccctgccatatgtcctgtatgtgctgttgctaattaaaataagtgtattcttgctgtggaaattctgtggtttgagagtttgt

SEQ ID NO: 31901 - DNA, 201 bp, Bos taurus
ccgcacccccaccttgttctgctgcgggcacaccggcctactggctattacttggacactccagacctgctcctaccttcggccccttgcactagctgtaycttctgcctagaaaaaccgtcacccaggcagctccaagattctctgtgatcaacttccagtctgtcccgccctctggcctgtgttctagattccccttgt

SEQ ID NO: 31902 - DNA, 201 bp, Bos taurus
gcataaagtacaaaaggggccaggaaaatggagcttcaaggaggaatctgtaagagaggggagagaagacggatagagagtgtgctcagagcatggagagygggcatgtgaccatgtaaggccagaattatcaaggagcaattaaggggcattacagcaacccactccagtactcttgcctggaggatcccatggacggag

SEQ ID NO: 31903 - DNA, 201 bp, Bos taurus
ttaagtgcaaacactaaataacttttaccacggagcaaaaacatctttagattgtttatcaagaccttctggtagatcttgagtctctttaaatggccctragacaccaacaactctagattttcttctcagttggatataacaccagttatctccttaagcaaatttgaaaaagggcctgtcactacactgtacaaatga

SEQ ID NO: 31904 - DNA, 201 bp, Bos taurus
aaaagccaggaacatggttgactggtccctgggtagtatggagggaaattttgcatctggttaagagttaaaaatataaacaaaaaaacatggctgctatrtgatccacaactggatggaaggctagaagaggtcgctataacaaacacaatcacaatgaaaaagccccaaagattatgagacttaaaaaaatgtgacaca

SEQ ID NO: 31905 - DNA, 201 bp, Bos taurus
aggtttcatgcatttgaaaacagacagttaaggcctgtgattcctgagtaaacatttcggagtctgaatactttcttgcaaatttacctggtaatgaaaakttaaagttccttaggaaggtcctggccatagttttcatggctgttttagctgccctgctaattccgttctgaggatgctatctgagacatttatgtgaca

SEQ ID NO: 31906 - DNA, 201 bp, Bos taurus
attctttcattcatttttggtgaaattgtccattctaaaggcctttattactagacagtttggtaatatgaaacaaaatgtatactatgtatattatagcrttctaacttctagttaaacttaggagctagtatttagaaagataaaagatatgccaaggtttcatcatagcagcatttttaatattaattaattggaaac

SEQ ID NO: 31907 - DNA, 201 bp, Bos taurus
gtcatttccttcactgtcccttcctccaaagcatgtgagagtaatccataaattacgttcagaaaagggaatattcagaaacaataagaaccacaaagcartcttcagttggtcaaaagtgttgtacttctccaggcaagtagaaaattctaatttgccttctacctcctttccaagcctctactctgtgcctttgaagat

SEQ ID NO: 31908 - DNA, 201 bp, Bos taurus
ctcaatttgggaaaatctgctctcaagatcattcatgttattggcagaatttatttccttgtggctgtttaactgagggccctaaactttagctttcgtgktggctgaggaagtcctcaaatttgaaggctaactgcaggttggcgaggacaccagtggttaggaggcagcctgcagatcccggtcatgggcttcctcaac

SEQ ID NO: 31909 - DNA, 201 bp, Bos taurus
gttaatattttacagagtcttattgggtaatcacacttgccctgactcattacttccacaagttaatgtcctactgtttaaaatagaactttctccctgtrtaagttctctatcttctgttttcatgatgaacatctggcatcaatagtatgatagtttaggaaaaaattttaatcataagggtttttttgaggatttagt

SEQ ID NO: 31910 - DNA, 201 bp, Bos taurus
aggggtgaggtcattggaaaaaagtacaatagtatgcactggttatttgaattaaggaaagagtgaagcaggagatagatggtccctgggccgaacagttyctcccctgtggacggaaattccttaagagcagaaactccattaaagcaggatgatgaggggaggctgggccctgcccagataagagataaaagaccacac

SEQ ID NO: 31911 - DNA, 201 bp, Bos taurus
aaggtcttatcatagctttccttatctattcagtctattaaataatgcaaatttgaggaaagaggatgttaaaagactcagggtcttcagggatattcctrttggtccagacatggactctggctaacctacaagctagttaatcatggattatttattcattttatgttgattgaaaattaatgcactgtattcagttga

SEQ ID NO: 31912 - DNA, 201 bp, Bos taurus
agagtagagagatcacccgggttttcttaatatctaagatttcatgggagcaaatcacagacttaaaataatctatcaccttggaatcatagaacacaagrtattatttgttcaaaattttattttacataaggggagctatgaaccttagaaaaaaatttttttagtgatgtgtccaagattgcagagcgatgcttctct

SEQ ID NO: 31913 - DNA, 201 bp, Bos taurus
tgaatattttgtccttccctcaggataacatgctgagatctcttccatatttttttaatacatttcttgacctgcccctagactttttggggttgattttyataatgaacatttttcttttatactttcttttgaacacttccagacaaatgaagaacttccagacaaatggaaaaacaaacaaacaaaaaaaacaaacct

SEQ ID NO: 31914 - DNA, 201 bp, Bos taurus
aaacaaaaactattgccagtttttccctcattacagtgtcgtggccagccttctctgctgaagtttttcttctgtggcggcctcataggaaggtgtcatcytcatcttaccataagccacaccaacttcagtatttgcagtggaccctgcattcttgcagcaaagatctggctcctcccccatctggaaagcttcccacca

SEQ ID NO: 31915 - DNA, 201 bp, Bos taurus
ccctgtgagaaggaggtcagaaaactgccgagtggtcagaaagtgatctgtgtcagagcagagtggccaggggcttatgccaatgaaagatctaagccaaygtagaaagcacgtttttaacaagtaagtagtgctatttaaggagaccagttgcaaaagcagtctcattgcctaattggagagggcttgttgatcatgcaa

SEQ ID NO: 31916 - DNA, 201 bp, Bos taurus
ataggactactttcagttctaaggggttggccgttgctgaacagcagtgcatagaaataatccttggcaatcccatgggtgacatttctccttccttatcycccatgctgcatgcggccagaacttgataagacacccagaaagaagataatggctgctatcaagctgtctaggtagaaataataataataatctgtttat

SEQ ID NO: 31917 - DNA, 201 bp, Bos taurus
aaaatggatttttccatctccagtcaatccaagtgttatgagctgaatggtttcctcccaaagatgttgaggtcctaacatccaatacctgtgaatgtaaycttatttggaaacatgagtctgcagatgatcatgttaaggtgaggtcatgaggtggggccctactccaacataactgtgccctcgttaaagaggagaaat

SEQ ID NO: 31918 - DNA, 201 bp, Bos taurus
aacatttgtccagtttagcaaatgtgagcatggcagcatgaagaacagaaaatcgagtgccattttcatgaagcaaagttactgggccaacagcagatgcrtctgttggcaccaggcaaggtccattatgtaagcagtggtaataccagagatcaagagcagacaaagcccaggctttcaggcctggtaaaaagacccatc

SEQ ID NO: 31919 - DNA, 201 bp, Bos taurus
actgaactgaactgaataaacatattcaagtatctctggtttttaaggaagaaacatttcctagatgaagttccactccagtttctgcccagtctttatgkaattcacatttgaatttcattccttctctttacaaattcctctttatcagtgtcaccaatggcctcatgttgccaaatccaaaggattcccagtcttcat

SEQ ID NO: 31920 - DNA, 201 bp, Bos taurus
cgaaattgcaaggaagataattttaattcaacttctaattggatgccgttactccaattaatctttcaaaaagtggcagttaataaatttttgaaagtaayttgtctagcaaaaaaaaatcttctgaaacatttaacagattgaacagtttaggatattaacaaaagaaaattaggaagcatctatcaaaattttaaaggg

SEQ ID NO: 31921 - DNA, 201 bp, Bos taurus
catcttctcttatgatttgatagaaactcattgatagaagattccacagaccacctaattcagtgtgttgcttaagtccatagatggcttagaatagtctraaaatctaaagtagagtattacagtcagggctcaaataaatggtcctttgtaaaatactaatctgaaaatgtcttgccaccacaggtagcatgaatgaga

SEQ ID NO: 31922 - DNA, 201 bp, Bos taurus
cgtggagtgttaactctcctctggatttctgagttgaatactgcctcctcaggcaaccactaaagacacctaagcctttttggatctgggtgctaagggckctcctaaagctatggagcccacagagcccgggaggctgaagcaaccgctgatcttagacagtgatcacagggacagccacaggactcaaacgtatcagaa

SEQ ID NO: 31923 - DNA, 201 bp, Bos taurus
gaaagtccatggtgaagagaacacaggacatcttagtgactctaatccagaccagcaagacagggcagttccacactttctgccctcacctccaggcctcmagggagcagatggggagaaacccttgagggcttatctagtcagataaagcagtgaagccacagcctgtggcctctgacagatttctgtatgggtgataag

SEQ ID NO: 31924 - DNA, 201 bp, Bos taurus
cttctgcagtttcagtatcctcagtttttctaatagttactcaaataccctggatcccaagctcctcaccagctctctcctagtgatccagcccagtaccscagcatcttaaccaagtaggatgagtccagtagattggacccttccatgagtgtttcctaaaattcctaaaattcattgacttctgcttgctccatcacg

SEQ ID NO: 31925 - DNA, 201 bp, Bos taurus
cctgtgactgaacatgcagagcctcttactgttcagggtacagcaaagcagcaggatggctgcaatggggtgacccaaggagagaaatgcaggacatggtmtcagagggaggtagatcccagatgcatggagagccttgtagctaggaggaaacacaatgaaaaacctctgcggagttctgagtgggagaatgactagatt

SEQ ID NO: 31926 - DNA, 201 bp, Bos taurus
aacaggaagtacgtggtccttcagtacttttaccaaggcatgtgaactggtaggcacacttcagagtgtattctgaattgggatggaattccggcctaacrctcggctctccttaaatgaatccctgcagtcagcaagctggcaatttatgtgcactacccaagatacagagataaataaaacatagtgcctgccccagag

SEQ ID NO: 31927 - DNA, 201 bp, Bos taurus
ttttacttttgtttccctctattttttgtcaggcctgcaaagcattttcctccttatggttagtgatttctgctaaagcacagacattacccaacacaggkaagccaggagcatgcaggccaacagctgcccttgctgagggaccagctcctcccttcctgcagtttcccaggactcagccttgatgccctgaaggacaca

SEQ ID NO: 31928 - DNA, 201 bp, Bos taurus
agtttcttgtcacgttagggtgtccccctatagccataaaaggttgtttctctaattccaaagtaattctgtaatttgtcagaggccactgctactggtaygtcataggatcacagtcacacgtggtctgttgacttcctttcctctgtgcctgttcatacactgagctcacacacttgctgctaggcctctcatgacacc

SEQ ID NO: 31929 - DNA, 201 bp, Bos taurus
tcgcatttaagttttattgtagactatttgtttacttaattaagaatttcttcctcaatcaaagattttgcgcatgaaggtatttcctgagatctgatacrtggtgtgaatgaaactctgacttatgaaacccaaatgtacttatggaaatgaacacatattttcatttcctagtaaagttaaacaagattaggggtttac

SEQ ID NO: 31930 - DNA, 201 bp, Bos taurus
tactcatcagttcagttcagttcagtagctcagtcgtgtccgactctttgtgactccatgaactgcagcatgccaggcctccctgtcctactcagactcargtgaaaatgacttttctgatgatgtctagtcaagacctcaagacatgataactataaaggaaatgaaaaatgcaaataaggggcctggaaattcagtgct

SEQ ID NO: 31931 - DNA, 201 bp, Bos taurus
gagcactttaagagaagagatgacctttcacattttcctagtaccctcctagtacttcatttagtgtggtcagtgttagcttttcaataaatacttgctamttgattccatttaggacctttgtgttaaattgaaaataattctctggaaaaacacagatatttacttaaataatgtgaattgcaatctactataattctt

SEQ ID NO: 31932 - DNA, 201 bp, Bos taurus
atgtctctagtctttccaaccctgttgttttcctctatttctttggattgttcacttaagaaggcattctcatttctccttattattctctggaactctcyattcagttatgtatctttcactgtcttctttgcctttttcttcttttttcagttccttttctcagaccttttgtaagatctcatcagacaaccctttgtc

SEQ ID NO: 31933 - DNA, 201 bp, Bos taurus
tggttgtcacacagctactgctagagctgtgcaaatgtggcagccatcttagagctgaatgagcatctccaggaaggttttagcatcttcaaggcccctcyccaagaatcatggggcatccccttcaagaagccaggggctgaatacattctgtgagtctttgggctcctgcccctttgtagctcctctggccctcaaacc

SEQ ID NO: 31934 - DNA, 201 bp, Bos taurus
tccctagaaacttcagttattgaggacagacatacatcaacagatactcattaagctataaattggttgcactggttgagtagattttgaatgctactggrccaagggagaaagatccttatcacatgagggagagaatggagacacaggagactgagaagtgatacctaagataaggcataataataaatcattaagctg

SEQ ID NO: 31935 - DNA, 201 bp, Bos taurus
cacacatacatgcacacagtcaaagaatacctaggaatcaaatttagaacagaaaaaacattctctgagtagcattttaaggagaagcatatgttttaggkgtgtgacatacattgaccacacaaatgatataactaaacgttttgttaattctggaaatttttgcctcaaatgacattatggggcatttgggattagcag

SEQ ID NO: 31936 - DNA, 201 bp, Bos taurus
agagaaaaaacaggacatattatacacagagggacctagataaggagttcagaagatttctcactggcaacaatgcaaagaagaaaacagttgataaataycttgaaagaactaagagcaagcaactgccaacctagcattgtgtatcttgtgaaaatgtctttcaaacatgaaggttaaataatgtctctgtcagacatc

SEQ ID NO: 31937 - DNA, 201 bp, Bos taurus
agcatgttttttcttacttggccagcaaccgccatcttgttacaaaatcacattatttacagcaagaaaattattgaaatgggctggtgctctgacctccrttaacagtcacaggcttaggaaggcccatcaagttcttctctgctctcaggacaatgatgagatggtgtaagaacagacacagttcagaagactgcgtta

SEQ ID NO: 31938 - DNA, 201 bp, Bos taurus
gcattaatggctccacaacctaattcaagcagcatatgcgtccccacacgcccccccatacatgcgcacgtgctgagggtgtttgttgcaacagtggaacmatcccagaaatgggccattataaacatcttgttcatggctttccagctaagaagtttccatcaaaatgatacatggtactggctatgcaagaatttccag

SEQ ID NO: 31939 - DNA, 201 bp, Bos taurus
tcagctcctgctgtgataggctcttccttcacctcttgcaatccaagcctccctctccttggtgcctctctcctccagctctgccaggcttgactcatttrccacttccctccattccatggctcttgcagatggcaggggggagtgggaccattggccatgagtagcaagtgatatgttatgatggaaaattcttctcta

SEQ ID NO: 31940 - DNA, 201 bp, Bos taurus
tctgctagcctcccatgagttagggaagggaagcttacctaaccctaaccctaaccctgccaactttggattcctaaattcacctgatcccccatccaccrggggccaggataggcacagctgcaggaaggcacttcttcccactttctctctctcatccatcagatctcagtatcaatgaatttgtccttcatcattgga

SEQ ID NO: 31941 - DNA, 201 bp, Bos taurus
actttgaaaactatgttttaatgatgttgtggattaaaaccagcaccacaaagccacatccaaagaataatttcacctaatatgacaaaagagaagttcamtttcacttgagcaagatatcttaaccaagagaggtcagatccccaaaatgacatctatccctttagaacttttcatgaaagagatctgggatttacttat

SEQ ID NO: 31942 - DNA, 201 bp, Bos taurus
tacatgtatttggaaaatatgttgacactgttatttagatctcaagcaaggaagtaaaatagtttattcattatggcctctggagaagagtctatggcttygaatgaaaggatttatctggtttgtgttaatcaataaaaagtagctgaaagtcacctttagtacttctcttcaaagtaactaatcttttggttccatggg

SEQ ID NO: 31943 - DNA, 201 bp, Bos taurus
gactactgtgagatgatacctccttgaagttttaatttacattcctttggtaattaaagactgagcatcttcttctatggtttttggccatctaattaatyttgacactgaaaatccctgtttgctgtagcatcatgagtcccacattacactgtataccttaggcacattggaaatagaaggagacatttgaggtgctat

SEQ ID NO: 31944 - DNA, 201 bp, Bos taurus
cctggaggaaaaggcacagtcatgcagaccacatggactgctttcactgtaaattcattcccacaaaactcaaatgggccatcaacactggtagacaatcycatatgcttcccttgtgaagctgctcttctttcttcataatttttccaataaaatatgcccactcgcagctgatggcctcccatcatacttcacaggata

SEQ ID NO: 31945 - DNA, 201 bp, Bos taurus
tattgtgacactcaatgtgttgacgctagcaagagggtccacaaataatttgcagtcaaataaattgcttcaaaatggcccagactgtgaggttatttaayctgtttcttgatgtgtgcctcaagtacataaggtggctcaagctcttcctagttaccatgtcagttctcccttggcctcagaatacaggtgagcaacaca

SEQ ID NO: 31946 - DNA, 201 bp, Bos taurus
tacttctctagaggatattttttttagtgaacatagtaaaggtctagaatttaagctagggacaacttaggtattttctaggccagaatatataaaattartatttttgagaattgatccattcaatatgtatgtagagtgtgtttggccttgaagtacaaaatgaagcagggaaaaggttaacagagctttgccaagaga

SEQ ID NO: 31947 - DNA, 201 bp, Bos taurus
tctgaatggcgcctggtcagtcattgttccaaccagtgtgggcagggagggccattttcctgtctcagcctacaaggactgatgagatggaatctttagtstgtctctgtggcaaattttcttggccaaagtggaaagcaaaggcaattatccaagaatctgaggtaaatgtgtgtttttctgacccaaatacttgaaaaa

SEQ ID NO: 31948 - DNA, 201 bp, Bos taurus
agattgtaaaggaagaagtaaaactatctctatttctctatttgcaaatgacataatcttatatgtagaaaatctttagaaattcactaaaaaactagaaytaataaatgagcttatcaaggttgcaagatacaagataaatatacaaatgtgaattaaacttcatgaaaatgaaatttaaacaattacatttataataaa

SEQ ID NO: 31949 - DNA, 201 bp, Bos taurus
tatctgtattttatttgccagatgatcaggttaagaaggtctgatacttggaagttgcttataaaatagcttagaaattatatagcaaattcttgaactaraggaattttgtggtggctaaatgattgggtctatatataaagcttctttaaatactatactctgaaaatataactaacctcaattttaaatcaaagtgac

SEQ ID NO: 31950 - DNA, 201 bp, Bos taurus
acttgacagcagaagccgggccttttagagcggttattggagcggcaaggaaagtggggcgggcactagagagaaagccgcgtgtctgattgggcaaacgkgatgtcactcatcccaggaccagggcttgctgcggaacagggtagctgctgctagacccaaccgcaagggtctctgcagtccctggaaccaaaccctgca

SEQ ID NO: 31951 - DNA, 201 bp, Bos taurus
tgtctaggggtggctgtcagctcagtatgactttaggcagcctatctgctgatgggtgtgtctgtgtttccactctgcttgttgtttggcctgagacatcscagaatcagagcctgaggtctgttgggttggaccaggtctcagtgccacaatggtggacctcctggtaagctcactcagcaaatattccctggggccagt

SEQ ID NO: 31952 - DNA, 201 bp, Bos taurus
tttggcaacaaggagttcttagatagattgccgttttccactttacttcattcttcttctgaggttttatcttgttctttcctttggaatatgttccccartcacctcattttgccaagcttaattgtttttatttctacctatctggtaggagatgttctacacatccaaggagcacattaccctctgaacactagagct

SEQ ID NO: 31953 - DNA, 201 bp, Bos taurus
tttcactgaggaattcttgcgacctaaaagaatgtttggaatcaagctgtaaagttagttcttacattttcagtttcagacacaatgttttttgatggacrtgctgctctagtacagacgtcctcttgaaagcctataaacatgatcttacatttatagaatgagaactttccttttacccaaaacaacacagtgacattt

SEQ ID NO: 31954 - DNA, 201 bp, Bos taurus
gttgcagaattctaataaggtctgtgtgttaagaagagaattttggctatttaaactgaaaccaaaggaaatattgctgaagtctgctattagatgaaatrtaaatttattacctgtactccatcttcacaaacttcatagcttttactaacagccttcgaacaatcatcaggaattttactatcggcaatgtgctcattg

SEQ ID NO: 31955 - DNA, 201 bp, Bos taurus
agtggcaacctcagatagctagtatttggttgttttctgtgtatctgtgcagatcaggataccaaacaaaaatgactggcccttccatgtggtggccctcyacttatagtgcacacccttcacacctgttctacctgtgactgtggtcaccagcctctgtctccaagcatccaggcctggtgctctctaagcacctgtctg

SEQ ID NO: 31956 - DNA, 201 bp, Bos taurus
ggttaggaccctttgttttatcgttctctagaatggtggaaagtacagaaaggcaatatgatgagcaacgggagagaaacgttattacttttgatgattcrtaactacttgttcagggaggatccagtgttctccaaatgcagatcttctcaaaagggcttttcgcttgcttcaagaatctgaaagttgagaaatggctgt

SEQ ID NO: 31957 - DNA, 201 bp, Bos taurus
gggtatcgctactttattgtgagagctagctaacgtaaataatatggaactttgtaaatatgagaaaggaaatatcatttttctgcttgaggagaaaactyattggtgctgataaggtttttctgaataatttagaagaactgttgtttggaaacatatcaatcctccaaaactcagaaatttgggagaattgggggaaaa

SEQ ID NO: 31958 - DNA, 201 bp, Bos taurus
agccactgagcaagtgctgaaaaaactagaagtctaagcaccagcctttctagaacctgacacacttattctgtgctaggccaaaaagatacgtttttacraaaaggaatctgttttaaaatttgaattataggcaaatgtatagctagtgttcaccatcatttcaaaataatacatcaaaaaggccactactcaattatt

SEQ ID NO: 31959 - DNA, 201 bp, Bos taurus
agaaatggggccatgctgggtgagctaacaaagcaagtttctagaccttcaagacagaggggctgaaggagaaccagggttaagttgccaaggagttgaaygctacctcagagggcctcgtgggagacaggagacttactgcccctgtgcaatacttcatgtcattttccatgttgactttctccaggaaagacgacctac

SEQ ID NO: 31960 - DNA, 201 bp, Bos taurus
gccaggagacccgcctaggcgtgactgctttgggcctcttgttttttattcagaagttgaatttgtaagatcaaaggcactttattcaaggaacagatctstaggcctcattccatacaaattgtatcgggatctagggctgggacccaggattctttttaatgcacgttcgttttgatgctcagccagatttggaaagca

SEQ ID NO: 31961 - DNA, 201 bp, Bos taurus
gtctacgtcagggatgttacacacttggtgtttatttaaaattcagcagcattgtcaggtgttactgccagattttctttaagttggaggttagaggccartgctaagtatttgttaatgtattttgagactgataatctccagtttgactcccaaaggagtagctttttttccatccagggcctttgagtgatgttaggc

SEQ ID NO: 31962 - DNA, 201 bp, Bos taurus
gtgggttgccattttcctcctccaggggatcttcctgtcccagggcttcgaaccctgtgcctcctgcattgcaggtggattctttacccattgaaccatcygggaagccatttttaaagctggtgatctaaaagtggaaagagaaacaaacttgcagttggcagatttctcctcaaaccctggctgtgccacatgacagtt

SEQ ID NO: 31963 - DNA, 201 bp, Bos taurus
agtaccatttatgaactttttgtatactatacaatttatttactttttatgtctgttggttctcccctcattaggaatgttaacttcataaagatgggcayctctgttttgggctctgatgaagatgtgtaagagtaacactgttttcatacctactaacacagtatccattctgcagtccatggattcagttggataatt

SEQ ID NO: 31964 - DNA, 201 bp, Bos taurus
cattggtgagagacatcctctccaggtttacggtgggtgggctccacgcctgatggctgggctttaccccttgtcctccttcaggacttcagacaggcagraaagaacaccggggccacagccactgtcttcctgaacaacagcgtcagctccccacctctgccgttaaggctccctgtggagagactcaatggaagcagc

SEQ ID NO: 31965 - DNA, 201 bp, Bos taurus
aagaaacaccaaactaacctctgcccccaaaagtcaaaggccattttctgatcgacctcttcaactgaagtttccagcagttaaatgctatgataacgacwttgctctagggccctccactaacccaccacccaagggggaaaaaaatccaccctagtgagcttcttgaaatcaggcgttttaagcaatggatttcacacg

SEQ ID NO: 31966 - DNA, 201 bp, Bos taurus
cttatcttattcagatgtatggcaaggtctgggttatggctgagagccatctgagagggagagtagcctactggaaagagtgtagtttgttggttagaccktttggatttgaactctgcctctgcctcttacttactgtaaagctctaaacaaattattagcccactctgaagctcaagtgaccctctgcgagcagagggc

SEQ ID NO: 31967 - DNA, 201 bp, Bos taurus
tcaaactacagtatgatacagtatgctgtagtatgtattgactctgaaatatcacctaattgtatgaaaatatgtaagtcttccaaatacctacctttaartagtttttaaaaactttagcatcaggctgctgaagcgcttgacaaaactcctgaggggccaggaggggaggagagagaaaagaatgagtcatttgtatta

SEQ ID NO: 31968 - DNA, 201 bp, Bos taurus
cttccctgccaagactctatgctcccaaggctggggtacaggttcagtccccagtcagggaactaagatgccacatgatacaaggccaaaaagaaataaayacagattaaaaataaaagaaacaacctaaacctataactaattctgaagctttttagtctagtgaattttagaacctggccatttatgttttccagctaa

SEQ ID NO: 31969 - DNA, 201 bp, Bos taurus
gccctccttcagacctgaagaagctgtcccttcatggccaaagagcccgtggacccttacctaacccctccagaagttgtcagctcacatcagccagtagmaaagctagtgggccattttgtataacagacacaaaagaaccccaggggctttcagatcacaaagactctctaagtgaaatccctttcaagtgcaatggga

SEQ ID NO: 31970 - DNA, 201 bp, Bos taurus
caaggcaactgaacaactggtatcaagagatgtagagctgagctttgggatagaaagaaagatatgaaggatcacctttaccttgcactgcaaatgaaccyaggctggacttggctcggttaagctcagtttgaagtggatattgaagttgcagctaaacatgatggacattcaagattaaatggtgaaatgtgtttgatt

SEQ ID NO: 31971 - DNA, 201 bp, Bos taurus
ttatatatatatatatatttttaattctttatttgttttggttggtgcacacggctttctctagctgtggtgaacaggggcttctcattgcaggagcatcycttgttgtggcgcacaggctctatggtgcatgggcttcaggagttagcagcacccaggctcagcagttgctcagaggctctagggcaggcggcttcgtaa

SEQ ID NO: 31972 - DNA, 201 bp, Bos taurus
aggattcaattttctgacggaactgaaaaggaacattttctaacatgtttctgtttatcaacccacacccattctgttggccagatttctacttgagtagygggcaggacaacttccgcttaaaacaactcgaatctccacactttgggggccagcagaaagcacctgaagaaactttggcaccctacacatagggcaggt

SEQ ID NO: 31973 - DNA, 201 bp, Bos taurus
acaaggccctactgtatagcacatggaactacgttcactatcttgtaataacctgtaataaaagagaatctgaaaaaaaaaaaaaaaaagacctcacagargagatggcctttgagacaaggtcttaaaagatatgagggagtttgtaatggggaatctgggggaagaatattctttgcagagggaataagcaggtatgga

SEQ ID NO: 31974 - DNA, 201 bp, Bos taurus
tagcacatgattgtgtgtttggaaaaaactattataagtaggaagggtcatatgggagggagagtgttaagagggcccatgagagttctaccttctggagkacatcttgatataatcccctctctttaaatgtgagcctgcactaggcccatgatgaagttttaagaaagagagattttccttggtgagcctgaatccatc

SEQ ID NO: 31975 - DNA, 201 bp, Bos taurus
tcagcatgatgtgtctctcctggagtttcctctgctggcctggaccccagcttttgctcttcctcctgtaagactaagatcgtgataggtggtgctgtgcyccttccctgttagtcatttggcctgaggcatccagccagtcctgatgtctacagtgtctatggtaggactaaaggtgactcccaaaagggcttaggccaa

SEQ ID NO: 31976 - DNA, 201 bp, Bos taurus
catgctggtgtaggcctgttttgagtctaatttagcaagctattagggaataatgtacttgcagatatccattgttataactgtcctattgcaacaactgrctagcaggaaggcctaaacaaagattcattacaaatagactaatttattttagtaagtatcttactgtgtgaccccataatcattcagtttgacaagcca

SEQ ID NO: 31977 - DNA, 201 bp, Bos taurus
aacaatggacatatttcaaaatatttgtttgctgatggtttcctccaaatatttctaattcattgtctttctcttgtctttcattctgactactatatttrctatttgtcttaagtcatttgcttcagaatatattgagcatgtcattcagggctcctgccaggtccaatttatagtagatataattacccacacacagcc

SEQ ID NO: 31978 - DNA, 201 bp, Bos taurus
aaaaggttacttacatttttgtgttgcttgtaagttagtcaatgatcaactcaactgaaaattatgaatgtatggaacccaaagtccaaatttaagtaaayttacacaaattcactagaggaatccatttcagttgtatttaagaagcaggaaactacatatcttaacattagcatgttttagaactcaggacaaaacagt

SEQ ID NO: 31979 - DNA, 201 bp, Bos taurus
tcactaagtcatgtctgactattttgaccctatagactgcagcatgtgagcttctctgtcctccatttcattgaattggtgaggctatctaaccatgagtyagtgacgctatctaacagtagtgcatggatacagccaaagacagatcaagctctctggtgcctccgcatataagggcaataattccatcagactagatct

SEQ ID NO: 31980 - DNA, 201 bp, Bos taurus
tcctactcttttctctgcatgtctgggacttttacatggtaaataaactaccttatattctcaaactctccagagaatactctcttcttttccaagcttarctgaacttgactcaccttcaggtctaatctttcaccctacaaccacacagagtatacatgttcatgcagggatggcccacaaaccacagggcaggttcat

SEQ ID NO: 31981 - DNA, 201 bp, Bos taurus
ccctgaaagtacaatagggaagaaccttttgtattctattacaagttaatcactaaaggaatgctgcctataaaatgaaattacacataaatggcccatcyctgggaaccttgattcccgagtaaaagcattaagttaaaatacatttatttagctcacaggaagcattctgaccaggccctactgtgaatgactgcaggg

SEQ ID NO: 31982 - DNA, 201 bp, Bos taurus
ttcgccatctgtcttcctcttcctgagacttcctactccctgagacacaacaacattgaaattagaccacttaataatcctacaatggcctctaagcgttycagtgaaaggaacagtcacatgtctctcacttaaatcaaaagctagaaatgattaagcttagtgaggaaggcatgtcaaaagctgagacaggctggaagc

SEQ ID NO: 31983 - DNA, 201 bp, Bos taurus
ttaaaaattctttgtgaaacatacagtcataaaagacataaagtgctcctttcagcaactcctgtgtgaaaaaggaggccaaacctcacattcctcacaaygtactaaaaagaaccctcttaaaacgacacaaattagaaaatgttttgctgatacttgatctcacccaaacttggaggccctcctttaactcttcttcag

SEQ ID NO: 31984 - DNA, 201 bp, Bos taurus
actcaaaagtgaagagatggctgaatggtaattgaacttacggttcagtgattaagacgtgttttaaagggacatgccacattgacaacagcagtgaagcygatgtggaagctgccacagacccgttcctttgtccctttttgggaccctcaggccctgtgtatttgaaggggagcgtgtatggctcagatccttttgaag

SEQ ID NO: 31985 - DNA, 201 bp, Bos taurus
ggctgtcccctgttatgcagtgccatgacacttcctttggcatgccatcaaaagtcctcatggtttaaggatgtcactagcatacaattttacaacatttkgggggagctaacttgtagtgatcaggatagactattgaactatagatttacagctcaactcagagagtagcaatctatgagtttcaagtttggagtttgg

SEQ ID NO: 31986 - DNA, 201 bp, Bos taurus
gaagtttacttcaattttcataaacctgaagatagaatactgtatttaccagtgtcatgatgaataacttttaacgaaaaaaaaaaaaagagggtatacayatttcgtctttctggtttattaaatattgtaaagcctacatgttaaagaccactgtttacacggctctgtcccagtgaaacatatggcccagttaactga

SEQ ID NO: 31987 - DNA, 201 bp, Bos taurus
cactcttgtctgaaatggattggtattcatttttcagatacgaaagtaggcaagagaaataactgaaaatctcttccagtttgtattttattagagcaggraggcacagaaggcaacagccagagcagtcctgaaccggtgtgagtttcaaaagtcaaccttggtgtattggagcaggttacataaaataactcttttgtc

SEQ ID NO: 31988 - DNA, 201 bp, Bos taurus
gaggaaaaaagcatggagactcatgtaccagttcctaagtgcttccacctggaaatgatagccatgcctaactgcaacggccttggatgcctaatcctctrtgtacacaaaaatagaaggatatgagtaactgttggtgctattgccatgttagacatggccatccctgttcaaatagaatcactatatgtacacttttat

SEQ ID NO: 31989 - DNA, 201 bp, Bos taurus
caactctcccacttattagctctggaaacttgagcaatttatttaatctctgttttccagatctttcatctgtaaaatgatataataacagaatgtacctyaaaatcatttacaggttaaatacagttatgtgtttagcacagaatctagctcatagcaaacatcagtaaatgctagaaaaaaggcaaccatacaatagaa

SEQ ID NO: 31990 - DNA, 201 bp, Bos taurus
caaggccacacaccttgtatgcagtagagccaaaattgaagcctaagtctgtgacacctgtgtcaccaccctgttgttcactggtcagaggagagatggtygagggtcccttgctgtatcttgggccttccttctttttccatctcactctcatgcatgtgtcacctagaacaggctccatagctggggagagaggaggca

SEQ ID NO: 31991 - DNA, 201 bp, Bos taurus
ctaatggatgccacctgcttctggcttgaggatgagaagcataaaaatcagctcatcagcagagtagtgctctctgtcctcggctgagtgaaggaacaacrctccgggccagcgggggaggactcagtgttaggaggagctcaggaatgaggctgcgactgagaaccctgcctttgtttttgttaggatcagagaaaatac

SEQ ID NO: 31992 - DNA, 201 bp, Bos taurus
gagcctccctcctggcctgggttccttgccaattccgggaaagaaggcagaagggattgtcctcgctctctgatattcacccttggctggtccccccttcyacctcccaaaggccaggcaaagccctgctcagcaggccggtgaggacttggcaagaacaggaatccccggcctggcctaggctccgctttggtatttttg

SEQ ID NO: 31993 - DNA, 201 bp, Bos taurus
atggttgaagatcattttttcaccaccttaaataaatcttcaaaagttcctactgatcctcatgctggacttgcatctgtttttagaaaaacaacaaaaaygacaaatgtggactctggcttgagtgggagatcatgctccagtattgttttccacgactggatatcaatgttagcaaaggaatcaatcatttactgaaga

SEQ ID NO: 31994 - DNA, 201 bp, Bos taurus
tcttacctattatcccctacctgctgtctgctgcctctacttcctcaccctcaggatgcacaagaggacttgggggtggggagcatcaggactctcaactytgggatgggcaaagggaagggcgagctgggcccaagctctgtgtacaactgacatcacagcttcttcccgccctggagcatctccttcctctccctacag

SEQ ID NO: 31995 - DNA, 201 bp, Bos taurus
aggagttaatcaaggaggatgtggggttgttttcctctccctaagaagaagttagaaatggaccacaacttggttaccctcctcttccccgcccccactcyaactgggcacttctctacccccatcctgcctctctaggtcctggaataaatatctctttggggcagcacacagcccctattgtgtctagggagggtggga

SEQ ID NO: 31996 - DNA, 201 bp, Bos taurus
agttggtgcagcgaataggctgcacatggccgcggccctttttggcacgaccgttgttccttcttttcttggtctgcgtcaggatgaagattccattaagraggagcaacttacccggccttagcccccatccggccacattccttgccgaccacccccaagaaagcgcgactcacatctccagtccctccgcagatccct

SEQ ID NO: 31997 - DNA, 201 bp, Bos taurus
cacaggttatatttgttctatggagagcatgcactggggaatcaattgagtgaagaggcataagttgccctggggattcttgttggagcaggctaaagacygtcctctgtcgacaactctgggaacaaattttaaacatatggctgttggatgagggtccagagagactagcttggaggtgaggtgggtatgggggttcca

SEQ ID NO: 31998 - DNA, 201 bp, Bos taurus
tgtgaagtgatgtcttatcagtgtctcaggataagaaatggcaatcattccatcaggtgctggaaactggttagcctcgagacaagggtttctagggccayaggtcaggatgtgtatttagttacagggtcccagaaacccgtctcctggctaccacaagcaatggcttcttttctgggctaaggagccagacctggactg

SEQ ID NO: 31999 - DNA, 201 bp, Bos taurus
gttcctgcaaaattcaaaatggcccctcccatgttctaccttaaactttctgtacttataaatgctatttactcacagaaatattgcctactaaacttgargaataagggccttaaatccaaagttaatacaaaattattatgaaaatagtcctaactctgatgaagtctaagcactttttcatgaatgcagttagtttct

SEQ ID NO: 32000 - DNA, 201 bp, Bos taurus
tgtttggtatctgtgactcggtttcccctttttcacatggcccaggcattgggacggaggactgtgggatttcagcccaaagagagatcagaggattaagrtgacttcctcaagagacaggccaagtcatgcagttcagtctacatctgatctcccttgggcagatttttaaatctctggggaaagcaatttcagattcta

SEQ ID NO: 32001 - DNA, 201 bp, Bos taurus
aacattcaagttattagcaagagttgaataataaaattagagaccaaaaataacacttgacgattatttagtcagttctcgtattttccagatgtagaaaytgagactttgaaaggttaaacgactttcaaaggtcacagagcttagaggcagagccaaaatagaaacctgaacttttatttagtttagtattctttccat

SEQ ID NO: 32002 - DNA, 201 bp, Bos taurus
gtctctcattaaaatggaagggatgttcttcctctttccctttaggtctttgggccatatctctgcaaattgccccttcatcccgatccaacttcctcccygaatttcttcctcttgttagagacagatttgttgaaggaattgcctttgttcactgttccatattcttcccctcctacttatacttggcagtctgctgtc

SEQ ID NO: 32003 - DNA, 201 bp, Bos taurus
catactaatcataaatgtgtatataccaaataacagagattcagaatatactttggatacccaaagcttgaaaaacattctgcttggtggacacattgatrtactaagcagatctcaggccctgagtccataggaaaggtcacagaaatgccttatcttagacccatccagacctggcccgtcttgcatttggctattctt

SEQ ID NO: 32004 - DNA, 201 bp, Bos taurus
agatcactgccatggcagtcggggccacggagagacagtccctcacccctcatgggtagtggctgctccttacgtgtccagcctctcctgaaactctcttrtggccgcagaccaccctcaggtagagaggtccaggtggttgaagtaggataccatccacatatgagtgacctattcatggaagatgctggtgacttccag

SEQ ID NO: 32005 - DNA, 201 bp, Bos taurus
gaactggcatctcctgcactgcaggccggttctttacactagcaccacctgcgaagcccttgttatgaacactctgtatatttctccctcttcatctaacrtctttcttttaggacatacagtggccaagcaagtatattataccagtaaaaagaaggattcttcaaagtggttacctgcccttcatttttttgaaatagc

SEQ ID NO: 32006 - DNA, 201 bp, Bos taurus
tctggcctttatgccttatgcacttcattgttggttgtataactcctgcttcctgttctgattagagtctgatgttttgaaggggatttgccctgtttgakaccctttattagttctttatttggtgaaaaagactttgctggagtgagagaccagccgttctttctgcacaataggggtcaggtttcaaaagctcttttc

SEQ ID NO: 32007 - DNA, 201 bp, Bos taurus
attttccattcacttgtccaacctccccattctcaccttttttctctcaatacattcagttagctgttgattgtccctggttttagacccatttttcttgkcccttggatttttcattttttaaaaatagattctggtcctattctatctgcaacataattactttcttgtgaagtcttgggtttttctcctggactcttg

SEQ ID NO: 32008 - DNA, 201 bp, Bos taurus
tcacctttgtttccctggggaagagctgtgctttttttcccctccaccccactccatgtctagtggtgcctaggactaacagtttggtttccttaggaagmacatgacctatttaccccatcttttaaaaagaactttgcttctttaaagtggtctggtttgttctgagaatttccttcctattcattctagacttgtgaa

SEQ ID NO: 32009 - DNA, 201 bp, Bos taurus
gtccacattccttggcatttgactggccacatgcctccaatctctgcctccctctctctgtgcgtcagttcccatctgtgtatctcttacaaggacactckccattggatttagggcccccttggataatccaacatgatcttcttgcaagacttcaacttaattatatccacaaggatctttttttccaaataaggtcac

SEQ ID NO: 32010 - DNA, 201 bp, Bos taurus
catattcagttcgaccaagtttctgtcctgattgagtgaaatgaatctagtattaaatgtattttatgcagctatgattatacatggccccttggcttttrcatacattatgtttaatcctcacaaacacccctgttgaaacagtatcattccaatcacaccaggaaactgagactttaggagcataagaaatctatacat

SEQ ID NO: 32011 - DNA, 201 bp, Bos taurus
tggtttgggcactggtattccagaggataagctatacctacagggaactaggtgcacgcccctagggaaagactggaatcaggccttgactcttctaggcrtctactttagaaccatttgcagattttaagccagctaattttaacatctcatgagaacagttcctggaggggcccagaggctggcattaaataactccca

SEQ ID NO: 32012 - DNA, 201 bp, Bos taurus
tcctgaagattgtgttagtctgctagaggactggacacggcccatctgctcccatggtagggtctggactgatgggggtgggaagctgtgttccagcccarttagttgtttggcctgaggcatctctgcactggcacctacaggctgttgggtgaggccaggtcttagtgctaatgagccaagatgtcagctgccaacaca

SEQ ID NO: 32013 - DNA, 201 bp, Bos taurus
taataaaaatgttctataatcagttaatagctcatgttactggcctttaatcatcctaattggcagttgaaaaatatgcttataaatgaattcatactgakggactggctggggaggtatcttgaacagaacttcctgataggttggtggtgctggaatgtggacaggacctgggatctcacaactgatgtaaccgagcag

SEQ ID NO: 32014 - DNA, 201 bp, Bos taurus
ggtgctggaatgtggacaggacctgggatctcacaactgatgtaaccgagcaggactcactgctgatgtaaccgagtgaggccttttcaggacagaccccrctcccacatgctctcagaagtacccagataatagtagctcatgcctgagtttttcagatgctaaaaaaccaccaccatgcatgcatgcttagttgcttca

SEQ ID NO: 32015 - DNA, 201 bp, Bos taurus
aaagcatgaacagctcactctctatctggttacttgtggttttatctttacctttccaagaaggtgggaaagaagaaatgggggccatttccttaaaaacygtgaagtgtagtgaagtaaaggtcgctcagttgtgtccgactctttgtgaccccatggactatacaggccagaatactggagtgggtagcctttctcttc

SEQ ID NO: 32016 - DNA, 201 bp, Bos taurus
cccagggacgggggagcctggtgggctgccgtctatggggtcacacagagtcggacacgactgaagtgacttagcggcagcagcagcagtctccatctttrtgtatactgggtttaatcttaaaaagctcttgggatcagccaaagtggcatcggtcatttttaatatgtgaaatatttatattttagccatcaattgtaa

SEQ ID NO: 32017 - DNA, 201 bp, Bos taurus
actcaccaggctacccacttagaactgggacaggccagaaggccctggggtaacccagaagtataactgccagagcacctggggggcactggatgattctrtgtgcagagagttactgggggcctcagaggcaagcagtggggacaatgggccatgcagatcctggtctggattcagagaaccaggcccagacaggattgt

SEQ ID NO: 32018 - DNA, 201 bp, Bos taurus
agaaaaatggaaaaattcccctgtgaaggttaaaattaaatgaaaggcagataagaaaacattatctttgatggcatgtgactatttcataagggattttyctgccattatagccacttgcttttaaggataatattcattcattcattcagtcatttaatgattcattcatttatgtaactgagtcaccactacgattat

SEQ ID NO: 32019 - DNA, 201 bp, Bos taurus
aactgaagctcagagaaagtgaacaactaactctggcatataactagtaaacagaagcctacggatacaaatcctgatctgtacaactccaaaatatatgytctttccactatatgatgaccagcttagaaacgatataatccaaatatagagagttgagagcctagggtagagttactttatttcattcaataaatattt

SEQ ID NO: 32020 - DNA, 201 bp, Bos taurus
tctaccacatggcctcacatcctctgactggctagacccagcttcattacatgatagatgttatagatataatagatagaatgtacttcttacattataakaaggagagaatggaagcagtaggggcctcttgaggccaagtctcagatgcctcacagtgtcacttctcccacattttttggttccagagccatccccagt

SEQ ID NO: 32021 - DNA, 201 bp, Bos taurus
gatgactcactacttaaggggttggtaacatttctataaaggaccagatattttaggccttggccacacggtctctgtgagaaccattcaactccgccatkgtagtgcaaaagcagtatagacaatacactgaaaagcgagtgtagttctgttgaaataaatttataaaaccaggtggatttagtccatgggctacagttg

SEQ ID NO: 32022 - DNA, 201 bp, Bos taurus
tggtcccttccaccatagccccttgagttgtgaagtggaaatttgatgcccttatataactgagcacttgtattattcaattaagcaaggtgcttgctgtrtgaatcaacaaaacaactccaaacgaagatcaggaaaatacatctcaattagtgacagcaggaccagtgcccgagggccccaatcctcgagaaaaatagg

SEQ ID NO: 32023 - DNA, 201 bp, Bos taurus
actaagtagagcggccacaagttcctcccatgcagggacctacctgcctgcatctgtgtccataaaagtagccttgcccctggtgctaaaggtgttctaakcgtgctcccagctaaggccaaccttttgctttgggctggaaaaggaaatggcaacccactccagtattcttgcttggataatcccatggacagagaagcc

SEQ ID NO: 32024 - DNA, 201 bp, Bos taurus
tagcttgactctcaggctttccagcctggtggtttttgcactgtgtgtctttccttggcaagatggaaggggatgctcactgatgtctgagtggcacagtktggggccaggagtgggtttgtggaagaatggacgttagtcatgcagccacagagggacaaactcttgttcccagagccacttacctgggaggtaaggaca

SEQ ID NO: 32025 - DNA, 201 bp, Bos taurus
ggcaggacctgaggaagtgaagtgggaggagaggggagaggcacagttattgactcaggaggtggacttcacctaactgatcaccctactatttgtagccyagcagtgtgtcccagaaagcaggtcaggaaaaaggaatcctagagagacaggctccagtaatctcttgtgtgatttctgtttctaggtttttctgaaata

SEQ ID NO: 32026 - DNA, 201 bp, Bos taurus
tggaggggcaaaaagtcaagaggggcctgctgaatttctgaagtacacaatctcaaaggattttaggaagatttggggcctcagtgtgctcagagataccragaatttaataaagtatgccttttcttatttaggtagagactttgcctgggcccattaagtgactaagttgacaaagttccagttggcaaatagcataca

SEQ ID NO: 32027 - DNA, 201 bp, Bos taurus
taaggtaaggagccttcttggcacgggggcgtgcgttttgtgtttctgggtgtagatgtgaaactcagcagacctgacactcttctgtgaagggagggtgmagggaaaaggccaggtgggacatggcatggctattacaatgaccacacagcacactctgtcctcccctgattcagcacttcacatttctccagtgaaaaa

SEQ ID NO: 32028 - DNA, 201 bp, Bos taurus
tggttcccagtaaacctcacctgtgcagctctaggaaatcagagagtagttctggtagacaactagatcttatagagaattcccaaatcaaagttaaaacyatactagccacagaatataggaagtgggttgagtgtaaacattatttacttaacttctattctataattaggaatctagttatcattccatgtatactgt

SEQ ID NO: 32029 - DNA, 201 bp, Bos taurus
ataagaacaaagttttgagtagatgtagcactcggcaattccaggaactacctttaaaaggagacaaaattagcgagcatagctaatccaaggaaatggcrtctccactcagttttgattcagaaagtataaacacaaaaatttaatgataagcctctgggtgaacatgcatatttttgagctcttgttttaagtcatcaa

SEQ ID NO: 32030 - DNA, 201 bp, Bos taurus
tctaaaattcagattttctcaaccctgtaattcattgtaattcccactatttctgtggtcacctttgccactgcatacagcaaggtcttctggggccaacrctgtagcactttaaactgagttgagagagaaattttcatcccacataacaccaactgtgtgctctgccagaaagaggccagatattcccaaagctatgtg

SEQ ID NO: 32031 - DNA, 201 bp, Bos taurus
tggccactggtgatccattcattctccagcccctctccctccctgaggagtagggggactagaagacataagtgctaaatctccaatcacagggctaggtmcccctggcaaccaggcccccctccttggttgcctaggagtactccaaaagtcacctaattaatataacaaaggatacctttatccatctgtatacttagg

SEQ ID NO: 32032 - DNA, 201 bp, Bos taurus
tggggcggcttgtcttgttggggaggataggttctaggcgctgggctcagtagttgcagctcctgggccctagagcacacgggcttcagcagttgcggccsactggcaaagttgctctttggcacatgggatcttcctagatcagggctccaacccctgttgcctgcattggcagacagattcttaaccagtggtccaccc

SEQ ID NO: 32033 - DNA, 201 bp, Bos taurus
aattgcgatgtttcatagaatagcattggggcttggagtgggccacccaaaatatgcactatggcacgttgattattttgaattaaagttacttaataaaygaccagtgggacactctggccctcctttctgttgcctgaaagcaggaagtacgtcacatgaaaggtgcactccctacatctaaggaagtagaaagacacc

SEQ ID NO: 32034 - DNA, 201 bp, Bos taurus
gcctgtaccttttcctttttaatctcaccttttgagatctatccatattattgcatttaagtcttgtgctttgtttaccaattgcacaatccctgattgcyaaaatgaataaaggaagagtctaacatgaagtggattacatacagaaggcccttcctgactgttttcagggagccattgaacatcagataaggctctgcg

SEQ ID NO: 32035 - DNA, 201 bp, Bos taurus
actggggagctggatggttaggccctcaatatatgaatttggggaggacacgattccgtatattacattcagtaaagaatcaaaccttgcttttgcatttmgaaggcctaaccttgtcattgagcagctacactggaataatcttttcctgggaagagaagttggaggtgccccagtgttccagaaaatggggtgaatttc

SEQ ID NO: 32036 - DNA, 201 bp, Bos taurus
agttattataattttagctcttatatttaaatctatatttatttagaggtaattttgtacatgatacgagataagggccatagttaagatcatacgtataycccatttttcgagctgttttttgaaggaactatattcctctcaccttggtgcctttgtcaaaaaccaagtggccatatatgtatgggtaactttctggcc

SEQ ID NO: 32037 - DNA, 201 bp, Bos taurus
cttcatttgaaaacaaatattgattgaactcctcctatgtgttagacactggagatagagcattgaacaaaagcccctgttcacaaagcttcagttctaaygggaagagatggatgattaataaccatgtggtgataagtgctgcaaaaacaatgcaggagaaggcaaatgacaaaatgagaggacaaatgtggtgtggat

SEQ ID NO: 32038 - DNA, 201 bp, Bos taurus
tgggctgcaaattacatcccaagcatatgcaaatattcatgtattaactagaaaaccagtctctaaactgttcttgcctgggggaagggagaaggcctcayttattaacccaggtgtctaagagtcatctttaaatacccctctctcaaatccaaatccaatctcttggccaacactcctcctaagtatctactccatttg

SEQ ID NO: 32039 - DNA, 201 bp, Bos taurus
agacatggaaagtgagagttgtcctaagaaagtgcttgaggccagagagagtattaaaaaaaagaatttctactcagttggaaagaacaagaaaggagtgrtgagaaatgggacagtaaacagaggccaaaccttgtgagccttatacatcatgtctacaaatttggatgtagtcctaaaagcaaagggaagtccttgaaa

SEQ ID NO: 32040 - DNA, 201 bp, Bos taurus
ccctttctctgtggccagaggtcagccctgccaccggctggctgcctagccgtctcctcagctggagtccctgccagcttccaggccgcactttaaaccgwgttctgccacttactagtgtccttaagcatctttcctaagctgtggtaaccatgatgaccatcttcccctgagtctgcatcttctctgggcccccacact

SEQ ID NO: 32041 - DNA, 201 bp, Bos taurus
tgacggcggcccacctctttccaaattcctcttccctcccttttaaaaactaccaaagcccaggtcttggctactcagctctccagggaggaggccattcrgtctgcttctcctgcgaggacagtggaagcagagaaagtgaacactgaccctaactcccagaccgcagtcgggccccctagactacctaaaatcaaacac

SEQ ID NO: 32042 - DNA, 201 bp, Bos taurus
cctagacctctgttggtcaatcaagacattgggccttcattgtctctggcatctgctcaggtgtcttcttccaggtccttgtctgcctgtggataccatgmcagctggcctctgctgagctgtcctgtctggtcctccgtggttgatccacagaaagagcagtttatccagggcctctccaggcaaggctctgtcttgtca

SEQ ID NO: 32043 - DNA, 201 bp, Bos taurus
tagtggctgggagccaaggaaaggtttggaaaggaggggaggtgtgttgggctcggaggcctggggattagggtcaggggccctcgtgtgttgccaactgyggacccatctctgggtccacactgccttcccacctctgcccaggcaagtagcttcctgccaggttgggaaattgctttggcctggaaattttctgctggg

SEQ ID NO: 32044 - DNA, 201 bp, Bos taurus
tgacactgggaagtttgccactaacctggccctcccccctcacttttctataaaagggctttgttgagaggttttggggagtttgggggttttaacacatragccgcctgtctgcttgcatggccctgcaataaaactcttctgctccaaactctgacgttcttgtattgcttgactgcactgtgcgtcaggcatatggac

SEQ ID NO: 32045 - DNA, 201 bp, Bos taurus
tctcccaccctgtgggcttcttcccagcccctccctctctccccctttcccatgtgatacctgcctgacttgctgatgttgctctggccaatggggtaaargttgctgtccaggtctttgatctagaagaggagagctggatgcttaccccataccacaccccactccccgcagcagtacccaccactgagctctggagca

SEQ ID NO: 32046 - DNA, 201 bp, Bos taurus
ccgtcatgtggatggaagagaattcacaaaggcaggccctccttcaagtacatggaagaggagagctggctggtgccctgtctcctcctctgcccaaaagyggcagggcctcaggaggcaggtcagcctattgaaatcatgaaacatgagaacagagtcaagtagaaagaagaggagggctcagacagaaaggccggctcc

SEQ ID NO: 32047 - DNA, 201 bp, Bos taurus
ccagattgtttcctctacaaagaaactctaccaatccatgaaaggcattgggaagaatgtccaaaacttcaagctggccaaagctgaccctcacttagcarccagttctcagtgcttcatgaccaagtctcagtccaaattggcaaagtcaggaaagcttttggaagcatagctcttgcaatgtccaaaggagcccagatg

SEQ ID NO: 32048 - DNA, 201 bp, Bos taurus
aaaaccttttgctgcagaacattttgctaacaatctctgtctatgtaacagaccacagttggtaaacacggccaggcccgtctctgctgagatgctgcagrgaaccgctaatcaatggggtagtccaagaaattaaccagagggctgtgacagacagcaaccagggctaaacacgtcattaggcaaataggccggtgtcac

SEQ ID NO: 32049 - DNA, 201 bp, Bos taurus
atgtatcggtttttttaataaataaaatttaaatttaaaatggaaatacaatacattatgtctataatgtacaataacaaaacataataaattaaaatttwaaactaaattttaatctcatgggtagaggccttgtctggtgtaagaagatacccaaatgcaaagtataacccggtacccacacaggccagaatgtacctt

SEQ ID NO: 32050 - DNA, 201 bp, Bos taurus
tgctgaatatagcctcccttgctggattatgggaactctttattattaagtctttgtgggcttcgtggattgagcccctgaactcggtgggcatccattcygaggcctgcacatggaccgtgcatgcacaagggtttggatgcaatgaaagatttctatctccaggcctcagttcccaggatgagaaatgaaagattctta

SEQ ID NO: 32051 - DNA, 201 bp, Bos taurus
ggccaccacatggtctgcccaaggtaacatggtgagtcagagaaagaataggaacgaaagcaaaagaatctgtcagtggtttgcccagaaggccttccaayttttaactcaggctacactggttcctttcaggctgccctactctgaggggtttgtccagtagttttggagtcaggcatcgagccaggtctcaaaggtcta

SEQ ID NO: 32052 - DNA, 201 bp, Bos taurus
ttgcaagtgaagttaagttgcacgggagcaaacacagccatactcagttgcttccgggtttgcttttgtgctacaaggtcaaggttgagtagttgagacaraaactttatggcccacaaagcttggaatgtctcttttcagaaaaggtttgcgaatttgttatagatgattaaaaaatatttttggattaagtcaactcaa

SEQ ID NO: 32053 - DNA, 201 bp, Bos taurus
agctgatctccttgtagtaactcagtgatccagactgagggagatttcagaagtctgtggctataccatctagaacatggcctctgattgggtagtatatyaggtgaacgcagacatggtgaacaccacatcggctcttaaattctttccagtagaagggcacaccatacttcctgttacacttctttggccaaagctagt

SEQ ID NO: 32054 - DNA, 201 bp, Bos taurus
tagaaataggagttggtcaagcagagaagctgtggacacgactggggaccaacctgcaacataaactggagttaggtgaggaggggaatgaggcctgactygggctggatggagcctggcttgaatggaagccatccgggctcagtgtcctgagagccagaaggattggaaggctgagagtcagatgtatttagggaaggc

SEQ ID NO: 32055 - DNA, 201 bp, Bos taurus
aaaaaagcacaggtgatcttccccaaggtgattgaagccgagataacatcactgagcaccattgacccgttctgtgcagaggaaggtccatggaagttccygaacctttgtcgttgttcagttgctcagtcatatctgactgtttgtgagcccatgggctgctgcagaccaggcctctctgtccctcactatctcctggag

SEQ ID NO: 32056 - DNA, 201 bp, Bos taurus
cctctgagttgggtgaggccaggtggagggcttggagttgagaagcacagggttctgagtagggaagtgtcctccaggtgtctcccttccccccataaggrgaccttcacccaaggcctcagctaagaggcctagtaatgcaaggatgtgaaagagcatgaccgaccatggagagcctgaatccttgacctcaactctgcc

SEQ ID NO: 32057 - DNA, 201 bp, Bos taurus
ttggcagcgccccagctcaggcaggccactctgaacccagccctccacacccacctctcctgccttttgcctcctgcctcctccatcagcaccaccactgmccactggccctgcattagtggcagctctgagccttgggctacactcgcaggatttgtccatccaggtctctctgtgcccagtggtgggtcctcctctccc

SEQ ID NO: 32058 - DNA, 201 bp, Bos taurus
gagaaatgaggaacagaggactataagaaaccaatagaaagagaggggaaacgggggtcggtcggaggtggaaagacagggagagacagagagagaagacrgcgagtgggtggaaagccagaatgagggggagtgatgagaaatgcgtgacaggagaagagaaaagaggagaaaagagcagagaaggggccagagggaggg

SEQ ID NO: 32059 - DNA, 201 bp, Bos taurus
tcatgcttgacttgcagggggtcaggggaggctgtgcagggctctcggcctgcagaccctcaatttcgtgaatttcaatctaggggggacttgccctggtytcctagcaagccagacacggcctgtcacccagatcagtctctcacacccagtgctttcctggctgcgggaacaactcggccctccctccctccgtcctgg

SEQ ID NO: 32060 - DNA, 201 bp, Bos taurus
cacaggggccatcaggaaacggatctgaagaaatcccagaaaacagctgcttcctgtgagctgaggggcagctgccctcggggctggtgagggtccaggtrccacactgggcccagggagcccttccttgaatgcatgcaaatgaatggcataaatttctacttacttaacttcacaaatgctaacaagctcataaaaaat

SEQ ID NO: 32061 - DNA, 201 bp, Bos taurus
ttctatgacaaactgtttaatgttccataatgtgcagcttctgaggggaaaaaaaaaagcccattaaaaatccacaagctgtacattccggtaacagagtrgctggccccctccccacccatccctctgagaggcagggcagggaggggcgcaggtgctgtgagaacatggtcctcgggtgtgctcaccaggaacacacgc

SEQ ID NO: 32062 - DNA, 201 bp, Bos taurus
tggggttcaatcccagtatagcacatgcttgtgattctaggcaagtcacaatctaacttttctctacgcttcatctgaggggccttaatgcacatgctcarttgaattcatctaacaatgactcttcctctcccactgtccaggatccccctagggtcgctctgtgcagaaggccagaggggccctgcttccctgagacct

SEQ ID NO: 32063 - DNA, 201 bp, Bos taurus
ctctgttcacaggattctctaggcaagaacactggagtgggttgccatttccttctctgtagaataggtgaggcatactcaataaacagcacaattttttwaaagtgtgttttgaaggaattgtcaacctgaggaggaagcagtgggagtgaattcttgtcatccgagaggaatgttccccacacctgtccgatagaaggc

SEQ ID NO: 32064 - DNA, 201 bp, Bos taurus
tgacattgttacctaatcccattaggagacccacccaacaacccctttttgtctgtcaatatctccttggtaggaagtggccgcagcagatggtacagatyggctactctgcttttaccctactttgaacagttctcattgacagatatccctgagctgggcccccaggctggcagagggccaggtcaccttgagggcagc

SEQ ID NO: 32065 - DNA, 201 bp, Bos taurus
tgagctataattaataatttatgcacatttccacaatgtaagcatgttatgattaaacatgaacttaagtgttattaacccttactgtctatattggaacrtcctgcctacctcctgggatacatgaatgtgaaatttaaaacataactttagaaaatatttgaagcagtattaacttcccctactgaaagaaaaagaaac

SEQ ID NO: 32066 - DNA, 201 bp, Bos taurus
atctaaaatgggggcagaagacgtgctttaactttacaaaatatatacaaatattgttaaaaatattttccaccaagtttcataaaataaattcaccatamttgtggacctgcctgtacataaacttattctggaaacaaaccttgtgtctgggttgcactttgcggagaagcaagtatagtaaatagaagttgccaacac

SEQ ID NO: 32067 - DNA, 201 bp, Bos taurus
gggagaaggggagcagcaggtggaggaagagttggaagagaaaaaaagagatatcatccagccaagtaattcagatagaaaaagatatgtagaaggagagmgagagtcagtgacatactgctagcagccttttgtttccgttattcttatataatctcaagagaagtttttagataccaatcaaagcaagcatatcattca

SEQ ID NO: 32068 - DNA, 201 bp, Bos taurus
atgacagtagattaatcacattctgatttgtgctcccattttattcctactgcactaaaagtaaaaaatgaaaagagtcatagcaactaagaaatttatarcagaggacaaatataattttttgaagttcattctgttaccatgtaactatgtcatataactagtcattagtacagtagatttaaaagcatttctgaacaa

SEQ ID NO: 32069 - DNA, 201 bp, Bos taurus
ctgagcgactgaactgaactgaactgaaaccaactatttaaaataaattaaaacaaagcacctcaaggtaggctgagactaaggttttctacatgcaaatkctcaaaaatagcagagttaaagattaagaacttagatctgggatatttgaactcaagctctacaacttacttattctatgacctttcatttaacttttct

SEQ ID NO: 32070 - DNA, 201 bp, Bos taurus
gtgaagaactaggcctaggtcctcaggtggctccccagggtcaaattggtgggggagtaccagactggttctccactcctccacactagagagactctccyctaactgccttgtctccatctccacaggacctacatgggcagagggtgccctcagagggggccgtggaggacagagatgacccacgtgggagtaggtgaa

SEQ ID NO: 32071 - DNA, 201 bp, Bos taurus
acaaaatagatgtctaaatgtgtggtagtggcagttgcagcaacagcaagagagggtcacacagctttggaaggcaccaaaatgtttagaaaaaggcaacrgttcccttagttcaccaagtttgattttgagacagtcaagatcctcggcttctgtttccatgtgcattcaataatagccatatctagaaaaatggcagta

SEQ ID NO: 32072 - DNA, 201 bp, Bos taurus
aggggcagggaagtctggtgggccgccatctatggggtctcacagagtcagacacgactgaagagacttagcagcagcagcagcagcagtcccctgtagcytttctgtctcactgaagagaaggaaatgactataaaacacttggtaagacccaggaacacagtcccactaaaaatggagatttaaccagaagattataaa

SEQ ID NO: 32073 - DNA, 201 bp, Bos taurus
ctgcctccggcaaccctcccagctttggcagtggcaatcacatctatttctgcaacagtgttgaagcagccctctcaacacatcctaacaaccaccagccyccctacctctcccaggggtctttggcagagcctccactcccagtcccaccctctgctgtaggcagaagctttctagccactctctcagctccctgtcccc

SEQ ID NO: 32074 - DNA, 201 bp, Bos taurus
ctgatctgtccaagaactttaacatggactgtccgagagcggtgatatgcccagggctttaaggtctatcacttcaaatctttgttgtgacaagacagaamcaaggagatcacactcctctgacacatttaataaattttttggagtcatatatattgaaacataatttttacacagtagaatttattttttccgtacatt

SEQ ID NO: 32075 - DNA, 201 bp, Bos taurus
ggaccccaaggctggggagtctgacatggggtttggactccttgttccttgaggagaacctttgcaattgtggctatttatgagctgctcccatttatgasctgcttacctagggtgtgaatcatactaaactgactctctgcccttcctacctgtctcactgtggttccttctttagtgaaaaatcttttccgatagact

SEQ ID NO: 32076 - DNA, 201 bp, Bos taurus
tagcttttgcttgtctgtaaagcttttgatttctccctcaaatctaaacagcagccttattgaatagattattcttgattttaagtttttccatttcatcyttttatgtgtattccgacacgcttttctgattggcagagtttctgctgaaaaatcacctgataggattatggaaattcccttgtatgtcatcagttcctt

SEQ ID NO: 32077 - DNA, 201 bp, Bos taurus
acacacaactatttactacctactttcacattcatgtgctccttcacaatggcacttgctcagttgcacttaaatcatgagagagccaagtttttgatgaycttctgtcacctgaagctaaagtactaagtcctttcaatgatttgtcacagaagataatgccatagcatgtttcacaaagattccaattttaaaatccat

SEQ ID NO: 32078 - DNA, 201 bp, Bos taurus
atgttgtaacactaccaccttgtgggaaatttgagcatgtgagtcaaatatttgagaactattttcaaacagccaaacaataaggcagaatttcttgatarttagagtcacaatatatgaacagatgatatatgaaaaaaacatttatggtcaggtcattttagaaagctcaggataaaacaaataagtatttttttttaa

SEQ ID NO: 32079 - DNA, 201 bp, Bos taurus
atctcttttctgtgtgtgggttggaaaactaatcagaaataaagtaatgcttttaataattcttgaagcatggaaaaacgtggcttaattttgtttaaagkaatagtgcatatgatagaaaataactcattgaaaatgattcatcagctctctgctgaagctccctgaactcattacaaagaatgtaagaaaccattactg

SEQ ID NO: 32080 - DNA, 201 bp, Bos taurus
ttcatatctaccatatgaatgtgaagtcattcacattgtgaagtcaggtgaaggcccacttcctggttcagagttggccatcttcttgctgcgtcctcacrtagtagaagggataagggagcttctctgcagtatttatagagtctaattcatgagggctccactctcatgacctaatcatccccaaaggccctacctcca

SEQ ID NO: 32081 - DNA, 201 bp, Bos taurus
aggaggctcccattggccaaaggtgagatgatttgatgattcaaaaacactattgttccaagtgattaaaatgaatgaaaaatataaaatgagaaaggaaraatataagccttcatggccataattaaaggttgttgggcaccaactcattatttttaaaactgctaactaaagcgaaagaactgagattttatattgttt

SEQ ID NO: 32082 - DNA, 201 bp, Bos taurus
tggagattagactctgagtccactttggcatcactatcaaacagcagttgtcttactgaggctgaggatggtgactcccaagggtgttctgaagattgtgyttccatatctgcagcttactgacaactgatggaaagtttatccacagtttattaaaacacacaaagacataacaaaaccaaaaaaaaaaaaaaaccaccc

SEQ ID NO: 32083 - DNA, 201 bp, Bos taurus
tgtctctgggcattggctgccactgtggtcctggtcagagaagcagataagcttatactgggacaaaatataaatgtaaaagttccccatgctgttactgkgctgatgaacagccaagggcacaagtaactgaccaataccaggatgactcactgtcagggactgctttgtgaaaacccacaggtccacctcgagactgtg

SEQ ID NO: 32084 - DNA, 201 bp, Bos taurus
gacccagaagaaaggagcagtgacccaaatagagactgaaccaaacttgcctgtgagtgtccaggagtctctgggggagacatggattgacagtggccagycatggggtaaggagcactaaatacaacagtcctggcataagccctcttgaaggtcaccatccccataccatagtttggcctaagaccaaactacagggag

SEQ ID NO: 32085 - DNA, 201 bp, Bos taurus
cagctgaaccatgctgttctgttgagtataagcagccccacgggaccatccactacaagcaaggtcactgtgcaacccacgaaatacgaagcaccctcttycttcaagctgcctggtatatattttttagaagtgctctgctaagcaggttttcacctaacacttaataatgaatcagatgagggaatttttaaatacatg

SEQ ID NO: 32086 - DNA, 201 bp, Bos taurus
ttgacgaagggtatctcctcatggctgcccttcctgaccttgaacgtggagtagctcctcgtggccctcccgtgcctgtgcggccgctgctccttggatgygtggttgctcctctcagtttttaatccaattttctgttgatgggtggagctgtgttccctccctgctatttacctagggccaaactgtggtggaggtaat

SEQ ID NO: 32087 - DNA, 201 bp, Bos taurus
agtaattgagactctgcacttccattgcagggggtgcaggttcaatccttggtcaggaagtaagatcccacatgccatagcatgtggccaaaaaaaaaaarcactaagaaacatatcatttcttttcaaaatctctttcccctccctaggatttctggatgtttccagcttgctttatttaaggttctgccatctggccct

SEQ ID NO: 32088 - DNA, 201 bp, Bos taurus
ttctaacgaatacacccaacttctcagattcttttaattcaataattccctcctcaacccacattctgattcatgagttgtttcaagtcattactcaggayagaagcttaatgggtatgaattttaaattctttcgggaaggtttctgagcctacagagctgggaaaagagtttcccgataggggagaccactgacagttc

SEQ ID NO: 32089 - DNA, 201 bp, Bos taurus
tataactctaaccaaaattttgttttcaaacttaaattattttcaaagccaagaagtccataattgttttaattcatgaccaaaaagcttttaaactggtygagtgttcatcaagaaatgttttcagcttcccaactggtggtacagatccctatttttaattctgttaggagaaaatatcttaaatatctgatggtctct

SEQ ID NO: 32090 - DNA, 201 bp, Bos taurus
caagagccactgactgctgtcacttgagacactataagtttcagcctacattagctttatggttgtagaaaggctgaatatcttaatgaaatcaagcctcyttaagtgacctataaattcaatatgattttaatcaaaactttataaatttggaatatttaatgtctaagaatagctaagaacccataaaaaaagaaacat

SEQ ID NO: 32091 - DNA, 201 bp, Bos taurus
tggaatattcaacaaagaagatgttatgactgactgaattgcttgtcagtcagaaatgcctagactgtgttatcttctctttcaacatatgatcctggccrtttatctgaaggtagatacctaaattgattagttttaactgagaaaggaaatagtttatcttccattgactgaaattcatatgggtgataaaaaatggcc

SEQ ID NO: 32092 - DNA, 201 bp, Bos taurus
ccaagatgacttcttcacccaatgaacagcactgtggccaggatgccaaagtatgggctcaactggactgccaagcttaatgccaacatgatttccctggyatcgcatttaaggttaggccactcctccctcagtgcctcaggactccatcagcaagtgttcccagtgaacagagtgaaagctgcagcctcagaagcactt

SEQ ID NO: 32093 - DNA, 201 bp, Bos taurus
tgaccgccagcttctcactgccctccatcttggactctgccctaaggccaagacctcagccagggtaaggatctaatttgctcactgctgtagccttggamtatttttcaaagtaggcctccaggcttcttgcccctgtgccatcttaaagcaagcggaggccaaaaaagagatcaagaaggttcccgtttattctcagac

SEQ ID NO: 32094 - DNA, 201 bp, Bos taurus
aaacatgtattgtattaactttaaaaaaaaaaaaagttaaggtagcctatgacttagaattgaaaaaagagagactaggaaaatgcacttttctcatataytcagaaagataatgcctttactaacatattgacttaaattcgatttacccttaaagaaaagtagagaaatcaaagattatttagggaaaaactaccaaaa

SEQ ID NO: 32095 - DNA, 201 bp, Bos taurus
tagtaactgacagaggattttcaaaagtaataaagtttatatgaccagatataaaatatgggagtaaaagaataaacacttaaaaaacaaaagcaaaagaraagagaaatggaccgagacagtgccagatcatgaaagccaaatttaaggaagctttgaaaaaaagtcataagcaagttttaggaaaaaagtgaaagtgaa

SEQ ID NO: 32096 - DNA, 201 bp, Bos taurus
ccttaacgcctgatttgtcttgttatttcctgcatctcagctcttgtggggggacatctccacttgtccagacacactcatgataagattgatccaaaatrtgacacaaaggaatgttaccaacaatgcttatatacactcttctgctatgatcattacctttcatgcagagattctttcttccccaagttccaagaaaag

SEQ ID NO: 32097 - DNA, 201 bp, Bos taurus
ggtttggggtaggtatagtgggtgcaaggtgggagtaacctttctgagggacaaattttggaatatctgtttagcctacaatgatccccttaactacctcytttctccactccaaactcagggatatattactatagcttgatgaggtacaaccacagttgattggaccatgatagcaccaatcagtgtttctccctcagg

SEQ ID NO: 32098 - DNA, 201 bp, Bos taurus
tagcactcagccttctttatgatccaactctcacatccgtggatgactactgaaaaaaacattgctttgactatccggccttttatcagcaaaatgatgtygctgctttttaatacgctgtctaggtttgtcatagctttccttccaaggagcaagtgtctaaatttcatggatgcaggccctgtctacagtgattctgga

SEQ ID NO: 32099 - DNA, 201 bp, Bos taurus
caacttttatttgggttgcactttccagttacactttcaccttaattgtgtcatttgatatttcaaaaattctgtaagatgggccaggcaggaatcattarcttcattctatagataaaaaaactgaggcaaaaagaggtcacttcccaatattacactgctgagaggtttcagctttgacccacccatggtcttctgatt

SEQ ID NO: 32100 - DNA, 201 bp, Bos taurus
gtcgtggcccaggttcaattcctggtcagggaactaacatccaccaagccatgtggtacaagctgtaccagagaactgagatgttgtcaatcttctttcaraaactgagtcaacagggcctctaattgtaaagcctgagttacctttcagttcagttcagtcgctcagtcgtgtccgactctttgcgaccccatgaatcga

SEQ ID NO: 32101 - DNA, 201 bp, Bos taurus
aaccatcccccacctcccctggtctgtggaaaaattgtcttccacaaaacctgatcctggtgccaaagcggttgggggccactgtaaatgagaactaagayggctgatatctttattaatatatacatatttcttatttagtagaaattttataatattctacttcattttggtagtaaagattacttgggcctttcacac

SEQ ID NO: 32102 - DNA, 201 bp, Bos taurus
tgcctcctattagactgggggaggaaaaaaaggcagactgcctggggtgaactcactcagctcttatctcttccaatcacatttctttcctcaatttcccrcaacctttctttcattctctcaagaagcattcttacagatttcaaagctaacccgcattctccacctaatttcagtctatccctttcctttccccttctt

SEQ ID NO: 32103 - DNA, 201 bp, Bos taurus
tttaattaatcatcccataatagacttgcagggtatgttgaaaagcagagccttaactgaaaaaagagtgtcctgtgattcaaggaggtgccatttatggraactaatccttaaaaattacttgcaaaagcaagaaaatatatggatttttgaggtatagtttataattgattataaaaccacaaatatctaacaaaataa

SEQ ID NO: 32104 - DNA, 201 bp, Bos taurus
acattttctccaggccagaccacctacctgctagctggtcagtttgggatctcaaaaaatttatagcatgatattaagaatcagggatttggtgtcatctkggccctggcacagttataatgagcaggtatggctgtgaaattgtatatacctggtaatatccttgctccttccaatctgatgatcacagatacctctaag

SEQ ID NO: 32105 - DNA, 201 bp, Bos taurus
ctcatgcctttggcacagagctctggagtgttaagtgaaatacttggtcaggcacttgagcagattaaaaagtcctttatgaaaaggtgtttgactctgaytgcaggcttctgtgtggcctagcctggcaggggaatgaacgtccgtgtgtgggcagggagacattcctagagcaggagccaagcccctggctgtgtgtct

SEQ ID NO: 32106 - DNA, 201 bp, Bos taurus
aggtgttatagagatatttcaaactcatgctaatccctcccctggcatgtctttcactcataaatggacaatttctatttcactttatataggaagccatmctaatctctccagcctgaagcactcttttctccttctgtttcccagtaccctgttacttgcttatcactttctgcttgatttacacttatttgtactcat

SEQ ID NO: 32107 - DNA, 201 bp, Bos taurus
catttttgtgatggatatgtcatgtcttctagcatgaatatgatttactttacagtttctgtaaccagctactccaaatgcttattggatgaaaactttgmccatatgatatatcctggttaaacttgctgcataccttttgaatatagtttaactatattttagtatatatatatatattaatttaaaagaaaattctga

SEQ ID NO: 32108 - DNA, 201 bp, Bos taurus
catattttatttcatggactacagaggataattctgctttcttgtatgactcctcatgtctttgcctaggtgctcttttataaataatttactcatcctgmcagttcatctccaggtgatcctacctgctgtcttcttgcctaaaaagagtcatgctcctcaatgctttttaaatacttcccaactgctaattttcttaca

SEQ ID NO: 32109 - DNA, 201 bp, Bos taurus
gatgatgccatccaaccatctcatcctctttcattctcttctcctcctgcctttgatctttcccagcatcagggtcttttccaatgagtgctgggtcgacygcatcttttttttttgtttgttggtggatatgcttcatggaaaaacacatcatcaaaatgaaagcattcagaagtaagcatctgtggtactaaagggatc

SEQ ID NO: 32110 - DNA, 201 bp, Bos taurus
gggagcatcatcatcaaagggtctaagactcaggccttcttgtttctaaatcaatgctccttccctgggtatattagatgccagataaatatatgtgcctkggaaggcaatctgtgggcctaatcctatcccaccactgcaagttctctcttatcccatcatattaaatgaaactgcccagggatgtcatgttaagggctt

SEQ ID NO: 32111 - DNA, 201 bp, Bos taurus
atagatgaaccaggatttgtatttcctgcaccttgtcctgaacttataattccccaaagaccacagttgttaagtctcactggaattgggatcattgatcygagtaagataggtgagactcaatccttgggggctgtggctaggtgggtaatagattccatctttgtgataagtcataagtcacgaatgggttattttgag

SEQ ID NO: 32112 - DNA, 201 bp, Bos taurus
tgaaactctgccatgacattagttataaagaaagccaaagaaagaaatcttggccacaagatgggaattgacgcaattcttatgtctgccacattcagackatgccttttgcagacgtttctgcgtttatttatagcaaggttgactttagtaacaagaccatgttccactaatgatactttttaaaaatataccaaaaca

SEQ ID NO: 32113 - DNA, 201 bp, Bos taurus
tatgtgggcatgccattgcattatgtgtttttttttttttagaagataaatttaacagtaaaagctaagagggaaacattgatgttggtaacaatccaaaygtaaggcaataagagattagccgacagtgagggaaggtgggaaactggagatgccagtttgttaaaagggacttacaggaatgagttttcctaccaccat

SEQ ID NO: 32114 - DNA, 201 bp, Bos taurus
gatatatgcccaggagtggaattgctccttcttctactttaaagatgattgtgatttctcattcattggtgttccaccatcctttgcttcttaacccagtygttatctctgtaaacagtccctttattatactgttaggcttaagccctttgaagtggatacttgcagtgttcctgatactggaggagggagccctatcat

SEQ ID NO: 32115 - DNA, 201 bp, Bos taurus
tggaaactaacacaacattgtaaagcaactgtatactccaataaaaataataataactactttcaagctttcctcagaaatcagacaagtaacaggagtayggactaagatattttaaagtgttgagagaaaaaacccaccaaactaaattctgtatcctgctaaattacccttcaaaagtggaaagagaaagaaaggttt

SEQ ID NO: 32116 - DNA, 201 bp, Bos taurus
ttaggcaagttacacaataaaaattccatgataaaggtgttacaatctgaggatatgaaaatctaactgattaaaagggtaggcaacggaaagaggccacyccccgaaaagcagaataagtacagtctgcccttttagcttacctgtgtctttcagtcacagccaaagcaccatcctctatttcttcatatctgggccttt

SEQ ID NO: 32117 - DNA, 201 bp, Bos taurus
gacgcaagcaccctagtgatcctgtctgtccttaagagatcaggaggccggttcagaccctgaaaataggatcagggccatttgggcagggaatccctagmactgagtatttggagtctgtctagaaaagggtccagtcaactgcttgctccaaggaggtcacagctgggggaagatagaggtgagaggccctcgaaagtg

SEQ ID NO: 32118 - DNA, 201 bp, Bos taurus
gatgcagttgtgatctgtcatgatattattaaattattcctctcatattaagtgaccacaatttcaacataggtttctcttgacagatgtacaattcatakagacgatgggaactatattcagggcgtgctgtgatttcatttgctgtgccactcatagtggaaaaaatatgccacacttttttaagcaaacaggcttctt

SEQ ID NO: 32119 - DNA, 201 bp, Bos taurus
tacttttttgcacagaatattctaacagttctgaggatgagtcactatcaacgaagacttgaggagtttagggtatcaaaaacatatggggttattaagckgtggacttgaaaatgtccaatggtcttgtcagtaaaaaaaaaagagaagaaacaatggatgaagtgttaaaatggtggaagtgtaacagggaaaccttgt

SEQ ID NO: 32120 - DNA, 201 bp, Bos taurus
gaatgacagtgcagatagaaagcgctgtagcaggtttaaagaaggaaaggtctttaagaggtaggtggcgtgaacaaggccttatagtccaggtaagattrtttctggagaaaggaataatattagaaggcatgggcaggaaaacatggcaacaatctgggaacgctttgttcctctagtttgcttgatgagtgcactctg

SEQ ID NO: 32121 - DNA, 201 bp, Bos taurus
ggtaatgcattctgtgaacacagtttagatcatgatgatatagttacactcagggagttggggagggaaaagagtgtaggccagattaggttaagtggttyagggcaagcttctttgagaaagtggcattagactgtgacttgaatgcaaagaaggagccagcgattagaagagctgggagaagaggggaaaggcacagaa

SEQ ID NO: 32122 - DNA, 201 bp, Bos taurus
gcaggttcattcatttctaaaatgagaaagagaatattctatcattgagttattgtgaagattagtaaggtaacatggaaagctcctagcatggtgctggyagctggctcgctcactcagtcacttcagttgtgtccaactctttgcaaccctacagagtagcccaccaggctcctctatccatggggttctccaggcaag

SEQ ID NO: 32123 - DNA, 201 bp, Bos taurus
ataatcagtggaggaaatggttcggttattaaaagcaaatgaaagatatttctacccctgacagctcaatattagtaccagtccttatagttctgcagatyttctcaacaaggctgggttacacctaggtattactaataataataaccagcattttcgattgtttagtatgtactgctgctgctgctgctgctaagtcac

SEQ ID NO: 32124 - DNA, 201 bp, Bos taurus
ctagcattgcctagtgctgataagcagtgaggaataatctttgaggaaagcagggaataataaaaattcatcagccgtcaaggggccaccgtgtttttcartgcagcagtgtgactagccttgtgtctggggatccgtttcctcacatgtaaaaatcaggaaatgcattgcccctgtttcttcacctggcctactcttgat

SEQ ID NO: 32125 - DNA, 201 bp, Bos taurus
ataagccagaattaatgaaaataattgcatataatgtgttagagggaataaatagaagtgatagagatggaactaagtctcctaagatcttcccaggtggygctagtggtaaagaactgcctgccaatgtaggagactcagaagacgctggttcaatccccaggtcctgaagatcgttggtcaggaaggtcccctggagga

SEQ ID NO: 32126 - DNA, 201 bp, Bos taurus
aattaggccctatctgttaaacctgttgtgtcaaaatcttcttgaagtgtcttcatttacatatttctaacgttgcagaacaatcataatagttggttctrtcaaggcccattgtcaaatgctttcattctttgattgacagtgataataattgatactatgggtcctttatattagagtagttgtttatttgacataata

SEQ ID NO: 32127 - DNA, 201 bp, Bos taurus
gtattccctcccgatcaacggacactggctgcagctgcccagcaaggattcctccttcctccaggcttcagctataaggctggatgtagtaagtaccgttkatttttcatttgggagtgggtggagggcatgtctttaggcaatttaatattcctgccacaccaagaaatgagatcacccgtatagcatttttattttaaa

SEQ ID NO: 32128 - DNA, 201 bp, Bos taurus
caaggatcccagcatacatccttgcggcttagcagacccaaatgccaagactgtataaggggattctgcgaatcagagttccttcaaaattcctactgatygttggcttcggttacctcagtataacgtgctaagtgtgcaaaggtgaataaatcaacgtctcatcccttcctgaagcaaatgtacccaaagggggggaaa

SEQ ID NO: 32129 - DNA, 201 bp, Bos taurus
cttccctgaattccaaagagcagatttaaacagttgctaatcagggaagggaagacttgcagagataagggaggatcagccaagaaacaatggtagagccytggggcagggtcctggttccacctcaagggacaaaccctttttaagaactaaaacccagtaaatggaaactacaggcatactctataccagagaagacca

SEQ ID NO: 32130 - DNA, 201 bp, Bos taurus
aattagaacaatagggtaaaattaatgccaatgttaagtacagatgtgccagatatgatgggtagttgatacacaattcaaattgacaaccacgtgcaatrtggaaagtatccaggcataacctcagatccagttggccaatggatgtcatgattgcctcacagagaacatatttaaaagagatttatttggcagtaagaa

SEQ ID NO: 32131 - DNA, 201 bp, Bos taurus
aactcagataacatgctcagtgccttgctcttcccttctcctccacatcctactgtacacatttggcaataaacatcatgcataggtgcaagttgatcctrtatcaataaatcgtcaagtaaccagaatgcccagagactgggcctaacagacttttttatccctaagcattatatggatattccactcttcctacaagct

SEQ ID NO: 32132 - DNA, 201 bp, Bos taurus
ccaggcccatatgtcaccactactgagcccatgccctagaacctgtgctccgcaacaagagaagctaccagtaaagctcaccacaactagagagaaagctyacacacaagaaggcccaggacagccaaaaataaatattttttaaaaactgaaactttttatattaaaaaaaaaaaaaagctaacaatcaatgaaaagacc

SEQ ID NO: 32133 - DNA, 201 bp, Bos taurus
gacacctcaatgctgtttctctgaagcatccatgcaaggatatcatggacaaactgcctctatcctgggctaaaatgactcaccccaaatagacacttttkggaaatgctagcactgctgtccaccaaggagtgcattccaggcttcccataaccctcttaacagcagttcagttttactcaaaagtttcagcatgagtat

SEQ ID NO: 32134 - DNA, 201 bp, Bos taurus
aattaatatgtttaattaataactgatggccggaacataacttatttaaataaatgtaaaaaaccagaataagttaataaataataaactaaagaagtgtrgagtttcaacttggaagtttcaattaaactaattttccttaaagaaaatacgctgttattgttcagtcactaagttgtgttggactctgcaacccatgga

SEQ ID NO: 32135 - DNA, 201 bp, Bos taurus
atattaaagtgagtgtatatttaaaccacactataatacttatatttgtaaaactgatttaggttctaggtaggtttttgacccatctggctatctggtgyggacattttgatagtcatgacattggacaagtcttcattgttggggactgtctcttgaattgcaggacacctagcatctctgagcttcttcgcttaatag

SEQ ID NO: 32136 - DNA, 201 bp, Bos taurus
cctggagttcactcaaactcacatccatcgagtcggtgacgccatccagccatctcatcctctgtcatcccgttctcctcctgcccccaatccctcccagyatcagagcatccactatacagtagatccccttgatccatttcatcttcccctccacctctttccttttggtaaccgctactctgttctctgtatatccat

SEQ ID NO: 32137 - DNA, 201 bp, Bos taurus
gtaaaattatctaacgaagggttcacccttcaacttgctgatgtagaactttagctttaacaaattaccataaatttggttaacctgatgctgagaactcygtaaggtccttgaaattgctccaaataccaattcctcttctgggattttgttggctatgtgacaaagtggtatttaaaaggctgttaatctatatggtgt

SEQ ID NO: 32138 - DNA, 201 bp, Bos taurus
caagaaattttgaaaatgaatcttatgaaggaagacgtgaatttttagaaattaaaatgtatttttacattttatagatataattcttatatagagtgacyctaggcagaaataggcatgttaatgagattagaaagtccccagacacccataatttaataagttttaaaggtacagaatcaggacttaaaaaaaaacttt

SEQ ID NO: 32139 - DNA, 201 bp, Bos taurus
acagaatgagctttggcatcctctcttcttccttttatgcaagccaaatagaaatttgaagattttctgtaaatgtcaatattgttgggccagttgaaggrgaccaatctttctcatggtcacccgtttccacaggaaaggaattcactagaacatgtctgacctttggccctacactcactcctttgatcactggtggga

SEQ ID NO: 32140 - DNA, 201 bp, Bos taurus
acaatatatatatgtataaaacactactttataatagaaacacatacatccactggtgtgtatacatagaaacaaagctacagaaagtttatagagaacakattagggaaagaaaagatggcagaggagtaggtagacaacagtacacctcttttcattaatgcatcaggaatacaccttcagatgcagatcttgcacagc

SEQ ID NO: 32141 - DNA, 201 bp, Bos taurus
atgtggctcactgggagcaggagtgatctgtagagttggatcaggtgtgggttagtatgcccaaggacatactgagctgctctctgaggctattttaggcygtgactttggccaaccctctcctctgtcctggatctcaggcttcattataatttgcctatcatccttaccccatcacataaattaacttccctatctaag

SEQ ID NO: 32142 - DNA, 201 bp, Bos taurus
ctgctatacgtcaaatttataaaattaatattcttcagagaaatctcaaaattgaattacttcccctggtcaaaatcgaaaggtttacctgaggggcgctygtggcaaccaggaaagcattagtccttcccgggtgatcatagtcatgcatggctgcagccacatacaaggccatcaactccaaggcagggatatttccag

SEQ ID NO: 32143 - DNA, 201 bp, Bos taurus
cagtacagattttattcaactaatccttctgctctgtctgccaaaactaccatcagtaatgaagcccaaggttacaactgctgttagaaaagccttataakattgggcctgaagtcaacccaaatctttaagccttttgcttcatttgtttataagcaaatattcaggcactttccatactggaattttattaaaatttat

SEQ ID NO: 32144 - DNA, 201 bp, Bos taurus
caacatagcacactcccatctagtccaaagttaaaaaaaaaagcaaaacataaatttatctactatagtcagctaaaaaagggccccaaagatagtatacygtaatccctagaaactgtgaactgttatgtgaaaaaagggacttggcaaatgtgattaaattaaggatcttgagatggtaagattatcttggatcactgg

SEQ ID NO: 32145 - DNA, 201 bp, Bos taurus
tagcaattattagagtacagaaaagaaagtattctcccagtgttcaagaagaacataaaaataatttccctgaatacaggccattaagctttaattttgaycctctttaaaatattaatatggattataaattgttttctagctctcataaaggtaatgcctcgaatccagcatagattcacttagagtaggccatgccac

SEQ ID NO: 32146 - DNA, 201 bp, Bos taurus
aatgcaatcaaaggggaaatttagcactggaaaagcacagtttagtgtctgctcagactacccagatgtgtaaatagccactgtttgatgtatacttttcrggcattaatcataaacatcatgacccagaaaagtacatattagttgctggaaaaacaaaacaaaacaaaaaaaaaccttctgcaaatgaaaaaagatatc

SEQ ID NO: 32147 - DNA, 201 bp, Bos taurus
attcaataaaacagtccaggtaagggaaacactgtgtaggaaggcccaaggcaagaactgtaagaagagaagtacagccagtgtggctgagaagcaccatkcaaggggagacaagaaagaaggcccaagataagaggtagggccaaagtcagactgggccttgtgggctatacagagaagttagagttttatcctaaaggc

SEQ ID NO: 32148 - DNA, 201 bp, Bos taurus
tgttctaatgaggtgatccttggtggctcctggataccttcaggatggtggctgctcaccaaatgattaagccatgatagcttagtttgggattttttttyctagccccataaacaattttccagggaggggagaggggctggagaatgaattaataaccaatcatgcctatgtgatgaaatttccatgaaaatcccaaaa

SEQ ID NO: 32149 - DNA, 201 bp, Bos taurus
gtgccccatccttaggttagaacacggacatggtggtgggggtgagccagcctccaccatgcctaccaggaccacatcctaggatgacagggccccagccrgcatgacttcaatgccactcacccccatggattaacatctcagactatcttgtaaaagagaaataaatcttttatctagtttgtcatttctaaactggcc

SEQ ID NO: 32150 - DNA, 201 bp, Bos taurus
ctgatctgaaattctgaaaagtcttttaatctctttctttgtttgtagtgtttttaaaaaatttttaaagataagcttggaaatttttgttatattttctkaaaatctttcttttctttggaatttaatatagcttctacttcacattatgtgtcaattttaaggattttttttttttgatgtgggccatttctaaagttt

SEQ ID NO: 32151 - DNA, 201 bp, Bos taurus
aggaaccaaccctgtggacactttgaactcaaactggtagccttcatatctgtgagacgaagcttctgtgctgttctaagcaccaccccccttttctgatrcttatggccactttagcaaactaatacaagcactaaggaccaccaccatctctaaccctctcctattttccctttaaaatactaactttctcttcttaga

SEQ ID NO: 32152 - DNA, 201 bp, Bos taurus
ctttcccactttctaggaggaaggttctgaaaccatctttgccttttgggggcttggtgtgtggtttggccctgaaggcctactgagttatgtagggctgyctgtgtctacacctgtgattctcaaactgccctttaggaaagaatcaccctgtatgcttgtgaacattagactttcccacaccccaaggacagggctcag

SEQ ID NO: 32153 - DNA, 201 bp, Bos taurus
ctctcttcctgggctccctgcctgctctctcatggctgcagaagcgccatctgtgtgagagctcctgagagacaaattgcttcctatcctgggcctccatygcttgcctggagtagtgcttaagaaataattgcttcagggatctcagagtactctgacctgaggagttcttctggcagcttctcgaggagtcacaggact

SEQ ID NO: 32154 - DNA, 201 bp, Bos taurus
atatattaaggacttaaagtactgggcttggtgaaatatgggaaaatgtttattgcacctgattttgcaatgagaaaagacttgtagtaacaggaaataarcaatgacaatatataggtgattaaaatgccttaattaggatgttttgtttgcatttttatggaaataagggagtaagagtacatgactttattctagtgt

SEQ ID NO: 32155 - DNA, 201 bp, Bos taurus
tgaccactaatgatcctctggaacactgaaaataatcactacaagaaaggaggaaaaagggagaaacaggaagataaaataagctgcaccaatagtaaacrgtagtaagatagcctcagttcagttcagtagctcagtcgtatctgactctttgcgaccccatgaattgcagcacaccaggcctccctgtccatcaccaac

SEQ ID NO: 32156 - DNA, 201 bp, Bos taurus
gattttgctgcggtcatccttagtccacccatggtagtgacacaggtttcaacattagcgctggcaagtgtatgtggaactgtgacaaacttgaaacattygtctggaaccaacccaaatatacgataaaacattctaaagaaatatttaaatgcacaaaggaaattactgtgcactatatgagtatataatataatacct

SEQ ID NO: 32157 - DNA, 201 bp, Bos taurus
tgattctagagaattctgctaaataatcattcaaataattgccaatccaaacagtgatgatccaggggcttatatgttaagtcagccttataaagcaagamgatattatagataagatcctcctagaggaattgctttatactacctacaggtacctgttaagtgtttctgtaaagcagtgcttaaatattagcatttttt

SEQ ID NO: 32158 - DNA, 201 bp, Bos taurus
tttagaaataataatttcttcccttcatgggattgttcctacagactattctaattttttcccctgccactctttctcccagctagctttgctgtagtaakatcagcctgatgtaagtttattgaacaccccaggtttcttcccagtttagacttattcactatctttgaaaagctcttccctaacaatgacatgagtcac

SEQ ID NO: 32159 - DNA, 201 bp, Bos taurus
ctttcactggacaatctatgctatagactgttcttcatattctttgggttgactgctctgataaaagataaaataaaacacttgatgataattagagatargcaggagaggcaagcggtgacgggagtaggatatctgaatatgtgtggttcattcaaaaactattcaatgagtataaaatatgtaccaggctctgtggag

SEQ ID NO: 32160 - DNA, 201 bp, Bos taurus
aaatgtgtagtcagagctggttggcctgaaatcactttgttcatttcatttttgtgtgtgtagtttataaatatatttgagattgtcaggttagtagcacycacaattactacaatttaaaatgtaagctattgtccaagtctccttatgggcatagtttgatagttaaatgcattggatttgtaacagggccttttgaga

SEQ ID NO: 32161 - DNA, 201 bp, Bos taurus
tctctcatttctgcactcactcatcttttccaagccaattttgtgatcccttccatcagggcatgtttggaaaaggatggacagtgtcttccttctctttygaaaatgcttaaactttggaaagtgatcctgctaagagcagtggacagggagagaagagagtgacttgccttcacaagtcacaagtggctagaggaagga

SEQ ID NO: 32162 - DNA, 201 bp, Bos taurus
gccttccagagcactgatgtcccttgactccagcatcctcactggctgaagctagcatcagtctgctttctaccatggtccttttagcacccagcaagccrgcaggcctgtaaaggaggcttcccaggaagcttgtagaaactaggaacttaacctttcaattcaccctggctattccccttatgctgcagctgtgcttaa

SEQ ID NO: 32163 - DNA, 201 bp, Bos taurus
ggagaactactaaagcaagaaagtaccagattagttgtgactacatttgtttcctcactctttccagagacttgaaaagcaaagctttagccctttgaacragtttctctttttccttatggctcttctccaccccttttcaaccccaagtgttgagttggaaaatttagatcatctgtgagttcctatcagaatttaatt

SEQ ID NO: 32164 - DNA, 201 bp, Bos taurus
ttttcctgcgtcccttggaagactattggtgtgggtgaggaaacgggataaaaggtgtggtgattcacggctttcttccgttctctgattggtgctccccrtcacattctgacaagtgagtgtcactgggtttgaggtgggtgtcttggttacaggagataaggagtgacagcgctgtagagtacatttccataaattcac

SEQ ID NO: 32165 - DNA, 201 bp, Bos taurus
ccgaggggccaaatgagactggacaaaagtctctttccagagcctggtgcctggttttgtattcccttgcagtagcattactgaactatatagaaacataygaatcgcttaattgttccttaaacgttcttgtctggctgcatccctctttcctgcccacaggttgaaaagtaatgaatatgaaacgaagtgaaggtcaag

SEQ ID NO: 32166 - DNA, 201 bp, Bos taurus
aatctggaaaacagacctagccagctatcgcgtcggtttcttcatctgtaaaatgataatgaaagagtgcctgtgtcatggggtttttgggaagattttaygaaacaacacatgggctttgtataaggcctgacaagcaagtactcaatatatatatactgacttattatttttattattaaattctttctacactgagtt

SEQ ID NO: 32167 - DNA, 201 bp, Bos taurus
tgccatttactgatcataatttttttcttcctttatggctcagtttgactgttcttattagtctgggttcgtttgcagtgcattcaggcatgttctacccrgaatactcttagatccatgtaaaagagaaagtgttagctgcttattccaactctttgcaaccccacggactatagcccaccaggctccttggtccatgga

SEQ ID NO: 32168 - DNA, 201 bp, Bos taurus
ttccagcctttctgctttgttcttaaaaatagaaaagaaaaaaatcagagaggaggttttgtatttaagttcacccttgtcctttcttccttcactcttcyacccacagatgtcgtttgcctctttgccttcggtcctctctggttttcttattccggtccttctcatcaccgattcttttcttgtactccagcttctgag

SEQ ID NO: 32169 - DNA, 201 bp, Bos taurus
caagggactctcaagaatgttctctagtaccacagttctaaagtgtcagttcttcgaactgattctcattagttatctgttttataatagtagtttatacrtgccaatttaatcatctgtttatggctgtgagtgagaaatactaaagttgaatgctttacctacctttaaggaccttgctggggcttccctgatggctca

SEQ ID NO: 32170 - DNA, 201 bp, Bos taurus
acttcatttacagtctcagaggggaattaaggccgaggagacaaaccaggctccgagagtgtttattagaatcttgagttttaaaaattcattcccatttrtataaggccatagtgatttttttaaaaaaacatctttgaacagaaagcggcttatatattggccttcatggacagcaagaagtgaaggattggagagact

SEQ ID NO: 32171 - DNA, 201 bp, Bos taurus
ggctcatccccacatgtgggtctggcagaggtacgggggaccgtgtcctcacatcagggagtggcagaggtgtggccggtcctgtccccatgcagagggcrgtggaaccatgtccctttgcagtacacaacgtgcttgaggtcagggcactctgggccattcggtgggggagccaccacttttatcacattgttttcttcc

SEQ ID NO: 32172 - DNA, 201 bp, Bos taurus
catttctcagtctggaattgactgagctgatcaatggccaggagagcagaggtgtgtctgtctccctgccatgcctctcccaggattcccagccctgcccyggcacagacctcaacttggccgtccccaactttgtgactctaaagctgttttcactgtgataggaacctcaggttgtcatgctaatatctggcatgcccc

SEQ ID NO: 32173 - DNA, 201 bp, Bos taurus
tagtccttaagctgagaatgctgttttatggttctaacgagaggaagaaggaagaggagggaaggaagaggacaagatggggcgaagttaaggagaagcayggagaccatatgtggccagcaaagcctcaaattgttactatttggcccttttcagaaaatacaaagaaactcttgtatcaagttcataaaatagtttagg

SEQ ID NO: 32174 - DNA, 201 bp, Bos taurus
atcattccacaatatatacaaatatcaagtcttgtttgcacacctgaagcaaatataatatttcaactacatctcaataaaagagattgactccaggggcstctttgtcctgttctgcaactgcagcttgtgcctaatcactctgccttacccactctgtctctcctctgagcctatatgtcatcctgtcactgatttctt

SEQ ID NO: 32175 - DNA, 201 bp, Bos taurus
gcattgaaagggtgtgtgtgtgtgtgtgcacgcatgcactcagtcgtgtctgactctttgtgacccagtgaagtcaagagcttcctaaatggccagcttgytccttatacttttcaagtccagatctgagtttatcatcttctccctcaaattaattcttcttccagcttttctgtttcattaacagcatggccagtttcc

SEQ ID NO: 32176 - DNA, 201 bp, Bos taurus
ttaaaatcagaaaatgtctaataagacggtggttttccaaggtctctttaaaattcacagggaaaggcagcaaagggcctagatgagctggaaagagctgkaggtgtgaagcctgccaccctcggtggggaggggacatcccttccccctttaggcctgatcttttggttttagggggctggtctcctgtaggcatggata

SEQ ID NO: 32177 - DNA, 201 bp, Bos taurus
gtttgatttcagaaaacccagtcccactgcaaatgtaaccctcaaaaatgcttatacactccatacatgcctcatgacttccaactggccctccagttagrtggactcagcttttctaataatcacctctggtcatctctgcatctccacaagacatcataatagagaataagcaacactgacacttggaatcaagggccc

SEQ ID NO: 32178 - DNA, 201 bp, Bos taurus
cacatgttttccttaaaaaggaagcaaatccggagtgtttggtggcttcgccctcactcagctccctttgctggattgacaggccacaaactcagaagaaragaaaagagtggaggaggactcccctggtggtcggtccagtggttaagactccgagctcccactgcaggggccacagattccaaccctggtcagggaagt

SEQ ID NO: 32179 - DNA, 201 bp, Bos taurus
ctccctctgatattcagttatgaatgaaaacaggaggcagttcacttgccccagtggcagcggtttggagactatgttcctggccttccttcctcacagcytcacgtttacgttgtaggtcgaccttgactgcagtcagaaggttgtcgtgtatgatcagagctcccaggatgtggcctctctggcttcagactgttttct

SEQ ID NO: 32180 - DNA, 201 bp, Bos taurus
cagaatcaggggtcagagatcataaaatgtgtccagggtcacacagctcatcctagcagtaaagtcagaattcaaacttatgctttttaagcctaatctcyccctatcttttcttcagagcccattaattcaaatgattcacttcaatgaaatatataccatgttgggccacgtgttcaggaccttcttgatacccttgac

SEQ ID NO: 32181 - DNA, 201 bp, Bos taurus
tcactcccactcaccaacctccaacccatgactcagagcccacggtcttatggagagattcgttttctcagacgtctggatcctcggatcacttggagaarctactcaagattgatctggagagcccaccgtcatctgattataaagaagaaggccactctcagacgtcacagtcttcctcaggaccagcaatagctaatc

SEQ ID NO: 32182 - DNA, 201 bp, Bos taurus
ttttttacaagcttatacactgcaattataaatgtcttaaacagactctttgtatgttttaaatcttgtttttccttctgtagatgttaactggtaaccartgtacaaaagggttggatctcaccttcaggatatctgaaatttacagtttattgtccgtttttagctcatactctgtatacttctgtaggtacatgtatt

SEQ ID NO: 32183 - DNA, 201 bp, Bos taurus
gcagtaacacaccgactgtgaccctgggttccgcggccaggacaacactcatcggaccacggaaaggatgctgtccagcctatgggttccgttccaaggargacaaaacactcacttgggcatcccataccacacacttatctcccttgtttctctttctgttcatctctagggtgactgacgtggtcttcatttttaaat

SEQ ID NO: 32184 - DNA, 201 bp, Bos taurus
ttgtttgtatgtagtgcagaaagactctgttgagtaatgcaagagaggaaaactttcttctctaccctccctaggttcactggccgcccacttctccaatyaaactgataagaaatagattaataagagaacaacaaaaaaacccagacttcattatgtataggtgcaatgagtttccaaagaaatgaaagctcaaggaag

SEQ ID NO: 32185 - DNA, 201 bp, Bos taurus
acatgaacagctcttggtcctttcctgaaagcagcttacttcaatgggagaaaacagaagtgtaaataggtaattacacatattttttgcaactctgtgtrgtcatttatcccaacactttcaccatctaataccttgattctcttattcttttctctcccttatctctgtctatgctcttgtcaactgttaaaaaacaaa

SEQ ID NO: 32186 - DNA, 201 bp, Bos taurus
taatagtctctacttcttagaatttttttcagctacactgcataaacaagttttttcctttcttgatcagaattatgccaccttgttgcttcttccagttygagagctctctgggcaaattaatattcaccatggcctgtaaaaacttgatttatgggcaataaagtagatgcctttatcagggacaaatatattcttatt

SEQ ID NO: 32187 - DNA, 201 bp, Bos taurus
gataagattaccatactattaaccaatatatttcagataagcaatctaattttacaaatattatgtgaaatgcctcaggattatgtagcaatgcatatttmacttacatattctatactaccacttttctgctgaaaaaaatatgtatatttatgaattttatagaactgacaacttatctcaggaaattgtttacatcct

SEQ ID NO: 32188 - DNA, 201 bp, Bos taurus
taggtaggcctgggacaaaagtcatcgacaagtcttcgtggaacctgccttgcttcatggaattcttccttttgcctatatactgtgtcctgagtatcackgcagttctcccgaggcctggatagacctctaatctagtatgtatgtatgtgtgtgtgcactcagttgtgtccaactctgcgaccccatggactgtagact

SEQ ID NO: 32189 - DNA, 201 bp, Bos taurus
caaggatatgggtaattaactagtgtttatttatatttgagagaataatattaaaagattctcctcaacctggaatgtaagtatatatatttcttgaaagrataatagtaaattatttctctattcaaatcaaagataatgataagtatcataaaatatttagttcaattttattggaaagtagcatgaggcaaaattcag

SEQ ID NO: 32190 - DNA, 201 bp, Bos taurus
gttctgaatttgtattaagttctgaataatcatttcttcaagtttgtttgccaatctttcactttgtcactgggcatttcacttctgggccaacatgcccrtgagtatccagattcaactctgtttcttccagtcagatttatttacttcattgctctagttatgaattttagaatcttcttgccctgtctcttcgattca

SEQ ID NO: 32191 - DNA, 201 bp, Bos taurus
tggccatcttctcctctgtgtcttcacatggtcttccctctggcatttgcctatctgtgcccagattttttcttcttatgaggagatcagccatattggartagggccccctgtaaagacttctttttaacttaaccaacattttaaaacacttcatctcctaagataattgcattctgagctatgagtattgaggtcctc

SEQ ID NO: 32192 - DNA, 201 bp, Bos taurus
ccctgtctgcatgtatacaggaagactctttgggggtcaaaatggagggtgcaccatcccataataagtgtggacgtgtacccacaggcctctgctgtgcratccatctcagcaaaatgtttttgtgcacccacgttggggagggtccaggactagtcaagtgtgggaaaagaactgagataattggccaaaggtaaacaa

SEQ ID NO: 32193 - DNA, 201 bp, Bos taurus
ccatacactgtgtgattccacacaccggaaaacatctctggtgatttccagaaataaaggaagtatatatggattttccagagactgggaaagggagaagkgcagaggggatgttaaggcccctgcagtcaggcaaactgtctgttggtattgctgaaaaaatacctaaatctagaaactgtaaaaactgggaaatatgag

SEQ ID NO: 32194 - DNA, 201 bp, Bos taurus
tcccagaccaggaatcaaaccaatgcccctactttgtgaggcagattcttaaaccattggcctatgagggaataatctttttaccatcacctttgcctttrccagactatcatatagctggagttatactatacgacttttcaaatggccatctttcccttagcaataaatattaatatttaaagttccttcatatctttt

SEQ ID NO: 32195 - DNA, 201 bp, Bos taurus
acaaagtcagaggaattcctctcctctagaagcctcccccgcccaaattcccaagatccttggcctgccaggaaacaattttctttgtgtatgagcctggyaccctatatgtcatacaccatgtcagtttcctttgaggactttgtaaatattgactccacccatatttctctattgtgagcttgtcatgactgattaaat

SEQ ID NO: 32196 - DNA, 201 bp, Bos taurus
aaataacaacaaccatcaccaaactctcatttgtcacagtggactcaaaccttagacgaggaattcctttcacggggaaggtgaagtatttttcaattcaygtgtcaaaccatagtctcccccaatacacacaacatattctgctaaaaccacatttggctggtattatccattgattagtataatcaaaagcatgtgcgt

SEQ ID NO: 32197 - DNA, 201 bp, Bos taurus
tactttgagagcttttaacccaatttaaggaccctgttagttgacaaaaagtttttccccaaaagaggtgaatacttaaactcactcaaagaagagagacrgaagctccctggagggtcatttaattcctttttgctttataggtgacaaatgagaccctgaccttgaccttcacagttctgcaagacatcccagtaaggg

SEQ ID NO: 32198 - DNA, 201 bp, Bos taurus
catcactatgatatacattaggtctcaagaacttactcatcttataactgaaagtttatacccttgatcaatatttcccattttcctccacccaccaatcyctggtaacctttctaccctgtgtaactatgagttcaacctttttagtttcaaatagtgagatcatgtgagattggtctttctgcagacagttttacttag

SEQ ID NO: 32199 - DNA, 201 bp, Bos taurus
tctggtttgttacaataagagctctgcatcagtggatctggggtgtggcccacagtctgcagctccaacaagcttccaggagtcactgatactggtctagygtgttaggcagcctctaaggggccctgacaacccctgcatcctgatatttacactgctctgtcatcttctccccttgcttgtgggctggatttagtgatt

SEQ ID NO: 32200 - DNA, 201 bp, Bos taurus
agggaggctctccctagcccaaggtctcagaggacatacgtttgttggctctgaaggcctccgcggagtccatctcttagtttggccattaccgctttatkgcttcattctgctacacagagcactcccccacccctcatccccacctcatataaccctcctcctttcctctcctcccttttatgggatctgtgtgtgttt

SEQ ID NO: 32201 - DNA, 201 bp, Bos taurus
tgggaattgcctggcagtccagcagttaggcctctgagcttccactctcccactgcagggcacacggattcaacccctggttggagaactaagatcccacraaccgagcagcgaggccaaaagaaagtaaaaaagccagaaaagtgaaaaatcttggctctcagccccagagaaccaaaacaaatgagtctttctaaaaaa

SEQ ID NO: 32202 - DNA, 201 bp, Bos taurus
agataagaccgttaaaaattacgctgtatagacttattctctgcgccaacttctaaagtacatgtttggaagttaagggatgggtgtgcaggcaccatctyatctagagccggggcctgccgacacacctgaggtcttctctcatctgttcctccagttgggaggctctgccaagaatctcccttctcaagattttttttg

SEQ ID NO: 32203 - DNA, 201 bp, Bos taurus
tcttgccaaccacattggctgtttttggtctttgcattttgtataaacttgtgagtcagcttatcatttttcaccaaaaaagcataaggtattttgactgmgatttgatttaatctaaatataaatttgaggatgattgactgtagtaattttgagttttccaactcactgacatcatacattcctctattcaatttggtc

SEQ ID NO: 32204 - DNA, 201 bp, Bos taurus
agtgtactgagctggggacaggagaccaaatgaggtggctcaggagaggggtatggaccaaacactttttgtttgaatacaagagtgctcactaagacagyaggcaccgggcctccagcttcctcaaaggtgatgcggggacctcagggaccagggagacatgagcgctcccactccttaatcaagcctctgtctgtcctg

SEQ ID NO: 32205 - DNA, 201 bp, Bos taurus
ataagatatctgataatctattatcagatagataatagagatgataatctctccaggccttctgttgtgacctgtagctctaacaaaaattagatgccctyatgcagttctaggtgaattgttctcctcaagcagagagtttttaaggtaggggctgaagggtgttgacattttccctgcagttactgaagacaagggcaa

SEQ ID NO: 32206 - DNA, 201 bp, Bos taurus
cctgaccaccaagattcagcaaaccttcaagactagaggagaagagatactagcatctgaacatgacatctaacccttgggcttgccagcaagatcagacmtttcctttacctcactctaccaggtgatcaaaccctggcccacactggtttcatctcctctttcctgctaaaggctggctccaagggacccatgtgctgc

SEQ ID NO: 32207 - DNA, 201 bp, Bos taurus
ggaacaattagaggctggtttctctactgtcagattctgcaggtgcctgggggaggctggggggtgaccagctcccgagggggcccaggttggggacttcwcgaatgggtgagaccctctctccttctggggtcgccagctgggaccgcagtcagaaacggcgcaggccctcggggcagcaaggggccctgaggcaagagg

SEQ ID NO: 32208 - DNA, 201 bp, Bos taurus
tatctctatgcagccccctgagaggtcttggtgtgctccagcaatctccgcactgaataaatggccccggcgtagctgccagtctgacttttgggatcctrgtgcttgctgccctatgggtgctgcttcctttagctggtgcctcctgaggtttcatctgaagtggtttctagtgtctgtggacagaagcagaggtcaaga

SEQ ID NO: 32209 - DNA, 201 bp, Bos taurus
aggcagcgctggtaccggcacaggctgaaatggccttatcactgtggaaatatcgaaggacttccatgctggtgagcaaacggttcctgcccgagcctcamgccttccttcgccaagggccagcagctgagagagaacatctggcacatcagggggccgctaagaccacacccccaagctctactctgattggttgattcc

SEQ ID NO: 32210 - DNA, 201 bp, Bos taurus
gtttgggggggctgatctcaggtggcctcagcctgcagtggcttgaaatagggtttcagttcccagccagatatggacaccaggtcacagtggtggccatktgtctatccacgcatactgtactcttctcctcctaataagtgtttcacttgtttcactactctctgtctttgtggtaattcttttctgcaaagctgagga

SEQ ID NO: 32211 - DNA, 201 bp, Bos taurus
ttggagcacaaagaggaaggtctggaatggtgctgtgggccattttgaaaaaaaagaatagagtgtgtgtgcctgtgtaggaatcccgcctctcgcccccrgggcccccatcaggagtcagacctgttgttgataaccactggagggcaaagtggagggggtaaaagccatcaggagccaggcagggagaagtcctatttt

SEQ ID NO: 32212 - DNA, 201 bp, Bos taurus
gaccctgcggccccagtctgagctgtagggcatctctgttcactatatgtttttcctctacccacctggagagcctacggacagaagaggagagagaaagmtgggccccaagaatgctggtcacagtggaaacacggcatcatgtttccctcgggaaggacttaggttcaaataaggaggaggaataagggtgagccttgt

SEQ ID NO: 32213 - DNA, 201 bp, Bos taurus
gaagacacagagccatgccttatgtacctctgtgtcagagaatctcatgatggcccttgcatggttgatggatggcaaatatatacagacacagagtcgcrgaagcagtcacggtagacccaggcctcctgtgggtccacagctccaccctggtgttctgctggagtgcagagggtccacctaagtctgaggtgtgaggac

SEQ ID NO: 32214 - DNA, 201 bp, Bos taurus
cattgcctggagcctggaccctgtgaacccatccctgcctccctccctctcccagtggggaggtgctgcccccacaaaaacctgctcaaaagacccctggrcttccctggactgacctctgtgaccgttctttcagtcgtcctaggaatttttggctgtcactggtgtcgattcctaatccagcccaccttgccctgcagg

SEQ ID NO: 32215 - DNA, 201 bp, Bos taurus
ctcccaaaatgttcttcttcaaaaagcttagggatctccagatactccaatagaggtaacagaggggtccttgggtaactcatccccagggcccgccccartccagactttctgacttgacttgtgtcccaggatcttccagctcagccacacacatcatttttattcatgtgtaaacaacaaaacaggcctctcacccag

SEQ ID NO: 32216 - DNA, 201 bp, Bos taurus
tttatttatacctctttccctgacctctcttctctcacttcctctgaatcctccccgccccacctctctctgctgatggagtcggctgtgatgaagttcaygaggccgcatgtatgactctcctgctattgaacccggagcctgcccctccacatcttgcttccaggaggggcctttaagctcccctctggatatttgttt

SEQ ID NO: 32217 - DNA, 201 bp, Bos taurus
catgtaaataaggcaaatttactggggcttgttgcaaggatggcttaatgtttccatgagcaaaggcaatcctaaagtgcagcagctgacccaactgaccrgaagccaaggccataaatgcgatccacacagccattgggtgccattaggggccacccattggattccagggttgcactttcagtctgagccaggccagcg

SEQ ID NO: 32218 - DNA, 201 bp, Bos taurus
gttgatgaccacgcgctcgcagcattcgtggtcgtcgtgctcggccggccgcgggtagctgctgtcctgagggtggcctggggcagccgaagcctcgtccrcattctctccagacatcaccgtcatggtggaggtggtgggaggcagagatggtggccggaggcgggaggcgggggaccgggccggggcggggaggggcga

SEQ ID NO: 32219 - DNA, 201 bp, Bos taurus
tgagatttaaaagatctggaaatcacttaatgactaagaaagacttcatctaagaaaacaagaaggaagggagggagggaaggaggaaagatggagaggargggggaggagggaagatggagagagagggaaagtaactgagaaacagaggaaagggatttatcatacttggtatcatataaaaagctatgaccgcttcca

SEQ ID NO: 32220 - DNA, 201 bp, Bos taurus
acgcgcccacagaatgtcatctcaggttttaatagaggctctcattcactatatacaggattctccgccaaaggtggcctggttggtagcaacccaaacamcaccaaaagccgcgggcagctcaggggccactagtgggaattgtcttggccggctgcacgtcctcgatctcagaagacagccagcggtaggtgcggtgac

SEQ ID NO: 32221 - DNA, 201 bp, Bos taurus
gtgccccctagtggccacttccttcatcacggaggttgagatccgcgggatgtcaataggagtggcgacttggacgctaattttatgaatagactgcagtycttgcctagaaagagctcacggccctgagtggaggagccacctgcccaaccgatgctgcttcaatcagaacgcgtccgagggtgcccaggaaaaggtgac

SEQ ID NO: 32222 - DNA, 201 bp, Bos taurus
caaggccagaaggcaagataacagtgggttggataagggaaagaaaagcaggcacctaagaagtaaaggtgagtgagaaggaaaagattagaaaacgaagraaaaaaaagaaccacaaaggaaaaatccaaacacaccagaaaccagagtcaacatggattaaaccactctcaccagttaacaaaaagactgctttttttt

SEQ ID NO: 32223 - DNA, 201 bp, Bos taurus
cttcccctttcacacacaggcactctctgtggacagagggaccaaggccagctctttcacaagcagctttccccctcaactgcccacaacgccccagggtygctactgccgcctccagacctgggcctctgagcccctggctgccagagctcagagacagaaccagcgggatccacgtggggtgggggtggggaaacagga

SEQ ID NO: 32224 - DNA, 201 bp, Bos taurus
aatcggcttatagactcctgaagctgaaggccagtggagaaccagccgttccatccccactgccaaaggtggtcatgaccgaatcatctccctcgtttgtrgaggccaagaaaaagattctggaatttctggcgagtttctctgaagttctaggtctatacttgtcaacacatcttccctcatatttgctttgaatctatc

SEQ ID NO: 32225 - DNA, 201 bp, Bos taurus
tcacggagcagctccttctgatgtggggtgggtgtttggtattccgtgggtggttcactgacgttgtcgtctatgcttagagctatgaagtggccttgctytgtctcatctagccagggtctcctcattaacttctcctgaggttggtattctgcaagttgatcagttcagtccctcagtcatgtccaactctttgcgacc

SEQ ID NO: 32226 - DNA, 201 bp, Bos taurus
ggccagggaccccactttgagaagcaagattctaaatccttctcaaagacgtttgtgctccttcagcaagaatttgaggggcgtgacccgtgtgctcagcrtgtcccaggcactctggagggcccaatttggtggccctggatttcatgggcaggtgccagaggctgtgtcaggtggcgggggtgtgttgaggacatggaa

SEQ ID NO: 32227 - DNA, 201 bp, Bos taurus
agggctggaagctgccctcatggtggggagggtcccagggggccctgcaggagggctccaatgctccagttttaaggggtccaggttgggtgtttctaggrtgccatcatggccacacctgcctttcttccacttcgcctataactttcctgattgtgcacaaggtgcccaggtccctgccagccagtgggggaaaccccc

SEQ ID NO: 32228 - DNA, 201 bp, Bos taurus
agccgggaccacctcagggagcctatgtgggcagcttctgcacactttcggccaccccatggagccccctcaccctcacctttgaagcaggccagccgacygccacacctcctgtgtctccccacttcactcttgtcccaggaattcgagcagcgtccacagtctgccccaatcgtagcagcctagctccttccatcaaca

SEQ ID NO: 32229 - DNA, 201 bp, Bos taurus
ttccttccagacctgccccggcctctcacaagcatgctctttccaacagctcacacctgccccacaagtgttcacagcactcacaccagaccctgactggyaggccaggcggaagccagcgtgcagatgaagccagccccagagtctcaacaaggagaacgccgagcctggggggtgggcttcccagacgagaggcacagc

SEQ ID NO: 32230 - DNA, 201 bp, Bos taurus
ctctgcgggcagtggaaggagctgtcttttcactgcttccctacatgttccagagatgagagtgtgtgcccaacaccagccttgatcccctggagtgtgargtttgtgcaggcctgcttggggcaggccctttggtatggacgccttggcagcacccaagggcagctggctcgatgggtcctcaccttgtagccccggagc

SEQ ID NO: 32231 - DNA, 201 bp, Bos taurus
atttctccaaggtctgcagcgtcagctctgcacgttcttaactctaagcaccgggacacattaagcccgagagccgatcagatatcatgaagccggcaacrggagcaggacgccggcggcccggcacccgggaaagcatcagggcagctgcagtggcctgctccgtcctgcccccagtccccaccgagccctgtcctgtct

SEQ ID NO: 32232 - DNA, 201 bp, Bos taurus
aatgagcaaaaagtcaagctaagggacgggcagggcctgctgaattgcgacacctagtggggagagttcacagtgctggaggctaggttaaaggtccaccycaggactggccattggttatttcaagtcagctggtaaagcaaagaacaacagctaacatttaccaagcactatattttccagtagttatgtatggatgtg

SEQ ID NO: 32233 - DNA, 201 bp, Bos taurus
gatcagggcccttcctaatcttctttgtaagaagagattaggatgaagacttctcacagaggaaggaccatgaggacatggagagaggatccatctctaarccaaggagaggggcctcaggagaaaccaagcctgcctacaccttgaccttgaacttgcatcctccacaaccgtgagggataaatttctgtgtaagccacc

SEQ ID NO: 32234 - DNA, 201 bp, Bos taurus
gctgggttgtgggtcccacacagagtttgggggagtagaggtcagcccaaggctgtgctggaggagggagaattgggtctgaggaaggctgaccaggcctyggcagaaggacaggaacaaagtggagatttaaggtaaaagtggcagcagttgccccagagccacaccttagggcccgtgctcaccccagggcctcagctt

SEQ ID NO: 32235 - DNA, 201 bp, Bos taurus
gctccctggtacaggtgcaggagtgtgctggcccctgctgtcaccatgatccctgcgctcctggggctcaccctgttcctccccttccacctgttgcttcygccattgcagaccccaggcccaagaatgccctccgctcagcagcgactttgttggaataaacacccgtttctctaagctggtgtccttctctgtttctag

SEQ ID NO: 32236 - DNA, 201 bp, Bos taurus
cggcttatgccccagttgggaaggcagcaggcaggaaggcctcaactcagaaccaggaggggagttgggatccctcccactgatgtgctcgggcttccccyctcccaggaagcgcctgaaggccaagaacctgatgtacatcaagcagctcctgtatcttctggagaagttcgtggctgtcctgggcggtgagcggcctcc

SEQ ID NO: 32237 - DNA, 201 bp, Bos taurus
tggggcccaagtcagtgggggtaaccggagagagcccaggcagcagaggcttactccctggtggctgctggtcacaagtgggtgtggagcattagaaatgyggcctgtgtgtgcagctgaggaactgactgaactcttaatgtgcttaattttcagtaaaaatcaatttaaaagtcggttgcagatgaaccagttggttgg

SEQ ID NO: 32238 - DNA, 201 bp, Bos taurus
gtgtcatgggccaggctggagtagaaacatctgaacgtggccccctcctccttgccagttgcctgccgtccagaggaggaactgggccctctccctgaagrgcacagctcaacaacccagagcaagacccagagttgtgtgtctccttcctcttgctgtactagggtctctgctgcagggacctcatctgctgagctggcc

SEQ ID NO: 32239 - DNA, 201 bp, Bos taurus
gggccagggaaggtggttgtaagcagtggtatctcctttgtctgagagccctgggcagaggcaagtgccagggtcaggaccgaggggagagtcactcaccrtaggcccacgccacgcagaaggactcaaagatagccacgaacagcaggcacatgccgctggctgcatagtagtcaaagagctggaacacgtacatgccgc

SEQ ID NO: 32240 - DNA, 201 bp, Bos taurus
ggcctggcgccccactggagaagggatgggaggaagggggatggcgtcaggattctgcagatggtcccaggaccccaaaacagctcctgggaccagcatgytagagggcaggccctgccccgggaggaggcagccacgtcctacttctgcacccccgctccttcagtgaagaatcaggggctgtggtcgtgatcccagcct

SEQ ID NO: 32241 - DNA, 201 bp, Bos taurus
taccaggcccaggtggcagaacagtttgagggttttccatacagctcaccagtcctgtcaagtcctatgaagcagacacctgagcagaagccagtgcacgkgggccccacctccagttctgtctttgaatttccatcgggacaggctttcctggtaggacacctccagaatgtaagattagattcgggactgagcccaggc

SEQ ID NO: 32242 - DNA, 201 bp, Bos taurus
tttatgctgatgaaaacaggccaggcttgttgtcttgctggtagaagtagtagttgttgttgttgttttttgaccaaagtcatttcagcgactttgaagaraggatctgaaaatgatcactcagcctggtatttattttgatatatatgctgacctctacctctcagagccgaacagcctaatccttgaccatcccagggt

SEQ ID NO: 32243 - DNA, 201 bp, Bos taurus
ctggcctgatgtggaaatgtctcgttttcctctctttcctggtctctcggctcccagttgccttagggagtggtcctgagcagggctcccctgctccgccygcccccggccaggggcaaccctcgggtgagaaggccagggtggaaaagagcctgcggggaggcaggccttccgggggagcagggtctcctggtccatccc

SEQ ID NO: 32244 - DNA, 201 bp, Bos taurus
ggggcaggcgcgccagtcaaggcacagtggacgctgccggctgtggggtgtggaccgggctaagggggatggacgtgacctggcagcagtgaggaggggcrtggacaccaggcctgtggggtttcctggaggtttctaaccaaagactgagccagccctgcctggagggggagagagggtgggtgcagaagcacagagaga

SEQ ID NO: 32245 - DNA, 201 bp, Bos taurus
cctctcccggggcggagcagggtgtgcgggtacgtgcaaaacctgcccctcggggtgtcctgttgtgttggaggtgagagaagaggcccctggaacagccrcaggattagacacggggacgtgagggctgctgtgctgggattttcatgggtgttgtcaggccagatctgacctggagacggttagaagtaaagccagagg

SEQ ID NO: 32246 - DNA, 201 bp, Bos taurus
tgagctcagttgcccctgaggcatgtggcctcttagttccccgcccaggatggaaccaagtcccctgtgttgcaaggtggattcccagccatgggccaccygggacattctggcgtgtaatgaactgtaccctaaaaaaatactcttctggttttaggttttgtacatctgtaagtagacattttcggagctctgccggcc

SEQ ID NO: 32247 - DNA, 201 bp, Bos taurus
ctggagcaaggcttctgagggtccacggtccagaggcagtgtcccagaaccccagcacagcactcggtccgggatcaggacccaggccctctccctgcaayaggcaaaaaacagcagcaatatcgctcaccacctccagcgctgccaggaccctggccctgggaggccggtcaccctcatcgttcctcctccgtgctgggg

SEQ ID NO: 32248 - DNA, 201 bp, Bos taurus
gctgagttccaagatgctttacaccgtacagcccaaccgacagagcgcttctgctactagtggaacgtggcctctgtcggccagcaggtgataaactggcrcaattgctttgaagccgatgtttacaggacacacctgaagagctccgaacagcagctccttgataaggcccccctgaaaccaccagtgacaatcaacaga

SEQ ID NO: 32249 - DNA, 201 bp, Bos taurus
catcttccaagcagtaaagcaaggttgttgttaccacgcgatgggcctccatcactgttcctcaccctgccactgccaagctcaccttccctctgcaagartctgaggaggtggggccggaagacctctgacacctggtgctgagggaggcttttgctcatctgagccccctttcaccctcaaagcgcccccaaagcctca

SEQ ID NO: 32250 - DNA, 201 bp, Bos taurus
cctgcattcaggacgctcttagacctcactctacaggtctctcttcaactggctgctcgtcggtatcctttatcacattctttcatagactggttaaaacktatttccctgactttggtgagccaaattaatcgaatctgaagagggaaatctcagatttatagccaactgatcaggagcacaggtagcaacctggactcg

SEQ ID NO: 32251 - DNA, 201 bp, Bos taurus
ccgactgagtgactttaaaaaaaaaaaattatgttcagaacaggctgtggacagagctgttacattacaaatattggttaacaaactaacaaaacaggccrgtggagcagctgtgtgagattactgtcagcctctaccagccagaccagtcaccacagtgggtggaaaccaaggctctgggacgaggccaaggtgaaaaaa

SEQ ID NO: 32252 - DNA, 201 bp, Bos taurus
cactgggccattctgaggctcgaaggacagacacagcttggagagtgctcggcaacagcagagtcctcacaagtatctgctgtcaggacagtccttcccasctcaggatggaaagacagcgtctggtcccggctgtttgggatcctcagtcactggacgtgtgtgtggtcaccctgtgtctcatgccgtgaccctgcagag

SEQ ID NO: 32253 - DNA, 201 bp, Bos taurus
ttctgacagctctgctttcctctttatctcagaattcaaatactgttggaaaaagtttgtaaacagtcagaggaggcccttcaggccttggaagaaactakacagaaattatcagcggctggttgaagagcttgaggacattctcgggtgagggcttctttagcctcccctttaccccgacccacggcctccccctcacct

SEQ ID NO: 32254 - DNA, 201 bp, Bos taurus
ctagtcctgttggtctcaactcctctctcagcccccacctcacgtggcccagccaccatcacctcttccctgcatcaccacacctttggcctccccagccrgttagggatgtactaggtccagcaggtgttcagtcattcactcggtaaacatgcactgattagcgtagcgctgattgggtaccaggcaaaggccctgccc

SEQ ID NO: 32255 - DNA, 201 bp, Bos taurus
acattgtaggcagacactttaatctctgagccaccagggacgctcaaatgacccagaggtcatttgagccagaaacatagggagaggccacagaaaggaayattttaagggaaaggacggtgcgcccccgccctgccacacacacacagggagatctgtggaagggaaatgaaaacaccagtttctgtcccggcccctcct

SEQ ID NO: 32256 - DNA, 201 bp, Bos taurus
cacagcaccccagggtgggccccactctcatttccctcttcattagctcaccaggcacaggctccattcaatttacttaaatgcggcccctggggctgccrccacactctgctcggagctgcccgtttgccagccattccagcttaattacgagggtctctggggagggccagtggggaggctttctgcaagggtaaagtt

SEQ ID NO: 32257 - DNA, 201 bp, Bos taurus
gtggagagaaactgaggcccagcggacacagcaagcatcagttacccgacaagtgagtggatgagccatcagatgattcctgtccccagcctctgtgttckcgagctgaggcccagacatacgtcatggagcagagaccagtcgcccccgctgtgccctgtcctaatttccgacccagagaatccgtgagcagaataaatg

SEQ ID NO: 32258 - DNA, 201 bp, Bos taurus
tccgtagttgtaggtggctgcacagaaagaaagcctacctccaccctctgtaatgctgtgaaactgacagggacagagcagagcccaggaggcctgggatkggggcactctgacagcaaagtctcgccagtgtgcggcaccccacccctcgggaggaaatgactcagtttaacatgacatagccccacacagagaagcccc

SEQ ID NO: 32259 - DNA, 201 bp, Bos taurus
actgcgggccctccatgtccgcgggttccctgtcccaggttggttgagttcacgggtgcggaacccgcggatacggagggccgactggactccatcgtttygtataaaggaattgaacttcaaaaggtttgaactttcaaaaggtttggtatccatgggtggggggccaggggcgcgtcctggaaccagtcatctgcagat

SEQ ID NO: 32260 - DNA, 201 bp, Bos taurus
atagagacaagccctgttcatgaggcttcctttggtagccgtcaggacaggcccagcccagacagagaaaggcctcctggcccttccttcctggcccctcrtcaccagctgcaaagggaagtgcgagggggtgtttgtgtcgggcacttcagcagctgagtctcgccaggcctggacgtagacgtgggtccagcatgagtc

SEQ ID NO: 32261 - DNA, 201 bp, Bos taurus
accccgttctggcggccgtgcgcccaccacccctgccccgccatgtgtccgcagagctgtcgctcatcacgctgcactggttcctcacggccttcgccagygtggtgcacatccgcctgctgctgcgactctgggacctgtttttctacgagggctccctggtgctgttccaggccacgttgggcatgctgcgcctcaagg

SEQ ID NO: 32262 - DNA, 201 bp, Bos taurus
agggcagcccacgatctcccattaaacagacaaaattactctgagcagaaaatagggagaacaaggtataaaaatctgtttaactaagttcacattttagygaattcacaactgttttcttataaagatgttgtgcttggaactgacattcctttaggatttctcaaactgttaatatctgcctacattacatgaccgagt

SEQ ID NO: 32263 - DNA, 201 bp, Bos taurus
tctgaacccagcttctgatccactaattttggggcaatttagcaaaatttcacagaaagggagctagagtaaacttggaaaaggtctctgcacaagtgaamatgattttcaagtggatgacaccaagggaatgaagggtaatgatcttaattcccaataaaataaaagctcttccgcttttaatcataacgttctagctaa

SEQ ID NO: 32264 - DNA, 201 bp, Bos taurus
gaaccacggactaaaaggagggagggcacgggagggatacaagggaggcgagcgtggcggcgggacttcctgtgactgacggcccagcgcagccaatgggyagcggggagatgacctcattgtcgaggaaagtctggaactggtggagtggcggcgcggaggtgggaggaggtcggagacgagccggaggcggggcgctgg

SEQ ID NO: 32265 - DNA, 201 bp, Bos taurus
cccattattgctggctttaagatgcacaaaggatgcttgctttggcagcacatatactaaaattggaattatacagagattagtatggcccctgcgcaggratggcacacaaacttgtgaagcattccatatttttttttttaagatggacaaaggggccactagccaagaaatgtgggcagcgtctagaagccaaaaaaa

SEQ ID NO: 32266 - DNA, 201 bp, Bos taurus
actagtaatcatcctcagggtgatggcctctgtgtctagactgttaattctgttacgtgcacggtaaccatgtaaaaagtgggtatgagtaagcatacacrtacaagttcatatgttcacatatactatggggagagaggaatgcacgtcctaatcgttatcctcctggacagtaaggattggtgtaagtgagaagggata

SEQ ID NO: 32267 - DNA, 201 bp, Bos taurus
agagcagatattcatttatacagaaattgagctctcctgcaactgccaggagagcctgcgcaataattcaggtttgtgattattagacctaaaacaggcayttaaacatcattcctgatctgtttacattgacatggccacctaaactgtaggtaaaaattaaaagatgacattcatttctgtgttcatatactcaactgt

SEQ ID NO: 32268 - DNA, 201 bp, Bos taurus
gggggagccccccctcccggcccacagacctggcagcaggggcagagctgaatgggaggctttgtgaggtgagggagagacaggcaccacgggagcagccrctggagttacagggcctcctgctctgaatctgggcctgggcctgagacccaagtccctggaccagcccagcaaggaggggcctcgagggccaggcagccc

SEQ ID NO: 32269 - DNA, 201 bp, Bos taurus
cattctacttggcagcttcctccttcatctgaagagcctctaggcaggtactgtttctatctgggcagcattctctggggtcctggcctgtcataggtacmtcagttctgttcagtttagttgttcagtcgtgtccgattctttgcgacccatgaaccgcagcacaccaggcctccttgtccatcaccagttcccaaagtt

SEQ ID NO: 32270 - DNA, 201 bp, Bos taurus
tcttaacccctaagtcatccaaacagagattcaaggtctcccggcttccctatttaggaagcaaaagtgaaaaggtttggagtcaggcccctgcgggcacrcaggaggcgcccgggaagcctgtgtgtccagcgaggacctctttccttccaggaggcctgcaccaccaggcgccactctccccgaatggcccgaggccct

SEQ ID NO: 32271 - DNA, 201 bp, Bos taurus
tcgtatgtgccaggcctgcccctgtcccccagcctgcctcctttgcatcatttggtcccaacctatagtgagtgagtgatatctagactcagctggggagrtcaggtgggcccccacatagtcatggccctgggagtccctcagagatccttgacaggagagagaagctcaccatcagcccttatgctgtccatcggtgtg

SEQ ID NO: 32272 - DNA, 201 bp, Bos taurus
tcctttctggaaaaatcagtggacagaggacacccccctaagtcacaaccttcatggaagccagccaagaaaaccaaagagaccagagaaatgggcggccrttacagcagctgagaggtgaacgagcccaagcccccatcagacagacaggaagactgagacctagggtggggccacaactgacttgggtccaaggctctg

SEQ ID NO: 32273 - DNA, 201 bp, Bos taurus
ggggggtggggcttgtgagcctgagtctctcaaagtggcaatctccctcgcagggatgctggggggtggggggtggcagtcagaggcacagaagggccagyggctactgcaactgtcagccttgagattaacccacttggtgcccagctggtgatgtcataggacatcagtcatggtgcatcacccagcctcccttgaggg

SEQ ID NO: 32274 - DNA, 201 bp, Bos taurus
atttttttttttttttttttggccacacctgaccagggattgacctgtacccacctctgccgtggaatctcggagtcttaacccagtggaccggcagggargtccaagaggcctgcattttcattgcccactgggtcccacaaatcctgcagctggctctggcctcatggaagctttgcctggaggaagtctgctgggtct

SEQ ID NO: 32275 - DNA, 201 bp, Bos taurus
gggcggggcttactgatgccattttacaggtgtggaaactgaggcccagaggacccagaattgtctcaggtcacacagtgaggcatggacagggctgggayattaaccccaggtcccagaggccccccagccagtgctcagtgccaggctggtcagggtgatgctgcctaccccccacccctcttcttgctacctaccagc

SEQ ID NO: 32276 - DNA, 201 bp, Bos taurus
aggctcccccgtgggcctggagccccgcatgcatgccaggctgggcgggaggaaagctgcgatgcctacccccacggggcttccggggcaagccaccaggyacctccttacaggaagagggccagggctggcagctcactgggaggcgtggccagatccacttcattagaaacaacagccgcaatgcctgggccccggtac

SEQ ID NO: 32277 - DNA, 201 bp, Bos taurus
aggcggcgggagggtttccaccactgcagctacgccccgtgggccggtggcaggagtttggggttgattctaggtgagctgggctcttcgggagggtttgyggaagggagtgacctttaaaaaggcctggactgcaaaggcagaatggaggccgcaaggccagtgagggccgaggctctggaatgttccagaagtgatgtc

SEQ ID NO: 32278 - DNA, 201 bp, Bos taurus
aggagctgcagttcctgccttggcagctggctctggggtcctggctactaattaccagccacctgcttctcaaggaggccctttaggaaaggcggtgataygtagtttgtgtgtgtgtgcatgtatagtcgctcagccctgtccgaccccgtggactgtggcccgtcaggttcctctgtccctgggattctccaggcaaga

SEQ ID NO: 32279 - DNA, 201 bp, Bos taurus
tctagaaggtaggtagcattatcatcccagtttcaagctgaggagaccgaagcttgaggaggtttaacaacctgcccaggttgctctgccagagactctcyggcccgctctgtaccccgggtcctcttcatgacgcagtcctcaagtgaagccaaagatatttctggactttagatatttctttaccacaagaaatattca

SEQ ID NO: 32280 - DNA, 201 bp, Bos taurus
catgtgacactttttggaagaggagccatccagaaataaagcgttagtatagacgttgttagggtggttttctttttctttttttctttttttttttttgygttaagaacaaaggtcaagaacataaccttattcctgtctttctcttaattttgtagcatcaactttagaaatcaggttcacaaggaaaacgttatcacg

SEQ ID NO: 32281 - DNA, 201 bp, Bos taurus
tgtctccccttcgtgtatccacgtccctcgcttttgaccttgaagtccctgtctctgaataacatccatttccccactccttgaagccacactcagccacrtgacttgttttggccaaagagctacaaatcagcacgatacaaccgaggtctgagaagcacctgtggtctggggccttgagatcctggagagggcatcact

SEQ ID NO: 32282 - DNA, 201 bp, Bos taurus
ctccatgggcctgcatttgagaacatctggagacacgggcgggggtgatggggtggactggagtgggggacaggagcagacaccctcagacccatcccccrtctcaggcccctgggggattctttctccctgatacctcggagaggtgacttgaatcagttgaccctcttgctttcggtctgaaaaaatgatcaagtcatc

SEQ ID NO: 32283 - DNA, 201 bp, Bos taurus
acaccaggcccaaaggggtgacaagcccatcacctggtgaatgaatctgtaaagtgtgtctctctgagcaacggactgtgactcagccgtaagaaggagcraggccccggcatgtgccacaatgtgggtgaaccttgaaaacatcatgctaagggagagaagaaggaaatggcagcccacccccgtgttcttgcatggaga

SEQ ID NO: 32284 - DNA, 201 bp, Bos taurus
tgctccacttggacaagtccccggggcaggtccggggatgactcagcatccagggtgaaggaagcagcgctgatccctaagcaagagccaggcagaggttytccagcttggcctccaccaactgtggccctgggttctggcagcactgtctggaggagatgagactcaagccataggtcggggtcttcctcagcttgccct

SEQ ID NO: 32285 - DNA, 201 bp, Bos taurus
ccctcggagccggccgtgaggttcgcctgcatcaccgcctggaactctgtctcgttgcagcagtatttgaaaactgtgttgttatggtgacagcagaggaygaaggttttgttgtccgagagccgggggcagtggaagccgaagtggtagcggcctttgtggtctgtgtacggctcacagacccggaaatgcgcagacaag

SEQ ID NO: 32286 - DNA, 201 bp, Bos taurus
atctgatctggccgtcccagggggcctcctccctgagtgccctcgtgcccctgaacctgttcaccgagctgctgattgagtactacgagaaggtcttcagyggccgcggggagcgcggggcagaggccagcgagcagggcgctcccggtgccagaggctccgtccccaacgaaggcgccgctgcaggagacagacccgcct

SEQ ID NO: 32287 - DNA, 201 bp, Bos taurus
gggaggcctggcatgctgcgattcatggggttgcaaagagtaggacacgactgagtgactgaactgaactgaactggactcaccagaaaacattcaacaayaggaagcctacaggcccaaacacactgtgctcctaacggtaaggaatcgtgaaaggaagtgttgtcgatcctcagcctggcagaggggctgctgtcagac

SEQ ID NO: 32288 - DNA, 201 bp, Bos taurus
tgtgaggaaagcttcattccagggcagcctgcccgccacaaaaaagaggatgcaaattgatccccgccctcatcccggcctccagggtgtggcctgctgarggggtctggaagccttgtgacctcaggtgggttgggggtgggggatatatcggctctttgggacccaatttccccaacggtgaatgaaggcggggccgta

SEQ ID NO: 32289 - DNA, 201 bp, Bos taurus
ttctatgcctcagtgtcttcttctggaaaagggagatcctgatccatattgtctgccctgtggagttgcaagggataagagaaatagtccctctactatayggcctgttgagcactcaggcggttgtcgttcagtcgctcagttgtgtccgactctttgcgaccccatggactgcagcacgccaggcttccctgtccttca

SEQ ID NO: 32290 - DNA, 201 bp, Bos taurus
catggagttcaaggggccattgagaggtgtcgagtctgcagactggcagtcacagtgtgggggaacctcgtgggaacgagggtgtggagaaagagggccargtcctcactgcggtggatgggactccaagatgagactccggacggggatggtattggcaacgacagggtgagagcaggggttcccaaagcaggccgtctg

SEQ ID NO: 32291 - DNA, 201 bp, Bos taurus
tgtaaatggaccactgccctttccaaatggctgatgccctggttgctcccaaccagcggtcagttcctaggtcatcaccttcttggccacccacagaatgytccagcttgtcagcgaactcatgataaacgcctgcggttttcctctgggaggacagtggtggggggtggccccccacagaggaggctgtcccagggtgtc

SEQ ID NO: 32292 - DNA, 201 bp, Bos taurus
cttatggttgggctttaattagggagtcagtttaatcacaaaataatgcagtctgttacaatgacacttggcaccgaggccttgggtgggggaagggagarcagagagccccaaaaagacccgtaatcctccctggggggcgtaggggggatcttcctggaggaggggggcggatagttggtttgcagtgggccaggatgg

SEQ ID NO: 32293 - DNA, 201 bp, Bos taurus
aaggcccttggccccgttctcagaacgaggcatcccaacagggaggtgctggggtaggttctccgtggtcccagggaggcccccacctgccagccttcaartggcttcaagtcaggttgggtgggctcgagtccactcagtgtctctccagggccagagcaggtggtcctgaccccagcgccctggacgctccgtgggtca

SEQ ID NO: 32294 - DNA, 201 bp, Bos taurus
tgagtccaactgggccacgccctgctgtggctgagggcaccaccattgccgctcaccagagctgggctttggtccagtcaacaccactgagctccagaccygtagtggcaggtgctggggaccacacagtctcagtcgtggccctcagggagcctctctgcttgtgggcaaggtgaggggtgcccgagagactggggctgg

SEQ ID NO: 32295 - DNA, 201 bp, Bos taurus
agtccagctgcgcgcgggcgccgtggggcccattcctcacccatcactgggtgtaagaggcaggatccatcaatccgttgggtgtcatgggcagggggccytccgtacattctaagtgagatacttctgactcacagatctcctacccgctcctgcccccacattgtcacagctcccagggtcccctccagggggtgatga

SEQ ID NO: 32296 - DNA, 201 bp, Bos taurus
gtgcccatggcccccagcgtttaacagggagcagaaacgccagaggaactcagagctcctctgggtgtgctgctgcctccctccagcggcttcagcgtggygctcaaggtgcctttcctctgggcccgagccaagttcacccagtactttggccaaaccgtggggaaccggccgcaggcagccctggcttcagagagccag

SEQ ID NO: 32297 - DNA, 201 bp, Bos taurus
ccggtgccctggcctctggcttccacctgcttgagccacattgcaccccagagtcggaggctctctgacacccagtcttgatccccccacagctttctgcrgggcccccgtggcctccacaaagctgagctctgttccccgtttgcgggcaggccctccactcaggcctgggagtctccccggtccagaagctgcctggga

SEQ ID NO: 32298 - DNA, 201 bp, Bos taurus
agccccccaccgtagcccctccacacgggcctgagctgctccccgcccgggcccagggtgggtggggctctgcgcctggacaagcccgcgccttggccccragagacacaaagcccccgagacagacgccctaatcccgagcacttcccatggtgcgcggaggcagaccacaggggcggcctccaggtctgcgtgcaaact

SEQ ID NO: 32299 - DNA, 201 bp, Bos taurus
ccaaagctctgcccagccgggtgtggcccgtgctgcccagagctgggggcgtctgccgcctcccccctgcacccggggtgccccagctctccccgcggccygcctccatcccaacggtaagatgggcagaaccttctggaatgggctccctcctgccccaggctccctgcgtgctccggctccctttctcctccaagaggc

SEQ ID NO: 32300 - DNA, 201 bp, Bos taurus
tgagtcagtttcgttccagcagcaggagacccggccccctcgttcgccatcctttgacgtaacccctcagttccagcatatctgcagagccgggtcagccktgtcccgggccctggggagtggcttcaagggctggagtgctgtgtgcatgcagctcccgctcgtcccggtccttgctgttcggcacggaacacttgccgc

SEQ ID NO: 32301 - DNA, 201 bp, Bos taurus
tttgtgactggcttctctcacctttcataatgttttcaagattcatcacgcggtagtccgtgtcagtacgccattctattttataagcaaataatattccrcggtatgaatagcccacattttgtttattcatcagctgatggacatttgggatgtttccactctttcactggcaatgagttgtggtgccgtgagcattca

SEQ ID NO: 32302 - DNA, 201 bp, Bos taurus
ggagctgtgggcgtcatttcatcagggatctgagctctggccacaaggtggcgtcgtggtcctgctcgaggcagagggccggcgccagggcgtctgggctyttctctggaaggcagtgtgatcagagctgggtcacgtgccccccagctggggcgtggagaagtagggaccctgcgggctcggcctgcggcactttgcagt

SEQ ID NO: 32303 - DNA, 201 bp, Bos taurus
tgttctgagatgatccgcccttgggaacaagtcctctgcaggaagcagctcctctcgtctccctgggtcccccagacggcccccgcgtgtcagcaggggtygacgctgtccccattcgtcagagatgtgtctgcagcctgccacgtgcactgagcatttgcggaggcgtgcagtaaccccaggccaggcgcccgtgcgctg

SEQ ID NO: 32304 - DNA, 201 bp, Bos taurus
cagacccaggcacaggcacacacatgtctgtgtgtgcctgtgtgtgtgtgtcatggacgcatgtgtaagcacacacgtgtgcagctgtagggcctgcagaygcctgacctctccgtgccgtatgaggcatgtccagatggggtttcggctcttggtcctgctgtgggagctcggtggacgccagcccactgctgggtgccc

SEQ ID NO: 32305 - DNA, 201 bp, Bos taurus
tagcaggttaagctgggtaacctgtccgtaactgttcttccagccagacccgaaagaatctctgtgacagcctcagaagaagagttgctgggcctttcagrcagaaagtgtcggaactgggagggtttggctctcaccagcagcccctgggagaggcgaccccggcccccttcgctcactgtcctcctgaaggacgactct

SEQ ID NO: 32306 - DNA, 201 bp, Bos taurus
gccaggatctgatagaaagattacagttgtaatggagagctttaattctcacttatcagtgtgccagttaccaaacagaaaaaaataatggccaaggatcygaacggtataatttttaccgttgagttaatctttacttaccaggaacccagagaagggagaatagctggactctgtttagaggaagtcacacggccgtgt

SEQ ID NO: 32307 - DNA, 201 bp, Bos taurus
ggcccgtggctggtggtggggggagccgtggcccttcccagctacatggagtaattgttcctatctgcccatcctgccttcccagcctggtctccctgatrtctgcctgtggccgaggggccagccagctctgcagccctctgcctccctctccctcactttccatggctgctttctcttccagttttgtccaccatgtcc

SEQ ID NO: 32308 - DNA, 201 bp, Bos taurus
agaggaaggcccccctgcggtgtccctgcgccccctctgtgggcccccagggccgcccccaggactgcacagctgagcctgcggccctgaggagcggccarttcatctggaaggcatgaggctcggctgtctcatggacggatgaccctgagcttctaaggagactgagaggcgatggtcacactgggcatgtgagctgag

SEQ ID NO: 32309 - DNA, 201 bp, Bos taurus
agaagagctggtagtattaggaacatgagaccctcggggcctccagaattgtggagtgtggtctcgctttctctagagatgggcaggccaagaggctctcygagaggacacagaggctctgtgtgtgtgttggtgccacagccaggcttccttcccactccggtgggccctccttgccttgccgtctgagtcctgtgtttg

SEQ ID NO: 32310 - DNA, 201 bp, Bos taurus
atcgtggtcagatcgggagaagcacgcgtgtccctgctcactttctccctggtctccacgtgcacctctttctgcagttgtgtccctgcccccctggcctyttgcagcccccgacctgatggtacaagtccagctcctggaagacacagattgttcttgggctcaattccacgttccccgggaagggtccggggggcccgc

SEQ ID NO: 32311 - DNA, 201 bp, Bos taurus
gctcagaaggggatgggccatctgtgcggatgggcgggggcatggccaattttgctcatcctcagagactaagaagacttcctttgaggattctgtttcaygacgatctggttgacctggggcagtttacctaacctctctgttcccgggttgcttcatctacagatctgacaatagtaactaccctggcgaaacacagag

SEQ ID NO: 32312 - DNA, 201 bp, Bos taurus
cgccatgaaaatgggctgcttaaaatctcctgctgagaggaccctcattcactcatggacctggatggtgccccgtggaggccccaccatctgtgactccrtatctttttgcatgatccctccatccgatggttgagcaccgcaggggtgctgatctgggcccacgcatgcgagaaggggactcatctgatgggcaacttc

SEQ ID NO: 32313 - DNA, 201 bp, Bos taurus
ctggtttgagattgcaaagccccaagggcctgggtgggaaagtcaagggttctcacaggaaaaagcccactgctgtcagaggtcactcagagctttacctyctctggcctcctgcgccacatgtcctgcagataatcttgcgagtgtccccaaggggctttctgccgcccctaagtgccctaaaatcttcctcgtctttct

SEQ ID NO: 32314 - DNA, 201 bp, Bos taurus
atccaagaaaccagctctctgggccaaggaagcagagacaggcctcctgaaccacccctgagccgggggaggagaagggagtccccgggagagagggtgargcgacgcgcaaggccatgcgaggggcagagcacgaggccagggtcggggtgcagggcaggggtgcccgagtccctgtgctccatccgggcaggtggcctc

SEQ ID NO: 32315 - DNA, 201 bp, Bos taurus
tcttggcacagcccccagttctgaccagttacctgccctgccctccccaagcacagagcctgcacatccagctggtcatctcttgactggcccacggcackcgaggctggttcagtacccagggtctgtagagcttcccttttcaactgacgaggagctttcaaaactgcaggcatcccttgccttcttcttctgcccaag

SEQ ID NO: 32316 - DNA, 201 bp, Bos taurus
cggccccattgttcttccccttgacaaataagagagatgtcatggagcctggcgctttgttagaacacagggaaggaaattaggtcctctccatctgtcayggcgatgatggagggcctgccccagcctcctgtgcgatgccctggaatgagcggtgctctgccatgagcccgccttaaccgcgttcccctgcaagcctgc

SEQ ID NO: 32317 - DNA, 201 bp, Bos taurus
tggcccacatgctcctgccaaaccggaaaccagctcttgagtaacactgggtgctgagtgtggagctgagtgactgagcagaaatcggcatccggcctccrgtgacctcggatcctggtgtagccccgccctaggcaggctgcctggtattcttcgaggtctccctcgggcccccttactgattcaggatgccaatgagga

SEQ ID NO: 32318 - DNA, 201 bp, Bos taurus
gtataactgatggctgttgctggccattcattcttctaacaaaaatcatgtttcccagtgctgttcttgcagaagagaaagtggccagtccagaccccacygtcccggacacatgtccagggatgggggacagatgacaaatgggtggacacggaggataaaacagaatcataagacagaagtaaagcagagatcactgag

SEQ ID NO: 32319 - DNA, 201 bp, Bos taurus
ccttctgtgtccccagaaaaggaagagccaggtccaccacagtccagccctttagctgcctgctacccggacccacgtgtcttctccgtgaaagagggccrcctttccataacagagtccctcccggatgtctcctggagacattccctgcagctcccctacatcccactcggttcaggcgctctgggacctcctggccag

SEQ ID NO: 32320 - DNA, 201 bp, Bos taurus
cggtgggcaccgtgcccacctggggcgctccatgtcggtgttcctgaactcacgtcttcatatttactcttgccgcgccaattgaattagaaaaggccatygtgcactttagaagcaagagtcctcgtaaatactttattggaacaagctcaggatttacttgctcataaagataccctggacggctctgctccgtgatga

SEQ ID NO: 32321 - DNA, 201 bp, Bos taurus
ccccgccgagacgcctgaacttctgcgtcacgggcgcgggccggcctaggttgagacgggcggtatgcactgtgcaacttgtcttgaccgtatattcggckgaagcagctgtgcgcgaggccgggagaagaaagacgggctaatcccgccttgcgcgctcctgctgagggaaacagtccagaggagccccagggtggcgcc

SEQ ID NO: 32322 - DNA, 201 bp, Bos taurus
tctcactctgtgccaaactcccaggcagaggagcacgtgggctttggctgaaactaggcttcttctgggctgtgccctgaaccccagatgctgagtgctgrgccctgggactcccgctggcgcaatcgtgtagctcctgcctccgtgtgctctgggcctactgtctcctctgcggccaccgagtgtcccgaggcctgggac

SEQ ID NO: 32323 - DNA, 201 bp, Bos taurus
aacaggcagccactgctctctcctccagccccgtgggtctgcctcccggatgtcatgaagagagtcaccacaccgggggcctgtcgaagctagttcccttyacccacacggtccctcggagatcccacctcctggtgtgtgcgtctgtgttctgttcgttcatgccgagtcctctcccacagggcaattccatggcccgga

SEQ ID NO: 32324 - DNA, 201 bp, Bos taurus
actggggcccaccagccccatcaggccctcttgcactccctgtggtctctgcattcctcctgctcagtttttccctcacgtccgggccactggactctggmgtctccaggggtcattccaggctccaggctcacaggtctcccagggatggaaggcaagacgcgggcgcctgcagtcagtgacagacaaggggaagttctg

SEQ ID NO: 32325 - DNA, 201 bp, Bos taurus
gctggtggaggccagggggctgcaggaagttggccccctcccctcccagcggcactgagaccgaggcaaacctcagccacggtgacactactcctggtggygccggggccagagggccacgtgtgccccacggacacagccaggtgcctctctggagcgactctcgagaatgggtgcaccccgagcagtcccggaggatgc

SEQ ID NO: 32326 - DNA, 201 bp, Bos taurus
ggccaggctgctgacggacagtggacaacgtccaggcacgaggaggcctggatgtggatacacctggaagtaaccagaaccagggtttgaaagagctcgtygacgcctgggctgggggccgagaggccagcccctcctctggggagagccacagcgcagggcccgcgtggaacccactctgggtctccgtgacagacacac

SEQ ID NO: 32327 - DNA, 201 bp, Bos taurus
gtgggttgccattgccttctccgaatgcaacctcatagcagaatattatttttataaattattcagagctatcatttaaaaaaatccaaaaatcccccccmaaaaaaggcccccaaaatccagatcttaaatatcttttaaggctatccattatagggaaaaagttagtgagaccagttctttatgtctgacatgttctaa

SEQ ID NO: 32328 - DNA, 201 bp, Bos taurus
tgaattctgcttttattggactcagatttgcaaacaagcactatgttaagttttgactttaaattttaaaatatatcttatggtctagaacaaaagcaacrttcttaagtaactctgaaaattcaaatgtaaatgatctatgcaacttcagttggggatcaaaatcgtcaaacttcctccagggagaagagttgaattgac

SEQ ID NO: 32329 - DNA, 201 bp, Bos taurus
acccctatactcacttccatccaggaaaataattggtcctccttacattgcacagaccttattctcctgaaaattagatccacaaggtatcattaaatgtygtgggaaacaaaaatagaagaattctatagcttgagaaaatgtgagttaagaatacttaaagaaatatattgtcgtcaaacttctcagaaattttagaca

SEQ ID NO: 32330 - DNA, 201 bp, Bos taurus
gagggagtcagaataatggatggagggaaggacaagtgcaaaatctgttggaaataagatcagagcaatagtaacagaggtgtgggtggaatgggcatggmttaagagcagtttaggagacttatgggaaacaatgacaagacattgcctccaagtgattgatggaaggaataaggctttaagggaggcagtttacatgaa

SEQ ID NO: 32331 - DNA, 201 bp, Bos taurus
ccaaggccattagagactcaaaggaggacactgaccaaattgctatagactcaacataataagtgcttgatgattctcctggcttcaccaacagaacactytgcttgtgagattaaggccatagagatgatcatactccaagttgccattcctcttccaaaccaagtctccatgtccacccgtgaaaggatgccttggagg

SEQ ID NO: 32332 - DNA, 201 bp, Bos taurus
cttcgctttcactttcacttttattgccctagggaaatcactgtactactgctttgttgtcctagggaaatcatttattcatttaccttaacatttttttycccatgtgacaggcattattctagaattatcaattaatttggcaataagtttttatagaaaaaacaagatagggtttccctgatgctcagtggtaaagaa

SEQ ID NO: 32333 - DNA, 201 bp, Bos taurus
ttattactgaaaaatgaataaggagttggagagctgtgagcttgaccaaagtacactgagctgtggtgggcagtgagacaaaggggcctgagtcaggcctycaaaggctcagggtggtacctaactgccagccaacaggaaacccgacttgaggacttccactccaagaaacgtcattcagccaacagcccgagggaactt

SEQ ID NO: 32334 - DNA, 201 bp, Bos taurus
tacaaaggactttcttaaagatggagcatatttagtactttttcttctcaaattttaaaaatgagcatttgaacaattgtcagaagtagactttaattttyactgtgtttctttccttaattgaagtgaagggggagcaagggaaaggcaatgtcttcttagacaatacaggcaattatttgaagtttattgtttagttgt

SEQ ID NO: 32335 - DNA, 201 bp, Bos taurus
atcagaattcccaggccacagcactccacagaagttaactcctggggctgggagccattcttcacgcccacaagatctgatgacctcaaggaaaagtattygggccggtccttcctatttaagattcactgcttgtgcttactagagtagacattacagctgtggtctaaactctatgtgtttcagttggttcatttactt

SEQ ID NO: 32336 - DNA, 201 bp, Bos taurus
tgcaactgaaagctaagaatgagactcatttatatgaaggcacttaatatattatagaggtaccattacaaatccaggaagcaaagatagtctattcaatwgctggtgctgggatattggtacagtaaaattaaattcctctctcatagtatacgtaaattaatttcagatgaactaaaagcctaaatgtgaaaaagtaac

SEQ ID NO: 32337 - DNA, 201 bp, Bos taurus
ctcttgttttctgttgatctccatttacatgaactatctttttccagctcctcattttcagcctgtacatgtccccaggtttgaggtggggtctcttgtaratagcatatataggggttttgtatttttatccattcagccagttagcttggtaaggaacggactcaaatgcatcctgactatgatttcgattcctctttg

SEQ ID NO: 32338 - DNA, 201 bp, Bos taurus
ttattgtatggaattttaaaagtcctaatttctttctttcttttttttttttgtaacatgtagctatccaatttttcagcacaatttattgaagatactgycttcccccactgtgtaatattacctcattagttgcagattaattgaccatgctgctgctgcgtcgctttagtcatgtccgactctgtgcaaccccactga

SEQ ID NO: 32339 - DNA, 201 bp, Bos taurus
aggaaactggaacccaccaaaaaatataccccatatccaaagacaaagaaaaagccacaagatggttggcagggtaccatcataagaaaataaaatcccayacccaccaagtgggcaacccacaaactagagaacaataatacctaagaagttctctcactgttgtgaaggttatagaccacacatcaggcttcataactt

SEQ ID NO: 32340 - DNA, 201 bp, Bos taurus
tacaatgcccaaaatcctacaacatccagtccttacttgcttttctgacataatctcccaacttttaacctcacacactctgtttcagccacttgtacaargaaatgcttttgccaacacatctacatcctttttcttctctatcattcaaatctttctcaaaaaccatattctttataaagaacttcccacaccaaacta

SEQ ID NO: 32341 - DNA, 201 bp, Bos taurus
agattggtttattggcgtaaatccacaggtgtgataggccagttttccaatcttgaactaagtaggtttttcccccaagttatagactcagttggacaatygccagcttcatgcatggggtagactccttgctgcagtagatgatagcacccagactgtacacatcctgaagagatctccttagaaagagatcctaaagga

SEQ ID NO: 32342 - DNA, 201 bp, Bos taurus
aagctatggaatttcagtgtatagcttgaagtctgttagcctaatcttgtctaaactaagaaaggatagcagttcatcaagagaatcatcttttttccccrtatgtaataaggatgcttacacgattcaattatataatgacatgtattctcagcagcaactttgtgaaatatatgaaaagtcttccacatatcgttgctt

SEQ ID NO: 32343 - DNA, 201 bp, Bos taurus
taagaaactcattgtacagtcaacaggatttaactgaagaaaaaatagtggcagtatattgtatgtctgtggcatgtgtaaagtaaaatgcatgacaaaayagctcaaagaatgggcagggatgattgggaattgttgtacggcaacaattatactactttagcttcccaagtagaatccagaaggtggaggatcttaatg

SEQ ID NO: 32344 - DNA, 201 bp, Bos taurus
ttcctctagtctagggtcttggagtcagttctcccattccaaaggctcagggcttgatctatgctttttaagcaaggtacaattttcaagtttgaaaataygtcttttatgattcagtggtctcttaaaaagttcctaaaatccagctggaggaagtcacataaaggacataatgactgactgaatggagagctggatggg

SEQ ID NO: 32345 - DNA, 201 bp, Bos taurus
atatgtgtacatacctatgtttttttcatcctaagccctgcacactgtctcatttgtttgttctactttggacagccactgatttaaatggaacacttttycaaaattatccccaaatgtcaccaactgcagaagaaagtaatttgcactctgaagattgaagcaatagttttaagatgacagtcactaaatttttctaaa

SEQ ID NO: 32346 - DNA, 201 bp, Bos taurus
ttgttttaagacctatccatattattttagccacttaaatattaaaaatgcaatgcagtgtaggcattaaatgataagataaaacattaaatgacaatagkgataaaatatttaaaataagtgatactaatgataaaagataaaacatttcctctatcaaaaaatttgtagttcttagaatcaaacacgaggattccaaaa

SEQ ID NO: 32347 - DNA, 201 bp, Bos taurus
aagttctagaatcactcttcacaaggtattcttaatgtattactggataagagaagccatttgtaaatggttatgcataatcattctttagcacatccatraattatctgtcaggctcttctagtgaagtagacctaaacctgtcaaggcagcaggaggcaactgtttcagcgtcttttgaaacaataattaattttcaaa

SEQ ID NO: 32348 - DNA, 201 bp, Bos taurus
gaaagcttcctatgttcattcagggcaggacgagaaggagagttaatctctggatataaataatattataatggtttgtttctctgaaaattgtatggatygttcaaaaaaacgctcatttacttattcactcaggcatttattgattacagtgcatcaggcttttattgcaggcatttgacatctgagagcttactgtct

SEQ ID NO: 32349 - DNA, 201 bp, Bos taurus
acagtggaagatgattggctcacatgaggcctggtttatttaggggcacactgaacactagaatgaaaaataaagataagcattactgtattaatggtaaragaggacacggcgttttaaaaccacatgtacattctcaaaattaacttgaataggctttgactttcttgaaatgacaaaatatagagctctctaacagga

SEQ ID NO: 32350 - DNA, 201 bp, Bos taurus
tgttactacagcttcagttttttaaagtctttatctcttaaattatttaaaaaatggatacgtattttaatgggaaagataatagcatttggtaaaaatgratgatctcatatttgcttgtcaacccatctcttatctcactcatcatgggaaccagtattaagagccccatgtacatcctcttgttcctttggcccttct

SEQ ID NO: 32351 - DNA, 201 bp, Bos taurus
taaaactgtttatggggttttcatggcaagaagctggaatgggttgccattttatcctccagtggaccacactttgtcagaactctccactgtgaccggtmcatcctgagtggccctgcttggcatgcctcatagcttcattgaattgtgcaaacccttcaccaagacaaggcagcgacccatgaaaggggtttggatgtt

SEQ ID NO: 32352 - DNA, 201 bp, Bos taurus
tctcttcctgagccccatctgggcccacaatgttgcctctacaatcttgtggtgagacaaccaggagacagatgatccttggaagggaaatactgtataayttccaattcctctagatatccaggccttcatcttccatgtttcctacaacatgtgcaacaacatcatctcttagtgaacatgctagggtgggtgacaggc

SEQ ID NO: 32353 - DNA, 201 bp, Bos taurus
tgtgcccctttctgctgaattttagtatttgatactcaggggacctgtacggactgttgttgcagcagccagagccatccaagagctcatgaatataaacrtcctatttcatttgtcactattttaacacagcaggcattttgaaaatgcccataggcttgtgtggtgggtgaaaggaaagatgaaagtgtcaagaagcta

SEQ ID NO: 32354 - DNA, 201 bp, Bos taurus
taaaatctatgatgtgttcattttatatttatattttaccttttaaactgtattcttcaatataatttaataataatttgatcattgtgcattatatatayacttatttgtagaagccaggattcaaagatttctgtgtattccaattttgatttaagataaatttttagtcattttaataattagagttcttcatcaaca

SEQ ID NO: 32355 - DNA, 201 bp, Bos taurus
ttgcagtttacaagagtgaattcctgatcaattggccaaaaaggaatatctgactgcattagtttagagactgccataacaaaataccacagactgggtgscttaaacagatgtttatttttttccacagttctggaagctgaatatgcaatactttgggccacctgatgtgaagagctgactcatttgaaaagaccctga

SEQ ID NO: 32356 - DNA, 201 bp, Bos taurus
ccataatcacaatctatcatctggtgcatgtagacattaatatcaacacagggtatgggaaacaattgtctataattttctattggtcttataggatataratattattaacatattttacaggtgcaaaatgaaagaaaaaaactaaaaaagactaacaggaaggaatcactgacttattaacagatgattacttctgtc

SEQ ID NO: 32357 - DNA, 201 bp, Bos taurus
tatcatccatagggtcacaaattgttgaacacaacagtgtgactgagcacacattccctgagacactggacactcaagtgaattctgaggctacatagtgrggaaagcagtcagggcctcctttttaactacttttattcatgagagtctgaatagcttatgaataggattgtttttcttgtacttattcttggttattca

SEQ ID NO: 32358 - DNA, 201 bp, Bos taurus
aagaatcttgcactgttataaagtggaggtccactatcactggagaacaggacacttgctccaatccaggagctcctccccaaaatagtccagggacccgraacagcattcagggccacgggggaagggtcaggagtgctaagccctgttctccttatgagagcccgtgtggcctgagcccacagctggagcaagagaact

SEQ ID NO: 32359 - DNA, 201 bp, Bos taurus
atgaataataaacatatctgtcttcctgaatttctcatgggtgtatgtctagaaaacttacttgatttacgtattgaacaagaatatatttttttcaggcyaatcagttgacagtgttatcagttgacaactgaattgtcaaaagttattaaaagttgacttttggttgaaaagcatgaaataacaacactgcagaatgaa

SEQ ID NO: 32360 - DNA, 201 bp, Bos taurus
ggaaacatgaattttttttttatttaaaaagtttggtacactttattaccttggagaaaaaagctccatatgttaaaggcaagttatttcaactccctttkcattataaatgatatttgctttagactttgcctgtcataatatattcaagagcctatgagaatctaacggaacactcttacctagctccataagccctct

SEQ ID NO: 32361 - DNA, 201 bp, Bos taurus
ttatgaactttttggctacccccaatatataatctggaattttctgataattgaaccatggaaaaggaatgtttttctggtatttcagatacactcagtaktgttggaataatgatgttaggaaatgaggagagttttaaaaaatagatatttgtaagttgcacagcgtgaaaaataagataaacaagaaattgcttagtt

SEQ ID NO: 32362 - DNA, 201 bp, Bos taurus
gactccgctggggcctgggtcggagcagcctgtggttcctagaaggtccctggggtgggggtggaggttagccgtggctcactctggggataaggacgttmgtggctgaggccccagagaatatttgtggtgagctgtcaccatgttggtgccaagacctggccccaccccacaacctgtagagtccagtgctgggacgct

SEQ ID NO: 32363 - DNA, 201 bp, Bos taurus
ttgatgttacacaagaaaaaatttatatcccaaaacttaataagagattttaaacaaaatgatttatctataaaataaaaattctcaagctatattccaartacatttggtagaacatcaaaatcatggatattttgaacagcatgcctagtgtccacaaagggatgtgtgtacagaatgttgctgacactaataaaagaa

SEQ ID NO: 32364 - DNA, 201 bp, Bos taurus
tcctacattcaggaaacttgatcaactttagctttattattttcattataaatacgatggcagtgctttatccatatggctatatctcttgggacattgaygtgttcttttgcagataaaacatgagacattaattaaatgccatctttctccaaagcataagtaaactgcacatgataactcgattatctcagttaagca

SEQ ID NO: 32365 - DNA, 201 bp, Bos taurus
gagcccagcttttccaggaagcctgggccacggctgtctctgggagcaggcaaggacaggaggcaggctactgggccctggggcgcagctgagcaggcagrgcaggtccgcagtcactccctcactcatggagggtgactttttgagagacaggaagtaaggagcgtgggtgggcagggccttcgacagaattttgaggag

SEQ ID NO: 32366 - DNA, 201 bp, Bos taurus
gtcctggatattctgtttccatcccaggagggcctgcatcgcccagttttagccagcatcctgataggtcagtttagcaggaatccctcattctagaatcrgaagactcaggccaaacttctcagccttttaattagtcagtccctcagtcatgtccagctctttgcgatcccaaggcctgtagcctctgtactccggctc

SEQ ID NO: 32367 - DNA, 201 bp, Bos taurus
ggaaagtttggcactctgttagatgaaaaattgaagggtaagacaccttttaaaaggtataattttatttggtaattgtaaatgtttcttggagacagacrtcttctatcaacaacttacaggcatagtgattcactacggcctcacttaagtgagacagtgctgagactttcatgagttatgccatcacagcttggtggt

SEQ ID NO: 32368 - DNA, 201 bp, Bos taurus
cggcctgaagatgcacattcgtactcacaccagggtaagaatattctatctcatttcttataagatccacacttactttaaagatatttaactttacctgrgaaagcaaaggtggtagatctgaaactttatgtttgtggtgaatatttaaggatatctttttttttttttaaagacataacaatgaaagacacaaaaatc

SEQ ID NO: 32369 - DNA, 201 bp, Bos taurus
aggtagagatccaccttgtgggactgaaaggaggcgcttctttctttatcattcctgtgaatatttacgagggctctggcacaacatgactggtgctgctragaccatgcctctcacagaatgctcatctttcccaactagaaacaaatgcaggaatacccctggtatgcacagggcttcattcatgactaatggagacag

SEQ ID NO: 32370 - DNA, 201 bp, Bos taurus
actgttcaccatgtaacaagagaaggctttgaaagaggccaaaagctcgaaataccaaaaagtatttggccctcatatattctatacgacataacgtttgyaatcctatagctgggcccattctgatcctaggataagctagatatctttggaactgatttattactccaaataaggagaaatgttttatttccaacacat

SEQ ID NO: 32371 - DNA, 201 bp, Bos taurus
actttacagtagaaggttgatcttcactattaattagttcaaggagagaaatcacatatcacccccaaaagttgacctgaccaggtcagggaacagttctyctgggaatcatacagcatttttaagtctcttcataatggcatcagtggtgtcttggtttgcttctttcagctcctgtttttctatgccctcgaaactagt

SEQ ID NO: 32372 - DNA, 201 bp, Bos taurus
gatgttagcatcataaagtgccctgacaaagaatccttcctactgaaagatatgacaaatcttcttgtccctgttggcttccagaccttttctctcctgtracgctcatggatctctaaacagagtctcttactttaccaatctgcgtgtgctatgcttgttttcctttactgtctgtctttgacaagtcactcctcccac

SEQ ID NO: 32373 - DNA, 201 bp, Bos taurus
cttctctgccttgttttcatgtctgagaactgggaacccagatatctacttaatgagagggttgtaaggataaaatgagttcatgtatggaaagggcctgycacatagttcctgctcaataaacattcacctccttccctccactctgctaggagacctttctgtgactctgagaattgtcctctggtagctcttttctat

SEQ ID NO: 32374 - DNA, 201 bp, Bos taurus
cataatcttacaaccacaagaaaacatgtataaaaataaagtcacccaagaaataaaaatttcacatatgaatgattattagtaaatacatattctgtctwtatttggagtgttgtgtcaacaaaaacaaacagtcggtttctagtttgttagtactacagcataatgcaggaggttttaactggacagcagtactttaaa

SEQ ID NO: 32375 - DNA, 201 bp, Bos taurus
caaacaccattctacttttcatatcagatgaatgaaattgactacaactgactaaactttaaagactgttcctttaaaacaatgtttcccaactctgtgtrtatataaattaccaacttactacactggatgatctttaagaactaatgtgctatatccaaaaaatcaaggaagtttagtaacatgatgaaattgatgagc

SEQ ID NO: 32376 - DNA, 201 bp, Bos taurus
ttattcttttatttattttttctgaattaaatgaagaaagaaatgttcttctgccactgaaatccaatatttgagtttggtatttagtgcattagcttttyccttttcattcagtatgttttgtttttccctcttcattctggggtcaatttcttctgtaaatgaaaacattcccgtccatttcatcacccatctcctacc

SEQ ID NO: 32377 - DNA, 201 bp, Bos taurus
agagttgctggccaaaatccctctcagtaagggactggtctctgctgcccacggtggctcagcccagttctaaccctagcccactcatatactgaacacartagaagtggccacatgtgcctgctatctcctctcaaacctgggacaggccagcagtgtttcccttacacacctttgatacaattaatgccagttgagatc

SEQ ID NO: 32378 - DNA, 201 bp, Bos taurus
tgaaaagcctcatgtttgaagaagtaatatacatagcttgagaatagctgagttagaattccagccctggcctactttactatacaatctagcttcttttyaggatgcaacactgccttcattttttttggacagtaaaaataacatgactaaacaataaaaacttctggtcctatttagaagctatatattttcaccctc

SEQ ID NO: 32379 - DNA, 201 bp, Bos taurus
tttatctttaatatttctacagtgatctttgaaagttggggttcacctacagttcaaccagccagccaaatactaaaaacatttgaatatctttcaaaaaygactaaacatgtcactaggaggatatttactgggaattataaagctattaaatttctgatcattcttaataatattagactagtttttcttttgctattt

SEQ ID NO: 32380 - DNA, 201 bp, Bos taurus
cctttgttatactagcatatatgcctatctgttgtttctgatagattaatacaatttataggtattactttattttttgaaaatactaatttaaaatatgyaattatttgttggaagaggtctcctccctccatccaaaatcagtgactcaactagagtttgtttttgcctcctgtaacagttcagaggtagacatggggt

SEQ ID NO: 32381 - DNA, 201 bp, Bos taurus
tgctttgaacacggagcatgaagtccaaggccccagttcaggacatgcccctccgacccctcgtctcaacagtgtagcagtggggcctgcggggaggacgygaaggttgaacccagacgctacctctggttcattacccttgtgatgctggtgacgttcctaggcctctagatctcattttcttcacttgtaaaatgaaga

SEQ ID NO: 32382 - DNA, 201 bp, Bos taurus
tctggttaaataggcttagtgcttccaacacagttccagtaacctcttttatggttagctgttgcttttaagacttaaaaccctttcttcctcttttttcytcccagagaaaacttccctagttagaaatcaataggggactttggacatttcatagccaaactgttgacatgttccttctcaagtggttaacatcaactt

SEQ ID NO: 32383 - DNA, 201 bp, Bos taurus
cagggaagccatagcaagctctcttatcgtttcagtggccctcactgcagagctgagatgtgcagcaggtcattcaccctctgctctcccgcaggcagaargtggtggggccatgctcactgcatagcacaagtctctccagaaatcttcctcacaaattctccttcattgccggaaacttgatcattttatcatggtggt

SEQ ID NO: 32384 - DNA, 201 bp, Bos taurus
gtctcagaacagaggaagaagcccccaaagagacatgatcagcactgtatccacccttgggcttctaattcctcccccttctcccagatgagctcacacaycccctggctttcattaccaatgatgctcccccaaattgcaagtgtttatttggaattcaaacctctttcctctgagctccagcatttcaaattgaactac

SEQ ID NO: 32385 - DNA, 201 bp, Bos taurus
tttgtgcagtcagaggagtggaaactggcaatgtaatattgctttgggtcaggttgtcctgtgtgtatggctttgtgaaaatatctgcactgtcaccatayagtcataggtcaacttgtagcctattattcattttttttccaattccacagagctggtattacatgcaattaattcaggctagattactgtacttttaaa

SEQ ID NO: 32386 - DNA, 201 bp, Bos taurus
acccattcccttggctgccagcctcctccatgccccatggggtcaagtgtggagcgtgctctgaatgactcacagaaagggctcctgtaccagtcaatccygctcaatctctgttgcttgcctcttgaagtatcatttccctctccttccctctcctgggccttggcttcctctgtaacaccttacctgcaaatttatttc

SEQ ID NO: 32387 - DNA, 201 bp, Bos taurus
tatagtaatcaatttcccatttgtctttactattttattttctactggttcaggacttagacaaaaagaggtggtatctgaaaagctcacccataacaagygaatcaatttcctaaaattaaaggaaggggatgagagactcaaattctcgctctcccactcaccatttggtcaaaccagtttgcccaaatgggccctacg

SEQ ID NO: 32388 - DNA, 201 bp, Bos taurus
cattacgagggctgattagttagatgtagatgaaattagagttaaaatgatcatatgatttatcatcaatattcagatacctttgagagtaaaatggggcrctattaatacttaagccaagtaacaagtataattggggtgaactgggaaaactgggacctatgatccatctagatggggagactagccttactgaatgaa

SEQ ID NO: 32389 - DNA, 201 bp, Bos taurus
aaccaccaaggaaaaggtattgttgctttgtttttctggtacaaattcagatttcccttttgaaggtatgtccttcatttctacatcttaatttgatacayacaagtagtacttaaaatgtatttgtgaacaaattccagacttcctttgtttaactgtggatgatttataagctttgaacatatatattcttagtttact

SEQ ID NO: 32390 - DNA, 201 bp, Bos taurus
taatgtgcctctttaaacaattaatttactagaggtgtttatgcaccaccaaaagtcatttctttactgttaagattttggaacatcctggaataccttayaatattagatgagatagtcaatagttggacagaggagcctagagggttacagtccatggggttgcaaagagtcagatatgacttagtgacttaacagtaa

SEQ ID NO: 32391 - DNA, 201 bp, Bos taurus
ttgagttcctggtgcccatgctctaaataacagtggcgtgcctcttgtacacacacacacacacacacacacacacacttcccagattttccagacaactrttgtaggaaacatgtctcacccttgaattttaaagatctttccaaacttctcattttttagaggaaggcaatgcagttaccattgattaagggatgcttg

SEQ ID NO: 32392 - DNA, 201 bp, Bos taurus
gggtgttatagtgccccagataatttagattgtaatagaacccaacattgagctttggtaaaattgtttctcctgagggttggcctaataaagaggaacakaatgctccagaatatttcaaaatggttccttttcgcctctgcctgccagatgcatgagatttgtctccagtatttgctacaagggcctgtaaaactcctg

SEQ ID NO: 32393 - DNA, 201 bp, Bos taurus
ctatcatcaagttttgagaaatagttgtcagtcattgttatagaccaggcaatacaaaagcagtggggagtcctacaaagaattatccagtttctttacaytgagaaactcatggaattagggagtattgatgacttttgtttatgagcatttttctgtacagtgaaagtccaggttctcttcgttctctttaaatatggc

SEQ ID NO: 32394 - DNA, 201 bp, Bos taurus
aaaaagtgatacaaaaaaattactaataagtttcttgatgtctgaaatgagcagcttcaactttaacttatttagtatggagactgaattcaccttctacygatgaattaggagcatttacaaatgcatggctagacacaggatgctaaattaaaatgactagactgcaaaaaacaaagctggcaaagccaacgctatttt

SEQ ID NO: 32395 - DNA, 201 bp, Bos taurus
ttaatgaactctgggaattggtgatggacagggaggccttctgtgctgcgatccatggagtcacaaagagtcagacatgactgagcgactgaactgaactracacttcatagggtgtggcccattgcagagggaaagtgcccaggccatagaatgtggtgtggttagttttcatgatctgggtgatttcatatgctaatga

SEQ ID NO: 32396 - DNA, 201 bp, Bos taurus
gtgcacaaatttcatggtctacaggtattgaagtcttacagagtctgttctcttattcttatggagttagttccactgttctacttagtctgtactttgaycagtaccacactgtcttgattactgtatgtttataatcttcaagcgagatagtgctacctccaaccatcttccttcacttatttattgtgatggttattc

SEQ ID NO: 32397 - DNA, 201 bp, Bos taurus
tgaaagttgtgcttaaaaccctttacctaagattgggactcaaacccacgtgtcagggactctgtgctgtgcttagtcacagtcaagagtgtgggccatcrcagaggacaagtgcagcagccatgaaatgtagtgtggtttagtttttatgggctgggtagtttcacatgctaatgagtaggaggatcattccaacaattg

SEQ ID NO: 32398 - DNA, 201 bp, Bos taurus
tgaccttggaagtggggtagctctctcggctgcttctgcgccgttgcagcctggcactcacagctgccacccttgaccctggacatggggtagcgcctctyggccacgcttctgcgagatctgtcacagccagcacactttagtcaatagttaagctgcaccaatgtttttgaaaaccaattaaatcttcacaacctactt

SEQ ID NO: 32399 - DNA, 201 bp, Bos taurus
caccagggaagcccctagttggcttactttccctaattctgagaactttgctgttctcaataaagtatgtgctgctttccaaacttatactgggctatctrttattctcagataattgagcaagctatattttatgcaaaggaggagccgtcatacaaggaaaatagtctgtgggactcccaggctgtgcatattcttctc

SEQ ID NO: 32400 - DNA, 201 bp, Bos taurus
gaagaccccactgacaaggctttctttatttgatctgacctggagctcacctattatatacagccttttccccactggaggtatttgttggcaatagtgasaggcagttgttgaacactgtagctgtctgaggtcttggtagacaaaactagctagactgaccaagaaaaagagagaagacccaaattactaaattagaaa

SEQ ID NO: 32401 - DNA, 201 bp, Bos taurus
gggaacagattagaagcccctcaggcccatagtcagccatagtcttcatagggtcgaggaacgttaggcttggaggagatctcagacagcatcctgtgcarcggttctccaaggtgttctgaggcctaaatgtctgcaagagtcccctgcagaccttgttaaaaattcaaactctttggtcttactccgtgagctgaccca

SEQ ID NO: 32402 - DNA, 201 bp, Bos taurus
caggtaatacttgagagcagcttttaagaatagtgtaggaataaagggttaaaatcacttttttatttaataagatacaatatgtagaatgcatgagaatrtctggtacaccacacacacttaatacatatcaatcctgtttccttacttgagctcctgctaaccaagttagttccagattaatccaggactctcgctgtt

SEQ ID NO: 32403 - DNA, 201 bp, Bos taurus
aaatacctggctaatatatgtattctagttaacttaaatattctcatagaggatacagatttttttgttgttgttcattttaggtatttttaaagtaaagsagacaaaattttggaaagcatctcttcatattgcagttgcatacttaatgtgcaaagaaaaatatgagttcagtgattcttgataaaaccaaagtttcct

SEQ ID NO: 32404 - DNA, 201 bp, Bos taurus
ttggaagtggcagaagtacaagcaaggccctacttaaatttatgagcactcattttcactgtccaaagcaagaagtatgaccaagtcaaaggtcaggaagrataaaactctttttcatcattaggccattaaaaggatgaagatgcattatatactgtaatgatgtgaaaaattaaggccataaatttaatattccacaat

SEQ ID NO: 32405 - DNA, 201 bp, Bos taurus
gtgtagattacagtagattgaaattttgtatcccatttttcatccctttccacatccacctttttgtcatgacctaatctggacatagtgttctttcctaygccttgattttgaccttaggcatatgtcttgcattgtccaattgcttgcagagggtagtgacagtatgcctattctgaaccttgacctcaagtggaatta

SEQ ID NO: 32406 - DNA, 201 bp, Bos taurus
atgtcagctgaaagtctcagagatgatttcattggcctccctttatccatggcacacagttactttggtaaacatattttctgaacacatcctttttgcayatgataaaatatggccttggggtatgctccagaaagaaaacttatgtgcaaaattaggaactatcgaatcagcaactgtataaacataatgagtgaagca

SEQ ID NO: 32407 - DNA, 201 bp, Bos taurus
ccaaaactactggctactgaccaatagaaacataatttctaagctttctgaaggatgactatttgtgtatcttattatcaaaatagctaaatactggactyagatggggaaactaagtttgtaccccatttacataactgcagtttcaccaaaactgtgctacatatacagctgccattcgactgaaattagaatgacatt

SEQ ID NO: 32408 - DNA, 201 bp, Bos taurus
gcctctgggaagaaaggccatgacttttctgtaatagataagacaaatttcattatagcagccaagagagaagctgagattaatcagtgtcagaaaaactrtcaaagagaggccagtgagtatatcccttgccccacgtcacaaaaatacataaaccatccaagaaattagccctggataattagagcaggagatgtggaa

SEQ ID NO: 32409 - DNA, 201 bp, Bos taurus
ctcttggcgtagtcttaatcaaagctttacccttgtagtcaggagaaaaaaatctgttaccaaaaggagaattgggatagggagaagtagacatgttagtrtgtactaactccacacttccagcagatgtaaaccagacatgaaccattcactgcaatcttcagcattatttaagacctgggtaaagacccataagggcaa

SEQ ID NO: 32410 - DNA, 201 bp, Bos taurus
tactttggttcaaggcctctgaggggtgtgtgtgacgaggaaggtttctaagccatgagtgccacgttgcttgcattttaagcagatcgtgtgcgcagtcrttatggacaacaaaatggagcataaaaccttcatgcagatgaaccactgcaatcagatcatcgtaaaagtgaaacctagatgttataagaatccaagcaa

SEQ ID NO: 32411 - DNA, 201 bp, Bos taurus
aaggataaaatagtacttgacgaatggttatagatcttaaggcagaaatgaaagaggacatgaaaaggccgtactttaaagatggaaagctttaaaatcayttgaggtagaagtaactcatttttattgtctcagaggagtagtggtaaaagaggaggtcaaattgctggttaataagcatatggtggataaccttaaatg

SEQ ID NO: 32412 - DNA, 201 bp, Bos taurus
cactactacaaccaaatctactatgtaaaattcaaattttcttggcagttattttcgtccttatagtttatctcactaaaggttcacagttagagacaaayacttcaaatctttattgatattgtttcaaagttattggagttatgcaaggggaaaatcaagagtatattaataatggcagcaaaatctggaacaactaga

SEQ ID NO: 32413 - DNA, 201 bp, Bos taurus
catatgcataaataaagatacatttttaattactaaacttaactaaaatagcatcacattattgtgtcattttaaatttaccattcacagagttatcaaartatatttattctgtgcttagcccttactgtgtccttacgtctgtcataccagctggcacatggtaagcacacaatccagactactgaataaaataatcat

SEQ ID NO: 32414 - DNA, 201 bp, Bos taurus
gcaacctaaaacaatgttgtccatatacagaccgatatattaaaacctcatgggaacagcaaatcccaaaaccaagacagatacacaacaaaagaaaaagyaactaaaacacaacactgaagacagtcatcaagccaaaagagtagaggacaaaagaggaagggatgaaaaaagacctaccaaaaattaaatcaatctttt

SEQ ID NO: 32415 - DNA, 201 bp, Bos taurus
agtcatgtctctccataaagactgtcccactgttaattatctcaagcttcagtgggtctaaagccaaattaatttattcctatcatagtgaatattccttktaccagtagtacttatatcttaatttcatgctgctttccttaccactgtccccctttgttatgcccctacctaggtcatttgtgaagtgaagtcgctcag

SEQ ID NO: 32416 - DNA, 201 bp, Bos taurus
agtttgaaaataattgatgctattcatgaaaatttaaatgttataacctttcagggagacagtttgacaatagtattttaaaatctatcaacagagacatytgctacagcagtttcacttgtaggaatttatcctaccagtatatccacatatacgggcagaaatacaaccgcattcactgcagcaccatatgtgatgaac

SEQ ID NO: 32417 - DNA, 201 bp, Bos taurus
ttttaagtgattattattaaatttttattatattgtctttaagtaaatgaaggacattacttttgaaacttttcagaatatatttctatatgaataatctrtgtagttttgtgtaacagatgggaactgcttcctaccattttgggagcaagtgatatcacgtgctttagttgactaaaattaaatacggcctgaatcctc

SEQ ID NO: 32418 - DNA, 201 bp, Bos taurus
gtagtaggaccaacgagagggaagacgagagcttgaagtggagtgtttgaggttgaggttactcccaggagaggctgtaccagagtcaaggtgtttatgckagaatgggtaactgaagagcaactccaaactcatttgcagggaactttaaagagtttttatgtccatttgactggtagaggttgaattgaatgatctctt

SEQ ID NO: 32419 - DNA, 201 bp, Bos taurus
gttctttgctgtgcatcctcctttcatcatgcgtgtcccctctggctgcagaattctgccccttttcttttctttctcctttgaggccaattccactgctyagctagacccatctcccctcctgttcaggctcctaacatcatgtacctctctttcttagccttcatgactgttcaaagtttccatatagttgtgtgattc

SEQ ID NO: 32420 - DNA, 201 bp, Bos taurus
ggagacatagttactgaagttggcagagttttaactcccatttattcactgatgattctcaaactcacacctccagcctatatctcctaagcttcaaatgyggctccttaagtcatttccatggatgctccgtgggctgtcaaattcaacatttctgcatgctgaattattatcttctttccctaatccacttctccagta

SEQ ID NO: 32421 - DNA, 201 bp, Bos taurus
acagaacaataaagggttgtttactgttctttctctttctggattatatccatagttttcttggtttcttttgaaatcatttatacaaattaattttatayggccccaaaccaatgctatacaattttgaatgcttccagaggcagtcatttttttcccttaaaaaaggctttgctgcagtaatataacaatgctgccatt

SEQ ID NO: 32422 - DNA, 201 bp, Bos taurus
cttcttatgacagcagcgcaaactctaaaatattttaagttgtacatattaatccaaatctcttaatgtttcttgccaagctgcagtctactgtcaccaayttagaataattctacctctcaggactcagacctcaggtttaaagtgtctcccaggagtgaaaacctgaatcaagctgtgactgcctgcaatccccctttc

SEQ ID NO: 32423 - DNA, 201 bp, Bos taurus
tatatttaccaacaaatagtttatcaagtgccagcattttatatgaattatctcatttcattttcataacctatgaggaatatccaattaatagaataccmatttcatagatgaggaataaggataataaaactaactttccccaaggcattcagtcagtaaaaaatggctgtaatttgcagtgtgttagactccagggtc

SEQ ID NO: 32424 - DNA, 201 bp, Bos taurus
tggatttaggatacagaaggtttttctctaacaagacatcctttagataattctattattagtcttctcaggctgccataaccataggccagttggtttawataacaaaaattaattttttctgagttctggaggctgtaggtctgagattagggatcattatggtgagattctggtgagggttctcttggcctcacatga

SEQ ID NO: 32425 - DNA, 201 bp, Bos taurus
aaagaatccccctgccaactgctttccaaacaggatctttgtctgtgtaaaatatctctccttaaagagcgaaggtatccaaattaaacctaagcaagggrgctctgttaattctgcactgaagctttattctaggcaagaaggtgaatgacatttggaaaagaattgtaagatgatccctgaacatcctttgcacttttt

SEQ ID NO: 32426 - DNA, 201 bp, Bos taurus
ttatagattgttgggactgctattcatgtaacttattctcctggatataccctttgacgtgttttcataaatattttctttgtctctccaaatgaatttcraactcctgaagcttagagggcagataaagtgctttattagcaatataccccaggtctcacattcacttgctgcttagtaaatatttcctgaataaatgaa

SEQ ID NO: 32427 - DNA, 201 bp, Bos taurus
acattatattcaagtatagaaagcatagaaatgataataaatgattcataaatatctgtaatccattgcaagagatggccacagatcatttttacatctgyacacatatttctttgtaatgtgtctactagcactttttttcatcaagtggtaaagtctatttccactctttttgaatttgagttggccctgaggacattc

SEQ ID NO: 32428 - DNA, 201 bp, Bos taurus
atactcaagttccctggtatctgctgggtctgtggcctaagttggataactactcatactacttccgggaaaagtgaaagtaatgctacattcagttagarggcaagactgtttcctggccattctaaagatcttatgccacacaaccaaccaacaaacaaaaaatctcctagttggattaagtgttttcagttgtcaaga

SEQ ID NO: 32429 - DNA, 201 bp, Bos taurus
cttcatgttccttgttactttatataattaagttgggtaccttggttcaaatattatgcatcttctaagacaccttagaaatcttcagttcaataccctaraaggccaaggaaatcataattggccagtcacatgataaaaatcaagagaattttcctgcagagatacagatatttcaactctctgcaagtgtaagagagt

SEQ ID NO: 32430 - DNA, 201 bp, Bos taurus
caagaatctgatcagcatgcaaaaattcacaggtgaatggagacactggaaaatgtgaatagtacatggcagtctggactctataaactctagaaaccaaycaagtgtaactgatttaaaagactcagtctggtttgaaagaaacttctggaaagagaaacttcattgagcaggaaggagacaagaaaaaggaaaaagaag

SEQ ID NO: 32431 - DNA, 201 bp, Bos taurus
cagtgattggttccagttaatccaacttttttgctaaactgcatatttcaggagagctaactatagttctacatcagactgacccttattatttcttctgytcactacaaatatggtgatttctgtgataatcaaaaatgttcaatattttattttcttgctttatcatctctatttatgagaggactatattctttattt

SEQ ID NO: 32432 - DNA, 201 bp, Bos taurus
ttatgtccaatatttgaagcagggtggccttccaaagaaggggtgttttatacctgaagaatgagtaggagttatgacatgagatggtgataaagtgtggraagtgtaatggccagctttatgtgtcagcctggctaggctgcagtccccttgttcaatcaaatagtaacctaggtgttgctagtgaagtcttagtgctgc

SEQ ID NO: 32433 - DNA, 201 bp, Bos taurus
caacacagaaatatcaaaatcctagttataggtaacccagcacaccgaagagagtcttagctccatcctgccaaaactgccttatgcccatgctcgaagtrggcccaataactcagaaatgcccttcattaccaaaattctgccttcttggcatgttgcctgcccatgttcccctccagcctccctcccatctccctgatc

SEQ ID NO: 32434 - DNA, 201 bp, Bos taurus
aatgagaacatctgaggctgtgagtcagcactccatggccagccagggacagttcggctgggtttccacctagaccccattgtcatggtccagacaagacrtacggaggacccaaagtgggccgtagccctaaggtctaagttctctacacctctgccccaacctctatttatacctaatagaagtgttggccacttgtgt

SEQ ID NO: 32435 - DNA, 201 bp, Bos taurus
catgttacttttatgttactttatgacccagttttcaatgctgtcatattattttgtcatttgttgcttttataggattactacttacctaatgatctgarttcttttgtttgaaatacaattcaatagtcttaaaaatctggttgatattaaatgaccaaatcgactctactaggttgcttgctggaatttatatcacag

SEQ ID NO: 32436 - DNA, 201 bp, Bos taurus
gacaagtgtaatgatgaagttatgtctaaggcatcatgaaagcccaagagaattgtgatcaatgtggttttccaggagaggtgggcaacagcaaatcttarttcttagataagctaagatttgaattcaatttggtagtgattattagccaggataggcaaggctaagccatggaaaacaccaccacagatatttctgtta

SEQ ID NO: 32437 - DNA, 201 bp, Bos taurus
aaagtgacttcttttttcttgaaattcaatgtgcctattaaattattccaatgtgtcattcattagtagtagttactggatgtctgacaatttttttgttrtttgaaggatgaggaaaaaggaggagacagtaagagagtatatcaatatttttcaatactcaatccttctagatctctcacttccaatcataacaagcta

SEQ ID NO: 32438 - DNA, 201 bp, Bos taurus
acacactgcatctcagtaaattcagtaaaccatccaacttaaagaccagagaaagaagatggaaaactatagcaactaacactgttgagggccatagaggygtaatctgtagcaaattatggtagcgccacctgggaagccctgaataaaggctgaattacttttaaataaaagaaggcaaaactcctgaaccgcatctgg

SEQ ID NO: 32439 - DNA, 201 bp, Bos taurus
ccctaatatagtaactattagatatttcttgaagaaatattaattattctgactttacctcttgtgcactctgcttcactggctggtttattggaggctgytatttttgtcaaccttggcaactatttatgggcaaagtgctcctggaatacttttcttgaaaaagagcagtatattttctacatgttattttattttaaa

SEQ ID NO: 32440 - DNA, 201 bp, Bos taurus
tctctgtgatggaaaaaagtttcttaaacttttattaatgaccttccttaatcaagtgcaaagacaacaggcattttcattatcatatttctctttgataratctcactgccatcttaaactcatcatgttgaaataaaatacacctttctcttcaaaatacagaatcccaagtttgttactttgattctagtagctgttc

SEQ ID NO: 32441 - DNA, 201 bp, Bos taurus
aacacagtaaacatgggtcaaaatgttaatactaaacaacttaattatttctttcctcagaataagagcttcttggcaaaatgattgcagcatcaaggaaygctctggattaaatgggtcctggacactgattccaacttgccgcctacattccctcagtcttgggcctcattttgtgcatgaaattctgtagtagctgtg

SEQ ID NO: 32442 - DNA, 201 bp, Bos taurus
gagggtggagaggggcccaccacaagggacctacatataaaatgcctggcacctgggaaagtgctccagagactctcccaaatggaccaaatagattaccyccccttctacagccctgaaggaggcctggactccctcattaatatagtctttggctgagcaaccaggcctcctagccccaccctccagtccttgcacata

SEQ ID NO: 32443 - DNA, 201 bp, Bos taurus
gaaatcttcatttattatcagattttgacagcggcagtcagaatgcttgatggggggaaaaataagaacaacaacataaaagagccttggccattttagcyacacaaagagttgagttataacattaaaaaatattcaacgataaagtcatgggtgagttgagtgccaggaaaaatcttgcttttgaaataatgtgtattc

SEQ ID NO: 32444 - DNA, 201 bp, Bos taurus
tcaaaactgtagaatccaaatactgcacaatttaagggacgattctggagtccagaatggaagataaagccaaaagccatgaatttgaaaaaaatatagtsttgaaaaaggagatgcaaggaaaagtcagggcaaggacagctagaaggcctggggtcactagtgggtattctgagagatgtgtacgaaccaaagaatttt

SEQ ID NO: 32445 - DNA, 201 bp, Bos taurus
tcctagttctcaggcctttgcatgtggactggatatttgttggctttcctaggtctcccgctttagacagtagattctgggacttgtcagccactgtaatytcatgaggccccagtttcttaaaataaatctcattctctgtgtgtgtgtatgtatatatacatatacacatatatgtatgtatatatgtatataaaatat

SEQ ID NO: 32446 - DNA, 201 bp, Bos taurus
attctcctcagtttcactaagatatagacggttttctttctgaatctagacctttgaaatcccttttcttagaatatttactttagaacatttgcaatcaygcattctttctcttttcctttaagatacaaatcttcttctaacctcttgctagttttacaatactaacaatgtctttctcaaagacctaggagtcattct

SEQ ID NO: 32447 - DNA, 201 bp, Bos taurus
ggtatacacatcttttgtccagtgaaacatagtacttacttggatttttattttctaagcatgctatgaaattgtactatctcacttattttctcttcagygctttctttgttaatgttagaattagtaataaaatgtgaaaaataagagtgtcttactgctgcgccttagtgaatcaaactaagacattgggcacatgga

SEQ ID NO: 32448 - DNA, 201 bp, Bos taurus
gtgatatctatgccatggtctaaggtccctgctttgtgtatcaaaattatagaacagcactgcccaaggaaatataatggtagccacatatatgatttttmactttctaatatgcacttaaacaatcttcttcaaagatagaattcattttagtaatttattttattaaaatggacatatccacaatgttactatttcagc

SEQ ID NO: 32449 - DNA, 201 bp, Bos taurus
gggattttctatgtccatctcatgcgtgatctttcctttgcagatagaagtttatgtgttggaattgagaatattcagtgttggatataactagttgaagycaatattattgagtcctatatagtagaacttacatagtagtacaaagtgtcagaatttatattaaataaggttaaaaagaaaacactttaacacaggtgt

SEQ ID NO: 32450 - DNA, 201 bp, Bos taurus
acttagtgtaaaggaaaatacatagccaaatagtggagacagacaaacagattttaattatcaaacggaaaatattaagaaaaaaagtcagctgaatgtaytatggagcttgcaggaagaatgcataggtcaggttgggagcaacagtgaaaataattttattattgcttcatttaatataaaatcttttatatagataag

SEQ ID NO: 32451 - DNA, 201 bp, Bos taurus
ataactgattctgcagaacttcttctgacctacactctagtttttgagctgtgctgtttctactaactttctaatgagatttaatctcaatcattacatcycatgttctagatgttctctttgtttagtgttttctgcttttttctgaatttcattggtcatctttgagggtcttatgcttttaccaattacttttctttc

SEQ ID NO: 32452 - DNA, 201 bp, Bos taurus
agaattcccaggcctgttgccagcctactggtgagtagactgggaactgccatcacaggctgaaggtctgtggtggttacgactccgatatctaccagctkgtgggtggcctggctatattttcactctggagtcactttttaagttctaggtcattagtcttccattttctttataaaaaaaagaaaaagaaacactttt

SEQ ID NO: 32453 - DNA, 201 bp, Bos taurus
tatttcactatttttccagtaattttttttccactcaatgggatggagaagtttccagtatgcaacaccacttacaaattacatccattatcatatacatrttattacattgctattactttttctttcctcaataattgaagaaaatcattactattatgctctagaatgtagagatttttttttttttttggaagcaag

SEQ ID NO: 32454 - DNA, 201 bp, Bos taurus
attcatttaggttgattgtttttaagaaacaggcctcaggaaggtgttcttgctccctgcccttaactgcctaaaatattttaggtaaagggcctgttccyggaacaggagtatcaccagaaataactcgcaaagaatactggactggtgtggtgggggaaattgacagggcctagagatcagagtccattatgtgtccca

SEQ ID NO: 32455 - DNA, 201 bp, Bos taurus
tacttagtctcttatttttggcccctctttttattatgtgtagtgatctgattacatataatgctgtattttcaattcttcaattgcttttcattttcccmaaatcatcaattctaaaagggcctttaagaagccccatattttgccacttaaatgttaacaaatgagttgaaagcctggcttacatttaaataaagtaaa

SEQ ID NO: 32456 - DNA, 201 bp, Bos taurus
tcagtcaccatggatatttaacaaatcaggtggtgtgttagaagcagactttagactacagtggactcagaagcaagctgaagatgagggagaaataaggrgttaccaactacacacttggaaattaaagcttcttccaagaatgaagaatagtagctaataggatcgagatatgctgtgcaagtacattacatggaaaac

SEQ ID NO: 32457 - DNA, 201 bp, Bos taurus
tcccaaattaaaatataacatgattgaaaatttaaaggtgacacactaatcacaaaattgtattcttacactgagtcctattttgaattgctgctcatctmgctagaaatttgtaatgaaatgagaaattatatgttatttcatgagtaaataatgaagtagacaacactgtattcattttatatttttatcatatgcata

SEQ ID NO: 32458 - DNA, 201 bp, Bos taurus
attgcaccctgtctgaattcctgacccaaaaaatcatggaatatgaatgtttgctgtttaaagccattaagtgttaggaaaacgtgttgtacagaaatagytaagcaatatattcataaagaacacatataactaatgacatataaattttgttgcccctagacatgtttttattgaaagtattacctcagtaatatagaa

SEQ ID NO: 32459 - DNA, 201 bp, Bos taurus
gagtgggaaaccactggaaaatgctagaaaatgaacataacacaatttaatttagatattaaaggatcattccagtggccatgaagacaacagactataartgaacataaaaagaagtagggagaaagttgggaggctgttgcaataatccagtcaagtaggtgggccggaaatatagtagtagtgtggagggtgcaaact

SEQ ID NO: 32460 - DNA, 201 bp, Bos taurus
cttgtatttgccaatgtgatcactgaacttgaacgaatcatatacattgttctaacttttattattcaaaatgctggatattgtaattcataaatcagaayaatttttagaatccagggggaaaaggcatgactgatacatattttagtaataaaagtctctgttgtaatacagtatcagattgaaattacttcagattac

SEQ ID NO: 32461 - DNA, 201 bp, Bos taurus
catgattaatgtctataaacatttgacattaagtaaagccgattacctctaataatgtgggtgggtctcactgaatcagctgaaggcctaaaagcaaaaaycgacatttcctggagaaggaattttgcctcaaactgtaacatagaaatcctgcctgagtttccagcctgctggcctgccctacagatttcagatttgcca

SEQ ID NO: 32462 - DNA, 201 bp, Bos taurus
tgtacaattaaaatttaaatgtgtttgtgtgtggcctgcatctattccatatagaataaaaacaacttaaaaccatgcactaggaaatattaagaagtttsttcaggggccacttgataaagcatgctggagaactggtgatcagtggacatctctgtgtgggtatgtgatttgctataaagtctttgaaagcacaaagcc

SEQ ID NO: 32463 - DNA, 201 bp, Bos taurus
cacctctctaggttgtcaaagagcagatttgagccccctgtgtcatacagcaaattcccactggccatctgtaatgtgaatgtttgtgtaaagtgtatggyaatgtgtatgtttcagagttactctctcaattcgtcccaccctttccttcccatggtctgtgttcaagtctgttctctatgtctgtgtctctactgttct

SEQ ID NO: 32464 - DNA, 201 bp, Bos taurus
atgccagtcaccaacctcaaggaatgattggatcagctgatgacccaggttgtaagctgtgtgtggaaacgaaagcttggccaccatgtgtaccacagcaytggtacttgagctgtgccataaggatgagagcagcgaggatgttgaggttccctgtgtacaatacaccatctgctgatccatggcctctcctgtagactg

SEQ ID NO: 32465 - DNA, 201 bp, Bos taurus
tacatattgcagctgttatttttttattatgttgagtcacacatgaacacattctaatcacttaaaaattggtcagattccaagatcttaggacctgtaarcccacctttaaatctctttctgctttcaatacaatggaagtgcagaagagtgcgtgaagagaggccagaaagatggatgatggatttcagagtgccatca

SEQ ID NO: 32466 - DNA, 201 bp, Bos taurus
aagtaatacatgatcaccgcttctgtgtaataaagaacatttgctactcaggcatctttaactttttggcgacatctgctgtacaaatgggaaaatgctgyggaatcattctgaacccagagatagtctagaaattattttgtttttaacttaaacactacagccttttttattctttccttcagtataagcaggcctctt

SEQ ID NO: 32467 - DNA, 201 bp, Bos taurus
gagaatgttaggtaattagaataggaagaaaggagtccagaatggtggtggctaaaaaacaaagaagggaaaagtctgcaaaaatagaacaaaccaaggtycaaggacaagagtgaaaatctcaggcaaaaccaacagccctcctggctagataaatttacatagggcaggctggggatgggtggttggcggagggacata

SEQ ID NO: 32468 - DNA, 201 bp, Bos taurus
gtcagaggaaaagcagaacccaatgatgttgctgcatggcccccattaccatcagaaatcaacaagttccttgtagtgggacctggaaaagagaggccaaytcctggaatttgatagctctttcatgtctttgtttctcatagataagtcctgtacaggtgactttctctgaattgagcacataaaactactttggaggcc

SEQ ID NO: 32469 - DNA, 201 bp, Bos taurus
ctggccaacaggaagatcatgttctatctgatctgcaggtatttctttttaattaagccaatatttaaaaataagaagatctattataaaaatgaaacacyaacccacactctctaagccagagttgactacagtatgtgcctttattacacctcagactatattacacttcagtctttattacacttcagaccccactgc

SEQ ID NO: 32470 - DNA, 201 bp, Bos taurus
ttagtatgtgagaggtttaaattgtacctctttttagccatggactagatttgttgtaaatcatagaaattttagagctggaataatttgtgttgtaaatytgagatggaaagaaatccgtgaagctgtgttagatcttggatactcatttctgcgtcaaggacagaactgaaaaaacattaacactgaaactttgcttct

SEQ ID NO: 32471 - DNA, 201 bp, Bos taurus
gaaaacccaaagttgccacttgcaaatcagatgttgttttgctgcatctgaaacaacaaggcttctcaacatctttttgtaggaatttcatgaaaatctcrttttcccaggccctggttttataacctaaatatccaagagaaaaaatatattagtcaaaagagctatatatttgtcttctcttttttattaatataagat

SEQ ID NO: 32472 - DNA, 201 bp, Bos taurus
ttggcctaagggcattttcaaacaattacggatcgtgaagattttctaatctgaattctacactttgcctatcaagaaactgaggctctgagaactttacyggctccttctaaggcctgttactggttttagtggaatccctgagcagctgatgactggagaataagagatgtccacttctgagcagttttcccatggtcc

SEQ ID NO: 32473 - DNA, 201 bp, Bos taurus
cccatctttcagctctgtaccttccttccgtgggtgacaactccttcaagtcttccaggccaggcttcacgttcagtagcttcttatagagagccagcggraagtgcaggtccaccacagtggagttgtaaatggcgagtccgcaggttatgccaatcaagtgaaaccagttgtgctctacgaaacactttaagcacatgc

SEQ ID NO: 32474 - DNA, 201 bp, Bos taurus
tatccttaggtttttgtgcattttttatcttctcatggcactctccatgtgatccgagctatctccccagctagcaggcacttttctgccatagttctggmtataaaactgcataggttttgaggggcctgccttgtttttcccataagccctgctatttctattgggcaattttgcagtgtaagaatttttggaaattcg

SEQ ID NO: 32475 - DNA, 201 bp, Bos taurus
atctaaatgagacttagaaaagaggaatgagttcagaacattaggtatttccaacaagttataagtgtatacacttttgaaattacagattcacagacaayggcagtttttaatgctgcatgcatttttttgtttatccacttgtataaaactaggtatttgtacattcatttcattctactgacaataaaagtattgaat

SEQ ID NO: 32476 - DNA, 201 bp, Bos taurus
taatagtacaagaaatttttaactccggtgaagtctgcttatgcatctaacggatggtagtacttctgataaccacaggagggcgtatgtcagccagttcycgaagagagcagcttgtttcgtccgtctctaaatcggttttccttgatgatgagtatcaaacagctctctccccccagagtgtatcaattttactatcaa

SEQ ID NO: 32477 - DNA, 201 bp, Bos taurus
cccagatgtaggaatggagaatctcaacagtaaactggatgtagcactggcaggatatacaatgaatgtggtaaaagcaaatggacgcaaggacattacarctatggaaagaaagaatgtcaactaatgaaagcaaaactatattaggaagttgaaagggacaaaaactttaggaaaaagaggaaagttcagggacctggg

SEQ ID NO: 32478 - DNA, 201 bp, Bos taurus
gagaaagaaaatataacgtctcagcccgatacactgcgggatgttgactcactttgcaacaatagtccttcatgaatgtagaaaggaagctagtcttttaygcaatgagttcagttcaaacaaatctctcctaaccctgcgttgctacaggaatagatgtcgccaatgttaatatctgtattggacactctgtgtaattat

SEQ ID NO: 32479 - DNA, 201 bp, Bos taurus
gtgggaaagacaacaatcgctgctaccctacttctttctagccgccatttcccaggctaatatctcatttctgcaggctgatcaggcttggtctctagacygggatgtcctagggctcagggagccagggaggtgtccccagaacacaagccccctttgtacctgttctgcccagtccaatctgcctgggaccacagtgtc

SEQ ID NO: 32480 - DNA, 201 bp, Bos taurus
ttcttgctttttcagaatggccattagcttatttcactgtcatttaattctttctcttaatgctgaggttcagggaaaacaaattcgctttagttgagggytcttattatgaggatttacattatttcttctttcttacaaacagtatatttcagaaactggtgattaacatgatgggaaggagtgtacatgctatatgag

SEQ ID NO: 32481 - DNA, 201 bp, Bos taurus
aaaatgactctttctaaagtctttaaatgacttagaatgtctttggcataagtatatcttgtgatttcagttaggaatgaagaatattgtttccattattygagtaaccttctttccaccctgttttctgtctatcactacaaatggctcctgatgacagtagctaatatcaaagccatctgcaaaagtgtatgttattaa

SEQ ID NO: 32482 - DNA, 201 bp, Bos taurus
tggagtgagacttactgtgagaaatgattctcaggggaagcagggggagttggtctttccctcttttctttagtctaccttcaagggcttgaagttagaaygcttgatagttcagagccagtttcagatactctgcattaaattttagctctaagacctgaggtggggtgaacactataaatgcgggaaaagatttgggtt

SEQ ID NO: 32483 - DNA, 201 bp, Bos taurus
agctgcctcactgtgaatactgcatcatttattgttagccataggcagagttcattgttgaggagaggtaaattgaaatcaaatttgtaagtcagccctgrgtaaaatattcaatgatccaagttttgtgattagtgacccaacctttcctcctttggccccccacagtgatgagacaatgatataattttaagaagaaaa

SEQ ID NO: 32484 - DNA, 201 bp, Bos taurus
gttttcatatcccttgctcttaatgaaagcaaatgaaacttgtgtggaagttaaaaaactcagagactaaagttgggacttaactgtcctctttcaaactraaagtcaaattttcatcttaaagacaggcccattttacatttttcaagtttttattactgttgtgttttgcccattactaactgcagaaatctatgatct

SEQ ID NO: 32485 - DNA, 201 bp, Bos taurus
agcatctctggaaattatatatgctgtttagagctggagtaaagttgaggtagggttaaaataaaaccctttgctttggaaattaaaaaaaattttttctkggtcttaagtcctttcctaaagaatgtatatatacaaggaacagtcttaaatatactggcaactggatctgttggttggaacagacttcctgttggatgg

SEQ ID NO: 32486 - DNA, 201 bp, Bos taurus
tctacagttgtactgatttcctagagaaaccgctgtgattatttagatagtacagttatctcagtcttgcagagggagaataaatttccttggttttggarctagctgctaattctcccaatagcgtgactgtagttttaaaccgctgatttctgctctgggaagtaagggtgaaaatctctttactgccttattgcatga

SEQ ID NO: 32487 - DNA, 201 bp, Bos taurus
aagaaaaagtttctagtgtaggtgatatataacttgtgtttcaaaatattgaatgcaacaacagtaggcagacaaacaggtaaggggataattgaccaaargatcaacttatacaaaaacctgaaggtatttttaaaactttagtatatgcagaaagccagcattgaatctgtgcaatacaaaatttagatgcagaaatga

SEQ ID NO: 32488 - DNA, 201 bp, Bos taurus
atagaattgtaatgaacaaagcaacatacctagggttgactactaaccggagggcttgctcactttaaaagccattccatttaggcaatgccttattttckgtactctctagctgaccctgcccaaatccacacaggtgacctctcaggaacccgacaggatacttatagggaggcttccattctagtcccctcactctgg

SEQ ID NO: 32489 - DNA, 201 bp, Bos taurus
tttcctcgttttctatcctttttattctgacagaagaattattgtaaaaacactctgattcaatattgctcaaacatgagtaatgtaagctacaattttayaggaaaattacacctgtgaacttctgccattgaattacttttagcataatgttaatgtttccatgtctatagtatataattttcttgtgcttatatctct

SEQ ID NO: 32490 - DNA, 201 bp, Bos taurus
gagtcaatgaaagtccaatgctaccttaatgtaaaattcttgttatgaaataaaacatcaggagaatgggcttagtgattttgcctaatggagtatacgcrgaagaagtttgatgaaattacacatcataacatatggttttattttgtttaaacttctggttttaactttttctttgttcttattaaagattagcaatct

SEQ ID NO: 32491 - DNA, 201 bp, Bos taurus
aggtttttgtgtgagagaaattccccatagccaaatgatgaaacataaggaaattattctgatgaatatgaaacatgttaagcattatttacttttcatcrtaaaatagtataatgggttttcatttcactacgtgtagcttttggaacatacatttttccaacaaatagcaaacgggaaagcaaattggaattaagcaag

SEQ ID NO: 32492 - DNA, 201 bp, Bos taurus
ttcatagatatgacactacactgataaaagacatttatctgttgatgacaggagagggacagaaaagaaatggtaataaaagttttcataggtcacagtcktattgtggggaagaggcttgtgtaactaaatgaagctatgagtcatgctgggcagggccacccaaaatggatgggttgtagtgaagagttctgacaaaac

SEQ ID NO: 32493 - DNA, 201 bp, Bos taurus
tggtcatgtacaccatagtttctcaaccttgaaactattacattttagaccagatagttgttcgctgtgaaggctgccctatatgctttcctttctttgcmctgcacacctgtattgcccctgcccaactgtggcaaacagaaatgcctccaaacattgcaaaataccaccagtgcggcaaaaggactcttgactgagact

SEQ ID NO: 32494 - DNA, 201 bp, Bos taurus
tatggtgaacctgagacaaagactttttctcacaaaccagtcagaagcagccctggcctggagggctgattatcatacacaagttacatcatctgttcatmttggctgtccctcagatgctctagatgttttggaggtgtctctttggctagaatttattgtttcacccattaaggtattttattaccagcaagtctgcca

SEQ ID NO: 32495 - DNA, 201 bp, Bos taurus
aggccaggagtttacttaattgataatgtaagacaaaatgtcactaaatttttatttcattggagcaactcataattcacaagtctgtgtagtcctgagtrtacataattatgtcctaattcttacctacctaagagatttgtaaattagaaatttgatattttcctctggttctttttcttgtaagttggcttgacataa

SEQ ID NO: 32496 - DNA, 201 bp, Bos taurus
agacatttacatcaagaagttaagtgtgtttctttctagatgataggattacaggtgatttttatttccaaatttctagcttaataggtaccctgattctyattttattttattttgattcttattttaaagtcagaaaattctataactatttcaaaacctttctgcctcttggtcaaacatttacaaatgcattagtat

SEQ ID NO: 32497 - DNA, 201 bp, Bos taurus
tactgttactactgaaattacttctactaccaccactgcttatcaatcattggaaactcacaatgtgctatgctttagtatattcattcaaaaaatatgtrtctaatccttgctatgtacagaacattgtgttaagtcttgaacacactttaacacggatttgcttttttcagtactgagcactttccataattaagttgt

SEQ ID NO: 32498 - DNA, 201 bp, Bos taurus
actttgattcaacggggaaaaacaagctttggtgtgcttttctagacctacttctctcttgcagaacatttcccccttctccctgttgactgttttctacyttttctctgattgaaatctactctcaggggaatatacaccataggcttaatcactctagaaggtatacaaactgataacccttacacatttaagtgtctt

SEQ ID NO: 32499 - DNA, 201 bp, Bos taurus
atgaattgtatggccttcactatcttttgagaaaataaataaatattaaaattcatttaaaattgctaataagtgttcagattggtaccctttgaacttcrtcacatgcggagaccaggccatgaggagtcaaagtttttattaatgttagttctttaaaaacctgaatctttatgacaatgcttagattttattttttct

SEQ ID NO: 32500 - DNA, 201 bp, Bos taurus
ttctttccaggaatacttctctactttcacccccttaccccaaatacccctacaattgtaggattttggtgctattttatttatctcttcaatttcctatrttcaccaatagattaataattcatgagagcagggtctgtccctcctaatcactcaatacctagcctcatgactggccctttatcactctctgtccagaag

SEQ ID NO: 32501 - DNA, 201 bp, Bos taurus
tttcaacttgcagattccttgaagaactgatgaaatctctggaaatttgtctgaataaaatgcccacaaataattttgcacataatttcagagacatagaratctcctaaagatcagagatagactttttagttgtctcttaaccctaaatttagatattctataatatgcaaaactattaaagtttgcagttttaaaaat

SEQ ID NO: 32502 - DNA, 201 bp, Bos taurus
agtgttggaggtttgttttttttttcctagtgattattcccacatgtgggaatacaaagcagtgagcctggcatactgttttcttcatacttgtctatctrtctgttggtctttattcactcttttttttttaattaatctgtgattatcaacaggaaacccctgagaccactattattaacttgaacacaaatggaagat

SEQ ID NO: 32503 - DNA, 201 bp, Bos taurus
attcttgagagaatgaggagtttagcagaaggatgtgtgacagcagaaaaatagttttctacaataatcatatttcacttgacttggtagtggattatctratcagagatgacctggagaaaattcacggggtactattatattagtgggaaagcctccaaagtttgacaggtaaggttgtttgtatgttggtgataacta

SEQ ID NO: 32504 - DNA, 201 bp, Bos taurus
ttttcttcactaatgcccaggctaacacagttgtgctttcatgccgaggtaaatgatatagttgcagaaacttctctttaggatggattaatttaaatttktctcaagccctctgcatattataacttatatcttggattacttgtttcacaatcattattggcataagatttgtatatttagacactcatatttacctga

SEQ ID NO: 32505 - DNA, 201 bp, Bos taurus
tgcagtccattcagtacttccaatcctgttcccaaccacatgtgctgtcaatgatgatgtggtgcggggggtactcttcctccctccagctctctggaccrcagttcccaagccacacagatgctcttttcctttctaaacctcatcccaaactttccactctgttcacatgatgatggtggctcaactctgcccacttgg

SEQ ID NO: 32506 - DNA, 201 bp, Bos taurus
aacaattcatgctctggatttgttgtcagtggtatgctcccaggtggatattatcttttaaaaattgagtacatgccatttgtctgtaaggtaaagggtgrtatttttaacagtaactgaaaaactgttttggaaagaagctctaacacaggtgttttggaagtggacagggaaatgtttgcatcattgtgtgtgtgtgta

SEQ ID NO: 32507 - DNA, 201 bp, Bos taurus
cgggtacctatgatagactcatgtcttcactaatagctgttgttgcattggggccaacccatggaccactgctggcttcttggtccacacctttactgagmcactgccaggttctcctcttatttttcagcgatttttcttggttacattgtgagatgacacactgagtttcctggcccagaatagtcatttcagtagcgc

SEQ ID NO: 32508 - DNA, 201 bp, Bos taurus
gatacagacaaagagggagcaagatatcagagggaatgggattaataacacagggaaaatagaacatccttttcttttgtactggaaagaataaaccaatraataaatctgaatcaagtgccaatggttctctacaccctgagctaggaattaaggatgggtggtgattgataaagacagacaaaatacctcagttcatag

SEQ ID NO: 32509 - DNA, 201 bp, Bos taurus
agcaggaaaaaatcagaagctctttaccacaagtgattttttccctgcagtaatgttaaaaaaagaaatgcagcctgtagacagggatttggagaggaaargagaacacagccaagggcagggtgtgttttgtgctcccaactcttccaaccaagcaaaggtcccgcctccacatttcttcctgcagggatcagaatttgg

SEQ ID NO: 32510 - DNA, 201 bp, Bos taurus
aggtcgtcaagaacatgttcttcaactaaaacataatctctctataactcacactaactaggcttcaccccaaatacagtgggactaaaattttaatcctraaaatccttaacatcactcatttcaatgtcataaatgtctgttgatgctttagtttgatccttgatgccttctcttcccagggatcttagagttttattg

SEQ ID NO: 32511 - DNA, 201 bp, Bos taurus
tgtttaaaggaaaacaagggttgatagctcatcaaggcacatgagactcccctaagagttgacaacctccacttggagaatgcattagccaaacacttccrttttcactggaggctgttattagatgcacttaagcaaagaaagctactaagagcaaaaaacacccagagtttttttttttcctcctgtaaaggcattgtt

SEQ ID NO: 32512 - DNA, 201 bp, Bos taurus
gactatatcctcctctggtttactgattcattcctttactccccaattcaacaaatcatgccagttaatatgcttaactcactatctctagcttctctctytccattttctcatttctaaagagaaataactccatgactcaaaattcaagaaaggtagaaagctatgtatctacaatctaacatttctcaccactagcct

SEQ ID NO: 32513 - DNA, 201 bp, Bos taurus
agtttcccagccagggatcaaacttcggccctggcagtgaaggctctgagtctcaaccactgaaccaccagggaattccctagatagaatgattattaacyccagtttccagattaagaaatgcagcaacaaaattcaagctggaagctctttcttacaagcacaaattttgtatacccttttctaataatttcaaatatt

SEQ ID NO: 32514 - DNA, 201 bp, Bos taurus
agtaaaagcaggccagtctgcttacaagacttgtcaacacttctaatacatccaagtatgttctgagtctccaaactgaccgacagcagtgtttccaaaaytccatggtcattgaggccttttcttacctgacctttgactctactgaaaacacttccttggcagctcagacagtaacaaatctgcctgcgatggaggaga

SEQ ID NO: 32515 - DNA, 201 bp, Bos taurus
cagtgactcagacacactttgaagctgtattttagtgcatccttacaggactgaagataaatgggaagaactgtaaatagtagcaatattatccaggactkgcaagagagaacagaaaactgttatacatatatattaactggcagtgcttaaagtttagactgcatcagaattaccttgagatcttcttcaaagtgaatc

SEQ ID NO: 32516 - DNA, 201 bp, Bos taurus
gacttgcaatttcttggctgactacagtttatttctcaaacaatttaacttgtataatctcctgagaaatatctgagggtgtagaatacatgggaaaatgrtctgttttgcttagaaatatgtttttaaattttaagtggttaggtaatgtacatacagaaaacttctgaagttttattcattctcataaacttacaggtt

SEQ ID NO: 32517 - DNA, 201 bp, Bos taurus
aatgaaaattgccccatatattcttgatctttaacatggttatagaaaaatgtcctgtacaaagaaaaaactttttactctaataatatttcattgggttkgcattggtgattttatgaaaaatttgagctttaaactccctgataatcaatattttgcatcttaatgtcagaaaaatagacagaacaatgtgtcctgtcc

SEQ ID NO: 32518 - DNA, 201 bp, Bos taurus
ataggagggttcaaacttgtttgataagcagaagtagctacagaacttgctgggcccatgacagaatgaaattgcagggaaccatgtttaaaaagcacttrtaatttccagacagcaacaacagtacattaaaacaagtactagcctcttctaagcttggacaaggactgcatatccatgaggctggccctgttgacaaac

SEQ ID NO: 32519 - DNA, 201 bp, Bos taurus
tagttctaacagctgcctttagactactacttccaagcaaagcaataaaaatctttagggaaaaaaattgatcccataagtataaaaagataggaaggacyccaacacatgactatcttacagtagagaaacggggtcaatttttatagtatttgagagtctattatatcttcaaagaagatgcaccacatatttcaaagt

SEQ ID NO: 32520 - DNA, 201 bp, Bos taurus
acccccttctgagacaatcactggagtctggtctactttctgccatctgcattctaaagtaaattcagtatccccctcaccctagcccctgctctcaggargaggatatcatggggactcattcctcttgaaggtcttacctcactatacccgaagggtacttggtagaattggaagaaaggtaaataattaaatcagcct

SEQ ID NO: 32521 - DNA, 201 bp, Bos taurus
tataatctttaaaacttggaaaccatttctagctttccagcatttagaacatcaaacaaacaaatgagagctgactggaacaggcctgtggatcaaatatytgccagggtttgcagactccattactggtgtaaaggagacaaatcaagttaataaaaacttgatcttgtatcttgatgacaaaatgtaagagaatttaag

SEQ ID NO: 32522 - DNA, 201 bp, Bos taurus
ccactatttccctccaacaactggcaggcaggttgtggcccctgtcaaacatgcattgtcattccaagttcattttcagcatgtgagtgggttggccaacyctgaactccaatttgacacatgtctgcagccaaggtctatgtcagtaaaaattccagagatatacctgccttgccctgggtcagctgggccctatgaact

SEQ ID NO: 32523 - DNA, 201 bp, Bos taurus
ttttatgtatgaaatttcttcccttatacttggtaatgttcttgctctgaaatctatagttattcataaagctactttggttttctttgattagtgttagyatggtatctcttttccattctgtcacttttaagcttctttgtctttatattttaaaagggtttcttttaggtactatatagctgagtctggtgtttttac

SEQ ID NO: 32524 - DNA, 201 bp, Bos taurus
ggagttcagaatcagaagggtcacctcagattcaagtttaacaaagttactgtggagggtataaaatctcagagaggaaattgaatgagcaaatcagttcmaagcattagagtaaaattcccaactgaacagctccacggcagttacaatcacgagcagtgaaatcacctttcaaaacacgatcatggcaagcaccaccta

SEQ ID NO: 32525 - DNA, 201 bp, Bos taurus
ttgacttgtattgggctgaaggtaccaagctgtgaacctcccactggggctggtgctacaagtgtcaatacattgcaatgcattcatttaaagtccctttkgttctcactaggtagctttgcctggagaggaaaacagccccacaacaggcagtgtgatgtcccctctgttattgatgggagtttagtaggggaggaattc

SEQ ID NO: 32526 - DNA, 201 bp, Bos taurus
cagtcactgatgacaccagtggtggcttaggcagccaagataaatacccacttggaggatccaggaggtgagagtaagccatgggactcccaccacgaccrtgggaactgcacatctaggttctttcatgttgtggagaatcggagcccgtgtttatttggtgcaaaggacttatttggatattgctggccaaatggctgt

SEQ ID NO: 32527 - DNA, 201 bp, Bos taurus
cctgagagtattttaaaaattacatatcattacataaataaaggcataggcttaaccttgtgactttgtaatttcaaatgaaataaataagatatagagayctacattctaattctggttttacaactgcatctggttagtcaactactgaaatttgtttttataaaattgcattcactcatattttattgtaactctaag

SEQ ID NO: 32528 - DNA, 201 bp, Bos taurus
tctctttccagagagtcccaccaattacactgcagtgaaaatgagaatgaaatgggcttcagtaaaatttcagggaggctcatattcttccagattcctcyttctaaccaatacatgcacaaatgtatttctaagaaaaaatactcatgttatgtctcatatatatattttttttaatcctgatgtgatgtgtaaggcctt

SEQ ID NO: 32529 - DNA, 201 bp, Bos taurus
aatgatttcaacaatgtatgtattaataaattacctctaagtttctttccttgggatttttatggaaaaaataatacagactaaagtaaatatgaatcatrtattgcacaaaccaataattttgtgtttgcctctaccatccatgtttacatattttgtataattgtactgattatgtgttatttaattatgtgccttata

SEQ ID NO: 32530 - DNA, 201 bp, Bos taurus
tgtgtcagtttcaaatgattgaattttctcattatcacaagtcatgtttatctgattctttgcttgccttctaatttttgattgtggccacacattatggrttttattttaatgggtgttggatttttatgtgtttatttctataagtatttttgagctctgttctaggatacaatttgtatcctacattggaagcaatgt

SEQ ID NO: 32531 - DNA, 201 bp, Bos taurus
tttttattatttgcaacagaaggcgagcaaacaaaataaatacccttaaaggatatatcattcagaaaccctttctaggacaagttaggatagaaataaaygtaataattaagtataaaaacaagctctgggcataatacatttcttcacatactgaggttgttattaattctagacatccgtttgtagggatgctatgaa

SEQ ID NO: 32532 - DNA, 201 bp, Bos taurus
cctagaaacctcaactatttcatccagtcaacaatctttatgcttcctctgatatagcttctttctccttttttttaaaggcctttcttataagcatattmcaatatgagttttaaataaaaaccaacatcttacatgcccagtattctaggtacaatgaatgggccaaagctagacaacaccactttctttgctagactg

SEQ ID NO: 32533 - DNA, 201 bp, Bos taurus
taggcatttattgctctgaaaattactcaagtgtccttgacctaggtcccagagtagtgccatatacacatatgtacctggtgattgtcagttcccttcartcttttggctgttgtgctgctcctcatcatttgaaatccttcctattggcaattagaccctctcatccagtctgtcaaaagggccatggtgagaggctga

SEQ ID NO: 32534 - DNA, 201 bp, Bos taurus
atcttctagttgactgatggttattctatgtggcaagaaacactgcaaaagttaagtgcaggtgtaattgaaaaagaaaaaccccagtaaataaataaagyttcctggagtcttcaatttttatcaaccaacaagaaaattatctaagactggtgtcattatgtagtttgtaagaaagaaaatctgaaaatatggaggtgc

SEQ ID NO: 32535 - DNA, 201 bp, Bos taurus
cggggcatccccgatgtacctatgaatgaccgcccaaccttcacccgataaggagcataggaagggaaaatagggccttttagatgtgaagatagagtgtraccatggtagatccatgcaggaagatgtgtgtctcttcctcatcaattccactggagccagaaatgatgtcaccccaccctctgaccctcttccgccctc

SEQ ID NO: 32536 - DNA, 201 bp, Bos taurus
ggaaatccgatgagaaaacaggaatggaaagaagccatgagaaggtaaagaacggatttgcagaagctttctggaagtcccatttttcacttgtcattggyagctgacaacaggagagtcctatgggctgaatgtcagaatgggaaggggaactatccagagcttattgaacagtttcactatctgacaatctctccccag

SEQ ID NO: 32537 - DNA, 201 bp, Bos taurus
tggcccctatatatagctctccttacaacatcatgtctcacgggtattaaaaatagacccaaatcacttgaagacattctgaaaaatcaaaggcaaaagcrctttccaagaggaagttttaaatgttttctttcttctcgttgagatttttaaggagcaaaagccgtggtgtggccctcctcttcctaggaggccaagttc

SEQ ID NO: 32538 - DNA, 201 bp, Bos taurus
gtacatgggaagtctgagttgcagtgctttagtaaacatgtggacgggtatcataaggtcttatggtttgtgtgtaacacaaacagactctaagttaccarccctctccagaaaatcagaaccagaggtgaagaaccataagaaaagtgcaatggaaatgctgcacttatgaagtcattgtaccaattatctcagggaaag

SEQ ID NO: 32539 - DNA, 201 bp, Bos taurus
gcagatgttttgatatccatctcctcattcctggctctctcatttgattgagaattggagagagtggagagcagtgtagttaattagttccctcggcccamgcagaagggaccggaccagtacctccaggaagatgtcgtggcaacaacctgcttggacatgttggaagaaagcctagcctggcagggaaaggaggtagct

SEQ ID NO: 32540 - DNA, 201 bp, Bos taurus
caactgagcgactgaactgaactgaactgaactgaatctagtttggcccataactgctttgaccaatggaatttggaggaaagatgttgcaggaatctgarcccaggcattcagaaggcctgaaccttttgccatgccctgagctctcaagtataatgtctgagttgttgtttagtcactaagttgtgtccgactctttgt

SEQ ID NO: 32541 - DNA, 201 bp, Bos taurus
tctctctgtgtccctccgtgatggaaagggaacaaaagagctctctggcatctctttcataaggttctaatctcattcacgagagctctgcactcatgatytaatcacctcccaaaggccctaaatcctaatactatcacgttggggaagaggtttcagcacatgaattttaggaggacagactctatctatagcagagag

SEQ ID NO: 32542 - DNA, 201 bp, Bos taurus
ggtctttctgaacctgagagaatattagcagtgatttcttctgagaaatgtactgcttaagaggagctgataaccaatgctcattgaatctcatgcattcrtagttcattgcttgattgaacaagcatttgttgagcactttcaatatttatctactgaggtccttgaatgtggcaacggaaggactgaggttacaaagat

SEQ ID NO: 32543 - DNA, 201 bp, Bos taurus
gttctgcaacaaatccaataaaaaaacaatatttatgctacatatatgcaattatggtttatggaggacatccacgtttttcaagaaaaagactttcctaytgaatgaagttgttaaaaagcaaacttttattctcttacaatgatagagttctcaaatgagcatttttatactctgaagattactactatagatagtctc

SEQ ID NO: 32544 - DNA, 201 bp, Bos taurus
atagcttgttttatgtgactgtttactataagtttctaatgttgtataaataaaaaacttgaaaatcttactttttaaagccaactatacatggcagaggkgtctagtctgatagataagcttataatgtccactgaaacaagaaaaagaaatttaattgaaaatctattccaacccatctctatatctccaaaagaaaag

SEQ ID NO: 32545 - DNA, 201 bp, Bos taurus
tgttaagtctggagagcttaagtttggacagctgttcctctctttgtctcctttcctgtttcctgtgttctaagggatgccttatagtaaacctattccarcttggtggggcctggatttccatcagcgacgtttagaatcaccataaaaggaattccctgggagcctagtgaactaaggtcccgcaagctgtgtcagttc

SEQ ID NO: 32546 - DNA, 201 bp, Bos taurus
ccaagtgtgagttcttggcttcacacaggaaaaaactcaagagcaagccgtaagaaagtgaaaggtttattcaggaaggaaacacattccatagtcggagygtgggccatctcagaaggcaagagaggcaccagggtttgcgcttgtcagtttttataggggtgggtaatttcatagggtaatgaatggcaggagtattcc

SEQ ID NO: 32547 - DNA, 201 bp, Bos taurus
ctttattttgtacttctaggccaaatttgcctgttactccaggtatctcttgacttcctacttttgcattccagtcccctatgatgaaaaggacatctttkggggaattagtactagaaggtcttttagatcttcatagaaccattcaatttcagtttcttcagcattactggttggagcatagacttggattactgtgat

SEQ ID NO: 32548 - DNA, 201 bp, Bos taurus
ttctctagggaacccaatgtgctttgcaaacgtattaaataattaactctctcaaatctgagtgaagtggaaaggcagtgaaaatattccaggaagagccragcaggttggtgagtgatgaccagatgtgttgctttgaaaaggcaaatccacatggcacctggcagagaccacaggacacgaggcttcttctgggggctg

SEQ ID NO: 32549 - DNA, 201 bp, Bos taurus
tttggctgtcccacaaatgagacagttggtggctgaagagggtgacacatgcaagacaagttggacagccaaagccaaggtcagcaggcaaggcctcaaaycaagccagtgccatgaaagtgatgggcaagggaagcaggagtgagtgggtcttgaacctgaagctggccatcaggcacatgaggctgggtctagacaccc

SEQ ID NO: 32550 - DNA, 201 bp, Bos taurus
gacctcaccaccccattccctgcctctcagcctgatgcctcacttgaagacagctcttgtaggttcaggagccctgcttgcaaagctctgtgtgaggcacyaggggccccagatgtcaggcacccctgggtgttctttggagccagagatgctacctctcatctgcggtcatagttcaaggagctggggtacagggatctc

SEQ ID NO: 32551 - DNA, 201 bp, Bos taurus
agccctcaacgtatttcttctcatgcctcataggtcaggcctgggttattggacaatggaaataggatttcctttgtttagaacaatcaggattcattgtycctgggctaggcgagtggcccaccttcctgagcacattgctggcccatatttgaacaaaatggaggttgtcttaggaaggaagaagagagggagtgacac

SEQ ID NO: 32552 - DNA, 201 bp, Bos taurus
tgcagggtacgggccactctgggcagcaccaacacagactcagacacccagaccttcctctcactttcccttctcttctctctcttctgctccaggagtgyggagtctggggaaatcctgaacgagctcatcaggatgcagctgctgggcggctcaatcctacttaatgtctatgtcagcacatccctcgcctcttttaag

SEQ ID NO: 32553 - DNA, 201 bp, Bos taurus
ctcctgggtagcttggcagtaagccctgagaggtcctcctgagaagcaggcttggggactctgccactgttacacaggatggggatgaggcttaggaaaaygaagttataggaccaggccagtaagtgcaggggctaaggactctcatcaagaggcatttggctccagtagctcaatgaataattgggtagctgaaatttt

SEQ ID NO: 32554 - DNA, 201 bp, Bos taurus
tctgaaaatttattcatcaactaaagtttctctacagagaaaaggcaaacagaagacatggggagagccctgttctgggaaggtcctgtagggtcctgatmagttgcaattagatgattaaaagtgtggttgaaaactttcttacctgtgggttttggcctttgactctgcaaagtatagtggttcttctcttctcattaa

SEQ ID NO: 32555 - DNA, 201 bp, Bos taurus
ttcataaatatggtaatttcaggatgtttctagatgtagtaataaaggtttaatgccactttattattaaatataagcaaatgccaagttcacaattcacrgtgaataagaaatgccttcacattgggttcctacagcttctgcctctgagtgatcttttattagtgatggattatgcaaatctcaaatgaagctttgtcc

SEQ ID NO: 32556 - DNA, 201 bp, Bos taurus
ctcttgcttgaattttcaaaccataccatttagcgcaatgtcctctaaggaaaggtactattttctgatccacaaaacatgtaataggtaaggagaggccmtacaagtagatgaaagttacttcttttccttgaatagtgagaaaaacatcttctaagaaatgtttttcagggtttagtcgaggattgcaacctctggccc

SEQ ID NO: 32557 - DNA, 201 bp, Bos taurus
tacaattaagtgttgcttttagagttgttatttggatatgatgcttgttaaacaatgtagaaagatattaaaagaagtgatgtgaaggtaggcctctgagrtggacccattttgcttctattctgaggatgacagctttttaaatatttcactttcttcaacccaagaatcccacattcttctacattaccttagaaactt

SEQ ID NO: 32558 - DNA, 201 bp, Bos taurus
atacatgaacaagtgacttataatggaaaataagtgtaatggagatggtccacatctgggtcatgttaatgccaaggaggttatgcaagaaataggaaagraataggctgacatcattcccattgaatgaacaggaattctgttgactggaagacatatggctccttgaataaaaggagtactgaataaatgagttactta

SEQ ID NO: 32559 - DNA, 201 bp, Bos taurus
cccactataattgtcaccctgccatttaatttctgtcatatgagttttctaaaatttaaatatagtcatcttgcttactgatccagattttccagtggctmttagaaccttatgataaaattatgtgccttttgcatgatagatgaagccttcataattggacacctgcccacctccattacatcattcctttttacacat

SEQ ID NO: 32560 - DNA, 201 bp, Bos taurus
gcctgcttacccctaccaaatgaatcagagactgaatattcatctgaagttgttgttcctaaaacactttgccaagtccaggaatcttttcagttgacagmgatattttcctctacaaagcagagtaagtctggctgcctattccaccattttgtcaggttcattgtggtgatatatttcttccttttatagatgaagcta

SEQ ID NO: 32561 - DNA, 201 bp, Bos taurus
ttgatttatgacattattattatttttgtcttctagtctgcatttctcactataatgaaagatttttttgttgttagtttacttataatcatagtagttartggaatcactagacataataaatactcagaaaacattgttcaaaattccctgaattgcctcattgtattgcctcccaagactctcagacggaagttagca

SEQ ID NO: 32562 - DNA, 201 bp, Bos taurus
gaatgttttaccatggaccatggacagggattatctttgctgagttatatataggcaagctgcttatacaaataagaactcctgcaaggaaggcaggtagrtagatgatgataacaaccaacggtgtaggctgtacattttttgcatatttatatcaacaatatctgaaagcatacaaagcatagttgaaaatactagtaa

SEQ ID NO: 32563 - DNA, 201 bp, Bos taurus
catagtcaccactcagttccaaaaagacagacctccaactggtctcccatggtcattctagcacgttctaattccttccttgcactgtaataagagatgtyttcaaaattcaaatctcctcatgacatttgctgtgataaaatatctctatgtgttgcccaagctcttaggtttaaagatcaacatccttgcagacagtct

SEQ ID NO: 32564 - DNA, 201 bp, Bos taurus
gtaagagtatataatcatggactgggaaattttgtggtctgaagtcccatgtctttgccttttctctttcttttcatttagatgttgacctaaaaaggtayggatcatttttaaatgtgatttcagctcagctaacagcataaacttgggacttggaaaattatttttgttagttctgataataaaatatttaagaatgct

SEQ ID NO: 32565 - DNA, 201 bp, Bos taurus
tgaattaatctattcattttcatatccattttctaattaactgatataaacagttcaggtactgcctgatagtttattgctgcatggcaaaatgcctcaakggatgtgcaattctaaaaatggttctgcaattatagtagttttatttatccataggcacttaatgcatcaagcagcttctaattgctaacgaagaaagac

SEQ ID NO: 32566 - DNA, 201 bp, Bos taurus
cgcttctctttgcatcttttgggtcggcccaccctcatgccttgaggatatattttcctttgtttgccaaacaaaactgagctataacactggtccatccrttgcttcaaatttttcctgtggccagaaagaaccgagtaaatcacacattctgtagacatatatggtgccatgactcggatttaacctgcctgaaataac

SEQ ID NO: 32567 - DNA, 201 bp, Bos taurus
atattcttgagagatcatatcaccaaccttggaatttaatgttaagtatgacaatgagtttttaatcttatttgaattatttcaatttgatgtttctttcrgccaaagttatcctcattgattccaaaggaaaatgagatggatacaacattaaaattgtaaaattatgaatgtttctgggaatagattttgtgatcttag

SEQ ID NO: 32568 - DNA, 201 bp, Bos taurus
aagcttcagcgcatcctctacagtgtgagctagttgtgtggttcaggcatcattggaacacctgacgcatgtaccttcttccatttttccatacctgtgcytcctttaatcaacatcatcagtagaatgggagctatcaatttaaatgcccaaactaaagaaaaacatcattttgaatgatataatttgcaacaaggctta

SEQ ID NO: 32569 - DNA, 201 bp, Bos taurus
aagtaaataaactatttcgagaaaaaataaacttaaatgtaaatatcataagatttcaaaaggtggtaggttattagcacatagcctttgctatcagtagrgcttcagcttaaatactgaaaaggaagttattcaccttttgaaattaaaaattcacttataaactatgaataactgaaccaattttataaaattgttgtg

SEQ ID NO: 32570 - DNA, 201 bp, Bos taurus
tatataaataatacaaataaatataaatgagccaactgattatagtgtgactcttgggatgattctttagtacttttcagtattataattttggcaaatayaaattcttctcaatgaagtctggtgctctttccctctaagtgagaaggatgacagtcctttatactttgtcctaaggctggtgtattccacaggttatac

SEQ ID NO: 32571 - DNA, 201 bp, Bos taurus
gagccatcgccaccaggtaagccccaaattgggttgtactggccaataatctcaggggtggagatttcaaccaatgtgggataacctttgtgttgtgatawggtctacatgtaagcgaaggccaggcttctcccaaaaagggtccaacttgcttttctttattgtttttccttttttcactattctctattatgtgggatg

SEQ ID NO: 32572 - DNA, 201 bp, Bos taurus
gtactcctttgtgtgagccctcccaggggttgctattagctctgcttaacaatctgtaggttccagtgctgggatgcctcaggccaaacaaccaacaaaayggaaatagccccacccattagcagagaggctgcttgaagttttcctaagcatagctctgcccagcagagggacaagacctagatccacccaccagagaag

SEQ ID NO: 32573 - DNA, 201 bp, Bos taurus
aaatactaaaaactactgagaaaaagacagcattagtcatggtctgccatttagcaactaaacacagaagcctcatgtgtgttgcatgggttgatatttayattggcttgtttttacagctcagagcatccttatataaaagacttgaatatttttgtataattctaataactatgtttattattaatatatcctgtgagt

SEQ ID NO: 32574 - DNA, 201 bp, Bos taurus
ttgtgtgtattattaaactctcatggtgtattggctacctattacaacataccaaattactgcaaacagtgacttatagcaacaaagataattctaacatrtattattacaattaaacttcttatctagacagtatatttaagacaactaaaccttttatctagacagtgcatttaagtccaataataaagttattggatt

SEQ ID NO: 32575 - DNA, 201 bp, Bos taurus
ggctctctgatgatatttttatgaaagtgattttctactgctttttttcagtacatgtgctccttttgtagaaaacattagagcaaaaacttgttcatttytgtgtgcttgcaaaataagcaagtgtccttatgtaacgtaattatgcattacagaactagtcaagaggtaaagacaagtcaatgtgggtgtgtttatagt

SEQ ID NO: 32576 - DNA, 201 bp, Bos taurus
ctttctgtttaatattctcccaagccttagttctgctctgtaaagcaacacaaaacatatttttgatttatctcttactaaagcttatgtagttcaaatgkgtcaaaatgtagacttctgagtcttgtgtcttattttctctctagtgcaattgcaaacttttcaagatcctctccaggtctcttatagtatgcatttaag

SEQ ID NO: 32577 - DNA, 201 bp, Bos taurus
tggtaaactatacactgtgagaaaactccacttttattatctcaaaacttctgtaaattgtgttattttaaagagtgaaagaggcagcgacaaattcggtrcacctcttggttgggaaaacaaagattcagtggactcaaacattggaaaaaaagagaaatttaagtctcttggtcacctgtgatgttattaggagatgct

SEQ ID NO: 32578 - DNA, 201 bp, Bos taurus
ttttaaacctttccattttacaagaacctttttttctatcaatttcctaaagcagccctatagatatgttcttggcaatgatgaaaaattactatagcttytgtgaaaaaatatgaacgtataatgggtatgcatgtgcataaaatttgaagttcattttttagctcattatgtctgtctaactttttacgcacatcattg

SEQ ID NO: 32579 - DNA, 201 bp, Bos taurus
ctaataataacaatatcaaaaaataatagcaaaaattgacttaacttttactaggaactagactttgcaataaaaatattatgcagaagagctcatttaaycctaatcataaaatttattttcaagcagtaaaaaccaagtttgcaatttagtattttaaactgaagatggctttgggaaccaataggtggagatcagctc

SEQ ID NO: 32580 - DNA, 201 bp, Bos taurus
tgtcacattcactcactgttgaacttcactaagtgagatgagtgtcacagagttcattacagctgactcactttaagccaaacaggctagcgcagttgggyattccgggcccctccttgaaacacaaataaaacattttacaacaggaagctagcttttggctgtcacaattttcaaaaataaagtagcaagtgacagacg

SEQ ID NO: 32581 - DNA, 201 bp, Bos taurus
acctgatatcatgtcatgcctccaagcatgacattcacttttactgtcctgtcaatggagtgctctactaacccctacactattccttggtaggcaaaackcaatcatttcccaatctagattaaatgatcttccctcagatatagacttctatagtacaagactttgtgcatttacagtttctcagtatttgtgttatct

SEQ ID NO: 32582 - DNA, 201 bp, Bos taurus
ataggtgtggttttttggagctcataggaagcagtgcaggtaccataacaggaaattaagagctttctagaattcaaaatttctctctcaaaccccagctrgtgtctcctgttaccagttctaaatgccaaagaaaggaattctgattgactcagtttgaatcgtctgcctggtgcattggtcaaagcctcgggtacagac

SEQ ID NO: 32583 - DNA, 201 bp, Bos taurus
ggaaatagcaacctattctagtattcttgcctaggaaatcccatggacagaggagcctggtgagctgcagtccataaggtcactaaaagtcagatatgacmgagcaactgagcattgatacaaaagataatgtacatggaatttaatgattctataagttacacaaattttgtaatgcctttctggggtggttaagtgatc

SEQ ID NO: 32584 - DNA, 201 bp, Bos taurus
aaactgactcttcttacaggaagcatgctcgatttgttattttttaaaaaattatcttgctttaatataatgctgccacaatgtctttatcagggaaatarccatttccattttccattgtaaaattaaaatatgaaatgcaatatgacagttacctgataagggaaagttattatgcttctttgtggcatatccaagtaa

SEQ ID NO: 32585 - DNA, 201 bp, Bos taurus
agatgtacacaagaagcaggtcatgttaggtaggtcctggcgaatgcagtggagctgaagtaagataattgttattagtgaagttgatgaacaaagagaayggcagattatgaagataaccgtaggcaagttgatctcagaaaagcacctgacatcctcacacagttggatatctttttaacacatatgagaggccactga

SEQ ID NO: 32586 - DNA, 201 bp, Bos taurus
aagtgtcttttcagccatcagaaaaagatacaattatcttcagtattattttagtgctaactctttgacttcatacccaggtgtggaaactctaccttatrtggatattgtgcactgtaggattttccttggaatacatgagtattagataaataaggcaagacacaaggttcaaatgatgctgaataaagaaaagaatgg

SEQ ID NO: 32587 - DNA, 201 bp, Bos taurus
aatacaagagaaaaaaatgttaataggataagtaccaaaaaggattaagtgatgctaaatagcaaagaggattagttattatcctgcctttacaggcaccyaaatttcatgtggccaagtagataggaaatagaaaaccaatgctacaaaatgggacctttttcttctctttgcaataagcttatattaaaatcagtttta

SEQ ID NO: 32588 - DNA, 201 bp, Bos taurus
gctgattaacagatgaccagaatacttaatatgttagaaaaagaacatctctcttagttggaaaaaaaaattgaaattgcacagttactggacagagatamaaataaactaggaaagtaggggagtgtagagtcctaaggtgtgacaataccaataaacagagaaccaaaatgaataaggaatactagtctgaattaaaag

SEQ ID NO: 32589 - DNA, 201 bp, Bos taurus
ttatatttgctcccttgtattgccttgaattccttttcaaagatcagttaactatacttacaagggtttattttagtattttctgttctgttgttttgttrttgtttatttgctaagtcgtgttggcctcttttgcaaccccatggagtgtggagccaccaggctcttctgtccatgaaattctccagtcaagaatactgg

SEQ ID NO: 32590 - DNA, 201 bp, Bos taurus
tcaaccatcaggtggtagcctgaggtttgggtaaaacagtgaagatgattgcattcccttgtccatggccattggctcaggtaatttcaatttaatcttayctgtatgtgacattacctgaaggtagatacccctgaagggtggttcagtcaatgaaaacctcagaatggtttttaatggttgtgactgaaagcaatttct

SEQ ID NO: 32591 - DNA, 201 bp, Bos taurus
atctttatgtatatagctaatttcacaaattaaactccttttggagttggtattattattcttattttactaagtaaagaatgaaaataaggaaacaacamaatatctttccacagttgtataccttagaaattggttacatctgacaccaaatgctatcaggttagctctcttttggaaaattgagaggagaccaataac

SEQ ID NO: 32592 - DNA, 201 bp, Bos taurus
gctgagaactaaactaaaggtaaaaatgtcaagaaattgaaatatctctactactgagaaagtgtcttgataatgcactttaggtctataggcaaatgggyctatgttaaatatacttgattcccttgtcacagcagcattggtcaactgcagaccttcacctgcaggagcagaagctgttctgactattttgatgaaagc

SEQ ID NO: 32593 - DNA, 201 bp, Bos taurus
ttcattttatactcaggcagttgaatagtttatgtggcattttctaagtagtcatattcttctataaatctgtatattatgatttatttatcataaaaatmctaaaccagaaatatcctaataaaagtattcctttggtgaagacttatatcaaagattattagtctatttatcaagagctcagttttttagtatacatac

SEQ ID NO: 32594 - DNA, 201 bp, Bos taurus
aaaagtatcttagataatgtctatctattttgtccatcactgtaattaagtaaatatagcgatatctgatgtgtaagacaggctaaatccatatttgtaarttaattttcaagggaataaaaaataattgagctgtgaatagcaattttagctgcatattgctgagaggtaatagacataattgctacataagaaaatggc

SEQ ID NO: 32595 - DNA, 201 bp, Bos taurus
gcaaggcatatagtcattttaaatctgctcagcttaatgttgtgtaatcattaaaagcaaacaaataagcacaaactaatactatacataggcttgcatayataaaagaacctccagatagtgtgctaattaagaaaaacttacctaagattctcccccaaagaagagactgaatgaaagcctaggagacgagtttattag

SEQ ID NO: 32596 - DNA, 201 bp, Bos taurus
gacaccttttcccaaagctatattattgtttctctagactgtccctcacttgtctctgtatcctctccctttcctaattggtaactgtttgaacctcctcyttggaactgagggaaggtcataaatgaagcctatttcctatagtcaagaaattggggacatagaaatacagggtcctgcactctatcagtcaaattcaga

SEQ ID NO: 32597 - DNA, 201 bp, Bos taurus
agagagttttgagatacaagaatatagcctaatggatgaacgggtaagggcatttgaagcagacgttcaatctttgatacagccagcaggagcctcgagtrgctaagtttttgttgtgcagtttttggaagaacaggaatgaactgtatattcataaaagtcagttgttttatgagcagtccaaacaaggtgaaacttgaa

SEQ ID NO: 32598 - DNA, 201 bp, Bos taurus
cctatttaattgttgtggcaccattggtgaaaatcaattgaccatagtttgtttctggagtcaattctattctattgacatatagtcctagccttatgccrgtagctttttgtgtattgccttgtagctttttgcaaatcttgaaatcaagaactttatgtccaacttggttcttttttcaaggttcttttagctattctg

SEQ ID NO: 32599 - DNA, 201 bp, Bos taurus
agaaggttatttgtgaaggatggaggaggacacagtattttgtgtagcagagaaatttaaatattttaaaatataagtaactttttatcacaccatagtgktgtttggatacatggtctcttctttcacatttcattccaaacctcagaatggtcttggaatggtaccccattcctcagaagtaaaccccccaaattctcc

SEQ ID NO: 32600 - DNA, 201 bp, Bos taurus
taaatcaggaatatatacacaacattcaacattaattatagcacaggtccctctttgtgctgaaactatggttagtttcaagatgatactggcaagtcttygtagcagcagttaattgtagagcttcacctcttcttctttaagatgatcttggtttcatggggatcagtgcggtccttttgtatagtccactcagcgtct

SEQ ID NO: 32601 - DNA, 201 bp, Bos taurus
catgggggaagtctgctctccccatgccagatatggtgcacagcccaggcactacagtctctgagaggagttgtgttcaaggatacaaactagccagtcamactgtttccagtatttgggctccattctaagcaccttcattcctaggtctcttatcgaaggccttggccagagatattcttcaggtacttctgctgatgc

SEQ ID NO: 32602 - DNA, 201 bp, Bos taurus
gtgtaatgtgtccagatataatgccacttgataacattctaaattttatctttaattgttctgtttcacacactcatcttgtgaaacaggtgatgagcttkgtgagaacagaggagtatttgtagcaatagattgtttagtgctaaagagaatgtactttagaactgaatcttggtttttcaacttaaaaactatgtaact

SEQ ID NO: 32603 - DNA, 201 bp, Bos taurus
catcacatcacttcctgtgtagaataaataattacttaccttattaagggtacatcctgtaccacagtgaaaaggaattggactgagcagccaaaaaatgmtatgacttaaaagaataagaaaatattttcattcagcatattttcgttctgaatttacatattaacctcacaacattaattcttgccaaagacaattata

SEQ ID NO: 32604 - DNA, 201 bp, Bos taurus
aaaaatagttatcattttcctttgccttgttgctttaatttggctatcccttccgaacttagccctctatgaagtccccaaactattcatgagctgtttcycttcccatgattctcctaaaagtaagcttgacggtaaggcaggtgttcttgcacctcattcccagtttcataccattttgttctttatttcactaaaaat

SEQ ID NO: 32605 - DNA, 201 bp, Bos taurus
tttgcagaagatgtatctaaaactggtctatatttgtcatactatctctacctactcatccctaccaagagacctgtgaaatttcactgttaattatgaayggagagtggggtttggggatgaaatggagagagagagaaaagagatgagaagagagatgagaagggagacagaattggtaatcttcatggaacaaagtga

SEQ ID NO: 32606 - DNA, 201 bp, Bos taurus
caatatttttaagtcccttgcaagttttaaacttgcaagtgagacctttctgaatttacatggaagatatgtctcttggtgtagaaagtaattcatttgtrttattcacaagagaattataattataaagatttatggaaagtacaaatgactttcctttaattcttaccaggatttcagatggctttgttgtagagaaat

SEQ ID NO: 32607 - DNA, 201 bp, Bos taurus
ttatctttattaggtaaaagcattgaatatcatgttgcttattcaaagcaattattgagcgaggcaggaaaaacaaaatctgcacatagtattctagagaytgataaatgaataaggcaaagagaaaagctattttaaaagtaagttttatttttgtatattttggaattaaggtttttcaaataatagattttaaatatg

SEQ ID NO: 32608 - DNA, 201 bp, Bos taurus
acagggagacctggcgtaccgcagtccatggggtcacaaagagtcggttatgactgagcaactgaactgaagcaacatctccccagttcccccacccccasgtctctagttccactctttgattttatgagtttaggttttttgtattccacatataactgatataatacagtgtttatctttctctttctgactcaattc

SEQ ID NO: 32609 - DNA, 201 bp, Bos taurus
tccaccctgttctcaaccctcttttcttatcatcagtcctctcctgccctgtacacacacacacacacacatacatgataaaaaaatatgatccattctaytagagatttcacttaacattgattgtactggaaatgggtgaacttagatctgacaaaattgtaaaattcctggataatttgcctaataagagtgatttta

SEQ ID NO: 32610 - DNA, 201 bp, Bos taurus
tcccagctgttattaacactatttttcattctaactaaatctactttttatcagagcccccacagaaacttgctcgtacttcctgctgctccttggttcaratccttgacttcctatatatataatcccattcttcagaaagcatagtcctccaacatgagcataatgagagagaaaatggtaaatgacagttgcctcgtt

SEQ ID NO: 32611 - DNA, 201 bp, Bos taurus
acacattcaagaatcacaagttttaaaccaattaaagaaacaattgctttatgcttagctaccctgttacctgaaaacaaaccttccacacaatcactgarataaattttttcagaatacatttagtgttttctccccttgtaaagatttatggtaggatggaggaaaaaatatattaccatattatctgaattaaaatta

SEQ ID NO: 32612 - DNA, 201 bp, Bos taurus
gatgttggcatctctgtgttgcatgcaattttaacaacctggggtgaggacctcaaagtcttgctcaacatattcttctccttccagccttttagtaactyatcactataacttcaacatttcatcagtgattaaaagaagcataaactcacctttcttttcttactgtactccacttttttacttatcatcgatttgtga

SEQ ID NO: 32613 - DNA, 201 bp, Bos taurus
gagaaaattacaattgtcagttatgatagaggcagacagttggtcctggcctgaataatataaccctactagaaagaagcctaaggcaaaccttgtagtgrgaaagtaaaaacaaaaggaatacactgaaaaattcactttatttgtccttgtgatcagtcaccaaaaggtttttgtcaagattggtggcattattagtgt

SEQ ID NO: 32614 - DNA, 201 bp, Bos taurus
tgggacacttggacatcagccccttagatttttaagccaggcattttgggagctcatctctctggtgtcaaatccatgggccagggtgtctgatgtggggytccatgccctttgtcttccaggagataaatccttctaagaacatcttgtggccaggccaggaatggggttttgagtgagaacttttctctgtctctctta

SEQ ID NO: 32615 - DNA, 201 bp, Bos taurus
taaatttatatttcagttgagtttggaattatatctctccactgagaagagagagttttagtgtgtggatttaaaataaacttttctttaccaaaaatatrtagtgaacttcactggtagaaatgagaaacaatagagagcttagttataatatatagcatgctagaggcaggctcagatcatagaattatagacggttag

SEQ ID NO: 32616 - DNA, 201 bp, Bos taurus
gtgtattatgggagtgggtctggtaagatctttctattgttagctctaatcctgccattttaaaatgtaaattgtggaagtggtgctagtaagacctttamaaccttgagatattcttttgattaactgtaataaccaactgcagtgtaatataattatataatggttactgtaataaccatgaaaagtatgaaaatacaa

SEQ ID NO: 32617 - DNA, 201 bp, Bos taurus
caggacctgggctcaaatcttgtttctagtgggtagcacaacttctatgttgagctgcctcctgttgcatagtaacctgaaacatccccaaccacctgtcrggggatattggtcttttattaggcattgttttggaggagttcattatgttttggcagatttcaaataccacagaaattattcaagacattaactttcttt

SEQ ID NO: 32618 - DNA, 201 bp, Bos taurus
ctaaactattttttagtgacttgaacctcaagtgattttagtaaatcaagactgcttccgtcaggctagtctgtcataagagcaaaataggcataaaccaytgcatttttttaagggcttttgttttcctgagtgagatactgctaaatttcaaggttgcttttcagttaaatgtgacatatagaatataaccttgcatcc

SEQ ID NO: 32619 - DNA, 201 bp, Bos taurus
cagggagtctagtaaaatcccacacaatcttgactacaaggattgttatgaaaatataactctaattcagtttattaaacataaaagttatcttatgtggmattaaatttggcactgcctttccataaaccatgccagatacagatagaacttccttaggtttgttcatttctcatcagctaagaagttaaactaatctta

SEQ ID NO: 32620 - DNA, 201 bp, Bos taurus
tccaggatcataaataagcatagggaaaagtgaacttaggattgagatagcatgagtaaatatcttgtccaatcatgtccacaaaataatattacattaamaaatgtattgatggaaacacacagatacacacgaagcagaatgatggtcaagctcttctcaggggaataatgattagaataataatgttttggttcctgg

SEQ ID NO: 32621 - DNA, 201 bp, Bos taurus
taaaagctgtagtatgtgttgtcatggcaatagtgttttgtttacagaacttgccttttttagaacttgtcctttaaatggtaggaaagattcactttagkcttaacgttgtattatactcttagctttcattagtgaaatattatttgttcttttttcagtaagaagcacaaaatattccattgctcagtttgtgcattt

SEQ ID NO: 32622 - DNA, 201 bp, Bos taurus
ttcttgcctgggaaatcccatggacagaggatactggtgggctacagtccatagggtcataaagaaatggacacagctaaagcgacagcatacacgtacakatggcccacacacaggaaaaaaaaaagaagccaaagctgcctgatggaggaccaagatgttgggtttaacagacaaaaacatcaaaggaaccattataaa

SEQ ID NO: 32623 - DNA, 201 bp, Bos taurus
agattatagataagaatattttaaaatttgagtttcttctaacctcaggagtctatagattaaaatatttgcttgacctttaatacaagcaggaacccaayaattccagcaataattacaaaaatattactacctcccgtttattaagcatttattttcctgtttatcttacttgagaccttttcaattgttttcttttgt

SEQ ID NO: 32624 - DNA, 201 bp, Bos taurus
actttattgactctattttctcaatatgagatgaaaattaacactgacatttctagcagagatcacaaagagaaggaaatgggatcaattacatgtgatamaatggttgtacaattagaataaccaacacaaccaaggtgggttgtggcctcaaataagctcaactgttctccttccaaggctttaaaggaactcgcattt

SEQ ID NO: 32625 - DNA, 201 bp, Bos taurus
aatggatatgttatgaatttccagaaaatactgttgaatgaaagagtcacagaaaagagggcatggtaggagtctgttctctttagaagaaatactaacaratagcaattctatatgtgtgcctgatggatgggagtacttatgcacattcatatatacatattacagtactaccatatggatagcagtaaaagatgaaag

SEQ ID NO: 32626 - DNA, 201 bp, Bos taurus
aaatcttagactcttctcatattattccattcactgtttacataaagttgtacattttgtgagagaactttcactagggaactatttctctaaaatttctmtaaagacaaaaaagtacacacacacagacacacagacacttctcaatggagcttacccacacacacacacacacacacactactcaatggagcttaccca

SEQ ID NO: 32627 - DNA, 201 bp, Bos taurus
actctaagaggaatagaagataacatatctggttataaaataccaaaataaaatgtatttttgttcagggtttgcctacaaaagagaaaatcaaagtgagmaaaattttaaaatctgaattccatgatgtccttgattttataagattttatttcaatgaaatgaaaacaaagtatctcctttaaattttttcacttgata

SEQ ID NO: 32628 - DNA, 201 bp, Bos taurus
ttccctgcaaacgcaactttgagaaatggcccagagagccaacgttttgcgttcttggaatacccaaagagaatgtgcagggacattcaggcctatggtarattgcttctctcagcataggctgcaaagccattgaaaacctggctttcttgggcatgccactgtctcggattaccaaataaagcaggtaaggaggaagat

SEQ ID NO: 32629 - DNA, 201 bp, Bos taurus
tggatataatattccctgagttttggctgtttttataacctgataaatctgtttttataaccatgataattgaaggacagtttggttggaagtaaaatccrtggcttacatatttctatccttaagcagtttttaatgatattgtatggttgtctttattttttctgttattgtcaaaaaatcagaggtcaagtgattttt

SEQ ID NO: 32630 - DNA, 201 bp, Bos taurus
tctttcttaaaatgagctgtgcttagattctctttcctaattcagttagcatttttcttaaattcttgtctgggagacagattatccctgtttcattgtcyggcccccctccaccccacccaggggttctctcttgctcttttaattgagagtagttcctctgccttttgatcttaaactttctctgtctctatgaatcta

SEQ ID NO: 32631 - DNA, 201 bp, Bos taurus
tgctggccattacaggtactgtaactgaaccatttcaaaacttgctacacagtgtgagcaagaatattatctaagaaaccagactactggacttctatcarttaaccctattagtcaacgctctgatgatgaagatcttaatctcacattgcatcactttttagtctccaggggctaaagaataaaaagatacagattcag

SEQ ID NO: 32632 - DNA, 201 bp, Bos taurus
ctgtatctttgtggtatttgttactacatgacatctgtagacttctaccagaggatagaaatcttgtctatggttcactgctgaaggtcttaactttgaayaccatcaggcacataaaaggtgctcaataaatgtgtgctgaaagactccctctcaactttgagatgatttaaggtaacaagtggaaagtacaaagtttta

SEQ ID NO: 32633 - DNA, 201 bp, Bos taurus
gagtctcccagagaacaggagcctgtctggaatgtactgtcttctgcctctggtgctgtactctccctaatgaaaggaggggcctggagaggaggcagcargcttctctgggtttctcctcacaccctggactcctccagtatcaagtcctgtaatgccttggcctctgtacaatgtgccaatggaggggcaggcagcaat

SEQ ID NO: 32634 - DNA, 201 bp, Bos taurus
cctgcctcttgggtccctggaaactagaatgggaaggaaagagacatggtaatcggatcttccagaaagcaggtggaaaatggccccaagctttggaaatwatactcttacaagagaggaaataccatgtacacatatgtgtcctaggtaaacaggaaattctctctcaggtggcagagggtggggccagctttggtctct

SEQ ID NO: 32635 - DNA, 201 bp, Bos taurus
tcctcccttgtgttacgacttaagcacaaaatctgggtcttcctttgctctaattatggcttcagttatccctactgtataaacaataattcccatagacytcatctctttctctaatttggctttcatcagctcctggatttccaaatgtatctaaggcatttctgggacaaccttccaaacctataatatcctgaatta

SEQ ID NO: 32636 - DNA, 201 bp, Bos taurus
agttttaagctctggaaaatgtcatttctttaagcatggataaaaagaaacactggaaaatagaagtaaaatatttcatcatttttgaggttttgcacttytactctctgcttcttggaccctacttattattggctcatctttctctttgaaccatgtttatctgctttgttactaacctccactaacataaaaaggcga

SEQ ID NO: 32637 - DNA, 201 bp, Bos taurus
ttaaagtccctaggaaggcccatttaccgtttctcaatctgccacacccagccgctggttttccttctggtgttagggtatgagccctttcttcaactgaracggcaggcttatatttaggggccacgttgtgtcaaaataggtgtgtgcatgtgcatgtgtgtgaccatctgcctgtgcctgcatactgctttgtaggtg

SEQ ID NO: 32638 - DNA, 201 bp, Bos taurus
aggcagtaccatagggcttggtgcagttagcaaaaggacgcatcatcatccattcccttaggtttccctaagggagaactgccctgggctctgtgagggtkggggcatgacctggcctgagaggccagaatggcttctctgagggaagcctgtcccgccaagctgggaaggataagagggatctgatcaggcaaagtgggt

SEQ ID NO: 32639 - DNA, 201 bp, Bos taurus
ggaagactccatgatataaatgaaaaattttctgaagcccagctccaccatttgctagttgtgtaaccttatatgagttagttaagcttgctaaaccattytctatattcataagatggagctagtaatgcgtatctccaagttacgggaagaagacgaaataatgaatgtcaagcaccaaacgcaaactgggtgttcaag

SEQ ID NO: 32640 - DNA, 201 bp, Bos taurus
tcaactcttgactgctagggacaaatgggtagtttagtatgttttcatggcttcagagtccatgtatggcaggtatagagccaggagtaggagccccgccrggagtggggccccttggcaacagtggcacccattccagcagggtatcctggtcgttcgttcctgtgctgactgtctcatctcccttgatgcccatctgtt

SEQ ID NO: 32641 - DNA, 201 bp, Bos taurus
ttgaggtttttgggccaggttgtgctaattgctttatataatttatctcaatctatacaacaactctcttgagaggatagtcttttatttcagttttacargagaggaatctgggcctttgaaaggtcaagtcactcgcccaagggcacagagctagtaagtaatagagccagaattactgtctgtaataaaatggattgt

SEQ ID NO: 32642 - DNA, 201 bp, Bos taurus
tcaaaattggggcaggactagggtgaggcagtcacatgctccgagtgcaaattttaaggaggcactcacttttagggccctgcaagtatggaccctgtgcrcacatgaccctgacagtgagtgcctcctttatattttgcatcctaggggcccaccttcctcaccctactcactgctactctacagctgggacaccgctgc

SEQ ID NO: 32643 - DNA, 201 bp, Bos taurus
ccggttagatgaaggagacaaaggaaggattggtctgatacccacccaaggtggaccggagtgagaagagctgggcctggttaggagggaatagcagaacygtaggaaagagggcttgttctgggcagtacatgaagccctgccaggaaacgcacggacacctctagcacacagggagcccctccttgctctgggcctggc

SEQ ID NO: 32644 - DNA, 201 bp, Bos taurus
ccaattgttttaaaatgaggtggtttctagtatctgctaataggagcaataaatttttaaaaatcattatcattatgaactcatgaattgtagtttattgmaataaaagtccttactgaggctcaaattttcccatctttggcaagtgagatccttttcagattgggtcttgtgtctgttcacaatatgacccttgtaatc

SEQ ID NO: 32645 - DNA, 201 bp, Bos taurus
gctccagcaaagggcagccgccactccttacctctgacgcggggtagcttgtctcagccactgcccccaacctctggcccggggtagctcctctcagccaygctcctgccctgagcacaagtatctctttaagtatctctcttcagttcagttcagtcgctcagacatgtccgactctttgcaaccccatgaatcgcagca

SEQ ID NO: 32646 - DNA, 201 bp, Bos taurus
gggagagcaagacaccactgttccaacctgctggaggatcgcatggaacagagctgtgccagacccagccccagggctcgtgcacatgggggcctccagarcagagaactctgcccatagagcttgggcagaggtggtgtcattccctaggcattaccattcctcctttcacaggaccctatgacaccaaagcacgagacc

SEQ ID NO: 32647 - DNA, 201 bp, Bos taurus
gggaatcccacaatgtttttctaggtcttaaatcaaaagagcagtggctgtaatcattccaaggtaatgggggaggtatctgcgtgttccgtctggctacytataataccctatgggttgagactttcctggtggtacaatgaataagaatcggtctgccaaagcaggggacaggggtttgatctccagtctgggaagatt

SEQ ID NO: 32648 - DNA, 201 bp, Bos taurus
ggcatatcatttttctaagaaatgatttagaagaaagggaaagtggattgagtgtaaaatagctctgttcaaaaggcctctgttatgtttgtttgtttttmtttaaaatgtattcatttatttttgactgtggtgggtctttgttgctcacgtgggccgtctgtagtcgtgacgagcaggggctactcggtgtttcttctc

SEQ ID NO: 32649 - DNA, 201 bp, Bos taurus
ggttatgctgtctttactttttatttttaacttcagatcagtattatagcagtcagtttaaattaagcaggaggttcaaaatttcaagggcaagacaatgraggaaatagagaagggacactgctatatcctaccagagtggtaggtggcttctagatcacacaattattctccttcagcagtgcagttaacaaagcatac

SEQ ID NO: 32650 - DNA, 201 bp, Bos taurus
gaaatgggggtgacaaactcttctgaggttgaagggccacatgctctaggactcagttagtcccacaatcttacctgtgcctccctgctccttgcccccarcacgggggcaacactggccccttttaagtccttcagcatgcccagcttcctccagccttaggaactgcataaatgctataccttcagcaccacatcacat

SEQ ID NO: 32651 - DNA, 201 bp, Bos taurus
aattatccctattaagacaactattattattaacatcttccattacagataaaacaggctcaaaaagaatgaatgaatttatttacaagaggtgaagccaractgggacctaactcatttctccaaaatttctgctctcatcacaaataaataaaatgtaataaaatatggacttcccatgtaagtggtaaagaatccgcc

SEQ ID NO: 32652 - DNA, 201 bp, Bos taurus
caggtatttttgtataacacgacaaatgttagatatattgtttactgtcattattactttgaaaccggtagctattagactccccactaaatctgactatrtaatgcattaagcagcacatacaccatgacatcacatgtgtatttaactttttgacaattatatttcagtacagttggtctcttttgtaaccctttgtgt

SEQ ID NO: 32653 - DNA, 201 bp, Bos taurus
ggtggagtgcacaatcggttttggcccctgttttaggatgatccttcttggtctctgggctggatgatacggtggctatgtggccctcctcggggctagaytggggcttgtttggtttctgcagcagcacatcaccgttcccgacagtgggggaggcctggcctggctgggccttctctcccacagccccaagctggttgc

SEQ ID NO: 32654 - DNA, 201 bp, Bos taurus
gaacaaacctgttgttctggcttaagatatgcaaacagatgggtctccacaaattttagtatctttgagaggtgatactgactgcatgggtctttggcaayctgatttaaacaaatactcaccttggtcatattaatgtttgaatcaggctgtggtaagcacagtgttcctggatttgaacctggaaggaattatgaaaaa

SEQ ID NO: 32655 - DNA, 201 bp, Bos taurus
taaaattctgtgagtaatttttctatccatacctgtaagattttgttttaattaattaatttattacaggtagtccttattggttttcttttcaatataayagtgtgtacaagtcaatcccaaactctgaggaggctctacaaatagctgaggaaagaagagaggcaaaaagcaaggggaaaagggaaaggtacacccaac

SEQ ID NO: 32656 - DNA, 201 bp, Bos taurus
gggctcacctgaagacaagactctggacccagagacatctgcgtgcgtggactttgtttcttacctggatgaagatgttgagttagatgttggagtcgcaygtgtggagtggcaccaaccattgacccattacaaacacattaatgaatgttagggttgtttagaggtggagaggtggagactatatctgagccatggttg

SEQ ID NO: 32657 - DNA, 201 bp, Bos taurus
gcaaagagggaggccaggggtgtgagtccccataatgataaccatcatattaatatattaaaacccacctgtgtacaaagtgcaaggtgtatccttcttgrtctttacagttgccctgtgatgcagttattgctatgccttagctataatctcaggagacaagggtgctaagaggtgggttaccagctttccaataaaaaa

SEQ ID NO: 32658 - DNA, 201 bp, Bos taurus
agtccttcctttgcacacctcctccccaaggcctacccccaacaatctacttctgctgcagacctgggcatttacttctcacattaccacccctctgcccyccatggccttcaagggcccctttgatcagcccctgactccaaagcctcctcttcctttggtaccagcctcagatttgatgcttgatttcctcatgtctgc

SEQ ID NO: 32659 - DNA, 201 bp, Bos taurus
aaaaaagctctaaccagaaaaaaaaaaagtacttcctggtataggagaaggcagacaagagtttctctttttatttcactaaccagcttttggccatattygggctgtggtagttagaacttcatggtagaaacagaaataggaacctgggacagaagaaggcagttctgaaggccttgttcccaccctctccatgccaat

SEQ ID NO: 32660 - DNA, 201 bp, Bos taurus
aaaatataagaccacaaggccaagtttcccaccagtttatatacaggactgctatagaatcatgtcagctaccacatggccattgtaccccatggtaccaycaccgccatggctaaaccctagagtcgatccctaagaagcagcaaacacattactgaggccagctctgcccacacaggctggcaaccaaagcccctgcac

SEQ ID NO: 32661 - DNA, 201 bp, Bos taurus
aaccattctgatagggagaagatgctgagggcccagcacattaattcctttatcgccacaaacaaattcattcctacatgaatcaaggccttcattttttyagcagggatagtgacattgtccgtgttttcttcactgtccaccaaggagagagagaattatcacagcaggccctgttgatttagaaaataccttggctga

SEQ ID NO: 32662 - DNA, 201 bp, Bos taurus
caatttctagccaaaaggagtaatggcctcttggtggccaactgcttcagctacagagtttgtgttacagtggaattttctttttttcaattaaagtaagytgggtaacgcttagacttgaccctcatcccacggaaaactcttatcaagtagaaactgattaaaagggatttgaaaaaaatatatatgtgtgtacataaa

SEQ ID NO: 32663 - DNA, 201 bp, Bos taurus
tgcttctccaagcacagacctgagggtgggaggagagagctgctggacacctggtgaagacgaggaagagcggatggatggcctatgggctggagcacagygagggtgggagctggcaggggcggcactggtggggtggaaggagagccaagttggccaaggctggggctatggacttggttctaaatgtgatcgagtctg

SEQ ID NO: 32664 - DNA, 201 bp, Bos taurus
gtcagctgtactctccagtttacccctgaggaccagcagcatgaagatatagccaggttcctgaagcatacactcagtcaggcccacactttcaatcttgktttctctggcaatatgaaatcaagtggatcagatctggcaaatgccagatttaggactgggccaagttgtgtccccctccaggctaacttctcatcaatc

SEQ ID NO: 32665 - DNA, 201 bp, Bos taurus
gagagcagggtcttgacagtatttctgtggttgccatttcttgccgtgagagaggatgttccctgggtatatctgatctgaaactaaccccataataaacyagtatttgcttttgtcatttgctcagtgtctctgccccactgctataaattctaataaatcaatcctaaaaaacaaattgacaaaggatgtgactagaaa

SEQ ID NO: 32666 - DNA, 201 bp, Bos taurus
gcttaaagccaccagaaaatgtttttaaaaatggaagaaaacctatctgttttacagtttaaaccagcaaaagattcacactggacattttcacttggaaraaaagaacaaacgtcacctgctaattacctctaatcatatttctagagactgacagtgatagatgaggagatgtccattttttatttcttcagtttgagg

SEQ ID NO: 32667 - DNA, 201 bp, Bos taurus
aggattcatttcagttcagtcgctcagtcatgtccaacagaactgaactgaactgaactgtccaactgaactgaattgaactgaactgcccaactctttgyggccccatggactggagcacaccaggcttccacttccctgtccatcaccaactcctggagtttgctcaaactcatgtccatcaagttggtgatgccatcc

SEQ ID NO: 32668 - DNA, 201 bp, Bos taurus
ttacagagtagatctggaaattgcaattttaataaacagaaacattgtgttctgtttatacaagccatctcctggcaaatgttcaaactcctactaaaatytgtggcagaagagaatcaagcatgtagctgaaattgtatttaaaaaaatctatttttctgtattttctgatgctttgacatctggggccttgctgacact

SEQ ID NO: 32669 - DNA, 201 bp, Bos taurus
cttcttctgcaaccacagtgaaagtctaaaagcattttgttcatgaacacttaagtttccaaactttctttggctttccattgtccctaggaaaaatctartgttttatgtggcttaaaaggctcaggtatctgctgacttctgcagcttcatctctctacattctgctttctgcatttttcttcttattcttctaaggct

SEQ ID NO: 32670 - DNA, 201 bp, Bos taurus
ccaacattcactatagccaaaaggcacattcaatttttatacagtgagactctgaatgaaagaaaatgcaagagcaggaaattagtatttttgagaactamctctgctattaaattttttatgaatggttcttctaaactagagtttctagcaaaatagagaattcattatgttataaagattatcagtgtatatgccttg

SEQ ID NO: 32671 - DNA, 201 bp, Bos taurus
catttataatccacctccttccaaaaaaaatgtcttgagttaatcaatgccttagtcaagagcaccaatgtctgtgcacatcattgtccaaattccctacrtaaaagtggttaatgcccctgagcaatttcagacagattttagtagaataactactctaatttttattgttattagaaactgctgacctaagattcagac

SEQ ID NO: 32672 - DNA, 201 bp, Bos taurus
aggacagagatgatagatagacacatacatagattcctttccccttttatagcacaactgtatttggatttactagttctatataatttttctgggcttcmaaatcactgcagatggtgactgcagccatgaaattaaaagacgcttactccttggaaggaaagttatgaccaacctagatagcatattcaaaagcagaaa

SEQ ID NO: 32673 - DNA, 201 bp, Bos taurus
tctggttaaaaaattatgtgtcagggtctttagttttttgcaaaacacaaagttaaataattctagaaaaggaaagtaactgtgtaaaactcggaaggaayactgttgtactaaaatattcaaaacagtcattctttctgaaataaatacaattactttctccctttgtgcacaaccatgacaagtccacagaagaggcga

SEQ ID NO: 32674 - DNA, 201 bp, Bos taurus
tcagctcaatgttattcatgtctttggagtataagcatcaggagattgggagctctaaagaaaaactgattgtaatatagattcaggtcatgaaaaaaatmccctctatacatgggatggcacaagcatgcttatatccccagactgatatttttattatagattgcctgttggggtactaggcataggtgaggatatatt

SEQ ID NO: 32675 - DNA, 201 bp, Bos taurus
tctgcacagggctactcgagtgtcctcagcatggagctggattattccagagtaaataatcaaagaggccagtgaaaaagttccaatgacttttatggccrtggcttggaagtcaaaagtcttctttagttttgctgtattcttctgatctcagagatcacctctgatcaacatgcagtgactgtacaaaggcatgaggtt

SEQ ID NO: 32676 - DNA, 201 bp, Bos taurus
gatatttttattttataaacttaaaagtgtattttgcaagatttgatcttcctccctcttactcttcatgggaaaaaatttttattcagggtctctccttyctatattttattactctttctatttctagtttttacacttgtaaaacacagttggacttaacctactgttaattataaaattgtacattgatttgcattt

SEQ ID NO: 32677 - DNA, 201 bp, Bos taurus
taaacctattgttgtattttaatccttctcaaattttaattaagttatggttttaatgcaaagtaattatgcttactgacagacctatgattgaggcaaakcacaaagcaattagctgaatagaaacaaaaaatatagctaatatcattgacataatggtcctgggcagaatcaacattatttttgaaatgtgaacccttc

SEQ ID NO: 32678 - DNA, 201 bp, Bos taurus
atgcttgtgacaagcatatacagtgtctggaagaatagagttttttcccctctttaaaaaaatccatgaggataggaaattctggcataagtaatataagrcttatatgacaattcatcagcagtataatgatctctactttttctgtacatcaactttggcacttagaattcttctgtctgaatccaagagaaagaaaga

SEQ ID NO: 32679 - DNA, 201 bp, Bos taurus
catctcttcctaagtaaaataaattgaacttttcagggattctcagctaagcagtcaaagagatctcaagaatggccttgagtatcattgaaatagacacrttgacctttcaatgactctaggcaagatctttggtcctggcccattgccataaataatttggtgaaggaaaggaaatgcttggttttaaactattcacaa

SEQ ID NO: 32680 - DNA, 201 bp, Bos taurus
cattttatgaatttgttaaactacaatttatcttctatcctcattttctcaacaacctaaaacttttgaacactcattcctttccaaatttaatcaaaatytgtgggaaatgttagcacaatcaaaataaacatattactttaaatttggtgtctccttagctctctgattcactgtatctatgttttaagctcttggcct

SEQ ID NO: 32681 - DNA, 201 bp, Bos taurus
aatcctgatttttatcaggatataaagattaagagtgtccaaatattcactgtcaattatttgttaaaatctattaagaatcgagtattatactaggtacrgtaggtgatttcaaaattaagaaactttcctagatcttatagatctcagaaacaaactgagtaaaatttcaggcttgtaaccatttaatttcagagctct

SEQ ID NO: 32682 - DNA, 201 bp, Bos taurus
tattggaaaagtgaaaacaagtatgttttcatcacaaggtataggagaggaatatataatgggtatctttgccccccatttttggagtaaatatacacaayaaaatttactatcttagcagtttttaagtgtacagttgagcagtattaagtacatttttatactgttgtgcagtcatcacaccactatctccagaacgcc

SEQ ID NO: 32683 - DNA, 201 bp, Bos taurus
ataacaataataataataataaagtttgaaatacagtacaaattacccaaatgtgacacaaagtgagcagatgctgctggaaagatgtcaccaagggactygtgtcatgcaaggttgccataaaccttcaaatttgtaaataacgcaacatctgcaaagtataataaagcaaagcacagtaaaatgaaataagcctatgct

SEQ ID NO: 32684 - DNA, 201 bp, Bos taurus
agcgagagaagtggtcaagagtatggcatggtaagaaagttctgtgataatcgggaatattgctgtttgctttcttttcaacgttcacaaccaacaaatayagctatatggcttaattattccctagggtctcacagtcctaaatgctaaattaaattatgacagccttttgttttcagctcagaatggtttctcagaaac

SEQ ID NO: 32685 - DNA, 201 bp, Bos taurus
tttaatggtttcagaattatcatactctattatgctgaagaggcaaaaggaactgccactctgtagaagtttgatctactattagagagaactcttattcytccctgttccccacagtttcctgggaacaataatgaaataacacttccagccccattccctatacagtcatgcctccctgaaagagaattgtgacaagtg

SEQ ID NO: 32686 - DNA, 201 bp, Bos taurus
gctccatctcagaggcaaaaatgtttcaacctttaactattttctgtaacagttttccctcttattccagcaaaatgtacatattcttattttccagttaytttatttcaaatgttatctacagatttcctgctctgagggtataggtctcttacaactcaaccctactgtctatctcatcagtcctatttaattttatca

SEQ ID NO: 32687 - DNA, 201 bp, Bos taurus
cgtgctgcgattcatgggtcgcaaagagttggacacgactgagtgactgatctgatctgatttgatctgatttatactgtgctcacaactgtgactacgtyctggcccccagtcacctatctgctctgatacatacccctacattttactcacctgttgagttttttcactccattgctttacctttactcctgctgttac

SEQ ID NO: 32688 - DNA, 201 bp, Bos taurus
gcagggactgttggtattactgttacaggttagaatataggctaaaaagaaaagacaagcagtatcacatgcggtattggacttaagtgatacttttcatratgttactgggagaagtctgttggaaatgtcacatataggtaaacagtataggtgagcatctttgaaatcactgtcatgttacctttatttctatagttc

SEQ ID NO: 32689 - DNA, 201 bp, Bos taurus
agagactgaacaaccactcacacaaatctaaatattaaaaatttaatagaaatattctcccaagagtaaagaattgccttagtcagattaggcagccatawcagaataacatagattgtgtaaagaatctgcatacaatgcaggagacccgggtttcatctctggatcccctggagaagggaatagcttacccactccaga

SEQ ID NO: 32690 - DNA, 201 bp, Bos taurus
tatggttggcaggaaaatactggtaacaagaataacagtatttctctcccatcaataagcttctgaagcatatcatctccagaaaaaccttttctgcagarcctggaaaaatgtcattccccattctcaatggaaaaatcccacttgctactgaaactatagagaaatgcattatttaagaatgctaaatatttgcacaat

SEQ ID NO: 32691 - DNA, 201 bp, Bos taurus
cttaggaaacaaaaaaatacattttgcatattcttgtcctaaggaacctatgtgtatattagcaccagtacatcttttttgttaaatcaagagcataagaragtaaatttgtgatttggattccacagtctcttgctgtctcaagggcatctttctttcagttatcctttccctccactctaatattaagttattctctcc

SEQ ID NO: 32692 - DNA, 201 bp, Bos taurus
gtaggccagttcctaaccactgaaccaccacggaagtccataccttgttttttaaccaaatccacagaatgtcactataaaaataaatgacatagtctttkggaatgtgtttttaataagatatgcaggttaaaatccagaatcagtttacatctttgaatgtatatttgctgccatatcatccagttgttttgttttttt

SEQ ID NO: 32693 - DNA, 201 bp, Bos taurus
gcttgcatcattcattaggggatacgcatgtggacaggaagatgcaaaatgttaagataaatcaagggaggcaaatgagagagctagacagaacactttcktatataaactgaactaaattgaaatgtcgagagaaggcaaaagaaggggaggcagagagaaatttgggaccagggtgagtttagagggtatagttaactc

SEQ ID NO: 32694 - DNA, 201 bp, Bos taurus
tggttagaaaataagtgaaaaggcctttctgtttaaaatgtaaacaacagttacattgtcatttcatataatctttaaaatggtagtaaatggggaaaaartactactatgactataaaaagaataagatgaggatgcataaccaggaaacaagaagttttaacaaagttttgtaaaacacaaaggaaaagggctgactga

SEQ ID NO: 32695 - DNA, 201 bp, Bos taurus
tcaccatcactatctattttcagaacatttttttcaccccagttagaacccttgtaagtcattggcagtcactgcctattctcctcacttcccaggccctrgcaactactattctactttctgcctctgtggatttacctattctgggcatttcataaaaacagaatcatacaatatgtggcctgttatgtctggtctctt

SEQ ID NO: 32696 - DNA, 201 bp, Bos taurus
gaacccacttttgttgttgcttctgtggtgcgacaccatcatggccaccaatctgggtcaaggtcccaacccagtcactttggggtcctaggggttcccakacagtcctcaagcacatgctttgggccaacaggccaattgttcagcacccacacctcccaaccatcatgcgtttgaatgtgcacacactaccacctagca

SEQ ID NO: 32697 - DNA, 201 bp, Bos taurus
agttttcctgtatttaggaagcttatgctaccatgtatccccactgagtaagtcagttttcctctattttaactgccacaaaggcatcctttgtacaacamgccagtatatactttagttccacaattgagaagactctcaaacttgcctctgttcttttcttaatggctggacaaatgtctaagaaataaagcttagcag

SEQ ID NO: 32698 - DNA, 201 bp, Bos taurus
ggtggaatgttgccccagtggggaataactctgccctacttcggtactatacccacttcctgctgagttagttcccaaagagaaagcagtgaggttggggraaaaacccacagacagcaagtgtttaatgcagagactattcctccactgcagctgaattcacagtaagccaaccagaagcaccaaaggcacctgcagctg

SEQ ID NO: 32699 - DNA, 201 bp, Bos taurus
ataaaaattaacccatgttgcagaatatatggccattccgagagatgctctccaatgccaaatacatgacccccacagcccaagagccaggctatactcamtgtgggcccaccagcacctgggagggggcattatctgtttgattttctcttctaaagggatataagggtaaccctttagctcccttccgagcacagaggg

SEQ ID NO: 32700 - DNA, 201 bp, Bos taurus
aaaatatatataaattttcaattttcagatgactgtaactgacttttacacttattcatcatgcagacaatatcactggataagcccaagatatgaaggcrtgcaagactctgcagaaacttaacatagtaccttggaagttattttataaaatcattcaaagcagttgttttcatgcattagccttttactcataaaaga

SEQ ID NO: 32701 - DNA, 201 bp, Bos taurus
ataagtatagcttacaacagtaagactaaatttttaatgtagagattatacaaacatttgattgtatgagaagccaccttgggaattgataacattttttwaaatgatgtatctattgcataaaaccagattggattgataatgccccttttggcagaatcacagaatcctgattgagtaataaaatgatggtcttgtatg

SEQ ID NO: 32702 - DNA, 201 bp, Bos taurus
ggaaatgggctgaatgatgtggctgcttttcgaagtctcgggccaagcctgttgcttcacatctttgtgaagcaaagcttcactgaaaggagctgtctgcrgatgaccttgttgagtggccactagatggcaacgtacagttcagacagggtgactcagcgaggcgtggatccctggtgggggttagtccacgggctctat

SEQ ID NO: 32703 - DNA, 201 bp, Bos taurus
aactttttttaatgccagggttatacatacgtccttgaaaagatttttcaaggtaagcagacagatgaaagatctcacaattagatgtagggaggccctcrgtttctggctgtcctcactgtgccaggtttgtctactgagacgctgagacccagggagggttatagaaatctgcccctggcccttggggaggagctcaac

SEQ ID NO: 32704 - DNA, 201 bp, Bos taurus
gtaattttgaatacttacagggaaccaaaacccgtaactacagttaaaggcaggtgtgactttgtatattcactggcaactggttaaccttgaaaacaatyccaagcaagagaaaactctaaattcttagaaaactctaaagcatacctatatcccagctttgactcaggcttttcacaattataactcaaccagatttct

SEQ ID NO: 32705 - DNA, 201 bp, Bos taurus
ggtcttagaagacagagaaaccgagaagaaaggcatcaccttttcagtgcaccaagcaacattaatgccactcgacaggagggagcagggggcctgtctcygcgtggagaaggaagagaggaaatggaaacccaccaggagccacccaccacgtttaactggtcctgcgccagtatctttgcagctgtcactccgggaagg

SEQ ID NO: 32706 - DNA, 201 bp, Bos taurus
gagaactgtatggagcacaacttctacatcagctttggtcctgatgaacatctgccttgttcaaggtcctgttactgtggccctgtttctggcacagaackcctaaaactcttgatgagtacaataaaaagtgtcttttgttatgctaatgacatgacttttggaaagtacaggataggggccggttgccagaggacccaa

SEQ ID NO: 32707 - DNA, 201 bp, Bos taurus
ctttcttccctttctttctttcatcagtatttattaacttttctacttctgaaataacttagaaagtcatttaaaataggttgatttgtgttcatccttaygtaaaatagaaaatttgctaattaatatgaaacataaggggaagattttagagcattttatttcaggcagttaagtttatattttttaaagacactatgg

SEQ ID NO: 32708 - DNA, 201 bp, Bos taurus
aggttctggcctaatgggatcacctgaggaacaacttcccaagactcaatcactttgatagcaagttataaaaaattctaaagggaaataactcctggacsctgatttctgaacactggccggctaacaaactccagctcactcaccatgaaagggaaggaagagtcccagcataaacactgccctggcaagagcttcagt

SEQ ID NO: 32709 - DNA, 201 bp, Bos taurus
cttagttttctgaatgttaagctttaagcttatcattattaaaagtaactttggaggaggcataattttaatatttaagaaaaagaaaaaagagtatttcytatatgtgtcagtactgttaagcactttcatttctttaacaaattaaaaaagctcaaataaagctatcttaaataataaaggaaatgaattcatataatt

SEQ ID NO: 32710 - DNA, 201 bp, Bos taurus
aacaatggcacatgtgttcaatttggtgggaatccggtgagccataaatcagaaaaaagcctgggagggcttagtggggcctccttcctgggctgtgtttktaccaccccagagctggagccacagccctgggtgagccttgccctggcacgcaggactcctggggcctggcacgctgcttgtctgctggcggttgtgcta

SEQ ID NO: 32711 - DNA, 201 bp, Bos taurus
gatgtgaaggcctaacataaaccaatggctgtgagacagccatcagcacagaggattcaaaggctgacgcttccttggaaatttccaaatgtgagacaacygaggcccactttcagtaatgaaaggggagaactgttctctcaagccaattatagaacacatgataatggtaaaaatgttccttttcaccttgttaaactg

SEQ ID NO: 32712 - DNA, 201 bp, Bos taurus
atagagtatgccaactcacaactcagtgaagttagtaggtttttttttagattttagttgaagtggtgaagagatattgtattgatttatgcttgctacayctttacacattcaaagataatcatttatgcttcctctaaatcttctttttgcctgggcaatgacttctttaatagactttttatattttttattatgtaa

SEQ ID NO: 32713 - DNA, 201 bp, Bos taurus
ctgatagtattttgaaatacccaaagggaagtcattgtatacagcaatccctactgaagaattcctagtaaaactaatggcagtgatggaatttactcttyctctacttcgaatgttcactaactggaaaagtttaaaatgtggacgagtactataaaggtcaaacaatgttacttatgacaaaacaaaagattccttctg

SEQ ID NO: 32714 - DNA, 201 bp, Bos taurus
aggccttgttactttgaaatgtgtaccttaagaggcgtgactcaatccaacagtgttggaggtgactcatcacacagaccgagctccaaaaaaaacacatyggccaccaatctccacacatcatcccacgatgcctgttcctttattttattttattttttattttaattcaggagctaatcccaaacagcttcctctctt

SEQ ID NO: 32715 - DNA, 201 bp, Bos taurus
agcaaaatactccgtaggtctgtagattatctgtaaaccaactgacaggtatccaatgcagaccacgcggagacgtttcttcgcccctatcgctgccctcrgatgatgctgtgaaaagtaaaagttcatcaggtgctgaccgggttcatgatagacctgcactgtgaattcctgaaagaccaattgcaatttatcattcct

SEQ ID NO: 32716 - DNA, 201 bp, Bos taurus
tgtcagtatgctgagattttcaagtaggaagagctatttttcccccaaatcagagaaatggcatcacaatatgggccctccccttctaggcttcttcagarttgacaacttccaacaagctttagtgagagttgctcagtcatgtccaactttttgtgaccccatggatatatagtccatggaattctccaggccagaata

SEQ ID NO: 32717 - DNA, 201 bp, Bos taurus
gactggctctttcccaagcaactttaactcaaaatgatcagggtacccacatggcatattttagggtggcatattctgcttgccttcagtcttatgttccrgtctctccccttctctgacctccacttctgtcatcacacctcttcctatgaccctttaaaggtacttgtgtttgcattgggcccacctggaaaatccgtc

SEQ ID NO: 32718 - DNA, 201 bp, Bos taurus
tccagttgaatagcaagtgtatatcaattgtttgattagaaaagatattctgagtactgccgtctgtctatgctggcctggatgggagacatggagatgtragatattgcttctataattagagagtgtagagtctacttgaaatgcaatcttaagttgctcagttgtgtccgattctttgtggcctcgtggactatggtg

SEQ ID NO: 32719 - DNA, 201 bp, Bos taurus
tataaactcaaaagataaactaaaacctccactacttaacaatttttagtagttctgaacaagtgctataaatactagatgtttgttaacaaatttttgtyccaaagaatatgtatcagggtagaaataaaagtaaatctctaccatatatacattaacaattactaacatgatttatttggtacaaaggatcttttctaa

SEQ ID NO: 32720 - DNA, 201 bp, Bos taurus
aatctaattccaatcttcatttccaaatgctttcctcaggactcctctgtaagaatcctatgatttagccaggagggtttccttgtcatttcttaaacatrctatttccttcctccaagcctttggtggtgcgttctctttcgtgtccaactctttgtgaccccacagactgtaaccctccagactcctctgtccatggaa

SEQ ID NO: 32721 - DNA, 201 bp, Bos taurus
ggccaaagactcaggctgtacaccaagccagagggagaatgctggcagtttagaggtgcatgcagtgggtacactaagacatagtccagcagggtcctccrtacccaggcctgcaggcagcaccagcatatcaaacagtctgaaagctatgggcagaaaggggaaattggtagggctagttgggcttcacattgttgaaca

SEQ ID NO: 32722 - DNA, 201 bp, Bos taurus
ttagaggcccacctacccatgaatgctcccaccaaggccctacactcatcttggtcctcctcaactccttgccttttttctgtaaggcatggtcctcttamttccttgtggcctgtgacactagtttataataaactcttaagagaatataaatgcaaaaggacttcccaggtggcacagtagaatctgcctgccaatgca

SEQ ID NO: 32723 - DNA, 201 bp, Bos taurus
tcccttcccaaggagataccaatctaaatatctctggaggcttgttgtctttctttttagcttagaagagagctggctctgtagccctgagtcactcatcrgaagaacagggctgtgctctggagtctccctatcatttctggaagcaagaactccctgcagttagctattccctctgtgtaagtaagggcttccttgata

SEQ ID NO: 32724 - DNA, 201 bp, Bos taurus
ttctctgaaatgctgaaatgtgattctaaatacactttaactgaagggatagtgaccaaaatttaaagtagaaaagaaatgaggtacttctttcagtattycaacaaattctggtgtcaatgaaaatctgggaggagaaacgttagccagtttgtaaactgcttttaagttattgacttatcaatacaattcaccttttct

SEQ ID NO: 32725 - DNA, 201 bp, Bos taurus
tatcatgaggttggaaaaagagtagtgtaacgatgtcacagaattcagctggtggctaaaattcagctagtgggaaaagggacaaaagtagttttttctayaagactagttcagtttataacttaacaactctttgggtaaataaaaattcttgctctggctgttttgtttggttgtgatgagcaaaatccaatcgacgag

SEQ ID NO: 32726 - DNA, 201 bp, Bos taurus
tataaacaggaagaaactaagaatgtagaagagggctcctcactgaggctaagatttagaactcagaccagaatgaatcatacagtttgtaggccccatgyaaaatgtccattcaggtatgacctaaatcaaaacacttatgattatatagtgggggtgacaaatagattcaagtgattagatctgttagacagaggcctg

SEQ ID NO: 32727 - DNA, 201 bp, Bos taurus
tttttctcatgtctaaagactattgtgacattatttcttagtacaagtctatggccaaaaaaagaaatcatagattctgctgacatcctatttattcttaygattttatgacttcaaataaaaatctgccgctgtcagtgtttcatcctttttttttttttttctcagcttctctgagtactgggtaggcttctatctccc

SEQ ID NO: 32728 - DNA, 201 bp, Bos taurus
attcatgcaaaccatgaaatattcactctatttactttttaattaaattctgatcactatgataatttatttcaataatttttgaaatagcaatcccttaraaagatcagtggtgaacaatgtttaagacctacataactgccttcaatctcttgcattgtttctcagtttacttactctgaaaagtaatctgaggaatca

SEQ ID NO: 32729 - DNA, 201 bp, Bos taurus
gcaaagaaagtcacaagactagatttaagagttgtgtaaacagacacattgcaaaaatgcctgtataaagggagaggtggaatcattatggccttttgttrtaaacaattggacatacaaaggcatgaaaagtatttgcatgttgagacttgatacctccatcaaatccttcagctatcattctggaggatgagatctatg

SEQ ID NO: 32730 - DNA, 201 bp, Bos taurus
ctgcgattcatggggtcgcaaagagttggacacgactgagtgactgaactgaactgaactgaaatgcaattaaacactactgaattattttctaataattrggccaaagaattgccagtgtaaaaatattccagtgaatatttcaaaataagataaagcatatgcttctagtcatctttttagatgctctgagaaccgtct

SEQ ID NO: 32731 - DNA, 201 bp, Bos taurus
ttcatgggcttttcataactataatataacatttctcatttataaaaacatgactgaaataaactcacatcccatgtagtgggattaaatgtccagtatayccaagaacttcagggcaagccctactacctcagttgtttgcctcatgcaactcaaaaatcccagattgttctatggaagtttgcttatggtaaattagag

SEQ ID NO: 32732 - DNA, 201 bp, Bos taurus
tttgtttctgcagagctttcaattctgcttatttttatcctagctttggagttggttacttgcttcactgtctgtctaatttagagactttctctcttgtyccactgttaattcagtgacatatcatttgaaattgatttgtcagtcttacaaattttcattcaacatcattcacattttgcttatttttatagagaccct

SEQ ID NO: 32733 - DNA, 201 bp, Bos taurus
ctgagcatcagctctgttctgtgagtttacccagggactcagggtccttctatgcttcaccatcccctagggtgttttgttcatccatagcataacaggtytgtagggtcatatccacatacagcccattagaataggtgaagagcagggaaaacaaatacccaactattttaaagacaaaagtcagaagttgtatatgct

SEQ ID NO: 32734 - DNA, 201 bp, Bos taurus
atggcctcttttcagtttatacttactagagcaggtcagtctctggtttcaacatttccttctgtcatagtctgaattgatcggaatacttaaggtcaatrgagcagaataatttgtccttggccctttctttaattccttaaaagtaaaaatataaaggctagtttcattttataaaaataggagtatagagatctcctt

SEQ ID NO: 32735 - DNA, 201 bp, Bos taurus
ttaaaatgcagatttcctatctctctcaaatcacagccctaagatgttgattcagcgtcaagtgagacctggggacagtatttttaaaaagtgattctggrtttgaaaaaatatatcactgctttagattccctaaggtataaataaaatttgtatcttagcaggaatgttattttaatgcattaagaatctgtggagcga

SEQ ID NO: 32736 - DNA, 201 bp, Bos taurus
catgactgagcgactggaaaacaacaaaaacaaaaacaatgtgagagtggcattttcagtcaatgtttcatttcctagatgagtttatcaaggaaatgagyatagagaggaaggaatctagggctgagacccaggacactgtcatatgatgaggtctgggagaggaagagtaaccagccgcagagaaggaggaggacctga

SEQ ID NO: 32737 - DNA, 201 bp, Bos taurus
cataaaaaataaagacttcccctccagaagaatgagaatttcagaaacagacataagaaaattaatatatggtcagctgaaacttgtagtaccttagaaamtatgacagagtaaggtccaactgccttttttaccaagcttgtgtagaccagcatttagtaaaataacacaaaaaataagaaaatgaaagcacttatggaa

SEQ ID NO: 32738 - DNA, 201 bp, Bos taurus
ttaccagtgtgatggcacagtttgtgatatttttggccatacattcaagacaatctatagtcagacccttctgactggtcagtatgtaaagaattaaactyatatttctttgtggtggatcctggtttttgcagccagtgcatgctggcctagacttacgtaaattttatctatcgtttcatctttcttcttccctgaact

SEQ ID NO: 32739 - DNA, 201 bp, Bos taurus
agaagatgagatgagatgtcccagctggtgcaggaatctaggaaaaaagggcaaattccttcttccttcacattttgttctatttaggcccacaatggatkgaataatgtctacttacctacattctttgagattggactgaaaactgaccttttccagtcctgtggccaagactgagttttccaaatttgctggcatatt

SEQ ID NO: 32740 - DNA, 201 bp, Bos taurus
gataacttggcatagaatgatcttctggatgttaagattttgagaaagacaaaaatgtagtagaaagtttttgagtgttcaatatatgatataaaagtatrttattattaaagctcagtagttgtcccaagcaaaagagatttctaacatcaagaaagaaatatttgagtacaatgtagcaattacaattcttctagtagt

SEQ ID NO: 32741 - DNA, 201 bp, Bos taurus
cttctggggaaaagagaaatacttccacaacaggaaccaatagccattcctacttcattactacctaattgaaggaatatacatcctgagcaacactcttycaagtggaacagcatcacagagtctttcatctctataatccacatatacccctaagaaatagtgaaaaaaaatctaggttttcctctttgcatttattta

SEQ ID NO: 32742 - DNA, 201 bp, Bos taurus
ttctgttttcctttctctgtaggccagcatttttttgcttatttgtccaaaagaatggaaattggtgcattaatggcttctaggtttatatcctctttttyaataggccagttcatggtaagctattttcaacttaaattccaagcttgcaaaagatagaatgaaaatattccagtttaggtgttgttcagtagcctgcag

SEQ ID NO: 32743 - DNA, 201 bp, Bos taurus
gattttaagaagatgcaaatgttcagactatggcagccattaaaagttaacacctgaactttctaatatgaatattttaagagagtcagaatttctaagcmaaatctgtgaaatctgaaagatatttaacagattttcatcaaaggataactccatatgggatattgttataaggaaataatttagaacataaatttaact

SEQ ID NO: 32744 - DNA, 201 bp, Bos taurus
aggctattaactacacctgtgatctctgtgtctcactatatcccctcactccttatgatttcttgtatgctggcctgatatcctactgccagcagttgacycttatcactggggatttttctctaaatcctaaggcccattctatttatttgtgctgtcaatccaaaactgatggattttttaagcccctggggtaactat

SEQ ID NO: 32745 - DNA, 201 bp, Bos taurus
tggccaaaacgtttggatttttccctaaggtgttatggaaaaatccaaacaaacttttgccaacccaataataacatcctcagggtcttcctcatgctttkcccagtagacaccaccatttctgccctcatcactaacacaagataatgagattctgagagcttcaccctcagtggagatggagaggggcaaacataacat

SEQ ID NO: 32746 - DNA, 201 bp, Bos taurus
gattggtatgatagtggcagcattctgctgtgtcctgtcaagaaggaaaaaagcttaatcaaatattcttggataattttacaaggagcccatccaattayctaaagctatatctccattcactgtcaaagcaaatggacaacaacaacaacaacaaatcactacctaataatataaaacattttatttgatgtcccttat

SEQ ID NO: 32747 - DNA, 201 bp, Bos taurus
acataaaggtaggaaaaaagaaaaaattcagcactttctaaatgcatccccaaaagagtataacagtgttgcttttattttcctttcaatattatctttcmttcaatattgtttattgataaagagcccagttagaagactaagggaaggggctaaaaactatttcactaaatattccttcaatttagttcaaatttcaat

SEQ ID NO: 32748 - DNA, 201 bp, Bos taurus
cttactacagtccttccctctaatagacttagggagatcagtatgttccaaagtctaaaaataaaatgcaattttcttctggcttacaatactaaaatgaraccattttcattaacattcctacctacattatgctttttaaagtgtgcttttctaagaaagttattaaatcttataagaattaattccccactaggtaaa

SEQ ID NO: 32749 - DNA, 201 bp, Bos taurus
tagagacatgagggtgaaaatcactgatgttctccaagagagacttcaagatacaagcaaaaacaatgattacaaatgttaatgaataaatagagaatatkcagcaaagggtcttttataatttttcatacattaaagaagaagaagtgaaataggcaaaagtatatatttgtgtgcacatgcatatatataatttatagt

SEQ ID NO: 32750 - DNA, 201 bp, Bos taurus
atggtttaacccccagagttcctgaatgtgattttatttggaaatagtctttgcagatgatcaaagtaacatgaagtcactagctgttctaagtagtttartcatgtccaactctttgcaacctcatggactgtagcccaccaggctcctctgtccatggggattcttcaggcaagaatgctggggtaggttgccatgccc

SEQ ID NO: 32751 - DNA, 201 bp, Bos taurus
gagatattaaactaaggtgttttctgtaaagtcaaattttcttacttgtattttttccagatggcattctgaaggccatcatttttcagctgtttgtgaarcaaatgctaggccatctttttgggaattacttctccagaatcattaaacccatgttgagggtagcaatgtgagaattccacaagaagtttaagccctaag

SEQ ID NO: 32752 - DNA, 201 bp, Bos taurus
aaaacaatatatcaatattttctcaaagacaataaaaattctcactctctagcatcctttatcaaaattaatcagtaaccataataattctataggatttrttttctttattatgcctttgattacttaattacctgtacctttaccatttttctactttgtattcagtttctcctctctctacctttgtggaagctccta

SEQ ID NO: 32753 - DNA, 201 bp, Bos taurus
tattacactaatactgggaggagaaaacttgcctgtatacttggaaagagggagaagtggcttggtaacaatatacatagatgcaaggtagtggaacagaracctggaagggcaatctggaaagttagaggcaagtacatctaaagaagtctaatgtagatttaggagtatatgaggatgagcaccggagaaggcaatgga

SEQ ID NO: 32754 - DNA, 201 bp, Bos taurus
aatattagcttttatttttattgtgttctgaaaatattacattagcacttccttgtatcttctaaacagttttaaataaagttatctgaaaaagtatcaakactctctaatggctgaaaacaggaaaaatatcttttcccaatccttcacacctttttgtttctatgtccttttccatgtaaatttagattgtccattcac

SEQ ID NO: 32755 - DNA, 201 bp, Bos taurus
taagtgtggcttcccttcccttttgggatctgcttctcagcattatatcagcaatcttttctactcctacttcgataggacatatacttatgggccagggyctccaacccacctcttagagtctggtttgaatactcatctatttttatccttgttctattagaactcaaactgttctaaatagtgcatgtcattcagatc

SEQ ID NO: 32756 - DNA, 201 bp, Bos taurus
ttatgagattagtattttagccagatattcgttttcctacgtgtactgaatgtgtcattagcacatcatctaatgaaatcatctgctgacagagaccactrgagctgtttgccatttctgctgactctgtgttcccagttgatttggctaaagagcagttctagggtggcagcaggacatttctgaggcagtttacagcat

SEQ ID NO: 32757 - DNA, 201 bp, Bos taurus
aatgacagaatttaataaattgtatcagaaagagaaacagaattatggcacttaaatcatgcctcacatttgaagaaacacagtctttcactttaacatcytaggaattgatacactacttaaatgcattttgtgcagacagactttttggtttacatatctttgttttcaggtgtagaaactaaagatagttattaaaaa

SEQ ID NO: 32758 - DNA, 201 bp, Bos taurus
tgttatctatcatgggactaagatttatgtaccaatagtgttagatatttctaaatgaacatatgaacaaatgtttattgacagtgtttaaaaataggtcmttgtcattaataaaatagactgggttcataaaccacacaaataattagcaacattatagagttatatagtaaaatttaaaaaaatatcttaaagagatga

SEQ ID NO: 32759 - DNA, 201 bp, Bos taurus
attcaagacaggtgtttgtttcttttagcacttaaagaataccactccattgtattcacatttccatttctgctgaaagaatatttgctatcctgatattrctcctttgaagataatgcacactcttctctggctgcttttagaatattcaatttgtttgatttccagcagtcttactgttgtatatctttaggtatagtt

SEQ ID NO: 32760 - DNA, 201 bp, Bos taurus
ccagccctctttcctagcttctggtagtgcccaggattgtaacagcataactctaatcttcacagggtattctatcagtgtacatatctgtttctatgttytaatttccctttaagaagacaccagtcatattggattagggccaacactgatgacctcaccttaacttgaacatctgtgaagactgcatttctaaataaa

SEQ ID NO: 32761 - DNA, 201 bp, Bos taurus
aaaatactttcttacagagacaccaggattagggccccactattatgacctaatttgcctcatttatctttttaaaggccctttctctaaacacagtttcrttcaattgctcagtcatgtcagactctttgtgaccccatgaatcgcagcacgccaggcctccctgtccatcaccaactcccggaatttactcaaactcat

SEQ ID NO: 32762 - DNA, 201 bp, Bos taurus
aagaatatactatggggcaaagatagcctcttgaatacatggtgctgggaaaactggacagctacatgcaaacgaatgaaaaattagaaaactacctgacrccatacacaaagataaactcaaaatggcttaaagacctaaatttaagaccagaaactgtaaaactcttagaggaaaacataggtaaaacactcgatgaca

SEQ ID NO: 32763 - DNA, 201 bp, Bos taurus
ttcaatttttttcctgacttgctcagcactatcagtagatgggaatcgaaacacaagcaccatatgaatgttcataccattttgatctggactaaagaggraaaagcagatagaggtaatcataataaagtcagttctctaaccaggaactatttttacacgttatgattcacactagatttaatagtgagtggcatgtgt

SEQ ID NO: 32764 - DNA, 201 bp, Bos taurus
accgtccaatcttctgaatgatttttcctggaggcacaatttaattaaaatacactcaatttgtgggtcaaaatggtattctcagtggttatcttataacyttaagctatgtttcccaaacagtactataaagcacttaaattattatcttaaaaatgtctttgatgtggggatgtcataaatgctgcagacatataaaaa

SEQ ID NO: 32765 - DNA, 201 bp, Bos taurus
ctttacaaagatctttaaaaacatcaaaaaattcccagtataaacttcttactaatgaaaaatgtgtccaaaacaaatcttttgccagatatgtctatgtkctggccacatgcttgataaaattcttacaatgtgctgtgtgctgtgcttagttcctcagtcatgtctgaatctttgggactccatagaatgcaacctgcc

SEQ ID NO: 32766 - DNA, 201 bp, Bos taurus
gataagtacattgtaagctttgataacatggcactgataatatagcaaagaaataagatgtgatgtttaagagacactgatggaacctggtgcttatttamtttcatggctgcagtctatccacagtgattttggagccccccatctatttgccatggttcttctagtgaaagctatgattcttccagtaatcaagcatgg

SEQ ID NO: 32767 - DNA, 201 bp, Bos taurus
cttcagttttcctcctccagtggtttgtggtgaggcataattctacgttattaaaactcacactatgtacttattattaccttcatttttgaaatatttamatttctaagagtttttaagaatagataagagaaaagcaaaggggaaaggaaagatatacccatttgaatgcagacttccaaagaatagcaaggagagata

SEQ ID NO: 32768 - DNA, 201 bp, Bos taurus
ggtttgagttcgggttccatccctgtcaccgaactaaaaccccataattcatgtaccacagtccaaagaaaaaaatggctaggaaatcgtttgtttataamgtgtttgatgtggtctttttgatgctttgcagttataatttgttgtgctcttgatctatgagttgcagatttcctaacatttggacattatttgttcact

SEQ ID NO: 32769 - DNA, 201 bp, Bos taurus
aaacatctcacctctaacaggaactgagttgtacagtatttgactgtacagaatttgtagtaaattttattctaaatagttttaacatgtgtagtaatctygttttcatattatctttcctttcctagttgcttctgaatcttaataatgctcagcttcgaccactacagcttcaggtatccctaccccaataattatttc

SEQ ID NO: 32770 - DNA, 201 bp, Bos taurus
gcaggtggattctttatcatctgagccacactttagttaaacatacaatgaaaatttataggctttagatttggatagaactgaattaaagttttgctcamaatcgcttgcttaactgtgtggctctgggtaataaataaggtggaaagtacattttttgatttactgatatatgtgtcaggctctctataaaagatttta

SEQ ID NO: 32771 - DNA, 201 bp, Bos taurus
agcacctactaggccctggtactgcgctagcccactagagacacaatgataccaagatgagtaggtcactcagatgctgctgtaaatgctgctacttagamaaggactcaaaggaaaagctgactctgcagggagtgaaggaggaagtggcacaaataagggtatttttgagctggctctgaaaaaatacagagctttcta

SEQ ID NO: 32772 - DNA, 201 bp, Bos taurus
ggaaggatttaacttctaggttgttttattttttcctgcacttttgtccaatctgaaaaattaagtctttgtattttggagaaggaaattatgaatgcctraaagtgtatttaaatcaaaaatttgctttagtttttcttaaaacaccacctttagcagagcaaagaattttgatagctaagtatataaggataaaagaag

SEQ ID NO: 32773 - DNA, 201 bp, Bos taurus
tgtctactgtgaccactcacactaatattgatccctgcaagtctttgagaattaatgaatacttccactgcccacacctcactgggttcagacccaccttrccttacagcttctgagccccttcctgagtttgacccacttctacatcttctcctcatcctggcccctagccttgtctcagctatccttgtgatcttctgg

SEQ ID NO: 32774 - DNA, 201 bp, Bos taurus
tattttagaaaacgttccctgtgtgcttgagaagaaggtatattccgctgttactgggtagaatgtcttttatgttctgtggggaccattctgtctgtagyagtgctcaaggccactgtttccttattgcttctctgcctggatgatgcctctattgttgagagtagggtattaaagtccccacttatgtctgtattacta

SEQ ID NO: 32775 - DNA, 201 bp, Bos taurus
agttattagaccttgcagattttgtattagctgaagagaatgctagcctttgaggtgagatagatataagctcagtttagaataaagctatagtcacacaytacttaatggcctttatctgaataccaaaaagttggggggaagacttccacatttctagttcatttttaaaaatctatttttaattagaggataattacc

SEQ ID NO: 32776 - DNA, 201 bp, Bos taurus
cctatgaaatgatctgatcactgtaagcaggtacacgtattagctttgactaaaaattaaaactaaaaagagctaatgacatttaaatccctttcattttyttccttgatatataaggataggtcaaataaatgcttacagtggatgtgtgcactcctgaatattgcacattcttctaataggttttggctttttgttgac

SEQ ID NO: 32777 - DNA, 201 bp, Bos taurus
ctccattggcagccctggaccaccagtttgtttgcagcatttggaacagctggggaatttaatcgcaatgtagactatacttctttttgaaatagagcacrtataaaaagaatgagaaaaacaaagaaataatcagttacctccttacaacctctttccatccttcttccctcttctgtccacgcttgggacttgctactg

SEQ ID NO: 32778 - DNA, 201 bp, Bos taurus
agagtagagaggatgaggacaaaacacaaataacaacgaatgacaagcccaaacccaatctactacctttctaaaggacaactactctactccacgggacmcaacaaacagttccaggtcacttacaatagtaccaaaggcatggaagataatcaggatgtaaaactatccaggcaaccttgcaatctcatctctctggtt

SEQ ID NO: 32779 - DNA, 201 bp, Bos taurus
ggacacagctgagtgacttccacacatacaatgaagcatcaaacaaatctcctttgaggatgtcttctatccaagatcactcaggaaaataaaactccttrcttctgaaatgttagtgacttgacatccaaatctgagaaagaaggagaaaatgaatgttttcttcttattcctctctatttttttctctttatcttcttt

SEQ ID NO: 32780 - DNA, 201 bp, Bos taurus
gatgattccgtaacggtcagtgatattagaaaccacacagagcccagcatggagcacttgctgaataaatgtttattaatacatttagatatttaatagakttttcattgtgttagtcctaggatgtcttgtttcaaaacattagctgaaagatttttccagtgtttactttagccttcaaatcctaacaataataaaatt

SEQ ID NO: 32781 - DNA, 201 bp, Bos taurus
gtggtccccacaatgtgatctgtatccagggccaaggtaaacacttagatgaactgtgagatttctgatggagaggacatttgaaacggctcctgagtgaygggtgtctgggccatgcttgtcctcctgctctctatgtatcccggccttgatgacaaactccaggttacaacaaagacctagcccaacaaaataaataaa

SEQ ID NO: 32782 - DNA, 201 bp, Bos taurus
tactggaaaaaccataactttgactatacagaccttggtcagccaaatgcttagtatttggcacaaccctgactattgactggacataataagaacctagrtagtgacaaagtagggtcactagagtggggtctagaccagtggttttccacatatggtctggagacacttaggagatcttgaaacactgccagggtgact

SEQ ID NO: 32783 - DNA, 201 bp, Bos taurus
gttctttctgctaaatacctgaataattaaagatcagatgacatttaaaatcaaaggaggtggaaagctttgagggctgtgccatccaggccatgatgagrtttctcagagaccatctccttgtgaccaacctcagttgagttcagtctctcagtcgtgtccaactctttgcgacccattgaactgcaggcctccctgtcc

SEQ ID NO: 32784 - DNA, 201 bp, Bos taurus
tctgaaatccagagaatccacagaaccatgctctcttggcctgttgttgctggcaatccttggcttttttttggcttacaactgtatgactccaattttgygtctatagccatgtggccatcttgcctctgtcttcacgtgatgtctagtctgtcttttataaggacaaaagtcatattgtatttatggtcactgaactcc

SEQ ID NO: 32785 - DNA, 201 bp, Bos taurus
tcacactgtattacagttccgattcacagatctgtttttatgtgagagtagagaattgtgtgtctccattacttggcatggccctgggattatttcttggytgttgaataaatgaaatgcctgacaaaagtaaattcctcatttaggtaattctaacaaaaaaaatgatactctaaaatgaatcatattgtgttgtcttag

SEQ ID NO: 32786 - DNA, 201 bp, Bos taurus
cgactccataaggtaccagggaaaactgtgttcatgagggagtctgtgcttgaacttgaggagggatttgtaggtgaggagtggggtggtcctagagagarggaacagggggcatctaggccagccatcctgggacagtaagaggaaagagaaagtcagatgctggatcagtctgtctgtccattcctaggcctataactc

SEQ ID NO: 32787 - DNA, 201 bp, Bos taurus
tcagccagtttctctaacagacacataaagtttacaagtaatacaagaaaacacacaggaagaacagaatcccagaaaaactggcgacatggttttgcaayaagaatctctctactcaagagaatcttgagaatctactcaagtggttaaaaagttgtgaaagacattacagtcagaggttgtgtaaaaggttaaatttga

SEQ ID NO: 32788 - DNA, 201 bp, Bos taurus
ccatacttcattgcacaatgatagagaattgacagaataaacattctttcttgaaatctgagaagcatagatctcagtgaggcaatggcttgccttagagytttccttttgaccctgagagtttatgagctgcctggtgttggcacagcctgagatgacacatcacgggcaaaaacacgatgacaggcctctccggtctgg

SEQ ID NO: 32789 - DNA, 201 bp, Bos taurus
ctttcttgcctcttccccatccctcactccacgccctctgatgccagttgactcattcattctccatgacccaccatctcctctggaacacgtccatgttygccccgccttcccgtttcctctgcctggagctctaagacagagaagtgctttcctaaagagatgagtgatatcacaccctttcccaaactgtttatctta

SEQ ID NO: 32790 - DNA, 201 bp, Bos taurus
cctctgtagtgcgctgattgttacctaccccttggccagcttcagaaggggaaagtacagagctgatcttgagcggaagagaagtcattgcttctctgatraagcagatctaggaagcattatggccttctagcctgtgaggacatttccatatcttttctttcctgttgcatgcctgctcaaagctattgggcatgattc

SEQ ID NO: 32791 - DNA, 201 bp, Bos taurus
tctgcataacattttctagcaccccattggccaaagcaagtcccataggtaaatctacattcaagggtggtgaaaaaattccacatctttataaaagaaaytgctaaatgttgtggccactttgtttccatctaccacagtccattcccaatgcaaactacactgacctccccataatttttcccaaaatctgatccattt

SEQ ID NO: 32792 - DNA, 201 bp, Bos taurus
acctttattccttttcttcttcaaaactcgttctcctcaagattgaggaatatataagaaaaggggggaattgtaactgagccagaccctatggggacttyctgagacctgccttcacccgtatcctctgctttatgtactctctcaagtacctaattaatagtatttgatgcaaatttcctgacttattttgccaatggg

SEQ ID NO: 32793 - DNA, 201 bp, Bos taurus
cggctcacccactccccctactgggtcgcacctggcggttcatttccctcccccagggaagtcgaagaggttgggagggcacctggagaggtccgagatgkggggcctgcgggcggccctgggggaggccggctgtgaactcttggagcccactgggcgagaatcagagccccggaccgctctggaattccagcttctctt

SEQ ID NO: 32794 - DNA, 201 bp, Bos taurus
tcagatgtatagcaaccaaaatttgctatgtatgtaattccattgggtgaatgtgaaggccatgatagataattcagaaatcaaacaatcttgggccctcrgaggtaggatttttatgatagatttgaatggattcttttgttattctagtgtatttgcttttttatttttttattttttatttttttgcaaattcttaaa

SEQ ID NO: 32795 - DNA, 201 bp, Bos taurus
tcatgaccttttgcaccgatattctataggaatgtgtttactgaacaaagtttcagaagagatatcttaaaggacttgttactttgaaaaaagtcgaataygctactatacatatacccatatttgcatatttatgatgttgggattttttttttgccttctacttccaaaaatattaacatattcaagtctttgaaagga

SEQ ID NO: 32796 - DNA, 201 bp, Bos taurus
atggctgttttctaccaaggatgacaagtggatgccaagaacaaaatctgagtattaaactgtgaataaatagctgaggaatacaaagagtgcaagcaaargattcaaaccaggtgctgacttaccatgttggcatgaatctgacaggccatgagcaataagcacaggcctctatggataccacaccaagctgaaggctgg

SEQ ID NO: 32797 - DNA, 201 bp, Bos taurus
gcatgagaagatctggatttttaggcaaattaaagtcagcatgctttacacaggtgacaaattaggtggtaattaattgcattaaataaggattcaccacrgaattccttcaaacagcctgttcccctcattgcttaatgtatttgattaaaattcattacccacaacatctcttacataaagcatggttcctcatatcaa

SEQ ID NO: 32798 - DNA, 201 bp, Bos taurus
aagtaactaacacagacattgactttctctcttctccatttgtgaaacgcatcatgcatatctcaggaaactgggaaagtagagagaaacccatcagaccrtagaaggttgtaagacttaatcctcaagaccattagagtcatatgatttaggacagagagtaattgcaaaagaaaacaaagtaaaattagctatataata

SEQ ID NO: 32799 - DNA, 201 bp, Bos taurus
gtgcagaggtctctctgttcccctccaaggtcttgggctggacggagggtgtgaggacagggccgctcacagctgtgctcccagacgaggaaggggcccargtggacgcacttggtctggaaatgacgggcactggctgaagctggacgcgtgccaccgtgctgactctgggcctaattccatctggcgctccaaaaatac

SEQ ID NO: 32800 - DNA, 201 bp, Bos taurus
tgtcaagatgcatgtaacatatcctttattagccaagtaaatatttgctttactaagtccttcctctgttcattctcagtgctcatgaaactgtaatttamagcccttagggtatctgctataccatcaaatatatttcattatatttaatagcaccctcccagcgatggcaaatactgcttcaaagcagtgagaatcaga

SEQ ID NO: 32801 - DNA, 201 bp, Bos taurus
tcaccagcagaattgaaacttaggaggctaactggacctgtctttaaaaggcagaccctgagccctgtttagggcttgtgaaattagaaattaagaatatracagcacaaaaaattaaaggctagagaggtgagcatggttagccatctgtccaacaggatgttgctcactgaggagcaattctcatttgttaaatcacta

SEQ ID NO: 32802 - DNA, 201 bp, Bos taurus
ggagagacgtcgtgtttgaaagtgttgatgagggataagatttcatctttgtaaccccagagcagttcatccacagtgtgggtcacaaagagcttctgcckgtaggccttcagcagggcctcgatgatatcccgaagtaagggcagctgggtccattccatggcggtctgaggagcacaggcaaattcagagagctgtgtc

SEQ ID NO: 32803 - DNA, 201 bp, Bos taurus
ttcaggtgtggccaagtgacttgacttgattaactgaatgtggatggaatgggaatgccccagcttcaagctgaggccttaaaggcatggcaagtttccaycagccaccctctgctaccctgtttcaggcagttggtgacccttcagccaaggccctaaaatggtcatgtgtagaccagccatggtgccaggagtccagcc

SEQ ID NO: 32804 - DNA, 201 bp, Bos taurus
gcaggccatctcacttgacctctcaaccaactcctcagcaatttttccactctccctggattctctcactgaatagctcaaggatgggggtgtggaggccrtgttggagagaggggctcccctcaggcactgtcctcttctctttccctcagattggggcatttctcatactggttggccagcttccatttggtgtgctga

SEQ ID NO: 32805 - DNA, 201 bp, Bos taurus
tagtctgattcactattcacaactagtattcaacgtgttaaaaagatgactaaactttctactaatgctataaaagaaagacataaatttcattggttaartataagctatgaatacttacagaatataatcggaaacatttctgaagacttaaagcaataatagaagacatcatgtcttcttacagatatatatcttatc

SEQ ID NO: 32806 - DNA, 201 bp, Bos taurus
tggtctctcctattaaccttgatggcaaacactctccagagttcagcactgtgctaaataaataatagtaatagtttacacttattaagtgcttagctaaraaatagttaagtgcttatcacttggccaggtattgttcaaaatactgccatattaactcctcaaactcaaagaacggtattagtttggtggtgggggttt

SEQ ID NO: 32807 - DNA, 201 bp, Bos taurus
ccctgctcttttgtgctctccctcgcttaccccggccaaccccaggatacactgaactgtgtgtgtgtggtgtctttgctgcagatgaaggatttgggagmagagtacttggccggtcgcgaaggtgtccagctcttcggattgttgaacctctacctagagcaggaacagagattccagcctcgagaaaaagggctgagc

SEQ ID NO: 32808 - DNA, 201 bp, Bos taurus
tcttctctctctttcttcccagagtcatcccagatcctcttctttgcacctgagtctcaaataaggggaacaaaatagcaaatcacagcaaacattcctcyctatttcatcttttctccaagaacctcctccttgcattcctgaaaatacacagggcactgtcactagagaaaaactggtggcccgtgagtccacagttcc

SEQ ID NO: 32809 - DNA, 201 bp, Bos taurus
ttgtttctttgttatattctacataaaagtgaaatcatatggtgtttatctttctcttgtagctttaagtctaatgtcatgactacaaaagcagactgatrtagagttgtgttgatttgtcataggggtgacactgtcatgagtcacatgattttaccaagatggtgaactaaccttggtaaaattccaaacaaaatacct

SEQ ID NO: 32810 - DNA, 201 bp, Bos taurus
aggccaggcagagtttatgttgtacaagaacataatactctagcaaaacacaaacagtgcatttatgaccattgcagaaggcaagagccttaaggcccaarttggaaagaagctaattcacttgatgtaaagaacatattaaatgaactaaacagtttctagtacagaactgtatgctaatgtagaaagttctgagcattt

SEQ ID NO: 32811 - DNA, 201 bp, Bos taurus
agcctttcaaggcccataagtccattatgtttcaaacagagaaagagcagattgactcactttatcaaggacagcagaaaagcaatgtatctttagacctktagccctatattggcctcttttctttctttctttaaacctcattcatcttggatatgtgttttcagtactttacctggaagattcctgaactgtgtcttg

SEQ ID NO: 32812 - DNA, 201 bp, Bos taurus
cctcacctctcaagatgtaattattgaagacatttaagggccatttgattgattttcagcaaccaatgttagtatctgaactgatttctgttatcattacyatgtagttttattaatctggccctggattttacatgattaaaattttttttttacccgcagttcatagagcactctatatggaaaaagagaagacccttt

SEQ ID NO: 32813 - DNA, 201 bp, Bos taurus
caatcacaaagtcagcaacttggttgtggtggagcaatggggtatgaacttggttgggataattaactcagccacgtaattggcccaattctgtggcaaaytgggcttcccttgtggctcagctggtaaagaatctgcctgcactgaaggagacctgggttggggagatcccctggagaagggaaaggctacccactccag

SEQ ID NO: 32814 - DNA, 201 bp, Bos taurus
ccggacctggaatcaaacccaggttccctgcactggcagggcagattcccaacctggactaccagagaagtccctcaatggtttttgaagctctgtggctrgaattcaggacaaacatcagttatatctttaccaaaccatatatatatatacatcaaggatgagtaaagtgtctaaaacatcatattcctgtaaacatat

SEQ ID NO: 32815 - DNA, 201 bp, Bos taurus
agtgggtagccgttcccttctccagggcatcttcctgacccagggattgaacttgggtctcctgctttgcaggcagagactttactatctgagccaccagrgaagcccactttagaatagaagcatcaaataattctcaaggagaaaaaccaagcccttgattctgggtaaaacggctcatagacttcaaagaccctccaa

SEQ ID NO: 32816 - DNA, 201 bp, Bos taurus
agttcaattaaacatctttgtgtttattgatactgagtgaggatttgtgcttgttaggaaaaatatttaaactttgaccttgtatttactattaagaagtygatattattgcattgaaaactgtgtggaaaacttgttactttctaatgctgttttggagaactctttggtagaaatataaatcatatctgccttatgttt

SEQ ID NO: 32817 - DNA, 201 bp, Bos taurus
cttcatcaactagtaaatgggtttaggtttcttccagacatccttaaactgtgctggaagttgcttttagttgaatctattatgttgcattgataattttraaaccagttccaataagcagatgtaagttccagtcacttactgattataggtatttcacattagtgtttgactattgaatacccaagtcattgttacggt

SEQ ID NO: 32818 - DNA, 201 bp, Bos taurus
tttcgttcagttttcttttaaacagactacaggcaacttttttgcacacctgacataaagaagtgctgccaaaagggctggttgtgtttaggagccatcaytggctctttgcacttagatgatctttgtattctctttttctctgtctttcacagctgcaactgtcatgcattcccccggctcatttggaattctctgagc

SEQ ID NO: 32819 - DNA, 201 bp, Bos taurus
cccagtttgtatatatcaggtgcagactttgaagacagaccaagtgaaccgatctttgtctctctcttcctgcattcccttccaggggttattctctggcygatattttcccatttatccaggacattagaatcagtcatatgaacactagcgctatgaagatggagggatggagagtcattaaagaaggaaagttgtgag

SEQ ID NO: 32820 - DNA, 201 bp, Bos taurus
caagtactcatccaggcaaacatttggtgcatgatttgtttttgatacagttgtaatgaaattccattcttctctatggaacaacaggccagatctttagygcattgctgcctggtgcccagtgggcagcgagtgcctgattgccagtaccactttttagcgcgtgttcatctgcaggatattaaacagattgccgtcctt

SEQ ID NO: 32821 - DNA, 201 bp, Bos taurus
tcttatcagtgtagatctctaagccccactctgcatccttcacattagaatctctggggacatgacccaggaatctatagtgtcaatcatatacaccctgkgtgacacttccacgtatgaatactcaagaaccatggattaaacaaccgaatcctagtaaagataatctagacattccacttattccctgaatatcaactg

SEQ ID NO: 32822 - DNA, 201 bp, Bos taurus
tgactttgggaagctataccatcttgaagtccttgttgttttgaccctttgctagatgtgatccttgcacatctaataccactcctctttagatctaaagkcattgatcacttagaacactgacaatctctctaagtggactgccctacagaaggatcaataactccatcccacatggtcctagcttcttgccattcctag

SEQ ID NO: 32823 - DNA, 201 bp, Bos taurus
agcaaaatgaatggtaggttggctcaagacctgagtccgggcccttagctagcagaggggcggagggtggggagcgttggggtcactctggcgcctgggcragccttccctcctttggggttccttgtagagagcttctgagatatagtctggggtgaagctgggacagctaggtgaggatgaatcgggacacgctaggct

SEQ ID NO: 32824 - DNA, 201 bp, Bos taurus
catttataacatgaagatttctgaggctgaaactcactctacaagagtgaaagaaaagcaagaagagtctggaaggggtcaagagtctggaaggggccccmaaattggaggaaccatggagagtagatgtcttagaattctgtatgaaaaggacagaagcctgtttggtggctcagtctcagaaggccagagcccaggaat

SEQ ID NO: 32825 - DNA, 201 bp, Bos taurus
ttttttttgacagctgaagcagactgcctaacattcaaattcccaagggaatgaagagtgattacacatttcttctgcgttgccttcaatttccatagtcyggcatttaagactctcccagatcagctcatctacctttattttctttttgtccttctattactctgtactacagacagacagaactgtttttattgttca

SEQ ID NO: 32826 - DNA, 201 bp, Bos taurus
tgttctattttatatctttgtggttataccttaactgtttattgtagttatagttgcttttataattttttgtcttttaatctttatactggcttattttrttgtttgattgttagtccttattatatatttgccttttctgtgagacttttctttcccatatatttttattttttttctatttagagaagactctttaac

SEQ ID NO: 32827 - DNA, 201 bp, Bos taurus
gaggagatcaccaaagcagatttttttcttcattaggtatcctccctgggtaggttataaagatgtgagaaacactgaaggcaggccaagaaagagcagasagctcacagaactgagagagagcaaaaagcaggggagagaaccaaagattcacagggaaaaaccaaaaagggagcaaatttccagggcctattgaatttt

SEQ ID NO: 32828 - DNA, 201 bp, Bos taurus
atttcttgtgagcacaaaggccaaggcaaatttacttgtgtggcatttcatagcttactcgtatatacaaatagaaagcatatgataaggcatatttgtcragggcccaagatctaaagctgtaataccagggcttgattcctaattctgtcccttatgagttggggaaccctgggcaagtcacttaatctcaagttttct

SEQ ID NO: 32829 - DNA, 201 bp, Bos taurus
ttgcagttgtctatctgcgtttcttatctctcctacttgactgtaaacacctggagggcatggttcacatctgattgtctctgctgagtctctcacagcamtcgctgaaagtccaaatcctagggacagagagcgttatgacttattacctagcagaattgtacttgaggttctgaaattctataggaagaatctgaaatg

SEQ ID NO: 32830 - DNA, 201 bp, Bos taurus
gcattttgcagtcattgggtggttgtgatgtgcggcctacaggctctgcaaggcagatgaagggtctggaggtatcacagaagtggtgaggggtccccggrggctccaccaatgggaactcaggacagatgttaagaaacgcctcaccagggaagctgggagcttagttagaatgacagaaacatgcctaacaatggcact

SEQ ID NO: 32831 - DNA, 201 bp, Bos taurus
atgtgggtttattgaatgaatgggtcattgtgaaaaggccatttcctttgcttcagtgatgctgctgatgaatttccccagaagaggcatactgtcagtaygtctgctttgacacgggccttgcactggccctggtaacccatgaagatggaggctgtagggataggtcagtgtcacgtggaagaaggggagaatttgttt

SEQ ID NO: 32832 - DNA, 201 bp, Bos taurus
ttgcccaaaggcagaaacccagaggaagcagaggagatgccagtgtacaagtcagcaccacttcccaactaaggccctgcctggaaatccaaatgactctrctcaatttaggttaccaacctcctcgccactggctattcggtgagccagatcttttaagtttctcatcattctttcatcccgaaaatcataaggaaatgt

SEQ ID NO: 32833 - DNA, 201 bp, Bos taurus
aataaatcattcttttgagaggagattcaactatatttaacatgaatttatttagataaatgttcttcatcttgtaaaatctttatagtgaatggcagacrtactatttctctagttcaaatttctctttatagtggtttggtctggtttcttgtggaggagttgatcttataatgaatgaagaaaaagttttatgtttca

SEQ ID NO: 32834 - DNA, 201 bp, Bos taurus
aagtgaggagtggatgttgatgaaaaggcaagtctctgctctctgggacaagttcatatttttaagagatttacccggaatgagaaacaaaatcaggcttycctgactaacacacagaacaatctgcatcgtgtcttcttctgatcgtatcaaaatttttcccagacactcgctggccagggccacttttgcgcggtggat

SEQ ID NO: 32835 - DNA, 201 bp, Bos taurus
caccaaccacaaactttaaaaagaacatgtctttaaaataatgtgttgggcccataactctctcatctgtgacaagatgtcacagaatgtcccagtgcagygttcttcctgattagctgtcttgtcataagagaagtctgtcaggactgatcttggccaaagcagaggaagggccaacaggtctgcgtaacctgactccct

SEQ ID NO: 32836 - DNA, 201 bp, Bos taurus
tcgagttcaaagctgacagacttgagatccaggaagaactgatgaattaatttgagtccaaaggcaggaagacacctttgtccaacttcaaaagcaatcaracaggaggaattttcacttccttggggaagagtcggcctttttgttctattcaggccttcaactgattggatgaggcccatctgcactagagagggccat

SEQ ID NO: 32837 - DNA, 201 bp, Bos taurus
gcgctctcactgccagggcccaggttccatccctgatttgggaagtaagatccccacatgcaagctgcatcacgtggccaaaacaaaagaaatctagttaragatttttaaaagacaagtgatgagagtaggtggcaagcgatggttctggcctggtgctcggcctctgcagcctggctggcatctggcccaggaatcaag

SEQ ID NO: 32838 - DNA, 201 bp, Bos taurus
tagatatgtaacaaatatttgtttaagtgaatatttttatcccaattgatttatggtgagaaaccacccaaatgtatcgaaatatgggaacaattacatamgttacattggggttggccaaaaagttcgttcaggtttttactgtaagccgttaaaccggaacaaagtttttggccaacccaatagtatagccatgtgtta

SEQ ID NO: 32839 - DNA, 201 bp, Bos taurus
taacatttttggttggtgccaaattagggggtgctgcagacatcattgagggacagagaaataacacagatggatctaaagaggttagaaataggaagagmaattatcacaatgagatttgatttaggcaaaatgcaaatgaaggcagctgggagagaaatcatccaaaatgcaaaataatcagtgggttgggaaacctag

SEQ ID NO: 32840 - DNA, 201 bp, Bos taurus
cttcattcactcttctgatcagggaagggtcctccccagggctccacgtgaatacagtgggcttggaacaaacctccccacagagcagccacaggacagaracaaaacccatttggcggtggaagtgccttgatgcccccaaagggaaaaatgatgaaacatagtccttccaacgttattttaccacaatgtttctgcctt

SEQ ID NO: 32841 - DNA, 201 bp, Bos taurus
gtttctgctttggttccctgaaacattgcctggatcactcatgaaaggaagctggtttagcctaacaaagaatgagaggccctgagaaagagatccgaggygtccagccagcactcagcgcccagcgcccgctgtgtgagtgtgagtgatgactacccatccagcccaggtgagaccaacagagaagcaggccagccaccc

SEQ ID NO: 32842 - DNA, 201 bp, Bos taurus
gaaaaaatcttcagtgaaattagatttaaaccactgatagaaccctggttgatgtttttctagttcgagtcaatttagaactgtcaaggaagaggagagtrataagaaaataagttgtgctaaaaaaaacacacaaaaaaacctgtttcttgcctcccaaaagcactaaactgcaacaagcagacaaacagatggcggtgg

SEQ ID NO: 32843 - DNA, 201 bp, Bos taurus
cattttccctcgatttcctcagaaacttagttctcagtggagatgtgggattctgtaatacgccctgttcaacagctcagttcagatatataacaaacacrtgataaacagaatagattgtgccagtactggggctacaagatgaatacgattggtcttttgcctccagaggtatgtccaacacaggggggatgtcaataa

SEQ ID NO: 32844 - DNA, 201 bp, Bos taurus
ggaacattttcagcaacgttctgatgctgaaagctgggcctgtttgtccccccttcgcccactggattccatctttcctttctctctgtcttctttactcrtagttatggacagatactgtggccaaacagctcattgtcactttctttgccaatcacttcctgtttgtttttttttttaacttgagatacctctaccgtg

SEQ ID NO: 32845 - DNA, 201 bp, Bos taurus
taaaaaattcagagctataaaaaaattaccatttcttccaggcaaatgtacataactgattttaataatacaataaaaaaactttgtagttgaggaacaayagaagattgtttttattggctttgcagggaccacaattttgttaacctattgtatacaacaaaaccaaccagaaaacctagttcatctatcttcacctca

SEQ ID NO: 32846 - DNA, 201 bp, Bos taurus
tgtcccctgtgggtttcagggactccaatttgagaagcactggggagatgatggtctccacctgactgttgactgacttacgaacaaggttgggttaccarttttctttgtgtttatgttgaggttctgctcaatgtgttgttagacttctaacaaggaaaaaagaatatatatgatggacttaaatgtaagtaaaacaaa

SEQ ID NO: 32847 - DNA, 201 bp, Bos taurus
catctctagcattctgttttaagacaaagtccggaatcctagattttcatatttctcaggtacggagtttttagacaaataatttgtactgaagtaaaaayggagcttcttggttccatccggccccacctggcccccttccgacattttcaaggcacgtcttgcttttattacccttgcattaacagatctacttcaagg

SEQ ID NO: 32848 - DNA, 201 bp, Bos taurus
ccagagttctcctgtcgatggttgttcaacagccagttgtgattttggtgctcttgcaggaggaggtgaatgcatgaccttctactctgctatcttgaacyggaaaacctgataatcatggactgatttccctggcttcctcatcagcaagcttctgttctctttggccagtgggaggtactggcagaagactggaaagcc

SEQ ID NO: 32849 - DNA, 201 bp, Bos taurus
ctgtgctacccatctaaatttattttgggacaaaatatactttcattcatgcacactttaatataaatttaagtcattatgtcatcacctccaggaatgcrtatatcaaaaccttgagtcctaattgagcaatatggtttccctggtgactcagggctaaagagtctggaattcaatgctggagacatgggttcagtctct

SEQ ID NO: 32850 - DNA, 201 bp, Bos taurus
aagctgcaaaacttcttttgctttggggtccaatccaagtcaaggcctgagtacagcaccttcctctgcaaacagaggggaaaaaaatgaaactcagtatraatgtgagctctggaaagggcccggctttggcatttgcaagccagacccctgctatcctgtgaagagttagaaagtcctgaaagtgaagtcggtcagtcg

SEQ ID NO: 32851 - DNA, 201 bp, Bos taurus
agcaaaatgcaatggaaggaagtgcgccagttctgagcaggcctccagaggtcctgtgtgctcaggttctctcttttggaggcttgctcagatgcccagaygaccaagcatggactggcctgccggaatatgagagccgtgttgggcgggactctgccaagtcagccagcccagctgaggccatccgaaactaaccagctc

SEQ ID NO: 32852 - DNA, 201 bp, Bos taurus
tcctccttggcactttggagaagaaatcactatgcaatcagcacgtatgaaaatcaggcaatgcatgcattagcgtctggccagtgagggaggggtggtargtttcaatccttgcattggctagagatgctgttaatcccatcctcctgacatctctgcaaatgccttgaggtagcaggagggaatgagtcaggagacaat

SEQ ID NO: 32853 - DNA, 201 bp, Bos taurus
aagctttgctgaaacctatctttcaggaaggaggggagctggagctaccaagtcctgtcacccggagccccaccgattgatttgggccttactgctggccrgtggccagctgaggggaagtcgcctttctccttagtgtcataagttaagggacagagggcaggaacatggagaatgaaaagtcataatcctcctgaggtt

SEQ ID NO: 32854 - DNA, 201 bp, Bos taurus
ggaaaaaaaaaaagattccaaacagggaatattgttaggcttaattttttttcctcctttgtttgttttgcctatttgaaggggtaatatgataaacattraacaataaatcatgagtatgtaaattgcattattttagaagggactcaattagtatttttttaatgcaaaagggttgtaaaaagtgctcaataaaattaa

SEQ ID NO: 32855 - DNA, 201 bp, Bos taurus
cttttgctctggggatctgctaacatttgcaatcatttcttgactctaatctggcttgcctctgctactgagtatgttgccatatcatgccaggatataaygtgttaagtactaacttaatgctaaaatagttaaaattaatttatcttttataagaattcaaaagaagataggacagcagcagaaatccagatgttaaaa

SEQ ID NO: 32856 - DNA, 201 bp, Bos taurus
cccaggctgctgccccaggggagacagcaggtcagggtgtgggtcccagctccgggctttgttcacacgcagttctcctgggatctcctgcaaggtcagtycatctgtccaggctgaccgtctcctcaggccgttctgtttgtgaggcgttgtcggaagaggtagacgttctccacaaaccggggggctgtggactgctgt

SEQ ID NO: 32857 - DNA, 201 bp, Bos taurus
aagggcggggtggaggctggcagtcctgggcggccctggaggagggaggggcagccttcagggacagagcagcccccaagctgagttgccattcccacccrgagtcccggcctcctctgacgtgaggaggatcgacctctggttgtttcctgccgatggagctagggtgctcagcttgtgccttgcacgtcattttaggag

SEQ ID NO: 32858 - DNA, 201 bp, Bos taurus
ccacagcctcagcctgggccgtggggacaggaaggcttcgctggggtcctctctggacacacaggtttcccaactgcccggcatccttggtagctgcagartccagggcccgctcaggggctccatctagctctgcacacagctccagagagagatgggccgccctgagttcttggaggctggctgtgcctccaccctgcc

SEQ ID NO: 32859 - DNA, 201 bp, Bos taurus
agggtggtggcgcggggcgggggggcggggagatgcccaccccaaggtccgagactcgaggcgaaccgccgtctccacctgcgcacggccgcccgcagcgyctctcctccttgggggtttaatactgcctcctccgagaagccttcggggacccgggagggctcaggcacctccctccttcccggccccagccccgggccg

SEQ ID NO: 32860 - DNA, 201 bp, Bos taurus
gaactttacaccttcacccacagtccgcttcccaggtcacactctctcccgtgctgggtacactgagaattgcatactcagcctggggccacgtgcccttyggaggggacccaggctccgacagggtctgaggctccctcgtctctttggaccaggtttggccgccccacctggcaggcaggcccaccaagcgctgagact

SEQ ID NO: 32861 - DNA, 201 bp, Bos taurus
cgctctgcatggtgctgaagaaagtcctcgccactgccatggtctcccattccacccaggaactcagtctcctctgaaagccgtgtggctacgggcttatrtccatggatttccctgggccaacacacacaccacgtcacctggacatggctggcctgatagaagagcagacacactcccggagctatgagggcgctgccc

SEQ ID NO: 32862 - DNA, 201 bp, Bos taurus
catgcggcctccagggctggcagggcgacggcaggggtgaggacggggaggtgccgggggacagggcagacctagtgcagggccagacaagccctcgagayggcaaggtcggctgcgctgggtgggggtcagtccacagcatagccccacggagaggggcccctcagactcaggcgaaagagggctggagggcaaacctgg

SEQ ID NO: 32863 - DNA, 201 bp, Bos taurus
agagagaggccttgtttaccccggaggcagggagccaccccacagggagagaaggggcagcacagagtgacaggagggcagagggcagcccgatgcccccrgagctgtgggccctccgtgagccccagtcccctgctcccagaccccggatccggtccccaggccggcaggctgtgtaggtgctgaggacggcggagacag

SEQ ID NO: 32864 - DNA, 201 bp, Bos taurus
tgcacagcccagtggggccatgggacccccctcactccgcaaggagccagtcaaggaactcactgcccagggcgaccccttggtgggctctactatgactygggggccacaggagcagggctgggggggttcctggatgcagggcccacaagcctgcctctggcagagcaaagctagtgagacagggtcctgcacgtctgg

SEQ ID NO: 32865 - DNA, 201 bp, Bos taurus
tgccccccaccagcgggggttcaccccaggccgacccgtccaagcctcttcttgaaagcgttactcattccatttatagacaacacagcttagccttgggrattcaggcctgagcacaattaccgtgagaacgagccagcagcgaaactccccgctgagacaaaaggacccctcaggcctccagtctagctgcctccagct

SEQ ID NO: 32866 - DNA, 201 bp, Bos taurus
ggctcggagactcagaaggcatagcttgatttctttaaacttttacagcaaatacccttttcaagaaacgtaatattaaatgacaatgatcagacatttgyttgttttacttatttcccatattagacaaaaatttaaagagccctagtcggagaaggcaatggcaacccactctggtactcttgcctggaaaatcccgga

SEQ ID NO: 32867 - DNA, 201 bp, Bos taurus
ttctgctttggcctccagaaagctcaccaacctaacacaaaagaacatatttcacggtgaataattcagctactgaacaaagccgcgtggacggcctgcayggcacgcagaggaggacggccaggccagggccgcaggtggaagccggggaggctctgaggcagccccacgccacacggcaggaagatgcctgcttccaac

SEQ ID NO: 32868 - DNA, 201 bp, Bos taurus
ggttggaggacattctgatgaaacgtcccactgtgacaataagtccctaaggcagggttttaaacaccttctctcttcttgttcatggcccactgcccacygcctatccgggcactcgtctcagacctggagtggggggtctccagagcagcagttccctccctgccagcctcacggtccgtctgcgggttccacggcctc

SEQ ID NO: 32869 - DNA, 201 bp, Bos taurus
acgcagacgccaccggggaaggtctgcctgtcagcaaaccagcacaacttagcagagcagcatccgacttgtaagcgagcttctcctaacagtgtggctarcactaactggctctcagggatcactgacactctgtgaattcacagatcagagctctggaaccagagaggggaggaccagacccccagccacatgacaccc

SEQ ID NO: 32870 - DNA, 201 bp, Bos taurus
gtggacgacagtaactgccgtcagggaggcgaagcgggagtgccaggtggaggaagcactgcgcaagcgtggcagtgtgcatacaacagggccagattcgmgttgtcaaaggttcactttgcagcaatgcaaagaacagacacaggggaagttgcctcagtttctctggcacagatccctattgcagcccagaggcacagt

SEQ ID NO: 32871 - DNA, 201 bp, Bos taurus
cattggtcacctaaggcggccttcttctctctccttgttattctctggaactctgccttctgtcgagtgtgtctttcccttcctcccttgcctttagcttytcttctctgctctctgtaaggcctcctcagacggccactttgtcttcttgcatttccttttcttggggatggttttggccaccacctcctgtacagtgtt

SEQ ID NO: 32872 - DNA, 201 bp, Bos taurus
ttttatggtatgaatctttcttttttacacaactgtgtgtcataaagtacaaacccatagcacgggaagaacaataatcaggtcaggtatttaaatacatrttttgcacattctatttcgtcctcatagcagtcctgtatgatgatcagggatgacgttgctgtccccattttacagatagagtaaccgagacttcagaag

SEQ ID NO: 32873 - DNA, 201 bp, Bos taurus
tcataaatttaagcatttcaggcaacttcagctctttcaccagtctttccaacgtcctcctagggatgggggctctgaggagctccaggggcccatctcaycctccctggtaaccagctcaggaaagccactctcccgatctgggagcaatgcctctatgagctgagtgacaccaaagctactctccaggtgcccaggccc

SEQ ID NO: 32874 - DNA, 201 bp, Bos taurus
cagggtgtctcctggttcgcctccctcccctgcacctgtccacgcagggctcccggtccggtgatctggatccttctccaccactctcctacagggccccrtctggcggggctggctctttgggacacaaagaccaggtccccctgtggctggtggctcaggggagctcggcctgactccaaccctggccccagtgtacgt

SEQ ID NO: 32875 - DNA, 201 bp, Bos taurus
gctcctgcctggagaatcccagggacgggggagcctggtgggctgccatctgtggggtcacacagagtcggacacgattgaagtgacttagcagcagcagyggctgcttatggcttacagtttccttcttggcacggcctggatcctaacactttgaactgtaccttgtcatgcaggacagttttgtttaagtctgtcggg

SEQ ID NO: 32876 - DNA, 201 bp, Bos taurus
gcagagttctcactccacagattcacggggcaactcctgcactcgtctgcaacaagcggcatcacacagcatctcctcttgtcgggcctctctcacagtaycatcacttggagatgatccctcgtgtggctcacgagactgctcctttcactcctgagcagtggcccttggagataagtcacaactcgcttaccattctgc

SEQ ID NO: 32877 - DNA, 201 bp, Bos taurus
gaacccaggtctcccgcactgcaggcgggtcctccaccagctgagcccccggggtgcggctccactctaaggagcccctgaacgacgtcaaggcaagtcaygacagtgcgccggccctaaaactttaggggcgaacatacgagccctgtgactatccagaaatctgtgtcatctttgactgcctttagttcagtttagtcg

SEQ ID NO: 32878 - DNA, 201 bp, Bos taurus
aggctatgcctcagggcacagagcctagcaagtctgtgtcccccggctttgcgtattttgtgtacagagctgtgctatgggccgaagactctagaagctamgctgtttcctattcatcccacagtcctcatttccccgtagaagccaactgcacatggaagcggcctctctgcctcaaggccgcctccgacggccgtggtc

SEQ ID NO: 32879 - DNA, 201 bp, Bos taurus
cttcagccttcccggccactaaggcagcctaaactggagcacagagtgcaggaccacagagctggagaccccaggtctggttccaagaaaagtggcgcagraggaggaaggtagggccgtgacagtcgacgggcaggggctggagttacacaaaagccaacaccccccgaaaacgcctaccaaggctctgaactctcccct

SEQ ID NO: 32880 - DNA, 201 bp, Bos taurus
gccagggcgtgcgcgggggccggagggcttgtctcggtggagagcaccatgaccaggggctggaaacgacagaaatctctcctctcaaaggttggagaccygagatctgaacctggcggggccacgctccctccggaggctctgggcaggggtccttcctgcattttccagcctccggtgactctaggagtcccctggcct

SEQ ID NO: 32881 - DNA, 201 bp, Bos taurus
tagtcggacacaactgagtgactgaactgaactgaactgatgcatttgattaaacgtgtatttattagagtacatctctattttgtctaaatatctatagraatcaaataatgttttctaatacatacttatccaaaatcttttttaacttaatagagcttagaggtgaatatgtttttttttctggtaaaataagaatag

SEQ ID NO: 32882 - DNA, 201 bp, Bos taurus
atggagctgaggcttgagctgcagggtctgcgctcactgctgggagtttgtggacacgcagctgcgtctgcagagaacggcaggcgtgtggggggacacarcagacaacacttggcccagttccaacagctgtcaactctgtccagtctttgttccccactagttccaaacctctgtcccctgggttattttgtagcacgt

SEQ ID NO: 32883 - DNA, 201 bp, Bos taurus
cgaaacccctgccctcgtggagcttgggggtggagggcccgagaccgacagcaaacaggctcaactagtcgcggtgtggcaggtgatgagcactggagaayacaactcaggggcggggcgggccgagagcacggaaaggccgcattccggggcagcgctgacggggaggcgacaaccgaaggaagccggccctggaggcgc

SEQ ID NO: 32884 - DNA, 201 bp, Bos taurus
cagtttcctgttctagacttcttgcagcttttggcctctgacgccttctttcatcagctggttgtggtggcgggctggtgagagagacacgggcagtcctsgttggttcacagtgcccagggcctgagggacccagggcaatgactctaggccccagagggcagctcctggtcatggggccatagacacccacccctcctc

SEQ ID NO: 32885 - DNA, 201 bp, Bos taurus
gacatccagtccccggggtggccactgaatgaacacagagatgaattagcagaggctgaattgacagccctggtgaccggcataggggcggggcccctcartggagaacaagaagaggctgagttttggcaaaagtctgagtttagggtcctaagggaccctgaggagggcagtgagcaggccgttcgctgaaagcacaga

SEQ ID NO: 32886 - DNA, 201 bp, Bos taurus
cttgcccctaaataagggccttgggagctcaagctgcccagggcctctgggtcacctttcccatctgccccctgccctcccagcggcctgatatccccccyatagtatgagcatgagcttaggcctcacaggccagcctccccaccccaggggcagcacaggcctctgcattatctgtccccagatgcagctggatgcccc

SEQ ID NO: 32887 - DNA, 201 bp, Bos taurus
acttttttaattgagtgtttgtctttttattgttgagttataagtgtttatgcattgcttgtattcttacatattcttttctcgaggaagattttgggttmtttctttttggtcgcgctgggtctttgttgctgtgtgcaggctttctgtagttgcagggagcagggcccactcttcctcgcagtacgggggcttctcatc

SEQ ID NO: 32888 - DNA, 201 bp, Bos taurus
tctgggccccaccccaggctgccccccgaggggtccccacctcaaggcgctccttcctgtctggtacagcgacctaagtcctgctggaactggctggagcycggggccgctggccctctccacaggggctccctccgcaaccatgtgctgtcctcgctgggccagcttcccaggagccacactcacctgccttggtaccct

SEQ ID NO: 32889 - DNA, 201 bp, Bos taurus
ggggtctgtgtcctttgatctaaccacgcctgattgaaacaagtcccgaagacagagtttagggcagtcttcaggaggctttctcttctgaagtccccacrgggcctctgtcatgtcaaatctccccccgacaaggacattagggcccagtcagataatccaggatcatctccttactgtaagacccttaactcaatcgca

SEQ ID NO: 32890 - DNA, 201 bp, Bos taurus
cagcgctgccgcaggctcttcctggacacggggtgtcttgacgtgttctcaggtccccacagatccccagaaagttttaacatctgttttcccactttggygatctaagcatttattatagcgtgttcttgattggcacttcttaaccgagtaggatctgacctgcgctcttatgacccagtgtcgctgagcggaagtcgg

SEQ ID NO: 32891 - DNA, 201 bp, Bos taurus
tctgcaggcacttgggcagagctgtcagtggggtgatgggttccttgctgccatccatacccagggcgggggacagtggggggtctctgctggccttgccygcatctcggtctgctttcttgctctttgctttctatggaagtaggtcttacgagcacatggaggagatggattttggccacgtgtctggtgcgcatggcc

SEQ ID NO: 32892 - DNA, 201 bp, Bos taurus
accttggccctcttcaccccgagataccgggtgccccaaaggaggacgccctcgccttgccgccacctgcatccctgctcccacctggacgcaggtgaccygcactcctgggaaggctggcccagaccttcacaggggtgtcagttgactgatgggaaaaatagatgcttggggaggttgacagatggctggacggccggt

SEQ ID NO: 32893 - DNA, 201 bp, Bos taurus
ccttgacgagctgtgtgcccctctgacctgacgagctgtgtgctcctctggagcgggcagacagcgtctctgtccacctgagcttcctcttctcagctccrcaggtccacggggccgggggcagcccgcctttgtggctagtctgggaactgggctggctcagagtctgcaaggccaaaggtggcccttggccaggtgatg

SEQ ID NO: 32894 - DNA, 201 bp, Bos taurus
ctggccgaaccctcccctgctctagtttgcgttggggaggggaggggggtgcaggctggcagcgacaaccacagcagcacctgagtggaccccgtcacccragcgagcttttccagaaacgcctcaagccctacaaggggtcaatcggctgccacattcacacccgctgcccacctcagtcccatgagtgacagacgccct

SEQ ID NO: 32895 - DNA, 201 bp, Bos taurus
ttccaactttcttcttgcaggtgaagaagaggccgtgctccttgcagtggttttcgttccttgttacacgctgtgcccagtagtctttgtgcagcaggctmgggttggccgtgcagccctggctcctcctggagtccagctccccctgaggccagggacaggagcgtgcaggacgagggtccacggggccaaggcttctgc

SEQ ID NO: 32896 - DNA, 201 bp, Bos taurus
ttcaggatgtcagccaccatgagcacccaggggtccgagtccaggctggcgagctggatgatctccgtgagtgcgcccttcatctgcgagacagcacaggygcgtctgggcccaccccgtgctgcccgcgcgggtctgagggcaggcgccgagctgggcctctgagcgcctcgccttctcacaccttctcacacgtgggcc

SEQ ID NO: 32897 - DNA, 201 bp, Bos taurus
ggtgggccctggtggccagagcagggacacaggacaccagcgtggggaccaggcttttattggtgagggcacgtgctcgtgtgggtccttagtgcccagcmggccagcaggcacacagggcccggcgctcggcctgcagcaggaggctctccgtctgcaaagcaatgaggggtgtgagagctccatcaggcggcacccaga

SEQ ID NO: 32898 - DNA, 201 bp, Bos taurus
atgaaaaataagattgcccctcatttatgagtatatacatgtgtaagtaaaaagtattcctaaaacatatctagataataataataaagaccaaattctarataaaagttatcttggaagagggagagagaattaataggggaggcatgtttcaggtataccggtggctttgggggtcttaaaaaggttgacgacataaac

SEQ ID NO: 32899 - DNA, 201 bp, Bos taurus
ctcctccgcccatgccatccccagggcagaggcaggctggccagtgatgccagagaagggagaaacacagaaggagccctgggcttgggatgtttctgaaycagagacagcaaaaaggggcctgactgacagtggccaccacaggggctatggtcttctaaaaaaaaaaaaaaaaaaaagtgtgcatgtgcgtgcatgtgt

SEQ ID NO: 32900 - DNA, 201 bp, Bos taurus
cctgcacacttggagcccctaggtccctgtgatccaagcagctgtgccagctccatgcttgatccacactgtggcagagctaccagaggctaggaaaaaarccctaacagcctcatatctcctaagcctgtgctgccagccccactgtgtacttggcactcttagggtccctgagatccaagcagggactataaaagtctt

SEQ ID NO: 32901 - DNA, 201 bp, Bos taurus
tcaccctggctcacctggaagccttgtatcctgggaggccccccagacccctccatgcttcactcttagaggacaagaggttgtccatctgtcccctcctrtatcagaagtccctaaggagaggccatctgtcctgagcacagttttaccaaagccaggatggtatggccaagtcagtgagctgtccccatccccacctcc

SEQ ID NO: 32902 - DNA, 201 bp, Bos taurus
aacaaatacttattggcctctgtcccttacaaaacataaaggctagtctgttggtagctacacacagaggctgtccagtagaggtggccaggtaaggttcytgagatgtgggcttgctggcagagttcaaagctgaggcaagggagtggaggaaccagccccagagcaagtagagatgaaggagacactgggacttggaca

SEQ ID NO: 32903 - DNA, 201 bp, Bos taurus
cattattgttaagctttattaattttgcacaagcaaaccgtttgtcttgcttgtgtctccccccttgggcccagacatacatggggaagcagtgtcctctygtttcaggggtgccttgtaagagctgtagcatacatgtgcctgtgttaggtgatgtttggtccttgcagtgtaggcccacacctgcagaccagaaagtcg

SEQ ID NO: 32904 - DNA, 201 bp, Bos taurus
cactcttgcggcagggtggagtggacagaagctggcgggaatgcacggggcccactgaggtggctgcaactgcagccaccagggaaacaactgtggcctaraccacatacactgtggtggaaaacacgggaatggaagcaagcaaaatcaagagggctgctgatggtctggagcggcctaagggaaaaggtggtttgagga

SEQ ID NO: 32905 - DNA, 201 bp, Bos taurus
cctggagcatctccacaaatatagtatacacaggatacctttgttcagaggcctgggaaggcagttctgaaggacttgaagctggaaggctggcaactggkcccactggatctctgcagagaaggagaatttcagtttgggcttccaggtgacctggatctaattgcaaaagcaggggtgagttatatgtggtagagtcag

SEQ ID NO: 32906 - DNA, 201 bp, Bos taurus
ttgtatctgtacctgcaaagatacctggaatatacctgtagttccacatctcaagggggagatccgtgttttagccctcccctgctcacatgtcaattctrttatccacccttcatttgagaaacagcactttgtgctgtgcattgtaatatgaactaatatgaactggtgagagttgataaaaagagccctgggccacac

SEQ ID NO: 32907 - DNA, 201 bp, Bos taurus
agctgcactgcttattccttctgagtcagtcttggggactgggaggagccaaataccaaatgagccctccctgcttctgatgacagggttgctctgtcatmcccattatgctccctcaagtatttattgcccacaaaataaaacaagtgctcaaataatcacctatgagatccttgccctttctccctcttacctgatgcc

SEQ ID NO: 32908 - DNA, 201 bp, Bos taurus
ccagctctgttgctgcagcctgcctgagaggggccagggaagtgataagtgaaaatccatcacaacttctggaaataactcaaaggacacactcgactgcrgaaataccagcaggactcggccaagctcagcaatgttgtcaggagaatgattccatttcagcaggtactgtccttgtggaaagaggtctttggaggatag

SEQ ID NO: 32909 - DNA, 201 bp, Bos taurus
tgaattgcttccgtctgagattgaccattaattaagcttacacattggagcactaccaaggttctgagtatgcaaagctgcctgtgatacggcctttgtcytgagcattcaaggaagcagatgagatgggggggcagacatctgccccaagaccccggatgagttcatggagttgatggtatgtgtaccagggccatgtcc

SEQ ID NO: 32910 - DNA, 201 bp, Bos taurus
atctgctgtctgtccatgtgagattgcaggaaagtctccacagggacaactctgcttctgtggagtttttatattaaagacccacaaaatcccctacaggygccgggcccaccccttcaaggaggggatctttgtggtgttcacagcccacccacatgattccacatgctttcacactgttctaaatctgcaagaagatca

SEQ ID NO: 32911 - DNA, 201 bp, Bos taurus
agctgccctctgccacgtgggagtgaaggccacctgcgggctgtgccctgtgtgtttccctgctaaggtttgtgaagaggaggcctagtgttgctgcagcygctgcagtgcacactgcgtttatccccccttccaatcgtgttgagaaaggactcgaagcagctgcagcaggcacattctcccagaggggtttacggtgcg

SEQ ID NO: 32912 - DNA, 201 bp, Bos taurus
atgtggaatctgagaaataacacctccaacccccacaataaccctgttcccaaagaggaagtgccgaaaccaagagagcctgccatggagactggcctggmgctgatgctcagatctggagctgggatggtcgtgtgtgtgtgtgtgtgtgtgtgtgtgtgtgtgtgtgtgctcgtgtctgtgggctgcctgtcagggccc

SEQ ID NO: 32913 - DNA, 201 bp, Bos taurus
tgggccacagtgagcccccggggactcagctggcccttgggcaagaccctgctcccagagccccagtgaagagataggtcaggagcaagagggaagagatragtgagctggccacggggtcacgggaccaggaggtccctgcctgcctacctgcctctcttcctctccatctgccttaagtaagtcactgactctggaatg

SEQ ID NO: 32914 - DNA, 201 bp, Bos taurus
gagtgctggagacatgcagggaaaatacagagaactcaggaagtaatggaccctgatgcttcctgggaagcagatgagatctggaggctgggcctccagargagtcaagtttggtcaggaagtgaatgaatgaaggggctggtagtgagagcattgttccaggtaagatcctgagagtgtgagggtgcgatcagtgggaaa

SEQ ID NO: 32915 - DNA, 201 bp, Bos taurus
caaacagtattacaagttgccatatggagcaaactaatctctctaccagttgagtcccaacaagacataaaaaggccatcagcaccgtgtttggtgtacaycacacaacttttttttttatctttcacaccaggacttcccaagtactaaatatagggttgaaagaaaattattttcatcctgcattccttctgacaacat

SEQ ID NO: 32916 - DNA, 201 bp, Bos taurus
actggcctttgccctggaagccccctcctggacaaccctgctgtctccgcggtggcctcaggcctgagcattccactcaacaggccaggagccttgaagcraccctaccctgccagagatctcagtcgagggtgagactgcgtgtgtccttgataaccatgctgcctcctgcaggtggtcggagtgttggcctggctgggg

SEQ ID NO: 32917 - DNA, 201 bp, Bos taurus
ctcgcgtcaaatcgttctgtacgcaccgagctgcgtgggcttttcccgtgtgcgcaggttagacgtggactctcagaggaacacgtcctgtgagggccatyctgaaaggagaatccaggaacagcccgcgaaggaatgatcttccagggacacgcaagatactcacaaaggccaagtttgtttcaaagagtagaagtacag

SEQ ID NO: 32918 - DNA, 201 bp, Bos taurus
caataactatatcacaatccccagatcctactcagactttaccaactgttccacttttggccttttctgattattttgctaagttttaaattatagaaagmattctgttgttcatctcttggacaacattggatggacaatggattgcactcgattttagcaattatgaacaatgctgttaagaatattcttgtcctgaac

SEQ ID NO: 32919 - DNA, 201 bp, Bos taurus
caaccacttgattctgtattcatggaaatgatgacatctttttcattcaatctcttaatgtcaagctttctgtctattaccatggccaaagttaaacccawaatgcaaccctggactaggatcgctgatctctaccctcagattcaatactgaatccattttgatgacatttaatttatgatttgggccagaatagtcaca

SEQ ID NO: 32920 - DNA, 201 bp, Bos taurus
cccacgccaccgtggggccaaagctgcggagatgtggtataaaacggtactggggctcccccagctggtgccactgagcacagaggtatgcttgggaggaytctggtgggtgtgaggaatgcctgtgcctctactcaaagacactgtgttccacctggtgccacaagattcccaccttgacacatgcccccagtcaacatg

SEQ ID NO: 32921 - DNA, 201 bp, Bos taurus
ggccaggcaacatttcacagtaccagaggctgaggaggaaaagtcttggcacggcagtacatggtgggcagttcctatgggcattagttgaggggtccatyggccttgctcattcccagacaggatgaatgagtcagatgtgatgagggccaagccaagtagcccaccggagacttcacaatggccagtggcaggtaggtc

SEQ ID NO: 32922 - DNA, 201 bp, Bos taurus
ggtgggcatctagggtgcagccacgtttctgaaggtcactattgggaaacagcccagctctgtttagggtccaggtgttggggtctacacgttctctccayacaccactagggaagggaacagcagtcctggcgcttctgggccccagggacagtgtagccaattggtgcccaggctctgggaccacagtctgcccagggc

SEQ ID NO: 32923 - DNA, 201 bp, Bos taurus
tctccactaaggccatactgggcaagaccacaaacaaatgcaaaggctaaagctttttgacagtccctcaacaacacagaaagctgtaccagcactgaaakccagtggtgtacaggcctagatggcaaagcaacaggagcaggaccccacaaatttatacatctcaaacttcccattgtcgatggatgagcaaacactgga

SEQ ID NO: 32924 - DNA, 201 bp, Bos taurus
aggagcctggtggactagagctccatggggtcgtaaagagtcagacatgactgagcacagcacagcttttttgtagcccagtttctggggccactggcttytgactggagtaatgttgacctaaaacaaatagactgccagctatttctccagcaaagatgggtttatttgggatcaacagagaattgaaattcagggtct

SEQ ID NO: 32925 - DNA, 201 bp, Bos taurus
aatgccttgtctgaggtctccctgcgggccaggtagggcccagaggccagctggagcctgggtctcttccacacctcatacaccatccagcttcaactcaytgcacacccactattggccatctaaagtcactttgcaaactgattcaacagccactctttgtgcactcattctgccctgtccagaatttatcattacact

SEQ ID NO: 32926 - DNA, 201 bp, Bos taurus
tgcagagcagagggctagggcagtcagcatgcccgcctcggcgctgcacagtcaagaagacgggcttgaacggagcgtcccgttgcccagggaggccctcrgtgcccccaagtggaggagtcaaggtggggcttcctgcctgtaacagggtgagccgtctgtctttcagggccgagatggtggtgcctgacttctcggagc

SEQ ID NO: 32927 - DNA, 201 bp, Bos taurus
tgatcggtagtttcagccttctggttgggtctgtcccaaagactgccctttgggcaagtgtgtgacttctttcggaatccgggccccttctgtgatcggcrggacctgaggagtagttcactgtggctgcgcagggagcagatctcctagagctgggggttatttttcaggttgcttggagtatcctttcttggccccaca

SEQ ID NO: 32928 - DNA, 201 bp, Bos taurus
gaagcacccccagcctcctactcagacagccctctggcccagaagccgctcattaaagctgctcattaaagccactcagcagagaataacgtgggatatgrgagatggggcaatcgtgctgagggccagggggagcttgtgtgtcccatgagctggggttccccctcacgaggaccccaggggcaaagacacgaccctggg

SEQ ID NO: 32929 - DNA, 201 bp, Bos taurus
gaagaacgtgggagtgagatgggccggcgcgcacaaaggctaggagcgtgaggacaggtggggcctgcacacggcgcagccgctgtcctcagggacatgcrgagagaaggggctgagcttgtgcagcgactgccacggagctgagtgacaacagggtccagatgccagccgcactgggcagcggccaagctccacaccctc

SEQ ID NO: 32930 - DNA, 201 bp, Bos taurus
aacaacaataaaaagagctcatccttctcccattcctgaccataatgccatgtctggctctgtgtatatcagcctggggcctcttgaggcctcttgtccaycgcttaccatggacagggggagtgaatgtgaagccctctccccctctctcatcccttcagtggtgtttctctggaggcaggagggtctcccctccccatc

SEQ ID NO: 32931 - DNA, 201 bp, Bos taurus
tggaggaggagaagggggccccctctgaggaggtggcagagatgccaacagaggcttgaacaaagcgcagacaaaggtgaccatgggtgggtgttcggtgkggcaggaggggcagaggccctgggcctggtgagctggatgtgttggaggaccgaggcagttgtaactggagtgggtgcaagcggggagacggggctaggc

SEQ ID NO: 32932 - DNA, 201 bp, Bos taurus
tgctggggaagggtgctagcagtcatggccccacaggagcggttagtgttgcctggcttgaagggagacctgcgtccttcctggcaggtgcaccctgaccytggtctctcctcaggccaaggccttcaccctctgcctctggccctgcacgtgggggtgagaatggggtgaaggctgatactcgacacgacggaacaatgg

SEQ ID NO: 32933 - DNA, 201 bp, Bos taurus
acagctttgttgcgggacgtgaggcaggaggtgctgtgcttggcacacctttctccgtctcatggctggagggcgggaggaacagagagtcacagcacacrcaggcctagagtggccggtgacataattagagatgaggtgaggcccaggccagatctcctgggggtgctgttagagctcgttccagcgtgttccctgacc

SEQ ID NO: 32934 - DNA, 201 bp, Bos taurus
ggaagcgtttggacgtcggcgtacacgattcattctctggtttcagggtcctggagcaggtcaggcccacgtgggtttcgagggctggcctcacagcatcrcactgccctctctgggtgtcgctgccccagtttttaagatgctgtgtacctccctggaaggtcccaaggacactgcctccacgcctggctccaaggaggg

SEQ ID NO: 32935 - DNA, 201 bp, Bos taurus
caaggaacctgaggttcaaagaactgcagcgagtcaggagttatcctcaggtcagctccctgggaaggagcctcagatggaggtgaagggccccctctctyctcagactccagaagagtcttcacttggcactcagggccccttccccagtgaaaccctgagagagacaggtaatgtgactagatattacttttctctgaa

SEQ ID NO: 32936 - DNA, 201 bp, Bos taurus
acacccaactcatcaccccacccccgaggccccacatcagtttcccaccaactcacctcctcgaactccattcccgcctcccctcactgtccatctaaccraccagcttgatcctacctcagggcctgtgcatgttctgttccctctgcctggcatgctacttccctagctctcccatggccagctccttttcctctttcc

SEQ ID NO: 32937 - DNA, 201 bp, Bos taurus
gcgggcggaggggcgggacgttgccagggccgcgggcggaggggcgggacattgccagggttgcaggcggcaggggcggggcgttggcggtacctggatgyagggccttggaacttggctctcttccagcaaaatgtaaatacgacagcttctccctctacccattccctaggcattaagcccttcgggagggagtgtggc

SEQ ID NO: 32938 - DNA, 201 bp, Bos taurus
cacacagaaattgccagggggctgctactcagcaactcatgtctcggatgctcttctctgtcttgatctcagaagagggccagcagcaactggccttcacrtgggaaggatcccaccattctttttctgcactgctaagggatccgtgaactcagtcgtaatctgctcagaagcgacgtggcctcgaggcagatccccagg

SEQ ID NO: 32939 - DNA, 201 bp, Bos taurus
tgtcctcctttccatcacccttaagcccagctccaatgtcctctcctccaggaagccccgcctgaatccctcagctcccctccctgcttctggccttcccrtggctttgtggtgctgggagtgtctgtgtcagactctgtgactgtgggcttctcagggattgcccagtatggcccaggcttagagcaggcaccaaggagg

SEQ ID NO: 32940 - DNA, 201 bp, Bos taurus
gtgtcggggattcagagtggactcagctcctaccctgtgccagggaagaaaggcctgggcatggatagcccctgccccatggagcagagctggggcctagrcaagtccaaggaaggaggcagggaaaggtccatcagccaaaaaatatatcctgtgcacttcctgggtgccaccctgatgggaagaggccagggccacagt

SEQ ID NO: 32941 - DNA, 201 bp, Bos taurus
ttgaaacttatggggcttggtggttaactcagagcccctcaggggtctgagcccttcagaccctcaggggtctcccgaggtcctggccccatccctgtccygcaaaactggaaaataaattccatgtcattatctccatgtcacttgagccacaaccaaatgtgcctcatggccaagttaggtctaggatgaagggtgcac

SEQ ID NO: 32942 - DNA, 201 bp, Bos taurus
gcagcagtgtggataagcccacctcacaggaggtagcttcccagctccagggctatgttcagcgtctccaggaacgccgtgctctggtgaagattccctcygagcctggctccacctgggtgcccatatctaccgtgccccatgcagaagccatggtgcaggccattctggggacccagcctggcccagccctaccccggt

SEQ ID NO: 32943 - DNA, 201 bp, Bos taurus
gcccacatccccccaaacagatgatgcacaaggttggcctctctgtgtgcagaaatgcggccaccagatgccgctgcgtctgggtgtttctgattcaagcrgttgccgggttccttattcaggtcaaccctgacctgggttcagggtgtcgggtttctggcgccattttaaacaacgccgctgcctacaggctccagctgg

SEQ ID NO: 32944 - DNA, 201 bp, Bos taurus
tctgacatacaagatgcgcacgagagggcctgagttgcctaagctgactggtttcctcgcaaagatgtggcaaggacacagagaagtgggaccaggaagcrcggagggcagaaggggccagcggagtcacaggctcagaggggctgcgtgggagggacagaaaagcgagctccttgaggatgggcgtggatggggtgggag

SEQ ID NO: 32945 - DNA, 201 bp, Bos taurus
catcagctcactgaggcgctcagctgacttctctggcttttacgcatgccttccgcacagagtccaaacacagcctaaaacctggaagccagtcacactgyagcttaaggtcttgttccaagtgcctgtgaaacctgcaccccaggaagccccagactgtgtctggaatgaaaggaagcaggtctggggctgaggaactgg

SEQ ID NO: 32946 - DNA, 201 bp, Bos taurus
tcctgactgcagtgggttagctcacatgatcagaggccaccaggaggtagagaagagaagttagtctagctccagcctctgagactgcaggaagagattcyacatggcaggcccggcacacacagccctcagccttccccaagagacggacagacacatatcatctcttgctgccttgtgaggaagacatggtctctgctc

SEQ ID NO: 32947 - DNA, 201 bp, Bos taurus
ttccaagatgtggttgaatgagggaggtggaatattggcccctgggcatccctcagccatccctctccgggaacctggagcctcctgtgtgcatgcctccrgagaacttggcctggagtgggtctgtaagcagtctctaaaccccaaaccacaaaggcaattgtaaattccagtgcagaaaggcacaataaaggccttaaa

SEQ ID NO: 32948 - DNA, 201 bp, Bos taurus
cagcagccaggtgagttaggtgtgtcctggtgctgtgctccacagtggaagggagaaagctcaggttggagacacatcatctgggcctgctactcaccatrtttccaagaatcaaaggctacagcagacagttcccagacatatccagacctgctgccaacagctcaactgtagccaggtatggatttccagactctgaag

SEQ ID NO: 32949 - DNA, 201 bp, Bos taurus
tggttggccctccagaggctcggtagctttgttacctgggaagggaagagtagactgggggacagcaggcaaggatgctcggagtcaagagaaccccttgkggagggactgtttgttcaggcccaggcgagggtggaagcgggtggctttgggcttctgggctaatggaccgtgggcaaggccagatggtgttagctggag

SEQ ID NO: 32950 - DNA, 201 bp, Bos taurus
ctggccagcgtcctgtagggagactcctctgaaggggccattgactcagatgctgtgggactgggagatttttcaaaatcttctgagtaagtcgagttcaycgcgctggccataggttccggagacgttggccccaggcaacaaatgccctggggcccaggggatgaggccgacggctcactcaggcgctcggagatctcg

SEQ ID NO: 32951 - DNA, 201 bp, Bos taurus
tcagatccctcaccttccacgtctccttttcccttttctgtcctaaaagcagtgtgtgttaactggagaactcagaaagccaggggaggcccccgttcacrgggaaggatcattgcacacgtgtgtgtccgtcccaccaggtgcagatcccgtgcacgtggctgctgtgtgctcgccagctgggtcatcaccggccttctg

SEQ ID NO: 32952 - DNA, 201 bp, Bos taurus
caggaccctggtggtcctggtggggggctgctggcttccagacagtgttacttagtcccctgttgtggctggagttcactgccgtggccctgagtcctggygtgtgtggtttctggctcactcggactaatgagggcgtctctgtgctgctgcgggagccagggggacacagctggtctctagtttccttgtgcgctgccc

SEQ ID NO: 32953 - DNA, 201 bp, Bos taurus
atgcccacttcccagacagaagcaggccagctgggcctgaggccctgggcctggtctgggtctcagaactcaaggggacagaggcagaagtccttagggamccctgggaaccctgagaaatgtggccttaggaagcagcgtcagagagtgtggttttggagctgggcctggaggtggacgtgtgggcaggtggcgtggcag

SEQ ID NO: 32954 - DNA, 201 bp, Bos taurus
caggaaaatattgaaaaacattgactgtggcttcggattcagccaagtgtgactttgctgggctaagtcgcctcccctctctgtgcctcggccttcctttyctgtaaaatgggaaagcccttgggaactcccaagggcactatgagcagtacggagacgctgctagtgggctttgtgctccagcggctaagactccacagc

SEQ ID NO: 32955 - DNA, 201 bp, Bos taurus
tggtgggctggagtccgtagggtagcaaagaactggacacgactaaagcaacggagcacgcactgtttcctgggacaggaccggggagggttatggggackgaaacaccaaggcccggagaggtgaagctgtttgccctgggtcgctcagccagccagtggtgcactgagattgaatggggcgggggagtcgcacacgggc

SEQ ID NO: 32956 - DNA, 201 bp, Bos taurus
tgtctgagactatgtgatctacgtgatccagactttgcaaggagcaagctgagttacagaggcagaacgagcaggaggttatgtaaaatttcaacttttcytcttcaatatattgatgttgcaatatgattagcactgcatgttaactcacacctctggtgtgtgtgtgtgtgaacaattatgatgtagtgtcttatcagc

SEQ ID NO: 32957 - DNA, 201 bp, Bos taurus
ctgtgaccaaatgaaggctctggtttcatgttaatgctgtttgttttgttgtgtaaaacttgggatgctgccaagcctggggcttggttggccaggccctytccaagggctcaacaaccttgagatttcttcctcgccttatctaaggtgtgcaagtcttgcactcacagcaggctcatcatcatcatcatcatcaccatc

SEQ ID NO: 32958 - DNA, 201 bp, Bos taurus
ctatggcccatggggctacagagagtcggatatggctgagcacacagaatacagtatagccccaccacaaaagatgatccatcagcccccaatctcaacayggccaaggtcaagaaaacttgagctacataaactaacatgaatatcactccaaaatactgagtaagaaagcaaattacagaaagatatctacaaaacaat

SEQ ID NO: 32959 - DNA, 201 bp, Bos taurus
acaggctcacaaagagttggacgtactgagcacacatgcacagggacggtgtattcagtaaataacttcaatttaatgagatttcaatgtgcctttataamtaacaactatttttgagtgattttttttaaaggcattttcaagtttaaactgcagtgaaccactaatctgctttctgtttctatagatttgcctgtgcct

SEQ ID NO: 32960 - DNA, 201 bp, Bos taurus
cccagagaaggagtgtgacctggctctgtggcacttggaggaactcacagaggggccagtccccacccaaaactcaggggtcaaaccctcctatggccaartcctatctacacatatcatggcagcagagttttccaactttagcatcagggactttcagttcagtcactcagtcgtgtctgactctttgcaaccccatgg

SEQ ID NO: 32961 - DNA, 201 bp, Bos taurus
aaaggatgaacaagagtccttgagcacagtgtaggcagggcattccagatggaggaaccaggatgagggaaaatgtacagaaaggcccagaacagggttakcggagactaggagttcagaccaggaccaaattgtgaaggggcttgaaggcaccttagaaccgtcactctaaggccaaaggaaatgatgggctggaagcaa

SEQ ID NO: 32962 - DNA, 201 bp, Bos taurus
actatggttatggctatggctatggccaggataacaccaccaactatgggtatggtatggccacttcaaactcttgggaaatgcctaactctgacacaaaygcaaaccctagtgccatgggtagtgccagtgctgattccgttttgtccagaattaaccaacgcttagatatggtgccgcatttggagacggacatgatac

SEQ ID NO: 32963 - DNA, 201 bp, Bos taurus
ttatggtctacatgcaggtcacccgtaacactacgtcagcctcgtttggctaatcctagtttctcacttctcagacattttcctcatttcagtactttctyggtgttgtgaaatgaacaccatctctcattcttgctgccttgcagattattcaattctgcattgttccctatgcttcctttctactgggaaactctcatc

SEQ ID NO: 32964 - DNA, 201 bp, Bos taurus
acctctcctgtgaccctctgccctctgctccctctccacaacctctttattcctggctacatctctcacctgctatgaggataactctgtcttccatgacytacgatgtcatctgctgtaacccatgctgtatgcctgtgaccctcacctgtcccatagacatctatctgctctgacctctgactccactcctgtcccttc

SEQ ID NO: 32965 - DNA, 201 bp, Bos taurus
cgtgaagtgggggagcagttgggcaccaagggcacccactatactggactcatttctgcgcggttttacctggggtataggtgcccacagggtctggaggyggggttttcaggccctgtgtgcgcggagtggggactcgggagatgttcacccaagagtggcggcctgcctgctccagaaccttgtccagtggctggttca

SEQ ID NO: 32966 - DNA, 201 bp, Bos taurus
tatagcatttaaaaaaacatacatttcttgatacaaaaaggccagttagagttccttctgagctatgatactactaaatgatttctcaactttggccctaytgacatttgagactgtgtcattctctgctgtgggggctgtcacatgcattatacgatgttgagtaacatatctggcctaattatcagtagaaatagcaat

SEQ ID NO: 32967 - DNA, 201 bp, Bos taurus
agcaaactcgtcctcatcatggttgtgcccccatgtccttacatggtttcacacagatccctactccatcctctgttgctgctgacatctctgaaagatgygtaagactctttgttattgtcattgttgtttagtcacaaagtcatgtctgactcttttgcaaccccatagactgtagcctgctaggctcctctgttcgtg

SEQ ID NO: 32968 - DNA, 201 bp, Bos taurus
ccccccagcagaggatcagtcagtcacccctggtaccagaaagattccccactgtggcacaaatgctttttatcgttcagagagttttgtcgttgagagcrcatcgatctttttagtgttcagagcatttggttgtcatgatatttgctgaaccatgttccatcaagaatcgcttcacttcctagcagcaggagcttgttt

SEQ ID NO: 32969 - DNA, 201 bp, Bos taurus
agggggcagctgggctctgtttcacacggtcatgcagggacccagggtccatgcttcctgtggctctgccaccctcaagtcctccactgggccaattacamtttgatgctggacagaagaagagaatgagcgtggaggatcttgcaggaagttttaggaacctggccctggagtggcttatgtcgtttcctctcccatccc

SEQ ID NO: 32970 - DNA, 201 bp, Bos taurus
gacggagtttgacctaaggacgctgagggcagttcgagtgctgcggccgctcaagctggtgtctggaatcccaagtgcgtgagtttctaaccctggcaagrggtctgctcaggggtcctgggagccctccatttcccttctgcaagaaggtctcataggtgccctcagatgcttccctagcctgggtcagggcagccttat

SEQ ID NO: 32971 - DNA, 201 bp, Bos taurus
acccgcacactctttttctggttctatttctttttttatttatgggacgcacaggggcgagtggaagttttcctccccggccatacacacgagcctgcctrccgtgctatgaatagaaagagaagaagaaagagagcttggaaagtgcccatgccagcagcacttccagggcagggacccggcgcccagggtgcggccacc

SEQ ID NO: 32972 - DNA, 201 bp, Bos taurus
gcccctttctctccccagatgccctgccacactcaggcctgccacacagagctgaccccttgctcctttctggggtgtcagagagccaaggcctggccatygccctgagtctgggggctaccccagccctccctcatcttttcaccagtggaccagctggtgttttctttctcagggtgctgtgatgtctgaggagccaat

SEQ ID NO: 32973 - DNA, 201 bp, Bos taurus
cgcccacctcgccctccacgtctgagatgtccaccagctccccggggggctcattcaacatctggatgaactgctcctgatgccggctgatttgctgtggkagacagaggagggaagggtgacccacggcctttgtccccgctcccccaggtccctatcacagccctttgcactcactcagcaaacatttacagggcacct

SEQ ID NO: 32974 - DNA, 201 bp, Bos taurus
ggaagcagggccagcagcatagacagcgcgacttctgccccggaaacgaaaaggagcctggcgccagcaggtacagaagaggtacagaggtcgcagatatyggttctgggtgtagattcaggccgtccccgagactgaaagcctccttaaatttcgatcttggtgcctcactggcctcacactaggcgctagtggtaaaga

SEQ ID NO: 32975 - DNA, 201 bp, Bos taurus
tgaggtcagagatcacaggcctggacctcccactccccaggatcagagatactcaggccagctagtctacaaaggccagaattaggtctgaagcaggagaygaagggcaggggattaggcagatgaacagagagtgagatggagcaaaagatcagagaacacagtaaaaggtcagctaggccggctgggctgggctagacc

SEQ ID NO: 32976 - DNA, 201 bp, Bos taurus
agtaggggacagcaggccctgggctccctctcagagggagggagcctatgcagagcaaatcacaaagattcaaatcacgacctcggatcccaggggttacrgaaaggagggctggtggcctgccccatgtgcctccctgagccccacccccctccccgatttcctctcctgccccagggaagtgctcggcggctgcactgg

SEQ ID NO: 32977 - DNA, 201 bp, Bos taurus
ctggttggacagatcccaatacccacgccttaggcctaagtgatgagctacggaaggtgggatgggacctgcaaccttctggcacttttgatctgtgacaraactatttcctggccttggatcgcctctgctgtcttctggggttcctcctgcaatgggattcttgattctgtttcaaggtggagcaagtacagatgagac

SEQ ID NO: 32978 - DNA, 201 bp, Bos taurus
atgtgggtgagttatatactttgttcatcttgaaataggctgggacctgggatgtaagactttgatgcagggcttgcacttggacaaatgtctcctccagyaataaagtatgaagaaaatataatgggctaaaaataactgagtgtttttgtgcctgtgctcagttgctcagttgtgtctatttgtgaccccatggattgt

SEQ ID NO: 32979 - DNA, 201 bp, Bos taurus
caggttccaagcttgtgcccaaaacttctgtggtttttcccaagtcagaggtaagaactgaggttgcgggtacaggagagaaggtattgttcccttccggyatagacaaatgtcctggatctgcagcagctgtggtggaaagctgggtagaactcttctctgcttccttgctagcaagatctggcctcctcaataaagtga

SEQ ID NO: 32980 - DNA, 201 bp, Bos taurus
gaacagtgagggccaaggcgtgcctaagccacatggctgtgtcaacatatatctcataggatctgaacaggatccccctcccctccaagttccatcccttrtgatcttcccaagaccccaaggcccagggatgtcatctcaatatggagagaaacgtggatcagcttatttgtcaccattcattctttcactcactttaaa

SEQ ID NO: 32981 - DNA, 201 bp, Bos taurus
tgcagaatcacagagaaataaaaaactgcataaatataaggagtgtgggaaaacctatacttcctatagacagagaacataggaaatctcatagttaagayggccttttccatgagaaaaatgtggaaaattatttcaaagttctttgcatcttaacactcacaatcaaattcaccctggaacaaaaccatgtaaatgtga

SEQ ID NO: 32982 - DNA, 201 bp, Bos taurus
aacagaattcacagttgccctgggattggtgagcttggtaatggacgggatatgagcatccagtgagatgaggacagggtgagggtgaggaggacagagcrtgaggcccacaagtcaagtatcctgtactattcttgatgtgactctcatgtcggtaattttatatttatttgtgggtcagaggtcgtgaccatttttgct

SEQ ID NO: 32983 - DNA, 201 bp, Bos taurus
actgtcccttcccataagggatccagaggaccacgaagctgggagtactcaccggggagccggggtgtcccaccagaccccgtatccctgttggtccaggygggccctggaggcgggaacagagtcaagaaaccctcaggtttaagattaaggtcgcaggtggggaacttccctggtcgtccagtgactaagactctgcac

SEQ ID NO: 32984 - DNA, 201 bp, Bos taurus
attctcaaaaaacatcagaggtatatagggcaccctcaggcctgtggaggcgaaggagtgctggctggatgaggacagccagcagggggagccctcttgtrtggaggatggtcggggctggccagggctgggaggcacagcaggactggatccaaagcccagtggtcaaggtcaatgtccagcactcagggccagactccc

SEQ ID NO: 32985 - DNA, 201 bp, Bos taurus
atatggccaaagagagaaggaagaacagaagttttgttttgttttgtttttttatagcaaagtctagagactgggcagcttaaatgtactgtatttatttrctgggactcctggcaatagcctttaagttcctttcccacttgtgactctcagatgctgcaatgaataaagagttgttttgcctccttcacaaccacttgg

SEQ ID NO: 32986 - DNA, 201 bp, Bos taurus
aggcttttgtcttcctggagtggggtggaaagggggcatggtcactgggggctgtagatcctacccttacccatcccacatggcccaggtaaaaaagacarttgtggttattatggatatggcagcacattgtcacagtgacaaggcagtccaagatccccagtgagtccttcttgttttcccagcactggaggccaaggc

SEQ ID NO: 32987 - DNA, 201 bp, Bos taurus
atggagaaggaaaggggaaagtgggaggggctgagggcagggaggggacaggacagagtgggcacagccttgtgggccatggggaggacttgggctttggytcagagtgaggtgggacccatagagggttcagggcagaggagggacataccctgaatcaggtgatcactgcctccactgggccctaccggggaaatagac

SEQ ID NO: 32988 - DNA, 201 bp, Bos taurus
ctccatccccatccccttgtgaatgatcctgtggaacagggccccacgtgtgccaggcactgggcttcatgtgactcgtccttctagtcctgcctgccaaygacctgatgggccaggcactgtttttttccctcatttttagttgctaaatcgtgtccaactcttttgcgaccccatagactgtagtctgccaggcttctc

SEQ ID NO: 32989 - DNA, 201 bp, Bos taurus
tgacatgggcacgtcagagcatcgggcagggacacctgaccagtaacagggcaggtggtgcgaggagagagggtggcccagagaagtctcagaaggtgccrgtctttccaagccctcagggagccttgaggttccttggagagcagacccagcctccagcctgagatgcagcacccagaggggagcctgtgggtgcgtggg

SEQ ID NO: 32990 - DNA, 201 bp, Bos taurus
tggggttttatggaggcttcattgtataggtacggttaatttaaccattggtctttggcggctgaggagggcggactgaaagttgcaacggtctaattgcyaagctggtcccgacatggctttctaaagtcatataccccagggtgcttgaagggggcgtcacgtgaatcacagaagacacctttattgctctttaattta

SEQ ID NO: 32991 - DNA, 201 bp, Bos taurus
tcagcgtcagccgcttggggcagacgcagaaacctcaagggtctgtcgtggaaggcgtcctttttccttgtagctaacgttaggcctgtgtacccccttcrgtatttgtagatgctcctcccgcccctcctactctgatggcattctggtcccaccccagcctgggaaggggccttgcagggacctctccaaaaaaaaagg

SEQ ID NO: 32992 - DNA, 201 bp, Bos taurus
gaccaggcctgccctcgcactggtggagggatgcccatggatacccttcggcacatctatgggggagaagcagccctgagacagatgcaggcaccacgcckgggaggagacggagcgagaggcctgtggaagatgctgcagaggggcagggtcttcctagagctgggtctgatcttcccaaactgggagtggagaatagcc

SEQ ID NO: 32993 - DNA, 201 bp, Bos taurus
aagccctgcccccaaagccaagattccatttttcctcccatatttacatctttatttcttagtataagcaaagtccactccaagcacggctctgggcctgkactccaatcctgaccacttgggggctgtgggaccttgagcacattccttctgggttttgtgcctcagtttccccatctgtaaaatgggccccatggcaac

SEQ ID NO: 32994 - DNA, 201 bp, Bos taurus
gggcccgtgtgctccaactactgagcctgtgcgctagagcccacaagccgcatctactgaagtctaagcgccctagggcctgtgttctacagcaagagaarccactgtagcgagaggcccaagcgctgcaagtaagaaaagccctcacagcaatgaagacccagcaaagccaaaaataactaaataagcaaataaaaatat

SEQ ID NO: 32995 - DNA, 201 bp, Bos taurus
ccaagagccctttcaactaggtctccaggtctgcctcctgcctagtcccccagaacccctggcctcagtcccatgggcccattggaattgcttttcctagycccccagtccccaggaactctgagctgacccctcctcaagctcccttcagttccccaccctctgatcctagctgtagacctgggggctccgaggggccgg

SEQ ID NO: 32996 - DNA, 201 bp, Bos taurus
ggtagggggcctcctctgaggcccctgtatccctcttacaccagtccatctgcaatacatgagctctcctgggatccagagctttttgaggatgaaacctrggcacccttcctggaggggccctgagctcacagccatgtagctcctccttatcccggggtgaggggcgggaaacaggtcagcaggaagagggcaggcctg

SEQ ID NO: 32997 - DNA, 201 bp, Bos taurus
gacactgtgcccccaattcagggggcatgggtttgatccctggtcaggaaactaagatcccacaggcggagcagtgaggccaaaataaaagaaagtaaggraattcttttttttaaaaaggatatgtactatcaactttatttatgtgtgttgatattggccttcatcacctggctaacttagtatttgttaggtttttcc

SEQ ID NO: 32998 - DNA, 201 bp, Bos taurus
ggttctcttgttgctctgcataggctttctctgcttgtggtgagtggagggagggctgctctctagatcggcatgcaggcctctcattttgacttctcttrttgcacggagcatgggcttcagggcgctcgggcttttggcacacgggtctggtggccctgaggcatgtgcagtcttcctggaccagggattgaacctgtg

SEQ ID NO: 32999 - DNA, 201 bp, Bos taurus
cagctccttgttagacccttgcctgggggtggggagatttcgtcagggctcaaggatcaagggctgttggtcggggtctgctgaagttagcaagatggggragggagtttccctgtttggggtgggggcaccttgtcagcatttcaacgctttggtttgtttacagggtgctggatgtctgggttgtcgccttggcccacc

SEQ ID NO: 33000 - DNA, 201 bp, Bos taurus
tgcctgggctggaggcagctggcaatgccctggtgttcagaaagacagaaactgcctgacccttgctgcacggccagagcgcttctcaggccaagagatgmcgagcggaggagccgattctgtgattcctgagtgaagctgttttcagattgattttgcacactcttgtacacgaggatgatgaacagacagatgtggtcc

SEQ ID NO: 33001 - DNA, 201 bp, Bos taurus
caggatgactttcttccccctcacttgcttcctcctaccttggcatcctcctggcccatccccctgagattctctcagtcaccatgtctagtgccctgctmtgaccttggtcctcagctcccccagccttcccaccacctctgctgtggtctccatccttagagagccagttctggcacattccaagctcccactttccct

SEQ ID NO: 33002 - DNA, 201 bp, Bos taurus
gctacaggccatggggtcgcagagagctggacacaactgaagcaacttggtgtgcgtgcatgtgagggacatcactcttgatcctagagtgttgatttgcrggctggcctcagtttcccctctgctcctgggacacagacgtctcagctgtcctcctctgccaccctcagagccggtggggggcgatcctactcaagcagt

SEQ ID NO: 33003 - DNA, 201 bp, Bos taurus
ttatggtcagaattcctaggagtgttgttatttgactgtttatgcctccatgctttttcaaacatggccaagagcacagaataaaagactaacttcaaacmataacattagaggagaaaaactgcattcccaactcaagaaaccactagagttcatctcaaaacccagtgctgagtttcctggtggccaaagcaaggaggc

SEQ ID NO: 33004 - DNA, 201 bp, Bos taurus
cttcatcatcagaataagagagtgccagtttcctcagagcctcaccaacaggaggtgttatcaaaccttttgatctttgccaatctgatcggttaaacatygcattgtggtgtagttttaatgttcacttcccttatgaagttgagaatcttctcttgtgactaagaaccatttgtttctcttcctctgtgagctcaaagt

SEQ ID NO: 33005 - DNA, 201 bp, Bos taurus
gtatgtgagacagcccagccaagatcagcaaagctgacatgcaactgcccagaaacacatggagaccagcccagtggaaaccgaaagaactgaccagcagmgcccaatctaaactgccaacacatggaatgcagagagctaaataaatggttgttgttttagtcactaactctcagggtgattttgttactcagcaatagc

SEQ ID NO: 33006 - DNA, 201 bp, Bos taurus
tcctttgcttggctctgtgtcaaagggaactgcatttcccaggtgcctttgcacccttcctcccagctagttctaaccaatgggaggcccaggcaggagamcagagggtggaaggaagagagaagccagggtatttctccttctcttgttctgcctctccagcagcaaatacacctcctccatggcctcagctccctgaag

SEQ ID NO: 33007 - DNA, 201 bp, Bos taurus
tttttagggtgcaaggtgggttcttgcaaaccagtccgctccttctgtgcagcagggtgcaggtccccactgcatctggctgggtgaagaaacttggacgrcttccttggtctccatcaggggtccccagatgcttgggtatccagcgtgagaagggggcttgtgctttcaagggtcaggctccaggcgctgtgagaggac

SEQ ID NO: 33008 - DNA, 201 bp, Bos taurus
aggaggctggtattcaggctgggtttaggtacaggaaactctttgaggcgctctgtggcttcagctgcccagagacaccattgagtcatttcctctccggrgacctgcagtctctctgcaacagggaacaggactccagcctcttctagttttcagtcccctttctccagaatttctcagggggatgtagcctttcccctt

SEQ ID NO: 33009 - DNA, 201 bp, Bos taurus
ctttcccctgtctctctctccctctccctctgtatgattaagtttgttgctctgagcgtgtgccttttgctacatctcagtgatggggagtctggcttcckcggccagcagtgggggaagggggactctgtgtgtccatgtgtgtgtgtgactaattgtgtgggatttatgtcagtgtgaggatgaagctcagcgtgagga

SEQ ID NO: 33010 - DNA, 201 bp, Bos taurus
aattcccagctcgtgggccatgaatataagtcatttggcttgcggatcggattctgctgcgggtccagactgtaccaggacaccggcaataaggcgtctgrgtccccaaaactcggccttccgggagctgcgccaccagcaccgagcccgcgcgcgcctccggccttccaaccctccttcgcagcgcgcgcctcccgccaa

SEQ ID NO: 33011 - DNA, 201 bp, Bos taurus
ttttctattctcttacaagttctatataaattttagatcagtttatctatatttacaaaaaattcctagtgagattttgattaaatagccttaaagctctrtatcagtttggagagaattgacatctttaagtatcttttgggtttggagctattgtaagtggtattgatttttaatttccaactcttcattgctaatgta

SEQ ID NO: 33012 - DNA, 201 bp, Bos taurus
ggcagccccagcttccccaaggccgcccggcagttcctgctgaaatggtccttttacaggtgagtgtgcacgtcatctcccagagagctggggaggtggarggagctgaggcccacagacgcaggccagccttcaggactcattcctgggggctcccagggacaggccctcctgggacctcaaactgggttacagaggttt

SEQ ID NO: 33013 - DNA, 201 bp, Bos taurus
ctttcacttagccacgtgcatttaagcccctccgcgtctcatcatggccgggtagctcatttctttttagcactgaatcacattccattgtttgaatgttycacacttttgtttctttttacctgctgaaggatgtctgagttgcttccaagctttggcaattatgaacaaagcttccataagcattcacgtgcaggtttt

SEQ ID NO: 33014 - DNA, 201 bp, Bos taurus
ccggggctaccagggcgacccctcatctgcactgcttgagctgctggaccctgagcagaatgcaaacttcctggaccactacctggacgtgcccgtggacytgtccaaggtgcgtgtcctgcccggggctgggccagcggggagggatgggcaccctgtcccccaacacctcacggccccacccccaggtgctgttcatct

SEQ ID NO: 33015 - DNA, 201 bp, Bos taurus
tcctcaccaacatcagcgcttgattttactacccccattcctacctcctccgcaacgggctcatctgtacctcaccccacatcaggccaagtcctacacayttactgcagggactatgtgctcacagagagcccgcccaactaaaggaagggacttgcaacgtgtggtcactggcccctgtgttctctctgttcaagggac

SEQ ID NO: 33016 - DNA, 201 bp, Bos taurus
tttaatcatggccggacttggtttccgatgtgttagtcacatgggttagatcataccagaggttaagaccaccaaggctttcttattacccagtttgtcamcaggccacagattaatttggcattggcttcgtgggttggatctctacttttgagacccctgtgagggactttagttcagtaaaaccttcctccccacttt

SEQ ID NO: 33017 - DNA, 201 bp, Bos taurus
gagcatccgttagctgcctgggggctgcagacgcccccaccccaccccgacctacaactccagaccctttccaccttcccagccttgctctctattccctyggccgccccgtgccaggcttctgtttagtttaataatctcccgaaagtttaattgttgttttattcatccgtgacctttctctctcatctggagacgtat

SEQ ID NO: 33018 - DNA, 201 bp, Bos taurus
gtcaagttgtaattatgacactccctgtagctggtcacaaggtgactcaggagactgcttgccccctgacccaaagtgaggctgcaaagaggaccttcccrttggagctctcactcctccttgattggaactgcaccctccccacctctgacatcagcctctgacgagggggcgcttccacccctcccttaccctgggggt

SEQ ID NO: 33019 - DNA, 201 bp, Bos taurus
gagcagactcggatgctccttaaacatccagtgtctgcctggcctgttttcagaactttaagtaactgggatatgggtgcaagtattacatacgaggctgmgtgtgaagatcggtggccctggggaggagtggtggtcttcactgcagcctgggacagctcctgcctccggtcttgcagccctgacctctcctgacttttc

SEQ ID NO: 33020 - DNA, 201 bp, Bos taurus
tggaacagtttcctgctggtgatgcggggccaacacctgggtgtgctgacacccaggaccacagcctcgctgggtcttaggcgatggaacttcacctctgrgggcccgacccaccaaccttgaaaagattgttctaggcagcccggtgccttcttgcgagtcggtggcggggatggctgagaactcaactctgggaactcg

SEQ ID NO: 33021 - DNA, 201 bp, Bos taurus
tactgtgttctgcagctgtcatttttatctcatttcaaaatattttcatcagcctcaaagacagccacatcccatcagcagtcactctgcaccctctttcyaccaacccactctgtgcgtcagtggatttgcctgttctgggtatttcgtatacatggaatcacacactgtgtggccttctgtgcctggctcctctcactg

SEQ ID NO: 33022 - DNA, 201 bp, Bos taurus
ctgtctctttccctccctcccaattcagttctttttttttttaaacttgttattttgtgttagaatatagccgatgaacagtgttgcgacagtttcagggkaacagtgaccaactcaggtcttgtagttcttctgcgggcaactttcaaaatctgttcaaactctgacctcttcttttccagggtctgagtcccatcactg

SEQ ID NO: 33023 - DNA, 201 bp, Bos taurus
gggaaggtgtctatggctttgggctctggctcccaggagtatgaagggaggatgccctgccctgcccactcctgacccgccctcagcagccaaatttgccrccaaagggcctttgcacatgccattgtcttttctgggatccagccctccccttacccaatcctcctccctcaggctagctttgactaagccatcctgcat

SEQ ID NO: 33024 - DNA, 201 bp, Bos taurus
tcacccttaatcctgtacacattaagcagtcctttaattcccccttcccagcccctggcaaccactaatccactttctgtctctgtggatttgcctgttcrggatatttcatatcaatggaataatcgactatgccatcttctgtatctggcttctctcactgagcatcatttttccaggatcatctgcatggtggtgcat

SEQ ID NO: 33025 - DNA, 201 bp, Bos taurus
ggcacagggcagcacatgctcacctgtagagaggcggagggaaatccacttccagggtcccccgggggacacagggccaggcagcctgccgcctcagggtytgcatgtctgcctctgcgtgcctgggggctcctgcctccaagtcctgtggggccattgttgacagcaacaaaggccaccccagtgtcctggcaacagctg

SEQ ID NO: 33026 - DNA, 201 bp, Bos taurus
gagtttgagtgaactccgggagatggtgatggacagggaggcctggcgtgctgcaattcatagggttgcaaaaagtcggacacgactgagcgactgaactkaattcccatctaattggccacgcccctgagacttgaccacgccccaggagcaagctgcgtcgcttgccggcctcacctctcggctgaatcgggacaaacc

SEQ ID NO: 33027 - DNA, 201 bp, Bos taurus
acctcagtgttcacagcagcactatttacaacagccagtacagggaaaccgccgaagtgtccacagacagatgagtgggtaaagaccatgtcgggtatatrcacaaggcaataccatctggccatgaaaagaatgaagcaaatgccacgtgcagcagcctggatggacctagagatcatcacaccaagtgaagtcagacac

SEQ ID NO: 33028 - DNA, 201 bp, Bos taurus
cctgggccttctggattggaaatgtagaatcttagcctttggaccaccagggaagtccctagcattctgttctttctacccccaaagctcctccagacagygggcctgggccagcctgggcctctcctgaaccttcgtttaggtatccgctgtggtctcctggcttcctgacttgcctatatccattcccactaccggcaa

SEQ ID NO: 33029 - DNA, 201 bp, Bos taurus
tccaggttccagcctcgatctggcctgtcctcccaggtcctacccttcagctgttgccactctcgccttctaacttctttgggttgttgagtatcaatctrgctataaaaggcaattctggcctaaggaaaagtggaaaagaggaaaggggtggccagctgcctgagtcgagaccaacttctgcttgcagcctggcgtctg

SEQ ID NO: 33030 - DNA, 201 bp, Bos taurus
gcggtggatctcattacctacccccacccctgctccgcatggatgctgcctccattgcgtgggcagagaatgactcatatctggcctctgacacactcttycccatttgaacaccacccagaaggaagtggggagacaatcccattctacttcccttgacagggctccatgaaggtgagcacttggccaggtgcttctctg

SEQ ID NO: 33031 - DNA, 201 bp, Bos taurus
cagcctgattcttccactcctgtctgaacaccaatctctcccaggtctaatccagggtcacctccagcactgcttacactggagccacatcactcaagggracattcctagacaccatggggtggccctggccccatctacctgaggccagcagtaacaccccctcccctcacccctcgggtgctaacagctggtccactg

SEQ ID NO: 33032 - DNA, 201 bp, Bos taurus
agcaggaacagtttcagaagcctcctttgtctgtgagctgagtgtccataaatcctgccgtgtcctgcgggcgtgtgccgtgtgaggtctcccgccaccaytctgggccgctcctgactcaggtggacggtggaacatggttcattggttggggggggcttcctcccaggggtcactgtgcctcgaaaaggcgtgtccgcg

SEQ ID NO: 33033 - DNA, 201 bp, Bos taurus
tcctacggccaccatgtgcgtcgtctgtcggtccgtctgtccgtcggtggctctggctcccgacctggggcagcgccgggccgtgtgggcaaggggctaaygctgtgctgccttttttcccacgcgtgtccgcaggtaactaggatttctacctcaaccgcgagactatgcaagggtgggctgggccggcggcgcggggcc

SEQ ID NO: 33034 - DNA, 201 bp, Bos taurus
tttggttcatttctgtaactcgcccaccttcccttctttggctacatctaggttttgcatcgtgttagacactctggccagttccgctggtcacaacagtrgtgaactcttggtctgatctttagtttctctttgaaagagtagctggtcggcctgcatttcggaccccagggcatggcaaagcaaatatgtgaaaggagt

SEQ ID NO: 33035 - DNA, 201 bp, Bos taurus
cccacctgtttggggtcactgtcctccttcataagtggtccccttaggatttcaaggagaggctgagagctagcttctcagaagtgtttccaccttggacrctggctgatttaggccaagtagaagcaagaagcatcagctaacagctgacctcgtggtatgggcaaggaaaatgttttcctctaccttttttttttttta

SEQ ID NO: 33036 - DNA, 201 bp, Bos taurus
ttgaggccagaagaggccagggtccattggtgtctcccagctgcctggctctgcctcttctcactcccagcagaaacaccttacacaacccacatagctaygtcttatgtccaggccagccttttggctcttccttccacatgttatttctgaggccactaagaagggatggttcttggggttacggacagtaagggatgg

SEQ ID NO: 33037 - DNA, 201 bp, Bos taurus
agatagtttctaaggtcatatgtcgaaaagtggcaaatgtgtagattcacgttgaggtctttctactctgggacctttgttcttttgctgtaactatactrccttctccaatttaatgtccgcattaagtaattaacaaacataaatttcttaggattagctaaaatgttcgattttacatttatctcattggctctagaa

SEQ ID NO: 33038 - DNA, 201 bp, Bos taurus
aattgtgattaaacagttacatgtcgtgtagtctggtttagaagcaaagttgctatgacactttgcaccataaagagtggatttttcagtttcttgttaaycatttctctttgattatttactgtgtggaaaggatacacgaatgaaagatatcacagattgctttctatgttgtccaaaattttgttgcttattgataat

SEQ ID NO: 33039 - DNA, 201 bp, Bos taurus
ctctttggaatgctggcagctctgatgtgggtctggccacatggttcttctttttttatgaacctggaagagggaatatgtctcggccgggtcaggcctgrtgtgtcctctcattctcctgtaggacagagtcatggagcctggatggtgtgtcttaagcttgagcccaatccaactcagataaacctgtcttcagcctct

SEQ ID NO: 33040 - DNA, 201 bp, Bos taurus
cacggcctccgcgcctgcccttgggcgtggggtagctcctcccggccctcgctgccccggcgttgcgcagccactcctgtgggccctgcccgcccgtgtcygggacgtgcgagtggacgctctcaagaaaacgctccagtagcagtgctgctccagccgatgggccacgccgtctggtacagagttcgagctgctgaagtt

SEQ ID NO: 33041 - DNA, 201 bp, Bos taurus
agttataatactttacaagagaacaaaaccatcctgaataaatacattacaggactccaatgggagattcaatattaaaaacattttccctcaagtaatcygtaaattaaatgcaatccaaacaaaactcccaacaagattaaataattttttaaataaaacccacaagatgactctaaaattcatatatgagagataatg

SEQ ID NO: 33042 - DNA, 201 bp, Bos taurus
ggggcaaagtaaacctgaatggaagtgatgagtgctcatctgcagcaactcagctgtgagttgcctgcatgctggcccaaggcagaaacaggcccctgacrtccacacaggggtattctcctgcccagggcagttctttctccttcagctcattaacactcttttgctggcagaaacctcttccccttcgtctcaaggcct

SEQ ID NO: 33043 - DNA, 201 bp, Bos taurus
gatgtggggaactatccaaaaataggagagtggtcaaaaatcttggagagctcgaataacagagggtccatcactgtcggagaagcatggcccgggtgtcytaagtgtggaaaacctgggtccagagtaactgagtccatccttgactggctgtcagggtcactagaaggctggacgtagaatggacatgagggacagaag

SEQ ID NO: 33044 - DNA, 201 bp, Bos taurus
tttaagaggtggtagtttttgataaaagcttgtagaagtgactttttaaaatgtatactataatttgatataaatgtaatttaaaaatgcatttacatttmttacttgtgacaccaggagcaaccttctattattatagtcaggaacatttgtttattcttttctctgccaagttacccagggggtgagtacagggctttc

SEQ ID NO: 33045 - DNA, 201 bp, Bos taurus
taaggtgtggtaaggagttggtggagccagggcactctcactgggagacgaaccaccacctattcctgagtgtgctgacaatggcctccacagctccactyggatcacattccagccactctcagctgtctctgaatagctagatgaagtcctttcccagggcctttgtgttcaaggttcagcacttagccactacacact

SEQ ID NO: 33046 - DNA, 201 bp, Bos taurus
actcaggtgcttgcttccaggctgtaatgttacgctctctcggtcttcagactcttaccttctcttggtcaagtgtgtggcagctactaccttgagcggcmtgggagtctggccctgacaggctgcattggctttcctgcttccatagtggctgacctctgctctaggaactctggtttctcccattaatttataatttag

SEQ ID NO: 33047 - DNA, 201 bp, Bos taurus
ttgtggaaacagttaccttaatattaaaaaccaaattcccctagtttgaaggctctcacacacacagctgtaaaaccctgggcctctgcggaggttctctyttacagactatctctggggttttgcaggtcatcgcagtgtcacaaggcacgcttggccactgtgcgtggcgctgctttcagttggctctgggccgccacg

SEQ ID NO: 33048 - DNA, 201 bp, Bos taurus
cttcttcccatacacagacagctacatctgtttgctatctgacccctaaggtctcatccatgttcaaaaccaggacctccagatgatgtgctgtagccttyccattaggtccagctgtgggtcacatggtagctgcctactggaccacagcaaagaacaacaggatacagcaatagaaacctggaatggaaaacacatggc

SEQ ID NO: 33049 - DNA, 201 bp, Bos taurus
tttacctcctaaaataacagtctcccttgaatggctttctattctagaaaaccatcacccactactttcccaggttagtactgctatgttgaggcctcacrtgtccatgtaaagtggaatttgctgggtaggtattgagagagatgcatattaaccctctatagtgtcatactggggccttgtaactccaggaaacctcta

SEQ ID NO: 33050 - DNA, 201 bp, Bos taurus
tcaaagaagaagcagaatcacgaagatctcaaacttctttcaagctcatttctgaagagtctctccacagagtcttatacccattaacaggctaccagaayggcaggagttgagtgagcaaggacaggatcaacctccagtgatttatgtgagacagtatttgggaaataatcaaagcaatgatatacaaaaaaggatgtc

SEQ ID NO: 33051 - DNA, 201 bp, Bos taurus
catgtaaaacctttcaatacatcctaattgaaagcatgcaaaatgttttcacatagtattaataacagagtttgtagaggcataatagcttaaataaatayattgaaacaatgtatatcagtaggttgggattttgagagtggttctaaaagtgtatttggaaaacctgctcaataacttggacaaagaaatggaagtcag

SEQ ID NO: 33052 - DNA, 201 bp, Bos taurus
ccatctttattcacgtcactgaatgttttgtgcccttcgatggcttaaatgaatactacttactctgcattttctgctgaagtggcccctcagccttctayactctatttacattgagggtcaggttgggacaagacgggtagtcttctcgtttaacattgtcatttcttgccagatcacggcccatgcctcatgttaaaa

SEQ ID NO: 33053 - DNA, 201 bp, Bos taurus
tgtggagggatactctgcaaacaaagattttcaccttttaacttctctggatctcagctgcattatatgaaaaaggggcaaatggtattatcattaggtarcaatatgtgaaaaactttggaggttttgggaagatttttctgtgttctgaagtactattactttatataaaaagtcgttaaaactgccattagcaaatat

SEQ ID NO: 33054 - DNA, 201 bp, Bos taurus
ctggaggctgcagctttgagatcagggtgccagcattgttgagttctgctgacagctctctgtaaggtggcagaaggccattatcctcacatgacaaagartgtaagagagatttctgggatctcttttttaagatcaacaatctcattcacgagggctccaccctcaggacctaatcacattctggaggtctcatctcct

SEQ ID NO: 33055 - DNA, 201 bp, Bos taurus
tcaaaaaattcttaacaaattctcaactgaggcattgtcctaaaaacaaaaggttgaaatgaactctgaatagccaggaagtccatctcatggaccagccwcggtgtgcaattccttcttccaccataaagatggatgagcttccaccacagctcaaaaactgtagtaagctcaaattttagcaagagactgaccatggac

SEQ ID NO: 33056 - DNA, 201 bp, Bos taurus
catataatccacctaaagaaatccctaaatgatttcttatatatagtatctaggagactggcatcccgagtgatttaacagattaatactgtttctgtctycttcaattatacactgtgcacttagatccaaatgggaaaacgatggcaatggtattggtgttttcccacatgataaaaatcagatgacttcaagagctgg

SEQ ID NO: 33057 - DNA, 201 bp, Bos taurus
tcaagtttctataaagaccttacctggtttcccctggagggtctccccatcttactctctcatggttacctcctagtgacagggccccctacaggaccagmgggtgcaagatttcctagcttcagctctctgatccactcaactggtggtcacatcctcctcaatggcctcctccagtgcacttgctatttgtgctaagct

SEQ ID NO: 33058 - DNA, 201 bp, Bos taurus
actgagacagagagagtccaagaaagagggcaaagcagaaatcgggacagtgtgggacgggaacgaaagacaagcctgcagtcatgtcagaagaagcaagrgagtatgtctgtaccccgtgaccaggttattatattatctcattttaatcaccatgacaactctatgaaataagaaacattatccccattttgcacactg

SEQ ID NO: 33059 - DNA, 201 bp, Bos taurus
gacacacagtataaagaacgtattttactgtattcaccaaaacgcaagatttcctggcttctgtctctccagtcacccatcaaaagctgaaaaggcccttrcttcacctacattcatttttgatgttgcctaaaatataaaccatgatagctagttgcctcataatggctcgtgaacagaattcaccaagctagaaagaga

SEQ ID NO: 33060 - DNA, 201 bp, Bos taurus
ttttcctatgccacttcaaagaagatgttgaaagttaatttaatattactttagatgtaaaaaagtctcctctcttttaggaggcacattatggccagcamgatattccatgaaaatctttatatgaggtaagtggcaggatgaacatctggattccctctgtatcatgaaaagacctagggtttggcctcttaggaactt

SEQ ID NO: 33061 - DNA, 201 bp, Bos taurus
gctagaatccccaatataatgttgaaatgaagtggtgactgtgaacatctctgtatattcccaatcttagaaggaaagcattcagtatttcaccattaagwatgaagtaggttttttataaacatgttttttctgcttaaggaagttctcttcggtttgttgaaaggttttattatgaatgatgatttgctttgtcaaatg

SEQ ID NO: 33062 - DNA, 201 bp, Bos taurus
gctgaaggcacagaacttccaggcttcaagttatcagcaagtacatatgatcagtttagaccacacagaatatctgctctccgcatgaggagcgagactgrgacataaaacactcatttagcgatggtgtgactataaactggtactgtaactctaaaagtagtcaaatgctcacacgtgttctgggtaataagttatttc

SEQ ID NO: 33063 - DNA, 201 bp, Bos taurus
tgtggagaaccacattatgccactaataaaatatatacatggctccaaagttagaactataaaacaaggcatactggaaagatctaggttccaccattatktaatccttcgtatcctcttccttctctaagataactaattttattagatttggtgtttacttctagtttataaaaaatgcacacatacatacatgcacat

SEQ ID NO: 33064 - DNA, 201 bp, Bos taurus
ggaatatttttccttaatttaccatgatagaaaaaaagaattttttttataattaactaacaaagaaaagcaggaagtatagcattccagcctttgtttgyaacttgattttacattttaaaatattccctgtagcttcaagatggaagatgggatattttgatgggtttgttttttttccccaaaagaatataatgttgc

SEQ ID NO: 33065 - DNA, 201 bp, Bos taurus
tttgtccttctgagagttaagcttgatgactgaatggggaacagaacagaagggagataagggattaaagctactgaaatggccaaggcagagacggggargtctgagctcaaaggcagcaggtttccaagtctaagttctacccggagagaacttccaccttcatagattttctttcttcaaaccggtcgttctgaaaat

SEQ ID NO: 33066 - DNA, 201 bp, Bos taurus
aagagctgttaagttacatgaccaggggaaatgagtggggcttagactgttagtatgtcttgagtatttccctcctccaaataatcatccgtcctgggaargggccacaagagccatgtgtctgagagttgaataagctgtgagatgtgtacagtcaacgtgtatgtaagttgaggtattcaacgtgtgactcttctacag

SEQ ID NO: 33067 - DNA, 201 bp, Bos taurus
ttcctcaccttgtgtgggtagacaaaacttaatgccctgaaacagacacgcaaatagctttgatccaatctcctgccagagctggcctgatgcctaggtakagtaggtggctgccttcctggaaagatatgagggtactttaaagcctgacctgttgcttcccatggaatctctgttttgggcctgccagagcatagcttc

SEQ ID NO: 33068 - DNA, 201 bp, Bos taurus
gaagaaactgcctttgaatataacataattggccaagtacagtaaaaagtgagaacataggaagttgctattattaattttattttgagctttcataaaartctctctcatcgggtaagggaaaaattaactggcatgttagctattactaagtatgaaaaaggatcccatgtgctttatttaaaaaattgagaaataaaa

SEQ ID NO: 33069 - DNA, 201 bp, Bos taurus
caatggcctgacatcccagttagggtggatgacatgttctttttttcaccccttctctgtaccacccagcacctccaagcttgaattcagttccctgaacyctaaggggccagaggtttgtctcaacctctatttagagaggcaatgatcccagagcagcaaggaattcctcaaggagcctgttgtttaaaaaggggatgg

SEQ ID NO: 33070 - DNA, 201 bp, Bos taurus
gggggacatagaatattgaaaattcatggcccagtgatgtcactcaatacatgtctttttcctttctcctttctcatctctgtaatattggagtccacttrtctgagtatctgtcctccctttctcaacttttttcacattatgagctcctggagggtagaaaatttgatgaattcagctttatctccaggctttagctct

SEQ ID NO: 33071 - DNA, 201 bp, Bos taurus
ctgaattatgtttcaaagtgagtgcagatgttcagagcactgggatcccaccacgactggggggatctatccctaccaccttcccttatctgaagctggarggaagcacctctctctggagaaactatcttataatttaggttaaaagaatgatgtattcattgttttcacaatgtaatcaaagagatcttaatgaagtcc

SEQ ID NO: 33072 - DNA, 201 bp, Bos taurus
tggaaaacctgagatacctatccaaaagacaggcaccatcaaaaggtagtttgtgcccctggatcaatgcaacaggacaggcacaagttaatattaaggarataaacgcctgcacagagtggcttcacaattttggcagaggcaatattgcctccactggtgcaccaagacggacttccctggtggctcaggtggtaaagc

SEQ ID NO: 33073 - DNA, 201 bp, Bos taurus
gggttaagctatgaaatcaagacatcagagtggagagatacaaaaatacccttaaagagaccaaatagctcccaggcctcggagaccagacagtgagctgrttaaatgtattaacatatctaaaggaaaactgcaagaaaaggaaaattttagtgacaaatgctagagatggccatccaagcattcaggagtcatattggc

SEQ ID NO: 33074 - DNA, 201 bp, Bos taurus
tccaaaagcttgctcaaaagtgggtgactgacaaaggcagtattctccaggggctcttggacctcagctaagaggaactgaattggttcacgggccacttyacagtcggcagcccagagcaaggttggtatgcctagtacccgatgcacaggtgggcgagactcctcccagatcctttggtgtttgatgctagctcccaca

SEQ ID NO: 33075 - DNA, 201 bp, Bos taurus
cagcccagggcttaggactccatactttcaccgctatgggtccaggttcaatccctggtcagggaactaagatccctcaagccgcatggcatggccaaagraaaacaaagataaaataaatggaaaaacaggctggcaaagctcagtgccccccagtcaaaacagattttaagatattctggcaatatcagccaggcctag

SEQ ID NO: 33076 - DNA, 201 bp, Bos taurus
actggcaaccagtgaggagatagcatgtgcttcagagtttggccaggagatgctgaccagagttagaggagggagatggagtggggagggtcaggctgackgggaagatccaggcccagctggcctttgtcagggattttggaattcaagctctggggaatcaaagtcttcagtatggtctgcgggggaaaagatggtctt

SEQ ID NO: 33077 - DNA, 201 bp, Bos taurus
gcagtccctgctgggcctccactctgccaagaggaactcaaaggagacaattgtttgatgtttgtgtgtttggttggttggttgatttgttgtttggggtktggaagtttctgcactggggccatacactgagccactcccaaacccttcctcaagcctgtgggtcgaagaacatccagagccatgtaatcacatcgccct

SEQ ID NO: 33078 - DNA, 201 bp, Bos taurus
ctagagagcaagctcctaactcctgactctggaggctgaatacataacaggatgtttatttggagcaggactggggctaattaaggccaatgaacagattyataaatctagagacatggtgataaagtcttataaggataagagtaggaattttgattaatgatcagacttgaacagcttgagaatataaactgaaggctt

SEQ ID NO: 33079 - DNA, 201 bp, Bos taurus
ggcaagcgaggctgcccgcccgctagctcctctggccagcagggagcactccaccagaacaccctgggagcacctacttgaagggaagtacgaggtactgmgtggctcgagcttcagtcaccattctcaagcagcttttgtaagttgttttgtatcttgaaataatagagagaaaagctcctgttagtccatagagtggag

SEQ ID NO: 33080 - DNA, 201 bp, Bos taurus
agagggtcaggacaataagtcaataagtgacatagtattagtggtattatttctccatgttaatattaagttttagtttctagtcctgtaactttcttctkcataatataaggacatgggtccagaaattggggaatttatgagtgcatgtgcatgcatgtataatttttttctaggactgagcaggcttttttttttttt

SEQ ID NO: 33081 - DNA, 201 bp, Bos taurus
cttgtttatcatcctggccttagcaattctgtaatagaaaatagtattcaaaattttcaagatttttgccaagtgctttttgtgacagtgacactcttgaycagttaacagtagtctcaggctattcaggagattttcaggagcagtggtatatttcagtggtcagtataacctgtgcctgaagaaaacatttataagata

SEQ ID NO: 33082 - DNA, 201 bp, Bos taurus
acactgctttcccctcttcagcttgtcatttatgcttctgactgtctcacaaggacacttctcaaggcatttaaggcccattttgataaccagaaaaatcycttcatttcaacatccttaacataatcacatctgcaaaaactttaccagctaacattcattggtgccaggaattagaatctgatatcattgatggccatt

SEQ ID NO: 33083 - DNA, 201 bp, Bos taurus
ggtacaggcagtggccttggatatcaaagaccaatcttattaagatattttttttctatacatgtacatttgcatatcaagattaggcacctcagggactyagcacacaattcaggccatgatgaacttgaagcaatgtaagataacacacgagttttctagcccaaaagaatgtaaactttcagccctctgtgaagggga

SEQ ID NO: 33084 - DNA, 201 bp, Bos taurus
gcccgtggacatggggtgccattcccaaaggccaggaagacaatcattcaattcccaccctgtcactgggctgaacacagcctcatgaaacttctcaattyagccaagattcaggccaatactgccaacttttaaacaggacataagctgagaaagatattaaatgaagcctctatagccatttttctcaacttttaattt

SEQ ID NO: 33085 - DNA, 201 bp, Bos taurus
gagtacaagtctctaaactacttaggcaggaacttctctcccagacaaatgtgtttatcagagagcagttggattgcatgtacggaagcctcaacaaagargatgttccatctcaaatttatggcctcttggcaacccaagtatgcatatgactctcaagatgccacagcgtgtcagcaaccacagtcgctgatgggaaca

SEQ ID NO: 33086 - DNA, 201 bp, Bos taurus
cctccttgcagatgtagtagcttttttctttcacttttaatataaaaatttccaaatatatatatatgtgtgtgtattacattaagaataatattatgatyccaatgtttacatcaccagtctcaaaaatgaccagtcttatgtcatttttaacttcactctgctacccattgtaatttttctttttaatgtttagaacat

SEQ ID NO: 33087 - DNA, 201 bp, Bos taurus
ttgcttcccaagtcaatgtattcatttacctctgaaggaagtcactgtagcacttgactcccaagttttagagacgtatatatgtacaaatttggccaagstttctctcactttctggtccatcaaggagagcaatgctcagtttctctgtgaatcacccactcctggcgctggattctgggcggtccaagatagcagctg

SEQ ID NO: 33088 - DNA, 201 bp, Bos taurus
aaaaaaagtgaccatacagttggccataaggaaatttccattatattctccaaatggttaaccttccttccttccttataaattcagttactttcttaagyaacttttgagtgaaagagctggccagaattgccattgaagactatttacaaataaataaatatgaaacactacttactaaattctgggatataaccaaat

SEQ ID NO: 33089 - DNA, 201 bp, Bos taurus
gagagagtggaatgtgggtgtggccatggaagaatctctaaaagggatggctggaaagttgtccagtctttcaagcaatgggttaaatcttgccggtagcyctgtaaaatgtgtttacaggtggcagaaattaattcctgtgaacagcaatctgtaaataagcagctctgaagagtaagggtaatgaagcaagtgaaaaat

SEQ ID NO: 33090 - DNA, 201 bp, Bos taurus
atgtggcggatcttttcctcagggcaccaggtcctctttgtaccacaggcaaatcttgttcccctgcatgagctgaatgtttcctaaccaaattattactmaagtctgattatcaaagtcatctcaggcaaagtcaagtaggcagttctcttcctgctaaggcccaggtactgcctgacagtgatgtgatcctgagtctga

SEQ ID NO: 33091 - DNA, 201 bp, Bos taurus
tcattctagtgatgggccggtagaggaacaggctctaacctgaagcccctgggttgttttcttagtgagaatgcagctttctatagtcgacagatcagagytctggcatttaggccaccatggattctaaatcagggttaacttcttaattaggtacgtggttctgagcttcaatttcctgtcttacaaaatggcgatagt

SEQ ID NO: 33092 - DNA, 201 bp, Bos taurus
gacacaaagccaagctgtgttattcacctaatgccccgatttacagttcccaagacaaaagaacatacagatagagtttcagggctctgtttgccttcacrtttattgaaaggttagtttcaggtcaagctcaagaaacctgacaaatggtggtgaataaacctaaaaataaagtaagtgcaagtaggaaacttaagcatt

SEQ ID NO: 33093 - DNA, 201 bp, Bos taurus
aaaatttgtaagtggggaatgaggtggtgatggactttttaggaaggctcagttatccagtagtttgcaggatggaagtctacaaaaagcatttgaagacragataaacatttagctgtagtatcaagaagccctgcctctcacgttggttatagggaacctttcaaaatctattctctgtcttccaaggatttctgaaat

SEQ ID NO: 33094 - DNA, 201 bp, Bos taurus
ttggagggcacaaacgaaaccttgctcacaccagaggaaaggagcagtgaccccacaagagactgaaccaaatctacctgctggtgttcgagggcctcttrtggagatgtgggtcagcaggggctcaccacagggatggggcactgccagaaaagtcccctttggcataaaccctcttggagttcaatatcaaccctgcca

SEQ ID NO: 33095 - DNA, 201 bp, Bos taurus
aattgtgtctcagcctcactagcctgtaggtacagatgtggtcacatttacagtaataattcaaatttctctgctttgtactttcaccaatttctggaagycccccgagagagactcacaggctcataaataattctgactctactggtacttctgctgttgcatcaggtgtcaaggcaccaaatggtcacagcttctgtc

SEQ ID NO: 33096 - DNA, 201 bp, Bos taurus
aatcaatccataaattaagttgagggcccggggtgtggagggcggactattataggatttctttttaagctaaaaataataataataaattttaaggactrggccaaaaagtaaacacgcaaatatagctgaccaacctctgatcttaatataaaagctatggtaatttaaaaagatgaataggttagcttattgacagaa

SEQ ID NO: 33097 - DNA, 201 bp, Bos taurus
taagatgggggtggatacttggcccaggttgggggtgggtaatgagggatagtgaaatgggcctattttccacggaaactgacaggtggccaagccccttrgaattcctttgtcaccatgcatctggaaagcaagctaacggtgtacagcagtgggaagagagggaagagagaggccgtgctcaggaggtcctgaggccag

SEQ ID NO: 33098 - DNA, 201 bp, Bos taurus
tacgggcctgagggtagcactttctagtccccattcagggacagtgatttctgattccaggatttatgggaggggtccaatctcagctgcccactgtgcaygagggcctggaactggacttgtcccaactgcattaacaccgagcctaccggcctggtggctcagagagtggagaatctgcctgcaatgcaagagacctag

SEQ ID NO: 33099 - DNA, 201 bp, Bos taurus
gtattatgtatatataatacatgttacagcattctaggccaaacaatacataatatgtccacttgtattcataaagaagaggcaaacaaatgttcctactrtctcttaggatcgtgagagatagtatactctccaagcaagatatttggaaatgccactatagcactggggaatatgagatcatggtctctatcttgaaca

SEQ ID NO: 33100 - DNA, 201 bp, Bos taurus
agtgtttgttccatttgttcgcttttgcctagtagcatttgttttcaaaatgtggtgtcttcttttaactctctgaggatattaatgaccttttagtattytgttcattgttttcttttctttgcattgcttctgatttccccaagctgcattttaacctgttggatcattttagcttctatcttcaaagttcataacatc

SEQ ID NO: 33101 - DNA, 201 bp, Bos taurus
tcttggccagagatacacatttgggaatcatctaattgtgaatgtgatctaatgtcaggagacaggatctgattatctaggaagagaagtttattctgcartcttgaggccatatcagtgcttatggttttccattctagtatgagaaaacttagctgcattttaaagtcttccccttccagattgaaacttctctagctc

SEQ ID NO: 33102 - DNA, 201 bp, Bos taurus
agactccaagctcgtttcaattgctggtgcaagggtgtaatatattttagtaatttggcatttgtttattattattgtcactgaatctgcacatgtgaaayttatttttggttaatgaatgctgttgtacataagtgggtctctcagacaccaacagggtacatcaagacccctgtgtcaattaaaagttgagtaatggtt

SEQ ID NO: 33103 - DNA, 201 bp, Bos taurus
ttaacagcgtgttcctgctgcaaggccagtgaggcccagctataaatgatcctgttggagacagtttggaggaggtccatgttggcatgaggaatgtttgyaggcaggcagcagggcccaaagcaacagctcagctttaaggtcaagcttccatcctttctggatggaagaattgggcagtacttgatcctgaagggactg

SEQ ID NO: 33104 - DNA, 201 bp, Bos taurus
ggcaagcgaggcatgggcagcatcagtcagtgagtggggaaggcatgcggcccaaagagccagtctccttctttgctccttctccttggcccttcttcccrcctgtattcagaaatagccttcaaagtcattctatttcatgaccatccaccaccttcttgaccctggagaaggtaaagacttggggaaactggaccttgg

SEQ ID NO: 33105 - DNA, 201 bp, Bos taurus
acagcagccaagagtcagactggaagcagcagggagttcgtgagtgcagaggacactaagaagttcatcagtccacaggagtacaggatgaatcagggcckcagaggtcagcctgtcctgtccttagcaatacatgactcttcctcgatattcccaacaagtgtccaacccatgttttgaaagctccagttactgaaagat

SEQ ID NO: 33106 - DNA, 201 bp, Bos taurus
tactgtctgctccttcctgcttctgagactgcactgcttgtttgcagttttaagtcatcatattcttatgtgtcagtcaggactcactccctttaccccaratttgtagtcagtatctcttcaagagtcactactgcagcccaggctcttctctcctctgggactgccctgcccttcttctggagaaatgcctgttttcca

SEQ ID NO: 33107 - DNA, 201 bp, Bos taurus
tggaagtctgggccacttcggtgctactgtttgagtcagaaccaacaatagccatcacgcccacctggactccaggcccctgaccctctctgcatccctcratcaagtccttgccgccctagatctgttccatgctgtagtttggggtgagaaaggcttgggggcctcactcagcttggggtgagtcacatggtaatgtgg

SEQ ID NO: 33108 - DNA, 201 bp, Bos taurus
cagcctttgttaaaatattttctagctgagtctactctagagcttaaatctacccagcagcatctgcctcagtaatacaaatgcctgggcttcattttgtycagcaggtacctttcttttactacattatagcttagtatttgctctatgctctccattctcttaagggttaaagaaagtccctttcagttttcccgtctt

SEQ ID NO: 33109 - DNA, 201 bp, Bos taurus
ataaggctgtcctcaggagaaaaatatcagacaaaactcattttcaaaagcagacagagttgcaagtttagactgaatttaaaggagtgaactgaagtatktgattttccttttttgttaccaaaggaattttttcaaaccaatagaaagaactaggtaagttattcactacagtactccatattttttaatgaatatggc

SEQ ID NO: 33110 - DNA, 201 bp, Bos taurus
tatgtatattagttgaaatgttaccgtttactgcactatgcagcatttcaaatggcttagctaatgtataggatattacatggccagctttaccatgaacraatgaaaagacaaggacttatgggaagttgtattttagagagtactatgaaataatgacccacaaggagatccaaccagtccattctgaaggagatcggc

SEQ ID NO: 33111 - DNA, 201 bp, Bos taurus
actgatgtccaacagtcccaaagtgctataggaaactgagactccttcaaggggtgaatgtggtctcactcatgccaagaccaagaaaatcacagcaataygaaacgtgccaagactatgtaggaaaggaggtcatttgcaaacctaaaagcattggctagagaggaaagcactagtgaggatgcttatccatgctcctca

SEQ ID NO: 33112 - DNA, 201 bp, Bos taurus
ttctttatttaatgatcttcttgtatctaacacaaagtgctgtttagaagactgacaaaaatgaagtatgtgagaagagcactgtaaactcaataatgttsccagatattatctttatgatgtgtctatggattgctgaggttgccaactggttcaattgttttctttcactcacatctgattccctctttcgcagcataa

SEQ ID NO: 33113 - DNA, 201 bp, Bos taurus
aaaacaaaaagctaaatggtgttactttgttcattcacccaacttaaaacctgtgaactcctaccctctgcaattaactgtaatgaagctactgtatattytttcatcaatagcaataggaattgtggttaaaaagagagtaatacttgttctacttgaacaagtagataatactacataatgcttgttcttacatagaac

SEQ ID NO: 33114 - DNA, 201 bp, Bos taurus
cagtgctctagatgatatgagatagaaattagtcattttggcagcatcctgcagagctcagggagccaggttttcactcacacactctctctttccttgaytgaataaatcataggccaaaaaaagatgtttcttgatcctatgctgtacttccttgaggcaagggatgtaggtaaagtataagtgtttctcctgcccact

SEQ ID NO: 33115 - DNA, 201 bp, Bos taurus
cctaaacagaggcaagggcagagtcatggaggaactcaggagaaactttgtggagagagcattacttaatattgaaggaatggtagggataaagtaagcayagaagtgagagtaggtgtgaaaaagacgtgagggagatctggaatagttttaaactgaaaatgagcatggtaatgctggagttcaaggtaaggatggaag

SEQ ID NO: 33116 - DNA, 201 bp, Bos taurus
tgacttctctatatacagaaagaatgtaaatagatggaaaagcaggaaagtctccactaagtgcctcagcaaacacctgggaacctatctgcttctacagytatagctggtcatgacaaaattatctttcaccactggttaggttgccacctcttaagctactcacacaagtgaatcagagtccaggcaactaagaaaaat

SEQ ID NO: 33117 - DNA, 201 bp, Bos taurus
ttctttcaggccttcctgaatctttaccttcctaagtaaatagctaccatgtggtatcacctgcttccctttcgtgaatcctttaatgaagacttgcccaygctcctcactggcaatttgtttgtcagtgacaaggtgatagttttggttagtttaacaaacaccaatttccaaccactgaaaaaccatctgggaatcctg

SEQ ID NO: 33118 - DNA, 201 bp, Bos taurus
gggttttctttcacagcgacgccccctgggttgttggccagaatcagcctggcaggaagctgggtactttgaagagtcatgctgtgtgttcctgagatcaratgaagagggaggctccatggaggcctcctgcacatttcagtaaatggctaaagtgatatggtgtttctctttccaaataattaatttgcaaaaattggc

SEQ ID NO: 33119 - DNA, 201 bp, Bos taurus
taaagccaggttcacctgggcctgaagctaactgagattccttaagaatatgccctgatttatcaaatgttcagccacttaattgaaatgttaataaaaaygctaacaacaatggccaatcgttattgggtgcttcagtgtacactgtttgaagtgctttgcatatattaaccttcttatccttaacataaccttgtgaga

SEQ ID NO: 33120 - DNA, 201 bp, Bos taurus
agtcttttttatacatggtccattgaaatcaaaatttaaacaaggtccacatgttgcaattggctgatgtgtctgttagtctacaacagctctccctcctyttttggcactgatttattaaagaaactaagtaatttatcctgtagaattttccacagaagtctattgactatattcctgtgatgttatttaagatgctcc

SEQ ID NO: 33121 - DNA, 201 bp, Bos taurus
cagcagccagggttttaatgtaaatctgaaaacgatgcttcacttaaattctctgctaaccatcatacttccttgttcctgaaatcctcatcatttgcttmcgttttcattgtctgtcttatttgactagaatctacgcactctgagagcagaagttgtatatattattcactgtgtcgtccctctaggcccacgagggta

SEQ ID NO: 33122 - DNA, 201 bp, Bos taurus
gtattaagagagggaaaatgacattatttagggagacagcaaggtaaaataaaatataaagtttatctttgaagtactaaaacaataactgtaggtagagrgatgctgaaaaaccattggggatctgtcaaaatagtataaattcctcctgacaaaagaaatcttaagaatcgctaaaatgattggaagtaacttttgggg

SEQ ID NO: 33123 - DNA, 201 bp, Bos taurus
caaaggattcaagatgctccccagccgtgcccccatcagcctagcactgttctacttctgggtccctgttcacccactttccttggcctctggggtccatyccaccatcatcagctacaaactactgccagtctcccaaggctcagtcacacaaggccattgtgatggctatgttgctgttgtttagttgctaagtcgggt

SEQ ID NO: 33124 - DNA, 201 bp, Bos taurus
aacaaaatgtttattttcaccttatttactgcactgattcctgagatctgagagaaatctacaagaggcttggtgggaggtgattaaagcttggtctatgraaacactttaaaattcagtaaacctgagcagcaagctacatgatggcataggacattcttctcatctttgacacattaactcacctctcctttaaagtaa

SEQ ID NO: 33125 - DNA, 201 bp, Bos taurus
gttgtgttctgaaaatgacctaagcccttacactgattctctctacttgctgtttcagttcagaaaggctataagtttcccaaaagagaatttataatttyatcaaagtaaagttcattagctaggacatgatatatccccagaagatgaactctttacttctgacagactataggctgttcaaaactttgccaggccagt

SEQ ID NO: 33126 - DNA, 201 bp, Bos taurus
ccaatgaaataatctgtcatggtggcccactttatccatctcacctcccaggggaaagaggcaaatttgatgataaaactcttgcctttccctcctccccsctaaaaaatgtcctggcccccaaataatcctttcttttgctaatagcttccttgcccctcaatagaaccaccccccaccttttttacaattaaaaaaaaa

SEQ ID NO: 33127 - DNA, 201 bp, Bos taurus
taatagcatctgttgaagaaaacatatagtggggagaagcaataggagaattgggtttctcactgacattcacctgctgaagcagagcacagaaatatttwtaacagtgctgagtgaaggccctggcccttgggatgtagaattttaaaaattaattattggaggatgtatcagcccatcccctgccatgatcaggagctg

SEQ ID NO: 33128 - DNA, 201 bp, Bos taurus
tcatggatttcccactattatagaacaaaaggcagagagcaggttgtttctgtggccactgcaagtagggtaaaccactgttaaaattagtgggccatggmgatttgtttcatcatcttggttcttaaaagtgacagttgtgttgcaccaagtggattcagcataatcttctggtagcatcatacttggccaacagtcatc

SEQ ID NO: 33129 - DNA, 201 bp, Bos taurus
agatagtaaagtgttattagttcatatcaataattttattaaatgctgaattggtacaaagaaagactacaatgtatgtggaagatattaaattaacactraaacacaaatgtgaatcctattcagtttaatatatggaatgtttcagtacttttgaaggtccttttgtgtccattaaaagcccatctgcctttccctggc

SEQ ID NO: 33130 - DNA, 201 bp, Bos taurus
tgctgagctaggagtgagtgatgagaggacaccagatgctgctctctaaagcggggcccccactgtgagggcctcagcaggccagagaggagctcctcacygcttcttctgagtaaggcacaatctcgtgtccagattggggctggcagttgcaggctcgccaggaatggagagagagagccaactccctcacaggctgat

SEQ ID NO: 33131 - DNA, 201 bp, Bos taurus
agaattctatagctgaaggatggagtgaacttacacacccccaacctgctgccactcccaccacttctgcccctcacacattggtcactacacgtgcttayggttctcactccatatggggagggcattcccttttcccacatgtgtccatgaacatttcaagcttctagaacttgacagctgaaaagaacatttcaagtc

SEQ ID NO: 33132 - DNA, 201 bp, Bos taurus
gggttgggtacccataaaacaagacccttcaggtgaggaagctgggctgaatagagggagaaataattgaagttgccaggcatttcaagtgatacaggccrtatataaactaaaatatttccactgcccaaagtcggcaagtgtgttcctgattaacacatgcgtgggtctttcagctgatagtgacccagtcttttagca

SEQ ID NO: 33133 - DNA, 201 bp, Bos taurus
ccacccagggattgagcccgagtctcatgtgtctcctgcattgcaggtggattcttcactactgagctaccggggaaggcccctgattcaagtcaaggctkcagcaaatgttgtgctactggaggagcgcatattccagtttttgtttgtggggccatgagtgcctttcacaggaagtatactgggttctgtttcagggat

SEQ ID NO: 33134 - DNA, 201 bp, Bos taurus
taaaatataatttaacacctctttttggtcttatttttaatcactgcttaacaaaaagtatctcctgcataaatgaagggaccctagtattggtcacaatrtcaacttggttcagttctctcaaagcccaggttactgcttcccccaaagaataatgtaaacacttataagctcttgcctcctaagagttaagcagcttct

SEQ ID NO: 33135 - DNA, 201 bp, Bos taurus
agtgattggtcaggagccaattgtgaatggaggaggttttttaactgcaaccttgaagctacccacggaatcctgacttgccgcaagctggaaggggcccmaaacagaagatatttcagtcagtacacagcttcacagagtcccagggtgggagtggggagaataccactgtgtcttttagacaagatcttggccaggcct

SEQ ID NO: 33136 - DNA, 201 bp, Bos taurus
tcaaaatgtcaaatcaaaatccagagtaattattatgcatgtggatatagaaacagacttttgtggttaacaggaaacatactcacaactgacttttgtargatattacaaagtgtcaaaataagtttgcccttgggagagcaaaagtctgagagtgcttttctaaaacatacaccatttgatacattagaaatctttatt

SEQ ID NO: 33137 - DNA, 201 bp, Bos taurus
cagtttgattttttgttcagttactgctacttaaaatactgtctaaaaatgtaatccctagaacggtgtttttattgtttgaaactcagaaaaacagcaaygtgatctttcagcttgtgtgtattagcaaaagctaggtcaccttcttgggggtcaacatcagtttctctttatgttaaatttctgcctttaaatggaaaa

SEQ ID NO: 33138 - DNA, 201 bp, Bos taurus
attaacattccagacaatcagtctcgaccatctctcatagttgaatgctaagctttcccattaaagtgtatctagcccccagattttgttttgcaagatcytgaactgagccatgaaaaactttccaggaacatcaatattttcttcttcctgtacagctttcagcactatgggggactaactgtaaataatcaaagagga

SEQ ID NO: 33139 - DNA, 201 bp, Bos taurus
aattttttaatgttggaaaatactttaatactattataaaaccttatgattatcccttgctaagatgaatgtgacagattctacctcctaaagatattgargggcaggaaactgcaatatatgttaaaatggtcatgaaaggtctcagggactctgagaaaacttctgaaaaaaaaaatgaatatagatgagcagcaaaga

SEQ ID NO: 33140 - DNA, 201 bp, Bos taurus
atctataaaagtacctgtcattctctccttcattccatccaaagttggcctttcatctactccctgatgcaatgacatgagaaatcatggaagtcaacttratctagctgtcatcacagctttcaatgacttacaagttactcataatgagaaaagacttagagacaactgaactgaataaagagctatgaagcttataca

SEQ ID NO: 33141 - DNA, 201 bp, Bos taurus
ggaaggtggaggagtagtttgtctctgagcttttaatataggaggattaaaagaaaatgtttcttagggttcatcacttgctataatatcaaaatgtatcycatagtgccctcacctattacataatccccatccatcttgcaacaaactcatctgttctgtggatgtctttaagctctactccccttcagagtcctcatt

SEQ ID NO: 33142 - DNA, 201 bp, Bos taurus
tacttactttccctacatgggtgaggccagtatttcccatagcctcgtgattgaggtggttagagaaagaaagcaccatggtagcttctgtgcttccaacrttcaatgagaagttccccaggatgctcaaagtctccagagattttttcatatgaaaaggagtgcaccgaagccccaggacagtcagcaagcgctgcatag

SEQ ID NO: 33143 - DNA, 201 bp, Bos taurus
cggaagttgctctggggcatgatggtcgatgagtgaggaagctgaacccaaactggaaacagtctcagagatacagtgaggtcccacctcaacaatctggygcatctaagtcacactctattctgctccccattttatccccctacccagaccctctgcagcttccagctcttctttcacctgcgccgcagcccacccttc

SEQ ID NO: 33144 - DNA, 201 bp, Bos taurus
ctttgttcttttattgttttgacgtgtgtttttatgcctttcaagggacttccacatctatgaggccatctcatactgatgacattcctgcgagatagacrgacaggtattattgtaactcggtcactctcctgccgttggtcatggttcttgatggaagccaccatgtcccacagcagggaaagcaaccccatcattttc

SEQ ID NO: 33145 - DNA, 201 bp, Bos taurus
tggggctgggagcctgggccaagtacaacacagaaaaaccctaaggaagcttcccatgaagtctgtctgagacaagagattccaggtcagttgaggatccrtactggcctgcagttcttgctgtgtaacgctggccacctccacatcaggatggacaggaacagccagcgtcgacatttttcaattgcacacacggaaata

SEQ ID NO: 33146 - DNA, 201 bp, Bos taurus
ctggtggggagaggaccaaaggaaacggcctttcacatctgcaacatgaagagaggatgcaaaggaaatgacctttggactagaaaggaacattcacaccrtaagctggccacgatgtcaggggttctaagcagaggagtgtgtgaaagggtcacttgcgtgagaagaagagctgggatcctttgcctaactttggaagtg

SEQ ID NO: 33147 - DNA, 201 bp, Bos taurus
ctgctccttgactgctgagaacagggccccgctgacagtgcgctacctgaaggagacgccgctcaggagttgcaggacctgggatttctgccagtgtcctyggaacacagagggcctttttcttggtccaaccccgataagcattttgcagtttgtttctggtcatggcctgccagccagcatttgttgcacaattttgtt

SEQ ID NO: 33148 - DNA, 201 bp, Bos taurus
ctttgggtgaagttaaaaaaaaaaaactccattcattacttcagacaaatatttgaaattccttaagcagagagtgaaatggccccatttgaaagcatctkaaagtctgatcagcatgggttcacccatttcaatgccctgctctccagaccgggcccttcgaccggaaatgtcctttgacctgcttctcctctagccccc

SEQ ID NO: 33149 - DNA, 201 bp, Bos taurus
ttccaacactagggcaaggggtgggcgctggcagattccagctcttaggaccccaagtacagacagccccatgcagaggaggaaagcgttcttggtccccytgggccttgattgccatagtctggccctcggatgatttatacaggccacacaaatattttttattccaattatcctaatttaaggacattttagaaaact

SEQ ID NO: 33150 - DNA, 201 bp, Bos taurus
caattctaacagaaaggtcacccagaaaactccgtggtcggagcctccctccaaacaacaaatgtgacaattaaaacaaagcacccttcatttgacgggcrcggaagcaactgggctggcccaggcccgtggcatttgttacctgagggaaacaatagcagctctgtaggcacgtctggccgaaagggcaggagctgctgc

SEQ ID NO: 33151 - DNA, 201 bp, Bos taurus
caggaagtgcctcatactggctcttagagcaagcacaggttatgaagtgcaaaatacaagcatttgcaaatctgggtagtatccttcctcactgatctcaytgggccaggtaaaaagagccatcctcactgtagcagattgtgtgtgtgtgtgtgtgtgcgcgcgcgcgcgcgaagtcgtgtctctctttgtgactccatg

SEQ ID NO: 33152 - DNA, 201 bp, Bos taurus
tggaggtgatgaagctgattggccgacacaagaacattatcaacctgctgggtgtctgcacccaggaaggtgggagcggggcggggtgagggacagggacrgtgggggcatggagccacagccttgtcagcttccctgtcgcccctctcctctgcagggcccttgtacgtgatcgtggagtgtgctgccaagggcaacctg

SEQ ID NO: 33153 - DNA, 201 bp, Bos taurus
cacattcagggtgccccatgcctaaaacacccctactttataactttctatgtcttgagaaccctatattctgtgcacctagcacctgggcacccgggccrcagatatggatggctctgcttacctgttccctgctttccaacgcttgccctctttttgttgtgcccagtgtcttgggcccccatgctgactgccctgggt

SEQ ID NO: 33154 - DNA, 201 bp, Bos taurus
aagtgctataaacatgcctgggagggtggcctgggcccaagctgcctgccctgcagggctcggggggcccaacacccctctcccaggtgggactgccagcygccagcagcagggtacaaggagcacctgctcccacaccagggtcctttgagtccattccaacagtgactccaagcagccctggaggctctgtgagggctc

SEQ ID NO: 33155 - DNA, 201 bp, Bos taurus
actgaatccgcagcgttcactcacttgcatagtcattgaggccctcctaccaactgggcctgaaggtggctaccagtgaaagacaagggcctcacacctgktttccatagccctggttcctccactgccccaacctgcccatgctaggagtgggagtgcccatctatggtaggggccatgatgaggccccaaattcccctg

SEQ ID NO: 33156 - DNA, 201 bp, Bos taurus
ctgcttaggacttggcgcagctttaaagaaagtggagtggcagaggttggaggcagttgttcaaggaggtgaagacagtacagtgaggattacaccttcartggggacgctggcccaggccagttggagtctggagtaccctggaacacctgtcttgacttgccattgaaaatgggattctatcccagcgaagttgtgaaa

SEQ ID NO: 33157 - DNA, 201 bp, Bos taurus
tactctgcctgaattgtaacagaagccctgtgtaaggcaggtgttatcattcccatcttacagaggaggaagctaggtccagtgaggggaaggcattgccycaggccaggcagccagaagtgggaactggagcccagatggcagggacttaaattctgtgtggacacagaaacctataccacactaagccctggcagtggt

SEQ ID NO: 33158 - DNA, 201 bp, Bos taurus
cctgaggcctgagcaactcttggctgcgtgcacctagcttctctcctgctctgccagctctgtcccaggcacagactcccattgcagctattcagttgctytgtttagggcccttaccctccttgcactggttgctagtgcccctcagagctcccctcacctgcatcagccaactcaaatcttaaggaccatcaccctcca

SEQ ID NO: 33159 - DNA, 201 bp, Bos taurus
ctattgggcaggggagcccagatgatgcagtaacaaagaggtcagcctcctaagggcaaagagctgagtcagagtggtggagggaagatctaggggatggraatccactgcattccctaacatgcatatagattaccaaggtcagtctagctactattgcctctgaaatggctaacctgtcagcgataggcactaatcctc

SEQ ID NO: 33160 - DNA, 201 bp, Bos taurus
aagttaagaccaaagaaaattcacaaaactgctcttctgaaattcatcagtcttaggatatacccatctgtaactaagctctcttccttttttcagaactrtacacaatacgagacaggcaaaaaaggattcctttcttaatgtaagtgaattttagatttctctggcacagagaattctctcaagaaagctgaatcagag

SEQ ID NO: 33161 - DNA, 201 bp, Bos taurus
cataagtttgagcatgctccagagatggtgaaggataggcaagcctggcgtgctgcagtccatggggtcacaaagagtcagacaagagtgagtgactgaayaacaacaaaaacattcaaacaatggccatgccactcctatactgcagtgctgtatttacagaaagaaagaaagaaagaaaaaagctttgtgttctgatga

SEQ ID NO: 33162 - DNA, 201 bp, Bos taurus
gccagccagggctgtagcagaggccagaaggacaagggaaaataggaagaagtcatatggtgaatagctgaacagacccaaaaggatgaagtctgatagcraggtgtggttccagatgtccatggccttgaccctgagggaaaaataaatgagtaaacatcaaaacgaaataacttacctggcatctccatcatatacgta

SEQ ID NO: 33163 - DNA, 201 bp, Bos taurus
agtatatagctcccttgctaagattagcaagtggtacactctctgtcccccttttgatgtctatatcagaagcgttctctgtcccttactttaataaaacyctgctatacaaaagctcttgagtgatcaagcctgattcctggtccagaagctaaatcttcttcggaaatcttgaatccaacatccttaaccataagctat

SEQ ID NO: 33164 - DNA, 201 bp, Bos taurus
atcttgggaactccccccaacccccaaccccattcttgacatgttgccttgtgctcacagcaccatcacctccactgggcctccactgggtttggaattaytggattcaagttctctggagaattattctcctactttctgccaggatgagggatgggtggggcccatgtgtgcggagttgggagggaactgtgctccttt

SEQ ID NO: 33165 - DNA, 201 bp, Bos taurus
agctggatatgtcccaacccagagcaaaggaaccagtagttggaacagctctggtgacagactacttcttttctgaacttctatgtcccaggcccaggctrcgtaaaatgaagaacaatggtggggaggtgttggggcagtttaaggctggtgcctcgttacatgtcacagaggccaactttgccaacagtactcaggcag

SEQ ID NO: 33166 - DNA, 201 bp, Bos taurus
ctcattttatggttaagtaatcagccatgaaaaggaactcattagaagtcagttctaatgtgtgaatgaacctagagcctgtataacaatacagagtggartaaatgaggaaaaaaacaaacattgtgtattaatatttatatatggaatctggaaagagagtattgatgaacctgtttgcagggcagcagaggagatgca

SEQ ID NO: 33167 - DNA, 201 bp, Bos taurus
tctcttctccctttgggcattgcctcactgtcttgcttagcaaccagcctctaattaagtaatttctacttactaatggagtctctccaaagcaatttttrctttgaatgtatctttacagcccctataactgtctagaatgtagaacaaaatagaaatctaaagaatgtgtacttagttaaatatatcttttttccccct

SEQ ID NO: 33168 - DNA, 201 bp, Bos taurus
aggatgtgtcagagtatttcaattttgtagttacaagactgggatagagttcataaaaatcaagaagagggccatgtgtggatttgacccctagttatgayattacaagtccatgttctcagcctcatgcttttgattaagcgatgttcaaatagatagcagagccatatatgtttgagacatctctaatttgagggaagg

SEQ ID NO: 33169 - DNA, 201 bp, Bos taurus
acccagggatcgaacctgagtctccagcattgcagatagattcttttaccttctgagccaccagggaagcccaaatcaggaaaagaacaacactcttactytagcaactcttatagcaaaggtggcgtggatcatgctggagggcagataaaaactaatcagaataagtcagtcttctctgtctctctttgaaagacactg

SEQ ID NO: 33170 - DNA, 201 bp, Bos taurus
agataaaataaatgttttacaagatggttttatgggttaaccaagtacttacattgacctttctaacagaaagattttaaaaggccagcaatactgttctktaattcaacatcagctcacgagcttttctcatgtgacagaatctacactggctccttcatgctcatgaagaagcagggccagggctctgacatacagagt

SEQ ID NO: 33171 - DNA, 201 bp, Bos taurus
cactcagtgccctcactataactaaatatttggccatttctgaggaccccagtcttctcctgtggatgcatggctccctccacataaacacagagcctcayagcaaggccagaacctataggcaaagggagttcaaacatttagtatagattttccccaaattatgtttcagctattttcttttttttttttttaatttta

SEQ ID NO: 33172 - DNA, 201 bp, Bos taurus
acaccatctcccgggcagcattgtgcatgctcacagcccgctcatatcgcagtgctgccttctgtgtctcctgctgggcctgggagggggcgtggggaagraccatcaggagactgagctgcaaaagacccctggctgcccatggagaccctccctgggcaaggacaagagaaggaaaaaggcccactgtaatgctggctt

SEQ ID NO: 33173 - DNA, 201 bp, Bos taurus
gaaggctttgattggtttaggcctaggggacttctcattgcccatccctccttggtcatttcctagtgcatcaccaggccaggatccctggtccaaagctwtaaaacaagctggacactcttcctcttctgagcactgtactggaggcaaacttccctctgagtccctcctgcccttcctagtggcacaaggacacacccc

SEQ ID NO: 33174 - DNA, 201 bp, Bos taurus
aggactgcatacaataaaaactctaccaccaagactaactttccagaatcctcaactaaggctttaaatccaaaaaaaaggggggaggattgtaaaagtaytagttaaaaataaagatgaattatttcatctgctctaagtgcagaaggtctttctaaacatagtattaaccaaacattatggaaaccaaagtgaaaaaca

SEQ ID NO: 33175 - DNA, 201 bp, Bos taurus
aagcacagcatctctttcattggctgtggaatccaaatgtttttctgcctgagtctaggtggtgctgagtgtctccttctgaccttcatgtcgtatgaccratttgtggctatttgtaatcccctgcaatacacagtcatcatgaattctaaggtctgtttgctcatagcagtagcatcatggactgggggtgctctaaat

SEQ ID NO: 33176 - DNA, 201 bp, Bos taurus
ggatctccttgcagtccaagggactctcaaaagttttctccaacaccacagttcaaaagcatcaattctcctacccacatccaaatctctggcctgctccrggtcccccagcagacacatccttactgtggagacacttctccgcccaaccaggactcaggactctcctagcctctcaggccttgggggccaaacaagagc

SEQ ID NO: 33177 - DNA, 201 bp, Bos taurus
gaccactctggggtcagggctgccagggtcagggccaccccagggtcaggactactccaaggtcaagaccagtggaccctaacacaaggacagagttcatyggatatggccacagggtccagcccatgaggctgccacctgccgcactctgctgcagcatcagaaagcatccacaactatgtcaacagactggtaaatact

SEQ ID NO: 33178 - DNA, 201 bp, Bos taurus
ggagcccaggaggaaagtggtggcccaggatgagtgagtgctacagtgggaagagcaatgccgagtacagtgaggcaccttcctccactgtccgcgccagyacaggggcccaggacagcaagctgaccggctcaggtgtcctgctgacaggctgacctggtactgtggtttcactctccacatgtccttgccacgcttagg

SEQ ID NO: 33179 - DNA, 201 bp, Bos taurus
cctgggcctcacacccccaccctgcgtagaccatatgaagggagactttccttctactcggttgtgactagaggacatgggcagcgttctggacatcaggyagtgaccatgggctccctgccctgatggccggcacatccagactccccagctggctgggtgtcccttccgtgggcccctggggagccgaccctccatggt

SEQ ID NO: 33180 - DNA, 201 bp, Bos taurus
aatcatctctcctcctccatcgaaacatttttcccaggaagcaacggtctctggcagcaccttctgtgctcatccaagggtgttctgagcaggaaaggccrctggtcaggcagcccagaaggtgagtttgcccatcacaaggcaatagcttttctcttctggtgatgcggcagaatttcctgtcttctgagcactgtgagt

SEQ ID NO: 33181 - DNA, 201 bp, Bos taurus
gtgggcgggacctatagtcccaagagagtatcacaagctcaggtcttgtgggatcgggaatggggaagagtagggtacaagtttggaaagggggcttctgrggcccctatggggtgagaaatacgagtatgagagtcagaggaacttattggcgcaaagtggggaaagattgaccgtagatctggggcgtggcgtggttcg

SEQ ID NO: 33182 - DNA, 201 bp, Bos taurus
cctcagctttctgtgtgtccccagggaagttactacccagctctgccttggtttccttcaaagttggatgcccagaggcccatccaactctgatatttttrgatcctgcagtcatcacttttcctgctgtgtatcagtttgatgtatcagtgtgatgcttttggagcattcaggtccgcgtcaggcctgagccccagcctg

SEQ ID NO: 33183 - DNA, 201 bp, Bos taurus
agactctcccagagggctgcccgcccgacagcccctgacttgccccattgatcccgaaacagagactgaggcccagaggtgatctatgggccctaatggaygatgcagtccttggggaaggggatggacgagtggtggaggagacccctctcctgtgtagagggggaaactgaggctccacaggtcaataaaggtggatcc

SEQ ID NO: 33184 - DNA, 201 bp, Bos taurus
acctgtgcctgtgctcagtgtagtcagcacccagcagcaggggtgggcctggagtgagcactgctttgccgtcacaggctgcgtggcctcatctgaggccyctgtctcaccgtttcagtttcccatttctttaacatgggaaccagctgaatggctggagtaggtgagcacttcctctgtgcctgacactgaaggccaaga

SEQ ID NO: 33185 - DNA, 201 bp, Bos taurus
ctggccatggagaacaggagagaccgggcaggcgaggctgatttaaaaagccccagaggtaggtggttactctaacatgggtgggattacaggtgatgctyggcctcttcctccccccaggtatttttagtggtcttgtatcttctgacacctgctgccttgtctctggtctgcttttctctctggagtctttgtttcctt

SEQ ID NO: 33186 - DNA, 201 bp, Bos taurus
gaggctgcccagggctgggagactcatctgaaacccagctggggatgtgtcctcttccagggttgctcactggcagttggctgcattcagttcctggccgygtgggtcttcctgaattttcaccttggcttctagcaagacggaagtcaaaactgtttacagtctggtcacaaaaggacatccccacaccctggccatgtc

SEQ ID NO: 33187 - DNA, 201 bp, Bos taurus
gggactggaacctgccctcatgggggagcctcaaagcgggtggaaccctgcagctttctgttcacgggaccccatcctgccctgacctgagagcagcctcrggtggagccctcagtggccaaacagaaccctgctcaccacccccacttcagctgtgatagtcactgccccccccaccactaagacccctagaggtggcag

SEQ ID NO: 33188 - DNA, 201 bp, Bos taurus
tgtgaccatggcagccaatgagagtcagccctgagacttcagctctgagcttacagaggactccactcctggctggggctgggtggctgcagggaggtgartctggggccaaggttaaagcacctgtagacatttcagtgcctaggatccccacaaaatgatttaatgtctggggcggggaggggggggtggagaaaaacg

SEQ ID NO: 33189 - DNA, 201 bp, Bos taurus
gcacgggtcgacgtcaacgcgcgctcgcacggcggctatacgccgctgcatttggcggcgctgcacggccacgaggatgcggccgtgctcttggtagtccrcttgggtgcgcaggtgcacgtgcgcgaccacagcggacggcgcgcttaccagtacctgcagtcgggcgcctcgtatgctctgcgtcgcctacttggcgac

SEQ ID NO: 33190 - DNA, 201 bp, Bos taurus
aggccaagagagtggaggtagacagggattttgtagcagacatcagactttcctcccagcgaaaaagacccagaaagaatagaatggctcttggggatatraggtggccatcaaattgaactcatgagctctaaactattagttcaaatacttaataaaaatagcttattttgatacagagtgatttataattcttcattt

SEQ ID NO: 33191 - DNA, 201 bp, Bos taurus
tcaagagcacagtgatgcaactgaggagggaggccaagatgatgtaaagctgcctttatgacagagatgcagacgtttcaggaaggaggcactgcacaaartgagatagaggtacagggccccaggcccccagagtccccacagggacatggagctgtgggggaaactggtagtgggcttgactttattgcacagtaacca

SEQ ID NO: 33192 - DNA, 201 bp, Bos taurus
cagagagggttaagcaccctgccaaggccatgcggcaaataaatgacagagctgggactccaaaccagccaggtggacacggatctatattcagaccttgyccactgaggcctcttgatacttagcaatatttcatttggatgaatgggagtttttagtacgatggggaaacatctacgtagaacaagattggaggccctg

SEQ ID NO: 33193 - DNA, 201 bp, Bos taurus
aggtttgcgccaggagtagtaagtgaagcagggcaaaccttcaccccacaggcatatgttctccaacctcagggaaataaaaggtgattgttatggccctkcctgattccagcagccctgggtcagatgcttcccataaacagctaccagaagaactcagctgtggccccatcaagtcggtgatcccttcctggaaatgtt

SEQ ID NO: 33194 - DNA, 201 bp, Bos taurus
ttaaaaggaaagctgtgaatgatagcggagagctccagaccctccaaggccttcatgcaaatgtctcgctgctctctcagcaccggaaatctgggccaaamtgtaatcattgctcaatttttttttttttaaatgttgtcacccagctgctttgagaggctgtgctctggtccaggtggtgtgactgtgtgtgcagagggg

SEQ ID NO: 33195 - DNA, 201 bp, Bos taurus
tgcccatccaaaaccacaagagagagctgaccaggcctggccaccagatgccaagagggctaagatgcacagcacagcaccttggagttggggtccagagyccagagttggggccctaccacttacctactgggtgaccatggcccatcccttccctctctgagcctaagcttcctcacctgtacaatgtggtggtgggaa

SEQ ID NO: 33196 - DNA, 201 bp, Bos taurus
ctagagatttgcctactgaaaccagtgccccatgtggccaattggtctctcaaaagcagtaccatccactaatgcgtataacacatctggggatctgcacmtcctcaatctctagctcctaacaagtggctgtctgatttgggaaccatctgcatatccctaaggaagcaaggtgtcaaggacttgccatggaatcagcac

SEQ ID NO: 33197 - DNA, 201 bp, Bos taurus
atcgtcctggggtgttgagaaagaaggcagcttaggcagggggctgggggcgggggtgggagtgtggagaagaacagagcaccctggcccctttaggggckaaggtcttattgaaaatatgaggaggagttcctggaccccttgaggtgctggagaatagaagaccgatgccacaactctccccaggcccatgatctgttc

SEQ ID NO: 33198 - DNA, 201 bp, Bos taurus
gtactgtctgtagattctctgaccatcatcatgactcaatgtcctgtctattgtatcacttactggcttattgtggaaaaaaattttttttattgtaacastcttgagttttcttgctttatttcacaagctcgtccaagatttactgaaaactttgccgcaaatgttcaccaagaccttggagactcagagtgccttggg

SEQ ID NO: 33199 - DNA, 201 bp, Bos taurus
tgccgggtttcttcacctccgagtgaacggcaacggggcccggtggcaggggaggagcattgaggaccagcccaggtgggaggaattagagcggccaaggmtgccctcactcaagatggcggcgcaaatctcgcgcttggtcccgacaagcagcgcgcccgtttacgctgcatatgcggccctgcgctctggggggcgggt

SEQ ID NO: 33200 - DNA, 201 bp, Bos taurus
agttacgcagtttactcttaggagaaattcttgcttttctcaacagtattgtagccagatatccaaactagtagaacattttaacctctttgacctcttgkatacctgcttttttttttaaattgaagtatagttgatttacaatatagtgttagtttcaagtgtacagcaaagtgattcagttatacacacacatgtgta

SEQ ID NO: 33201 - DNA, 201 bp, Bos taurus
ccagcatatttgatatttgatcacagaattttttttttttaatatactgcattaaaccttggctcagagcacaacttaagaatttaggaatttaatctttmaggaaatgaccacactgtctgttaagcacagtcaggaaccaatgtctcctattaattctaggcctttttttttttttttttttactagtataccatattg

SEQ ID NO: 33202 - DNA, 201 bp, Bos taurus
aatgatattttaaaaatttcacctgatgaaaatgttttcttggacgttatgaatggctccaaagaactttaaaagcccaaccagtgatgctggccaggcayttagagattagtagttgttacgtcttggtttggtatgcctagtggtgtctaatcatgttgtgtgcttgggaaccatgaaagaattttcttttcaagtctt

SEQ ID NO: 33203 - DNA, 201 bp, Bos taurus
tgtttgcatttccagttgtattctcttggggtagattctttggatctgaggatatgaatacaactaatgtttttcagaaaaattggtcagtttacattccyctggaagtttatgagaatgctccatcatattgtgctcttgccagcattaaatattatcaagtttaagtcttctctaatttcataagcaaagttaatggtt

SEQ ID NO: 33204 - DNA, 201 bp, Bos taurus
accctggttctgccaacacctctctccaactcccatcacactgatggggggcgggttgagccgacctctgggaaggggcaccttgccatgggctggcctcrgtagttgaccccatcatggaatccatcccgtggcatcagaactgaaaagacttcagagactgccttgtacaagtcacgccagactctagtgaggcccggg

SEQ ID NO: 33205 - DNA, 201 bp, Bos taurus
ccgcagtcactttattgcatgtggcacgtctagatggaaaggctttgcaggaattttgctttatgggtaataaaggcctttatgtgcctataatgtggacrtgggtccaaagaggattctgccctgctttctaccaaggggcttggcggagactcctgtgggggctggagctgctggccctgctttgagtagactagaccc

SEQ ID NO: 33206 - DNA, 201 bp, Bos taurus
actaatcagtttcagcaaatagggaatggtatacatggagtctgtaaactgtgagcatcagctgtgtatggcagcgaacccacacttctggcccagcccakctgacggggattgctcaaggatgggaggtggcagcagagcccttgagccacaggcaactcagatgaccccagggccagctgccggcccggcccgagcaca

SEQ ID NO: 33207 - DNA, 201 bp, Bos taurus
ctgctgagtggaaggtggctggccacgttccagagcctttcctctcagcctgtaggtctgcctcgtccagaccaccagccagctgcatgtctctgaaccayggcctcctccccatggttcctcacacacactgccttcccgtcttggtgatgctcaggtatttcttcccgccagcagagatgggctccaggaagaaacctg

SEQ ID NO: 33208 - DNA, 201 bp, Bos taurus
ctgtgtggtagggacagttggcacttggaagggagctcagtgccaggccctgagcataggcatagtgttgttgcttgactgacatgttctaggaggccctragtcacagcttgtttggggattgtcatgccctcactggaggacctggctcagatttgggagaagattcctacaagggggccgtcccctcacatccatcag

SEQ ID NO: 33209 - DNA, 201 bp, Bos taurus
ggacgcccctctctccagcaacgctgccttcaggccccagttcctccttcatgcttcaggatttgtgccttactacagaagccccgaggaggggctgcacmtaagccctgggccccctgcctctccactgtggggccaggagtccacaggaaagctgcccaggcccagggcagccacactgtgagggagcaggagctggtg

SEQ ID NO: 33210 - DNA, 201 bp, Bos taurus
gctaaggattttcaggagaaactgatgtgttaagaaatggtgttgtgtccacctccaacccccaccggcaaacagaggagatctggtgtccctgaggcctrggctctccttacttcaagtggatctgtgactagtcactgtgcttcacctgactttcctgtctccaaggccatgacccactgaagacactgaacagcactg

SEQ ID NO: 33211 - DNA, 201 bp, Bos taurus
aattgctttttttttaatttaatgaagtttagttttctccaagctttcattctacctggtggcagaaagagtgattttgccatttcaggtgtaaaattccrgaattccaagtaaaattcaggcagttcagtacttcctcctcctcctccctctcctggggtgactttgaattcttggggcttggggtttgagggagaggct

SEQ ID NO: 33212 - DNA, 201 bp, Bos taurus
aactggctgccccgaatcacaggaccaagcctggcgtccacacaggacgggggtaagcaaaggcaggagtccctagaggcgtgtgtcctgggggccctgaktgttcgttctccacaacctcactctttcttggtaagtcaccccaatacgtggtagagcaggcagcagccaggcctgtgtccacctgactttttccaccag

SEQ ID NO: 33213 - DNA, 201 bp, Bos taurus
ggtaaaactacctctgtttggagggaatagagggtatggatggactgaaataatttcatcttccttgagtttatcccatggcccaccatgcaagtcatgcyaccagattcctgacttaagtgccccctcagtgaccaaagcaagtccaggctgctgacctttgttgtcacctctggccaaaacatgtttattctttacata

SEQ ID NO: 33214 - DNA, 201 bp, Bos taurus
ctggctgagaaggggtagaatgcagaaaaaagttgattttcaaatggccaggctactatcaacatctgctttcccacctgtctgcacactcccttacattrgacctggctccagacctggccctggctccctcacatcggacctgactgtagaaactggacagaaagcccttcatctcttattctctgccctttgctgctt

SEQ ID NO: 33215 - DNA, 201 bp, Bos taurus
atctcctatgggagaaaagtgcttgccttttaaggtgcctcttatagcccccgaaaaaggcaggagaggaggattaatgctccagaaataggggccctgaygggtgcctcccatacacttggttccttccttgggaaaagacacttctgtgtggagaaaaccataaaaccacatttaaatcacactctgcccagaggtggg

SEQ ID NO: 33216 - DNA, 201 bp, Bos taurus
ccgagtagagactcttgtatacaaggcacggtggcagatacttctctgcaaggtggttgcttttccagaggaaatgggcagatggagagaaggatggccarcctggaacagggcaagtgtaggtaggaagggacgaatgaatagccatgaccagagagaatgctctcctgggcctctgctctcccaagcctttggccacag

SEQ ID NO: 33217 - DNA, 201 bp, Bos taurus
aataaggattccacgtctgttttcaggggccaagctgaataaaggtcctctaatttgcataacaaagccagtggaaggtcctgggcaggaaaccccaaagkaaaggggccaagtttcctgagggggcctgagaaaaacatggccctctccccaggacctccttcaagctggaatcaaaccagcaatctaaagataagctca

SEQ ID NO: 33218 - DNA, 201 bp, Bos taurus
ggccactcccaagcaccgcttcactgctggactgcctgccagagcataggagctccccacacatgttcttaggaactgagggaactgaaagcatgtccccmaaagagcggccacaggggcaagcattgctccgacttcaagaactaagagatgggataggactcattctgcacggtcccagggtcaaattggaactaacca

SEQ ID NO: 33219 - DNA, 201 bp, Bos taurus
acacgaggggccactgagatcccatctgtgagccaagtgttccccacattcctctcattatctcagaatcctagtgtccagctcgaggagggatgaggcartgagtggggccctcgtctgcatctggcctagtccttctgtttccagtgccctggactccagctggccttccttctgtatcattccactcttgttggacac

SEQ ID NO: 33220 - DNA, 201 bp, Bos taurus
ggaccacggccaaagtactcattcgaggccaggtggaaggagtaggacagggctctgcgaggtggaggcgagtgcccgcctaggacctggcatggtgagcrcagctctcctactgaggcctggaggagccactggaggtctcatagtttctgtgcacacaggtggcatctgggttatacccatccctggtttaggtgtcac

SEQ ID NO: 33221 - DNA, 201 bp, Bos taurus
catgggtctcaaagaatcagatgagacttagtaactgaacaacagaagataacagaagagccactctgttcccagaggcattccttgagaggacaggcctyggggcaagccccctgctcattcaagaacaaatctcctacaggctggtctagaaacttctgctgttttccttttaaacagcatatgtttcaaagtggatac

SEQ ID NO: 33222 - DNA, 201 bp, Bos taurus
ttggtcctgccttgtccatcccatccagccaaaacagcccatctgcaagatgcactgcatttcctaggaaggagggcctttgagttacaacccattactcmtacttggaggagtcaagaggaagagcttttaccataactgggtttcacagagagtgcagagggtgagcactgtggtggccaggaaccctcagcacagcac

SEQ ID NO: 33223 - DNA, 201 bp, Bos taurus
aatggaatctactccaattcatgtaaggcttctcagaggaagagagccaggctgagacccaaaaggatgacgagtagttaaccaggtaacaggccaggccrggaaagaggtccagacacaggcaagggaataggaaggctgtaggtgggtcagcagaccctgcaggtggcaggctccctaaatggaggggtggaggcagga

SEQ ID NO: 33224 - DNA, 201 bp, Bos taurus
ggatggaagatggttaacagaatagatcaggaacaggagatgtcatggtgccaggtggtgggggcggggggagcagggaggagcgcagtaaggcctcataycgcttgttcaccgcaagtgtttgaaagtctctttcaaggaaaagaccaccatcaactaaagggaaagggaagaggaacagagaggagagagataagtaag

SEQ ID NO: 33225 - DNA, 201 bp, Bos taurus
cttttaaaatattggctataccttaaaaataaataaaaatgctccaactgtgatcaggtgtgcagacttgaggtggcaaaaggagcacatgatattggcaytgcaattcctcatatgtcattggctaacttgccaaaggtgagattacgaagggatcttcattcaagagaacaaatatgtaactttaagatttctgagtgg

SEQ ID NO: 33226 - DNA, 201 bp, Bos taurus
tatacaagtgtaattactctgttttccaattcatgttgtatttgtgtttgtacacacttatatttgcatgaaataaaaatgagggaaagagtcagtgttcrtagcccctgagggaatttcaactgtcataaaatcccaacgacagagaagctgagagatcacactgagctatgcctcatgtgaagtgtgtgtgtgtgtgtg

SEQ ID NO: 33227 - DNA, 201 bp, Bos taurus
tgataacaacatgaatgttcgttcccaataatggcctgcctggggatctcctggtcccagggatgacctatggtaggctgatggtagaaacacagtgcctrtcctcaggctggcctaggctcagggaagagatgtggctcctttgctcagatctgagagaggagaaggaagctggggaaaatacaaaccacagtattactt

SEQ ID NO: 33228 - DNA, 201 bp, Bos taurus
tgtgaatcattttgtaaagcaaataatcaatctaaccaaccaatgtctgccagcttatctatctcagagaattttcacataaaagttttgcttaaagttarctatttctgcctgtggaagggatcacaatgtgtttctgaaatgattacctttcaggggcagaggagccaggccaggtttctacaggatgagtacaaatta

SEQ ID NO: 33229 - DNA, 201 bp, Bos taurus
ttctaaacccacccagagggagggagcctgggcaaagatgacatgcatgcacacacacaagcctatgcacaccctgaaaaatatacacatacatgagcagraaaaaacaacaacaatatcaatgtattggccagagttccctttgaataatgggattattctattcttctcattatactcctgtgtattttctacaatgaa

SEQ ID NO: 33230 - DNA, 201 bp, Bos taurus
gtacatattccaataagtaagtgggaaggattaattcacaggaaacaagtaagacaaaaatccccatttcacacacatccttccaaactcaaaatttggarggaaattacttttacttttggcgtaaattatactaacaacacctcagatcctgaaaagaaagttccaagaacaagtgtcaaagactacacaggggaaaat

SEQ ID NO: 33231 - DNA, 201 bp, Bos taurus
gttttatcccagtttttatagtttgtgataggagggtaaggccaatcccagctactgctcaatggctaagactgaattcttagaattaaaaaaaaattaayattgatattaggcctttaagagtggattattattattttatttatttatttttggttgctctgggtcttcagtgctgcacgggctttttctctagttgag

SEQ ID NO: 33232 - DNA, 201 bp, Bos taurus
cacatgtgttcttttggtgactggcttgtagcatctgtcaggccagtgtatgctctccggttcttctgtctcatctcaacaaaaatttgaagcaacagackttagagacctcggcctgtcacagctctcggacggaccgtgttatagctctcaggtctcaaacagaccgtgttatagcccttagacagatcagtgttacag

SEQ ID NO: 33233 - DNA, 201 bp, Bos taurus
ggctaagactttgccctccccatgcagggggcctgggttcaatcactgatcagggaactagatcccacatgcccaagcgaagatggaagatccctcgtgtyacaactaagatctagtgcagacaaataaatattaaaaacaaaaagaggtgaccagcagttctgtcaggacatatatgagctttcaggatggagagttgga

SEQ ID NO: 33234 - DNA, 201 bp, Bos taurus
ttcgaagaaaataaattgtacgaaatatccgtggaagcgattgacaaggggaatattccaatggcgggtcattgtaccattttggtggaaatagtagatayaaatgacaatgctccagaagttaccatcacttctttggctctgccggtgagagaggacgctcaggtgggcactgtcatcgccttggtcagcgtatccgac

SEQ ID NO: 33235 - DNA, 201 bp, Bos taurus
gcaagaggtgagctgctggcaagcaagtaaagcttcatctgcctctccccatggctgacatgactgcctgaaccatcttatttcaactgctgaccactgargggccattgccaaccattggtcaggacaataacttgctttttgcacttgccacaggatctccctccaaggggaacacattaaatgttcccctttaatgtg

SEQ ID NO: 33236 - DNA, 201 bp, Bos taurus
aacctggagtgaatgcagttctgattggaggaatgtggggtatgggtgctattgcctgggctctgatccctatgactggactgggttcactcacaacccarcctttccacagagggggccccggtgctataggagatagaacagatcagaggcttgaatcctgcctctgccacttattgactctgggaccttgggttctgc

SEQ ID NO: 33237 - DNA, 201 bp, Bos taurus
agagctccatttttgggtggataagggaaacatagtgtggtgtagtggagggaagacacaagctgatctggttttgaatttctgctctgccacttattgayagcatctacttccctcatagctcagttggtaaaggatctgcccacaatgcaggagacccaggttcgattcctggatcaggaagatcccctggagaaggaa

SEQ ID NO: 33238 - DNA, 201 bp, Bos taurus
gggatgaggtgagcttgatgccatgggtaagggccagatcaaggagtggcttttcgacctcattttagatgcagtgggagccattggaaagttgaaaactrgggcccctcatgagctgaggcatgttttataaagatcactggctgctatttgaagcacctctgaaggtagttgccaggttgaaatgaagtctcttccgca

SEQ ID NO: 33239 - DNA, 201 bp, Bos taurus
ccagatacagtcgtctcagtcatagtgtgcctggccagctggaatccgtgcagccaccgtgcttgacttctcagtcccaaggtgaaccctaatgtagagcracaacacctggccccaaatataatttcctcttgcagctcattgcagccatgaggaagtcgccaggggagggctggggagggcggcgcagcagcaccataa

SEQ ID NO: 33240 - DNA, 201 bp, Bos taurus
agttctggattttaatatgtgcttagatgcatgtgactaccaccacagtcagggaacccccccccccccaacacctctgtgccatctctttataagcataygcttccctttgtcccagctcctggcaaccactggtctgatctctacccctcgaatttttctttctgagaatgtcattaaatggacacttacagtgtgtca

SEQ ID NO: 33241 - DNA, 201 bp, Bos taurus
gaatccagctctgtagcttgtagggtaggagacaggtcagtgtacacagaatccaaggctgtgccccccttgttctctgactgtgaccatgaatgggccaygattcttctctgtctctttgctcaggcttccatgaaggcttctttcctcttctttgaaatcttaaggaaaccatcctctagctaaatctggccctcattc

SEQ ID NO: 33242 - DNA, 201 bp, Bos taurus
cccatgctgctcagcggtggagctcctcctccacgtgccagctggaggaaaggagaaagttaacacagggagaagagccatcctgggtgtgcttgtgcctrgggctgtctgttttatctgtgggcctcttgttcatgaagcccaaataagtgctgctaaaggtgtattaaaatgtaaagcctttttttaatggtctttctc

SEQ ID NO: 33243 - DNA, 201 bp, Bos taurus
acaactgagtgcatgcacgcatacacccacacacccacacatattactttattctcctccaggcacttccatacctatcatttcattgtatcttcatgtgmgactgagagaagaaatggcctgaaccctattacagagaaagaaaactaaggcacagagaagtggcttatacatagtcacatgactcctgaggtccaatcc

SEQ ID NO: 33244 - DNA, 201 bp, Bos taurus
caactagagtgtaaacagtaaagttagggaaccctgtttgtcttgttctctgctagtacggtagcaggcacatactaggagtgcggtacttgatgttcccytgtaatccgttttcctctgtttgaaaccgcccctctctcctcccagcgctggcttcttcatgctcctaaaacaaagtctatcttatggcttttaagatgc

SEQ ID NO: 33245 - DNA, 201 bp, Bos taurus
aggctgaggtaaagcagggacattcataattagaaaacagcgagatgcctggggcaagtttatttaaacaaagcaagccaaaggggccactgaggcaagtkgaaagtgaaagtgaaagggggaaagtggctcagtcgtgtctgactctttgcaactccatggactatacagtccacggaattctctaggccagaatactgg

SEQ ID NO: 33246 - DNA, 201 bp, Bos taurus
ttattttattatatgttatttacttctctggacctgctaacctggctatggatttgtatacaggcaggagttttgttcaggttgtcttttaatttctagarcttagcacagataccctattgatacaataaacatttgagaaagggaagagaaataaaggagtacttagatgacttttatattaactagataaaaagacat

SEQ ID NO: 33247 - DNA, 201 bp, Bos taurus
gcctgctggaggtggctcatgcactggcgtttcacaggagaattaaccccaggtaaaactgtgtgtggcaggaagtttgctttggtggtgccctacctctrtgccaggggcttttaggaagacaggcagtgcttcccagaagttttccctgaaagagactgtcaccagctttgatgaagactcatgggaggccaagccctc

SEQ ID NO: 33248 - DNA, 201 bp, Bos taurus
ttccagagagacatttataaatatgacatttataaatccataggccaagatgagagcaatgtttcattacagctcttagtttcctacattattttgtcacktatttgttaattcaacccagcatttagtcattttgtgcaaaatagatttaggatctaaatccttatttacaaatagatttaggatctatactttttttca

SEQ ID NO: 33249 - DNA, 201 bp, Bos taurus
aaaaagagccacaaacgagtgctccttttagacagctgctatatttaaaccagagtttattaatccttatatagtctgtttctcaagtgcttcagaaaagrggtataaattgtatggagcatacagtggactctgattttgcacattttggcaagaagagaaggtcttagcttctgtacatatctctcctgcaagaaagaa

SEQ ID NO: 33250 - DNA, 201 bp, Bos taurus
tagaaatgagtccagcagttctgaaaggctttccaggaaagacgtacaagaaagaattaaccctccttagggaaagttgggccattaaccttaccgtcagkacttctccaatactctcaggcttctaatggaccttctactagaacctatccccattctgagacagggcttaaagttctagttactatataataaacacag

SEQ ID NO: 33251 - DNA, 201 bp, Bos taurus
ctagaaaaaggactattctttcaatagaaactttgcttttattcctcttctcgaggattttgaagatagtgaagaacatttcctaaacagttgcatctttmtttgatttgaaattttaatgcagtttgttactctccaggaataatttaagacaaataatttagattttagttttaaaataattacaccggatcccccctc

SEQ ID NO: 33252 - DNA, 201 bp, Bos taurus
tgtgtggtaaggaagtatgtggaatctaagtttcacatgagtttcatcagggaaaaatatttggcatacactagggaaaagggatcaagttcctcttattmtttataatcactgattattctacctcaggactcaggataggaaagggatttaaggcagaagagcaacttgattagttttgcttggcatttcattgccaca

SEQ ID NO: 33253 - DNA, 201 bp, Bos taurus
aatccaactataacattaaagtggccggtctaggtcactgtgttttagttaatgctaatatttaaacagatattcacattccatgcctacaataaggtagmctgtgaactacctgtattgctgaattttagccaaaattccatgagataatttagaggaacgtcaaatttctgaagtgcaaactcataaaactttacattg

SEQ ID NO: 33254 - DNA, 201 bp, Bos taurus
tggaactgtcacggcgcctaaggtggtgggtgtgtcgcttagctaacgtattacagtgaacacataatgaggcttacagtctactggcaaatttcccaccrtcttgggcctagtttgttctgtcgcatcctgtttttctcagtggctctgtcctcctcttaatttcgttagtcattgtgccctgctcccttcttccttctc

SEQ ID NO: 33255 - DNA, 201 bp, Bos taurus
ggcacgcagagcgagaggaaatgatgtctcgtgtttgtcagcttggctgtggcagatgcattttatccggagccaaaggaccagctactatgccaggctayggcacctatctgctgtgtggcctcaggcaagttatttcacttctctggatctcaaactgctcatctctaaaatgagagagatttaattaaatcagggatg

SEQ ID NO: 33256 - DNA, 201 bp, Bos taurus
gccagtgtgtgatactgctagatgttgggctctgtcccttgaccgtttctttgctttgcctgtctgcttggcttcttcatgcatgaactcccctccagctrgtaaggaaaatggccagtgaactcacatcttcctactttggcacatccctaatcataagggatagtacttgtaagttcccgcagaacagtcccagtgtgg

SEQ ID NO: 33257 - DNA, 201 bp, Bos taurus
cagggatcgaaccccagtctcctgcattgaaggtggattctctaccaactgagctccctgtaccttggatcaaatactggctcaaagcaaccgtatgcaarcttaatattagcctttttcttagtttcacagtaactattttattattttaggaagtataaataccaatgaacctagtgaaataggtcacttatattctaa

SEQ ID NO: 33258 - DNA, 201 bp, Bos taurus
tttgtgtgaagttcatagtatcctctcatagaactagtttattatcttttctacctccataatctatagccatttatgcaaattagaagaataggatgttrgtttttccaaaaaaccttaattcattgtataatcagaattagtcttttggttcataagatcttattagaaaaggtagatacacaaatcttttattattga

SEQ ID NO: 33259 - DNA, 201 bp, Bos taurus
atgaaactttgacaatgttatatataaatgttacctcaataaataattaaataaaatgatgcaggctactttgggagaaaaaattttgagtcagacatgtrtttgatccaagctccgcaactcactaggtctatgagtactggaaaaccactatatcactctgagcctctattccctgagccaccaaatgggagcagtaat

SEQ ID NO: 33260 - DNA, 201 bp, Bos taurus
aggtcctgttgtgtccagttggaataaaataatccatgtctatgaaagttgttcacttgttcagtgacagggaacttcaaacttccatcatgtaaatgaakgaactaggccctgatcttgctactcgattcatttcaacctcacatattgaatcctcactatatcttcttacctacctcttagacacaatcaacttctcac

SEQ ID NO: 33261 - DNA, 201 bp, Bos taurus
tcccaaagtatgttgtgagtcaaagacattatcatgaagataataagatgaaaggcacataaaagacaccaagtttagacatttgttggttactgagaaaygaaaatgaagcagtcttaaacagtataaaggaagacaggggagaatgttttcccagactttattggctccattccttctcccaaagcagaactgagaaca

SEQ ID NO: 33262 - DNA, 201 bp, Bos taurus
atacatcttaaaatattctttcctctggtatctacttcattcccattgtccctttcccccacatagttaggaaaacttttattctagcctggctgcttgtrtgaatgtctcttgcccttcccaaactatcctcatacttctttgctgtctgcctcttcccttttcccaggttcattagcaatagcaaagaaccaaatggaa

SEQ ID NO: 33263 - DNA, 201 bp, Bos taurus
aataacaatagcaattagtgacatgcattttaaaagaatccatttaagatatctcctgtctgggaagaccagttttaaaacgctgatctcacaccagacaraagaccagaaattatggaagggcatctgtgtcataacaaagagaacaataatagtaaaacgaaagacatacagagagaatttcaaaagaagtgtaactta

SEQ ID NO: 33264 - DNA, 201 bp, Bos taurus
aagaagcagccatgggatcaaggagatccaactcaagaaaaactaaggaaatcctaagtaacagtggaggaacatcccagatgacattcgtgcatgcctayagtaagcaaccagtctggatgactgcaacaggctggaaggctctgggagaactttctctaagatgtaaacaatagcacactgatgtgtttcaaagtatag

SEQ ID NO: 33265 - DNA, 201 bp, Bos taurus
ccaggcactcccagcagcagacaccggttttccgcggcgggcggcggcgtggttaaaaaaaaaaaaaaaaaagtgtcgcggcccctttaagagccacagcrccttctctaagataccatcttgcaccaggagttcacgtaagctctctacctaccttgctaaatccctcctcatttactgggtacgaccggcgggcgggcc

SEQ ID NO: 33266 - DNA, 201 bp, Bos taurus
gagccttttcctcagaaaagacacatgactaggtgttttctccccttaacacaagaagggcagccttgattttctttactcagttgatctattcgattccytctcccctttttgttcatcactctttcccctcttttaatgcaccaaaggattgcaaacccgtgggtgatttaaaattaaacactatttttttaatctctt

SEQ ID NO: 33267 - DNA, 201 bp, Bos taurus
ccctcctgaccccaggaacagttttctgagcctgttgtgttagatttctgcccggagcacttggccataacaaagtggagagggaaaaatcaatacaacckgaaccgaatgcacacttaaaacatcagccttcaactgtgcaatcatgtccttgtcactaacatccaagtgcttttgctccatgatctgctcagagtctta

SEQ ID NO: 33268 - DNA, 201 bp, Bos taurus
tacaagaaatttatagtctttctccccacccccatacacacacttaaatctgatgatagctggtgattcagagattgtttgctttgacatgaataaaatgrggtttccattttgatggaattaatcagttaaatttgacataaaaaacagttcaagaaagttctcatggtggtggtgttctgtctgcccaaggtacggtct

SEQ ID NO: 33269 - DNA, 201 bp, Bos taurus
gggtgaaactcaggaaaggtggtggtgtaattcaatcagaaggtttgagaatcaaggggcccattgggtaagagaggtatgcatctgaaggcccaaggacygggggcattgatgtctgagggtagatgaagttggatgtctcagttcaagcagaaaagcaaactggcccctcctctgccttttcattcttccccaggaaga

SEQ ID NO: 33270 - DNA, 201 bp, Bos taurus
gttatggatattattgttgtaagatcagtgttgtctctcaagtgcctgccatgtgcctgctgcagcatgaacaataaatattaactctaaccactctcatractcatgggaagtacatcagtttgaaacattattacggactagcctcaaacacctcttcctgtggccaagcaggcattactaatcaatctttccccttgg

SEQ ID NO: 33271 - DNA, 201 bp, Bos taurus
aaattgaaactcagattaagactttaattagctaaaatatagcctatcttcagagtaaaaaaaatcatctctattgtgtctccttctaaatacagaatttmtccaataagaaataatttgtctcctatcacctgaaattttttttccttttaaagaatgtatttttctactattaaaaatttatacattatcaatgaaaac

SEQ ID NO: 33272 - DNA, 201 bp, Bos taurus
cagtctaatgcatgggactgagctatttagtcagcaaccactgaaaccaccttcagtgaagtaccttcttgggagcctgcaacagcttctagatcatcctkgacaaaaatgacttaggtaattgctaaaaggaaagaagcataagtcatttcattttaaggtagctatctttatatgtaatttaagttagtctttggttta

SEQ ID NO: 33273 - DNA, 201 bp, Bos taurus
gagcttagacaactctagtggaagcagtctagctggaataggatagatgaggcctggaagaagcaacgattctaactcagataatcctcaaaccttgagamgcagattgccaataagaaatggccttcctctactctgagcctcccaaactacattctcttgcacaacagctgactccttcctgacaccttctaatcatga

SEQ ID NO: 33274 - DNA, 201 bp, Bos taurus
gtgagaaacaaataagtactccgaagtctatcttataattctagaaaatgtaagctaatctgtagtatcaaaaagcaaatcagcagttcaccgtggccagmataaggggtagtgaaagggaggaatgaattacaaatggattcatgttgatatatggcaaaaccaatacaatattgtaaagtaattggcctccaattaaaa

SEQ ID NO: 33275 - DNA, 201 bp, Bos taurus
gggacctaccccaaggcttctcagctcagtccccatagaacagcccttgttccaaaaaaaaaaaaaaaaaagatggctcaaaggccaaaccagtccaactrgaacaatctggcttcaaatcagatcaaaatgccatgacctcttccacatagaagagggccttcctgtaaaagatgaaacttgaaaatagatctaaaaagg

SEQ ID NO: 33276 - DNA, 201 bp, Bos taurus
tctactgaattggaatacctaggtttggggccaaaatttttgaatttttaataagctgcctaagtgactcttccatattcagttcaagggactaaccattraaaaccaatgggccacatgacttttgacagataaggtctgtttccatgataccaataaacaatatggcaaagtaggtaactgggaatgctgcagaggtgg

SEQ ID NO: 33277 - DNA, 201 bp, Bos taurus
aatgatgaaattgaatatatttgaatttcagtttacatgaagacattatgtgttaaataaggaaatggacaaccaaagcagagaagaagatgcccaagatyctatttcaatcatcagccactctccaggactttagtgttctggaactaatgcctccaatgggtaaagaccgggtgaaatgatcaaataaactgagaaatg

SEQ ID NO: 33278 - DNA, 201 bp, Bos taurus
tagaacaaatattctcataatattctgggttttcttgtcctggacaagtgaggtaagagttgctcttgtccagacatttgtattgatcacagcctgaggtrtcttttaaagcatgctatatggcacccagtaagttgaatcaaaaaaaggacaacaagcagactagaagacttcagcgtcctttgaaatactggcaaatgg

SEQ ID NO: 33279 - DNA, 201 bp, Bos taurus
ctttacagaaaaaatagtggaaatattggttttagtcattggggttgttgttaactctgcctcagctacacattcctgtggcttttattgcaatcctattktgctatggattctacaatcaattagtctttcagtcaaggctttaaattcttagatgaccagactaagccttcagtagtacacaagccagaatatacattg

SEQ ID NO: 33280 - DNA, 201 bp, Bos taurus
gaaaaatgtggaatgtatatctgagtttaccattgcataagtaaatcccttcctattagattaaggggtacatctatcacataaggttctaatgttgtagrctggccttttggtctctcacaaggataaatttgaatactttgataggcttcttgtattttggtttgagaaactcctgtaatttggcaagaaattttttgt

SEQ ID NO: 33281 - DNA, 201 bp, Bos taurus
gtgggagacccacagcgagatggaaaatggccagcctgagaagagttagggatgagaggtacttggtggtgccgtgagaacatgtcataggggatggggcygaggtgagtgtgtcagggtagcatgactgaggaggtgagggagatgagagctgaaagatgggtaagggttaaacaggcaaagaggaggaagatgttggct

SEQ ID NO: 33282 - DNA, 201 bp, Bos taurus
ttcctaaatcagtatttatgtaattactggttaactgacagtctcccaaataaaacgtaagttctgtgaaggcaagagcttggtccttactcatactctcrcactttttcccatggcagggggacagagacatttaagagaaaaaaatgaaagaaaaatcagttgtggttttaatcacaattgcactaagtttttaaagga

SEQ ID NO: 33283 - DNA, 201 bp, Bos taurus
cagttgatattattaaaaaggattaaaaaaaaaccttttaagctctgagatatttcatggtagaaatatccattatagtcagatacaagaacaggcaatakacagactgagtgtgggaatctaagcttgtgagtatattgggggaaaacagaggggaagatttagatgtttactcaggaaaatgtcaagcaaggacaggat

SEQ ID NO: 33284 - DNA, 201 bp, Bos taurus
gattttcctttgtggaacccctcccctgcctcaagcccactgatgagcacatgaccaggactggccaatcagaacagttcattctctggcccccaaggatkcattaattcactggctagactgtaaagccagccctgagatatttgctagagtctgtctgtctttctcctggtgttgctaaactttcaatttaaagctgct

SEQ ID NO: 33285 - DNA, 201 bp, Bos taurus
aagtgttcagcatagatgatggccctagaaatgtgagcttttattattatctgcttgatatggctagataatgaagtacatattaaaaggtggttaaaacmtgagactgaaaagacagatggccagagaccagatcacaaaaggtagtagagactatgctagagagttcaggctttcatcaaagagttggaatgcactgga

SEQ ID NO: 33286 - DNA, 201 bp, Bos taurus
ggagaggcagagttgctcatcaaagagcaactagtggatatgcaataaacgttgaatgaatgaatgacagctacgactaggggcaattatatgtgccatayacaaggatggaaaaggtaatcaaagaaatcttcatagtagagatgatacttgaacgagaccttggggttgggtataattttaatagcacaggaagatgct

SEQ ID NO: 33287 - DNA, 201 bp, Bos taurus
tccccagcaagagcctcctgctcgcagacccttccttggactcacctgcctttatttcccccttgtttcctcaagtgtgtggctgtggcctagcccagtcrggcttcttcttcaagaaccaggagtacatctgcacgcaggactaccagcagctctacggcacccgctgcgacagctgccgggacttcatcacaggcgagg

SEQ ID NO: 33288 - DNA, 201 bp, Bos taurus
tgagtctgcaggcaggccagcgggtgactgtgctggaggcccaggacaagaaggggaacccagaatggagcctcgtggaagtaaacggacagaggggctaygtgccttccagcttcctggccagggccccaagtccagctccgtggggctggagtttgccttcttagagtgccctcctttaagtctatgttccaggagggt

SEQ ID NO: 33289 - DNA, 201 bp, Bos taurus
gctggggagagtgaagacaagtggctgaggaaggtggagtcaagagtcaagctaacttgacttgtgatgttaacttgtgcagttaaaagtaaagaatgcaygctttctagaactgtgtgttcctagaagttgtgggctacatctagggactcactgcagcagttggtgcagaatgtggcccacaatgggcgctgagccacc

SEQ ID NO: 33290 - DNA, 201 bp, Bos taurus
gcactaccctcgaagctcccaagctctggaggggctctggggaagggggaatcactctctgtgatgtgtctttcatgtactaagccgaatgaccttggccygaatcgctgagggttatgtaagattaggtagccacttagtcaaaaatagctttcatgctgactccagcccgcagaacatcatccaagcaaagggggcaca

SEQ ID NO: 33291 - DNA, 201 bp, Bos taurus
gaagagaccttagtgaacggctcatcagacctcaccactggaagcctgactgtgccccacccccaggtgggggagagtatgtctgtagtaacagtcatgarggtaagtgacaggtactgtgattgtgctttacctgagagagttaaaaaggcagctagacccatgcagtgtgattctggagtagtggtaattaggaattgg

SEQ ID NO: 33292 - DNA, 201 bp, Bos taurus
aggtcaccagggcctgggatctgggctgtagtgaatgcctcttatgagccacaccagcttggaactgggtcacaggttgcagggagggtggctggcttaakggccaaagccaaagcacatggcggggcagtgcgggggtggcagtggggctcagggcccccacccagaaccaagcactacggcaccagaagagccttcttc

SEQ ID NO: 33293 - DNA, 201 bp, Bos taurus
attctttccctctctgggcttctgtttttcaggtgacttccagacaaataaacaggtaatatggccctctggaggtgacagtggaagtgtggcatgggcarcaagctggtggattgggaagaaccagaatggggactgggacccaacctcctgggccatcttggatgactccttgacacctccagttgtctacccaatgcc

SEQ ID NO: 33294 - DNA, 201 bp, Bos taurus
gacctctccatgctttctgcttcctttcctcatccagcaaatgaggccagtttgtcccaccagtccccagggctcaggaaagaacaggtccaagaaggggkgacagaaagatgggtagaggcctctccaggagatgtctgtggaggggtaggcacctcctgcctccaccctgggagaggatggcaatgaagggggccacgg

SEQ ID NO: 33295 - DNA, 201 bp, Bos taurus
tccttcagtgtgaggcttgtgttctgtgatgaggacctcacagctcccaccatctgaggtctgtcttcgaggggcgggtgggtccggtccccttgtcctcyagcctgaggaagagacaggcaggtttgagaccctgggggagcagaggaaatcccagggacttgacctgtcacgtgttgtaagtctgtcttgtcactgcta

SEQ ID NO: 33296 - DNA, 201 bp, Bos taurus
tccaactgcccacatctgaatacattctactaccatggaaactacaaaggaaggaaaaatatatttattccaggattcatttactaggatttttaagcgcyctctcttctgtagagccccagagcggtgatgagtgctaggggctgctgtgcttcccggcatgtgctcccatcctctgagggtcctgagaaggataatgga

SEQ ID NO: 33297 - DNA, 201 bp, Bos taurus
caatccttgtaactttcaaatagagaaaatgaagtcctgagagtcaaaggaacatgccccagggtttctcactcctggtaaagtagtattctgtgttctgrttccacaaatgcagttccttgcacactatgtcagttcattcatatttacagttgagtaggaaaccagttgctgtcctaaaaagagaagaaagagaaaaaa

SEQ ID NO: 33298 - DNA, 201 bp, Bos taurus
aaagtatcgttgacctagggaaggtttcagctttctttcagccttccaccttattaagtcagacccacccaaggtaatctttctgattataaagccagcarttctggggccttaattacatctgcaaaatccctcacccttgtcatgtgacctaacctaatcacagggtaactccagggaacagattgtgggagccatctt

SEQ ID NO: 33299 - DNA, 201 bp, Bos taurus
aacatgagagcaactgaggatgcagacataggacagttaatctcaggtctggctagagcagccttcaggtacccaggatgaagtggagccagcatggccayggcaggcatttgtgaaatatactaaaaatgtttaaaatggctatagaaagagctacaagcctggccttgtcatggagggcacttctagtatgtcaccagg

SEQ ID NO: 33300 - DNA, 201 bp, Bos taurus
actgaggagatgaagttcagggtcatagagtgaaatgcttccagagcaggcggtagggggcggggtaggggcaggggaatcgtgcctccttggccagcttytcagaaccctcagggacacaacaggaccaggggctgacattcccagaggatgaaacacagaaccttcccgagacccagagctgccctgtgtccccaaagc

SEQ ID NO: 33301 - DNA, 201 bp, Bos taurus
tcacagacccacttttctcattgtttcattcctcattataaaaataatgggtgtgcattatagataatcaaaagatgaaaaaaaattaaagccatgatttyacaatccaaagatagcttacagcatcacatcattctttatcataacacaatattattactgtattataatagcaataatagcaacatttacggagaactt

SEQ ID NO: 33302 - DNA, 201 bp, Bos taurus
ccttgaaaacaggaaatctagccattgatgagggaaactgcgaaacaggcctggtgatgtcactctggtgagtccagcaggctctgggtctcacctaaggyggggatccaccctctccgggcctctgttacctaatacattaaatcaggataatagtaatacctacctcatagggctattgagatgattaagtcagaaaac

SEQ ID NO: 33303 - DNA, 201 bp, Bos taurus
aatgtgtatttaaggtagtctgcaaattcaggtgctttcagggcaaagcacggggcatccgtgagtgatgagggccacaagaagcatgttgtttccaggcrtatcttgcctttgtacaacagcactgatctaaggcagctgctgccccatctcgagctggggctctaatcagggatgtgaaatctgggctgaattagaaag

SEQ ID NO: 33304 - DNA, 201 bp, Bos taurus
ttaaatagggaggggagcaccgtggggcaggctgggacccagcagccacagtgcttcccagcaagtccctgcgatactgaatgactgggcgcagtttccaygtgtaggcagcggaggctcacccttcaggaacaccgagagaagagaggccaggcatccccttctgcttactctctctttgcacactcgaggttctaataa

SEQ ID NO: 33305 - DNA, 201 bp, Bos taurus
cagaccagccccttggttacttaagtttagttgcaaaggggctttgaggaggagaaataagcaaagacttacataggagaaccatttgtgtctaggcctaygattcattaggtaggacaaggtgaaggggttggggaagagtcaggatgcccctgcctcgttcaacccttagggtatgaagaccaacaatggtctggtgtc

SEQ ID NO: 33306 - DNA, 201 bp, Bos taurus
aatcatctccccatctatctgtttcttctctatggatcttgaaataaacctcttgtctattttcagctgaatgatgccatggagatgggcctggtgtccargaagtacagatcccagcggtctgtcctggagtgccttatgactctggagccagggcaagcacagagctcccactcctgtgggggcccagcctgggtgtgg

SEQ ID NO: 33307 - DNA, 201 bp, Bos taurus
gaagaatggtaaatgtaatgtggtaaggaaaaaggcagtcctggtgggaaagctggcttgggcaaagaataggtggccctcaagaccagtgttctagtgcrtgtgatgagattagagacaaagtctgagctggtgagtgtgactgagagggctcacccaggggccagaagctgcaggaacagctgcacagaattcaggcat

SEQ ID NO: 33308 - DNA, 201 bp, Bos taurus
gtggggttggaggtgtttggaggaatcaatgaaactcacatagtctttcctaaggtggagagagtaccatgctattatacaccctttgtacacacccaacycttttttcctcctcttagaacatatctgcactaggtattttcctttttggaagccaaggactcctctaattatttccttatacatctcagaatatatata

SEQ ID NO: 33309 - DNA, 201 bp, Bos taurus
gtttatctatctaataatcatctatgttattgattaatttgactatatatagagaaaaccaacctttaatagttaacatgaacattaacatactgtaaacrttcctcttcactttgcttttcttatttatgatgaaggtatatatcaatacattaaaatttttcagttcttttaacctattgccttgttttatgttgtatt

SEQ ID NO: 33310 - DNA, 201 bp, Bos taurus
ttcaagatgacttccagatagggttcaatagtgactgcctcttcagatagagcttgttcctcaccagttacccatggtccccactgctctctgtggtattrcaccaggcctatattatttgcctacaattccattaaggcttgtgtacacatttgagtttccaagacataagatatactgtaagatatgatacaccataag

SEQ ID NO: 33311 - DNA, 201 bp, Bos taurus
atccactgggtgacttctataccaaatcatagaagcagcctggatggcatggctcatctgtatggtggggtagacgaggctggaatgaacagcctattttkggggggcctgggagggaggatcattgattgtctactcacagggtagaaaatgctctagggaaacttgaagatgaaggaaacttctattccaaaaacatca

SEQ ID NO: 33312 - DNA, 201 bp, Bos taurus
ccatgtaaggcactgaagatacactggtaaacaaaactgatataagttctgttctcatggaaattacaaatgctaaattcttcttgttgctagatctttayacataaccatgatgatttcttttggatatattttagacatacatctgctggttgaaaaggtgtgatatatgctaacattttaataactgccaattttttt

SEQ ID NO: 33313 - DNA, 201 bp, Bos taurus
atgctgattctggttcctctaaaagtgaagcatgtgagtgaataatttgtattattatctattactgttatttgttgaaactgaatccactatttagaaaytgaaaaaaaaatccctggaaaatgacaagatggggctcttttgacattataaaactgtttgtttgtttttgcatatgcctttagctttctagaaggaact

SEQ ID NO: 33314 - DNA, 201 bp, Bos taurus
acacgtaagctttggcctacaaaaatatgatagaatgtcttaactgaaaataaatacacagctattaacaacatagacttgttttctaaaaaaaaaaaaarggataaatataaggagggccaaaattcctcacagtgcagtaaggaataagcaaattgcaaaggaagacactttcatttttttctgtctctaatttaatca

SEQ ID NO: 33315 - DNA, 201 bp, Bos taurus
tttcaggcccccagagcctgcttagttctgaaagaactagcctctgtctctctcctttgcagaaggaaggaaggggacctgcaatcacagcaatatttagytatggtcccacctgggcctctccagatagcctaggtgggagtccgcctgcaatggaggcgacctgggttcaatccctgggtcaggaagatctcctggaga

SEQ ID NO: 33316 - DNA, 201 bp, Bos taurus
taatctctactgcagggaattcattttcaaacacaaagctttcttgtttgattttcatattgaatctgcgggttcagagagatagaactacataagtatgrcagtctattgcctttttccatccaataacacacccacagggctttgtgtctccctcagttaactggtttcccacttgtatccaaagcataaaagtaaata

SEQ ID NO: 33317 - DNA, 201 bp, Bos taurus
taatttactacaaaggatatatgaaaagttacaaatgaacagctagatgaggatacacatagagcaaggttcagaagggtccaaacacaggagcttctttycccatagagtttggagtataccaccttccagacacttggaaattcttgttcactaactcagaagttcttcaaatccctttggttagggtttttatgaagg

SEQ ID NO: 33318 - DNA, 201 bp, Bos taurus
tgaataagtagataaatattccacaccaagggctaaatgactgaaagacagaatcttatcaacagtcacttttgtcaaaccaccccaacttcacactctgkcatgattcctattgtggaaggggaaagataccaacttggaacaatgatcaagagaaatatagactgaaatgaaactggttttcataatctgtcatcaaga

SEQ ID NO: 33319 - DNA, 201 bp, Bos taurus
cagagaaaataataaatatggaggatatgcaattcatacatgaagagtccaaatgcaaaagcatatatattcaagatacaataaaattctctttgaaatayagaaaagataatgagatgtagactaaaagattatcccacataatgacacagtgttctagtgatatgatgagacattactgaacatcaaaaataaagaatg

SEQ ID NO: 33320 - DNA, 201 bp, Bos taurus
ggggcctgtgacgagccttgatcacttggagcttttgtgtaataaagttttattaaagtataaaagaaatagagaaagattctgacatagacatcagaagyggccagaaagaataacccccttgctagtctttagccggatgttatatagcagactagcagcctgctaattaaagaaaggaaatgtctcaaaactcaagcg

SEQ ID NO: 33321 - DNA, 201 bp, Bos taurus
atgaattctttagaacatagtcaactctttctaattttcatcaatcttcaaaaaatcctgtgttcctttaataaatatctgatctttttctattttctgcwctgcattgaggcacttgcaaaagcaccaagaacacatgttatgtctctacaaagggtgcttcactacatttcatttaacctgtgtaataatacagtaaag

SEQ ID NO: 33322 - DNA, 201 bp, Bos taurus
taatggcctcctcacttaattacttcagcaaaaccaagcctgcgctctgaagcatcactggaaatgaagctagtgagtcccagaaatatcaggtttacccytcatgcactgaggtccactgggccactgttctgggaccagcttcaaagtagaagagagaggacgcatgactatgcatcccactcccctacatgtcactgt

SEQ ID NO: 33323 - DNA, 201 bp, Bos taurus
agtttttaaaagtactgatatgttatagcaactttaaataattacataaacaacaatgaaaattttgttttatgcctgggaatttttatcttttatgatayttgttatctgtttatttgactatattgcttatcttggttgaaatatatacatttgacctcctcattgggtagccatttaaaattggtagatacatagagc

SEQ ID NO: 33324 - DNA, 201 bp, Bos taurus
gttattttctaagatggatatactattttacatttttgtcagcagtccatgggcatttcagttgctctatatccttgcctttacatcttgatatgattatytttgaaatgcatctattctaatatatgtgtcatgataggtcattatgatttttaattggcatttccctgatgactgatgagttttccttttcatgaactt

SEQ ID NO: 33325 - DNA, 201 bp, Bos taurus
atttaaccaagtattaaaaaaatccataccatacattgtaagttcttcgaaaatcttttatttccattgattttcattaaagaggtaattggcagctgatyagtaggcatgattctgatgagctggtttggctgaaccttctgtgtgacagagcagcaggaagagagaacccagaggtttgctgacactccaatctatctt

SEQ ID NO: 33326 - DNA, 201 bp, Bos taurus
aacccaggttggtacagtgaagagtggtgtctatggcaaattggagaatgccctctctgtttaaagttgtttaaattcaaataaaaaataaaaatccattktactggctaaatagaagatctaactagccactgcatctactatggtaggcctgttcccatacaggatttttattttatgattaaactcagcactacatta

SEQ ID NO: 33327 - DNA, 201 bp, Bos taurus
aaataaaaatttcttaggtgtggagatggaggtgggcattggcagtactaggattctccaaacgattttttcaacagctttggacgttttaagtaggcaartgcaacacacaaattatcaggtggtttcttccatttattggtccctcttaaactcagttcttcatcatcctgtgaaattgtaaaattaaaagcaaatgaa

SEQ ID NO: 33328 - DNA, 201 bp, Bos taurus
gcagtttttggcacgaatacttgctgttatgtgctcttgttgcatcgtcagcgggtactttaggttggcttattatcagtgatgccagcctcgaacctttmaagtggtgaccaacatattttacctttgttaaggctcacttagttttaaattaaccaataatctgtaggatgattctttggcaaggtgtgaatattttac

SEQ ID NO: 33329 - DNA, 201 bp, Bos taurus
ttacactatcaaattccattatatccaacacacccgaaacctctattctctcacctttgattacccaagtgaacgttccatcaccatagacttaaaggccygttagggtttgacatcttggcttttaaaaacaactttaaaaaaatacccttgaagattaaggaaaacctaaaacttggggatggaggcctgaataccctc

SEQ ID NO: 33330 - DNA, 201 bp, Bos taurus
tgtctgccacagtgaataaattgaataacacacctcatagagctcatccttccatttcattcttggaaaaaacatgcttaagctatgaagatgtgtggggraaatagacatttcatctagcctcatattttctgtacttactagaaagaattattaaggtactactagaacaatgctcacttaaattctacaacccacagc

SEQ ID NO: 33331 - DNA, 201 bp, Bos taurus
aggagagagctccagagtgggcctcccaggctgacttcccaacaatcctgtggagctggtcttctcagcgtgtttctcctgctacactaaggataccaggracacgtaaaactgctggcccatgttagctatgacccggaactaggtaactgtttccacatttgttgaattcagagtcacgccttgccagccactcttcac

SEQ ID NO: 33332 - DNA, 201 bp, Bos taurus
aggtttcttataaagtagagttaaggaaatttttgtagctgaaatgagggggaatgtaacagaaataaagaaagacgatggtgaagtgcagctctttgacrtgatttgaggctgtgcatgtcactgaatattttggccaagtaatctatgtttttgaaagttaactctgtactggtggatctccaacttcaacatgcacca

SEQ ID NO: 33333 - DNA, 201 bp, Bos taurus
ccttcagagaggacaggttcactaaccaaaacaaataaaacatttttcctatatcaagaaaaattagactagataaagagaaatcaaaataagccagactrttattacaaatattttcttaagtaaacaatatatataaaactatatatatatatatatataaatgaggaaatatttccattttgatccctttttccaaat

SEQ ID NO: 33334 - DNA, 201 bp, Bos taurus
aaagcccaactcagtgaaagctcccgcagtggaagctgaaggcaaagaaaatccaactaagtggaagtgacaagaagcccagcatactggaaactgggacrgcaaaaacaaactcggccaaaagcccatgcgactcaatctcagattccagaagacctctggttggggtaagaagtcctcatccctacggctggaaggaca

SEQ ID NO: 33335 - DNA, 201 bp, Bos taurus
tcaaacacactctttctgaggtagcaaaagtaattgtttaacaattctgctgtattgagtcctcatttatttatatccttaaaaaggcaagtatatttctktattttgaaaatcctggaaacaacacattttgggttggttttttgttttttttttttcctcagtaagtttttccctttaaaataattttagacttaggaa

SEQ ID NO: 33336 - DNA, 201 bp, Bos taurus
taagagctgttttgatatctcatggacttttcatttacatgattagaaatagagactcactacatatgccaacagttaaccactgtgacttttaaaatagycatatttagtgacaggaagcatgagatgaatttttgtcagattttttagaaaaagatctactctacagcatgtttttagtttacatttttgggggtaaca

SEQ ID NO: 33337 - DNA, 201 bp, Bos taurus
gcaagagtcaaacatgacttagcagtctaaacaaccaccaccacaagcctctccttcctggctcacagggccattctcactatgtttttccatagtagaarggtcagtggcgtcctctgggtctctgttgttgtttaggctgctaagtcatgtctgactcttttgtgaccccatggactgtagccttcaaagttcctcatt

SEQ ID NO: 33338 - DNA, 201 bp, Bos taurus
catattcctccctgaagctgcaatgaagcagagatctcagccacaggctctgcccatctgtagaactgagtccatagctgcatctggctaaggagttcagytgatacaagctttgttggccatgaaacctgttctatgaccccaacgttggcagaggaaaaaaataaataaattgatgtcccacccaactgtttttttttt

SEQ ID NO: 33339 - DNA, 201 bp, Bos taurus
cagcaaaccacatttggttcagcttcttcctctgctctatcctgcttcccttgtatccttatagatttctcctgaaaatgtttctcaatgaatcacccacrtatgaatcctcatcttataaccaatggaaatgtactgtatgactcaggaaactcaaaccagggctttgtaacaacctgtgctgtgcttagtcactcagtc

SEQ ID NO: 33340 - DNA, 201 bp, Bos taurus
actccaaaatcatgagaaaatatttttcagctgtttaagtcacccagtctgttacactattgaagaatccatggcaaattaatacagtgaccttccaagayagatgtctaaagaaaggggacaatttataaggattctaaatagaaatatttctccagattaatttaagtattaggggaatttatatggcttatcaaagtt

SEQ ID NO: 33341 - DNA, 201 bp, Bos taurus
attttaatcttacaggcattgctattgtgatttcacactcaaagataccacgtttctttaatttggatgctccactaatttctatatgtaacaacaaccayatttagcaaaacatattttcctaaatccttgcttactacactgttgcaatcgttagtttatctattctgatagttacaaaccccttaggttcacacactt

SEQ ID NO: 33342 - DNA, 201 bp, Bos taurus
tattctcatcttgtctttcaaatggccaaagttgagagtttataccaattccatgaattgagatgtgagaaagtagtactatagtagctccttggtagctktcacagactgttattgcctctccaattgccattttgccctccatttttgctcacagatccctactcttttttagtgcagaaatacgtccagcagaatgga

SEQ ID NO: 33343 - DNA, 201 bp, Bos taurus
cagactcttcaaagcagcaggggtaaggatgttcatttacttaagcagtaggttctaccattagcgtttgtgattggtgttaattagaactgtgtgtgcayatctctctgccacagagcccacattttcaaaatcctagttacaatcaagctattaatgaattaagtacccatatttgtttgtgttcttttttaatctaat

SEQ ID NO: 33344 - DNA, 201 bp, Bos taurus
tggccaacttttcaaagatactttagataaccagaaagaaaacttattttacaaatttgtggggaagttccctaaatttgttgaataattttccatctgckaaggccaaacaccattttgatgttggcataaccatgtcatattttattacttcttttctttttactgtaaagatggacttttgttgtcactgttatcatt

SEQ ID NO: 33345 - DNA, 201 bp, Bos taurus
cctttcttctcaaagaagctaagtgatggaaggagagggagcagtggttctcttcctggaactgctgtgcaaaccctctgatttctttataagaaacattrtttatggtgatgaaatcagaacctgtaaaatttctatagggccttctgaaaattgtcagtatgattttattttaaatcatatttagtaaaattctgtctt

SEQ ID NO: 33346 - DNA, 201 bp, Bos taurus
gaggggtggttaaattatttctacttttaatgtgagagttccaaataattggtccggttgacttatttttcatagtttgaaggtgctccgtgctattccarcctttgaaagaagcaaatttcaaaagtaactcagacaacataaaggagggcctatcttgcccattttctgctttcttctcaatctaaaatggaatctaat

SEQ ID NO: 33347 - DNA, 201 bp, Bos taurus
ctgctctctgttgaactaatttaggcaagtttatgctatccagtttgcactccacacagctgctgaaaaatggccaagttctggggcccaccttggcttcrtaaaggatggagcatacctcactgacctcataaacttcacgtatgagatgtttcactttgaataagggactcaaactgactttggaccatagttcagtga

SEQ ID NO: 33348 - DNA, 201 bp, Bos taurus
ctttagaatcaaactgctttgaccatctaaaaagggatgcacttttgttttagtttgacagaacatagttttcttccacagtcaacccaactgtgaggaamatatcagaaattaaactagactaagttaaactaaattaatggaatgcctctactgagttttttaagtgaattgatgaaagaagtttgttccttaacataa

SEQ ID NO: 33349 - DNA, 201 bp, Bos taurus
atcatcatcatcgtatctgtttgccatttgtaatagtgttgatgatagtttgacaattagaacagttattctgttccatttgaatgttacctaatatcctrgcttttttaaaaaaaagtatggctagcattttcacaatattcaaaatactttagaagcccacaatatgcagttcgacaaaacgatttctcatttccaacc

SEQ ID NO: 33350 - DNA, 201 bp, Bos taurus
ccaataactaatattatcaacgttgtatttaaaatgcaagctgtgtgatagctgtattcagccagggggaaaagacccggatgcatttggttcagatgggyaacctgggctttgggcactcagtgatgccaagtgactcacccgggggaccgtctcttgtagcaggtttctctccagggatgtgtatccccaaccctgaga

SEQ ID NO: 33351 - DNA, 201 bp, Bos taurus
aatttggtgttgctgtattttaattcagcaatttggctactcaaagtctacgctgccatctattagtaaatgaattggactaatctctctgttagttgtgytgaaatggtttgccaataggtatggagagtaagaatatccaagacacagatttttaaagccccaattttatcatagattagccctttcccccctctggag

SEQ ID NO: 33352 - DNA, 201 bp, Bos taurus
actttctttaccagtggtagtgttagcctcttctactcaacccttcctgtacatgaaatatattgagatatccaatcatagggttatccccactatctgayagcaccaaatgcagggagcctgtttctttgacccctccctaaaattattcaacatagccctttctaatacccttctactgaagcaccccatggcaccttc

SEQ ID NO: 33353 - DNA, 201 bp, Bos taurus
ttgctgctttacaggagggccgggtgagtggagagttgagtatttgtttatcttctcctgttcgtccttctccatccctcaactcccccacccgccccccrcgatgatgccctaggccttctcttaaggagaaatggagaatttgacctgtctggaaaactggaaaactcaccctccatcttttggaaacaaaccactcaa

SEQ ID NO: 33354 - DNA, 201 bp, Bos taurus
aatgcagagggtgaatgagggtagtgagcagcttggccagtgaatggaaggatgtgatggaagagccgtggaaaatagtaggagaggtgcagcaggaacamttgatggatggcctagaaatctggcaggaggtttaatttgattaatttggcaacagggaggtgctttaagttcataagctggagtataatacaataaaat

SEQ ID NO: 33355 - DNA, 201 bp, Bos taurus
cgtgcaaaggccctgaggctgggatgagcttggcctattccaggaacagagaggagagcggtatggctgaaacacaagagagagaagttaggaggtggacrgaggagattatgggccgggtatagtcattgcccagcaaaggcatgccaggcctctcttggcatcttttttcatcatctccagtgggacatcttcctgtcc

SEQ ID NO: 33356 - DNA, 201 bp, Bos taurus
caggtcatatcacagctcttctcagactttcccagggcatctcctctcccatagaatggtgtccaggtgcaacattggccattcatttgcaaaagcaaatycctgcttccatctgatctcctttcttccttaccctctccttccactggcccagtgtccaccttcttgttctccccatagctcacaaaatacaccccatcc

SEQ ID NO: 33357 - DNA, 201 bp, Bos taurus
gggagcacaagcttggctcccaggtcagctgtgagtacctcccaccaccagtacccccaccaacatgacctcaaggaagaggaaatggccacactgactcytgcatgtattgcctctcgatgcttctcagatctacctgtgttctttcctctccactccttgcgcaaaccaccacccttttcctgctcctgcttgtgcttt

SEQ ID NO: 33358 - DNA, 201 bp, Bos taurus
tggagtgggttgccattgccttctccgaaagagtagccttagctcactgcaattagagaagacctgtgcaacaataaaggcccagagcagccaaagataayaaataaaaattaaaatacagactcctggacccctctctcaccatatctggatggcccagagacctacttttatccacattcccacgtcagtcttatgcac

SEQ ID NO: 33359 - DNA, 201 bp, Bos taurus
gaccctgcccctagcgaggtagtgacaactacagggcaaagagaaggccccgctccacaaccagggcagggtctgctcaccacaacacagtcacacctccygtcaaggggattaacagctggcccacactaagaggtggcagccatccataccaaaacagccctcacacccaaaagattaaacctacgcaggctacacagg

SEQ ID NO: 33360 - DNA, 201 bp, Bos taurus
gtgatgagccaagtaatgactagtctaaggaataaattaaccaaatatgttagaactaggatgatggcttttccggagtccatttagttataaactagacyctttaggtgaaaatatttcagtaattattactcaactttttccagggactgtttttccttaatattttttctggcattgcatttgatgtgtagatttctt

SEQ ID NO: 33361 - DNA, 201 bp, Bos taurus
gggtcatcagcggtgcccaccctcggcgcctgcgcagactgaggctcactgtcaccatgacagcgaccgccgggggccctggtaagcggggttccccaggytcggagtctgagaccgtgctccacactgttggcttgcagtgagtggacattttctccggcccggtgccgtagttgggggccctttgagactcctctggtg

SEQ ID NO: 33362 - DNA, 201 bp, Bos taurus
atgtgaaacatctgaaaagagctcacatgagacagtgatcacaaaaaaaacccttcttttagcgtttttcatatacaaatgggtttaataaagcaaagagmcttatagaaatgagctggaacataatctaaaatataaaaactactctgtaactgtcattcaagaagaggtaatagtatcaatcatgtaaaaacacctctg

SEQ ID NO: 33363 - DNA, 201 bp, Bos taurus
gatccaagatgagtggaggccaggatctggcttcccactctggaacctgaagcgaagcaggtgatccctctttggaccccttagacctgtgtgtggacatytggccaaggctcagccaatcagaggctctttggtgagactttgggtcttcagggagtgatgataaggctagagacagccataggtcattcatagtggctg

SEQ ID NO: 33364 - DNA, 201 bp, Bos taurus
gtaaattttcttgcatgactgtttggcactctgtgctttggagggatccaggtcgtcttctgtccatgtgctctagtagtttagggctgaagatagacackgtgataggcatgtatgcaaacagtgttcagatagcagaataaaacatttacgtcaacacatacgtggataacaaagggttttacaaatttcctctagatt

SEQ ID NO: 33365 - DNA, 201 bp, Bos taurus
ggcaagggtccttctcgctctgcatggtggggaaggggggtcattgtggtctctagataatctctgatttattctctgtctccctcttggttggggctgargtagcctcaccagctgaaatcagactgggtttttctcacttccatttgttgccatctttaagatgctgtctgtgagatggtgtctacctccttctctgga

SEQ ID NO: 33366 - DNA, 201 bp, Bos taurus
tttagacttttacttgcacatgaattgttctacagtggtcaccaagttccctagttctggtcttccaggcccaagcccagagtgcatgtgatggtcccatkccgcatcataacatctgtttggcctactgtctcatgtagaggtgtaatcactggcaggaatcagtggcttttccccaagagtaatgaggtggaaaaagtt

SEQ ID NO: 33367 - DNA, 201 bp, Bos taurus
cagcacacttccaaacttttcaaaaacatattaaaagcattcataattctgtaattactcccttagagtcaagttttcctttaattagcaattacacacayacagactaaataacaggtcgaagataccacattggaactacttccaaacaagaatcggaggatgtttgagttacagagcctcaggagttgcatgcggaca

SEQ ID NO: 33368 - DNA, 201 bp, Bos taurus
tcctggtcatcagtagaccctcataccaataggataaggaccagatacctaaacgtggcaaacgcaccctgcacagatttggcaatggcttcatcatacartaaaaagctgaacaaatgcaaaatcaactaaccttacatctgtaagagaggtgaggtcactgagcaaaccactgccctcaacactggagaggcagatagg

SEQ ID NO: 33369 - DNA, 201 bp, Bos taurus
gcccaaaaatagagtaggaacccattttattagaagtaaagcagaagggttcagccacccaaaggtcacacaccagtgatttaattggaaagatttttccytataaaaaagattagttccaattaatggaaaattcaaattatgtttatcaatataaacactaacaaaatgctatcattccatagcatattacttgcacag

SEQ ID NO: 33370 - DNA, 201 bp, Bos taurus
aggttctcttaaacatgtgttactgtatttcccaattgggattttaatggttgctgttttaaatttaaaatattggagtgaaattacgtatctgcaacatygtctttccttttagaaacagaatagatgctcactttaaagattgattctgctggatatattttgcaactagttacctaaatgaactgtcttactacatct

SEQ ID NO: 33371 - DNA, 201 bp, Bos taurus
ggtatcttaactccatccaagcttgttcatcttaacttctcagggctgtgtgagctagatgctggaggaggtgcttgtctgttcctctaggccttcatccyctgactcctccacatttctgcacaccccgctggagtacagcttcctgctggcagagccacgccctcttacatattcctaggactgagtcctggggtgaaa

SEQ ID NO: 33372 - DNA, 201 bp, Bos taurus
tgtctgtcttctgcaaggaggggttcagttacaatctattttgctccttcactaagcttgtcctccagtctggcctttcatagtaataaaggtggtatttraccctatacttgtctaacatcttgtttttgtggtttagtcactaagtggtgtctgactcttgtgaccccgtggacttggggacatagccagccaagctcc

SEQ ID NO: 33373 - DNA, 201 bp, Bos taurus
tggtaaacattagcaaagagaagccttgcaaggagtttattttttctgagacagatcagtttaagaaacaacagtgaaggcttctttaccttgggcccacrttgacttcaacctgtaggaacctgagagaaattcaggtttactcacattttatctggtcaaaaggcagtcttttcttagaactcatcttgagtgcaatca

SEQ ID NO: 33374 - DNA, 201 bp, Bos taurus
tggaaacagattccaagtaattctaacagtctgcagtcatgtgaaacttcaagagtttaaagcaacaggagaaatgagactgctatttgttaggcctgctygaccacatggcttcatttacatcattccattgggctatgatgttgggctggggttaaaagtttagtcttcagacaaaacaggtgattcagttggtgtcac

SEQ ID NO: 33375 - DNA, 201 bp, Bos taurus
aaggaaagttgtactatttacaaaaataaagtcagagaagcagatttagaagggataaacagctttgtttcgaaaatgttttgaattgctgggaggccatmcaagtgggtcttaagagggtgtgatgctcttgtaatgtgtcagcttggttgatacattgcaagcttggccatcctacattttttagaattcttagtttct

SEQ ID NO: 33376 - DNA, 201 bp, Bos taurus
tgttctgaatcagcctttcagcagtcccatttagtagttgtgtagctgcaatattttaggtgattggtgggttgtaaatcacgtgtgtgtgtgcacattcrtggcaaatacatgcacacccctaggttaagttcatgatttaattatccatggttgcaccatgttatcatagtccatgtggctacacagagcaggaaatga

SEQ ID NO: 33377 - DNA, 201 bp, Bos taurus
agatattcgcactggcgtgttcatgttaactttaaatatacaaagtaaaaatctgagctttcaccatatgtgactgtgtaggccctccctggttattgttkatcattttaaccaaccatttggatcagacttcaggtttctgctccttctgtgggccaccaatcattcctttatctccctagaatgagttccttaagctgc

SEQ ID NO: 33378 - DNA, 201 bp, Bos taurus
taacaactccaattggaaaatttgagcagcatacatcttttccacctggtgctgtcaccaaagcaaaaacagatgaagtggtaacgctaacaccaaccacrgggtcaaaggtaactttcagtccatggcctaaacaaaaatatgaaacagaaggtaccagtccaaggggatttgtatctccttttagcattggtgttaccc

SEQ ID NO: 33379 - DNA, 201 bp, Bos taurus
tcccttggcaaccatgtagcttgaccctgcacaaagcagttctcactgtaatgttagcatttcaaaactgaatcccttgtcaatataattgtgtgttgtcrggaatctagattgtccttacagcagccttcaggagacaatatgtctatttgtcgtctaatacttttgtgaccctgatggtaaaaggaacaggccagcaag

SEQ ID NO: 33380 - DNA, 201 bp, Bos taurus
tggccagtaaatgatatgcatgtaacttagaaaacaataacataactttcaagtaagaattaaaatagttttttatccagtgctttttgaaagtgcaatgmaaggacagcctatgtacaaacctgcatctttttataaaggtaaagatttaatgaactggcatgtacttcagtagtcagaatttgattggttgttgactta

SEQ ID NO: 33381 - DNA, 201 bp, Bos taurus
ctcaaactggggatcaaattatatgcattttaagtacaaatcaataacttaaataattctttgacggattaattcattctttcattcagcagtacttatcrtgagaatgtaaagtgatacagccacagtggaaaacaatacagaggttccttaagaaactaaacacagggttataatatgatcctgtgatcctattcctgg

SEQ ID NO: 33382 - DNA, 201 bp, Bos taurus
tttaaacagtttttcaagttagagtatcagagatgttgctaagtgccagagatagtcactagaatctctttgatagataattgtgcctagaaaaagataaktaaactgttttctaactaaagtaggagtgcatgtgtgatagagagagaggaatgttgtacaatgatcttttttggtcttgaattactcaaaacacatttc

SEQ ID NO: 33383 - DNA, 201 bp, Bos taurus
cacaaggataacaatcaccaccgcttgagatgaacagaacaaaactgttggttgccagaggcagcagggtggaggagagggtgaaatgtatcaagggaggktcaaaagataaataagtgctggggatgtcatgcagagcatgatggctatagttttaatgctgtattccatatttaaaggttgctaagagtagattagcat

SEQ ID NO: 33384 - DNA, 201 bp, Bos taurus
tcagtgtaggttgcagcagatgagaaacacaggacctgagataagtgtgaaaagagggacaggttctggggatataaaagggaaaggaaagtatgccctcracagaaagccatgaactaaagctttgaagtgagacagagcgcagcatgtgtgacttggaagagcagtgactatttgtctcctagggagaagaaacacggg

SEQ ID NO: 33385 - DNA, 201 bp, Bos taurus
ggaagtatgcagagaagtatttagaggaaggttttggtttataaagtctttgttttattgtttgttgatttgcttgtttttggccaatggcccaatgaggmagtgcctcaggacttaaagttgttattaccaactccttctttgtgaaagtatgaagagaagtgttaatctctcctggccaaagacttcaggcagcatact

SEQ ID NO: 33386 - DNA, 201 bp, Bos taurus
cctctgtccctgggattctccaggcaagaatactggagtgggttgccatttccttctccaaatgctgttctgaacatggccaaatccaatggtcagttctyacttctcatcttacttgtccagttcagttcagtcactcagtcatgttcgactccctgcgaccccatgaatcgcagcacgccaggcctccctgtccatcac

SEQ ID NO: 33387 - DNA, 201 bp, Bos taurus
aggcggccactggcatggcaaggacaccattaagccaaactatagatgccaccagggcatcctggactcctggtgaaaaaaggagccaccatctcggccaragtaatagatgcacctaagcatgaggtggaagagctgcttttatacagctggggcaggtaaaatatttatgaatcctgggtgatctatatgtgcttcttg

SEQ ID NO: 33388 - DNA, 201 bp, Bos taurus
tttaatcttagcttaatacattaaatgtggattttaagattatttcaaatattatttcatccagagtcctcagtgcctaagtccaaatgaacatctcaaayaagaatatcagatacacaggcatatctttgtagagtaggaaggcaatttttttcaaacatactctgcttacagagagacgggaatcccaaaatctttgaa

SEQ ID NO: 33389 - DNA, 201 bp, Bos taurus
tgatgttttcaaaaaacatcttgcattttacttggaaatttgattggtaggttaggggtataactatatttgtgttttataaataaactttttggtattarcttcattaaaaaatctataagtgtgtcttccaagatttcataataggtattctttcttttctagtgagaaaaattatttttttccttccatgtataccaa

SEQ ID NO: 33390 - DNA, 201 bp, Bos taurus
tttaccatgttagtcaatatatgttgatagtatctcactaaaatatactttataaaagctgagttaatcatataaccaaatagttttccatacatggcccyttgctaatatgctctaatatagcatacattttatcttactgagtacataaactactctgtgttcttcctctaatcatcatttgcccaagggccctctcag

SEQ ID NO: 33391 - DNA, 201 bp, Bos taurus
tgccatcaaatttggaaaactcagcaatggccacaggactgggaaaggtcagttttcattccatatcaaagaaggcaataccaaagaacaggaaaactgcyatacaattgaacttatttcacatgctagcaagttttaatgttcaaaaaccttcaaatatgtgaaccaagaatttccaaatgtacaagttaggtgtagaaa

SEQ ID NO: 33392 - DNA, 201 bp, Bos taurus
gtagaaatagaactcaaaacatttccccttctcttaaatggagttacttatcccttaaagaagtacaggtttctgagtcaacagataatcaaaactactarataaacacgggttatctttctgaggagtatcagtattgcttagagtttagaagaagaaagtatctaaattttatgctatcataagatttcatcagtcaca

SEQ ID NO: 33393 - DNA, 201 bp, Bos taurus
tgtgaatcctatgacctttttttagtagaaagtgaatcacctccctggtggattcactaacttgaaaatccaaccctgattggccccgacaaataatacaytgtagattttgtttactataggttattttggtttaattatgaagttgttttcactgtaattatatgctttgaaatcactgaaccaagaacatttccataa

SEQ ID NO: 33394 - DNA, 201 bp, Bos taurus
gcattagaagacagagaaaagtggagagtttgggtcatcccccaaaagagcatccactgaatgctgtgtatagatttttttttaaattgaaaatatcaccrtgaggaatattgctgcagtatcgtgaaactttatgcaagataaccactgaatgttctactcctattggttgacctgaggaattattgcacatacacatat

SEQ ID NO: 33395 - DNA, 201 bp, Bos taurus
agggcccctggcaatgaatgtgggtgattctaagacctgaaggccacccctgactatagccaaaggaaatagccaaagcttgtcctacaaccgcaattctrcaaccataagtaactgaattgggccatcacttgaatgaggttggaaatggattcttactcagagtctctagaaaggagtacaatcaaaaccttttttcaa

SEQ ID NO: 33396 - DNA, 201 bp, Bos taurus
aagagtgaattctcccacccagcaaaaggccacttcccacacctcccgtgtaacactatcagacagaacctctggctatagaagcctaaacccacaaatayacaggctacatctacatgttcttagcttgggttttggtcaacctcaaatacctcttattttattaggaaagtatctttcctttctgggtgcctggtgtcc

SEQ ID NO: 33397 - DNA, 201 bp, Bos taurus
cctacatctctccctgggaacaatacgaagacaagggccaacttctggatgtttgacctgtgcttgacttaacgctctgatgttgcctcttgatattcttratagttttttaacaagaggccccacatttttatttcgtcctgggtcccacaaattttgtaagtggtcctagtaaggagattggctatggatggaggaaca

SEQ ID NO: 33398 - DNA, 201 bp, Bos taurus
cccagttatggttttgaatataaagaataagagaaaatgctaattttctattcagtccatacaaatcattaagtatgtttcctagtatggataaatatttrttttccggtcctagatttggcagaaatgctgccactctgaaaccatctctgttttagtaacattcttctttcataaagttctcttagttctaacactatc

SEQ ID NO: 33399 - DNA, 201 bp, Bos taurus
aaagaatagtcagaagtattttcatccatgagggacaaatgtgactaaaaattgattgtatcaacaattaaatcctgctctaagttacctttagtagtttrgaacatatatattcgtactggcttttaaaattagcactgaagatgttagagtattaattacccatttcatccttaaaaataaacttatgaatctatattc

SEQ ID NO: 33400 - DNA, 201 bp, Bos taurus
gcacaataaaactctctttttcgcacaataaacagaccaagacagcttcaggttcctgggtggagataagattcggccccatgcagtcaatcaaggacccyggcagaaggtttttctgtatcttccacaaataaatttccaggtcatggtgagcatcaacatccagccagtgcaaaagaaatgagcacattgggcctttct

SEQ ID NO: 33401 - DNA, 201 bp, Bos taurus
gtgttattcactctaatagagaaaagagattgtgtcagtaatttctaaaaagaattttatcaactggaaataatgtgtgtctttccaagggcaggtgagargtcagttatgagtgtggatccctctttaagagtaaattagagaaatattatctaaatgaggactacaccagtaactgaagggggcagactagcaatagct

SEQ ID NO: 33402 - DNA, 201 bp, Bos taurus
gacatttgagctttacaaaaccaacaaaaatttataggccaaatgagtcttctatttttgatacttaaagatagattcaagagatatattgcctaaccaayatttttactgggccatcacatttttattagcctcatccactctttctaatatcacaacagttgctcgagtggcaggaaaaatcatccagatatcaccaga

SEQ ID NO: 33403 - DNA, 201 bp, Bos taurus
acagtattggagcttcggcttcagcatcagtccttccactgagtattcagggttgatttcctatagaattgactggtttgatttccttgcagaccaagggratttcagtgttatgagggcctacggaaaagaatcttttgtctacagcccaaactcagaggaaatgatttgctgactactttaagagaaggtgagctggtg

SEQ ID NO: 33404 - DNA, 201 bp, Bos taurus
agaatgcagaacacaaatgaaagaaggacgaatgaaagagaagtgacacttcagaccagtagaaaattcctgatttgaagaaagactcatagattgagcargctcagcttaatgaaaagacatcactataaagagaggctgctatttaaatagacttcaacattaggtagagaattccaagcaaaaggaaagatcatagag

SEQ ID NO: 33405 - DNA, 201 bp, Bos taurus
ccgtgaccggcagaggtgcagaggcagctgatgcaacctgagctgaaccggaagtccctgtttcctccaccgtctctgactggagaatcggagaaaccacycaggccaattcaacaacccttgctggaaacccagacagctgttttctggggctctctaaaggagacagtcaaacctcatcgttgctgtcatcattatcat

SEQ ID NO: 33406 - DNA, 201 bp, Bos taurus
gccagttttagaaaggtatgctggcaataatttgactccacttcacacaaatcagaattctactacagattgaaaggagccatggcagctagaaattattytttaataggattttaaaaaatcacgttgctaatggttgaaaatgtaactggtaattaaagaatggttttaacaattttttttttaccatattttacaaga

SEQ ID NO: 33407 - DNA, 201 bp, Bos taurus
ggcgccaggcctgggctcgggcaccaggccactgaggctgagaggccactgaggctgagaggcgcgctccggcgggccgggcggccggcttcatgacgctmttccacttccggaactgctttgccctggtctactccccctactccaccacctacaagtacagtggcctgtctgagtccagtgccttctggaagtgtgtcc

SEQ ID NO: 33408 - DNA, 201 bp, Bos taurus
tttgtcaaagcattcaccactttgtaatggattcactgctataactattgctgaaatcttcctttggacatccaagcgaaagagtttgcagcgtatatgtrttctgttggacttacattagccaagtttatagaaacctctctctctctaatatatacatgctaaagtgtgtactaccagatggaatttcaggtgcctaca

SEQ ID NO: 33409 - DNA, 201 bp, Bos taurus
atgttacacgtaagtcctatttgtccactctatgtcatcagtgttctgagcaaaagccttcacaaactctgtggaggaagccactgttttaaaggcctttraattcctttactctgaattttctcctcgtaaatgttattaccttaaagtgggatcctgttgataaattcacctggagtagagctcttcacagctctgacg

SEQ ID NO: 33410 - DNA, 201 bp, Bos taurus
aagcctggcatgacaatcaataccaaaattacagctccatggtaagaaatgctgtcaacatggtaatgacttgtttaaacatttattaaatcacttcacarcaaatagtaacacatgaagtgttatcctcacatttcacagcgacatcactcctaagcagaaaaaacgctagccaaactgttttaaaatcttcatcaagat

SEQ ID NO: 33411 - DNA, 201 bp, Bos taurus
cagggaaccctggcatgctgcaggacatgggtctcaaacagtcagacacaactgagcaactgaactgaactgatgtacatcctcccatatgctttctatcrcctccagattacttataattcagatcacctaatgcaatataaatgctatgtaaatagttctctgttccaaggaaattcaagtttcgcctttggaactttc

SEQ ID NO: 33412 - DNA, 201 bp, Bos taurus
ctaaaacccctgctgctggaagtaggaaaggcaaagcacatgatattaactaaggaagtcgataaatatctttattttagaaatgttatttggattatacracctaccatcttgaagatttttatcactctataaaatatggtttaaataaaaataattcctatagtaatcagctagtttaaaagtctcaaggcagcaata

SEQ ID NO: 33413 - DNA, 201 bp, Bos taurus
cctctgaaagaatctgccttataagaatgtttttgtatgcctgaagcctcatgccactctctatcagtctgacctggggccagggagaagagtttgagtasatgagatcagccataggaatgtactacaagacaaacccctaacaaaatctggccaccaaggcttgtctgagccttcctagttggcaacattcaaacatca

SEQ ID NO: 33414 - DNA, 201 bp, Bos taurus
ggcatttggggaatatgatcctctgaagcagtaaagagcttgccttgttaaggagttgaaacaagaccaggatggctgaggcctagcagacaggccatgawaaaacgtgagggtttttcctagagcattgagaagcaattgaagatagttagagaaatgatttacatggcctagttacatctggtatatttttcttagttc

SEQ ID NO: 33415 - DNA, 201 bp, Bos taurus
ctttaaacagctttaggaaaatgccagttgttttaattatttctccagtgggaatctttggcttcactgaaaagtgtatatgagccgtttggtggccaaayggcaaagtaaaaagaaaaaagaaaaatacacagaccaccaccaccaacatccccttctaagttacatgaaacttcaataaaatatggtttgatggcctgt

SEQ ID NO: 33416 - DNA, 201 bp, Bos taurus
aaagctaactcagagtaataatcaacagctagggaagacacaaacattttttaactatgaaggcagtggattataaatccaaatattagagttagagcttwagaagtcatttaaattttctcaagtttcaatcatctctgttttaaaatataactaattatgttgattctcttcaaagagctagtactaaaaatagaaaag

SEQ ID NO: 33417 - DNA, 201 bp, Bos taurus
gaacgttcttcaaattcctgtagttcggctggctggaagctttggggcagtaaaggtttattggaaagcaacagtggacagtgctggcctggaagactttragccgtctcatgggattcttgaatttgcagatagacaggtatgttagtcacagacatattagcagtttttggttgtacttcagacattttataggcatct

SEQ ID NO: 33418 - DNA, 201 bp, Bos taurus
aatagattattcgtgttcttgaagaactgtaatgttctagtgagctacaacttagaaaaaaattacattataagtcttggtttataatttaagtatgttcrattcaagattagtttttccacacaagtagttataacgagacattaagatcccaaaccagctactgaaaccctttaactcttcatccgactattatggatt

SEQ ID NO: 33419 - DNA, 201 bp, Bos taurus
ccaggagcacaggccctgctgaggggagcttacattccagttattaaagacgctgcactggtcaaacagagcacgcagtcaggctgaaggtcactctcccrtgtgtcccgcctgctgtcaggccaagttcagctgtctcagcagtttagtctgggggagcccatcagatttctcaagtgtgtgtcagcatttgaggggctc

SEQ ID NO: 33420 - DNA, 201 bp, Bos taurus
gtgtatagagagtgttgggctagggtctggtctacacaggaaatggtcaagctcttttaggagagcttcctgtacagaggacacttgcactagtggtagcrgtgacagagggtggcaggtcttcctggaatgctctcagtctgatatcacctcagatgtcatcagtataggaagtagctcaaccactcactctgcagtcta

SEQ ID NO: 33421 - DNA, 201 bp, Bos taurus
cctccctgtagtttggcctaaggacaaactaaggtaggggtaatgggggtgatggcaacctccttcaaaaggactcatgccaggactattatatttggtgyccctcatctcatggagggccactgtcaacccacacctctgccagagacttctgaacactcctggacacttacaggcaagtctagctcagtctcttgtggg

SEQ ID NO: 33422 - DNA, 201 bp, Bos taurus
actttatgctcacagaagcagctagctaatatgagtcagacaccagtttaagtatcctcagaactcgaggagatacacagaaagttctctatgtagatcarttaaacccaggtttgattcctaggtcgagaagatcccctggagaagggcctggaaacctactctagcattcttgcctggagaattccatggacagaggag

SEQ ID NO: 33423 - DNA, 201 bp, Bos taurus
tcatgtaactgaataaacagaatgacgctgagtcgatgctgccatgtctaccagcacactgtgcaaaagagacgaatgcaaacttggtaggcagacgagtrtgggatagagttgagttatctaggtttacttggataaccaggaccaaattcctggctttgtgtttttgcataatacttgcatttatttttaagatctatg

SEQ ID NO: 33424 - DNA, 201 bp, Bos taurus
acaggaactatagtctactgtgacctggagaggttgtagaaacttcatgaaagaattggaacttgggcagcatatttaagaatggacaggattaagctttyaggtaagggtagcgaggaagaaaggcataggaagtgattttgagcatgagagcgagttgtgatgttcaagatagatgactctcccaatatgataaaggac

SEQ ID NO: 33425 - DNA, 201 bp, Bos taurus
ctagaatttctaaaaaaaaaaaaaagtaaagctattttacccctaatcatagacaagcattaaagatcttaaaacatgactgtgatcaggcaatttttttyctggcatacttttaagtgaatactagtgtctgcacaatttagaatgaagacctgatgttctaatacatcccatatagtctcattttgaaagccatcagct

SEQ ID NO: 33426 - DNA, 201 bp, Bos taurus
ccttgaactgtcactagaggggcccctttcatgtacttccccaggtcctcagctccatgaaccattcctgttggtgtgcactctgctccctgcgctgtccygggcctcttcctcggcacatcctcgaacttgtcacatctctcctaaaataggaagcccacacggagcaccgggttcctgggaagaggagccagggacagc

SEQ ID NO: 33427 - DNA, 201 bp, Bos taurus
tcttagcgaccccatggactgcagcctaccaggctcctccattcatgggatgttccaggcaagagtactggagtgggctgccattgccttctccgttttcrggtaggatcctgtccaaattctgtttcattacagagatgtatgtagtgttgatccttagaaagtgaaagtgaagtcgctcagttggggtctgactctgca

SEQ ID NO: 33428 - DNA, 201 bp, Bos taurus
taaagggacaaacacatttttattatttctgaatgtatatgatctaagatgtatattatgtattatttctgcttccttcacatctgtttattcacaattasgtaacatttaggaactgaagtttacaagtgctacttgatttccaaaacaggcaggacccattgatcagacttttaaagccattcttttccaaaacaaaaa

SEQ ID NO: 33429 - DNA, 201 bp, Bos taurus
gagcctcagcttcctttttgtggtcaggattaattaaataacaatacaatgtatccataacattacccactactctgttcatgctcaataaatggcagtcwtaattttcacaagattcttaatagcatgagttagcaggccaaacctgtccacccctgttttataaataaagttttattgggccacaatcacaatcattag

SEQ ID NO: 33430 - DNA, 201 bp, Bos taurus
gcatttcctcctggattttttcatgcgagttggaaacggcaaacaagaaggaagggcgcccaccctctgctcgctcggggccttttggttgcttttgtgcygtttgctgaatcccaccttttgggaaatcatcgtgagtgggtttgtgtatcttctagaacaaaaccacagggtttcggctgggccaccaaagagcgaaag

SEQ ID NO: 33431 - DNA, 201 bp, Bos taurus
tatacatagaaaaataaggaagctgaacaatccacaattaaagaggtattcactgaaacatatggaaaagtctttgataatttctcttcactccaacaagyagcagtaaatggattaatggcccttagctggaagcgcatgtctgtgatcagaactgaaggtataaactgttgcatacaacacactcagaggattatactc

SEQ ID NO: 33432 - DNA, 201 bp, Bos taurus
cttttcaattgcgtaaagcatgcatttcagtagatgtagtagcttactcacatgtgtgcactgatcagtactcagccaaaaactcaagattaatgcactayagatctccagagcatttttctttttgcttctgtgcagctctctccttccaacatactgctgcacaaatgtgaggaaatcctagccaggaaagcctcccta

SEQ ID NO: 33433 - DNA, 201 bp, Bos taurus
gcatgtcagtttgagagttatcactctgaagcctgggttggctttgattactgcatcattactaagctgcagttttcccataactataaatcgcaattatytgccatttaatatttttcaaaatcaacctttttaatgactccacagtcgtctatcacacggctaatccataagtgagttgtctaattgcatactgtgaga

SEQ ID NO: 33434 - DNA, 201 bp, Bos taurus
atccagagttgccacaatatatgatctaaagtatctacttttcaacaagatattataagatatgcaaggagggaaaaagtggccaatagaaactgggtatmtctagatattgaatttaaacacagtctttaaagcagaattataaataaattcaatgaaccaaaggtgaccacacttaaaaaacaaaacgaaagtaaggca

SEQ ID NO: 33435 - DNA, 201 bp, Bos taurus
gatgaaacagaataaggaaatgtatcaaaagtacacacatgcttatgctaacagcatttggtgtgagaatatttgctgatatgaaaggcctcagattagamagataatgaatgtagaaggtttgccttttgaagaattaggcaatgcttaaaaaaaaaattgtaaggggcctagccacatataaaaactgattttgatgat

SEQ ID NO: 33436 - DNA, 201 bp, Bos taurus
tgtgtgcctagacctgggtttaatagaccaatgattccaatttcccattgtgaaactcccattttgaccgcaagacagataaaaaaaaaaaagtttttaaygtaaatacaggcctaatagtaacatgtcacaatgcatcctttatgggagtcagtgtgatccaatgtttaatatggctgacccgtgttgatgtatggcaca

SEQ ID NO: 33437 - DNA, 201 bp, Bos taurus
cacctccagggtgtggcctgtgctgtctccagggcccacctgcaagactgagccagctgccctctgcgatttcatttggtatcacatccttgctgggcttrcttcctttctggccctgcactcccaaccttctatttgctttcctgagcaaatttcctaataagtcacattcataagaatgagtcctctcaaggtcagctt

SEQ ID NO: 33438 - DNA, 201 bp, Bos taurus
ctattatccaaatcattaacattcgcttcaccctgttgaaatgcagtgacacccagggatttaaagtgtaccactacatgaatgaaccccacactctagtyggcaacagaattaccagagggcttattagattcctaagctccaccctcagagtttctgatttagtaattctggagctggacctgagtatttttatttcta

SEQ ID NO: 33439 - DNA, 201 bp, Bos taurus
ctgtaggatttatttccctgttcaccgactgttgactgggaactgtctgtggcagctgcagagtggaccaggttttgcaggttccctggacctggaggcaytttagataaactgcagaatccttgccacagacccggagccttgggatgcaggcatggaagccccttttaactagtttttttttatcctttgaccaccaga

SEQ ID NO: 33440 - DNA, 201 bp, Bos taurus
caagatgtcatacttaggtaatagagatgctgtccatcagctggtagctcagctaggactgtcagctgagggtcttgattttcctcaagacttcctgagcrtcttcttatgattgtttaggctctgtgtagcatggtggttggatttcaagaggcagaaggtggaggctgccagtcctcttaaaggctagccctgaagtga

SEQ ID NO: 33441 - DNA, 201 bp, Bos taurus
cacaattcagtgatatgtccaggaaaagcaactgtcgttgccaagctcctgggttttctgccttcagcctggctctctgctcgcttgcctggcccagtggkcagtcaccagttctgagagcttggtgcactctgtgtcctggtggtgaccggagctggactcactacacacgtgcttctctaggactgccttctgaaggta

SEQ ID NO: 33442 - DNA, 201 bp, Bos taurus
tgagcatctggatttgctcttccctaatcagatatctttccagctcctccaagtaggtcggcctcactcagcctgtcttgcttagctgccgtggccatcayaactgagataccagagactaaaccgcaactccacaggtggtcccagggctcctggagtgatgctgggctctctagcaactgcacatcttttccagctatg

SEQ ID NO: 33443 - DNA, 201 bp, Bos taurus
atgcagccccaagggggcttgggagtggctgagagcaccgatgaactctaagaagcttgaacccatgttaggatctcaggcagtagcagaagtcgtgggcrtaacatccaatttctaaagggtaggaaagacaatttaaatagctgatgccagcagagaatagagaatgcctattgaccagacacatgcacaccctgtcaa

SEQ ID NO: 33444 - DNA, 201 bp, Bos taurus
gaggtgctcccctttctgctctgggccatgggaggatacaagtgtgacttgactatctgcatcccagaagagggctctcaccagaacctgagcatgttggyaccctggtcttggacttctggcctgtagtagtcctgtgggaaatgaatgtctggtgtttcagttcactcagttgtgtccaactctttgtgaccccatgga

SEQ ID NO: 33445 - DNA, 201 bp, Bos taurus
gtgaagtatggcccatatagcaaatataaaaacacaatgtaaaaagtgctaaaaagcattgctgtcaaggtgctgtgaagcagtgcaagtttgagggaagkgggatgaggttaagatgggcctgtttttctgggaataaacattagtaaaatgagtcccttaaaggagatctgtaaccagtcagttcaaggccggactctc

SEQ ID NO: 33446 - DNA, 201 bp, Bos taurus
cggtgcagccatggctccttggacatggggtagttcctcccggccaccgcccctgacctcgggtgtggggtagcttctctcgccacgcttctgcatggtcygtcgcagccaggctgggccaaaaagaaaaaaagattaatataaagtagtcttatgggttaaacattcttttcagaattttgaccctagaatataatacct

SEQ ID NO: 33447 - DNA, 201 bp, Bos taurus
tactacctggctttgttaactttcccttctttatttgggcctctgaagtcaggctttcacttgcccacctctgaagtcgcctcgtaaaaagtcactggttygcaggttgccagatctagtggcctctctttggcttcatcgtacgtgaccttcctaagacattcaacaccagccacttccttcttcatgaactcttccttt

SEQ ID NO: 33448 - DNA, 201 bp, Bos taurus
acacacaggccttggggactgctcactcttgctctagacatcccccagaacttggcatgtctctgctgtccgtggcatcgtgcctcaagcatctgcattcrgtgcacaaggccaagtccatcaggagctcgaggaagctaatggcttgtcattagccgctggcatcccgtgtgaaagggctggtctgtggctttgtgtgct

SEQ ID NO: 33449 - DNA, 201 bp, Bos taurus
gctgtcaagcctgtcattcaggtggtggggggcatttgctggtatgactccgagtccaagtctcagcaagcgacttgcagagtttgtgtgtacggcctgcmagctctggtcagtgtcaccaacacctcggtttcatcctgacagcaagccatcagcacaaagaatgccacacaaaccaggccctgatgctaattgtccccc

SEQ ID NO: 33450 - DNA, 201 bp, Bos taurus
ggttttggatttgagccttggcggctcacaagtatataacaactttaactaatgtcacagtggtttagccctgtgccataacccttaagttaaagctcaaktttatttttatttgggaaaagagggaataaacttacaaaacatatttatgtacaaccagactctattcctgtatcttcctataaacataccaagaaaaca

SEQ ID NO: 33451 - DNA, 201 bp, Bos taurus
aaaccttcacattgctttgctctaatgagatgagggaaataaagagtgtttccttcactctataaagtcacaagtctgctaaatggtagaggtggatgtcrttctggaaacccaagcctagagctgcttcgtcttctgtaacatatttcttggtgttagtccaaactgtggtgcatacagatttagcactggtttccttag

SEQ ID NO: 33452 - DNA, 201 bp, Bos taurus
aacagcttacacagcactatggtggggacactctttattgtattttggagggttctcaagttctcaccaatattcaggccggtgcggttcgcctctgagcycctattttagttactgttgccttccttttgccccatatgtcattatttggggccttagttaaatcttctggacaaatattaccatatttacaacctcata

SEQ ID NO: 33453 - DNA, 201 bp, Bos taurus
cccacttgatgccaacagtatcctccaccaaaatgtatccagaccttgcagaaattccccaggtgctttgggcaggggagtggggggtgggtgcaagtcgyagagagagtagggccccggaaaccacctgagttgagagctggtgctctaaaccttccctgagcacttttcatccagaatctgcttgaacacatctagcaa

SEQ ID NO: 33454 - DNA, 201 bp, Bos taurus
tgctcccttggaccactcagtctgggagaatccagctgcctgttatgagaactccgaagcagctctattggagaggtccatcggtgaggccttttgagtgmgaaatcttggaggtggatcttctagcctgagtcaagccttcagatgactacagcctgggccaatatcttgcctgcaacctcatgagaccctgagctagaa

SEQ ID NO: 33455 - DNA, 201 bp, Bos taurus
ggaaagactttgtgtatataagtttgcatagggaatgtgtgtgttggatatttgttgttttctttgccttttttgcccccttgggaatggcctttcctcaycccctgtagctcagtagagaccaccagtgacaaggtctctctagcatggttatatgggtgggcctgggacttagagtggaaacttaatgtcccatcccct

SEQ ID NO: 33456 - DNA, 201 bp, Bos taurus
gagccagttttcgggcctacatcttgagaaaatagcagcttctcttggaatagacactcttggagtgaagtcaccacagtgtaaagcttaagctacacatkcgtgtcggggcctgccaggtggtatagtggtgaagaatctgcctgctaatgcaggagacctaagagacatgggtgcaatccctcggtggggaagatccca

SEQ ID NO: 33457 - DNA, 201 bp, Bos taurus
tttatttgattcaaggaaaaaaaaaaaaaaaaggattgggacaagaacatcaggtaaggttttaaagaggagttgagagggcatttagaaataaagcactrttgtagtcagagctcagagaagagagtatcatccttcactttccaggaaagaaggtaaggaggtaatatggtccatgggcaaaattagtgggagtttaag

SEQ ID NO: 33458 - DNA, 201 bp, Bos taurus
ggaaatggcaacctgcttccagtattcttgcctgagaaatcccatagacagaggaacctggtggtctatagtccatggggtcacaaaagagtcagcaggayttagggactaaacaacagtgtctgaccaggaaagaacataattccaggccaatggaatttggagtttttcttgaaggagtttaagtgtggtggggataag

SEQ ID NO: 33459 - DNA, 201 bp, Bos taurus
catctctaagctccaaatccaccaggccgtggtgtaaacaaaacaaacaaaaagcactctcccccaaatcaagaatgatcctttaatcaacaagttccaarggcctgcttcccacaggtcacttttaaagaaattccagtcttttgctctaatttcacccttcagtagtcataaaacctgcagaaaaatttatgagttcac

SEQ ID NO: 33460 - DNA, 201 bp, Bos taurus
atgtagaactacagtggagactttagtttttggcaacctgtcatgtagttatcctgcacaacaacaacaaaaagttagagaaatatccagaggccccaaaycacactcaaatagagaagaaattgaacaagtgtagctggtagctgcccatggaaaaaatattaaatctcacctgcctagattttcctgtttaacaggaca

SEQ ID NO: 33461 - DNA, 201 bp, Bos taurus
gccctcacactcaggaaatttccctttacgaagaccatgggcaatcctgggcaaccagttcagtgaccccagttcttccactgtctcaagccccagattcyactcttatgctgcaaactggcccacagtgagtgatccagtggaatccagataagccaccctcacactgcaataaaagtagagcctaaatccaggctttct

SEQ ID NO: 33462 - DNA, 201 bp, Bos taurus
tctacctttagttttttgaggaacctccatatcgttttccacagtggttgcaccaatttacattctcaccaacagcataatatcccttttcttcacacccyctccataatttgttatttacagacttaaattgtggccattctgaccattgggatgttgtacttcactgtagtattaattcatgcttttctaataaatagc

SEQ ID NO: 33463 - DNA, 201 bp, Bos taurus
gttaacaatagatatacatccataggccaggaataaagaacaaagaagtttgagctagagttgggattcctgattatcatttttcagccttgctaaaaccrgaggaaaggctcttctctaggcccaacctgcttttgtaccttttgaagtgagcagtgagatggatgcatacttcagggtgccaagaagcaaaggctattt

SEQ ID NO: 33464 - DNA, 201 bp, Bos taurus
atgactgagcacgtaagcacatcatctatctcaaaacaagaaatggaaaaaaaagttcagaagcaactatgaaactgatcttattgtgttgtacaactatrccgctttggtactatggaaaatcctaggacttaaaatagagtcagctatcagagtgtgctctgctcaaattggaatctgctttgtgagattcagctgctc

SEQ ID NO: 33465 - DNA, 201 bp, Bos taurus
ttttcctgcctcagtttgctctaatgatgcaataacatttccttctggtttcttcttttttcccctgacaatcactttaaagttcttaaaaattacttctygcattaaaactccagttcagatgttagatttttaggacttctttgttgacatgaggaacagattctacacttcagacaatattcccccttatcattgttt

SEQ ID NO: 33466 - DNA, 201 bp, Bos taurus
atgcctttcaaaacacttgtaaaataaattgattataatatctttaaccttcaaaattacttaaatacatctcctgatcttttgtgtacatagaatgacaygctgaatgtgctttgcagtatgcagttttgcaggtgcgagttcattgggaatttctgctagcaaaacaaaaatcacaagatcatggtgctaccaacactc

SEQ ID NO: 33467 - DNA, 201 bp, Bos taurus
gttaaagggtatttttactggttttaccacaccaagtccctggtgcagcagcgatcttaaaggggccgcagcccatggttctagtgtgggttcttagtctycagttccagagagagaagagcagaccccattcacaagttattgtgtaagtctgttctgattcatctggagggatacctgaacgaatgacgggcagtgttt

SEQ ID NO: 33468 - DNA, 201 bp, Bos taurus
gccaccagggaaaccctgtaatcaactatactcttgtaaaaaaaatagtattaatagtaattaaaaggaaaagatgcagggccatctgaggtgtgggagcygtggggaaagataactggaaataagaagagggtgaagtaattattgttctgtgcaggtgcaactaagttacaggttagcatgttctgggggtggggtttt

SEQ ID NO: 33469 - DNA, 201 bp, Bos taurus
atcccacatgccccaattaaagagctcacatgctgcaactaaaaattactgcatgtcacaacaaagattgaatatctcatgtgcagcaactaagatccagyacagctaaataaataaaaataaatactaaaaaaaaaaaacttttaaagtaatgacagcaagaaatgttggcaaggacgtagataaactggatcattcata

SEQ ID NO: 33470 - DNA, 201 bp, Bos taurus
gtcaaaaaaagtctaccctggcctaaaacctaaggaaagagtagaagtagaaactaggattttttaaatgtccaatcattttgagttcagtccctcagtcrtgtctgactctttgtgatcccatgaatcgcagcacgccaggcctccctgtccatcaccaactcctggagttcactcagactcacatccatcgagtcggtg

SEQ ID NO: 33471 - DNA, 201 bp, Bos taurus
tggagatcagctgtggccaaaagatctaaatctgcacacttcttcatctccatttctgtggtcttattgctgctaagactattgccacagcctcctaatcygttttcctatcttccttgtcaggccatcatctacactaagatcagaatcaatttttaaaatgtgtaattcaacataaaaattctcctgttacatctaaga

SEQ ID NO: 33472 - DNA, 201 bp, Bos taurus
agtctaaagggtttctttgcagagataaatgtctccagagagactgatgagtcaaggagtctgttaataggataagtaaatgtaacctttcacctagttaytgctattacctaagtcataactacgtagttttagcaaattgtttgaactcgttccagttacttaataaaacagagcatattggtcccattcttttctagt

SEQ ID NO: 33473 - DNA, 201 bp, Bos taurus
tggtttatttgtttattcattaagcatacgtaaaatcgagtcatctctgagtgcataatcccttagaagagataaaatggccaactagagataaaatacaraatagagagcgataagtgttgcaagataggtgagcacagaagcccaggaaatggagatgctttgtttgcttaggaccatctgggattgttctctagcaga

SEQ ID NO: 33474 - DNA, 201 bp, Bos taurus
cagaagacagagaccatctctgtgattgtagagttagtgaatcaggaaggaatttaggggaagatccccataaggctgagatgtggcctcagatggaggakcatgactgcccacaatacactgtattctactggggtgaaggactcgggggtctcctcacagaaacccgaggccggcctggggatggtcagtgcttcagag

SEQ ID NO: 33475 - DNA, 201 bp, Bos taurus
ggggtgccattgccttctccgtctttctgggtctagacctttccattctctggcttggcaagctgcaaggttgctgtcctcatctgggtaaccagagcttkattgcaaacatgccgttgtttcctttcacaagaagaggaaaggagaacactaatacagaagtgggcagtgttttgagttggagatgattcagaagttaag

SEQ ID NO: 33476 - DNA, 201 bp, Bos taurus
acagggcagagacacaggaggatctcacatcaacaattaattgccagtgctttccaaaacagctcatccagaattaggttgggaggcctacttgaatacartatgccagaaagagcaatcagttcagttcagtctctcagtcgtgtccaactctttgtgcccccaagaaccacagcacaccaggcctctctgtccatcacc

SEQ ID NO: 33477 - DNA, 201 bp, Bos taurus
attttagtacattataatgacaatttcgtgtgtttatatttccactcctttgaacagtttgttggtggagtgtccttttaattttcatttgttaagagctyttacattatttggcaaacaataggtttttaataaatatttgtagttagttggataaacagcatccatgtggtctaagattctcagctttttctcttaaac

SEQ ID NO: 33478 - DNA, 201 bp, Bos taurus
gggggttaactagcagtatctgccatgcctaacagtatagattagtaacagtgacattggtaaaaattgggatggtttaaaagaaccaggaacaactgagyggaaatagaccttcccaagccatccggactctctgtctcttgtctcctcttgtgcacatttttcatgttttcttctcaggctttctactccatattgcac

SEQ ID NO: 33479 - DNA, 201 bp, Bos taurus
agtgtcagatgttcaccgattacaatgttagtggctggaggtgagaatttagcactaacctgtagctatgctcttccagttgagccagtgactgtgggccytgtctcagttgttggtttggtgacagggacatcttcaatcagccaaatccaatgacgtaggagcctttactgtggttggttgaaacagtgacttagttga

SEQ ID NO: 33480 - DNA, 201 bp, Bos taurus
ccatgacattttccaggcaaggatactggagtgggttgccatttccttatccagcaaataggatagatttatttaaattactacttaaagagaatatttcrattaaagaaagcaaatgtaccataaatacatataaaatattcatatttataataaaacataattttttgcagtaaatgtatatataatactcaaaattgt

SEQ ID NO: 33481 - DNA, 201 bp, Bos taurus
ttttttttttttccagaaaacataatttggagccatgtaccctacctttcataaatctttgacttcataggtttcctctcttgatctaagacctccatttytatggtagtactttcattagtataaccaactagtttgaagttgtaatggggttttgtcaagttacttgacatcctcagacagtactttcttctgtgtgta

SEQ ID NO: 33482 - DNA, 201 bp, Bos taurus
tgttaaagttgtggggcataaaaatagagcttgaatagggactgattcactagattattttaacccaaaggctttcctccaatttacaaaggaatcagcayggtgctgaagcccactgtttaaataaaatatactgactgccaaaggaagaaaagactcttaagtcacagacacactttcaaagcctcaaaagactctgtc

SEQ ID NO: 33483 - DNA, 201 bp, Bos taurus
tagctcagttttgtctttgtaaattacttttgtaagtcttcttagaaaagtttctaatttctagttcatttttgcaataacctgcatttccatcaatagcytttcttcattttttctgtattttaatttcctccttttgaacttagtgtctgtttagacagatgaggtctgtttcattgttccttcaggggaattttcttg

SEQ ID NO: 33484 - DNA, 201 bp, Bos taurus
gtgtgcactggcttatttaggcaatgttcaatccttactatatagtctcatttcctactgagattttccgtttcctgtagattcttacttctcttccaatkggagaagaccctttaatatttcttgtagggcaagcttagtattgctgaattttttcaatttttacttgtttgagaaattatttctattatacatgacaat

SEQ ID NO: 33485 - DNA, 201 bp, Bos taurus
attccttattttatagacacaaaagctatacttttcaactgtatctggtattggcacacagtattcatagcatatattctgaaataaaatcaatctcatayataaaattatacagttttgaggtaatataacatattggctagaaacagctcatcaacttcatatcattttgtttcctttcaataatgtatttctttcata

SEQ ID NO: 33486 - DNA, 201 bp, Bos taurus
gaagaagtgatagttggaaatcaagcaaggtcatgaggaagagagagattattttctttaatgttttttcacacatttcaaaatcaacttaagtaagatgyctgtggacacataagccgacaaaataacacaatcagaaaacatggcaaaaatatccctcctctagatttttcctgaaaaaatagctttctttttctatca

SEQ ID NO: 33487 - DNA, 201 bp, Bos taurus
aatatatactacatgggtcctaatttgagtataaatagctcctaatgttcaaactgcttttatcactattaagtaatttgttttacatttattggattgartaacagcttcattggctgtgactttgaagacccatgaaagttaaaccctggcatgtactctgacactgactgtggcaataaagaaattaagaagacctca

SEQ ID NO: 33488 - DNA, 201 bp, Bos taurus
cacagactgttccaattcttgggcatgtgccccaaggtcacagcggataggaactaaccactggggggcttccccaagtccaccccatgggcccttgatgyagagttgtgtcttccaagtaacctcaggcagccaggagcccattcagttcagttcagttcagtcgctcagtcgtgtccgactctttgcgaccccatgaat

SEQ ID NO: 33489 - DNA, 201 bp, Bos taurus
ataccaggtggtgagtgtagacacggaggaccttgtcagcctaaggaccaggtggcaccccaaaaggatgcagcaaggaggtactgaaactcaggcagccrggccctgggggaggactcacgtagacaggaagagacagccctgagggcctggggtgcagctggggtggaccacaaggaccatggtcagggttcttgggag

SEQ ID NO: 33490 - DNA, 201 bp, Bos taurus
atttattactctcaatatctttaatactaaatattgatgagggatgataagtaactttttttccccccaaatcacacatttagatttgctactctaaatcraatcatccttcttactaattagtggagcactttggactgtaaggaaaaaatcagctaaaatagtatcatatccatgggggctttacatttgacaaaatag

SEQ ID NO: 33491 - DNA, 201 bp, Bos taurus
cttggaaattttttttacaaataaaaaggtagaaaatctccaaaattaatatggcagcattttaaaatattcttgtaatgaggaacatttggaaaaaacayttaaatgaaaccataaaagtaaaaggattaaatctaacagaacttttaattaaaaagaaatcattcaagagaaaagtcgtttattctacatagaacctaa

SEQ ID NO: 33492 - DNA, 201 bp, Bos taurus
tcaatgtgttgttctcctgatgacgaatgacttagtcatcagcaaaagtaacagtggcacatatattgtggttatttaggtcacacgacatgcaaaaaaaygccacttcattaggacagaaattatgttgtgggttttaagtgctcagaaataagagtgagacgaattgatttctctgaagcaaaccctgggaggagaaac

SEQ ID NO: 33493 - DNA, 201 bp, Bos taurus
atgtataattcttagaatcaaaccggaataacagtcggtagctgtcatttcatgcttcgctttgactttctctgttgggaagatcagagtacactctttcratgtgtagccccgcgcccagcagagcagggtcaagaacaataagcagtatgcactcttgttggcaacacgcctgtcagtattagcaagaggaatttagcc

SEQ ID NO: 33494 - DNA, 201 bp, Bos taurus
cccactaggctcccaaagtataaatcacccccatcctcctcccttgatcgccatcatcacccagggatagccccagggccctagggccactgggataatcytcatggtgtagtgacaaaataccgaatacgggttcaccaaaattttgtgtgagtttttccttaccaccttatggagaaactcaaactttttggccaaccc

SEQ ID NO: 33495 - DNA, 201 bp, Bos taurus
agactcctctgtccatgggattcttcaggcaagaatactggagtgggttgccctgccctcctgcaggggatcttcccgacccagggattgaactcgcttcytgtatgtcccctgcactggcaaacagtttgtttaccagtagctacacagcgaagcaaagacagcctggcatgctgtaaagtttgtccctttcagttgcta

SEQ ID NO: 33496 - DNA, 201 bp, Bos taurus
aacaaaacagagtgtggttattaataaattaggtaatccttggagaagtagatcaaccagttctctactcaccttcaccttactttacaatattttggggraaaaaagagagacacaaaattaggaaaatatctaagtgatttatttcctgatttcagtttggggaagaacttgttaagctgaaaaggaaatggaaataat

SEQ ID NO: 33497 - DNA, 201 bp, Bos taurus
gtctaacacaggcacttctgccctagtggagaacagtgctggggcaaatggaactgcagtggacacccagggcaggccaggttcatgctggaacagtcccygcaagccagtcagaacccgggctgtttccagtctactgcatctgtgtgctcactgtcaacagctatcctcactttgttcagaggcaggcccagatccaag

SEQ ID NO: 33498 - DNA, 201 bp, Bos taurus
tgcattatgggggatgtaaaatgaatcagatggtggattctgccctcaaagaacttaaagggctatgaactatcaattctcattatgagggttcagagaargtgaaatgacttctggctgagattaatttgagaaagtgtgtggaactgggtgtggagaaaagcaaacagctccttccctgtagcagaagcacacagagca

SEQ ID NO: 33499 - DNA, 201 bp, Bos taurus
atggctatcattgaagagcctacagataacaaatgctggagaggatgtagagaaaaaggaaccctcctacgctgttggcagaaatgtaaattagcgcagcygctatagaaaactgtatactcctaagtcgcttcatttgtgtccaactctgtgcgaccccatagaaagcacagcccaacaggctcctctgtccctgggatt

SEQ ID NO: 33500 - DNA, 201 bp, Bos taurus
cacagagtggacttgctggatcactgttgttgttcagtcactcagacgtgtccaactccttgcaaccccatggattgcagtcaggctttcatccttcactrtctccaggagtttgcacaaaccctcaacatgtccattgagtcagtgatgccatccaaccatctcatcctctgtcgtccccttcccctcctgctctcaata

SEQ ID NO: 33501 - DNA, 201 bp, Bos taurus
gcttgaacattttaaactcccctctgcatactcatagtgacacagtcttgaaaacctcagctcaaggcacgacaaactttaaagcgcttcccagtttttayagggtgtcactctctatccaactctaaaagatctaacgacacagaaatgcttccacatcaagatgtttcacaagatactttataaatgaatctggattcc

SEQ ID NO: 33502 - DNA, 201 bp, Bos taurus
catggctggcctcacctctgacctcctcgtgtgtatggatgcagtatggacacacgcacaccataaataccctctgtagtgctgtagtgtccagtggagcrccaagggtaatttccaggccaaaatgtatgaactactttgggcatcttctggtttcttcctgaagtactccctctcttgctaagtgttcactgatcccct

SEQ ID NO: 33503 - DNA, 201 bp, Bos taurus
gatgatgtggggaataacgaggaaatcatccaggatagagagaaaaagacaagtgtatgatgagaagtccttggggaataatgcccacattacacactcayattttgagtatgctttcccactgccttgcagcctccattgtttctgctgagaagttagttattaatcttcttggagttctcttgtacatggtgattcatt

SEQ ID NO: 33504 - DNA, 201 bp, Bos taurus
agcccagtgggatgcagtgcctagggttgcaaagagctggacatgaatgaatgacttcactttcactggagacacagctccatcacaggccacaaactcascagtcttgagtgaggaaacagaggataatttaacaagatgtacattcagttcaggtcagttgctcagtcatgtctgactcttttgacctcatggactgca

SEQ ID NO: 33505 - DNA, 201 bp, Bos taurus
tgaatggaaatcagaattattgggccatatatcctcaaaggcagaaggagtgccattattaaaagactcttctccatactgtggactttaggcaagctcargttatgattaaagtcatatgcattatgtgcgttaagtggaggaggccaccagggtaaaatcggcaagcatgcagcaggccaagttcactcagtgctcaca

SEQ ID NO: 33506 - DNA, 201 bp, Bos taurus
catagagactgaaagttgaggggacgattcatgcagggcaatgtcaaatgcactcgcctgacacgggctagagaggagtcctcagcatgcccagctatgaygaggccaattagaagacttcagatcaagcaatgcttaagccacagtcagtcctcaggagtgaggacctggattgtgactgtggagagagcaaagaggaag

SEQ ID NO: 33507 - DNA, 201 bp, Bos taurus
atgagctagatgccacccagatgtagaccaggcctcagacctagagctggatttgggtggaactctgtgtctgagggcgtccaggcagacaacaggcatcrcggacaggccccatctgggtgtatttggggaagccatcccaccaggctggctctgtgtggtgggtttgggtgggagattggcctgagctgaatggccttt

SEQ ID NO: 33508 - DNA, 201 bp, Bos taurus
atgaggcaatgtcctttgccaggttctggccacactcctgggtggacagtcctggtggctggtccacgctgaccctgcgggcctctgagggaggggtctcygctctccagggagggcgctatgattatgaaactccgcacctgaagccagcctggggtctcttctgtctgaggtttttatgaggccatgatcactgaggcc

SEQ ID NO: 33509 - DNA, 201 bp, Bos taurus
cggtacaactcagcgagaaagaggaaggatttgctgatggagatcatggagtcctgactgttgacggaccttccacacacacgtactgttcactccagagrtagacggcctggagtgtgggctctagagctaacagtttgtgctgttccttctgccctggcctgctctgtctccttggccaggttacctggcctctctgtg

SEQ ID NO: 33510 - DNA, 201 bp, Bos taurus
tttcttctctctccatggccacatgcccagagaggagggtgtaatataagaagcagagaaaaagatttgagatgggaagaaatcgcgtgaagggagcatcyggccaagatgcgggtccagacagcaagggaaatgggtgccagtgttcacggtgggggcacctgctgcaatctctcctgtggtcgggctgcaggttctctg

SEQ ID NO: 33511 - DNA, 201 bp, Bos taurus
aggccccacgggtgctgatgaacagtccacattgaaagaccccgggacaaagatgcccgggaggaacctgctgtgagctgtcccacgggaaccgcagcctycccctcaccggggccttctgcagctcctgcttccactgagtcctgtggaagggctgaggctcaggaggctgtggccgggcttccgggatccgacgcaggg

SEQ ID NO: 33512 - DNA, 201 bp, Bos taurus
gcattcataataaaatttgagatgagaaatttgatcatttgagatggccatgggaatggattcaattatagctaaaaatctactaaatatctactacatayctatgtttttaaaaatgtgttataactgaatgtttctttgggtaaagcaactagattgtcctgtccacaggctgtgagcacagtgagaccagggcaaagt

SEQ ID NO: 33513 - DNA, 201 bp, Bos taurus
agagtaacctccaagaagggaggaagatgaaactgtcacctctgaacagatccactctgttaagcctgtgtctgtggatgaagcataaacagaggtccccrtgctggtacacaagcctcactgcctaagaagcgacatattcaaatgtccgcgttaactatctctgtcaaaatttgtgtattgctcagtcaatcctaaagg

SEQ ID NO: 33514 - DNA, 201 bp, Bos taurus
aagtaatttaactacaaatgtgtttaattaaagtacttcctccctccccccctcaactactgatcagtctcgattcctggcctcctgggcgctcagtctgrctcaccctaacccaggctgaatccacttccttctccagtcactgatcagagccgccaggtgtgcacgcttacgacaggcccctctgcttcccgcagaggc

SEQ ID NO: 33515 - DNA, 201 bp, Bos taurus
cttggttccccgacgagggactgaacccacacccacagcagtggatgcgcacagtcccaaccactggagcaccagggcattacctatcacagaattttaarggaaacggacagcccgcggcttgagaatctattaagagcgccaagtctaaccactgacgtgcttacctaccatgagttcatctatagtcgctgcaccttc

SEQ ID NO: 33516 - DNA, 201 bp, Bos taurus
tttgtgaagtctcttatctacttttatatcctttagccacacttgacatttttctttagaaagaccccacacaagttcttgttacggttatcatctgttgyattagtcagggtccaatcagagaagcagagccagtggaggtgcatgttaaaaaatctgttgtaaaaaattggctaatggaatttgggaagccggtccaaa

SEQ ID NO: 33517 - DNA, 201 bp, Bos taurus
gaacccttcattcccgtctccagggtaggaagcatctttgacaaccacacgaggacacgacattgtcatctggtttttcaaacattaaggccttgtcctcmctctcaggtcattttgcaatatgatagtcctctttgtcttcagacaggtcttcctttgagaccccacactctccagggccctgcaggactgcgctcggcc

SEQ ID NO: 33518 - DNA, 201 bp, Bos taurus
aaaattctgcatgtcttacaataaacaaaactaaaagcatagaaactgggaaagtgtataaatatttaatgtaaccagaaaagtgaaataaatccaaaccrctttttaaggtatcaaatttggaggtgacctttaagctgggacttgagagataagtaggtgttggtcaagcaaaagtaagggaagagtccttcaaggaga

SEQ ID NO: 33519 - DNA, 201 bp, Bos taurus
tgttttaaaatgtcccgttctgtctaaattgaaacattgtttccttattcaactgaaagtttccccacccctctttcacctaaggaagctgggcctactgygttttgataaactcctggttcacattcctgggtgccgcccctcactctggctcctccaggtgggctggggagaggagagacaagggaagatgtggccacg

SEQ ID NO: 33520 - DNA, 201 bp, Bos taurus
agggtcttctccagtttaatcccctttaggctaggttttgagaaccagaggttctctaattctctgatctcctagcctcaagcatcctaccagggcctatraaatcctcttcctcctcaggcacactcatctgcgcgccgtccatgcagcaggcatgtacacctttgggccgtggcattggcttcggacagagctctgcaa

SEQ ID NO: 33521 - DNA, 201 bp, Bos taurus
tctaggtgggaaccccaaagcactctgcccaggggctctaatagaaggccctaggtccagcctctctctctgtcacaccagccttgacccctctacccccrccccaagcccctgtgcttctgtggcctcctcctcccggaccggtgatcaagaagcttctctatttcggtctccttgcgctcacctcagacaccccagggg

SEQ ID NO: 33522 - DNA, 201 bp, Bos taurus
agcctgaagatgactctgtcagtcccaaaacaggactgtctgctccagcgtggggtcattcctggatgtgactatatttggatgtccctctgcacaacagytcagctggtagagaatccacctgcaatgcaggagatcctggtttgatttctgggttgggaagatctactggagaagggataggctacccactccagtatt

SEQ ID NO: 33523 - DNA, 201 bp, Bos taurus
tggttagtatgtcattagactgggtatttttttatgcactctaaataaacatggggacaagagaaacaaccacagatttggcctgaagggctcctggatgyactgttggctagatttgggagcacagtaccattcaccatcacaaaagccccgcttggaccagagagacaggaggccacagcggggtttccaccgtcagtt

SEQ ID NO: 33524 - DNA, 201 bp, Bos taurus
tataaagaattatgtgctttgaaccagactacatattaatctcagatacaattcaaacatcaacatttattgtacagagggttaataatttcacagccaamtggtatttgctgttgtcactgaggcattaaggtaatgctgaattactgtatttcatcactacactgatcttcattttggtatattcctaattcatgccag

SEQ ID NO: 33525 - DNA, 201 bp, Bos taurus
tctttaaagaggtaattaagttaaaatgtggtgtcatgttggatttcccctgtgcgtcagcctttaaagaattccttggccaatgcaggaggtgggtcccmtctctgggtcaggaccatcctgtggagtaggaaatggcaacccactccactattcttgcttggagaattccatggccagaagagcctggaatgctacagt

SEQ ID NO: 33526 - DNA, 201 bp, Bos taurus
tgtgtttctctgagtcatcccacagtggaattgagttccttttcataaactgagttctgctagatgacctgctttagatgtggagaaggccctcaaggaasgtgtgagatgcagggaatttctcctttctctgatcctcctctacatagagtccaaaccagacagtgaacatttgcatttgaaagtaaaggaagtatgtgg

SEQ ID NO: 33527 - DNA, 201 bp, Bos taurus
ggacagaagagcctggtaggctacagtccatggggtctcaaagagtcgggcacgactgaacgatttcacttttcactttcagacatggccatgaggataaytgcacaataaaaattcaaccatggggcaaagcttatgcaatagacagactgaacaagaaagttgtattcacaacacagagtactaaccactatactatca

SEQ ID NO: 33528 - DNA, 201 bp, Bos taurus
ccattaacttacaggagtctcccacatttttttctacttacagtcccagagtgggattacctgtttgatcacttactttgtcctttgctctgtccctgtckaaaccagccttcttgcatgaccattcactatcttatcttgcaaaacatatactgggagtgctgaaacattatggaaattatgtagttgttaatgaaactc

SEQ ID NO: 33529 - DNA, 201 bp, Bos taurus
tctcttcatgtggtgttgatttctcagtgtgtaactcggccctcaaggaatagaaaatattttataaactgtatcattaagtcagtctaagctcccaaaaraggattatctaaaagggtctctgggggtaaatgttttattattttacgtaattggaatttaaggtggctcaaatggtaaagaatttgcctgcaatgcagg

SEQ ID NO: 33530 - DNA, 201 bp, Bos taurus
tggcactgtaatgacatctgtaactgcctgtgaaaaggtaacacaactcacaggttaaatttgagcacaaacaaattcaaatgagtaatgttttgcacagrgaacaacaaacagttttctgcaaatgtgtgctatttctagagaggtggaagagacaggcgttgaatatttcttttgccatctatattaggttatggtcca

SEQ ID NO: 33531 - DNA, 201 bp, Bos taurus
acctgttggtgagactggccaggaggtttgactccagagtgcatgctcttttcattattttactctaactcacatggcttgtagggtgttgctccaccctkccctgggccacacagatatctctaagtcctggcatctaatttaagtaacagagatttttaaatcttgcattgtctgaatctttttctggcaataaaaata

SEQ ID NO: 33532 - DNA, 201 bp, Bos taurus
aagggctatagaggaaatatataaaggaatggaaaaggagaatgccaatgggagaaacccaaacaagacttccatacactagttcagaaccagagaccctmgtttgatttgatgctctttaagtgagttgcagaggttttggagaagccttcatgaatgccagatgaaatcacctgtgccttacaacacttcctagtccag

SEQ ID NO: 33533 - DNA, 201 bp, Bos taurus
cagaaatcagagatattttaagagcttaaaaagccaggctgacccacctttagacactgggtataattgaagacaatttcagcttccattaagagttctgytatatgcaggccctgtcaaaatctaggataagccttatgtcactgcagaaaaagcagcaattcatctgtatttgtttcaacttaacactggctggtggag

SEQ ID NO: 33534 - DNA, 201 bp, Bos taurus
tctcagaccatagagagagccccaaagaatgcaagtgtctagggctgtcctcaatagaccttcacaccagcacatcacaggaatagtcacactcatttgcycttgtcccagacttagaagagataagattcattaaaacaaagactactccgtgttctaatgactactaaagcaaaatgagtctctccaaaacttattttg

SEQ ID NO: 33535 - DNA, 201 bp, Bos taurus
aaatgaaattgaaattgagcgatgcccccttttcctccttttttgtaggcaagaccctagcctccatgaccttccctgagtccccaaaggcagatgcaaayagttgcttaaacaagggccaagaaaccacctgaggcgagattaaagggaccagagaatctcaagattaggagaccacattaagccttggagataccataa

SEQ ID NO: 33536 - DNA, 201 bp, Bos taurus
tggtaaacctttcagatattagatagttaagaaagtagtaacataaatatgctttgattcagatttgtcaggggtacttgaactagtagaatatatttccraaaaattattggatcctaacaccaaaaaactgaatatatagtcttaaatgttcttgaaaagatttattttctccattaattaatggctaattttttcata

SEQ ID NO: 33537 - DNA, 201 bp, Bos taurus
ctccttgaagtaaatccacaataaaaactggctaacaggaaaaagcccacagaagactcttacgtgaagcactgaaatgccagatctcaaacgctatatcsaagaaggaataagacagatgttaaaatcgtggaggacataatgatgaagagttatgtagcaatcaatttactgtgaacatgcaaatgggcactttaagtt

SEQ ID NO: 33538 - DNA, 201 bp, Bos taurus
gtgggtacaggccttcaaagccctacttgatctagaaatcttttagacccactgtaatagaagggataaggtaccattggcctgctatggggagagccacrgtcttcccctcagcccttcctgtgacgacagccctcccctcacaggtctgagggccagtgtggagatctgaccagctgcctattctggttgggcaagcct

SEQ ID NO: 33539 - DNA, 201 bp, Bos taurus
ctaaaagccaatgatcaaggccctgattgttcctatgcatctaaaaagaggagaggaaagggaaaagacagaaaataaagagaaacccatttttccctttraagcatttcatttcctataggcctgatggttaagacatgatctgagctcaggattgctatctttttttattttcctctatcactgccttgatacatcttt

SEQ ID NO: 33540 - DNA, 201 bp, Bos taurus
ttgctgcgtcttcacctgggggaagggtgaatgagtgctctgctgcctttttcataagggcactagtcccattcatacacactgcacacttatgacctcaycacctccaaaggcctcacctccaaacaccatcatactgggggttgggtttcgacatttgaattttggaggatgccaaaattcaatccacagcagtgaggc

SEQ ID NO: 33541 - DNA, 201 bp, Bos taurus
tgggccacagtccatggggtcacaaagagtcagatatgactttgcaaataaacaacaataagattctttaaaaacacctgacaggttaggaaagagatcaraggaaaagagcattaaggcccctccatgtggcttctctacgggacctttgcccctcctggcctggggactgagtgctcacagggaagctcagagctctga

SEQ ID NO: 33542 - DNA, 201 bp, Bos taurus
cagtatctcattgtgcttaactcaactgggtaacttccctagaaacagttgcagaaagtaaaggggagtatttctgtcagttgccagcatccttctcttakattgtaaccttcttttcactgaaaataaatagtaagatctctcttttttttttttttaagtttgtttccctttgtcctctgtcttcaacaataaaagtta

SEQ ID NO: 33543 - DNA, 201 bp, Bos taurus
ctgctaagccatcagggaagccgataggttcaagcatccgaaagagctgggaggcttacatatccctgtgatatataaaaagggggaacatccagagaaaygaaactgaatttctgtacagcaatctatgcattcacagtgacataaaattccacagtgactcaggatcagttcagttcagtcactcagtcatgtccgact

SEQ ID NO: 33544 - DNA, 201 bp, Bos taurus
tgctcgtaacagtacaaatacacattcctattttcctaataataaaaaaccgcgtcctctgactgtgaaaaggagaggacagatgaaaggttttgttacamctggtggaccttggctgctggtttcaaatgcacttattccctcctgtgactggagttaagaccccttgaaggtcacctccgccaagcccagactctgtct

SEQ ID NO: 33545 - DNA, 201 bp, Bos taurus
gcctggatttctgttgatcttttttgacaaagaatcattaactgtgatgtatagtattttatatggaatttgtagtaatttctttgtagatgaatgataayccagaattcaacaaagtagaaaaaaggaattacttctcaatttgttggcatttagttaatagggctaacgatcgagtagtacgtttgctttaactataat

SEQ ID NO: 33546 - DNA, 201 bp, Bos taurus
aagtcttgtccagtagaggagctcagctttcaacccagaaagactggccagtctcttaaccgtggacccagagttccaccaggttctgccaacagatggayggcttgaccatcttgccgggggcctgattctcctcccagtagcagacagtgatttttgaacatgagcaattcaaaaatcactttgtgaaagacagtcatg

SEQ ID NO: 33547 - DNA, 201 bp, Bos taurus
gtgaagtcaagtgggccttaggaagcatcactccgaacaaagctagtggaggtgatggaattctagctgagctacgtcaaatcctaaaagataatgctgtkaaagtgccgcggtccatggggcctgtcttagggacttctgaacaacagtaaccacgcgaacagtagacggcaatagagttcaacagtaatgagagaggct

SEQ ID NO: 33548 - DNA, 201 bp, Bos taurus
ccctgaatcagcctgtgacatttcctgaactttctgggtcaaaagatgagcttcttggaggtcaacagctgaaacaaatctcccagccccactccggcccraggaccccagacccatatggaggacggagaacctgaccaaggggggtcatctgctaggtgaccagctgtctgtatccaccatgtcaaatggccaaaggct

SEQ ID NO: 33549 - DNA, 201 bp, Bos taurus
acccgagcactatgggaggaggttggccctgcccagcgaaggccacgttcagagtgcctcaccacctcagcagggatccactggcccaaagtaaagtcacrtgcactctggtatgagctctgaatcatgtgaccaacatataagcacaagcctgcccagggcaacggtgctgaggatccctgggcctgggtaggaggacac

SEQ ID NO: 33550 - DNA, 201 bp, Bos taurus
taggctggcaaatgtggccaagctgagcagctagccatgtgcctagaaagaggaggatagattctgacaggattaggcaagacaagaatccttgcccccartggccaattaaacaataatcagctctcatctagttatttactctgcattgcaggcagattctttaccatatgagccaccaaggaagcccatttactctgc

SEQ ID NO: 33551 - DNA, 201 bp, Bos taurus
gggcctctctgatgagacaatttacagagagctaactgaagcaaggtggggagccctgtaagctcctgggggtgcattccaggcaagagaaacagtgagtrcaaaggccctaaggcagaaaggaatgggaattaccactggggctggccaatgagaagacgtgacatagctatggtttctcatgaaaaggaagtgaaagtg

SEQ ID NO: 33552 - DNA, 201 bp, Bos taurus
cgccatgaaagtagcctcacttcaattttctgagtggaatttccttctgggaccttcttgaatttttctgctcaaggttatcttcctaaacacccgggccwgaggttttggagccatccctttgcttacccctcagcgggctaaaaggaaattcagaaagtcacagcagggttcatcagatggtcaggccatgggttcaca

SEQ ID NO: 33553 - DNA, 201 bp, Bos taurus
agctctagctccgcgtccaactctaagagcaatcgatgctgaaacagtcccccaaaggcagcacggaaggggcagaactgagagtggccttgaaaggcccrggaaggttgaaatgggctgtgatgaagaaagtcaacttcctggaggaagttactaagagcaggagtcaggctcaggggccaaagcagaaatgaagaacac

SEQ ID NO: 33554 - DNA, 201 bp, Bos taurus
ccttcttgccgaatacagtgcctagcacagattcacattcccagagggagttatcaagagcatcctgattccaaaagagctctgacttggggaagaaaaartacagtgtttgtccttagtggccagttctgcccaaaccacccctggggtgcagggcagagaggcgcaacagaaaaaaagacagctctcacagggggagct

SEQ ID NO: 33555 - DNA, 201 bp, Bos taurus
caccagagaaaccctgcgtcaaggccccacaccccccctccacccagattgccttcctgctcctggggaagctcactcacttttccgtttgtgttcttacraggccgtgggatcctctcctgaaaggcatcttcaaagaagtcaggatgaaagaaacccaccccttccagccatctgggattaggcaggctgaagcgtgca

SEQ ID NO: 33556 - DNA, 201 bp, Bos taurus
tcaggcctgattggcaggagagtatttccaggggttgtactgaaaagaggacctttatggttcagaacatccactttttgagacaggtttgaaaccgtgcrtggcctgctcctcaccgcagctctctgtcgggaggacgtcacgcctcccgcgcacgcttctgaaagccttggtccttgtgcttcggtccccacggtgacg

SEQ ID NO: 33557 - DNA, 201 bp, Bos taurus
gcctattgctgcacgtctcaaagatgaaaataaatgatgctttcaaagtgcctacggccccctcccgggtagtgatataagtgaaaaactaagcaactgtyagtctcggaaaagctttttaagttaggaaaagtaattttaaaatcatgaaactaagtgacatgaagattatggaaaaacctacacagtttttagttctgg

SEQ ID NO: 33558 - DNA, 201 bp, Bos taurus
ccaaattgtttcaacacagtaaacacacacacacaaaattatgtaaatgtgaagcctgtgaacaccatgataatttacttcaacttactcttttttcctaygaccgtggaaaaaactggcccattcaaagcaagtctttttacttccaacccaaaaaatggaaggaataccaactatgagagccatcaggtatttcatcag

SEQ ID NO: 33559 - DNA, 201 bp, Bos taurus
aaacaccttctttatcaggctctcacactccaggccaccatccatcggcaccaaaacctccaacacaacatagcagaaagtagggacctatgctctgcccyagggcctgctgaaatatttatttagccactcctaaaccttgttagatagcatcactgacacaatggacgtgaatctgagcaaactctgagagatagtgaa

SEQ ID NO: 33560 - DNA, 201 bp, Bos taurus
cctcgacgggcacctctccctgctgtaacaaccaaaactgtctccagacgctgcaaagtcttgggggtgggtggaggggtgggagtcgtcatgactggtcrcaagccatggtctcaggccaaaaagcaaaacaatcaaacacaaagctatgtagacctgaacaggaaataaagtattgagttggccaaaaagttcacttgg

SEQ ID NO: 33561 - DNA, 201 bp, Bos taurus
aatggctcaggatgactctgcttgttctttgacacatggcatggggtttggggcctgagccttcacagcgcctgctccttcccttcttccttggcctccamaacctccttccacagaaacagagtcttctattcctcacctgtcttcagtctccatccttcacctggcccgccacctatttgaaccattcaacttttgctc

SEQ ID NO: 33562 - DNA, 201 bp, Bos taurus
tcaaggtggaagaatgtcacattaagtgaaataaatccctaagtttgttctgacaaagaatccagttatcccaatgaagacccatgtaactttcttacctrgtcttttcattcgggaaaacataagtcttgctttacatcaatgaaaaaccatggtgatatgtgtttgaactttaaaagcaatgtctactagtttacattc

SEQ ID NO: 33563 - DNA, 201 bp, Bos taurus
taggcattttaataatggccaccctgaacccgtgtgaaggtggaacctcattgtagctttgattttcatttctctaatagtgctgtccatcatctttccaygtgcctgttggccacttgtattgatttggagaaatgtcggtctgtttaggtcttctgatcatttttctattgggtttgtttttgttattgttgagttgta

SEQ ID NO: 33564 - DNA, 201 bp, Bos taurus
acagactctgtttcccttcgtatatttcacactccagccaaagcaaatatctgctgttttctaccttgtgcctttgcttctattgttccctctgccctcartgttatactcctgctcagtcatcacatgtctggatccaagctaaggctgagggttgacacagtagttttaatagtaagatctgctactactgctgctgct

SEQ ID NO: 33565 - DNA, 201 bp, Bos taurus
ctagactgttgaatttagtggtataaccatgctccaaatattcctcactgtctgtaggatctatagtgcaacctctctttcattcctaaaactcttcatcrgtttaactaagagtttatcgattttatttatatttcaaagaatcgacttttgaccatgttgattttccttattgtttgtttcttattatattgattttga

SEQ ID NO: 33566 - DNA, 201 bp, Bos taurus
gactgaacaacaacagcaaagaaataggcgtgggtgccaaggtgatgagggacgcacttgtgatggttcattttagggtcaagctacctgggccgtgggayacccaggtatttagccaaacattattctgggtgtgtgcacagggtgtttgtggacgaaattaacatttaaatcagtaccaagtaaagcggattgtcctcc

SEQ ID NO: 33567 - DNA, 201 bp, Bos taurus
gcaactgtaaccaggaacccggggccagccacagttctctacccctgggccaattgttctgtgtaatcccaggaggcctccacagttacctggagggcagkggttatttcccccacagcaggaaatctgccaggggtagctttcatcagaaaagtgccctgtgaccaagaaggcctagaggggagaagaccacatcctagt

SEQ ID NO: 33568 - DNA, 201 bp, Bos taurus
tgttcaggcctcctctgtacctcctcccatcttctctagctcctagcaggtaactctgatttttactaaagcctacctttacaactctaacttctcttatktcactcagggcctccagagatgtaaagtatcttcagttgttttccagtgctgaattaacagagttttaaaaatgcttgcagctcattagggttcattagg

SEQ ID NO: 33569 - DNA, 201 bp, Bos taurus
tgtgtttataggcaatagagggctgtaaggaagctgctcagctcttagctaaggtgggaggaggcaccaagaggttcagtttggagaggaaaggccttcartactaggcttcaggaagattcatcatcgagaggtgtgaaaagaagcctgtgcatgaagaagccaggcatggggagggtctccacccacctctcccagctc

SEQ ID NO: 33570 - DNA, 201 bp, Bos taurus
tatcgagaataagctagtggttaccagtgaggaacgaggagtgagggaggggcaatataggtaggagattaaaaaaaggtattaatagattatatgaaatmatgtgtgtgaaagtttaaagcactaaataatttaaataatctttcattctattaaaaaacaaaataaagtgaatgtacctcaaaaggagggaagcttatt

SEQ ID NO: 33571 - DNA, 201 bp, Bos taurus
aaacctagggcctgttatacagagtgaaataagttagaaagagaaaaaaactcatatactaatgcctatttatggaatctggaaaaatggtagtgatgaayaaggccagctttgaattgagaactcttggtctccttgtatttccaagatgtgactcatatcccagctcccttctcttcgcaccctaggctatgtcttgtg

SEQ ID NO: 33572 - DNA, 201 bp, Bos taurus
agagtggtgcaggatgtaggccagtgactgaagaggctaatgaattgattcttccagaactggacagtaggcagtattctttattttacaattccctcccktccagtcttaattttggccgaggttttggaggcattttgtgactgatttgttccatggtgctaagaaagctcattaccaggtggaacatggatttcttgg

SEQ ID NO: 33573 - DNA, 201 bp, Bos taurus
cttgtttaaatacttcttgatatagacactcattaatgatattcctctttcctcaagcacctgttcctggtaaaaacaagggctatattgatttgctgcartttatcttctcccaggatttttgtcttgacagtgtgagaagattaattggaattaatggcatttgcacagctaattaaagtcactcttcctaaagtcaaa

SEQ ID NO: 33574 - DNA, 201 bp, Bos taurus
acaaaaataagccttcagtaaatgtattggctcatcaaaccatttatgttggattttttcctggaatataataagaagttatgaagatgatttattgctcrtgtaattcaaattgttgtcattcaaactttaggttatgaatattgtttcattaattttagtgctaatgttgtctgaatagctgccatgttatgtttttga

SEQ ID NO: 33575 - DNA, 201 bp, Bos taurus
ttcttttcagttagtaaacatttaacagtaagtgcattttatgaaacatgcacaagaatcttgaatgaacttgatgaaatttcttccacatcaaccatttmcacagagcttctgaatattctgggaatttataggcattcaacccatgcctgaatttattgtgtgttcaatgcgatttgtgtgaattcattaggggttttg

SEQ ID NO: 33576 - DNA, 201 bp, Bos taurus
tgcaggcagcatcagaaaatccacagaggagtctggctttgggggccattggtagcattggagacttgactgtataatgcccagcgtcagccctgtgaacygcagagcagtgtccaacataagggccaggagttcattgttggagcagcctcagacctaactgtgatcctactgatcacagtctgagagcatttatgtatc

SEQ ID NO: 33577 - DNA, 201 bp, Bos taurus
cacagccacctccatttattatttgttgtctaagcctgctttcatgatacaaatggcaggattgcatagttgtgacaaagactatagtcctacaaagccaratgttgatatctaaccctttataacaaatagttcgctgattcataatctaagatagcactatctattagagtatagtgtgagtctttaagtgggtttatg

SEQ ID NO: 33578 - DNA, 201 bp, Bos taurus
tcagccagggactcctcggcatcttaaaggatgcccctaacaaatcctcatatagattctatggaaaagatatggttgtaattctaattcttaagtttgarcatgaggcctgttcttcttttcacagcatgtaaggaggttgctcatagttgaataaaataaaaatgaaataaaattatgtgtcatcttagttcgcaacgc

SEQ ID NO: 33579 - DNA, 201 bp, Bos taurus
cagctgtcatctttagttatataagagctcgtcttttgcctttgggtgtgaggcatgggttagttagcttgccactgctacatttgctgctggcgcaagckcatcctggggcaaaggccacaccttgatatttaagcaaattcaagcctttgactgtgtggatcacaataaactgtggaaaattctgaaagagatgggagt

SEQ ID NO: 33580 - DNA, 201 bp, Bos taurus
gcaacaccttacacatgaagatatgatttaaacagatacctacatggccggattttccatatatttaactattattcacgctggactctctaaagtggccytcattgaatagtttttttttttttttttttaactccaacctaattctgcatgcatgaatagatgatgatgatgtgatgatggttgacacattaccttgac

SEQ ID NO: 33581 - DNA, 201 bp, Bos taurus
ttatggcttatgcagatttttactttatgaataatgctgctaacgatacatgtcttgtggtgcatgcatggattaatttctctagggaatacacttagccrtataattgcaagatcatggtatatgcctactgcatgggaatgaagttttgattctaacaatctgcaagttattgtacaccctgtttgttaatggcatgga

SEQ ID NO: 33582 - DNA, 201 bp, Bos taurus
ctgcagtttctagattctttcctcctttccttataatttgctgcatttatattactttctagaatttctatactttctgcatttatataaccacctagaaktgaggttttgttcactttaaattagagcatgtaaattacatcacttattatgcatatgctataattatattatgaatacagtcttgcaaatgatataaaa

SEQ ID NO: 33583 - DNA, 201 bp, Bos taurus
ttctcgtgattcaacaacaacctttcactctgaggtatgttttgtgactccagattccacaacaccatcatttgaccgctaacaaattataaaaaagaccycttaataggcctaaaaggaacacacaatagaacaacctagaaaggcagaatgtttacatctcaaagacacaaagaaatgtaagtttcccccaggaggtct

SEQ ID NO: 33584 - DNA, 201 bp, Bos taurus
aattttttaaatataaaggttaggtgctttccaacttctgtttaggatgttagcaagcaagaaagagcattactcccacatctataacaacaaccacagcrttcaactcactatataatctaaaatgtcacagcttttccagaactcattagattcatggttacaggacaaccaactcaaccaaaatccaaggatgacaag

SEQ ID NO: 33585 - DNA, 201 bp, Bos taurus
taactttgttctacttgatttgggaagtatgttgatgtttcaagttattggtttaatggaaatacatttgatgttcatcatgactattcataagcacaagygcaggaaaataaataagatctctggcctgggcagttgttgttgagacattattatcccatggctccaaacccatgtactctgaacttcactgaatgtgac

SEQ ID NO: 33586 - DNA, 201 bp, Bos taurus
gactctttctggagagaggtcattatctgatgtctttggtcatttgctacgttagaagtttagatcaatttcatctgattctttctgtttaccctttcttkagggttatttttggggttctctcagaaccctcacagcctgtccttgtaacattgtagtatctaagattgctatactgtctgatatttatgttttttgtga

SEQ ID NO: 33587 - DNA, 201 bp, Bos taurus
ctgattagcccgttttccttagttatgaccagacaaaaaactcactgtaacaggctaccagtgaggtggacactcagctgttggcctggttcagtgtctgmtggctttgctcatgctagtcttcttcttcatgcccgcactgggcagcacccattctgcctgcagtgactggccttttgagacaccttggaccattttgct

SEQ ID NO: 33588 - DNA, 201 bp, Bos taurus
ctgcattggcaggagaatattttcaccactgtgccacctgggaagccccaaagactgcagcaaaagtgttggctggcctgagctcttaatctggaggctcrgttggggtagatctacatctatgctcactcagttggctgacagagtcattttcttgtagttgttggactgagggccctggctttttgctggctgtaactg

SEQ ID NO: 33589 - DNA, 201 bp, Bos taurus
gtcatatttttagatatgatcataagaaaatgacttgtgatattccaggatcacctccctactccactgaaacattaaaatatgtttcaattaactaaacrgtagattttatttgatagctttcacattccatatatatttgtaattattcgataaacactttagacattaaaaaatattttaagtgacttaatgatataa

SEQ ID NO: 33590 - DNA, 201 bp, Bos taurus
cctacaaaatttttactgataggatgtgggtttgactctcatgtgagattcagtggtgaaggagtcagttcttggtgaacacacgcacacagaatatttcmtcactcaaggaaactcagaatatatctattgggtagaagtttctgtgtaacaaaatgattaacattcactccaagaactcatcagcaaatgcctgctgcc

SEQ ID NO: 33591 - DNA, 201 bp, Bos taurus
accaaagactcaaggcagttacaacatctctgtgtttcaggagtctcacttcacagatttactttaagaatgaaattgctcacagtggtgaagatctttgmagtttgcaaagcacgtctgcattatgcatttgcagaaatgaatctgaaaaggtcaaagatagttgaagtctttgagcccagacttaggagtttgaaatag

SEQ ID NO: 33592 - DNA, 201 bp, Bos taurus
gaccccgaatccatccagcagtcagccaacagtaacccatgggggccactggggttctgtagtcagcttcccatgaccaagtggtaccaaccagtagccartagccttcacacacggcagggcctagcaacaaaccaaaccaggaataagtcaagcctaccagactgctgacatagtctgctcaccacaacaggactcaga

SEQ ID NO: 33593 - DNA, 201 bp, Bos taurus
ccttggcatttctttatttctctcacactatttgttctgagctaagcaagttgccagctgtgagaagccctatagagaggttcactgttatggtggagaamcagggccctcggtccaataaccgaaactaaggcttgacaacaaccatatgagttgcttgggagtgaactttcagcttccgttaagtctggcaatgacagt

SEQ ID NO: 33594 - DNA, 201 bp, Bos taurus
aatttctagaaaaaagaaccaaagcaaggaaatgactacagatttattcataatgaaattaagaaaaggatttcttaaacttgtactagaaagtaaaatgmatggatttggatattaaagtgccattagcacttgacaactgataaaatcaacccttttattaaacaccttctaaatccaagtactagtgagctagataac

SEQ ID NO: 33595 - DNA, 201 bp, Bos taurus
actctttgctttctgtggcctcgtctttttctggccctccctggcttaactttctcccaatttccttcagttgccctcctcttcccatgctgctgctgctkcttccctcactcaggccagccagagacccttttagacagcagtatggctccaggatcttgtgtcataggatgttgcagatttgccatctagtaatggccc

SEQ ID NO: 33596 - DNA, 201 bp, Bos taurus
gcgagaatgttcagaaatgactcaaaccttaagtaaaagcctctactagatggtttttaaaattttgttggccattatgaatccatatcaagtttttttaratgtattttagggtttttgccttcttattggagcatagcatttttatgcacatataccttcacatccaattagtagctctaatcagaacagacaggtaaa

SEQ ID NO: 33597 - DNA, 201 bp, Bos taurus
ttgcagcctagagaagtaggtgtatccagcttccaacctcattttaaagcaaagcatctcccctttcatcaggctaatgcacaacatggtgcttcagaacrgttcccaggactggtgcagtttgacaatcactgattcagagttacatttgtgtattttctctgggtttgacttattcacgatatcccatcactcataaat

SEQ ID NO: 33598 - DNA, 201 bp, Bos taurus
tttctgggggcccggcagcccactgggtaaactataaaatcttcgctgctaactccttacactaactttacggagcccgtttttgagcaaaggggatagarcaagaaggccccgcccctcctctcgccggcctcctgcgtttacgtaatcgtatttcgaaaacgccaagacgtacctacggcgtcccacgaggaaatgcta

SEQ ID NO: 33599 - DNA, 201 bp, Bos taurus
ttccagggtggttcttgtattgttaatggctgagttaagttttcatgaactgaggtatatggtccctgtcactgtatgtctcagagtcccaggctagcccytcactaaggtgtggatgtagtttactggctggtcccctggtgagcccaatgcctggatgtgagtgcctgcagacaaagccccaggtgtgtgggatcctga

SEQ ID NO: 33600 - DNA, 201 bp, Bos taurus
tccatagggtcacaaagagtcacacctgagcttaccatacatatcaggcagttacctgttgactttacccacttctcacaggccagcattagagtaatttygttgctaatagcttcaattccttgccccaccccgccctgagagagaaggaacacacacttgattccccagcctggcccccattttcccctgcagcacagt

SEQ ID NO: 33601 - DNA, 201 bp, Bos taurus
ctcacaatctcccacagtaacacaccataggaccatctgcagaagggatgaaagagaaaacagtaatcagcgcacgcgttggccagtcagcgttctgcccscaaagctggggcaactgactctaggtcagaagagggcaagttccatgtctttttcctaggattgggtcttacacagagcatgtgtttatctcccctttgg

SEQ ID NO: 33602 - DNA, 201 bp, Bos taurus
gtctttgagtagtttttttttgtttgtttgtttttaagtatctttgcatgcagagagagctccttttgtgatggatgccctggccatgatttgccttttgrtagttagatgcataagctattcccgaccgttttgggtttggcacttctgtgctacccttcctctcatgcttcatgcctagctgcatttaacttgacaggc

SEQ ID NO: 33603 - DNA, 201 bp, Bos taurus
cctgcttcgggcactgtgccgcccgtgttcctttacaaggcctggctcccagctgtttcacggtggaggcatctgacactctgataaatgaacaggccatyggatattccatccaacagagggcagtggctcactgaaactctcacatatttgctctgaaaatagattttcctgaaactttccacttaaatagctgggatt

SEQ ID NO: 33604 - DNA, 201 bp, Bos taurus
gtaacaaatatgttctcccaaaagctgtgtgcacatctgctcatattgtacatgaggaaatgttcagtgaatctttttgtaaaaggaagacttccttcttmgcataatgtgcttaattttctctctgtaggagaactctatgtcagttagaaaccagtttgtttagtcggattgactggtagatgctaagctccttgagtg

SEQ ID NO: 33605 - DNA, 201 bp, Bos taurus
aatctcctttgcccagggaaatttcctggtccccagtatgtctcagactagggctcatttttgatcaatgttttgagtattatggaagttttcctgaaagygagatgtggaaatatgaatgccttctccctgttgaaggtgtcttatttgagtggatgaatctaaactgaaaaagactgattatttctgctcactagtggg

SEQ ID NO: 33606 - DNA, 201 bp, Bos taurus
tcagatcagtcatttgtcagtaaggcatttgcagagtttaacagtgctgaatggtagctaaacccaagaaattgcattctgatgggtagttgatattattygatatcaatattgtaccatacacagtaggagcatggatatgggggtcttagccacttgttcaattttacaacattcttgaaaaacagctggggaagaaaa

SEQ ID NO: 33607 - DNA, 201 bp, Bos taurus
gcctcagtgggggacagtgggccatagagttcttagtgaagaggcacagtggaggcaaggatccaatcaaaccgtgcgtttctgatctccacgtgcaggcragggagcaaaggcatgggcctgagagcctcatcacgaaaggattgcaggctggagctacagctggggctgaggcaaagcgttattagaggaaaagagaac

SEQ ID NO: 33608 - DNA, 201 bp, Bos taurus
actcacatcccaggacgatggaggaaagacattcaggccacgtgacagtgacagtatattaataactggagccagaaacaaacttttgatactctaagccrctaaaacgttcaccttccttgtgactgcagcataactcagtgactcgtacattgtacatgtaaataaaaattttgcagggaactggtatgtgcccctttc

SEQ ID NO: 33609 - DNA, 201 bp, Bos taurus
gatgggtggtcactgctcccttaacttgaccgtgggagagctcaactgcactgcccggataccataactgctcatgcctaagtgtcatacagccttcagtrcattgtattcaacttttaagtataacatatctcaccattttttaatggattgggaaagtgaggtttggttaatagaaagagaattgatgactgtaattct

SEQ ID NO: 33610 - DNA, 201 bp, Bos taurus
gaatggagaattcagtccttccaaaatagcacttactagagcaaaagattgcaaaatacttgaccatgtgcaagaacatagttcctttacttctctgttckagtgcaaccaagccttcttcaccttctttgtgttattatctcagcaggatctctaatgagggtctagtttactgacagtcctcactaaactccaaatgtg

SEQ ID NO: 33611 - DNA, 201 bp, Bos taurus
cgttgggctcttgtgtgggctaaggatatcgagtataggttaaaggatcttagtgaaggctaagttgaaagtattaaacatgagtcaggtgagaacttgaytgggtagtgctagcttgggctctgaccaaaaaagtaataaaagtgggaggcttggagtttgtgtacagttttcagatgcagattccaagacagtttcaaa

SEQ ID NO: 33612 - DNA, 201 bp, Bos taurus
gctgaatatgtacatttgggcatcaatacatagagagtcaaagaaatctcatgggagtaaatatagacagaaaaatattgggccctgaactcctaaatatktggatatcacctaaagatgctgacgccagaaaagaaaacttagaaggagtagcttgtgggatagaacaaaattcaggagcatgagacttcgtggatgcca

SEQ ID NO: 33613 - DNA, 201 bp, Bos taurus
tgaagccataaaagtgtttatacttcttgtgtaacaaggccatctttccccagtctctcagaaaataaactttagggtcaaccttgtcatttgtttctatycttaattatcttagtgtggccagtcctataatgacaatgacagtcaaaggtactatttatcaaaactcttaatataagtcaggaactctcctaggtggta

SEQ ID NO: 33614 - DNA, 201 bp, Bos taurus
aaaaaagagaaagagagaaatgttgtacttagtagggatattatagaatttcccttataatcattaccaagataagttttcctactattacccttaatatkttccctaaaaatcacactaaatagtgtaagtctaaaaacagtagtaagaggcataagaatcaataagaaatatctttcgtttcttagatgaaagataact

SEQ ID NO: 33615 - DNA, 201 bp, Bos taurus
ctaccacaacagccactgttttataaaccacatgtagatttgagcaatctcctaggtggactaaaaaaatttacatgcctaggtctctcctgttcggcccygctgcctatgagaggcaactcatccacatttcagggtggcatcaagcagtataccatttcatcggagtccagaagtggcaggacaaagggccaagactct

SEQ ID NO: 33616 - DNA, 201 bp, Bos taurus
gaagaaagattttcctgaaacaggaaaagatgtatttaaattgaaattaaaacaaatgtgttaaaaaagtactttagcctttgatgtgttagtcactgttwaagtgtgtataaatttttatttgtataaatatgtaactaaatataaacattgggttggccaaaaagtttgttcagatttttctgcactctcatatatgca

SEQ ID NO: 33617 - DNA, 201 bp, Bos taurus
catacactaaggttcttgcttaattaccagcgtgtttctcagaagagctttctatctgccaatttactatcttggtagcatgtgaaatgggcttcccaggyggcgctagtggtaaagaacccacctgccaatccaggcgatgtaagagacatggatttgatcccagagcggggaaggaggagaccatggcaaccctatcca

SEQ ID NO: 33618 - DNA, 201 bp, Bos taurus
ttcaaaagtaacataaaaggtgatgataccagtagaaatcaactttaagatcaaatttatctaaaaaatcatcatactaattctaaacattttaaatagcrgtgtatctaaatataagtagaatctagagaaaacagcacagtaacatagattcagttcaaaaacatccaatattgtgtgaagactaggcagtcttaatat

SEQ ID NO: 33619 - DNA, 201 bp, Bos taurus
ttgtgggccctactagcaaaatgtgagcctgtaagtcacaaacattaaatgtaggaaatacctaacctgcagatgactggggaattctttaagcgcatgcraaatatgtatttacaacttgttttttgtgaggagttagacaaaacataacctgtggtggattcattttgatatttggcaaaactaatacaattatgtaaa

SEQ ID NO: 33620 - DNA, 201 bp, Bos taurus
ctcaaattttaagattatttttaaggactcaataggttaatacatataaactacttaagaacaatgcctggcagataaaaagaccatggaagtgttggctrctactatgatttttactcatataaaggcagcaaaatatgtgtcacatagtagttactaagtaaaagagagttctatctttctcatatttgggtaagaggt

SEQ ID NO: 33621 - DNA, 201 bp, Bos taurus
gtttctgcattatctatctgctactactggaagtaagctctgtgaggacagtagcattgtattactttcatactccctagagcagtgcctgacacacacartcagttctcaatgcctcactattgactaactgtcagatattgttctaagacgtttatacacactacttcatttcactccccacaggacatatgtaatttc

SEQ ID NO: 33622 - DNA, 201 bp, Bos taurus
ctgacacaatactctcaaatcccttagaaaaaagaggctcccatcaattttacttgctgcattgcttattgatttgagtatctcaaactccccctttttaytgctgtatacttagcctagcttatgcagtatgcatatataatttggtacccttacatttttcactaataatacttgatggattttttttcttatggattg

SEQ ID NO: 33623 - DNA, 201 bp, Bos taurus
agtggtcttagggaactgatctgaaggggaggcactatgctacccttcttttctcctccaactgtacaggttttcactttccttcagtctcacctcctctyagcatgaaactttactaaaggctctgaggtcttcacacaatagttttctaccagcctcaccccaagtatctgccaggcgtaataggcaagtctaattttt

SEQ ID NO: 33624 - DNA, 201 bp, Bos taurus
caattgctgtagtaaaggaagccttaagcatcttcctgctgcacctttgggtgacagatgctgatgtaggttgaatgtagaggcaggtgttctgtggcctrtttccacctttacattatttcagattctgtgttactgagtagagcagtcttcctttaaaattttaggtcccatttcttggcctcttgccttgtctattgg

SEQ ID NO: 33625 - DNA, 201 bp, Bos taurus
actttcactttctacttgattgtctggtacctggccctaggctgattcagagtgggaagaatattggcttggtctgaggatttgataaaggagatgaggtrtggcctctggtttgtatatcaaaggtacctcccaagggagttgtttgctctctaggattaactattcctgggaatggaggtctcctggatctaggccata

SEQ ID NO: 33626 - DNA, 201 bp, Bos taurus
aaaagaactatgaaactaaatggcctttgctttaggctgggtaagaggaagagacagtgtctgtggaaatggaggaagaggcttgcaataaagcaccaggrtggatgatggaacatggccacgatacgggggatttcaacacaactctgaagcagatctcctttgctcaatggcccagtactttcccagtctcaccttata

SEQ ID NO: 33627 - DNA, 201 bp, Bos taurus
acatgggatcccagtaacaactcttctcttgcatccagaaagtttaaagattctcagggtcggaagggacatttcccaaatgctcccagtctctcttctcyatatactcatattcagccttcactcaagctgtacttaggttcttcaagatgccctcttttagcagtgttataaacactaaaattgttttaaaaacatgca

SEQ ID NO: 33628 - DNA, 201 bp, Bos taurus
gtcatgagcaccagatggcagcatgtgtgtcttagcagatgggtgacctgagagcataatcttggcttaagaaacatcccttcagaaaagaggtcctcatytcatgagtgtgtgacagttgtaagtgctgtttgggaaatgatggataatgattcagtaagttgatttaggtaagttgaatacagtagaacctggaatgct

SEQ ID NO: 33629 - DNA, 201 bp, Bos taurus
ctggtgcgaactgcactgccctgggatcaggaggcctgagcatctggcctcattctgttgtgtacaagctctgtgtcctctctagtttcagtgcatgtgartaccaagcgttgccacatggccgaggctaaggagatgctacctattagtactagtatttctgttattgctgctttacttgtattaatattttcgagatcg

SEQ ID NO: 33630 - DNA, 201 bp, Bos taurus
tgagcttgttcctgatccaaagcccaccagttaaaaaggagggtaggccacttaaggaaagactgcaatgtcactgcaagttgacatagtaatgattgccyatttctttcccaaaggactatggccatttatcagagtaattgtatactatagagaaaaggatatccaaatcacttaggggatgtaggatataatacgtga

SEQ ID NO: 33631 - DNA, 201 bp, Bos taurus
tgttttaaaagtacacatatgaaaaatgatagaagttaaaaaaatgagggttgaaaatatgatgatttaacaaagtcacaaaacacagcaacagattatgrgctaggtcactgcactgtcctgaactgtccatttcttgagcaacatctgctcccatatattttaaatgatcccaaatctccactgtgacttacaagaact

SEQ ID NO: 33632 - DNA, 201 bp, Bos taurus
gtcgaggtagcttttcattcacaaactcatatttaggtggttgaactgtattctcaaactgctttcagcaagtaaatgttagcatagctagtcattaatcktgcttttactttttattttgttaaatgttagttcattgttccccaatttcctaacccaaattaccctcttttctattaactaatttgggcacaatagacc

SEQ ID NO: 33633 - DNA, 201 bp, Bos taurus
acagcatagaattggaaacacttcaattattttctgtgtattaccagtctttcctaatccatcctaaaagttgtcgcaatttcaacttctgaaagcctagytctagtaacttttaagctcaaaagctgtcatcctttacatcctttgcttctcttctctaactaaataattgtaaaacttctcatttgtcatccaatgggc

SEQ ID NO: 33634 - DNA, 201 bp, Bos taurus
gccacaatgcacacactgcaggctccacctgttccctgttagcttccctggaaaactcaacactctacccaccgggtcccacctggccccggctctccggygtatttaaaagaggagaacatttcctcacagggacttgggtgaagagaacagctcccccatcgcaggctgccggccttgggcggaatcagagaaagcaat

SEQ ID NO: 33635 - DNA, 201 bp, Bos taurus
acctaatagtcttctggagagcacttcagaatagaaaacacccaggggccagcttatcctcggctctgagctactgagcaatctcaagaatacagaaactrctctggaagatgtttaaagtcaaaacaccttaaaacttaaattaggtgaacttcaacaattgcctttgttttctttagttgtagcatgggcaaacagaaa

SEQ ID NO: 33636 - DNA, 201 bp, Bos taurus
agtatgggttcttttctgtcttctgaaaggtaagatatggataaaagtatattactggccaactaacttattgctgtaagaattgggaggcatgaaaaaaktctaaccctggggaaaatgctatctctgcaccctcttccttttcactatatatttatttttaggcataattgtgggcccggtgcccagtgttttccagaa

SEQ ID NO: 33637 - DNA, 201 bp, Bos taurus
actgaggtgccctcaggaagttgattatgaagataaattgacccaatgttaataagaatttaagcctagaaaattgacattgaatttaagtaaatctgttyagtgtttctgcctccatgttcttctaggcatagattttcagccttcataaagaactttgcaaatctactactacacctttagtgagatttttaagttaca

SEQ ID NO: 33638 - DNA, 201 bp, Bos taurus
tgaggaccagtagtatcctaccgttgtgcaggatgctgggtgggaataagaaatgcagacttgctcctgctctggggaatcagttcctccccatctaaggkactctcagttagaaagtcctgatggaggatgtgtgtggggaagaggtgtttaaaactaaaaagcaagaccttgatcttgaaaagtacagactacaggaaa

SEQ ID NO: 33639 - DNA, 201 bp, Bos taurus
gttgggccagcatctccattccccgtgccccaccgatccagctgccctggatccgctggtcgatgtgttgggcaaactgctcgctcacgtggccagctctraggaaaggcagcttcagcagggcaccggcacagccattctgcagcgccagcaagaaggctgcccgtggcccaaacagctcagagctcgccttctgcagat

SEQ ID NO: 33640 - DNA, 201 bp, Bos taurus
ctcatttttagttgtaaaacatgtagcttgaaaagatactgaaggaagaacatgaacacagatggtgaagagactgccatttgtaacacagaagcaaagcrgggaggggggagtcactttcaagttttaaatctttaaaaatactttgtgttctaccactcacacacaagataagtaacagtccattcgtatgcaaagggc

SEQ ID NO: 33641 - DNA, 201 bp, Bos taurus
attcatgatagattggcaggtggtcagtggatgatgggctgaagccactctgagtccttttgcttttttcattttttattagagaaacttgtaaggtcagrtgagatgcctcattcatcatttacttctgatgtcagtttggggaaattttcccaaagtgggctacaggagatagcctaatgttaaaatcctgtcttcagt

SEQ ID NO: 33642 - DNA, 201 bp, Bos taurus
gtctgtgtacacacagtgctgaggaggcacagggtgacagtgtgattggtctaaatattactcctctgatgtctaagtcttgtggtgcaaagcagaacacytgcctacctgcctgtgcccaaatgcaaaaagtgatggagctggaagccatagaaggaataggtatctcctgtggtcaccaactccctctgagcttctgtg

SEQ ID NO: 33643 - DNA, 201 bp, Bos taurus
ttatgcctctgtattccacaactgaatacatgaataaacatagcattccctatggcttccaaaatttggctccttcaaattcaaccatttttatataactygcaaattatttcccagtaaatttatcagtgatagaaatgtttaatttttctgaagttgctagaaatactctaatactttctgagcagcctgaagctgccc

SEQ ID NO: 33644 - DNA, 201 bp, Bos taurus
aagagcataaaaacacacatactgaaaaccactgcagtgaatagtggtcttaatagtcttggtactcttaatagtccatcctctcgagacaaacatagaaytgtatttattctgtggatcacatttgaaattaataacagaacaattactttataggtaaaactactagcttattgccttgtttacataagacaccagaaa

SEQ ID NO: 33645 - DNA, 201 bp, Bos taurus
tgtccaagacccacaactagaaagtaaaagggccagattcatcctttaactcttcagctgtgctgccttagtgaagacctttctataggtatctgtgcccrtgtttctcaccagccagatggcctgctttttttccccataggttgtggccaatgccaaaggggctatgactggggcaaaagatgctgtgacgactactgt

SEQ ID NO: 33646 - DNA, 201 bp, Bos taurus
gggctggcctcatggggaagggcagggctctggctaaaaaccaaactgctcaggtttgaatcctgggtgaccttgggcttctctgggcctctgtctacccrtaagtcagtggagataatcatagggttcatgtgaggattgaaatgtggtagtgatctttagatgggggccctgatgagggtgtacacccaggatttcggc

SEQ ID NO: 33647 - DNA, 201 bp, Bos taurus
cacacctgggtcagacagcaaagagtgtgagggtggcgagggacccactcatctgaagacttcatttacagctatagaaagtgaggctcaaatgagcccayggccactcaaacgacattccttcttgaaagctgtaacagtggcttgaagtgaaatcaatgctgtactatctgaaaaccaaaacagccatttctggagtgg

SEQ ID NO: 33648 - DNA, 201 bp, Bos taurus
agactaggactcagatctcctgtcccaccggcagtctcccaccacacacttctttttcttcaccatgtctcggctgggcctctccagactctattggtacrtgtagtctggcatcacctctagtcagctcttaattattctgaggtgggtgactagtctggcaatgaatcagcccttctcaaatctgttctcggccttggg

SEQ ID NO: 33649 - DNA, 201 bp, Bos taurus
aaaacacttaagaactccacggtctgaaattggaagacttagaaacaaatgagaacctcaaggtcaagactattaaatgcctacaaagtgacctgatggakaaaattgattctctgcttgtacttgttccactatccattccttttcaactacatatgaacaatttgggcacatgtatttttacattcccagcaatgacaa

SEQ ID NO: 33650 - DNA, 201 bp, Bos taurus
tgcaccccaaagctgcattttgaaaacaattttaaactgaagagggggtaatgaaatctcaccctgaaaaacagtgccataaattgagtcctcgatgtgaragtgtttctttggcataggtaatgtatttttgtaaccttagttttacaattcaacacttctgctctatgctaatctttcattataaaaacattctgaagg

SEQ ID NO: 33651 - DNA, 201 bp, Bos taurus
gctgggagacataagactgaatacttaatcaattacagtggccatccagaaaaaacatagagaaaagtttagttgactagtaaaggcagaagactggatamcttcagagtatctgttttgttttattttgtttcttcatatcaggctcagaaaggttctaatttctatcttgtacaaaatgtgcatggttcctattttcaa

SEQ ID NO: 33652 - DNA, 201 bp, Bos taurus
accccattttatatatttgaaaattgaggctcagaaaacttaagtgacttaccttgggctccacccattagaactagcttttgaacagggtcttccgaatygaaatcacttccatttagtatacatatatgtaaatatataggtgtgcatgcttgctaagttacctcagttgtgtccgactctttgcaaccctatggaccg

SEQ ID NO: 33653 - DNA, 201 bp, Bos taurus
ctattcctataactctcgtggctgattaaaaagcaaaagataaaaccctgcaaagaacatctcactggctttgcctttcactcgacttctaagaagttttmgttttcttttgcaggtaattctttaacatttacacaggcactggtattcattatacactgaaaaagaaagacaaaagtaatgtatcctcagctagatcat

SEQ ID NO: 33654 - DNA, 201 bp, Bos taurus
gtgcttcatgtacataattccattgtattcctcacatcttcacaggtgatgaaagagactctggtaatcactaaacccaggccactcatcagtgccagagwtgggattttaaattcagttatatcggattcctaaacttatattccttttactctgtccagcagcctcttgatagagtcatgctgagctcaggtactccag

SEQ ID NO: 33655 - DNA, 201 bp, Bos taurus
tgctaggcccaatctcctgaagaggctatatgttctattgtaatatcatgaatctgtttcagggactccaaattctgagataaggatgccctttttttttycctaatttcaaagacacggccaagaaatcacaaggctctgtcttaaattcatgcttaggaaagaaataacacatgagtcctactctgaagttggatgata

SEQ ID NO: 33656 - DNA, 201 bp, Bos taurus
caatgggttttaccactcccccactagaccccgtcttacagaaccctctccctagccagctggtgttctctgggctaaagactgtccaacccgttcctccrttttatagaagtttactcactccaggggaaatggtgagtcctccgacctccctcccaaccagtcccatcattccaaccagtggtaccatagagcagcacc

SEQ ID NO: 33657 - DNA, 201 bp, Bos taurus
atgggagatgcaagacaaatgttgcctccatggctttgggtgctgtgtctcagcttcaagctttgatccatcaggacaaacattcccaccaggcgggccarttaataagatggctttacacccagcctctcacaacatagaggagttctttgccctcagcttctccagggctgctatttaacaattctctaggccaaagga

SEQ ID NO: 33658 - DNA, 201 bp, Bos taurus
gagaaattgaggaaaattttaaaagattatacttgcagtcatgtagcaaattgccagatagtggtcaaaagtgaatgcagtatgacaaattagaaggaackgtagcagactactcaagagctgatggcagcttagattagggtcctggcagagaaaagggtgtgtgggagtataagcactgaaggatgttgaaggggtgca

SEQ ID NO: 33659 - DNA, 201 bp, Bos taurus
aggtctgtcttcaccacctaccacctgattaaacctctctgactctctaacactcagtgggaataaagtgcctcctagttacattgctgtaaagataacaygggagtaccagtgatggacagggaagcctggcgtgctgcagtccatggggtcgcaaagagtgggacacaactgagcaactgaactatacttgttaaacaa

SEQ ID NO: 33660 - DNA, 201 bp, Bos taurus
aagagtacatactctatgattcctttcctataaagtacaaaaaggaggcaaaataaattaatgtcctgctattaaaaatcaggatagcagtcatctatgtrgaagactttgataattttccattccatgacccaggtgctggttataagtcatacacatagctaggcacatttctttacatatattatactctgtggttcc

SEQ ID NO: 33661 - DNA, 201 bp, Bos taurus
agtcagtgtaattatactttatttaactttgcatcaagaatattcaatttatttttacaaatgactctttttaggttgataaaatctaaaaagtgaagttktattgtttatttcctagaattataagctaagtttgaggctatcactgagtcagctgttgaaaagtgaaaatcatatagaagtaatgcttagtggtggtct

SEQ ID NO: 33662 - DNA, 201 bp, Bos taurus
attttgattaataaagatatgtttgagcctaattataatgatttaaaattcacagtctgaaaccacaattatttttgtaccaatctaataattagtgctarctaactataccacagatgaatcataaaagtttattcacaagtgcaatttatgtacagtaatatttcaatgaaatcttattaaagtttatgatacatctat

SEQ ID NO: 33663 - DNA, 201 bp, Bos taurus
acttgtgaaataaactttactcaagggagaacaagaagggcagtcatttcttaaaagactccaaatgaaacagccaatgagctaaaagcaggagccaacartggtgtaggaggggacccatgggattcggtttcttttactagtctgatgcaaagcagttcccagtggaaatctcagactgcagagctaagctcagtagtt

SEQ ID NO: 33664 - DNA, 201 bp, Bos taurus
aaacttctggcaactaatactgtgttttaaatgtagcccttaacaaaacaaaacctaagctccagctcttttacacgactggccgccaagagggcacgccrgactgtccagaagctttcttacagcctgtgccttccaaggaggacttcaaacaaccgatcaatgaactagagtttgcatggctgcgtctattgttgaaac

SEQ ID NO: 33665 - DNA, 201 bp, Bos taurus
cactcattgtgttttttgttcccccaggacatctttgaagatgctttggaaaccctctctgtgtaagtagtaacgtaataaaaatgtatatagtagagaamattgatggttttcttttaaaaaaagtaaatatttcattctcatttttttgagtatagtgactattgttggaaaaattcagttctctataatttaacattt

SEQ ID NO: 33666 - DNA, 201 bp, Bos taurus
tcaacttggtaggtgttgtggccagagaccgaggagctagagcaagagccaggtgtgagccagggcttctctgctcagttgccaacaccaccaccctactkgggtagggccatgtcccaaggtactggagcaatggccgtgagggtggggcccaagccagctctatcccccacaactgggcactctcctcagctatggcag

SEQ ID NO: 33667 - DNA, 201 bp, Bos taurus
aagagagaaagactgatttctgtttaggaattggctcatgcaattgtggagtctgacacattccaaaatctacgaggcaggccagcagcctgaagattacrgaaggagttgatgttacagtcttgagtccaaaggcagtttggaggcagaattccttcctcttcaagagacttcagtctttttttttttttttttttttta

SEQ ID NO: 33668 - DNA, 201 bp, Bos taurus
tgtatatttaatggtctctaggattcatgtcaactgctccttattccacagacaaatcagctaggtggtgattctgccccagggcccattcagtcatcaaygggagattttctctctctgggtcaagtccatcgtaaccttccagcaatgttttgctggaaggaataaggatttgctggtaggaataaggattcaggccat

SEQ ID NO: 33669 - DNA, 201 bp, Bos taurus
cagaaagataacataggtgcagatattgtttaatgagctctttctggtcccagcacttgctgtctcccttctcccagcccaggaatgctccacaggccatyggttcaaaagaaacattcccccacagcacagctaaatgctaagagtgacaacctgtcaggttcaaggaacatttttaggagtttttaatttggctcgtca

SEQ ID NO: 33670 - DNA, 201 bp, Bos taurus
cctgacaagatttcacctggaattccaggcacagatttgttttactgaggaagctcattccagaagctaggggcaaagtgagaggtccaaggccccagagytaaagaattaagaaatgttttttctttcgctaacgcaaactgcaaacggttctgcggtatccctcgtgagaggccgggacacctctggagagaaagagta

SEQ ID NO: 33671 - DNA, 201 bp, Bos taurus
aaaactaacagggcctcctgaaataaagaaaacccctttgtcattttccacatcgtgaaagtctttggttcttcaatcacttctttctctgtctctcttcrtcctttcaatgggcctccaattccaaggtcttcagtattaagttccttgtgttgcacagaaaggagttcaatgaagtcatcctctttcagatctagcttg

SEQ ID NO: 33672 - DNA, 201 bp, Bos taurus
taatgcagaacaataggggcaagtgtaggggtgaaggcaggatgctttgggagagcacagatggttggtcgcttaccccagtgttgaactaaggaaggccygtctggaggatgtgatgagatctaggctaagtcctctctaagaagcatcatttaggcaaagagaattgggtatggaggatgaaatagcatgccaggcaaa

SEQ ID NO: 33673 - DNA, 201 bp, Bos taurus
tgttacaagtctttcatttaaaagatgaaaaattaagggccaacaaaattaagtgacttgtccagggtcacacagcctgttgttagcacagctgagacaaratccatgtcaactaactcccaggtgaatgttgctttaatttttgtttttagggacttttgagtgctttattaaaatggatcttttggagtctttaaaaga

SEQ ID NO: 33674 - DNA, 201 bp, Bos taurus
catcactcattagttagtcatagttaagcaagttctatattagtgatctaaaggtataatgggaaaattgctaaactgagagaaagttctgattcaataaycaatatttgcacattctaggaacactttgaaattggggtttggcagaaatggtctctttgtgaatgtatctttgtattgtgaattctctccaaagtgaaa

SEQ ID NO: 33675 - DNA, 201 bp, Bos taurus
agtaaatgcaaatgaggctatgatcaggaatctctcaactcttgaaaatattgcagaatctgttactaaaacagtaagtttgctcaacaaaaattcctagwttctctggccaaagttgtcctttataagagtattatcttttagcagagcatccaaacgtttgtgctgtggccagcactgcctgccgcacttggattgaca

SEQ ID NO: 33676 - DNA, 201 bp, Bos taurus
aagcattagtagtagagcttaagtgagagaatgtagatttcctaaggattttcagtaggaaaaagaagagtcagaaaattttgaggccagaaatgtagtgkaaagtagaatgtcactttggagtcctatctctcaacaagtaaagggccagaggagaaattacttttgaaaatgggtggatgtgcagtaatttgaatgttt

SEQ ID NO: 33677 - DNA, 201 bp, Bos taurus
ataggccatgcttctcatccctttacattatccgagtgtttgactgtcccaagatgaatccaccttttcttaataaaatattgatgcttggagaggcttayccatcttgcccgaggccacacaaagccaacagtagaactacaaagttaaccatggaatcaagtattcctcctcccgttgaggatgttcatatttctctac

SEQ ID NO: 33678 - DNA, 201 bp, Bos taurus
gtgccctgttatgaaaagttaaaacgaaaaatcacctgtgatgttttccaaggtgtttttcaactcattctaggagactgttaaaccaaacacattttaarcttaattcttttaaaacaataagtaaccttttgtttcctgttgaatcttccaattacagtccaattagtgtggccagataatttagatgtgttgattata

SEQ ID NO: 33679 - DNA, 201 bp, Bos taurus
gtgggcaggagggcaccagtgatgcacagtagttaagaactttggttctacagtcggactgcctgagttcaaaacctggctgcggctttcccttcagtcartttacctaagctgagtctcagtcctaaacctgagacaagaataaccccaacctgtgtatgtggattaaattagttaatatttgaaaatccttagaagagt

SEQ ID NO: 33680 - DNA, 201 bp, Bos taurus
ttttaggctgttgaacagggagccattcttatggggcctagactccacctaatatagtgtgcaatgcttcctgacagaggtaacatactacagaaaacttytgtctggcctgtgttctccttacacctcagtttcaaatggcttttattataaaacactgtactggcttttcttatgaaatattgtataaaatactttaca

SEQ ID NO: 33681 - DNA, 201 bp, Bos taurus
gggcagaaagaacactgctgcttgcaattccatgcagatacatatcatatatttaacatatttaaataccacacataccacatatttaattcaaaatcttygctaaaagaaaagagtaagagagggcttatcatattgagtgaagtaagtcagagaaagacaaatatattatatcacttatatggggaatctaaaaaaatg

SEQ ID NO: 33682 - DNA, 201 bp, Bos taurus
agcacatcaatggtctagaaaaagttgaggtttttcatgaaacccattttttgttttaaaacaaactcacataagattttgcagtctttaattttgcatcktcaacaaataaactattaattctgcctaatcaaagtacttcatgggctcaaatccatattttcatattcatgaatttgtgaaagtatttcttgctagtag

SEQ ID NO: 33683 - DNA, 201 bp, Bos taurus
aaggaaaccaatataaattaaacaagcaaaacaaatgacagaggaagaaatatgtaagttttccactgggtaccagcatgacaaaaaaaaaagtttgataytttgatgcacttgatttaaaattcatacatccctgcctacttttataacactgattactatcagagaagggaaatgggtaactggggaggagactttata

SEQ ID NO: 33684 - DNA, 201 bp, Bos taurus
gacgaagaatccaaacagagagaaggaacaagagggcctaccaagtagctgatgatcttggtcttaacttgtcatctcaacagggataaatgctggtctargtgaaatgttttggcctcccaagaagaaaggaagtagaacaacccaaggtagcatggatatcttcaccattatttatgagctttaaagctaaatgaggaa

SEQ ID NO: 33685 - DNA, 201 bp, Bos taurus
ggtcttctgcccattttttcaattggattgtttgttgttttattgtcaagctatataagctgtttgtatattttggaggttaatctcttgttgatcgcatkgcttgcaaatatttcttcccattgcataggttgtctattttgtttatggttccctttgctatgtaaaattgtgtaaatttgattaggtcccatttgcaag

SEQ ID NO: 33686 - DNA, 201 bp, Bos taurus
tatttcaggtaccttttccacataagaccagagcctcttggccttaccttttccaaccattaactttgccccagatgcactacagtgatctgctctacacrggctgtttccaagtagagcttcacctactatctgcatgtgggcacagtaactcaccttccttcctggggcttccctgagaaaatgcaaggcacccagata

SEQ ID NO: 33687 - DNA, 201 bp, Bos taurus
gtgacattctatcaagaactcaggcagcatatgttcccagttcattattctgcactgcctgtctgtgacatagtctagcctaactcttgtctgtttgcttktatgaagaatacatgctagatacttttacatatagctccagaaatacgctccttgcttttttaatataaactaatttaatgtgaaattgtttttcaaaat

SEQ ID NO: 33688 - DNA, 201 bp, Bos taurus
ttaacagagttgtttttatcaagattttagtaagatttttctttaattagtaactcattttctgttggagagctgatgggattgacccttgagctcacttratctgtccttgacttcttaacatgttgattcaagttcctttatcaaagtttctctgaattcctcatttcttatttacttctcaccctgtgttgggattag

SEQ ID NO: 33689 - DNA, 201 bp, Bos taurus
aaactgtgataggtggaagttaagttcgtaaaatacagtttaggtagaaaatccactatattttaaggtttttaatggtctagtccaatgatttggccacrgtatatagtaaacaacctgatcatatgagaaagaataaatctttccatacatctccatcagtttgttctacaggccaatctctgcttgtaagtgaagctg

SEQ ID NO: 33690 - DNA, 201 bp, Bos taurus
ctctctttcagcttctgtgcattagccctctacccctaactgctcctgcaccacactgctgcctcatcagatcctcccatccttcaaggcccagatacagrcatcatcccctacagcaagtgttttccacctactgccttccttctctgcctgactaacttggaatctgccaggcagaattaatttcgttatttcaacaat

SEQ ID NO: 33691 - DNA, 201 bp, Bos taurus
agaaagtcaggaaagcaggctcatctgaactgtggaggagaaaactcaggaaagcctcctttgccccaaagggctgagctgaggatgaacatgtaggtatracactgctccactcagccagttcccagcggctggacttcagacatcaggttggagggggagctgtgcaaacaggacaggcaggcaggagatcaccaagtc

SEQ ID NO: 33692 - DNA, 201 bp, Bos taurus
gtcaaaagaagggccaggattactctcagcagaactgcgtttcagctgcttctgtcacttttctattttgctttccagaaatgaacgatttctgcactggratgagcagagcagaaaacatcactggaaaggagaagccctttgattttggattatcagagtggaaaactccatcaacctccctgaagatttgtctcacct

SEQ ID NO: 33693 - DNA, 201 bp, Bos taurus
acctgaaccaggactcactgtctctgtggaaatggtgattaatctcttcccttccttcctgtatccttcttcccagcacagcttgtgctacccagggcctyttgtacaatccagtagaacctggatgaacggaggagagagactcccagggaggacggggtgaaagaatgccttggggtgagtgtgaaggcctgtaatggc

SEQ ID NO: 33694 - DNA, 201 bp, Bos taurus
aaagtgacatacctgagggaagagaaaaactgaagctgtgatcgggcagtgatcagaagccagggacccacaaacccacagatattacagaaggccatgcrgacttttttaggaaactccaggaaagagagaaggaacactgaaccagaatagaccagaggcaaacctgggagaaacccaagttgcagccatcgtcaatac

SEQ ID NO: 33695 - DNA, 201 bp, Bos taurus
aactgtcaaacttccattgctatttgcactatatgtgcagggcatcaaaatgctttaaatacaagtcagaaattatcttcaggccctacccaagaggcagmgagtatttgggctaaatctggtgggacaagagttgtatttctatgttatcattttatattatataagagctatttatagaaaggctcaaagcaggccaaa

SEQ ID NO: 33696 - DNA, 201 bp, Bos taurus
ctctaggcacatgacagtaaaactgctaaaattcacagaggaaaaagtatgtatcagagaaaaagaaatatattcctgtcaaaggaactacaataaaactkagccctaatctcatctaaaatgatgaaagtcaaaagacactgaaattccagtttcaaagtgctgatataaaaaaaaatgccgatattgaattcttccctg

SEQ ID NO: 33697 - DNA, 201 bp, Bos taurus
atgggagaacatcaaaatcacagggccatgcagaggcatgaagaaggatttttaataacacacagtcttggtcccatctgctatagtctcatcaggtagayctgaaatggggcccaggcctgtgttttcagcaagctctccaagtgaagatgatgcccactgaaatttaagaaccatggctgtatgatacgttactactag

SEQ ID NO: 33698 - DNA, 201 bp, Bos taurus
gatcacatacttaatccaaaatatttaagccaaaatgggcacactttggaacatgaaagtgaggtttttggctgctttggctaaatgtcactggaagacarttgtggagatgtatgtctacagcaggaccaggcttgttgttcagttgctcagtcgtatctgactctttgtgaccacagggactgtagcacaccagacttc

SEQ ID NO: 33699 - DNA, 201 bp, Bos taurus
taggactggaaatcacgtgagcgagatcccgagccggccttctcccacccgcctcaagcccttgttagggctaggggttgggaaatgaatgggcgttggaktccgctgggggccgggcgagaggctggatggggtgacagtgaacgtgcctgggagaatcccaaatgtcgctaactcaggcaaccatccgcacgtcaaagg

SEQ ID NO: 33700 - DNA, 201 bp, Bos taurus
agcaaagtgccaggaaagggacaatctagcaggtgaaagcttttaattaataaccaccctactccaaccaaggaccactgaaaaagactgtggccccttcytagcctcaccagcacagactgagcaggaaacctaggtttccatccttgtaaagctgtgacaggacacctcccgcaacctgccctgtagtatcagagaagg

SEQ ID NO: 33701 - DNA, 201 bp, Bos taurus
ttttaaaatcatggtttttttttggggggtggtgcactttggttctttacatactttggatatttccctttgtcagaagatatgatttgcaaatacttcckcacattttgtgggttgtcttttgcttctgttaacagtgttatatacaaacattttttatgtaaaaagttaaattttgatgaaatcgaattcatctttttt

SEQ ID NO: 33702 - DNA, 201 bp, Bos taurus
tttgtgcaagtgtggaatttctgctgacagttgcaaatgtctttcttgaggcctacactacaggcactgctgtagaaaccaatgttcaaacatggtctgcyaaagaagaaggttagttattggctaaaatattccatatctgttactgaagtgctataataacacttagcttgattatccttctagatgatgaggataaca

SEQ ID NO: 33703 - DNA, 201 bp, Bos taurus
tggtatctctttaagaggaaagaatgactaacttgtgcattttcagttttgcctctcattggtaaataatgggtccaataaatgtcttgataaactggatrtgagtgtattggcattagtttaatgtagagacaattaagcttttatttttaagtgttagaagtaagagtgaaaaaagaataaaatacagagaatgtagaa

SEQ ID NO: 33704 - DNA, 201 bp, Bos taurus
caaatattatttggatgttagaggagcagtgggttgtcatatataaaaaaatgtcagtagccttcaaaatactctgtttaaatagaatatgtaggaaatayattaattcttgtggcatctagaaagcagaattctgcatttcttttgtaagccagacttggttcttcaaaatatcacatcaaattattgtaaattttcatt

SEQ ID NO: 33705 - DNA, 201 bp, Bos taurus
tagatatttatattttgggagattaattccttctcagtagcaccattaacaaaaattttctcctattctgtaggttttttgtttatggcttcttttgctaygcaaaaacttaagtttgattaggtcccatttgtttatttctgtttttattcccattacactaggagatggattcaaaaagatattgctgtgatttatgtc

SEQ ID NO: 33706 - DNA, 201 bp, Bos taurus
gcacgagtcccctgtggcctcctttgcctggaaaagcaataaagctgttcttttctgtttcattcaaaactgtctctgagattcgattcaattcgactctrgtgcacagaggccaagtttgtggcatcacaatctctttacctttacactctgtgcctaccattagataattaaatatggagggatgggttacttcaaggg

SEQ ID NO: 33707 - DNA, 201 bp, Bos taurus
ctaagtaagtgtaattgcaagggtccttataagtgtaatacaagggtaaagaaagaagaaggcaatgttatgatggaagcaggtggaaaaaagtctatgaratgcaaggccacaagccaaggaatgaagataccctttagaatttggcagaagcaagacagtaagttctctcctagagtctgcagaagaaaccagctgtac

SEQ ID NO: 33708 - DNA, 201 bp, Bos taurus
cattttcataaaaatcaccttaaattgtggactgatttcctcttaaagcccaggttcttgttcactacactgccctgcctctgttggaaactgtcttcacygtaattacatggagattagctaaataaaatccaattcatcatttaagttttatcggatacctagtgcaggagacagatgcctgagtcaccaaccgtgtga

SEQ ID NO: 33709 - DNA, 201 bp, Bos taurus
gttgacctgaacagatggcttcttcactcaatagtgaggtatctgggttgagataactgaaggatgaaatcagatgtgattattaattacaggcccaattyagtctctccagcatggtggtttaagagtagtcagactctatatagtgactcagggatcaaagaacaagaaagcaaggcagaagttacatggccttttatg

SEQ ID NO: 33710 - DNA, 201 bp, Bos taurus
ctgagaactgaatgttctaaaaatgcaaaatagataatttccccagaaagatgccaaataaacaacataaaacaaaaatattttggcccaccacaaaagaygcttgctgtttccacaactattctatgtatccctcaaagttaaagcaatcagaatgtcataaagtgtgcagtattaaaatggccatcatgttatagaaga

SEQ ID NO: 33711 - DNA, 201 bp, Bos taurus
aataagggatgtttagagtataatattttggaaatgtttctacttccctcagtattgacacagtgttggagaaaccccaggaaatgtcttgagtatattgyttgggaagaccagtccaaattttatttcagtcatgttgggaagaggcacagactataaatttaggtgagtatgaagggagagttgacagtgattccgtta

SEQ ID NO: 33712 - DNA, 201 bp, Bos taurus
caaacggtaatactgtgctaagaaataaaggtttacccagccagatctacatactaaatctagttctagccatatggtctattggaaattacataaatgcygtaaggcctattttttttttttttttttctgatctgaaaatgatagttataatacactcatcttaaaagggttggatgagcttatatatttaaagcactt

SEQ ID NO: 33713 - DNA, 201 bp, Bos taurus
ttttgacacctcgttaaacagaattttgttcagactaaacgttcttggcaaggcactggttcacccaagtgctttgttaattttaaagagcagtataagcrgaagcccttattacaggaaatagtgcagtgcacgtgtagtggagagagaggttggcactgtcggttcggcttcagaatcctcacttttggtaactcactt

SEQ ID NO: 33714 - DNA, 201 bp, Bos taurus
tatttacataatagttcttgagatatgggctacttggtgtatcatttattgctgctacagtatagtttgacctcataaccacagtatgggtactgaagttyccatccttattcaaatcaagaaggagaatgatcattaattttatcaagaaaagcagaagttttcttagagctcccagcttcttaagatcctttggccaga

SEQ ID NO: 33715 - DNA, 201 bp, Bos taurus
agtcatggggggcactggggcataggggtgggtgaggaacggtcagagcatcacagatgtcccaagcttaatccatgggggagaagaaagggttgaaggayggaggagtgggcagttcatttactgataaattctggtcttcttcatgtaaatggtgaaagtatgtggtgtcagggaaaactgcagcactcaaattttatt

SEQ ID NO: 33716 - DNA, 201 bp, Bos taurus
gtaattctgggtagctaccactgttacaaatagaggactcatatcatgtttaaatcctttgagccacatgtcacaatggacagaatgattggaaacatacraggatggagatttacccaagaccccaagagttctagtgagaccatgtctagggtaatacaaagacatacatgctgcaaattaaccatctcaaaacagagt

SEQ ID NO: 33717 - DNA, 201 bp, Bos taurus
cattaactgttgttgggagagtatgtcatctgagggatactttaggattatggtgtgatttggatctgtagctccattatccctgcgttaataggccatgygctgctctatgcatagacgattgaggctaaagggagttgtcacctttcaaaaattattagtaagaggtcaattcaggccatcctattaattgtaatagac

SEQ ID NO: 33718 - DNA, 201 bp, Bos taurus
tgctttgattggatgaccacagagacagctttgattggatgaccacagagacagctttgattggatgaccacagagacagcttgatctccctgagtactcycttgaactttcaactttaagtttcaataggcaccagtgggattctaatcaaggcgggggagactattgattgtttggctctatcatgaatgcacaattct

SEQ ID NO: 33719 - DNA, 201 bp, Bos taurus
tctaactttaatatatataccatatcatatatatatgcccatattcttgggagtgaggaatctaaaactatcttttatttttcttaaatttttccttactraaaaaataacattggcaagattggctgctaatattttgatgtcacaaatatggtgctcatgcatccctggttaaatttgccaggtagagacaggtggagt

SEQ ID NO: 33720 - DNA, 201 bp, Bos taurus
acctcggagtaatttgctgactttaaaaaacgcgttgttgacaactgggattatatggtatctcttatatcccagacgttttcctgatactagttttattrggttttaatcagacatgatcttagtgaaatgctttgaaatctgattaaaaagcaacatgaataaaggtgaaggggaaacaacagcagtgttgcagaccta

SEQ ID NO: 33721 - DNA, 201 bp, Bos taurus
tactttgtggccatgtctgtgaacctgcaactttctcttgatgggtgtaataaatccatgtaatgttctgcctttaagataaagtccagactccttaaccmagaaccaaggtctgtggggccctggggtctacatatctctcacctcacatctcactcttctccttagctgtcccctgcaatcctcttgcaacctaggtga

SEQ ID NO: 33722 - DNA, 201 bp, Bos taurus
ttcccttggtccactggtcctgcctggctgaccagcgctcactttggacagcaaccatgctaagcatcacttgactcacctggcaggagaacacaggccaygaccacgtgctctcaccctgttgatagtcactcaagaagtcagatggttcagactctgctgtacaagccctttagtggcttctgctagaagaagcagagg

SEQ ID NO: 33723 - DNA, 201 bp, Bos taurus
attctccctgtgtggcctgcctcctttccttgccctccccattattccttgtcagacccttgttgtcatgccaggacagctatgctagcctcgaagctcawcaccttgtctacagccttggccttctctgctcctttatctgggcttacaggagctctgggtatacttctgtatctatctgtattgtgtcattctttaagg

SEQ ID NO: 33724 - DNA, 201 bp, Bos taurus
cactgagagagcttgaattttcacattagcgtatatgttcataccagctgtgtttgcttgaagcacttgttgtgttcctgttgggatatagttcggttacyaaatctctcaaggtcactcggcatagaacctacttttcccacctgctatcctgtctcctgttgaaggagagaatgtgtgggtgaggacccataagagagc

SEQ ID NO: 33725 - DNA, 201 bp, Bos taurus
ttttttacattcatatatagtaacacttaccgtagcccactctggaaaaatcataaaattacctacagggatgctcagtatcctcacttctctatttcttragttatttctgctgcaacacttacttcaatccaacttatatattttgttttatggtgctttgaagtactccacatatcttctgggttaaagattctctgc

SEQ ID NO: 33726 - DNA, 201 bp, Bos taurus
gtcccagataggaactagcagcagagctgagctctcacttacctctccccagggaaggaaattctcagctgggatcttagctctttggcccacagggaagragagttcccacagggctgccttcagtccagagaaaaagcacaagcaagtgtttttaccgaagtcgctctggctgatctcacagcaggcctagacaggctg

SEQ ID NO: 33727 - DNA, 201 bp, Bos taurus
agggcctttaaagaggtacgcaaggttaatgaagtcataaactcagggctctaatccagtatgacttgtatccttgtaagaagaggaagagacactaggcrtatgcatgccacgaaggaaggccaagtgaggacacagtgggaaggcagccctctgcaagccaagggaagacggcttaaggaaacctagcccatttggttt

SEQ ID NO: 33728 - DNA, 201 bp, Bos taurus
gagtaatttgttatgtaaactataggtaattgaggaaccttttcaagtgcagattctctaacaatcctctcctgaaggcctgggattcacggcactttaayaagatccaggtgatgttagcttcctgctagtggtccacgtggtccacaatgaggaggtggatttggccccgccccccgctacagtgagccaatgagctca

SEQ ID NO: 33729 - DNA, 201 bp, Bos taurus
gcaatatgtatctcttttcttctgtatattggccattttgtgtgtgtggggtttctcatcatggagatattacagatatttgtaagggaaatgagaggacraaagttattttagttataggcaattcaaattactcctgcaaagaattttagcatcacatacaaaagctaaaataccagcagtctcacttcaaatcctgta

SEQ ID NO: 33730 - DNA, 201 bp, Bos taurus
gtctctcataggattattatgttacaatttgaattgagatcttaaccttagtcccacaaagctctcttcctccagtctacttttcatactgtcctcacacycattatttaggcactcatatcttattgtgccatttgacacataaaacatattaggattctctgtttttttccataccagtcagcacagataaagtccaca

SEQ ID NO: 33731 - DNA, 201 bp, Bos taurus
tttccgatgttctaaagggattaatttaccatatcgtatagccctggaagactgtgataattgaaaacatccatattcattgcatgttcaaagggatctgyctgactttgtaatgtaaaaagtgcatttttaacctgaacggggacctgcatctgccattgcttaatcctattagtccaacagtcccaaagctttagtgta

SEQ ID NO: 33732 - DNA, 201 bp, Bos taurus
actcaaagattgctagtgcttttaaagcaggcatttcagtagaaggatggtggttgcagttacagaatagggaattagttcgaggagaggagatgatggcrggttggaggctgagggtattgaatactctcaacatgtatattaagagataagaagcaaaaaggatgaacagttcagtaaggatatttgaagggtctttgt

SEQ ID NO: 33733 - DNA, 201 bp, Bos taurus
ttctattcccataagcatcattgtgaaaaatctagagttcccaacattagtgtaaagactactcaacttgatgattatattcctctaactagtagatagcrtagatagcagaatcatctcatttacctaaaatatttggcaaaataaattggaagatgttgctacaaatgagtcggtattcatccaaatacgagctttatc

SEQ ID NO: 33734 - DNA, 201 bp, Bos taurus
aaaatgtgtgcatctgtttggaatgcattgctaataaacattcccaaatacatttgctccagcctagcagtatgaaaccactagggcaaatccagaaagtyacatattgtgctggctagctcagaatgtgtgaacatggtgatcaaggacaccagaaagaagcctattattcctgtatataaaaaaagtaatgtgtatggc

SEQ ID NO: 33735 - DNA, 201 bp, Bos taurus
agacccaggaaaatcattgagttacctggatgttattattcaggttttctattgtcttgtctttttatactacggttttctaaatactaaaataaaataayacagatagtaaaatccaaactttagtgcttcatccccaaatctcgtattttgaaagcatattgattgtttctgcttattcctgaccttaactcatttcct

SEQ ID NO: 33736 - DNA, 201 bp, Bos taurus
agagcaacaggtgttgtcaagggaagaaagaaataaaaggtttacagattttcaagttttcttatgttagatcaaaagctggcaaacttctcctgtaaatrgccagagagtaaaaatttagactatgtggaacagttatacagtcttcatctcaactactcaactttgatattgaagcacaaaagaagccataaacctagg

SEQ ID NO: 33737 - DNA, 201 bp, Bos taurus
tgatctgatgatatttttaagaattttcttttttttcactttgtgcctactcaaatgtcataccatactgaccactgtataagaagcatgttttccatatraaaaggttatggtgcattgcaacgactagatacatcccagacttaacagtgaaaagcaaacattccagctagactgtgagacataaagcaaaattatatt

SEQ ID NO: 33738 - DNA, 201 bp, Bos taurus
tggggggttgtgctacaagtgctgagtagactcctccaaatcaacatggtaagttctttttttccttttatttgaatggtgtctagcttccataaaactcycctcagttttggccttatacaagcaacttcctgttaaaaagctctccctgaatcttattggaatctcaaatttattacattagcaaaaagaattaattat

SEQ ID NO: 33739 - DNA, 201 bp, Bos taurus
gacataagcaaaaaggaacacaattcagtttcagagaaaatgtcactttccacatctggaaagaacagaggtaatggtggcctaagaacaaagaaagaatratctggcaaaacgttcttaaataaaatgaagttcttgttcccaaaatataggaagaggaaaaccacttcagagtgggaagtaggggagaaacatgctatc

SEQ ID NO: 33740 - DNA, 201 bp, Bos taurus
gagagtgtcaggatgggagtaagtatctacaagacatttatctctggaggaaaacaatctctcaaagcgcataccttggcctccaacatggataggtttakaggtaaacatggtttaactataacctttagccaccagagctccaggcagattttcatttcccattctttagcggtgagcattgattcctgctctgtggcc

SEQ ID NO: 33741 - DNA, 201 bp, Bos taurus
gaattaaatgaggtaatgtgtctgccagctcctggcatgcagaaggcaccccctcccctcttgattcttcctctgagatttgaaggaacaaaaaagaggarctaagagatattttgaggtggaggtgagggttgataaagcagccaggaaagtcatccccttgaccatcaccctccagcgaagtagaagagattatttgcc

SEQ ID NO: 33742 - DNA, 201 bp, Bos taurus
tccttggatatctgtctgctgtttgcttttagcattttctttctctatctggaatatttgttccctcttcaatatttggttacagcctaattagcctttakaaataatcttgagattttcttctccggtaggacttgagtccacttggttgaactacctgtcccttccctccttcctttccatagcttttgtgtgtaggtg

SEQ ID NO: 33743 - DNA, 201 bp, Bos taurus
cttctgaggtatctctccttggcttgacaggtgccttctcactgtgtcctcatatggtcttttccctgtatccttatctctttttcttttaaggccactartcatgttggattagggcccactcatatgacctcatttaccttagttacctctttcaaggccctgtctctaaatacatgagtcacattctcatacactgag

SEQ ID NO: 33744 - DNA, 201 bp, Bos taurus
ctaggatgtctggctctaggtgagtgataacaccatcatgattatcttgcagggtaacaagtaatatcccaaatcggtagcagccttctttactgggcccraggccaaagtggtctttctgatacttgtcccactttgagtctcaacttctacaccagtatgtgtggaataatacagagaaaaccacaaatgacagaggaa

SEQ ID NO: 33745 - DNA, 201 bp, Bos taurus
aaatcctttcttaaaattcttaatcatactttctaaaacaataggttttgaggttgaactgcccattaagtgagagttcctaacttatggtggtgccacamaatgaacaaagggaaacactcactttcatctgcctggcctctcacctcacggaaatttagctgtctcttagcattggcacaaagaaggcaatggcaaccc

SEQ ID NO: 33746 - DNA, 201 bp, Bos taurus
tcaatttgactttgtcattcagaaagaaaaaatattggcctttaagacttgctttgcctgtagattgaggtgcacttatctcttcctttcctcattttccrtactcttaacatttccacagaagaaagaaatttgcactgtccagaaggaatgaaaatgtaagaaactctcctggcctctgttcctatatatttgtactca

SEQ ID NO: 33747 - DNA, 201 bp, Bos taurus
ctcaaatggattctgatagcttcttttaaagtttaatgtggtgtttgtggagtgtaatcatgttgcctttggtgctaaccagtaaaatgactataaaatgwccagtaaaatgaattttccctcacttccttatcagaactttagctgatgttcaattagttaccaaactcaacttgttttatctatggaacattgagaata

SEQ ID NO: 33748 - DNA, 201 bp, Bos taurus
tcagcttcaagaaaattaattctgaccttttgagagaattctattggtttgtatatgggcttgcctgtctctgaattcagggcacacacatttctacacayaagcattcaatcaggagccttggggcaagtttggcatgggactttggtctctgcttctttctacacggttttaatccagagcacctggagaatatactct

SEQ ID NO: 33749 - DNA, 201 bp, Bos taurus
aatgttgttctgctaatgtgtacctcctgcccagtatttcttattaataaggcactaaataaggggcaatcggtgtttccattgccaaaagaaaacgtctyttttaattaatcaatgtaaatgggcttttactggaaaatagaagggaagtgtttctagaactcaggatataatgttacatcagggaataccatgccctct

SEQ ID NO: 33750 - DNA, 201 bp, Bos taurus
aatgagtcagctctttgcatcaggtggccaaagtagtggagtttcagcttcaacatcagtccttccaatgaacatccattgtccagcatcatattaatgtrgcaagatagggcctgaaagtgttatacttattaacttttatattactaataagctgtcatttactgtatgccaagatccatgataagtgcactatgtata

SEQ ID NO: 33751 - DNA, 201 bp, Bos taurus
aaattaaaaggatacaacttaaatgtccaatattatccatccatttaattagtgtggctgattatctaccccagtgtcctgctccaagtcccaggcctgcycttcccactaagttcaccagctgttgatacagaattcccagcccctggcagtttcctatctccggtgcctctgtctctcttgcttttttgtcagacagct

SEQ ID NO: 33752 - DNA, 201 bp, Bos taurus
ctcgcccaggtctttgcaaaagcccatttttacatggaaataattcatttagtataattagaaagccataagttttcacttattcattcagaaatgatttytagttcctataaacactgtgctagaaaataacatggaaaaatgaatgaaatacctctcttgctcctaaggaactcacaggctaaagacaccaaggtgagc

SEQ ID NO: 33753 - DNA, 201 bp, Bos taurus
ccacacaccaacatcagcagctgaacaatagagaggctggcccatcaaatgccggatgcactgaactacagagtaggaccccacccaaggtgctcctttargagattgatgcgccaccccaggggcccccatctaggtacctgacacgccaaacaacagaaggaccccaggcgagggagcccgctaaatgcctgaatggga

SEQ ID NO: 33754 - DNA, 201 bp, Bos taurus
ccatctacatgctctcccttcctgcttctctcctgcctacccttgggagtttccatgtcctactgtgatgttcattcccagtgtcacttattccacgcagmtgatagacagaggaggtgggatacaggcaagagaactacagccgcctcccaggtgagttctccagaaagatctaacataaccgacaggagcagaagggga

SEQ ID NO: 33755 - DNA, 201 bp, Bos taurus
tgtcttagcagagatcacaatgggctccatggcagcccggccctggggagaggggaggtcgaggggtgagtctcaagactccttgaaagatgaggtggccrgcagttcatgcgttcaccctgcctcacctcagggctgatctgggcaggaacactggagaactcagggttggacgcaaaggcgctcagattgtccacagcc

SEQ ID NO: 33756 - DNA, 201 bp, Bos taurus
ccagaagatgcaggagggagtgctcacttgagcatcattaaaagttcaagtggcttcctccctccaccctgcaccccatggggtgcattaaaccccaggaytcattaaaccctctgcccccagagcccaatttggttgaagggaatgtttgatcttttcatccagaggaggtctgaactaagggtttggggcctccctgag

SEQ ID NO: 33757 - DNA, 201 bp, Bos taurus
aataaacttctcgtacatttttttctgattaaaaatacattgcataagtaggaaattattacttattaaccagtgaataagaaaattttttgagctgagcrctttgctaaattgtgtacaagaagtccccattcagtctggaaataccattagtacacacatgaaattattagagttaagtgataaagttttcagttctga

SEQ ID NO: 33758 - DNA, 201 bp, Bos taurus
ctattcatctccttccgaagactctgagccccctggatagtatccgggtcccctaaggatccgcaagagacaattactttcctgggttacgcaggcctaarcttgtcattccaggctaccagcctgagactgtctgtgcccaaaggacaggcagcatcacagacatgcatccacagaggggccctttgtggttccataaag

SEQ ID NO: 33759 - DNA, 201 bp, Bos taurus
tccttctgggacggttaatctcctttcagagactgtaagtcctagtggcttctcagcggtccttaagaagataaggacaaggtcactaaggccactgtaaytcagacctctgatctacagttgctcaagattctgagagagtaatagcaaacgacgtctttcagcaagtaacgtacggcagtgagagatacacctgatgtc

SEQ ID NO: 33760 - DNA, 201 bp, Bos taurus
gtatttgatgattttgttagcagagcacaagaaataaaaaattaatcttaaacatcgaaacaaacataaggaagacaaagactgcctctggcaatggatckctcataaaaactttctttaaaggcaaaacagcactgctcaagaatgcaaagtccttccaatgtttcccatatagtacctatctatatctttcttgctggc

SEQ ID NO: 33761 - DNA, 201 bp, Bos taurus
agataaaaccctatcatcttaatccaactgcccatcttagcatcattaacagtgggccaaccagatgtgacttctgatgtgatacactgtgaaattcagayatcacctctgcttggtaatcaagcaaaaaatactttccttggctccatcaaactattggatgtgattgccagtttacaggaaacacaggggacagacatc

SEQ ID NO: 33762 - DNA, 201 bp, Bos taurus
ggatcttaaaccactgatcattagactgagtccctttttataataaaatattacttgtttactacatggatatctggatttttatctttactgtgaacttyaaaattttttcaacttgtctatccacctcccagccaacttcttattttgaaaaatttcaagctccttgaaaagttggaagactgagatagtgaatacctt

SEQ ID NO: 33763 - DNA, 201 bp, Bos taurus
tgattccagaagaatagtaaatataagtggacaagctggcaaggtaggggaaccttggggctcctctgaagggctttctgggatataagggcctctgccarggctgcaggctctggttctaaatttttttctaatttcacatctcatctcagagttcatctttcccttgagagagtttgtcactggcgagactcttggccc

SEQ ID NO: 33764 - DNA, 201 bp, Bos taurus
aaacagaacacagagaggccaagtaacttgcccagtgccacacagggattgcccagaagatgcagtcctaaacagtacactatgccacccatccctggagygccaggcccactctgagagccgggctgagttaagacatgatgttcccttgaggaaaacccagtttcaggacgtgaaaagggacgctatcctttagtgagt

SEQ ID NO: 33765 - DNA, 201 bp, Bos taurus
gaattgttcacttccgagacaaagcagagctaaaattctgccgttgcaaattctggtgcatatatctttttcttctcattctggcctgatgagatgattaracttagcaatataaatgaaataatcatctgaaaaagagagaaagatgggaattccctggcagtccagtgcttaggactcagtgctttcactgcggtggcc

SEQ ID NO: 33766 - DNA, 201 bp, Bos taurus
tggacttgagtttgagtgaactccgggagttggtgatggacagggaggcctggcgtgctgcgattcatggggtcgcaaagagtcagacgtgactgagcgamtgaactgaagcttcaagacatggccaaaaatttgattaagtttagtaggagggtgtgatttttggcatatgtattacctgtaacatttgttgtcatttta

SEQ ID NO: 33767 - DNA, 201 bp, Bos taurus
ttaagttccacagcagaccagtcattcattttctttatttttttctggactttctagttcattccattagcctttatatctctgtacttcattgtaaatayttttaaataaacattttaaaatgctccagttgtaatagtaatcctcttgctatagaatttacttcattttatcttaagttttccatgcaatatattgggt

SEQ ID NO: 33768 - DNA, 201 bp, Bos taurus
agccctactcaatgcttccaggagttttgtgaaaaaatacactggagagctaatccctctatattgaaatttacatacacacacacccacctgtctcccckcagactggcacctctcttgtatggactagatctgatttatctctttttcctcagtgacccaactgagaatgtgcttagatgcttattaagtgaattgtca

SEQ ID NO: 33769 - DNA, 201 bp, Bos taurus
cacctgctaaaaggggaagatcttgatctgcctaaacctgtcagggagatggtcagccaagatggtggcccaccagcaggatgctgtctgaaagacgggcrtgcccaagtcagtcagttccaggacagagtctgatagtactgcacttcaacttcaaaataatttacaacaaacttcgtgctttatcctgttcagaacttt

SEQ ID NO: 33770 - DNA, 201 bp, Bos taurus
tgcgggtgtcatcatgaatacgtttagattctgatggttttgacacctcaaggcttaatttccagcagtgattagatcacagcatatgactggcctctgarcagcctctgtcctcatggggaagcaggcaccgtgtgggtcacttccgtcactcgcaccgaggggtggtgtggatggggaaaggccttgagtggtaagtat

SEQ ID NO: 33771 - DNA, 201 bp, Bos taurus
cattgctgcccacctctgcatcctgtgagccagccctgggggagccggtggttgggctagtggggctctggctgccttcaatgacaatgccacaggtcctygggctccaggcctggtccctgctctccaggtcaagggacattaaagagtccgagtcctcggtggggagcacgccaggagaggacctgatgagccctaaga

SEQ ID NO: 33772 - DNA, 201 bp, Bos taurus
gggttcttcccatcttcctcttcgacttcattaacagactcgcacaacctccaggctgaaggcaaccgcagagatccaccttcctggccccgtttcacaaraggggaaaccaaggcacagatgttctccggagcagctaagcctccaagtgccagcagagcgcggggccgcgggcggcctgagggcagccctcccggtgca

SEQ ID NO: 33773 - DNA, 201 bp, Bos taurus
gggtgggtgggtgtggcctcagacatgtcatgccctctgcctgggtgatattttgggctttacagctagtgctgcaaagcacaggatgtgttagatctcarcaactagctgtgagctggcctgaacgccaaagctttcatggcattgtgggtatgaggtcgctaggggaactgatttagtatctaaggaggttaaagaaaa

SEQ ID NO: 33774 - DNA, 201 bp, Bos taurus
tggcctgtcccagtcctgtcagaactttcctgaaaagctgaacacgctcaatgtcaagggtcaaaagggcaaggggcactcggggtaagagaagaggaagygactgccagtgtgggcctgctggtcaccacgggaacctgaacttcctgctgtcctcctcagcagctcctctccccacccggccttcccagtcctggagct

SEQ ID NO: 33775 - DNA, 201 bp, Bos taurus
cccacgtctggcctcacagagacactagggcatggggttagagcaggcccgggggtagcaccatcagggctcaaatgccacgtctgtcctctgctgggttkttacgcacgttactcaaattcctgtgcctcagtttctactcactggggataataaaagtacctactgggaacttccctggtggcccacggttaagaatcc

SEQ ID NO: 33776 - DNA, 201 bp, Bos taurus
ttaaaggtaagtgaccccaaaggttgtcttctaagacctgcctctgtttttaaatttatggtttctgatgggccaaatgttgagtgaaataagaggccaaytaagcgagttagaccttcagtcagcctctgggtagagcttcagggctgggaacagtgcaattgtgtttcttgatgagatggccgttcccgcagagcaagc

SEQ ID NO: 33777 - DNA, 201 bp, Bos taurus
ggctgtggccagtggagtgagggtagcactgacttggtggcttggctttggtgggtcatctcaaaaacttaggagacacctgactcacacaatagccagargggattctcaagcatcatctttggccctgtctctaacccacacaatgactgtgtaacactgggggcagggggtcaagtgatgatgaatgaggatcagcct

SEQ ID NO: 33778 - DNA, 201 bp, Bos taurus
tgttaaagggcatgggtcccttcagttccttagggtctgattccttctccttcaggctgtcctgtccggagtctttggcctctccctctaggctggctccytctcttcaaacagccctccctgacccacgttgggctcccctcccctctacccaccaggcccccttttctaggggtgttttcaccaaggatactatgggtc

SEQ ID NO: 33779 - DNA, 201 bp, Bos taurus
gggagggggccagttcaggctctaaatttagtaagaaaacattaggaaaaaattagagtgaagtataaagaaaagtctaaccaggacatgtataagactarggttgaaatttgctggtgatggccagagaatagtaagaaagaaaccaaattgtttgtatttttctttaaaacagacaaacctgaccatgaaatgcatgct

SEQ ID NO: 33780 - DNA, 201 bp, Bos taurus
tggccaagatcttccagcatcgattcccttatatatgaaatgggtattactacacttaccttccatgattattatgagaattaagaatgatgactcttgargacttccccggccattcagtggttaagactccaccttccaatacaggggtgcagattcaattcctgcttgcggaattatgatctcacatgccaagcagtg

SEQ ID NO: 33781 - DNA, 201 bp, Bos taurus
gaccattaactagccaagggaaatacagcagttttgtttaaatgaattctcagtcagtcacaacacattttaaactccctagtcattaagaattacataayggatttgaaatatcataggctacaaatctgaaaggtctatacttaaatcctcccttaatcaacattaaacatgaaaagcaggaggaacccatgattccta

SEQ ID NO: 33782 - DNA, 201 bp, Bos taurus
acagcctgtggatgatgtgtgtgggtaaagtatggggctgcctgcacactctgccaggagggctggctgcctcacgctgtgccaggccctgaggtcaggargatggatatctgggcacagctctggtccatttgcacgtccccaaggcagaggaaccagagatcaaattgctaacatccgctggatcatggaaaaagcaag

SEQ ID NO: 33783 - DNA, 201 bp, Bos taurus
ctctgttcaatccccgcaccaagtttttcttggtggtggacaggggtttccctagaaaccccccaacacccaagatgggctgtgaggagaaaggagagggyaggtgcaaggcccaggaaacgggtaggtgggagctgggcctggatcaaaaggccaaccagtatttgagagacgctgtcgcccacaaagacgggagctgta

SEQ ID NO: 33784 - DNA, 201 bp, Bos taurus
ctctccgccctccgtcccagcctccttttctggctgcttgcgttacctggggcgcctggtccggctgctaccctgactggggctggactcagcaaattgtktacacagacaaataggccctgattaactcgttcaacctcatgtctcattctaccacttgacctaaagtttttccccttccctcctgtcaggcgcatctct

SEQ ID NO: 33785 - DNA, 201 bp, Bos taurus
agtggacgcaggaaaatcctacacacctgttggcagatttcactctggcccagagttaccttcttgatttaattccccaagacttctatgtctgaatcatrtaggaaaatgacttcttggataaaatattaaaaggccacacgtggatgttcacagtctccctctgacagctctggtgataatggctcagagggagaagtg

SEQ ID NO: 33786 - DNA, 201 bp, Bos taurus
acagagggtccccgggaccactgaggggccacagaccagccttccggtcctcccttcctcctttccttccttgatggccttttgcgtgcctgcgacataamtgtaattgctgatttctctgcctccccacccaagtctctaggagaccaggtggccccaggaagctcttctacagtactccttgctcctggggtgtagaca

SEQ ID NO: 33787 - DNA, 201 bp, Bos taurus
gtgttgacacaccttctgaccccacaattcagctcgtgggcatttgtcctcaagaaacgccagctgggttcatagggaacatgtccgaggacactcactaygtgtggagccagggagttgaaggtgatctaggtggtgtcatcaggggagtggaggctatgtcctgtgagggccatggcctagatgtatactcggccatgt

SEQ ID NO: 33788 - DNA, 201 bp, Bos taurus
ccaacctgttctttgaagtcaagcccaactgtctagactaaaagtctaggccactggcccaggggctccttcaatgtttaaaccaataggatatgagtcaygtatgtcacttaaaagacttcagtaaccaaaactagttcatcacagtaatcaagttttgtttctgcagcattaggaggggcgatggcaccatccagtttc

SEQ ID NO: 33789 - DNA, 201 bp, Bos taurus
ctcattttcatttgaggaaactgaggcccagggatagtgagggtctagctgaggtggcagatggaggcactaaatctcctgattactagacttatgctgtyctgttctgccacttaataacaggcccactaagacatcacaaaaagggccaacttggatgtgctctgctcctaggcatgtcccaagttgagaggaagagca

SEQ ID NO: 33790 - DNA, 201 bp, Bos taurus
aacagtgctgtgacattagagaccctggaggtggcagagggcagggtctcagaagtctccaccatggacttttgcttggccctgcagggggctgtctggcrtgaacatagatgtcctgagatcagacaaatgacagcttcttcttagagggctagatctacggtcatggatggtagcggagacctatgtttacaccctcaa

SEQ ID NO: 33791 - DNA, 201 bp, Bos taurus
actttttcttccacctcattccctcctctgagcattccccaataaaccttccacaactctcaggttcctaagggaacctgactgaggccaggctcacccakgttcaccttggctcagcttaagccagtggtttgttctctgtttttaaacaatgacacctcttacgctgagaactcagggacagctgcttgcttaagggta

SEQ ID NO: 33792 - DNA, 201 bp, Bos taurus
ctgaatgtgcgaaaccaccatatggcacagacattattttgatctgcatttttcgatgaagcaactgaggctcaaagaggctaagccacttgcacgtcatyacagatcaagtgactggcaaagcagggagactaatatcaccagcttccattccacagactgttatgcttcttctgtgtgatgaacaacttccaaaattca

SEQ ID NO: 33793 - DNA, 201 bp, Bos taurus
ggcgctttgccgcgcaagaaataacgggaccgaattgctctgatacctaacttagccctgagttacctggagaaccccatccatcgtgggcagtgactctrtggatgatgggaagagctatagactgggaaccaggggatctggtactttctgttcctgggtctttgtttccccaccaagacccagaggcggttgtatgaa

SEQ ID NO: 33794 - DNA, 201 bp, Bos taurus
gaggtccgatgaggctgtgcaaggaaaaggtctcggcccagtgcctggcacaagggaagtggctgttgtcgcacttgttcggggctctggctatgagaggraagttggggccctcactcctgtgagatggagagccctcctaggagctcatttctggtcccatgggaaaggcagcggtggtgtgggcctcctccctcctgg

SEQ ID NO: 33795 - DNA, 201 bp, Bos taurus
gccctgcagaagagaaagcacaacccagagagtgaaggacactcgtctacaggcgcacagccagcagtggccgagctgtggccaggacagttgttccgctrcagactgacgcaaggctttagacccacccgcctcacccgctgggtcttctcagctctggcctccttttccaaagagggttcgtatttgatacttatcaaa

SEQ ID NO: 33796 - DNA, 201 bp, Bos taurus
gaaagctcgttctattgaggcctcttgtgactgcccttgggcgtagtccccagaggcacagtggctggagggtgatgagaccataaggcctcttccttcaygtgccatgatgttcagacatataagaagaggaagatgggcttaagatatttttctttcctggagacttgggcccaggtcctgcaccagctctgtgcttcc

SEQ ID NO: 33797 - DNA, 201 bp, Bos taurus
gtcagaagtcttcatcccctttttccgttttagtggctgatctgtcttctctcttagcaaggaagaaacctctgaatccttccaggggactttttgtcacrgatactattcttggagtaataatgctgtgtttggttttgaatgtgttgactttgcactaacaggtaagccaagcagaatatgcccgggcaggcagtttgg

SEQ ID NO: 33798 - DNA, 201 bp, Bos taurus
tctttgtccgatttacttcatgtagtacaatcatcgctaggtccattctcgctgcaatttgccaacacatcttcatagaaagctgactttcagaacagacyggtggcaaaagatctgagggtcaatttctcacaggtgagaagcacggcacaggccttgtttacaaacccagaaagacctgctgggatttttctctgctct

SEQ ID NO: 33799 - DNA, 201 bp, Bos taurus
tttaacatcttagtggatccctcattgattagcgagttgaataaaatatttgacttgtgtttatttcatacttgagagagtcataattttatctttttgaraatcattccttaccaagattaaagtccaacactttctgctaagaaattctattactatttgatgacagtactaccttacctgtctatagtaatttatagt

SEQ ID NO: 33800 - DNA, 201 bp, Bos taurus
aagattattattatccttacatcaaagatgagggcactgagacttagagaaataaagtaagttgctccaggacacacagctagtaagtggtagagacagcratcaagtccaagtctctctgacattggaatctttgtcctcaactacacaacttccactacaatgtcgcattctacagcagctcatgggtatggtaaagaa

SEQ ID NO: 33801 - DNA, 201 bp, Bos taurus
tacaaatctttcttaaacttattaaaaaacagaaaagggataacttccaaacttatattatgaggctagcatcaccctgttaccaaaaaagagaaggacamgagaagaaaaaatacaaaccagtatcactgataaacatagaagtaaaacttctcaacaagatagtcacaaaacaaattcacaatacatttaaaggctcat

SEQ ID NO: 33802 - DNA, 201 bp, Bos taurus
gccaaagccaactccaggaaccctagaactctgcaaccagagaccccagtacccagctccacccacccctgggggaacaccagccctagggctatcccaayccctttagccagccaagaccaggccccaccagctagcaagtcaacaccagcctcaggacaccttcagcccctcacctaaatgcgcctctcctaccagtgg

SEQ ID NO: 33803 - DNA, 201 bp, Bos taurus
tggagccagggtgtccaggacactgtagcacatacggccatctgtgtcacaatggagggaggtgcagagaaaagcgcagagggatcacgtgtgactgcacygtctctgcatatgacgggccattctgcgagaacggtgagtgtgcccaaggaacagggaaaggctggagcatgagaagtccatgaagatgcctctggtatt

SEQ ID NO: 33804 - DNA, 201 bp, Bos taurus
gatgggactttgtttagtattttaaatctttatttcaaaattattctcaaattcatcctctatttctctttctaggatattaactgctattagctgcttcyaatggtggtcttatttcagaaatgcagtttttattttgttaattataaccatttagctttctatttatgtgtttaacagagcgatgccctgtagtgaagg

SEQ ID NO: 33805 - DNA, 201 bp, Bos taurus
ttaggcatacagtggcattgagattccagtgagattacttagagtcatgccaccaatactttttcataatttggatcattttatctgggccatgattagtyccagaatgtaaagctttgagtaatgacatttttaaggactcaagaaaaaccaggctgctctccaggccctcagtgagaccgcatttaatattcaatttgc

SEQ ID NO: 33806 - DNA, 201 bp, Bos taurus
cctgtacaccacaccctcaactccaataaaggcaaagagctgggtccttgccccttctctccactcaagatctggctgggtggcccctgatgtgctctgtmccctctagtacctagaagcagtaaactttgtgttttcaaagttccctaataattattgttgatcctaatgatcatccttcagtcataataaggaccacaa

SEQ ID NO: 33807 - DNA, 201 bp, Bos taurus
aagacaacactctgtctggccttggctctcacttggagatgaccagaggatggaaacagaagtggacagtacggtgagagcagaagctctggctctggcayttgccagtggaggggcctcaggcaagtcacttaatatctctgaaccagctttctctgttgtaaaataaagaaaatagagtccactatgatgaactagttt

SEQ ID NO: 33808 - DNA, 201 bp, Bos taurus
gtcagtgctggatctgaatacttcctggcctcatacttcttgtgcggagtgaagaatgctgtagaaaccagcatgttttcatatttacagtacttctgtcrtttcctaaataagtactggcctgggagcaccatcagtgccctctgttttggtggcatgtccaggcatgcagtgttccatctccagcagcacctggagaca

SEQ ID NO: 33809 - DNA, 201 bp, Bos taurus
gctagaagcaggattttggttccctggccagaaactgaagtcaggtcacagctgtaagagtgctgaatcctagccactagaccaccagcgaaagtgatcckgttctgttggccttgtagaaatgaatttccacaaaaagccagaaactagtgaaacaagtaaagtgtttattaggagggaaaaagtataagtggatagact

SEQ ID NO: 33810 - DNA, 201 bp, Bos taurus
atctacatccatgtctatattcatatttgcctatatgtttaccagatgccaggtgcagagtaaggagaagacagaagagggaggtagggtagggtgttctkaggaggcctctttctgatactgtgatattcaagagttgacaacagtaaggaaataagccaagagaaacatcttgaggaccacagcattctaagcttttgt

SEQ ID NO: 33811 - DNA, 201 bp, Bos taurus
gctctgcataaaagattgggctgtgtcacacagtgaaagaaatgcttttcagtaaaaggtcaccatttgtttgatatagaaaccttctctgaattttcatmgataccccaactatctaattttcactcctggggggtttgttgttctatgagggtgagatttaaagtagaaagtatggctctggtatctattaccagaatt

SEQ ID NO: 33812 - DNA, 201 bp, Bos taurus
tctgttgtaataccctggaggaactgcgctacaggaggtggtggtctctgggcgggtaccacttctcgctttttagagagtaattcattatgaaatcatakaaacataactttgaaagctaacaatgactggcctgagactctttatgcctatttatagaaggtataaaaagaggcctgaccctgaaacccttttcagcct

SEQ ID NO: 33813 - DNA, 201 bp, Bos taurus
aaatgtgctgggcctatccaggcactgatgagcagactggtccagaggaggtgagggctgtgggtgagcagagagaaaagtcagggtggagagttagactkcgtcaagccaagggggcctcagatgctggctgaggcattcggacctgaataagcgggagccattgaaggataatgaacagaggttattaaaacaaaatat

SEQ ID NO: 33814 - DNA, 201 bp, Bos taurus
gtacagaggtggatagttcattccccagagagggtctgtggtgtgatggggatacagatgagatacagtcccctggcagtgctgggtgtggcaggaggacygatgggccaacggaatcacttctcccactcttgtgccttagtgcccccttctgtaaaatggtacatggaaaatggatatatagctccttcttgatttata

SEQ ID NO: 33815 - DNA, 201 bp, Bos taurus
tattcttttctatattatcaaagaagtctgctgagatatgaacattggccttcaaactctatttcacccagatttaagtcaacattgaactttgtgtttcrcaaatggaaggccatatcactattaatccatttggtcatttctttcttcttattttgagctttcttcagttatttatgcttgaaaaagtctaaaatatac

SEQ ID NO: 33816 - DNA, 201 bp, Bos taurus
accctgggtttgatatgtctagggaactcatatcccaccggtgttaatcctgcctgtgaaatctcattgtaattataaacacgtgggcaggcccagtgagygctttgactagtagagcccttggaggagggctgatttggctgaaccagggtcctgattccactgcctggccctgggcactctgagtctccagaccgcctc

SEQ ID NO: 33817 - DNA, 201 bp, Bos taurus
gttgccagctttgctaagaggctgtgaacaccagcagcagagcttggagaagcgaactgacagaggataaaatgtctgaggtggatccgggtggtccacargacagcgaccttggaggaggccaatatcacattttatactgttcaaagcctgtcccctctgctgggaaatagcagtgggaaaaggatgcaaggtctggac

SEQ ID NO: 33818 - DNA, 201 bp, Bos taurus
gtaagagccagtatgcttacaatggcctgcagggaccaacactctgacctcattatctctctgaatttaccttctatgactttcctctcattctgctctarccccactggcctcttcattgttgtgcctcaaatagtccccacctctggacatttgagggcttcccaggtggcactaatggtaaagaacatgcctgccaat

SEQ ID NO: 33819 - DNA, 201 bp, Bos taurus
cgcagactagcaggatgatgaggtgtcattttatcaaggctctggaatggggtcattagatgtcattccctttctctaagccaatttgtctgtatcagctkttgtaggccatcagaatctctcagactcatggagagacatctgaaccctgcaaatgcttggcatatggcaagcatagcatgtgcttatgagctgtgtctc

SEQ ID NO: 33820 - DNA, 201 bp, Bos taurus
cctgaacacacccctcctcaagcaacaaaatacaaagaagctgtatggtactaaaaataactgtgtgcctgccttccgtagggtaaattctggacaaaagrtacaaagataccaaaaaacccaactgctacttttgaaatgcctgaagcaaggtcagagggtcaggagcaaaagctgggttctgtacatgcaatcaacacc

SEQ ID NO: 33821 - DNA, 201 bp, Bos taurus
gcatgtccgttggcagggctagcaacgttataaaaattggataaataggtctgtagtacgtcaaaggtcacagttatgaagacaacagtgtatcaagtctkatggcccatcaaaatcagcactgagagcttggtaatcctagttgggaataccatcagaagagtggcttgctgccaggggcaagttgagataaacggttca

SEQ ID NO: 33822 - DNA, 201 bp, Bos taurus
cccttctttccttctcccttcttcctccctccctcctctgtcctcacttccttctgcactttcatcttttcacattttcccctgttggcttcctttccctyccttttcttcatttttccttcccttcttctgccacatgccttctaaactccagtctaaggagcagcatcaggttgatggataagaatggccagagcttag

SEQ ID NO: 33823 - DNA, 201 bp, Bos taurus
tgtataatcccctccccttgagtgtgggtgggatatgtgaccttcttctaccaaaagaatatggccaaagtatgtgatgtcacttttatatggaaaaggtyatatgttgtcattgttataattatattagatcacattgtattaatataagatgccagagaagactcttgagagtcccttggacatcagggagatcaaacc

SEQ ID NO: 33824 - DNA, 201 bp, Bos taurus
gactggttagatctacttgcagtcttgccatgtaccttttcttctctcttcctcccagaagcctggaaaagtcctacaggaaggcctactgtctccagttytttgtaggacattggtctataccccctccaatcccatccctgtcatcttctccacaaaaccctgctattccctagtccatgaacctttgctggcctggct

SEQ ID NO: 33825 - DNA, 201 bp, Bos taurus
tggggtagttccctgcagtctgggagtgctaacagtcctgtgcaccttcccatgagaaaacctgtctgccatttctctttcaagaaggcacagacacctgyattcaggaaatcacagattttgttgttttttcagcctcccaagagaagccaggatgaaccactacactggtttccaagctgtttctttgtttgagcagca

SEQ ID NO: 33826 - DNA, 201 bp, Bos taurus
gtgggctacagtccacggggcctcaaagagtcggacatggctgagcaactaacacttttgctttcatttgtacagaaaacttgctgtgcccccagtgcacytgccctctgcctctggctggccctacactgctatccctctgccaacaatatctgcctggctggccatgaaaacatcacatgagttgctagcagactcccc

SEQ ID NO: 33827 - DNA, 201 bp, Bos taurus
cggttgacaggaaactagccttgtatttgccctgggagcagcagttctgtactcactaattcaatgttcacagcgatagacactgcctaccttctcagcargaaccaactgtacacccatacataacagcacaaaaacagggttaccctgtccagttctagtttcaaaaagaaaggaaggcttgaaccctcctataaataa

SEQ ID NO: 33828 - DNA, 201 bp, Bos taurus
gaaattttgaaggcttctgaagatgtcccagtttctttttagatctgccggagataagtgtttctgatttaccatctctgcagtcttagctggacccagcraggcctctttcctgcttcatcctggccaccctcgtgactgggaaccagctctgaggctggcactaggatgcttggggtttatttctctgaaataaattaa

SEQ ID NO: 33829 - DNA, 201 bp, Bos taurus
atggccccagcaaaacaatcaaatcagatctatgcttgtaagccctctgaaaggaagtgcctaggagaccctttcaatgagacaaaaggacttgtgagaawcttgagggtattggcccacagcgaatgacatgctcaaaaaaatatatggacaaaattctgaagacatagggtgaatcccaccaaaattcctaggaaatgc

SEQ ID NO: 33830 - DNA, 201 bp, Bos taurus
tagcttctgaggtttgttggccatcactgacatcccatggcacatagaaacatcatcccaatctctgccttcattttcacatggagctctccctatatgtrtgggcctgtgtccaaatgtccctttggttaggactcatcctaatgaccccatttcaacttaattatctctgcaaagaccttgtatccaaatgtcacattc

SEQ ID NO: 33831 - DNA, 201 bp, Bos taurus
gcccagagcaagcctgaaacctcaggcctaagtgacaccccttcctggtcacatgtgtggcactcctgtcccacctgccacgtcagcaggatgggaaccasctggccggtgttatcccattgtgcaaatgaggacaatgagatgggagagagacagtgatctacccaaatcactggatggttagcagcagatctcaggcta

SEQ ID NO: 33832 - DNA, 201 bp, Bos taurus
cctggtatccaactaggttaaattgctttctatatttaaattgcctgctagctggttagatgtgggagccacagctgtgaaatggatagttccagccagtmaatagaaaggaataaatcctaatggattaatctgttataattagacaattctgtatgactttgacatggagcccaactcctccgagaaagaggagagggg

SEQ ID NO: 33833 - DNA, 201 bp, Bos taurus
tgatttcctttaggattgactggtctgatctccctgctgtccaagggactctcaagcatgtagattataccaatatatgaaaattcaaacatgaaataacrttaagggataaaaagcaggaaacgatatacttatgcaccgtaggtagaacaggggaaaatggtcagtgaactgacacaatccagaaataaatttcaaaag

SEQ ID NO: 33834 - DNA, 201 bp, Bos taurus
aagaggtggccaaagtggttcctcctccctgggcatctgtgcatgagtttccagcaggggaaggaggaggcaggggcccccagacctgtctacctgcccaratttcttccctgcacattttccagaaggtaaaagcccacctctcctgctagcacagttccacacctccttccaatggcagcagagagagctggccgctta

SEQ ID NO: 33835 - DNA, 201 bp, Bos taurus
gccaccttctcacttcgtcttcacgtggcccttcctccgtgtgtgagtatccatggtgtcttcatgcatgcaaatttcttcctataggacacccttacagratttgactaaggcccattttaacaacctcattttaactttattacctctttggagaccttaactccagacacaatcacatacggagagagtggaaggtca

SEQ ID NO: 33836 - DNA, 201 bp, Bos taurus
tttcatgggagaagagaaggacaaggaggaatccaaagtcagactgaaacctacaaattggggaccaaacacagaatgtaggcctggctgccctggttctrcctctgccccaccttgtaagtcaggaggggaagaggagggtgggagagaggaaagacaggatgaagagggaccacatgccgtcctctgcctggccaggtt

SEQ ID NO: 33837 - DNA, 201 bp, Bos taurus
gtgaaagtggccacgagccgctggcagaccagactgcagggaagctcttggggaaggaggagagggtgcctggctcgctggcgatactgggcagcgaggtsgaccagatgaagaatgtcctgggcccgcagtggggtaggcagtgaggttcgtgggtaccagccagcctgtagggactctgcatctgcttccttggaagtc

SEQ ID NO: 33838 - DNA, 201 bp, Bos taurus
ctgataccttcgggtaaggtctgaactagctttttttttttttttctcaaaggttcattgaggcaaggatttgattgattgattgagtttttggccacccyagccatgtgggatcctagttgcctgaccagggatcgaacccacgccccctgcacttgaagtacggagtcacttggccactagggaagtccctgaaactag

SEQ ID NO: 33839 - DNA, 201 bp, Bos taurus
gtccctggagaagacggccagcagagctgcccaagatgggggtggcatgcacagtgctgtactgggaggaaggggggccttggggttgagctgcactgaayaacccagctgggaccccagggcaatctgcattcattcctttggggaacaggccggcaggctggagtgtatggggctctgattggaaccagagccagggca

SEQ ID NO: 33840 - DNA, 201 bp, Bos taurus
ctctagttcttgtgtccctaacagtgatcatcacacttcagagctggaaggacctagaggtcagccagactggggcctctcagactgatggcacacaatcycttggggacctgttaacatgcagattcttacgcaatcttacgtcaatctcccaagggccctggatttgacactgactgcagatgctgccagccctcgtgg

SEQ ID NO: 33841 - DNA, 201 bp, Bos taurus
atcccccttcaaaagccagaagatgactctggtccacccgcagttgaggaggaggttttcagaagccctctgaacaagccacccatgtgttgcctggcctygggcaccccatcctgctgtggagcaggactgatggcagccttcccactcccaggactagtcgaagacctgtgccaggctggggactctggtggggccagc

SEQ ID NO: 33842 - DNA, 201 bp, Bos taurus
ggaagaccagataacttcccaagagtagcccagggcggatgatctaacttggagagaggtagttccatgtttgttgggatggcctggtcctgtcatgggtrctagggtggagatgccagggcttggcagacagtcaggaccaaggacttaggaaggccctctggttcactggaggtccagcgtcctcatcctgtgactcac

SEQ ID NO: 33843 - DNA, 201 bp, Bos taurus
gctgcagttcacggtgtcgcaaagagtcagacacaactgagcaactgaactgaactgaagagttctaactcctaagaactgcttaggagtaaggaactccytgagtggggctgctggccagtcatgtagattacgtgttaatttcttaatagtcatcaggtctgcaaagtaggagaggctagtgctagaactttctgccct

SEQ ID NO: 33844 - DNA, 201 bp, Bos taurus
aagaaaaaaagaaaggctcacctttggcccactgaagtcctaatttcagatccaatttcctgggccctagggtttcaggcaattaagctgggcctgtgacrggaggaagcaaaagctactgatgtctgcatgggaaggaagcaggtctgactgagaccagcttatgaggacggccccagagggactaactcagaaagcgct

SEQ ID NO: 33845 - DNA, 201 bp, Bos taurus
agggggtgaggcatctgggacgtacagggggcctgaggactcagagcacaaagcgggctgggaatgcaagaggtaagagcgagcagagagcaggtgtatcrgggccaggcaggggctctgtatataagtggtttctcaactctgttgcatgctggaaccactgcagtggctgaaaaatgtccccagaggtagtaggcccta

SEQ ID NO: 33846 - DNA, 201 bp, Bos taurus
gcatcagtttaaactaaaaccaaggtcaccttgctgaggcaggcagcacaattgagtcttatttgagcaaagtctattccttctcttgtctcatgtgaaakagtaacacctaccattaatgtaagtagtattctaccatgccatctacaaatgcccttaagtcctggctagttggcaacagattttattagatttttctta

SEQ ID NO: 33847 - DNA, 201 bp, Bos taurus
gcacgcatctcttagtcaagatggatgttactgaaaagctgtctggtagaacatcccttgtcataactctcctttggcctccaaggaacctttctatacaygtgtggtcagggaggtctcctgactttgataatgagaaatatggggtctgggtggggcccagcctcattgccttaattgtcctgctgttctcatctcgga

SEQ ID NO: 33848 - DNA, 201 bp, Bos taurus
aaaatgcagacagtgcagtgtggggcaagacacggaggcatggacctgaatccaaggcagcaaatccacaaggttcagctgtgagccataatgagtaagaytgatgggtgatgccaatgagtttgtgaaatagaaattaaaagaaacccaaaaaacaaaaaactcaggctgaagcatcattctgacatatgtagcctaaag

SEQ ID NO: 33849 - DNA, 201 bp, Bos taurus
atcattccttgttccctccagatgcattaagtaaacaaccctttcattgttatttccccagctttaatttatagactgatactcaactctctaacaaacarcatcagtatcttgggcagatagtgcagtttataaacttctttcactgaacattcatattttcaaacatctgttatcttcatggtactgtgctcctgaagg

SEQ ID NO: 33850 - DNA, 201 bp, Bos taurus
aattagaataagtgtaatagaaggagaggatctagaaaaggtaggacccagggcatccaattccaattgcttaaccagttttcccatgaattactgaggcrttgacgtatctcaaggcactgtttgtcagatttcttgctgcttcctttataacgtcttatttattggtgtagaaacaggaggcttcctccaaaaataggc

SEQ ID NO: 33851 - DNA, 201 bp, Bos taurus
acagtgaatgtagttcattgcaagaaaaaaaaacaactgataggccccctttaggtaaactggagacacaagaaaaacagcattatatattttatgagcayataccaattcagggccatgtatcaaagtccttggagcatgtgtccatggggagaaaatgagagcaagaatttaatgataaagaagagaaaaatctaaaga

SEQ ID NO: 33852 - DNA, 201 bp, Bos taurus
ggagatgagcagaagtgtggaaagaagccaggagttccattgctgccagttgtcattattacaatccaggcacctgaaatgaccatgactcctggatgctrccatcttggttttgattttgaatgacctatgctctggacctaaggaaggcattcccaagtgaacatcctgggaggattctccccaggagatcaggtggcc

SEQ ID NO: 33853 - DNA, 201 bp, Bos taurus
ctgcctctaagggttctttttctgctgcagtgatgctgcagaaaagcgctttaaaacattccctgcttacaaatgcactcagttgaatctggaaatcccarcaagggactctaatctccagcaaatattctattcttgacaactaattccaccgaagaattttttttcttagatctaatgggatttaacatcttttgtgat

SEQ ID NO: 33854 - DNA, 201 bp, Bos taurus
aacctcagggccccctgcattcttcaagagcctcctcagatgaccccgaaggagcctgactcttgctctttctgtctgaatatcatgttacctctagtgtycaggacacttccgggcctccatcttgaacttgtctttgcacctgaatctttggtttaagtataattccttgtaagggagcacagttctgaagtgtctgtg

SEQ ID NO: 33855 - DNA, 201 bp, Bos taurus
cataatgaccccacagtctcagaagcttcaccaggtcttatccctagtattagtattctcaaagataatctctgccaggacccctttgtttgagaagatcrgctcatcaacttgaccgtacaagttcaggttgtgaatattaatgttcaagaatgtaaaattcaaaaacaaacaaaaatttaagaaaaaataggtaaaaaa

SEQ ID NO: 33856 - DNA, 201 bp, Bos taurus
cctatggaggtcttggagacactttcagatggcccatgagattaaaacttcctggtaataatagtaagatgttattggcctgtcttcactctgttctgtcrtgagtacacagtatagtttcccagaggctatgtcgaatgtgatactgcatcagattgaatgcagaggcagagagtctaaaggccttttgtgaagccagat

SEQ ID NO: 33857 - DNA, 201 bp, Bos taurus
gcgtggtgacattagaatatgtacctttagtgctactcccaggtggagagtacacgtgaggccacgattgaggcatccttggtgttgtcagtaacaccctragtcctcagttgaatcactgcagaaatgcttggaaagggcagcaagaagatggttaaaatcctaagctagtcccagactctctggctgtttcttagggga

SEQ ID NO: 33858 - DNA, 201 bp, Bos taurus
tttatgagaacatcattaaggccatgaggcctcagcccgagtactttgctgttggctactacggacagggcttcccttctttcctgcgggtaagaagcgckagggtggtctccctggccattgagccatgcagttggaggagggaatgtcttcatctcttttccagatgagtctagtgtgttagcagctggagccctgtgt

SEQ ID NO: 33859 - DNA, 201 bp, Bos taurus
gacacagatgggactggccataaaccagtgggaactgcgccagttgctaggggcttaattccaggccagctaaccatgaggggtcatgtctccttcagccrcccaacttgaccgaccggaagcaaagccgcacaggatctgtgatgatcccctacatcatgtcatccacactgcggagattgtccatcacctcagtggctt

SEQ ID NO: 33860 - DNA, 201 bp, Bos taurus
ctcaattcaggatttcatactcctgatcccatcattttatacagtaatacttgacttccattttacctaatttgccgtattctgtctgggagacctatgtyctttcctatgagtgtctaatgttctgtatctgagctgccccatatggtcgccactagtcacatgtggctgtgcttgtgtactagttgttcaatcatatcc

SEQ ID NO: 33861 - DNA, 201 bp, Bos taurus
atgtcttcgactagagcataatgtattgaatttttctaaacaaggcttcatgtcccctattaatcaggacttctagtcaggagaattgcaaaccaaatacraaaattccacgataatccacagcttttgagaagagggtaaaactcagaacctatcatatctgatgaatgttctggagattggctttggaataactgtcag

SEQ ID NO: 33862 - DNA, 201 bp, Bos taurus
tgaagaagaccatgaaagggcggcagctgagtccatgagatagagcaagatttggagtcacatagatttgggtttgattctcggctctgctgctcattacycagatttcttactctgtcagaatggtgttctacaagatgagacgaatgatacctccgtcttagagttataatgaaacttgatattgtcataattgttatc

SEQ ID NO: 33863 - DNA, 201 bp, Bos taurus
aggaagcaactaataaatgctggctactattatcttattccataggagtgccttgggtttcacatagtacagcttgtatttacttaatacaagatggacarattagctgtcattattcttctattttttgtgcgaaatttcatgagtttttttcttcaaaataaattgaagaatgattttatatttcccacaagaaatata

SEQ ID NO: 33864 - DNA, 201 bp, Bos taurus
acaacaaaaaatctttaaaaaaaaaaattagcctcatatataatccaaatcttctcctgtatccttctccctccttcccccatgcagaggcttgtggcctrgggactgagggtgggaacaagactgatcttcactgtccctctgcacttaccaaggtgtgttttctctgacattggggccaacggaagaagaaagagggag

SEQ ID NO: 33865 - DNA, 201 bp, Bos taurus
caccagttttgaagcccaaattattatagaatatattcttctttacccttttacccttctcgttcagtttttccaggaagtgagatgctgttttcagagcrtcagtttgaaacagggtgattcttttctatttacaaacagtgcttttttttcagaaagattttctcagtgtcatccttgatctttggttctgtttcttaa

SEQ ID NO: 33866 - DNA, 201 bp, Bos taurus
cccatcccccctctcccatcattcattgttcttgtcacaaattaaaacgaaaagcaggcagtgctgagggaaagctgtggccccactcttgacacctccckcgcagaaaagcatgtgacaaccggttcccatggcaacgggctttctttgaaataatttctccttcggtgtaccagtcccccgcctgtctcttcttgggag

SEQ ID NO: 33867 - DNA, 201 bp, Bos taurus
ataaaaatgatacaacaaccaaaaagtaggggataaaagcaccaattactgttcaaataacaagcaacaacaacaatacaagaaatcctcttcagttcctrtaagactaaagagctacaaacagagggaaaaaaaaactggatgagagcactgcctagcaaaacataaggcaagaaactcaagctgcagggaagaaaatga

SEQ ID NO: 33868 - DNA, 201 bp, Bos taurus
ctatgagataggcccaaatgtttctatgcttaccataaatcacattgtatacttttttgataccttttatcttccagtccatacagatgtagaaggacttscctggaaggccaatggttaagactcaatgatttcactgcagggggagtgggtttgatccctggttgagaactaagatcctgcatgactatgtgatacggt

SEQ ID NO: 33869 - DNA, 201 bp, Bos taurus
agccttatactcataatactccattttgtctctacatacatgacagttccataaaataaccacagagaaaaagaagtaagaaaacttaaatgcacattgcyatgactgtgcaaatactttcactgaattttagaagataaagaaagcagattaatatcctgtgtgagatattcaagacttctgacacaacacgactgaaat

SEQ ID NO: 33870 - DNA, 201 bp, Bos taurus
tcaagtcacagcagaatacctgcaatggagtggggccaccaggcctaaccagggactaccagagaggggcaataaggggtgttattgccaaggtcagggargacagaatgctaggaatttagggaggcaggtgaaatttaaaagaccatagaggccagagtagggggtaaagctaagaagtcaggcccatcagtgggagat

SEQ ID NO: 33871 - DNA, 201 bp, Bos taurus
taaggcaggagtctggaggcaaggcagagggagaagaaatcaggatgaagatgtaaaaggcagcagaacaagaatgagcaggctgaggtcagcagagaccrgagccccggagcccctcctcattcctgataccaatacccccctccctggacagaatcgcctcccttccctcctaacacaaaggggctctcttctcctcct

SEQ ID NO: 33872 - DNA, 201 bp, Bos taurus
ctgggctgttctgtgtggggaatggcccacactgcccatgtgaccagttccaggtagtgagaactgtcctttcactctgccccaggatgagtggatgaccrtcctgtggcccttaggagagctgatgctcattctgctttgtttctgaagaaggaaagaaaggaggcagcagcttttcatcccaaaactactctctacttc

SEQ ID NO: 33873 - DNA, 201 bp, Bos taurus
tttgctacctgaccccttccagaaaaagtctgctgacctctggcctggtcttctgaccttttctgatgtcatctcctctgtatcttccccacctcagcccyactggcctctttacggttccccaaatgtgccaagcacacagagcttcataaatgctccccctggggactctgtacatctggtccctttgcctggaagatc

SEQ ID NO: 33874 - DNA, 201 bp, Bos taurus
aggtgcccgtggcgttgacgatggcccactcgccgctctcccagtagtccttcaggtccaccgtctgctccatctgcaccaggtcgatcttggccttgtcrtacgaccaggagccaaacttcatcttgcagttctgctggtcgaaggggaagaaggtgacgtcgatgctgcaggagctcttgtagatggcaggcggtgccc

SEQ ID NO: 33875 - DNA, 201 bp, Bos taurus
tgttctgtcacgaatattttccccttcacggtttcttaaaagcaaaagttaaggtttttccagtctctagtcgctaagcaatcctctgggtatatgctaaygtagagaagttgttaacaagaatggaaatgcagataaaaagtagcagataaaaatccagctgctctactgactttttaggcaactcccaaagccccttcc

SEQ ID NO: 33876 - DNA, 201 bp, Bos taurus
agatagtccaggccccagactcaggagagggaagtgacagtgctctcagttaacaacctccaaagagcgctgaggagaggaagccctgccactgaaatggmgtgatttcagggggccctgtccacaggaatgggggccctgtccataggaatggcacctcctagaactgcataacgtgtcagccctgtctgctccccagca

SEQ ID NO: 33877 - DNA, 201 bp, Bos taurus
agtcacggcctccgccaccgattgctcatcacagacagacagacaagtaaggattctttagctgcttcccaaagggccatgtctgttcggagatgccaccraggagtaaattgccctgggctgcactagtcattggcacctcattgggtctggccttggggtgttgcattcagatatatgatgtttgactgagatgctgga

SEQ ID NO: 33878 - DNA, 201 bp, Bos taurus
aactattctgtggttaagagaattccggggtaggggcccaggtttaaaccctggtcagggaactaagatcccacaaactgtgcaaaatgatacctcccccmaaaaaactattctattattaaaattaaaaaaggaatgagatgagagtgaggatttgttactatcctagccactccagccactaagcccagatatccaccc

SEQ ID NO: 33879 - DNA, 201 bp, Bos taurus
ctgtgtgtcatttattaataatgtaattaaaataacatatttagaattctgtccaaagttaaacatggagtcaagcatagagaaaattgtgttgtaactgytgtgacagcagagaagaatttacagtttaaactctcttaacttgtcatgtgggttattcatacattatgaacaagctcgatactgataatgtacagggtg

SEQ ID NO: 33880 - DNA, 201 bp, Bos taurus
aggaggaaaaagtcagacaggcccctgcaaataggaacagggctggctcaacaacaggaagctggcaggtctctgcagcccttccgtttgtttccaggctyctgggatgggtcacaggccagtcctttgagcagcccctactcctaaccccctgaagacgactaacctgaatacgggttattagtgaggctcccatctcga

SEQ ID NO: 33881 - DNA, 201 bp, Bos taurus
ccacaagtcaaggcccatttggctgggatgtggccagccaagggcactctgccctctggccctgccttagcacacagtgagtgctcagtgggcctggtgcrtcccctcctccagctgagctgcctgccctcaatgccctcttaaaattcttaacatttgacttcattttttttttttttttcaattggccacaccacatgg

SEQ ID NO: 33882 - DNA, 201 bp, Bos taurus
ggagtactctaagtcacagagaccttcaggtacctaaggttgccattgggctcctaatctgtgcgggggtgggggtggggaatgcagacctgggtggcccmagaacccattctcttaacctctgtgcaatgctggcagtcctggaaaagcgtgtcccagagagccgtggccctctgggcccccttggagggctgtccactc

SEQ ID NO: 33883 - DNA, 201 bp, Bos taurus
atatctccatggcttccagtccccttcagcaaccccaggctctggaatcctccaggaaaggggaaaggcactctctcttggggcctcatccccttctcttygccctgcagttgccctaggggacacatcctgggaatgaggcaagaacctgggacaaaagaacccactgattcaaaggcctgggaaactctacaggcctca

SEQ ID NO: 33884 - DNA, 201 bp, Bos taurus
cccgagacccgcctggtccgtacacccagcgctccagctcctccacccgggcctgtagccgctgaacatcggtcacagccgccatgactcccgctgcccckcctcagccaggaatagccagagggcaggacatccgtccaaatagagaaggcgggccaatccgagtggacgggagcccttgcatacaggaagtgacgcaac

SEQ ID NO: 33885 - DNA, 201 bp, Bos taurus
gccaggcacaaggtagtgacagaaaggttgtgcctgaataggggtggtgctattggggaaggatgggatgcagaggggatgggattagagatggagatatkgctgggatgggggccccagaagagaggggctggaatctgagtacattagaagagagatacttgagatcttgggttggagattttacaacaggctgagatc

SEQ ID NO: 33886 - DNA, 201 bp, Bos taurus
tttatactaacaggcaaagggccaaatgggccttactttgattccttttatagtctattagcataaggccctgagcacaggaatggggatggggcaatgcmcaggaaaataagcctttgctcacatcttgatcctcggtccataccacattttttcatttatggacatcacattatcaatgtgcttatatatgcagacagt

SEQ ID NO: 33887 - DNA, 201 bp, Bos taurus
tgggacctacagattggggtttacaaatttttaaaagtccatcttgtttcctaattattaaagtaatatatgcccactatagaagaataactaaatgaaaraggaaaggaaaggccaactgcaatgagacagtaaaatgatgtagctcctttggaaaagactctagcagtttctcaaaaatatcaaatatagagttctcat

SEQ ID NO: 33888 - DNA, 201 bp, Bos taurus
gtgcctgcagccagcatgctgtggtggccatgattctggggcgtatttgaaagtgaataggattttgcagatggatctgacaattttgtatttcatgacaycactggccagtgggagaagattaaccagagaagatgggcatttaaaatcagacccatctactcaagatggggccagtgctgggaaaaagtgttttaggga

SEQ ID NO: 33889 - DNA, 201 bp, Bos taurus
actacattccagttataattgttaaatatgctttaactttagtccttggttgtactagtcctatttcaaattctcagccacatatggccaagtgtctaccrtactagatggcacacatacagaacatcaccatcgtcacagaaagttctattagacggcactggccaagagcaaagcttctttaaactttaatctacattt

SEQ ID NO: 33890 - DNA, 201 bp, Bos taurus
taattttcttttaaatctatgaatgcctgtgcccaaaggatcttaaggtgaattagcattgtaacaccaaatgttaaaaaagtaacagaagtcaaatttayatcaacagagtatcccagtgaattccaaactggaacaaaagcctagagataaaatattttgcacaacctcccaaattatatctaaggaaattaatgtaaa

SEQ ID NO: 33891 - DNA, 201 bp, Bos taurus
agtaaaacatgacacaatgaagcacttcaaagttagtaaagtgaaaggaaatggtttatgatattaacaaagcattcaaaatcctaaaaatcctcaaaagyaaaaaccaaatggtcctttcctcagaatttatattcttaaaaatagaagcaaaaggtcagcagtgaaatggggctcagttaaaaatcaagctgaattctc

SEQ ID NO: 33892 - DNA, 201 bp, Bos taurus
aatactcagctctgccctcatatcacgaagcaactatagacaatacataaaagaataagcctgattgtgtcctggtaaaactacttaaaaaaaaaacccartttggcccaggaggtctaaatgtctatttgaggcattttctttttaatatcttttgtttattaatagtctagaaaaaaataacaagagcgtacttcattc

SEQ ID NO: 33893 - DNA, 201 bp, Bos taurus
aagatgtctccagggtttaatctaaggcagaatttctagaacacacagtccacccatcatcttcaactgtaaaagttaatgccacattgttctccaaaatkgctacaccaagtgacattactactagtaatctcttcttgttcttctacatcctcaccacactgcctattgtctgatttccatcactagtcttcaccttcc

SEQ ID NO: 33894 - DNA, 201 bp, Bos taurus
ctctcaatactatacactacaattatatgtgtgtctctcacttcactccttctactaaattcaatagcttggaccatgtctctatctttgtactgcatgcytagcaatttttgactattcaaaaaaatatttggtgagtgagtgacaggatagaaaatgccatcccacactttagctattatgaaaacctttaggctaaaa

SEQ ID NO: 33895 - DNA, 201 bp, Bos taurus
attttctgtgattgaaaaatatgaaaatgtacaaactgtatttgttgggcaaatcagtatttagttcttaattccaaactgaagtttatattatataatamtatttagagcaaacaaatcttggaagaaaacacacattcacagtatacaaaaggattccttcctccccttctttatcctgagagaagagctagtgaactt

SEQ ID NO: 33896 - DNA, 201 bp, Bos taurus
ctaagtaaaacaccaaaaacataaaatttccctactcttaaaatgctggccatgtaactatttaaggcatagcattaaaaatctagctgtcccttcacatyccaaacacaacttgtcatctggcctcttgagaattagacccttaatgactgtccccatctggtgccattcaatcttctttctggttcatcttttgttctg

SEQ ID NO: 33897 - DNA, 201 bp, Bos taurus
tgctttggcttttcagcgttgttcagaagaacaatatctcccagttggggattttcaacagaagcaaaggtgtttccgggtgttaattggtgcctgaaaartgacccttaaaatacctgtttatctgcttctttttaaattggagtcctacgtgctataataggtggcccataattacttcttagcccattgttttttttc

SEQ ID NO: 33898 - DNA, 201 bp, Bos taurus
cacaaaagaaaatctggtgatttccatctggtataggtgtttacaatattaaataacttataaaacttgctagactaagaagaataccctctttgtgtgayaaaaaggctacatctgataagatcaccatcagacttaatggtgaaatttcaatagttttcccattaaaatctgaagcaacacaagaatctgtgcaccatc

SEQ ID NO: 33899 - DNA, 201 bp, Bos taurus
ttgtgcttgattgcattctgctccttgcattcagactgtgtgccggcaattgaaaagtagagtttgtagctaccaaatgagtgcagataatgtatctcatyactaggattggaatcaggtgtgatctcctagggcctctaatttgttcagtattttctatgggtacagagacaatgaacaggaattgcttagaaggcatga

SEQ ID NO: 33900 - DNA, 201 bp, Bos taurus
agctgtatggggagctgatgttatctttgaggcttttccaaatccacagggctctttcaatgacaagaaacaggtccctctactttccaagataaatgagrtacatacagtaacaaagaaagggcaacccagatgaagttcaccccaggaggcccctccaaccgagtgctgcaaggagatatcattaggctatgaagtcct

SEQ ID NO: 33901 - DNA, 201 bp, Bos taurus
tggtttcagttgctctgccctatgagagcagcgttccaccgagtgcctgggaggatgagaataaaggtcaactatttgacacgaagacctagaaagacttkcctgggtttcatagtgggttcctgaattgaaagggaactgagatgctatttaagaaactgaaggagaataatggtctaggatcttgacaggactagacag

SEQ ID NO: 33902 - DNA, 201 bp, Bos taurus
caggtggtaggagagaggacagtgggagcttgtacacagtttgactcatctaatgtgaaaggaagaaaagaagctgcatttaattgaggtctagctgcttmaaggagaactaattcccttctattcccatgttctaggctatgtccctattttaaaatggtgctttccccaaactgtagaataataaattcaaatgtactc

SEQ ID NO: 33903 - DNA, 201 bp, Bos taurus
gagcagacctttccaaacaggctggaaaggacaaatggcaaagccaaacactccactttctgtaacccattcttgttttctctaatctaatgcagattttmtgcctgtgtgctttttacacactgaggtctaaattatttttttcaatgagtaattccttaaaatatgtgggatgtgattgcatgtgtgcatttgtgtgta

SEQ ID NO: 33904 - DNA, 201 bp, Bos taurus
caatacactaagcagagattccccatgtcaccaaggggcatacagacatgtagggcacagggtgaagtccaagaaagcaggccttgatgaagattccttgrtcacattgggcagcagtaggtagtgacagtttctacccaaacccttgttgtgtgggcccgcctgggagcacgcttcctgtcacctcagcgaagccttcct

SEQ ID NO: 33905 - DNA, 201 bp, Bos taurus
ggataccttcactgtataaagaattctagttggcagtttcattctttcaacattttaaagatgtcattctactgtctcctggcttctactgtctctaccgrgaagctagtgatgacctaattgttgctttattgctcctctgaaggtgataatttcctctcatttgggctgcttttgaaacttgaagtcacatatattagt

SEQ ID NO: 33906 - DNA, 201 bp, Bos taurus
gtagacagctttggccaacacagtatcaaccaggagaccaaagcagaggaggactcacaccataccaagaccagctggaagtttctccaaggcctttgccrggaggatgggtgtcagaggttaacacccagagccccgtcacaccctctttctgaacctctgcatgttccacaaaggccagcggtgcctagcaaatacttc

SEQ ID NO: 33907 - DNA, 201 bp, Bos taurus
ctaaccgcatcatgaaacatatctcattaatacaacagttaatgcaatcttggaaaatgggttaaaggaagccagtattcacttgtaaacaaaagtctgartttgctggggagccagagatctaattacaatgctattatgaacagcattattattatcctcattattattacagtctgataggaattagcagaagcaggc

SEQ ID NO: 33908 - DNA, 201 bp, Bos taurus
caggtgttctggggggaaagcctgaataagcaattgaaataaagtgtgatctgtaagcagatttaccattgtaaacagaaccttgtaaacagaaccttcartatctctcataaaacacatcccatgaaagcattttccctaaggaaaaacaagaagagtgggactgaatgacatctcttgttctgaagcctctttgtccta

SEQ ID NO: 33909 - DNA, 201 bp, Bos taurus
tgactgggatgaaattctagatggttctcctgggcatcaatttagaagttttctttaaaatcttgtgagaagagatgcctcacggcaactttataagggtkgttggtgtctggcgaatgtctctcaaggattttccaaaccagctcagatttcagaaaggacagactgaagggataggaaattttgtaaccactgttaact

SEQ ID NO: 33910 - DNA, 201 bp, Bos taurus
caggaaagagccaatcttcagagtaaaaaccaaacacagtgaaagaggagcaaaagaaagaggctgaaatgggtcaggaagacatgaaagaagatgtaacygcagaaaacaagagagtccagcctctgaagaaacagaagcaaaagaagccacatctgatgtgatgaacatcctctcctgaattttttccatggtctccat

SEQ ID NO: 33911 - DNA, 201 bp, Bos taurus
actagactattccaaagagaataatgcctcaattcaaatcaactgatagagctttataaaaactgcttttacaaaagttcaaattacactacatctaaatrttttgcaatgcggctaattacaagggtagctctaggtctacgcctttcatttcagtgttcagagtgagaatgaagttccaaatatgtgttgaagcaactt

SEQ ID NO: 33912 - DNA, 201 bp, Bos taurus
gatcttttgtttaaaaagcatgtctggaaaagtcagctccagtcctatacccctgcactaactgcctgaagaggaaacaaagcccaggcctgtgtgccgtkcggctttattctactaatcagaccattacagctgaccttgaacaaggtgtgacacacaggcccccgcagtagtgccggcctactggcagctgttacaccc

SEQ ID NO: 33913 - DNA, 201 bp, Bos taurus
acagtacataaagcaagaaagattgttttttttttcccctgccaggtgtgagatgcttctgcaacaagagcatcatggaggctcctttccaaagaagaaarggtgataaaaaatgagaaaaaattcaagtgacaaaaaaaattgaatagaacaggctttttaaaagtgtgttggttttggttccactaggtggcagtaaat

SEQ ID NO: 33914 - DNA, 201 bp, Bos taurus
gctacattttaggatagtttttttatatagcaatagatgactaaaacaattcccctccccttttctaggtattgcatgaactctttggaaaattgtactcygaaggagggaaagggcaccccaataatggttgaggttgactgtccctttaggctaatttaattgatttaaaaaaagattggcatgtgattgttcctgtct

SEQ ID NO: 33915 - DNA, 201 bp, Bos taurus
cccatggggtcgcaaagagtcggacacaactgagtgactaacactttcactttcaatatacgtttcaatggtcttctctcatatcatcccactttctcctycccccactagacagtggttctttattctgcattttagaatcattgaggactttttttttttaatgctaatatctgggctctctcctggatcaatgaaata

SEQ ID NO: 33916 - DNA, 201 bp, Bos taurus
agctgtaaagacagtgagtacccatagaagatttgacatctagtgagaaggtaacttactgaacaaggattccaatgcacggaggcactgccctgatgagrcagacatggagatggggaatagaacagaaacaagagaagtcatgttcaaggaggcaggaaagtccttctggagaaaaatgctttgtgacccttgaggtga

SEQ ID NO: 33917 - DNA, 201 bp, Bos taurus
taagctgcatttcttgaactatattgatttcttagcttgagagtaggggacaggatctgttatttaaacatgtagttttaaaatggaaaatgtattcaagyccctataattaaacccctcacatagttttttgcaaatgacatatcaatgggtctataacattatttctgtaatttaattacaaaatgctgttatcgcaaa

SEQ ID NO: 33918 - DNA, 201 bp, Bos taurus
aatatgaagtactagctgacaaagtggacaggatgtatgtaaagagaaaaatgtgacctacagacttcatgacagctctgcagctggagaaaatgcctcakatcctttgtcttttcatttttctaaaatgcgggctgttagggtaaattttttttctttgaggcctgagttaggggaatgagcactttccaggaaagtatg

SEQ ID NO: 33919 - DNA, 201 bp, Bos taurus
acttctcctctttccctcagtgttctgaaataacatttgaagttctgtttggtctctttggagaactgccaatgacttcaaggcatgtagtgaagttatayatcaagacacaattacatgcagtacttttgaaaagtgattctcacttaggagtaatatacgatatgaatttaataatctgccatactactcctttttttt

SEQ ID NO: 33920 - DNA, 201 bp, Bos taurus
atagcatcagaacaatatgtctaaggtaataaagagtacagccaggacaggatgttgagactgaccccagagctcatggtcatggccattgtgctgttctmagatagtgtcatgagactgatggtcgtacatcagtaccagagtcttagattcaaattctgatgccaccatttacaagttcaatatagaaaacagtgttgg

SEQ ID NO: 33921 - DNA, 201 bp, Bos taurus
gacatagggcccaggaggtgagggctgtgtctggctgcatcagtaagtaaaatcccagagaaagattctgactgctccagcctgggtcatgctctgtcccrgtgcttcaaatgattggcctggccccgggaaccctgggacagttttgggaaaggagcatttcccccaagaagggagtcctgtcagcaggagaaagggaca

SEQ ID NO: 33922 - DNA, 201 bp, Bos taurus
tttttcttgatgaactttttttctttaaagaccttaagaagcaatcatttggtaacaggtaggagatgagaaatccagccactagaaaaatgagtcataamactcttattcaaagactcaaaagtattcttcacatgtatttcctgcagggtttcattccttcctggggcaggagtcagtctggcagataacttatctggg

SEQ ID NO: 33923 - DNA, 201 bp, Bos taurus
ggccctcacacccagtcattctgcttctgaaacagctctcccatctccccactttttgccagttcccatcctctcattctctgcccttaatgctttactgmtcttgaagatactcagatcttgtcactccttcactcttgaatctctcaaggctccctactggcagggggaaaatgtcagctcttgagcaggacgtctaaa

SEQ ID NO: 33924 - DNA, 201 bp, Bos taurus
aggaatgcgctagtgactataatgttatgaaagctacttgaagtccttgacacttgagtgtgcccggccacaagagtgcacagaggttgggagagcatccrgtggagagctcgacaactcacgcttcacttcagcacttcatgtgggatgcagtatgggactggagtagttaggctgggggagggcctttgagcctctcta

SEQ ID NO: 33925 - DNA, 201 bp, Bos taurus
acaaacttgtggctgttaagaagtggccccatcatttcatcgtgtggagtcattggttaacttgcccaggcaaggcttgctctcgcagctctgtgaggagytctctggccagttttctcgacctatgggcttccacgcaaagatgatcccatctgtacaaagtatagtccaggaagccaataatctcgttcattatcgcat

SEQ ID NO: 33926 - DNA, 201 bp, Bos taurus
atgttttctcatctgggtgtccagctgtttcactgacacttgttgaaaaccttccacatttaacttccttggcatctctgtcaaaaaccagttgattacaygaaaatatctagatacgattctgttccactggtctatccttttgccagtacctcactgtcttgaatttgattactgtagcttaaagtcttgaaatcaatc

SEQ ID NO: 33927 - DNA, 201 bp, Bos taurus
tctacatccaaatacatacaagggaaaaaaacttacaacaaggtgctaggaggggcgtacttgtgatataatcaaatcccatacccctcaagtaggggacycagaaactgaagaacaattacattgcagaagctcctccacaggagtgaaagctctgagtgccatgtcaggctccccaccctagggtcctggcactggaca

SEQ ID NO: 33928 - DNA, 201 bp, Bos taurus
agcccagctgctttctgaataatccctggaacaactgtctctgtgggcgctggaggtcccaaggccttctcatttcttccgacttctcttactcgactctyctctagtctgacagtagcaggacaccgtgtcctcctagtgaaggggatctaacttcaactactttccactcaaggaatcaatcaaaatgtttccttctct

SEQ ID NO: 33929 - DNA, 201 bp, Bos taurus
atttagggcctgtgtatataaccttctcatctcaaaataatttaactgcatatgcaaatattcttttttccaataaatccagatgttccagagattgacayggatgtatttttttaggggccagttttcaacctaccacacgcattaaatgtaataaaaaagctcacatatagtcacattgaaatgaaagtgcagaaaaac

SEQ ID NO: 33930 - DNA, 201 bp, Bos taurus
ctggaatccaagtgtcacagccaagaggcaaatgcagctggagaatatgattaccaaacaggaacagctcttctttcgtcgggggtaagcacgacagtgartccatgaagggtccaaagatctgcatttccgtctgcctcactcatgacagagcaatctgtctgtcctcccctatccctcatgccacagtgacccaaagga

SEQ ID NO: 33931 - DNA, 201 bp, Bos taurus
gctatgttctgtgctacagtttgttcctttgtgtgatccagggatgaggtgggagagaaatgagctgattatcgagggcacagatgaatccaccagtgcaragaagacgagactcctggatcaactgcactgtggggataagcgggtgggactgtggcccggcaggccctctggaaacttaatactgcctgggacggaagg

SEQ ID NO: 33932 - DNA, 201 bp, Bos taurus
caaagaacaaagttcccaggccatattctattttgtttttacttagaaagtctatggctgcaaaacctggaattattggataccatatggcattactgggygtcccaggtgatgctactggtaaagaacccacctggcaatgcaggagacacaagagacatgggttcgatccctgggttgggaagatcccctggagaaggt

SEQ ID NO: 33933 - DNA, 201 bp, Bos taurus
ggtctccatcacctctcccctccgcctgcagctctgagcacttagcatgcctgagctcaggccccgggcatcacaccacacactggaggcagggcagttgycacccacctaccttgccattcattcccaaggttgtaactgtgtgtgccttacataagatgacagcagcactgaaaatccacttagggatcaactgattct

SEQ ID NO: 33934 - DNA, 201 bp, Bos taurus
tgcaataggaatgaatcatgggttctaagtaagtaagtatgtggcctgacatggtgctaaaaagagctctgactcctgtggatgagcctgggaaaaccagraatgacaatagggaggccagcgaggttgctaaagaattgtaacaatgacaatgaagaaataactcagtgtggtattctttcatcatagttggatacaata

SEQ ID NO: 33935 - DNA, 201 bp, Bos taurus
agagggggagggtatgacttttctttcagcttgggatgctaccagctcgggatggccccttcaaagaattccaaagcacggaaaactgttcttcagttacyaccacagctgtggtcttcagtttcctagctcggtggtcagactccacctggctttctctttgccttctacccattgcttgcaaacagtcttacacagctc

SEQ ID NO: 33936 - DNA, 201 bp, Bos taurus
cgggaggaggcgcggccgaaacaggaagggccgcgaaggggaccccacacgccctgcgccccaaagctgccgcacgtaggagcgggttcggctcaagttcrtcgtcaaaggccccaccctctgactcttggctgggtttaggagagtttttaaaaaccctatcttcctctaaactgccaccttagagaaaaacgttaagac

SEQ ID NO: 33937 - DNA, 201 bp, Bos taurus
cggggatatgtattcaatattttgtgataaaccataatggaaaagaatatacatatatgtataaccttgctgttcagcagattgacacaatagccaagatrtacttaaattttttaaaaaaggaatgattctgctgtataaaaaaaagctaactatctaaaatgtatttctttttttttattgttattaaagatatataac

SEQ ID NO: 33938 - DNA, 201 bp, Bos taurus
cccttgacacagccctgcctacatgagcaacaagacccagctcctccaccagcaggcaggtaccagatcctcctgccaggaagcatgcaaaggttccagamaaacctcacctaccaggagacagacataagaagcaaaaaaattacaatcatgcagtctgaagaactgagtcctcaaacaggtcggaacctatcctaggac

SEQ ID NO: 33939 - DNA, 201 bp, Bos taurus
caaatgaggatatctgtttgctttgcacatatgtgaagggaaaatatcaatgattagacaaaaaggcactatagcaaaaggggactattctttgccaaatragcagttctgttcctcttcctctccacagcaaagtactttttactaaagtttatatctattaaaataattagttttatttgcagcaactcaataccaatt

SEQ ID NO: 33940 - DNA, 201 bp, Bos taurus
ctaaaatggaatataagtcatctcttgggaagagacgtattccctcaaagcagactgaaacatcttcagatactccctgttgtgatgtttcaaaaccaatrtcctgatctaaaaaataaaatacacaaagaacagttagcaaaacacagaagggataatagagtggatacaagatgaacacagagaaatgggagaggctct

SEQ ID NO: 33941 - DNA, 201 bp, Bos taurus
aagcaaataaaactctggagtgaggtactgactctctgctggggacagtactatcaccttccttggggagctagttggacagccacaaggcagaggtgggyaacgctgggtgttctctcaggacctcccagaaatgccaggctgaaaatccagagatgtatgttgcctttagcacaaggtcataggggacagcctgatgac

SEQ ID NO: 33942 - DNA, 201 bp, Bos taurus
tcttatttctaggtatttggtgagaggaaaggagtgatatctgcttagcttgccctcttgaatctcggtagttctttttataactttatccacttgaattmtcctcctctagtcaggttgcacttgggtcacatgctgacttgtcaccactttacattagctcaacaaatggcagcctctagggtattttcatgtcaacta

SEQ ID NO: 33943 - DNA, 201 bp, Bos taurus
gtgaagactttgaggtttcaaacccactgtgtcctcccaggcccctcaccaaggggacttcagtgggcatttgtaggcctgcagacattgaattatgaagwtgttaatgagatcctggacaggggagtgaaggacactcaggtccggtgggaagctgagacaccacttctcaaggtgttggcgaactgggccaggaaagat

SEQ ID NO: 33944 - DNA, 201 bp, Bos taurus
tgctcaacatgcattgtaatgggcagtggcattttcactgggcctgggctgcgaattctcttgaacctttcccttgagtcttcagtttgacacacaccctrgaggcatccacacgtcaggcctgttccctttctatggcatcacccctcaccctcccaccttggtgagattccaggaggcaggacaggctttgggcctctt

SEQ ID NO: 33945 - DNA, 201 bp, Bos taurus
agttccttccttttttctgtctctgttgtgtggatgaaccacatttacgtcatggattcttgggttactttccccttgggctattgtgaaatagccaagtraatagcactgatgaatagtgctcctgtgaacacggttgtgcaaaaatcttttgggagtccctgttttcagtcctttgggatacggacccaggagtgggat

SEQ ID NO: 33946 - DNA, 201 bp, Bos taurus
aaagtgggtctcactgtgctaaaagcaaggtgtgagagggccacgtttcttctggaggctccagggagagtgtttcctgcctttttagcttctgtaggggytgtattctgtggctcatggcccttccttcatcatcaaagctgtcaatggccagtagagtcctgcactccctcatgtatgaaacctgctcctctgccttcc

SEQ ID NO: 33947 - DNA, 201 bp, Bos taurus
tatctcagaagcctgctggccaagggggcatttttgctgtttgagaggacactctgatcctgacctgggagcgtatgggggagcatttgcgagggggcagragaagctcctgagataaggaggcccctctgaggtgggagacagatggtgctccagatatgagaccaagaggcagatggtgggtggtgggtggaagagccc

SEQ ID NO: 33948 - DNA, 201 bp, Bos taurus
ctgggcctgccccctccgacctcagcttggaggacactccagcctggtgctcccacgatgtgcccccagcctgcttggctctccttgcccagctcccgggraggctgttgcctggaactggccatttgcaattctttgcaatctcacctcctgctatacctcagcacagcccttccagtgctcccagttacatgactttct

SEQ ID NO: 33949 - DNA, 201 bp, Bos taurus
aatgtcatttagattatgttggttggttttactgtcaagttcttctgtattcatgctgttttcctgtctagtagcatatcaattgctgagtaaaacttgcyaaagttctcagatgtaattccagcttttcccattgctctttcaagatctagtagttttttgtttccagttcaagatggtagagtagaaggatgtgcactc

SEQ ID NO: 33950 - DNA, 201 bp, Bos taurus
agcaagagtatctggagtgtagtaagcaggacaagcatagtaaaggcaggcatggagacagagaggagacttctctaggcaggcaagaggctttctccagrtgggtaaggggcctggatcatagtgtggccaggaggtagagaggaggggtagtgctagaccccatgaagattagacgctgcagggggcttcctgaaaagc

SEQ ID NO: 33951 - DNA, 201 bp, Bos taurus
tcctatgtgagctggaggcttcatcctggctgcactgcagacctgggagagggatgaaggatggaaatgggagggaaacatccctgagtgcctgctaggtrttggccctggggtcagagtgccactgaccctactcttgaagctcctcaaactacaacaggggctcaagccacaggagggccccgcaggcctctatgcctc

SEQ ID NO: 33952 - DNA, 201 bp, Bos taurus
gccctgccctactcacccccgtgacccactccccacagggtcttagtccaagttcgaccatcccttcatggctcagacccactccccacagggtgggcccygtctctcagggagaaacaaccctacaatagtcctcaagtacccgcctgctctgacctctgagatgctgcctggcctcaactcccccaggtctaccccaag

SEQ ID NO: 33953 - DNA, 201 bp, Bos taurus
aagggcatgctgaccacccacccagccactgtgaccagtatgaagccactgaccagcataggctgaggtcgctttctccagccctggggcaggaacatggrggcccaagaggagttaggtgggatccccacccgctatggtggccacaaaccaacaaacgtgtcccacgtcatggcgtcagagatgatgccggctgaggaa

SEQ ID NO: 33954 - DNA, 201 bp, Bos taurus
tttctccctgagatgggtgtgtgggttcttctgttatgggggctatatgtacagtcttgtaggctttattggcccctagcccatttggctttcagaccccrcattgtccaaatgctactggttgctgtttagcaagacagcacaaggtctggtcacaaggcagctggctacagaaccctagggagcctcatggctagtgct

SEQ ID NO: 33955 - DNA, 201 bp, Bos taurus
ggctcagtgatattggcttgttagcccaaaatgtaccatgaattatttgtagctgcttttccatctcctaccactaatcaagcaaggtgtgtacactttcyaggaggtcaggccttccagatgcagaggcaagaagaggaggcatggagcctgccttcactcacaactatttgacaggaggagagcacttccacgcatgat

SEQ ID NO: 33956 - DNA, 201 bp, Bos taurus
gatgacgagagactagacactgtgtacaacatcccgccactggcctgctgaactgtgagggaattaagaccctcagcctctgtttaggccacaataccccrtcagctcatgtttgaggacttcctaatcctggagacagccaccatgtctctcagcactgaagtaccagagtgctttcatttgcatctctgtcagacatgg

SEQ ID NO: 33957 - DNA, 201 bp, Bos taurus
tatcccccgggctcctggaagggcacctgaaatgcagcaggtgttcattgctgagtgagtgcaatgccagcctcctccactggcctctgcccccttctccyctctctgcattctcatgtgggaggataaagcacagcgcttattcttaacacaaacaaaggcctaaagttaaaggaaaaaaaatggacatcatagttcgag

SEQ ID NO: 33958 - DNA, 201 bp, Bos taurus
tgacattggccttgatgtttttagtaagcctctcttctggtcagagaggtgggatgtctgtccaaaattctcagagcagcagatccagtgctcaggtctcytgacctggccacagcaagcacatcagctgcatattagaattttcttcagctctctatggggtgacttgcatgatgtgaccttcatgatgcctgatgtgct

SEQ ID NO: 33959 - DNA, 201 bp, Bos taurus
gcctcctggaccagggaggaggcctgcatcagcctccagggaaggggatgcagtaagcagggaaggaggttggctttgtcacttactcagctgatgctcaytgcgctctgcatgtgctggccctgggcacccagcacccctgccctgatgcagctggcagttctaaggtcctgtccacctcttagcctgagtcctgtccac

SEQ ID NO: 33960 - DNA, 201 bp, Bos taurus
ggagattgtcaccatggctcctctccactgtctctatggccaatgtaccagctgtgtatgggagatgtaccatctctttgctggtgttcacttggagtcakgtagggacagtcactagggcccccttccacagtttctaccatacctactggtgaaggggacgggtgctattactgcctgtgttagtgcaggggtggggat

SEQ ID NO: 33961 - DNA, 201 bp, Bos taurus
gcagcagcagcatatctacttctccatctactgagagagagagattgagatttattatgaggaattggctcatgtaaatatggggcctgagaggcccacartctgcttctgtaagctgcagagccaggaaagccaagccagttgtataaccatctgagtgcaaaggcctgagaaccaggagagcagatggtgcaaatctca

SEQ ID NO: 33962 - DNA, 201 bp, Bos taurus
gaggcatccttggagttctttgttgtgagacagagcccaggtctgctgtggcacacctgtcccctgcaagctgtcagttggggcctctcatttgagttggyttctaaagccacactgcccagtgttggtgctatttcagtccttctcaattaagttacgagctgtaagctctttcagggtggggcccttatatatgttcat

SEQ ID NO: 33963 - DNA, 201 bp, Bos taurus
gcctccttgctagtcagtcaccttagcacactgtatgcagcgaggaagggaactcatttataaatggggacaaagcacactgtccccacaaaatccacatygggaggagggcatgacagggccagtaggtctcagaagtccatgtttgacctcattccctgacagtagattaagccccttagtaatctcctcaccaggttc

SEQ ID NO: 33964 - DNA, 201 bp, Bos taurus
tgcaccacctgggagccctgctcagtagtgtgcttgccagcatcatgccgagagcatccttggactcaggagaggtaccagccctaatgatccacagaacrgaaaagaaaatgcaacttctgggtgcttctgtcttgcacttgagcaaaatttaggcacgtgagacttccactcatgcagtgaaagcaaaatcagtatgga

SEQ ID NO: 33965 - DNA, 201 bp, Bos taurus
agaaaagggagaaatgatgatatgaaagagacaaatgcttaggaagaaaataatcctgagcacagtatagaaactggcctgttcaggaggaggagtggctrgaaaaggggatgtttgaaaccaatatctcactgtcctgtaatgtatcatgatcgcagagagcaggctgtggccatcagtggagatgactgggatggggtg

SEQ ID NO: 33966 - DNA, 201 bp, Bos taurus
gtgaattttagatattcgaagttgtttccatgacaattagttgtaggaatgtgggatcatttttcaaaagagattctagatcatataaaagaatagagacrtacttagcctccaagttctctaattctacaggagaacataattttagatggcatttgaaattatttacataatacatgctttattatgcgctatgaagaa

SEQ ID NO: 33967 - DNA, 201 bp, Bos taurus
tagccaggcactgtacaagcactgggaaatgatgccctgacccttcaggatataccctggatgcagagccctctgatcaggatcctggcctctccatcagrgagtgccctcaccataatgtcccactgccaagcagagacctaatgggaagagacaattatcaaaattcagctgaaggcctgaatataacaataaagatat

SEQ ID NO: 33968 - DNA, 201 bp, Bos taurus
tgcttccctttttaaaaggtaaggtccaaagcactgcaggttgttcctattgtttcaaatggaatagtcctagattcaagactgggtgggctttagccctrtatttctctgcagaatctactcttcctggagtctggtaggaacgggctctgaactaaggcactgaatcttgctcctgacagagtgtgtaaaataaaccca

SEQ ID NO: 33969 - DNA, 201 bp, Bos taurus
caaacaggtataatgatggcttcagtagataccactaatacatataaaacacgtgtatcaatttgtccacagtgttaccaaaccaaacttggttctattarcctgtacacagtgaagccaatctactgacatttggttgtggtgaaagaaagtgtaactatgactgtaagcaccaagaaaggaattgttgttcagatgtat

SEQ ID NO: 33970 - DNA, 201 bp, Bos taurus
tgatttgaacttcctggagtacaagggactttcaagagtcttctccagcactgcagtttgaaagcatcaatttttggtagtcagcctttctacggcccaaygctcgcatctgtacatgactactggaaaaaccatagtttttaagatatggactttgttggcaaagtgatgactctacttttaaatacactgtctaggttt

SEQ ID NO: 33971 - DNA, 201 bp, Bos taurus
cagagcacattgctttttatgatatgataaggcatcatgtggttctcagattccatggaattcttgttctaagtacccatccctttccatcatcgccctcrttcttggattggtccaatgcacagattcggggaagaaatcttgttgtcagtgtccttgcagtttccgtctcttagcaacagcccatgctcctgttcctct

SEQ ID NO: 33972 - DNA, 201 bp, Bos taurus
ataccctgggaccctcaggcatgcacaccaagggaggggtactgagtgtttgtagtgaggtcactatgatcagctcaaaactaggaccttccaaatatccrccaagtgaacaaccagaagtactccatgtatctgtcatgcagcaccgcatagcactgaacatgaccaacagcatggggaaaacccaagctcatattggta

SEQ ID NO: 33973 - DNA, 201 bp, Bos taurus
aaaagctgggaaacattccaaagggttggcctgtgtcactggagcacctttttttcttggctggatttgcattttcagagccttagagttttggcctggcraccctccagggtggcggtcacaataatgtagacctgtcagagacatctacacagcccagccactctcatcagtggggacatgtgagaggagaagagcacc

SEQ ID NO: 33974 - DNA, 201 bp, Bos taurus
tagaagaggagaggaaggatttcctcattgaaacaacggagggagcatggccctgcgcacaccttgatttagaaggtctggccttcagaactggagagaaraagtatttgttgctttctgccacccactgtgtgatagtctgttacaactgcctgaggccaaccctggtgcacaggttcttctgctgttttacatgaattg

SEQ ID NO: 33975 - DNA, 201 bp, Bos taurus
cccaggcttcaagcagcaaagaggggctgggcgctcagggctgggagctggcccgcccacatccctctacccaggtggctccaggaggcccctgctggcamcgatccccaagtaaacctaaacaagcctggggttgagggaggtcatgcccaaatcctaacagaaacttggcagtcacaagtcggagctctgggccctggg

SEQ ID NO: 33976 - DNA, 201 bp, Bos taurus
tttgcagaaactaatttgccagtattgggcttagaacaggaggttgtctcttcagggctcattttatagataatatttctggattttaatttgaataaaayaaatacaggggatgtctctcccataacaatgctgttttgaggatattaataactcttaggctttgtttgctggctcaggatggcccattcttccaagccc

SEQ ID NO: 33977 - DNA, 201 bp, Bos taurus
aacaagttaaacaatgtgttgctaacttagctaaaaggctggctgtgaatccaaaccgtccatcatcggtaggtgactgatgccctgtgtccttaggcccwccttgtgtttccatctgctcttagaagacagatgatggacaagtcaggaaagaattgcaaaggactgacttctggctggggaacccctttctcatctttg

SEQ ID NO: 33978 - DNA, 201 bp, Bos taurus
ttctctgttgagctgctgagtttctggcccttgtgctcgagagtccagcccggctgctgcctcctggcatccctaagcaaactattcaggtctaaggtcgytgcaggcctcggcccagtgtggagaaattctggctggcatgggctggggtgggggtgcttcttcttaccacttgtccccttgtcatgtgggatttcatac

SEQ ID NO: 33979 - DNA, 201 bp, Bos taurus
gtgggctacagtccctttggctgcaaagagtcgaacaccactgaagtgactgagcacatatacaatgtgttaaaaaaagattttgcactaaataagaattmtagtgttcaaagaaaaaaaatccagactccaatcatcttgtattacccagttactatgctacaatgaatttcagttataaaatacagggttcttagcaaa

SEQ ID NO: 33980 - DNA, 201 bp, Bos taurus
acgaggcctgtggtctagggcaagggtcgccgctttctggagcgcatatgctatgcaaagttgttcagcttttgatttgaaaaccaccacttatgttaagyacatccaggacttggggactgtggccaagtggctggcccccccattctgagtctattcagatccactaggcgccaccgagcggaagtttcctttccaagg

SEQ ID NO: 33981 - DNA, 201 bp, Bos taurus
gggcagccaggccagtgaccacagccccccagcccccacatgctgctgccgcagacctgccaagcctggcgccatctgtcaaggtgcaagtgggccgcacrgtcctatcatcaccgacatcacactccacctcctgctttccagacgcccacaagaggaggctttctttccgtggcaaagagcaataaactctgagcgtgt

SEQ ID NO: 33982 - DNA, 201 bp, Bos taurus
gcaaagagtcagacacgactgaagtgactgagcacgcacacataccttgaaagcatgtagaacagagcctggaaaatgtcaggcccccttttgcttttggyggctgttcagttgctcagtcgtgtcggattctttgtgaccctgtggattgcagcacaccaggcctccttgtccttcactctctccccgagtttgcccaag

SEQ ID NO: 33983 - DNA, 201 bp, Bos taurus
ctagaggaagatgaatatttcaccatcttggacctagttggttctcatcgtattctgtggccatgtctttcttttaaaggctatgccctgaccccttcccycctgcttcacttgcagtagctagaattcccagtaccatattgtttagtggtgagagtaaacatccttgccttgttcctgactatagagggaaacattcag

SEQ ID NO: 33984 - DNA, 201 bp, Bos taurus
cttcctctttcatcagagcagctcggaatgtccagcaccaactttgcctgcatctgttttgggaagtaagatgatagctttctccataattattcattgaygtgtacatatcaagatataaggcaagtgaattttctgggcatttgtagttatactctcttctgacttaaagcagatatgcaagccatcttttccaaagtg

SEQ ID NO: 33985 - DNA, 201 bp, Bos taurus
agctggcctgccttgagctcaggctgtctcacaccaggggcaggacctgatagaactctctacctggaactccagagaccaagggctgtggatggggcacygtggcctctgctatagcagggatacatcaacccttatattaacctcttcatttcttttatttttttatgtatttctttttattttttctgtgtatatgct

SEQ ID NO: 33986 - DNA, 201 bp, Bos taurus
gtcttcatcttggactaaatttattatgtggttggagccaaaaggaaacaatgaattcaaacaaaattctgtttcagtttttcagtggcaggtctttggtkgtctctctccatcccagagaactcatgcttttgaactatggtgttggagaagactcttgagtgtcccttggactccaaggagatcaaaccagtccatcct

SEQ ID NO: 33987 - DNA, 201 bp, Bos taurus
gcacaggacacagctctgcaccttccagcagtcactctcagcagctaaaggctgcaccccccagccccacaagcaccttgccttcctacaggccatctgaycccacctccttgctctgttggtgattaaactgtaattaaaacatgtttatggactttcccagtggcccagttgtttagaatccacctgccaatgcagggg

SEQ ID NO: 33988 - DNA, 201 bp, Bos taurus
gtccacggcgttcagagactcaagcccaatgcacttgggggtttggcacgtaaaacaatagcagaaatgaaatctggtttagaagcaactgtgattgtttyaagaatgcacagtcccttcaaatgctgcaagacatacacaacaggaaaatcaccttctgttggcactacatttgcttcaccagtgcatttatatcctaca

SEQ ID NO: 33989 - DNA, 201 bp, Bos taurus
cctcctctcacatgtgggtgtgcagagcagtcactgccctcttctctcctaccagctggtgcagaaacgactcctggccttgaaggaagacaagggagtgyggacacccagcagtcaaagtgtaccccaagtggactcaagtccttctgagtctgacgccagcaaagatgcccagagatatgatcaaggcccccagctagg

SEQ ID NO: 33990 - DNA, 201 bp, Bos taurus
gatagcccgaaattctaaccactaggtcactagggaactccctactcttttcattttttaaaaaatatccctctgtccaggaagtggtgtccaatttctcragttgggtcagaggtcaatcccaggtttgcattggtgctgagccataagtcattccagtgtttttgaactgaactcaagtactatgattctctcctacca

SEQ ID NO: 33991 - DNA, 201 bp, Bos taurus
aagcatcgggcaatatctatcaagacaaaatacagcaaatcatttgcccttgcactcccttttgatcatctctactatggaacaaaagaacaagtacttamggatatgtgaataaggatatttaatgttgtttgtagtaggaaataaacaatctgggaacaatcagaatgaacattaatgggagactggtagaataaatta

SEQ ID NO: 33992 - DNA, 201 bp, Bos taurus
acatgaacctaagatgtgaagcagaagctttgctagataaggctgtgtgatttgaaagaatcaggttcaataacaaagggtcgtgtggccttatggagctrgagaaaccaaaatcgttttgatgaaaatcaccaggaagattcagttgggtgaataggtaagacctggacaggctgattgaggttttgatgactggcagca

SEQ ID NO: 33993 - DNA, 201 bp, Bos taurus
tcatcctttgacttgcctgatgggtgtcggattcttttaggccacaaagtggcagcaagctcaggttaccatagtgatccatgtcatcaaaacagggaccrcagacctcaccaacgatgccagtctctgtcctaaagccaggctgcttctacctcctggtcctctgagcattctaatgcccctcacccctgatggattcac

SEQ ID NO: 33994 - DNA, 201 bp, Bos taurus
ggaagttgacaagttgacgaacaccagacttaattttgcccatcaatctaaattaatatactgcacaattacttatacttaactctaggcactgttgagargaattaaataggtctctgcccttataaattcatagttgaactcagctggcacaaagagaaaacaaaagctaccttcagattttacatgccctaagaattt

SEQ ID NO: 33995 - DNA, 201 bp, Bos taurus
tcgcttcacgtgaacagcagactggccaggcatgtcggaggcgtatgaattcatctgcccctgagtggtgccacctgctgctgctccatggcatcagcatytggccacctccacagtctgacgtgcaactgaagctcaaagttcaggaaagcaagagtgatgcttactggatcttatagaaccagcaactcctgagcaaca

SEQ ID NO: 33996 - DNA, 201 bp, Bos taurus
cagagagttctctctgtcctccctttttaactttcttcttttccttctttttttttatttcctcctctgccttaaccttattccagaatcaacaaacaagktttacatttgtctggcaggaacaaattatgcccaactgttttcttggcctcagttccctattctgttcccagttttatttctaaaacataaatttgacca

SEQ ID NO: 33997 - DNA, 201 bp, Bos taurus
ctgaagggaagtgtgaaagatattttccaaaaactgagagagaataaactatatagaatctttcttatgtttattgtttctctctaagcagtccatgttayctccccaaagcgattttcctttcattgcagatatgcttggctgaccaactggacacaagctgtaaaaatcagagggggagaaattgctttagtagattca

SEQ ID NO: 33998 - DNA, 201 bp, Bos taurus
ggatctcagatgtctccattgctagatagcaatgctggaagcagtatttaaagtggtagggagacaatgatagtagtatgactgaagaccccacgtgcagrgatactgccctttatgtacagctgcgacaaaaagacaccatgtactatgcacagctcatgagatgtagtacacaagttccatccagaataagagagatat

SEQ ID NO: 33999 - DNA, 201 bp, Bos taurus
cagatacacttctcttcagctttctttatctgcactaaggtcactttgaaaaatattcactcatacacttccatttcctctcatttctattttccaatcayggacattttcagagccaatgttagatttcttcagcttacctctgacctcagctacggttatagtgaacaattctgagtaccttgacagcatgccatctca

SEQ ID NO: 34000 - DNA, 201 bp, Bos taurus
cttagcatatcagatggacattgagttggatctaagcatcatgcaaaatagctagatgtgttgctaaccattctctcatcaacgtaagatagattaatagmttgctaaatgcaacaggatttaatgtgagtaggcatagcaatgacctggcttaattatgatattgttggatacagtgaagacatcctaatataccatcag

SEQ ID NO: 34001 - DNA, 201 bp, Bos taurus
acatcaaagtgaaaacagcttttaaactaagccaagttctttgaaactttgaaatgcttagtcatgatgttactcagttttatttcaaatcaaaagtcacmagtatttacagttcggcctgtagaccatcagactaaaaggctatccagctttaaaaggctaatcagctaaaaggctgattatgaattagaattttacttt

SEQ ID NO: 34002 - DNA, 201 bp, Bos taurus
aaccacaattacctcacctttttttaatcttcaattgactttccccaggtacctgatgcctcagaggaccctaccaaccggtaaatacctccagcccctcrcctttgtggtggcagacttgagatttgttgtcccgtctctctgcttgtctgccttgtgaatctaacttttctctgctgagaacctcagagttttaatgtt

SEQ ID NO: 34003 - DNA, 201 bp, Bos taurus
taagtaacaggcaatgttaggttttcaaacctgccatagaagtgtctaataagtccatgatctccataccttcctttatgattcacactgttacttggaayaagaggcagatcaatttagggcagggttagagggataatcatagtaattatctattatttgactagattatccttccttaagtgagtccagtctcccttc

SEQ ID NO: 34004 - DNA, 201 bp, Bos taurus
gaaggatgctgaagtgaaaaggctagaaccatataaaactgaccaagcgaaaaacaaaactaaaagtgttgcctctatagcaacttgaaaaggttataatygtattaccaagaaaaagaaatcagacacatttagggcatattggaaaaaaacaagttttctcagagtggctgagctgttttgtgatttgaagcagtggaa

SEQ ID NO: 34005 - DNA, 201 bp, Bos taurus
ataattagtaagtttaataaatatggctttatgaaatataaactattcaagataaatatgtcaaataattatggtgttaaattgtttccagctcccctccsacccaatccttggtaattagaaaatagaatgagcataaaaatggcaaagtatgcattactactgaaagctagggaaactttccactcaaattttagaaaa

SEQ ID NO: 34006 - DNA, 201 bp, Bos taurus
attagataccacaattcagggatggccagcctgcctacatgctctgggagcagctgcacttccctctcaggaaagtaaataatttacttttggagcacccrctgtcattcgttcaccacctgactttaaggacttactttctcacaaatccatgacccttctatttccttcccacatccaactaattcatgtcacccttct

SEQ ID NO: 34007 - DNA, 201 bp, Bos taurus
cagatgacaactatccatatgatagattaggctgcaatcagtataccaagaaagccagttcatcaaaaattagtcaaatgttgctaaagtcttaatatatyccatgacttacttgcatactgaggtcttctgaactaaggcaaatgcaattcacttccaaattgctctccattgttttcttttgtactctggaacagattg

SEQ ID NO: 34008 - DNA, 201 bp, Bos taurus
attttgaatcaacagagaatttggggtctgcaaacatggcaagctacatacaagcccctgcactgcaagggaaggagagcacttttatggaaggaagaggraattgtgagggctgcagtccacaaagagcccttggtttttcattggcccagttcttgcaaaagaaaaggagtctgtcttcttcctcttgggctctgcttt

SEQ ID NO: 34009 - DNA, 201 bp, Bos taurus
ttgttttgcattacttatatttcccactttcttatttctgctggctgattaaattgtcattcaccaattgtttgccttaacttgaacactttgttcctttyttccgttccataagtggtgagttaccttctttctttactttcacaatctgacatacagagcaaacatttgtttgtaaaaagtaactattgcgttggccaa

SEQ ID NO: 34010 - DNA, 201 bp, Bos taurus
aagaactgacagcctgtgacctgctggagcatccaagtcaaactccctatttaaaagcaggggaagcatctatctgcctacaaactaaaattcatggagtyccttcaacatggcccctcatcaccctctgagactcagaaggagagaagtccaacaagtaggaatgtagatcccaaggagatgaccaagacgcctgagacc

SEQ ID NO: 34011 - DNA, 201 bp, Bos taurus
ttgttttttgcacatgtctaatgattcagattcttactctgacattcttggtaaaagagataggcctcgatttgaagtaagttgtgaattaatgctttctmgtcagaggtagataaaagacttctggtaaccctgactgattttaacattgaaggcagccccaccctccaattcattgtgcaatggggaagtggtttgctg

SEQ ID NO: 34012 - DNA, 201 bp, Bos taurus
gcacactagcacatatccagtggccacccccgacttctactccaattctggaaaatggcaagacttgttttgtaaaaaggattaaaaagtaatagtagcarttctggcctatcaagaagcctttgtttatattcatgagataggaaggggcagggtacagactttaaaagaatcacagccattgaggacccaacatagact

SEQ ID NO: 34013 - DNA, 201 bp, Bos taurus
aatgcaatcattctgttgagtgaggggactggtccactgtggaaagtgaatgcaatctcctgttgcttgatttttatatccactgtgagtcagaacacttrtatacccttggtcatatcagcagtgcttctgctttttttccccctgcagtctcagttttggtgtatctggatgtcttgtcacatcatagaagaacaatct

SEQ ID NO: 34014 - DNA, 201 bp, Bos taurus
ccatcgtttggctgtgaaacagttgatattattttttgtcagagatgaggaagaaacagtctaaaaaggtaaatggatcaaggttatataggtggtaaatrgtagagtgagggtttgaatccagatctttttggatcctctttctattactctatgatgcctctcgttaaagaactgtattggaaaggttcgccattaacc

SEQ ID NO: 34015 - DNA, 201 bp, Bos taurus
gggaccaagtttgttttattcataactgtatccctagcattgtgtctggtgcctatagtagatttttaatatatatttgttgactgactgataaatggccraaatgttctttcataggtctctctgtatttaattcagttcagttcagtcactcagtcgtgtccaactctctgcgaccccatgaatcgcagcacaccaggc

SEQ ID NO: 34016 - DNA, 201 bp, Bos taurus
acagaggggaggcaggtttctttgggaaggggagcctgcccacctcccaaagtcaacagtatggaggaacacatcatgggagttggaggagtggccacaayagagataaaaaaaaaaaaaaagtctgtaggatggctggcttgtttaactttttaaacttccctcctttcccccattaaatctacctgcagagtgggtgtc

SEQ ID NO: 34017 - DNA, 201 bp, Bos taurus
gaatgatggaggtgggttggatgagacagcgtggggaaagggccgaactaagagctaaggggcgcctggacttgctggtgcatcagtgggaaaatccgagrgctatttaaggagaaaatgggccttgtgacggcttgttatggaggctgtgaagactagtaacacttcctcccctcctgggggagtaaggctggaaccaga

SEQ ID NO: 34018 - DNA, 201 bp, Bos taurus
aaagctcttactcaccctttaggccacaacttaccatttatttctgatagtcactttccgtaaccaccgctctcgaccctggactgtgtcctgtcactgtrcagggtgtttccatggcagggctctacaggaagcctgccttccctgccatggcacttgttttaattgcacggtattgtaattgccttggtgattgtttgt

SEQ ID NO: 34019 - DNA, 201 bp, Bos taurus
ctagggatatttgggagacatttattatttattgaaataaaggatttcagaggcaaaaacttgaaatttaaatcctggttcagagtcttcattagccatgygccttgagcatattaactgaacctctcttggtctcataggttttaaaaaaaaaggattataacacctaccttattgacttattagaatttagaagtatac

SEQ ID NO: 34020 - DNA, 201 bp, Bos taurus
atcttcgcttcctaggtctcatgcccttgtgtaatcccctcttcttgagtatgactcagttctagtgacttccttctattcgatagactgtggcaaaaatrgcagtatgtcactttcactataggattacaaaagattgtgatggtcatcttgttaacacactcttcccgggccctctcatttgcccactctggtgaagtc

SEQ ID NO: 34021 - DNA, 201 bp, Bos taurus
tctaaccatctcatcttctgccatcctcgtccccttttgccttcaatctttcccagcatcaaggtcttttccatcccaacttaaaaagtatgaaaataagmataaaatcattgggtggtgaagatatagcaagaaaatataaaataaaaaaagcagagctagtgataatttccaacaatatagaattcaagtttcttagag

SEQ ID NO: 34022 - DNA, 201 bp, Bos taurus
ttgtttcaataaagaataattaagtgaatgaataagaaaatgagcaaatgaatagatgcagaacagaacaaatggatgtttctcttcccctggtttggccyctctagcttttggaaatgcccatggtcacataccagcacacagagccagagcctggcagaccgatgtttgactctcggccttggtactggcccagcctgc

SEQ ID NO: 34023 - DNA, 201 bp, Bos taurus
tgtgaccttttaaatagtcatggagttgaaccatgatgcattaaagggtattgtttttactgtcccactgtaaacagctctaaaattgaacatatagacaytggacaccaaagagttcagaactctaattttaagaggagggcaacatgtaaggtgagctccacattcatcctaggtttctgcctgggagtattttttaaa

SEQ ID NO: 34024 - DNA, 201 bp, Bos taurus
tacggtcctgcccaccagagggccatgactcagctcaacccataagagggcaagcaaaggccatgccctccaggaagcctgcactaacttctagtccagcmtcactcaccaggaagcagacaacaaaggcaagaaaactacgatcccacagctgtggaaccagcccacttagagcaagcagaccccaccctgggaccactt

SEQ ID NO: 34025 - DNA, 201 bp, Bos taurus
ccagtggttaggactccacacttctgctgcaaggggcatgggtttgatccctggttggggaaccaagatctcgcatctccccaggcttctgacaaaacatyctgagatgtctgggcttctgccccagcactccctgaccagagacaaccccatcaacccatgatattagtagcacgacagggtgactcctttgcttaagaa

SEQ ID NO: 34026 - DNA, 201 bp, Bos taurus
gcaggactaaccaggagcccttccacatcgacagccatgccagtagctaagcgtggagcccaggtcgcccctcatggacaagtggcccatggagcttctgrtgctcaaggagcacagcgcagagcccagggtgccacatgtctgtgatgagagaaggggaagcaggaaggttgagcttctggtggtggcctgcccatatat

SEQ ID NO: 34027 - DNA, 201 bp, Bos taurus
tacccacagtttggcaaggcctggggaaactaggttatgcttagaaatatgttcatgtccgtaaaaataaaatgaagatggcctgtcaaagtaagtgctgrtgcacatcataaacatacaattagaaattacgggtatcatgttattcttttctgtgtaccatctcttgttttggccacagcacgcagcatgtggatctta

SEQ ID NO: 34028 - DNA, 201 bp, Bos taurus
cggagctggtcccatcatgggcctggatggcctcctcggtgcaggtctcccttgggctcccagcccaggcagaggccatcccagcatcaggcatcatcacrgtctgccttcctgactcttcgctgcatacaggctctcaccctcctccaaccccaggcccaggctagcacctggccggcagtgtttcctggctgttggact

SEQ ID NO: 34029 - DNA, 201 bp, Bos taurus
ttctccttggcccctttcctggtacatagtaagtgctcaagaaacagtccctgaataaatgagtgactgaatgggatgaatgaactgtgttgtgtgaacaygttaggtcctcatttggccattggctcctggttcttggggatggggcctctccttccctctgcctgcagggcctggcatggtgcctcggctggagaaggc

SEQ ID NO: 34030 - DNA, 201 bp, Bos taurus
gtcagtctctcccatcaggaagcttccataggcctcttatccttacccatcagagggcagacagaatgaaaaccacaataacagaaaactgaccaaactcyacctgaggacttactcaaaagagactctgaaatcacttcccctttattgctggatttctttttagaaaaaaatcagttcagttcagcccagttactcagt

SEQ ID NO: 34031 - DNA, 201 bp, Bos taurus
aattaccacccagaggaaaaagtgcagaagaccaccaaagacgttctgcaatgttcaacagcaccattattaataagggccccaaaccagaagcaatcaamtgtctaccaatagaataatggctacatagatggcaatgttttcatagaatagaatactggccagcaatgaatacgtgaacaaaataatgacactcgccag

SEQ ID NO: 34032 - DNA, 201 bp, Bos taurus
aggtgctggatattactgaacgggcaatttctctggccaggaattgacacttaccatttctatacaccatgcattggccagaactaatcagatcagatcartcagatcagtcgctcagtcgtgtccgactctttgtgaccccatgaatctcagcacgccaggcctccctatctatcaccaactcccggagttcactcagac

SEQ ID NO: 34033 - DNA, 201 bp, Bos taurus
gagtctactgatccatcctctgctccccatctcttacccttccctggtaaacccctactcctacttgagcacttacttcaaaaatctctgtcttcgttaartctcatccaatcctcactcccctcccctcccccaggcttgccctctgggttcctcttttattacagttgttaggtgtttacattccagtttctttactag

SEQ ID NO: 34034 - DNA, 201 bp, Bos taurus
gccttccttgactcacggctgattttcttcctcataatggacaacttaaagattcatatgattgctaatgaaaataagaccacaaacttgcttcagggatragactgtcttcatctttgtatggttagcacatagtaggtgctcattagacgacactgaatggatgaatagtaatactgatttatggaattcaattagcac

SEQ ID NO: 34035 - DNA, 201 bp, Bos taurus
agcttcaaagaaaaggtgattcttgaaccaaaccttaaaagagaagctggcacttgccaggcagatgacagctgggactaattcccaagagaggatactgrgagcaaatgctttagtgttccaggggaattgaaaatgatctgactatgagaggaaaggggacagtattagagaaaggtaaagggacaggtaagaatcatc

SEQ ID NO: 34036 - DNA, 201 bp, Bos taurus
aagcccatgccagttctcaagggcatctgtaggccttaaaagaaagcaaagaaggcattgttccctgacacctccctgcaagatgcataatgaggacttgytgtgggccaggcactatgctttatgcacatcaaatcacttaagcctcacaacaagctagaaaagctgctattattgtccccactctagagaaaagaactg

SEQ ID NO: 34037 - DNA, 201 bp, Bos taurus
accagttaattccccctgcagaagtctggagaagacaagagctagggagaggaacaggggtgacaggggttgaagaggtactggcaagggtgagaatgacyatctccctaacgcttttagctcaggctgtagaagagtcactcatggccaaggatcttgatttcaaagaaagcatgggaggaaaaataagtttttgttaaa

SEQ ID NO: 34038 - DNA, 201 bp, Bos taurus
tacccctactgctgagtgagacatcatgaagtgtccatgacaaatctgtggtcggcatcttcaatgcaacctgtgtcattcgatggggaatccacttcatyagctatttgaatattggtttcacaatctgaagaatagacctgtggttgccaagtttaaatcttaggcatcatctggttatgaaatcagtttggaaacatt

SEQ ID NO: 34039 - DNA, 201 bp, Bos taurus
tgttctagaaacctgcttttgtttctgcacagactgttgaacaccttcccaggtctgttcatcctcagacctgaatcagccactgctcacaccctcctgtycatatggctgaagccacctcaggtagtgacaatcagccagcccctgagactgcactttgagctatccctagggcaccacacagcccgcccagaagatcct

SEQ ID NO: 34040 - DNA, 201 bp, Bos taurus
gggagcagggcctgagctccctgggcaggtgggagcctccccaaagcaggtgttcagaacacaagccctcagatgcaaggggagtctgtggccacatcaaygggacctctaagctgccaggaagcaaaggtgattggtggggaagggctccaaggatgaggaccccactccttacccaggcattaggtagcgtacagctca

SEQ ID NO: 34041 - DNA, 201 bp, Bos taurus
agcctttctacacacaagcattcttagaaagtctttgaatgtctattcttacttatactggtggcaaaatgtccccaaataaaatcatcatgaggttctgyctgcttcctgctttagatgtactggaaatcttcccaggaaactcagggactttgtaaattctcctttgcctttcccattgccattaagtagttgaaagct

SEQ ID NO: 34042 - DNA, 201 bp, Bos taurus
caaatcctattgggatttttttagtctctatgaggacacaaggtttttctactgctccatatttcatgctatttgattgtcccttcatcaaaggtgacacrcagccaggtaataaaccttccaaagagtggctgcattaatactctgggtgtgttcctactgagccatggcagccacctggacctccaccaaacacctcca

SEQ ID NO: 34043 - DNA, 201 bp, Bos taurus
ctctgtcttgtcagcagtgctgacttgcaggatgagtacgatgtgatcacatcacggttaacaatgaaagcgttgatggccacactgcaaaacaggattcraagctgacggggcacttcatggtcattgttctaagtcaaactagactggcccctaagctctctgagaagcccgtgacctgattgtgtccactggcatcag

SEQ ID NO: 34044 - DNA, 201 bp, Bos taurus
ctctcatgatgttagagaccagaagtccaaaatcaaggtgttgtcaatgctctgctctctctctctgatgtctttgggggtagatccttcctggcctctcscggcttctggtaccccaggtctttcttggtttgtagctgcatcactctagcctctgtctccatcttcatgtggccttcttctctgtgtatatgtctctct

SEQ ID NO: 34045 - DNA, 201 bp, Bos taurus
cagaggagaggccaagtgtgaggatgcaggggaaggaaataaatgtggaacacgctggaaaggaacttcctcgggcacaggaagccagagaccctggagargaaatgaaggaaaggcaggcggccacaatctcggccaagaatgggagtgaacgtggtccaggagccaagtgttcttatgcgacagccatccttgtcccgg

SEQ ID NO: 34046 - DNA, 201 bp, Bos taurus
gcctcaggacagcatggccaccgctgggattccattccctcaccagactcctggcttggttgggggttagccagaaagcaggcctctatcaggacagaaartcaaggctggctaagcaaatggtacatcataaaccactcctatgctccacggcacctgaacttaagacccaaattctgtatggtctggccaatccacctc

SEQ ID NO: 34047 - DNA, 201 bp, Bos taurus
agtagcatcgtgtggcccagggacacagaggctgctcggatgcctggagagcaaagtgttctatgcttcgtgatttctggactaactctggatctggtcayggccatagactagatacagatggactccccatctttcgaaagaggaaacaatcctcaggacttgcctgaagtgtttggttctgttttgaaggaaaatgtg

SEQ ID NO: 34048 - DNA, 201 bp, Bos taurus
tggggcaactattgatcaggagaaaaataagaagggtaatttactctatgagagaaagaaaatgtatcaagtttagaagtagacagagagttgaactgatmaagtgttttatatatcagaaggtgaaatgaggagaaaacgcaatgacttatattgcttctttgggagtaggatgatggttaccatgacttgggtagattt

SEQ ID NO: 34049 - DNA, 201 bp, Bos taurus
gttaattctatattttctataatgaaatcaaaatcttggctagtttcatttggaatatgtgaaaatgaattaaaacttcgtattaataaatatatgagaaytgacttaaagaggaaaaaataagaaaatggagacttctcatgatcaggtatttaaataggttgtaaagttataataattaaatcatttttgcaaagctta

SEQ ID NO: 34050 - DNA, 201 bp, Bos taurus
ctttcaccactgagccacctggaaagctcctataaactgcatacccaaaacaaaataatgcagagctagcaaacgaattaagaaacagcaggcccagaaawactaacatttggagaagtctaaattcaaaaacaaacaaaaaattctgtgctatcaagttgatataaaaaaatgatccaacaatgtctgcgccatacacat

SEQ ID NO: 34051 - DNA, 201 bp, Bos taurus
taagtttaaacatgattcaaaaaccaccaaattgagtagttaacatactaaaaataagatgactacttttcatattactggagaaaacagagaaaaatacrggggagggggaacaaactatgtgaagaatgacaattttgtgaaatttaaatatttgtgaaatttatatagataaaactataaatgatttccctttcttat

SEQ ID NO: 34052 - DNA, 201 bp, Bos taurus
ttctcaggcctctttgcaggatgctcttcctgtgagagtccggaaatgttggtgcacccccaagtcctttgcttagccctttcctactggtgctaactctycctaggccatcttattcatagcaatggatcccacaaacacttgcaggctgatggtgcttaaatgtgcatcgcaagtccagaacataatctcccacactcc

SEQ ID NO: 34053 - DNA, 201 bp, Bos taurus
aatctctagttaaggctcatttggttatgtcataatctggaagaacctcagaagaaaagcaatagaaatcttgtaaaaaacttagactggacccaacttcrcacacactggggggaaaatgaagctcaaaccaaacatacacagctggtatatgaatttatttttagggcttgttcataaaccaaaatctctattagatca

SEQ ID NO: 34054 - DNA, 201 bp, Bos taurus
acatgccttgcactgaatttcatcccattccaaacagttacattaccctaaatataaagaaagaaaactacagactgtgatcttaagtaatttacaaactmgatttcagaactgcctttaacagtcagaaataatcgttctctatttcagcatcttcccccaaaatctattatgtcctattcaatgaacatcagaatcttg

SEQ ID NO: 34055 - DNA, 201 bp, Bos taurus
gagtgaactcggggagttggtgatggacagggaggcctggcgtgctgcgattcatggggttgcaaagagtcggacatgactgagagactgatctgatctgmtaagtatcttgcccagggccacatttgtaactgctaggccacgggggtcacatagggttttattatcagcccattagtattttacaatgcatgcattttc

SEQ ID NO: 34056 - DNA, 201 bp, Bos taurus
tttgaaggccctgtctccaaacatgtgaactagagcccacttataggatcttgcttactcttattacctcattaaagctctgtctccagaagtgattagtyagggcctggggttggggcttcaacatatgaattttgggagaacacaattcagctcaaaacagtgtaaggataaagtgtggtggacacacacaaggaggta

SEQ ID NO: 34057 - DNA, 201 bp, Bos taurus
tgttttggcttcgggggtaattgcttaagttatttaatatttgttgacacaatccacccagaagattgttctgatttattgaacatgttttcacctaagcrgtttagccacaggaggtaatagatcttaaacctcattccttgcctgggctctattatagtatgaagtgaaccaatgagtgataagtctccctgattcttc

SEQ ID NO: 34058 - DNA, 201 bp, Bos taurus
gcataagttgtttatatattttggagattaatcccttgtcagtcacttcatttgcaaatattttctcccattctgtggaatttctttttatttttagtttycttaggtgtgtaaaagtatctaagtttaattagattccatttatttttgtttttattttcatcactctgggaggtggctcagaaaagatcttgctgtgat

SEQ ID NO: 34059 - DNA, 201 bp, Bos taurus
ggtactaacaattcacattcaagcaaagttgatgactaaaataatatataggtaagacaagtttttagtgagactttccaaataaatatttctgagttcayaaaaagatacatttgcttaattggtgtaatttaaaaactaaatccacactcaaaaattttaatgctcagcagacattttattttaaaaggaagtctagca

SEQ ID NO: 34060 - DNA, 201 bp, Bos taurus
atatcacacatgctccctggctctttcacacactgaaaattcacaaaagctgtgtttctggccaaggtgaaaactttatccatgcttatacttgactccayaccctccaaaggagacacaggcgggtgtaaacagttatgctgttgtccttttccttggggaaaatgaaaaagctaactctatactttaacataagcctgg

SEQ ID NO: 34061 - DNA, 201 bp, Bos taurus
gtttcctgagaccataacttctagtgaactgcaggccaaaggaggccagtgtcaagatcattgccttgtaaccaggaggtaagccaagacacccagtgaayagtatatgatgaaatctgccctatccttaatatcatctctgatccactgttatgagaccaggttctgaattagggacacagaagcctgagtgaagttaat

SEQ ID NO: 34062 - DNA, 201 bp, Bos taurus
gttttgtccctgggagaaggggcaatgacagtgtgtttctgtgccagagatacttgttcttccaacctggaaggaaatccatccaacttgtctgtgtaggrctccaaacagaagacttcagaaataaattttggcctgacacttttgtttgtccatttttctattttcctgtaaaaaaccacagttttgacaatcttcctc

SEQ ID NO: 34063 - DNA, 201 bp, Bos taurus
atcacagtccctcaggatccagagacggaatttcagggagagggttcagtgaaagtcagggagagtgagaaacataaacgggaagcaatagtttagagcartagtgagaagctagactgtacgagtcaaagggagggatttggtgtttttttttaatgatagggtgatatgcatatttataggaagtatgtaggctgaatt

SEQ ID NO: 34064 - DNA, 201 bp, Bos taurus
tagtctccatcataattatttaatgaattcttaaattctgtaattgcctactatttccctactactcaatattagcaccacatgtaagttattgatccccmaaattatgctgcatttagaatacagtattttcttctatccatagaataaatattcagaagtaaaagagacaatcttttctttttgagtgaaggtaaaact

SEQ ID NO: 34065 - DNA, 201 bp, Bos taurus
gccccgtacaggactataaggagtatgcccagcggcggcctcctgccatgcgctatgaggatgcccctttctacttgtccatcaagccagttgtgaacttrgcggctctgcattggtacaactgccaggccctcggcaagaacaagctggccaagatggtaaagaccatgtgcgagaaggggaacatcccgggcaggaaga

SEQ ID NO: 34066 - DNA, 201 bp, Bos taurus
agttgcatttaaatattcaaggtcacggagctagaagagagtggggctgggatttgaacttggatctgtcccaccttagagcacgttctcgtcatcaccaygactgctgcaaactggcatcgacccgctccccactgtttgagcgtttatttgcatcaggcactgtgggttgcgtttcttatacaaaacgcagtttcaggc

SEQ ID NO: 34067 - DNA, 201 bp, Bos taurus
aagcatgtgggatcttcttggacccagggattgaacccgatcccatgaattggcaggtggaatcttatccacttgaccgccagggtagttccatggcccaytttctgatgatatctgatagccattgccagagcatatcattcaggttatagcactgggtatataaggccaatggggctcatagaggagacatttggcaga

SEQ ID NO: 34068 - DNA, 201 bp, Bos taurus
ttattcttttttccagagtcaaacatagcctgttttgcaccttccacttgcatgtgctttaaaaaaaagaaaatccaaccgagtaaattagaatatctaaytgactttattaagagattcatgaatgggacagcatttcatttagcagacagaaacgccatctgaggagctgtgcagaatggagtatttttaaaggtataa

SEQ ID NO: 34069 - DNA, 201 bp, Bos taurus
ataaaatgcaataattaaaattatgccccatgaggttccctcccctctttttagctccttgttatggtccccactaggagcctgtgatttactagtaactrcaacattctggacaaccattagatgataaacactgtatcaaattcataaattatcatatggccatctcagaatgaagttcacaaatataaattcctaaaa

SEQ ID NO: 34070 - DNA, 201 bp, Bos taurus
ccagggaagtccctaaccttcacttctaatatccttaacctcctcaattttgattccattcccagcaggttcttcttggggtggggacctctctgagaagrtcatcatagagggtgagtctcaaaagttcatagaagcaagaatgctccagttcttctagtccccatcatcaaccccttgtactcagccaattaaaacagg

SEQ ID NO: 34071 - DNA, 201 bp, Bos taurus
tacctttcgtgctcaaattttctgtaatgattacctgcctcaaatatcactagtttatgtccaaaaactacaaataataagcttgcacctatcgaagtccrtattctctgcctgcctgacttgggattatcatcctgagaacctttttcttaaaccttttatacagtttttcttcagtgaattgttagtaattttactagg

SEQ ID NO: 34072 - DNA, 201 bp, Bos taurus
tctggctgtaagacttctcctagctgtgacaccaaggtgcatgccacatatcatctccactgcagcacccagaggtggggccttggagatgccagggtccrtgtgagcactgtaggaaggagcaggggcaggtcttggagtcaggcagccctggcctgagtcgacagcgaagctaactccagttctgtctggttccacaga

SEQ ID NO: 34073 - DNA, 201 bp, Bos taurus
agtagcctgccctagtgcccgcccgtagaggcttctcgagtcctctctgcttcttcctttgctggccactgtcccctgctgtgtcctctcttctccatctyagggcttctgtttcttcgtggcctctgcctcctcatgtctacggctcctgtgagcgtacgccttcggtagccccagactttctctttcttcgtgtatctc

SEQ ID NO: 34074 - DNA, 201 bp, Bos taurus
ttgaccttggaccctctcggatctgtttcctcgttagtaaaatacggagatcataacagtactaacctccagaatgaatgcgtgctggccaaaaccgctasggtaagcaagggttctgtaccatatattgggggagggtctccttttatggacgcgccggagtggcctgaagtgttagtcctgtctgactctttgcgaccc

SEQ ID NO: 34075 - DNA, 201 bp, Bos taurus
cagttggtcatcttttttcttcttagaagagtgggagtgatgacttctgtgctctttacatatggaagctaaaaccgaaagcccccacctggtggcttttktcagtcttgttctctggtgtcataacggtgctggaggacttggtgccctttggtttcctgggtgatggggacacagtgaggggcctgggcatgtcataac

SEQ ID NO: 34076 - DNA, 201 bp, Bos taurus
tgggggtggtggcgggggggttaagtaaaccaagtgatttcatgagtcagtgcccgaggcaggcagtgaggtgtgccgtgggagccctgagtatgttgacrtggtcctttaaattagagagaacatcagctgttccaaactgcttcatccttttgaaaactgtaatgcctctccaaaaggtgggccttaaagagacggagt

SEQ ID NO: 34077 - DNA, 201 bp, Bos taurus
cagagtccacagggctgggtgatctcagccctgggtctgtgccccacttccctggggctgatcatgataccacgctccctgccaggcctgccctagggggyactaagaatgtctggtgagcataaagggctgggggtcccttttcctgtgggcagtgggtggcccttgtgaagtcctctctggaaactaggcactccacaa

SEQ ID NO: 34078 - DNA, 201 bp, Bos taurus
ctgattctatgccaggtgaaatcagatgggatgcagggcccaggtcaggtgagaagctctgggtctgaggtggacagggctccagctgtgcctgtgctggrtgatgaggcacctggcccttttctccttggcagctggctgcccttccctcctctgccctgcttggtttgcagtgaaatactcaggattactgtgagccct

SEQ ID NO: 34079 - DNA, 201 bp, Bos taurus
tctgtggggggagggtcaagcacagctttactgcgcatgctccagagcgcggcaccaggcacagcctctctgcgcacggctcatagccgccatcttgaatwgcagtgccgtgtgcagtcctaataaacgcggccccgagctgcagtgtcggctgccgccatggtttctcactaagaactctgctgtgaagtgcccggtgga

SEQ ID NO: 34080 - DNA, 201 bp, Bos taurus
ctgtagagcccagtctgctatccaggttcattcataggtgactgaccagtctgtaggcttgcccaggggtaacctatccctggtcaaactgtctgaagtcrggtcgtgcagacgtggctacagagtgcagcttcttgtgctgagaagctaccaacttttctccgcaaaggctggtaggacagggcagatgctctgagggca

SEQ ID NO: 34081 - DNA, 201 bp, Bos taurus
cttttatggaaaggagactaggagggaaggagaggggactgaatcatctgtgtgggtatttgaccaagaaaacagaagtactttagataaatgaaagaaaygtctagaacagaacgctattcttgttgtttcccactctggctggggagctgccgacagaactgcctcacagggtatcagacaaacgtaagggcaggtatc

SEQ ID NO: 34082 - DNA, 201 bp, Bos taurus
gccaatagaatggagcaagaagcgatgggcatgtcttccaggtctacaatcctttttttgagtgatcctttctctcttgtctcatattttggccaacagasagaattctgaggacccagaggagggtgacccacaagaccaaaggaagcaagagttctggattatggcctgaagcatatcacctctttctcagccaaacca

SEQ ID NO: 34083 - DNA, 201 bp, Bos taurus
gagaatcccaagccagagctccccagctgagctctgtgagaaactgtgagagataataaacactcaccattttaaggccctaggctttggggcaatttgcygcatggcaatagagaacaggtacaagaggaaagggagtgtgcgctaagactggggaagtgggccagagtcaatcacacagggaattctaggtcccattaa

SEQ ID NO: 34084 - DNA, 201 bp, Bos taurus
tggaacaggaagcaggaaatgtactcaggaagtaaatcataaaagacatgagtcccaggctaagtaaattagactttccccataaattatgagagagccaygagagacaggtggctagaacatcaccatacaccatccccaaactattgttgaccactcagatttctccttcatttagatttgctgactacatagagctat

SEQ ID NO: 34085 - DNA, 201 bp, Bos taurus
gccaatgcttcaagtacaagatactgtgatttcaccgatggtgaggctgcttggggaattgctttcctaaactttccttccagtgtttagattatggcacrcagtctagaggtatattatgagtgatcctcttgaacttagtcagaaagtcctcataaatcacattcaagaaaatatagttaacttccatatacatatata

SEQ ID NO: 34086 - DNA, 201 bp, Bos taurus
ccaccaggctcctctgtccatgggatcctccaggcaagaatactggagtgggttaccatgcccttccccaggggggaaccttctgtgctacacataaagcygggccctgaaacaatgctcaatctatgtaattaggggacaaagatcttcctgtaagtcaagtaaagtggcaggagagctcatcttctgcctgtgctcaca

SEQ ID NO: 34087 - DNA, 201 bp, Bos taurus
ccatgctccacaccacacacccttagagctgagagtgtgtggtcctcatcctcgccactgctccagcacatgagaaacacagaggaagggtgacaggcctrgtccatctcactacagctccatccagaagaggacagagccattccaggacagagccatctaatcccaccattacacggggacgttctctcaccctggact

SEQ ID NO: 34088 - DNA, 201 bp, Bos taurus
aatcttagtaatttttctattattttgaatctattaatttctattaattttaatgattaacattgtaacatttataatcaatgtaatatttaatattgtartatctcagatttaatggtagcccacaatacatttgttaaacactactagacttgacctatttttagaaaggtggaatgattttttcttgtggttctgtag

SEQ ID NO: 34089 - DNA, 201 bp, Bos taurus
ctgtttcatgcttaatgatcgctcttttgttatgctgacatgtgtgtgtgtcaaaggcatttatttagactttgtgggcaggaactaggtccttctgcagytccacaggagaggtttggaggccagttccccagcatcagctgctggggttggggcttggttagaggaacttggtccatgagagaaggaggcacaccatgg

SEQ ID NO: 34090 - DNA, 201 bp, Bos taurus
gaagagctagatttaaagtggttcaagcttgtactgttcctattttggaaggtgagtctttctactaattctcagaggccattgttcttatttctctgcartattttgtgttctgtccatggtggacaatatgtgttgctttgcctgcctagttctcttccttcatgagtaccaacccaggccagcccatccaatctacct

SEQ ID NO: 34091 - DNA, 201 bp, Bos taurus
cttgcagctctacaaccagcattcatcatctttctttgcctccatgtgacattccccatgttgtatattttccttctaaagtaggttccataataatatgragtgccacatctggggccaggttgtctgcacttgaatgctagctgtctgagtgaccttgtgcaagttatttagtatttctgtcctcttctgtaaaatgag

SEQ ID NO: 34092 - DNA, 201 bp, Bos taurus
aaaacataaatgatgaaaccatgtgaaacttggccatataatggttcaccagcatcctattatccaaaaaataacttctattctgcacttgaagaaaatgygcatggatttgtaggcttgtgaaaggagccatactagaaactctgcatgtagaagttctttgtatacataacaacacatcgataggcagtaccatgcaag

SEQ ID NO: 34093 - DNA, 201 bp, Bos taurus
tatagctctagatatttacttaaaatgggtgaaatgtataatatgtcaattaaaactcagtaatgctcttaagtaaattatactgttagatattaattagygctaaagcttcaaagtagaatcagcaggataaacactttagagactaggaaaattcaatatttatagaattcctgagaggaatttttaaaaagattttga

SEQ ID NO: 34094 - DNA, 201 bp, Bos taurus
acccaatgaccataagaatgtgtgcactggcaaagacaaatgtaactttttcttctactctgataaggacagcagtgctttctcgggttcataggagcccyagagtgtgtatttcagtaaaaggactcctataagaaatcttgacctagaagttactctccaggatttaaaaactgaagatgagccaagagagaagtcctg

SEQ ID NO: 34095 - DNA, 201 bp, Bos taurus
ttcaacatcaactgcctcaaagtcattccttcaaacaacaactaggaatgacaacaggaaagactgaaaagcagtgtgcattgccaacaaaatctatactraaaatcactaaacatggagattggaacacagtcctagatcaaatcctaaatgaattttagtagaagttcgtgaaataatgtttaaagcacaagaatacat

SEQ ID NO: 34096 - DNA, 201 bp, Bos taurus
cttacctttaaagtaccattttcaacaaataattgaataaaataatccatctactgaatctgagtcttgcttgaggtagagtaggagtccatatgcattgsgggcctgaaattccagggagatgttattttgtggatttaaaaacacattctggaattctagataggaatctccataataacaaacacaactgatatctgt

SEQ ID NO: 34097 - DNA, 201 bp, Bos taurus
aagtataaatagaaacaactcaaacatccttacatatcatattttctctacttatactcttatagaaacaattagatacaattttactctaacgtatttamggatctaagacccattggaaattcattttaaattataaaataggcagatagacatttttataaaagtagcataaaatcgatgaaagagtgcataattaaa

SEQ ID NO: 34098 - DNA, 201 bp, Bos taurus
tttttttttttttgctactttcttaatgtcttttcaatatctccccattaactagaataaacctgaattaatcttggtgtttttttttggaacttgaaaakgtctaatactccactattcatgcttgaggatcaagacttaataattttgacaggttctggtcctattaaggccatgggatctactctattgatgactgac

SEQ ID NO: 34099 - DNA, 201 bp, Bos taurus
ttcctgactattctatacattacttacaaatataccttaaatgctaagtatcattaaaccaaaacacttacgcttcataaatcatactgtatcatctttayatcattgttgattttcaatttaaattttctaaatctaaaccactgacctgaagagttaaatttactattttttgacccctgtaaatgtctcttttcttat

SEQ ID NO: 34100 - DNA, 201 bp, Bos taurus
gaaacattactggaaggaaaacaattaaagcccacagtgtgaatggcctaatgtgctatggcaccccaagacagatggcctgctggactcaacagactcaytttaggatgtcagatggcagggggaaacaggaaagaaggctaagaaagaagaagtccaagaggcggtcaaatggttaaaggcccaagtaatcaagacaga

SEQ ID NO: 34101 - DNA, 201 bp, Bos taurus
aggtgtcttaggttagggcttttctcatggtagctatcccacagtctggtttcctagcccaagttaatttgctcagattatcctcggggcattcaggctcrgtccttactctaggtaatgcagcccgtgcctccctgcccagcccccgcttgctagtggtggatgcaggagtctgtgctgcttctgtgctaggggagttac

SEQ ID NO: 34102 - DNA, 201 bp, Bos taurus
gatccccatgtgaagggaacatggtgttagctgcaccaattgaaacactggcagaaaaagaaaactgctctcagcatcaattccaggcaaggctggcactmttccagacccgtgtccacatctgatcaattacaattcccaaagacataaggtttgctatgtgtctcagcttggattctttcaaaataagaattgaagtaa

SEQ ID NO: 34103 - DNA, 201 bp, Bos taurus
acttaaataattatgatgaatttgtcatcttagtattttcagcctgctatgtaattagtaatttcatggagataagcttggtttcagttttatgatgaatrtcaggtatttattatattaaaagagtgttcattatttcttcacatatgcttaacagtaaggcatcctacttcctataaagtgattcagaggttctctttt

SEQ ID NO: 34104 - DNA, 201 bp, Bos taurus
ttgttgagtatggcagaatagaaggatgtgcgctcatcttctcctgtgagaacagaaaatttgcaaccagctgctgaagaatcatctataggaggatgtcrcaaaccaccaaaaattgatactccatgtccaaggacaaagaagaagccccaataagccagtaggaaaggtgccagagactcttggaggacacacaaataa

SEQ ID NO: 34105 - DNA, 201 bp, Bos taurus
accttgccttttgtttgtgggggaaaaaaagttaaagattaagcttaatgaaagtagtgagaaaaagcaaaaggaaagcaaaggaaaatagtccagcaagmccaaataataagagtatatacattaagcaaagtcaaggacctttagttccatgtcaagggctatagataatttgagtcatatcctttgagccattgtgca

SEQ ID NO: 34106 - DNA, 201 bp, Bos taurus
ttttatttgtaaattcaacatattcatacaaatgtttgaaagtatagcccttactatttcaatatcctattttttgagtgactaagcacatacacactccmcacacattatttcccctcctgtgtccgtgctctacaattcctatagcagaaacatctatgcaagtaaacctctaaggaactagcttgctttctggtatga

SEQ ID NO: 34107 - DNA, 201 bp, Bos taurus
tgggttaaagaaagtctacaatttcactccaggtcctgctctaagcactctgagtctaagtgcacctaacacttgtacacagtctttccaggccccagaawtgactgtgatttttcggcttccctcgtggctcagctggtgaagaatccacctgcaatgcgggaggcctgagttcaacccctgggttgggaagaccccctg

SEQ ID NO: 34108 - DNA, 201 bp, Bos taurus
tgggcaggaggttatgtcccaagggagggagccctgaaacaggagttcctgttcacagggaaactccctcacagtcaggcccaaaagggagctgcaaagtrttggaaaaccaggcacaacagggacttgaagggcagtaaacagagaaagccgcacttctcagcccgttaacagctcgtggactttggccccaaacagaca

SEQ ID NO: 34109 - DNA, 201 bp, Bos taurus
ttaactatatgcacataacacaggctctacaaggcaggtgtcccaaatgagatgtgattgaaaagacaataacttgagaagccaactgaatgagggtacgkgatctccagaaaagtaccaagcagacatgtgtgtttgtgtcacttgtcacaagcactgacagaacttaaggcatatgggcctgattattttctacaggtt

SEQ ID NO: 34110 - DNA, 201 bp, Bos taurus
tttgggaaaataatgtgcatatgaaaataaacaactttaaataatgatgaccatcatttcatagaatatcttgtatgtctctataatttttttgtcatctmtacattaaataaagtcagtcagaaaagagatcttatggggaaaaagcctaaagcttaatatttgactcatattttatcattttttgcccttgttatctaa

SEQ ID NO: 34111 - DNA, 201 bp, Bos taurus
gagatatttgccatagtccccgattttgcaactagaactattctgcaaaaagcaggggaaatggatagaggtcccctatgtccaaattttttcaactaaakacatgaagggactatgccttaagtatgggattaatctataccctaaaaatgaacttactaggcaaatggaattagacctcatataactaagagaaggaag

SEQ ID NO: 34112 - DNA, 201 bp, Bos taurus
aaaaacatacttatttttctaatatctagtttatagtatcttttaaaagataactctcaataaaataaatttttaaacaattgattttcagattggaaaamaagtaatataagagaaagacactacatggtttcattaccatctgtttcctgatttgtatttcctcatttcattctgaatattcagaatgtgatcatcttt

SEQ ID NO: 34113 - DNA, 201 bp, Bos taurus
atgagttatgcatgtttcagtttttactgacctgaatttctaatattcataaatttgggcaggtaattcaggtcatttataaaaaccatacaataaatcawtacagttctaaatcacatacagaattttcttccttaagaagaaatgcaagcatatcacaagttatttttcaaagaatttttcaagtatatatagaaatgc

SEQ ID NO: 34114 - DNA, 201 bp, Bos taurus
gctgtgcaaaaccatttaaatttaattaggtacattcacttatttttgtttttatttctcttgcattaggagaaacatcctagtaaaagtcttgctataayttatgttaaagaatactctgtgtaggttctctttcaggagttttatgatttctggttttaggtctataatgcattttgagttttcttttgtatatggtgt

SEQ ID NO: 34115 - DNA, 201 bp, Bos taurus
tagctatctattttgtatatgacagtgcaaatatgtcaatatgctattctcttgtctcactctctccccgtacctgctatgtcctcaagactgttcactayatttgccctgcaaataagttcatttattccctttttgtagattccatacatatgtgctaatatgataaaaataagttttaattattaaatgcctaagtag

SEQ ID NO: 34116 - DNA, 201 bp, Bos taurus
aaatggaaaaataataccctgcttacaatatcatcatttattaaaggtaagaaagacattaataatcaggatcagtaagtataaatacatgagtatttttrcacactactaatgtgaattatcaatgcaaagaaatagaggaaaacaacagaatgggaaagactagagatctcttcaagaaaattagagataccaagggaa

SEQ ID NO: 34117 - DNA, 201 bp, Bos taurus
gaaaaggccacaaggtcctcctaatccagttgaataattcttgtttagattgattcaacatttttaaattatttttctcaatttacatttttacatttacrttatttttcatatccttcccctgtatagtttattataagatgttgaatatagttccctgtgctatacaatgaatccttattgtttattttatatgtagtg

SEQ ID NO: 34118 - DNA, 201 bp, Bos taurus
gtagaaacgaatttctgcatagagatggaaagtagtgaaacaagtatactgcttatgagtacagtatgtatggatagacacatgggtgggctcagaaggakaatttggccctcatagtagtgaatagcttatatggggcatttcttctgggtttcctttgaccagtcatcacactttgcctggttctaagtccatatttgc

SEQ ID NO: 34119 - DNA, 201 bp, Bos taurus
caagtcagattcctaaagctacccctcacttactgagattacatagacagtgcaatcaaaacctttgaacctcccggattctataggaaggagaacacacratcaacaagcacctcactcacactaaaatcttaagctccatttctcacataaaactgtatcttaaaacctttctagtcattttaatgagagagagatggg

SEQ ID NO: 34120 - DNA, 201 bp, Bos taurus
aggcatattttatagacttagacacattccaagtccacctgaagagaaaaacttaaattcgttacaaagctatcaaacatcagaagtcaagggatacttcrtttctgttctatttttgacaactgtatgcaatcttattatcagttttcatgttcccaaatttagaatttgcttgccttgttaaggctctttcttctttta

SEQ ID NO: 34121 - DNA, 201 bp, Bos taurus
caaaaactcataaactgaaattttgcagcagaaagtatgtgatgtcatctgtagctattttttttaccaaggagaacagtaaccccatgaaagaagtcagscttcacttgtgattttatgttcaaatctcaagtagttatgtttatcttgcaagaatgcaaggagaaagaggagatatatcgtttctgagactttgatcag

SEQ ID NO: 34122 - DNA, 201 bp, Bos taurus
atgcaaagagaatatctaaataaggtctacaagaaaattttttgtaatgctgcttcctagaggctggaatattaatcaaagctaaatactaattctctttmttacttctacatatggaactctgatttaatttaagtaatgccatattcataagccttattaaaattaattgctcttttcattttttaatctggtttgtca

SEQ ID NO: 34123 - DNA, 201 bp, Bos taurus
aaagttgaggaaagataagaaagagaaaaaaagaaactgagcccttttagggctctttaggtgaagaaggtcaatctgaggatgctgcagaagcatgtccyagcgtgggaaaggaaaagagtggagtttgacataacggaactaaggatagaatgcattcaaagaaggggatggttaactgtgcatgataataataagcaa

SEQ ID NO: 34124 - DNA, 201 bp, Bos taurus
atccttctagagcactctatttcctgctaccctagccaccaactcccctgagtacatggtgatgtctggtcccctgagactcaagtagctgcaccaccttyactcctggccctcacaggggcaagcccaaaccttccagggcagcctcaggagcgaacccctgtggacaacccacatgcaaaggtggaaataaaaccacga

SEQ ID NO: 34125 - DNA, 201 bp, Bos taurus
tctatatgttgaactgaaaacccattttttatttgcacttttataatcccttatatatatatataaagtataaataaaatgttttttaaagatatgaattkaattcagttcttctcagagaatttattcattccagcaataaatcttgctacctttctaagtccttgctttgtgccagaaattgtgctaagctcttagata

SEQ ID NO: 34126 - DNA, 201 bp, Bos taurus
gtaaaaaatgtgtctcagaatcagcagtgcttgctcagaatagaactttctaagcagcactacaaatccactaaattgacattttgggggcttggggccaygactataaactttaataaacaacagagatgatgcagctgagccatagaccacttagagaaatcctgcttcctgttgatgctaggaaagaacgtcctggaa

SEQ ID NO: 34127 - DNA, 201 bp, Bos taurus
ggggcgggccgggacgacgcgacccgcgaacacctcagggcaggcagttgcggacgccgcgggagcggacgccatggctgcgttaggactcgcttcgttgytgggccgcgtcccggctacagcgtggagagcggcaagtaaggcgccccggcctggggccgaggtcgcgggcagggtcgcgaaggcccaagcaccgagaga

SEQ ID NO: 34128 - DNA, 201 bp, Bos taurus
aattagacatggtccctggactaatataaatcattaacatgatcttgaaacacttgcaagacaacatatggaaaaatgcaatatgcaatattctcatgacrtagtgtacactgagtagaagtaaaatttattataactagaaaaaaaagcatataaaataagctcatcccagtgcaccagccccaagcatcctgtatcctg

SEQ ID NO: 34129 - DNA, 201 bp, Bos taurus
aagagttttctaaagtttctactagcatcgttgtttctagatagaaatgttaaatagaaaaagctgcttttagaaaattctagttggtaactgatttcttygaagtggtgtttatttgaatcagtagctatttcatatgggtaggttttctctctgcaatgagggtttaagctcctgtgtcacacactcttttggaatctt

SEQ ID NO: 34130 - DNA, 201 bp, Bos taurus
tgctgcctcccaggcctaagtcctaaaaatttccaccaaataaaacataattaaatctttaaaacaaaacaaaacaaaacaaacactttaatttcagttgmtctctcactgaaggccttgctgtcttctttccctaaccttcactttcatgggacaagtgctcactcggccttcaccctctgtttcttatcccacctagac

SEQ ID NO: 34131 - DNA, 201 bp, Bos taurus
actgttagctgcttcagttttcaaaaacaaaatttgagtagttcatataatctggagagagaaataaatcagattcccttacttaaatattatgttgtaayagcctggtgctgagaacagtcctttgttcaacagaactgactgaaacctttctatcacttggcagagatcacaccaggactcaccgtctcagcaattgta

SEQ ID NO: 34132 - DNA, 201 bp, Bos taurus
caatctggcacctgcttcatggtcagcctcatcgttcaccctttcccaacatggaacttctatgtcaaacacatggatttatttctcgtgtataaaccctytctattccttcctctggcatttcatcttcctgctcggagtgtcttcctttccaccttttcaagatatctatttttaaagactcaatttcaagacactttc

SEQ ID NO: 34133 - DNA, 201 bp, Bos taurus
tagcttccattaagttaaccacccaaagattgttttctcatgaaatgttgagctttagtacattaaacttgagtgaacgtgtgaaaccctagtcacctcartcttaatgaaggcagaaccctaggttcatgcccttctcctcactctctgtccctccccttctctctctctcccgcagtagcctcactgtcttcactatgt

SEQ ID NO: 34134 - DNA, 201 bp, Bos taurus
gtggaggccagctgccaggtcctatgtagtgacagtggctagttgcaaacagacttgtagggacggggacagaaccaactatgggctcacagccagtgagrttctggttactggcctactgttccatggctgcacactctcccctttggtgtgtataaagtattaatatcttagttactcaagaactactttgtccacagt

SEQ ID NO: 34135 - DNA, 201 bp, Bos taurus
ttccttttcatatttagaattatttttcaatgtataaaaatagatggcacaaaccaattgcaatttccagcttttattgaaaatgtgaaatatctggtcawtttaggcccacgtgtgtgcttagtcactcagtcgggcccaactctttgcaaccccacggactctaggcaagaatactggagtgggttgccatttcctcct

SEQ ID NO: 34136 - DNA, 201 bp, Bos taurus
atggggttctcgtggcaggaatactgaagtggtttgccatttcttcctccagtgtaccacattttgtgaactgttcactgtgacccctctgtcttaggtgrccctacaagacatgtctggtagcttcactgagttatgcaagctcctttgatgcaattcttattggagatttgcatctcaaatttgcatattaaggtgatt

SEQ ID NO: 34137 - DNA, 201 bp, Bos taurus
agatcctaaattagaaggaatttattttagtgttgaattcctgggaacaactctgaagatctgtataaatcccatgacatcagcccatcctctttcttccrtaataattagaagaggttggtaaatacataagcaacagcagtggccctttgcccactgcagtcagccaacatgattgttacaggcaagaaccaaaatctg

SEQ ID NO: 34138 - DNA, 201 bp, Bos taurus
gtgaggtcaaacacggcctacaaaaatagcagatcaaacttggttattgacaactttcttttttctggtgcagtcacttccatattaaacttttccaggtrcacattttcttaataagtattttatgacaaagacaaccattgtgtaggttatttttactccagagaggatcactgccaatgtcctgtggaggtatttttt

SEQ ID NO: 34139 - DNA, 201 bp, Bos taurus
gtggagtgaatgaagtagcttgaagaactcacaggacaacgtgtgtggaacagatagttttgggggtatggagatgggtggtcttggcaggaactggatcrtgaatgtcctcagatacaagatcaatgagtctggacctggagacgtttctgacagcattgtttggtataacaggtccatgtgctcttaatatggccttaa

SEQ ID NO: 34140 - DNA, 201 bp, Bos taurus
gccagaggagccgtgagtccagacccaaaaggtctagataacttctttacaccagacactgatgtgggtgccactgtcatcccatgtctcctcccagagtyccgcagagggagcaaagcaaaggccttctgcttctaagggtctttagcatctttaaagcaccttcccttctggagcagcttctgcctgcaaagtgatggt

SEQ ID NO: 34141 - DNA, 201 bp, Bos taurus
cactgtactaacatgtccttgttttctcaatttacagcaagacggaccttttccccctaaactcagtattggtgtttcaatgggacaggaaatggtgatgyttttgtagtctgtaatcccaccggcttccgaggctctgcgtcagcaccgcgggccatactgtcagtggaagatattatattgctggaccctggtgctcaa

SEQ ID NO: 34142 - DNA, 201 bp, Bos taurus
cgtcccaccttgagatcttagaaaagcatctcatcccagcttcccaggcagctcctcagcctctggcaaggttaaattccatggcctcgcaccctcaaagkgtacccaaccttagcaaaaccccacaagccatgcctccaaggctctattatttcagcatctggacaagcacaccttgtaactgcattaacgaggaggccc

SEQ ID NO: 34143 - DNA, 201 bp, Bos taurus
cccagcaatgtcacagaaaagattctggggcagagaccatctgtcatgcaagatagttggcaatattaaagcatcttgccccaggcctggtgtcaagtatstatatgaatatgaagtgaactgagtggaatcacaatgttcttaaccatggttattgcatctactcataggtatactttggcctaataagaagcttgttaa

SEQ ID NO: 34144 - DNA, 201 bp, Bos taurus
aagaataaatcctttcaacaagaaaaaaaacgttgctgaacaggaaaaaaggaagaaaggtgaacaccaaagccatagtctaaatattgaaaataaggccygactttaagcaattaaggtgagaaaaaaatttcatgtgtcctcgatgttaagatcactattataactgatttaggagtcatgaccttgaaaggaaggata

SEQ ID NO: 34145 - DNA, 201 bp, Bos taurus
gctttccttccaagaagcacatgtcttttaatctatcaaatgtaactttatcaaactcctaaaaagcaatgcatcctattattaggccagcatgagcccaragtcatagaaataatgaaggtagagaaaatgtgggctttgttatggagtgttttcaaagagtaaagataggactctgtgcaggtgatggccaccctctat

SEQ ID NO: 34146 - DNA, 201 bp, Bos taurus
agggaggctgtgaaaaaaggtaagaggaggacttcgttgaaaacatggcctaagggagacaccatgttagaagatgaacatgtatttgtctttcactgtcyagaacttagaatgtcttttctcaaagaaacactgaaaatgatgagttcccacactagtccaaacagaaaacctattttagataatgacgtgaattaaaaa

SEQ ID NO: 34147 - DNA, 201 bp, Bos taurus
tgtagaagctgattactcaggtgtaatccacaaagaatcaataatgcagcagaaagacaagtaaaacaagtataataaagggtagtaagtgatgactaacractcttcctttgccaactgtgtaacattggaagatgagttaatctcaccgcttcagtctctggcagccccagtaaatgtagtaataaaaatattaatctc

SEQ ID NO: 34148 - DNA, 201 bp, Bos taurus
agcagttcccctatctctcttgtgggatctccatattccctgagacacaacgatattgaaattagggcaattagtaactctacagtggcctctgagtagtyaagtgaaaggatgaatttcttgtctctcactttaaatcaaaagtgagaaatggttaaacttagtgagaagggcatgtcaaaagcagagagaggcaaccaa

SEQ ID NO: 34149 - DNA, 201 bp, Bos taurus
gctaataaggaactggcaactaaaatttaggaaaatggagcctctgttacaccaagctttgggagtctcacacggacagagggattagcaagtttcggacyctgtgactctctaaatgccatcttggcacacagaggtcacatgttgtacatatttttaggaaatttgaaccattctaaaagtgaaattaattttacaatg

SEQ ID NO: 34150 - DNA, 201 bp, Bos taurus
gtaattcatgtttctcagaaaggcgtggatttcttttaagccagcaaattctggtttgaacagaaatcatggcctcttggggctttcagccttcctccatygccctcttcctcggttgaagatcactttgagtcttgccaaactcccttctgcacatcctgggtactggaattctgtgtcaggggacagcacgacgtgcga

SEQ ID NO: 34151 - DNA, 201 bp, Bos taurus
atgtcccattaatttctggacaatgagtaaggggccataaagggcagattggtgactggaaaagtagagagaacgtctttcctggttcttctcagacctcyctgggtcttagggccccaactctcttacagtcccgtcttggcccttgtacctcaaacactggggtttccagggctctttgctcacacaagtgctgttctt

SEQ ID NO: 34152 - DNA, 201 bp, Bos taurus
gaatggataaagtaaatgtgtgtatatatatataaaggtcttgaggagctaatgtataaaatggtgactatagttcataatattgtattgtataatggaartttgctaagagggcagatgtgttaatagactatatgaaaataatcctttcacaaatatcaaatcattactatgtatacatcaaatatcttacaattttgt

SEQ ID NO: 34153 - DNA, 201 bp, Bos taurus
tacagcttattttagaatattagtacttctgcaactaattagccaccatctatggactattgcttgcttcttatttattctaatatggccaaagagtgtarttagcaaatgtaaagatggctcaaggcaaaatttaatatacaaacataaaataagcttcatgcaaagctctgaatgggaactgaggaaacagaagttttt

SEQ ID NO: 34154 - DNA, 201 bp, Bos taurus
ctggtagaatcttcttatcatttttgtaactgttggacacattgttgtgtacagtttatgcctccgtttgcagtatctgacagagtttatttaacacaatrctgctggaataaacgtcacagacttttattaatggtacctgactctttgagagtcttagtgtatcaagtagttgacagcttcatatccaagtacacactg

SEQ ID NO: 34155 - DNA, 201 bp, Bos taurus
cagttttgggagccctcatttacttttggaggccagaaatcgttgatggctgtgatgtttcttgtttgttgatataacaagagatattttcatttcacaarccctgtcttgagaaaatctgatgactgacatctacacaaccatcaccagtgaaactctgaggagaggaggtagactaagtttctagaccatctttttctc

SEQ ID NO: 34156 - DNA, 201 bp, Bos taurus
gaagggttgattgtatttagattagagttaatcaagcaaagctgcagctctccagaagtgagctggaggattcatctttgaaatttaactcaaatcatttwaaatgaaaaaaaaaaaaaaaaggtgattaaaatttcccttttttccctccaatcctcctaagtccctaaagaaatttaagagtatcatcagattgacagc

SEQ ID NO: 34157 - DNA, 201 bp, Bos taurus
tgagtcacttttgaagaaaatactggtaacctctgctcccatctgctgattttgtgaaaggaacagctggtctctataaaggtattcaaggcatttgatcyagtcattgaagaccaaacgattgaggaatccaggtaaacagaactactggggattttcagatcaagagggggaaaaaaagacaacatgaggctatttatt

SEQ ID NO: 34158 - DNA, 201 bp, Bos taurus
tttatcttgatagccttataatgttataagtatcatctgccttctatggcataaacaaaagtatgttttttcgcccaaattctttttaaaatggggacacraagaaaccaatgctctcaaactctttttgttaagaatcattactctactttaactctgcaacaacataattaaaattttaaaaaactaaaacaaaatatt

SEQ ID NO: 34159 - DNA, 201 bp, Bos taurus
gagtttggctgtgagttgcttcaattttctttgggttttcccatcattggacagccatgttagtgggaggcctggaggtgatcagaaattgaagaattccrccttagaagaggactggaaacagcaagggaatattttaatgttgattatgattatatattttaggaaataaaagggattatgatatcctgttactggctt

SEQ ID NO: 34160 - DNA, 201 bp, Bos taurus
tcatgtaattcagaaccaaggtaaaagggtctcatgtcagaaatagtactattagcagccagatcattatagaggttgtttaattaattctttactgtgargagaaatgccattgacacttcattattttgatactgaaactacaattgggggctttcaaaatgtgtatgtgaaaccacaaatagatcccctcggtccttt

SEQ ID NO: 34161 - DNA, 201 bp, Bos taurus
tgtttcagataaatgagaatctttatgtaagacgaaactgggttattgactcaggacttctcctatctgctgaatctaatacagcaaacatttattggttrtcctgatactgacatagctttgtgaattacattcctaggaattctttccagatattcctgccaacatatttagtttcatcttctaggctgaaaatcaatc

SEQ ID NO: 34162 - DNA, 201 bp, Bos taurus
tctttttaaaggaagaaaaacagtctgcatagctggtttaaacttctgaactctatttcatccatgagaatgatagcggaccagcagtcccatgaacacarctcagtgtcatccaacttgggctcatctgtttatatgtacatgcatgtgtcctctccatgtacaaaggatctgaattacttgcacaaaacgcttaggaaa

SEQ ID NO: 34163 - DNA, 201 bp, Bos taurus
aagtaaaaggtgaatcaataaaaacgttaaataaaacagaaccaactgccaaagaaaaaccagacacacatgggaaataacagtttctatgaaaccacaaytgcggtcttgtgcatcctgcccagcaggatgctggcttgaggggtgaaatggaggaagcccacccctcaagactgctctgtgtcttgatgtcacaggttc

SEQ ID NO: 34164 - DNA, 201 bp, Bos taurus
tagaaacagtggagagaatgccaaaactacccatagtgagagtttcacactagtacctctgatctgaaattccacaggcatggttcgtaaataccagactrgattagaatctaagactgggcccctctccattgggtatatgtttccatttgcccaagacaatcagttgataaccattgtcctagaatcctgttgtttctt

SEQ ID NO: 34165 - DNA, 201 bp, Bos taurus
tctttttagatttgggatacaagtttgcttttggttcagaactctttttgttttttcagcaaacattgttcactacttacttggcccctgacaaccttaaygcatctgaaatggaacactccctatgtgcatggccatgtccaatcactgagcaagagaggagcaacaatgcctgatttacattaggagttcatcttcatc

SEQ ID NO: 34166 - DNA, 201 bp, Bos taurus
tcatatcaaaaaagttgatacacctctccatcatgtctccatagatactctgatagagaaataactttctgctcagcaggtcatgcatatcactcagggtmtcatttcttctgttcttagttaagtcatttaatcaagactcaggatatgagatgtggcagctagaaaaaaatctgtgtttatggatcattcccataatca

SEQ ID NO: 34167 - DNA, 201 bp, Bos taurus
ggccttaaaggtctccatgaagtccccttcccatttcccttctgcattttctggctgcctaccccagctcacttccctcacctacactgctatcctgtttmtccaacaggccgggcatctgccatgccagggccttgcaccctttgtgcctctgcctgattctcttctcccaaggatgttgcctatccttcaggtctgtac

SEQ ID NO: 34168 - DNA, 201 bp, Bos taurus
gtgacaatctctcattgactgaactcttcctaagtaagaagaaagttttcttcttcctgctgggctctgctattgtagactctgagagtgtccccttctcycctcctgattctatttcaattgaggtttgtgtttaataatttttacagctctacgaaaatgtgcccaatgatggacttgataccttgagagatgaaaaag

SEQ ID NO: 34169 - DNA, 201 bp, Bos taurus
atgaacacatttatttctgcaaatgtagaaggatcctacattttcaaaggtgaattgtaaaattataggtttatggtgatccccaagcttctttgccttaygtgtctggcataattgaggatctcacagaacatgattaataactgttatctatggtaatatttcttgaaaggggaaataaactgaggaaaggaaacagag

SEQ ID NO: 34170 - DNA, 201 bp, Bos taurus
aaataaccacaaagtattaaaaggtgaaagtcttacaaagagacaattctgagatttgtactatgccacactgtcatttttttctggctttaaggttcaamctctgttcatttttgacataccacattaacatgagataaaatattaattaatttacattccaaatgtacttctggcagaagaaactaactatatttcaag

SEQ ID NO: 34171 - DNA, 201 bp, Bos taurus
tccccttcactcaaattcttgtcaaaactctcccatgcaggtgactagttcaagtgcttgcttcaaagtttctagagttttttgactctgatgaactttayattcacctcgtctcaggccctcaaacccaaaactacacatgtgatgtgtgcttagtcactcagtcatgtctgattccttgcgaccccacgtactgcagcc

SEQ ID NO: 34172 - DNA, 201 bp, Bos taurus
gaaggtggttctcacattttagggagtatcagaatcaatggaagccttgttagaacacagatttttggcttttacacctgagtgtcagagttaatgggagyggggcctaagaatttacatttctaagttgtcagatgatgctggggaaagtgcagggaaaaacactttgacaaccactaatctattaaccaacctcttcat

SEQ ID NO: 34173 - DNA, 201 bp, Bos taurus
tcagtaggccttccaaacgagtttccccctttcatcctctcccctccaccacgtctcccatcagtaacatttcagatcctcttagcacttttattagtccrctgggcctcttcctgaaggtcacattaagatgttaatagtggtttagtgggtttccctgcccaggagtctttaaaaaaacaaacatataaacttttcaat

SEQ ID NO: 34174 - DNA, 201 bp, Bos taurus
aaaataagcgacccgcctcccccggcccagggattcttgtgcactagtccagttgtcagtcctttttatggcagatgctctgtgcttacttttctgctgaygcactggtgaattctttggggaggcctctctgcggatgtccacgcagcaattctttcacaggtgaggcttcttctggttcagttctctgaagcttcctcc

SEQ ID NO: 34175 - DNA, 201 bp, Bos taurus
tcttcttgactagcaagttggaagtctgacaaaaactgtttagaaggacatggcactatgatttccatagtgagaccagaaaatcaggactgtgtgttgakacttagtctcagaaagatttactctgcagaaggaaacctttggacaaaatgtcaccgagatgaaattaaccattttgagccaaagagcttccatatgagg

SEQ ID NO: 34176 - DNA, 201 bp, Bos taurus
tgaaaatagaaaactctctacagtaaaaatggaaaacataggttacttttacatttgcaaaaattgcctacatattaggccataaaaataaccatccaatycaaacttcaaaaaatgtatacagatctgattaaaacataaataatttgtataaggccctcagtgaactgccgcccgtctctcccctgcgcgtccatcccc

SEQ ID NO: 34177 - DNA, 201 bp, Bos taurus
atgaattactggtgggaaaatattttggcatgctatacaggaaaaacttggtaaaaattagtgaatagataagcctaaactatgaacaataatcccactcytagatatataccctaaataaatcctcaatcataaggacagctttacatggattttattgcaataaacccttgtaaagaatataaatatttattaatatgg

SEQ ID NO: 34178 - DNA, 201 bp, Bos taurus
agaacaagaaaaatgaaaaggagataattaaacatggataataacaaaattctttaacaattttattgtgaaaagtgaaaatacaaaaattatttgaatayatttaaaatgtgtgtagatttatggttatagttgcattcaggtgtatcttaaagaagcaatggtacgtcctttctaaaagttgatcattagggatacagg

SEQ ID NO: 34179 - DNA, 201 bp, Bos taurus
tcagctcatttaatcatccattgcattgaaatttattgagcgccttctacatggcaggccctggggaagtcacgggagacaagaaaggccatgtccctgcyctcataaacttgcagtctagaagggaagcctaacttctaacacaccctttcaatccagtgtgatatgggttatgaaaaacaagaacagggaccctgggag

SEQ ID NO: 34180 - DNA, 201 bp, Bos taurus
gggatgggtccttttctagaaaatcagagctacaaagctgagtggaaccccagactcgtcctgtctcttttttattttacagagggaataagcgaaggccmgggaacttgagatgagctcaaggctgtgactgagaggagcagccctgggatggaaacatcaggtctccagcgcccaggccagggcctcttctctccactg

SEQ ID NO: 34181 - DNA, 201 bp, Bos taurus
cggagtgggttgccatttccttctccaggggatcttccccatccagggatcgaatcctcgtcaactgaacaaatgaatgcaaatactgggctttcattttyccattccccaacaatgaaaaaggtcactgatgtaactgatgaaggaaaatggcattgctttctttaataaataaaactgagatctaaggttgacaatgaa

SEQ ID NO: 34182 - DNA, 201 bp, Bos taurus
tctccaccaacacagaacttatcccaaaggcaaactttaaaatctttcttacctacttgacctcaatggagtccatcaagttgcttaggactttgaacccmaaagctgaatgatttttatgacgtttattaataggaaaatccacaacatgggctactgagaatagttttacagcagggtggagttcccctgaacatagcc

SEQ ID NO: 34183 - DNA, 201 bp, Bos taurus
ctcccagcaacttcctcgagatagatgtgagcaacccgcagacagtgggggtcggccggggccgcttcaccacctacgagatcagggtcaaggtgaggccrtcttttcccactacggagagactcctgtggtcctggctgtccgccgcggaccctggagcgcagaccttcaaacggccacggccgcccaggcggggccccc

SEQ ID NO: 34184 - DNA, 201 bp, Bos taurus
tagggaatagaaaaaatttcatggcatggcatgaagttgcacatgacttacgagaaggcttcagaaaagaatatttggtgaacaaataatggcccatagaygctcactgcagatgaactgtaacttgatcagccaattttttttttttttttaatgtttgtgttgttcttgactgggccatggtctaaaaataactcctgt

SEQ ID NO: 34185 - DNA, 201 bp, Bos taurus
tattagcaaggaaagagcttttataagtttggccaagggtggaatggatgtgacaggttttagaatctgccctctcagccaacgaccagttagttacaagrgagtgggaaggcctttcacctacctggcagcagagctggaagttctggctgtgggcaaggagacacttatgccttgaagtctctatatacttactatctg

SEQ ID NO: 34186 - DNA, 201 bp, Bos taurus
ccccgaatacaggagccactgcaggcctgatgtgcttcgatactgagggctttgtgggtctctttccacagtctgcctctacatcaacaagcaagccaatrcagggccgtacctggagaggaggaaggtgcagcagctccctgagcacttcgggcctgagcggccgtcagcagtcctgcagcaggctgtgcaagcatgcat

SEQ ID NO: 34187 - DNA, 201 bp, Bos taurus
ggaggtggggatttgactgagccacagtgaggttgactgagtgaagttctaattagaatggaagaaaaatgatggagccatgagtctggccatggggagakgacatcaggttaaaaccatgagaatcaacatgttgtagagtctagccttgtgggtggtggatccgcctggcttcacagggcagagatggggtggactgga

SEQ ID NO: 34188 - DNA, 201 bp, Bos taurus
atgctatttcatacttaatagactacagaataatataaacttagcttttatatgcagtggaaaagcaaaaagactcatatgactagcagacgttggttcaygagttttaaggaaagaagccatctccatgacataaaagtgcaagatgaagcagcaagtgctgatgtagaagctgcagcaagttgtccgaagatctcgtta

SEQ ID NO: 34189 - DNA, 201 bp, Bos taurus
gcaggagggacagcaccgggcctgtaggaagtgacagcatcaggcatacttggaggagggaagcatgtctgaggtttctctgtgacacatctccttgggaytcacaaataaatggggccagaggttaagaatggggcaaggagggaggtggggtagcacaaggatctttgtggaaatatgtatcttgattgtggtggttga

SEQ ID NO: 34190 - DNA, 201 bp, Bos taurus
gaaccagtcacctatcagatcacaatctggtgggaaagatgtaagtgacagtttgtaactggcatctctggctctatgaagggccagatgtgctcatattmcttgtaaaagagacagaaggcaccagtgtctgtcctcagctgccatctggcattttacagttctgggtggggagtctgtctctccaccagtgcttcatcc

SEQ ID NO: 34191 - DNA, 201 bp, Bos taurus
gggtcaggcaagggaccgagtatccccagggaacctgactttcaaggtcagcaggatttgattatagaacttccacaggactggggaaacagagactcttyaaggacacaaacaaaatcttgtaggtaccaggacccaggagaaaggagcaatgaccccgtaagaaactgagccagacttgcctgtgtgtgatagggagtt

SEQ ID NO: 34192 - DNA, 201 bp, Bos taurus
ggacacaccatcagataattctaggcctggaaaggcccctagtgattacctggtgcagtccctcattgcacatttgaggagacattggctctgagaaaccmcgaggctggcagggctctgggcccgctgcttacccatgtgcttggaactgatgttaggcttctctgctgaggctctccaagagtcagctaatggcagtgt

SEQ ID NO: 34193 - DNA, 201 bp, Bos taurus
tagcacagaaatgcatacctgtcaaaatgctgcactgtcacttttaagcctagtttattttcatacatgtgtataaaacagtgcagtgtgatggaaagacrgccagaccagtgaaaggagacttggaacgcagctctgctctgttttctcagccaagtagccttgcaaagcaagtcacatgacctccctaggcttcagtat

SEQ ID NO: 34194 - DNA, 201 bp, Bos taurus
gcctgaggtgctgtgggatttctttttttaagtaagtttattacgtagctccgtttttaaaaactgcagcttcaagatacatcgaaggtcaaacgtgcacraagaatgcaggcctggcctagagtgagctagaaagcagagaagccggcaaagcctcaggttccaccctctctgccccatctcaattcacagcagccccgt

SEQ ID NO: 34195 - DNA, 201 bp, Bos taurus
gctttcacagggcccatctggaacaggtcaaggcaagttgcaactaataattggatcttggaaagaaaaaaggattttgtttctcctctcttaaaagatgrcgtggccacttgataacaaagtgacctttagcaagttgctcaactgtgtaagtcctgttttgttgttttttcaagaggaaatcaggtaaagcttggacaa

SEQ ID NO: 34196 - DNA, 201 bp, Bos taurus
agttgatttactgtgttgtgttagtttcagctccttcagctcctataggtctccttcttcagccctttccccctgggccaggtgcaagttgagttctgagrcgaatagcagcagtttctcctgagggttcctcctgtcctcaaagctgaaaggctggagagggtgagcaacctataggctccaggccatctctgttgattc

SEQ ID NO: 34197 - DNA, 201 bp, Bos taurus
tcagctgtaaaaaggggccgagatttgactccgagtctgtcctcagagcccatggctgtcacctttacctttctcacctatgccagttgcctgcttggccrtgtgcagacggtccacactctctgctcctagatgtctcagcagtaaaatgaccacacaatttctgctctgctcacttcctaagagagcagtggccactgg

SEQ ID NO: 34198 - DNA, 201 bp, Bos taurus
tttggggactggccacccagatagactgtgtctatagccaagtggaggatttgcagggacagaaaagccatcccactttcagtttgctgatgtggcacccraggcaggagtagctccatctgtggcctagaaagttatttcaacacatgtaatttttagaaaatcattaaatgacattttagaataatttttaaccacatg

SEQ ID NO: 34199 - DNA, 201 bp, Bos taurus
gcccctcctgctcacagcagaaatgtctgcaggcctagggcgcagttcctaagctgcggtctctctggacctctttggctgaggcagagagagagcccatyttgacttccacacgtggccccagaaagctggaggcggggaaaggaggctgtaggtgcctctcgtgggaagttgctgtgagtagaaaatgctagcattagg

SEQ ID NO: 34200 - DNA, 201 bp, Bos taurus
attgtggttagtttctccctggttagtttcttctgacaaagttaatcaactatatgtgtacatatatagagagagctccctctgagagctcccttccaccrcgctccctattcttttgtttttaagtgaataataaggctctgtctctactttagaaacttcatgtgtgtgtgtgtgtgtatgtgtgtgtgtgtgtgtatg

SEQ ID NO: 34201 - DNA, 201 bp, Bos taurus
catggatggatgtcagtgtcatgccggccagagagttcacattgggagtacctaagtttactctccggtttatctatttatgtcagatttgttcagccttyatcagctggccactggctttcctcctggccacctgaataaccctcagagctttgctttacctgtttctgagatgcccatctccctgacagcatcattgct

SEQ ID NO: 34202 - DNA, 201 bp, Bos taurus
tttccaacacgattcctttcccactgtgcttatgtgtcgcatgtgtacttgcctctgtgtgagtgaaatggcttggcagcagggaggggagggccagcccrcctctagcctgccgtgggcggcaactccataggttttcactggaactcatgtaaagttttagatactggccactgccagctcagaagataattataataa

SEQ ID NO: 34203 - DNA, 201 bp, Bos taurus
gtttagaggagtatgtaagcaaatgtgttttgaagactactttattgtttttgttcaatgcccaaattgtgtccagctatttgcaacctcaaagactgcarctccccaggcttctctgtcctccaatatcactgggagtttactcaagttcatgtccattgagtcagtgatgccatccaaccatgtcatcctctgttgtcc

SEQ ID NO: 34204 - DNA, 201 bp, Bos taurus
gatattctaattctatgtcccatgtttgtcaaagtttttttcatttttttaatctccttgtgttttatgcttagaatttttaaattttagatttgcttttyacatatatctgacagttaactagtcctctccagttatattcttctgatatttaagcccacgcattaaattttaaatttcagtgactggacctgggttctg

SEQ ID NO: 34205 - DNA, 201 bp, Bos taurus
taatgtgcttgaaatttttaattcatgaagtctgtaaactattatatcacttggaatgggggcagagtttacatggcctgcacagtctcgttgagatgacyggatcaggcagagattagtaagaagggacatgtcagcacaaacaaattttacagaaagtttgagacagaggtgttggccagcctggtaaaagtattaatt

SEQ ID NO: 34206 - DNA, 201 bp, Bos taurus
ctgtatactcttcgagctatttcacatcaaaatgtagctacacatcaaggagcaaagctatagggtagtcattgtagctagaatttatatattacggtcayttttgctctttgctcttttctagcagaagttccagattttctttaatttataactttccctaattaactcaggactttctctaattattatatttagtct

SEQ ID NO: 34207 - DNA, 201 bp, Bos taurus
agcagtgtcatagaacacaacttatatatatatatatatatatatatatatatttaaaatcttattgctatatcttagatcggaacaacaagaaaccacartttggaaaactatgatttacaataggtcaaacaattgagatactgagctataaattttacaaaagatgtgagaaattggaggctgaaaataaggaatcaa

SEQ ID NO: 34208 - DNA, 201 bp, Bos taurus
tcacatcttaggcatgatttttaactctcatagttactaatgtaatgttggcaaaatgatgggagaatggaagcatacatagcatctttataggaggcaaygtcagagaaactggcttaatgactacaggtcttctagcaaaagaaccttctaaaaagaaatggatatcttttactagttagaatttgtgcatttttattg

SEQ ID NO: 34209 - DNA, 201 bp, Bos taurus
atttacaaactgtcagagataatcctcatcaatttttttcctaccctctttctgataaaatttttatataacctattgtcttatcagagaactcaattaaragccccacaaaactgaagttatttttattctcactggcatgagtcaattatttaatttgattggtaccacaagagccagacatttctatcataatatccc

SEQ ID NO: 34210 - DNA, 201 bp, Bos taurus
ctgctgctgggcctgctccaaatagttttgtctcttcacagaaagtgttcagtcctgcttatggcatggcagaagagttgctgacattgtcctcaaaagtscaacttactagcttggcctgggggcaagattggatcaccgagctcctgggggtcatgttaaaagcatttgcaaaaggagattccacttagacatttttaa

SEQ ID NO: 34211 - DNA, 201 bp, Bos taurus
cccgccagatggcccagaggccaggcgtcccaggttggggtactgagtgcgtttcggtgcgcgaagcagccttctgcccagtgaccgctccagaccgctcrgtctgggccaaacgctcctgatctccgtccctctctgccgcaaagagcccagccgctgaggctcctggagccggaacacgaataccacttgctctgaggc

SEQ ID NO: 34212 - DNA, 201 bp, Bos taurus
agggccccaagtaccttaggactgttaggacatccctgggggataagcttataggggaggtcagactcccctctggttaggtgatgggagggagtggaggygatgggaggagctgggcccctggagagagctgtgtgtgtgtgcgtacatgtgagtgtgcatgtgcgtgcatgtgtgtgtgtgtatgtatggaatcatgac

SEQ ID NO: 34213 - DNA, 201 bp, Bos taurus
tttgtgtactttactgtacagtactgtatagagtacagtagaacagtatctttatttcaagcccaggatgtccagaagcaagcacaaaagcagcagtgacrtagctggtacttttcaaggtactgtaccgaaagagtaaaaatgttttctttcttatttgtttgttttttattatttgtgtgaaaagtattatgaacatat

SEQ ID NO: 34214 - DNA, 201 bp, Bos taurus
gagccaaaacaaaaggtatgactttatcatgattgccattaaatattgttttggttcgtggaaaaatttccttcctctttggataaagaccaaccaaaaayccactccatcaagaacctatgtgtatcagtattatctgtattatttaagggcctgctttcaaggatactcttcagggagagcttagagggctattgcaac

SEQ ID NO: 34215 - DNA, 201 bp, Bos taurus
tgcagtaacaaatgtccattttatggccactgtcagactatatattgtacaatgccccaagattatcagcaatctagacgtaaattatcacaaccctaagwccatgaaacacaagacacatatataatctcccttagtccatgtattgaaatgtttgaattgaaagcttgggctatcaattcaggcagaaaatgtcgtttc

SEQ ID NO: 34216 - DNA, 201 bp, Bos taurus
gcatagtattactatatttccatcattgattatattctctctgagcacatggatattgtcagggatcaagagaagaaaggcctcctcctgggaaagacctytccccagcatccacaccctgtgatcattgtccccagagcagccctcaggggtgtggcccaggaaagggttgttactcagagtcaagaaattaagagaact

SEQ ID NO: 34217 - DNA, 201 bp, Bos taurus
gctaattaggtgtgtgaaaggctacttggcatctgctattgactggacccagcaaaagtgatcactaggctggatgatcaataagggatcgataacaagcrtgtgattggattagccatttgatcaatgctgtgtgctaatatattaacaagcaaattacccacagcacttaagagcagaatgctgactctgattgcatta

SEQ ID NO: 34218 - DNA, 201 bp, Bos taurus
attatgaaaactagattcagatagtgtctttgagttctatacaatacataaagtcacaggtattttctagatggcaaagaaagataacaaaaactacaaargatgttgataggctgaatccaggtgatggtattatacccacctatattttaaaagaaaatatcaggaaattgggagttatgcaggtatctataattatac

SEQ ID NO: 34219 - DNA, 201 bp, Bos taurus
aaatggcaatccactccagtattcttgcctggagaattccatgaacagaggagcctggtgggctacactccatggggtcgcaaagagtcagacatggctgrgaaacactacaacactacaacaaaacatgactcctgtcctcaatgaaggcaatatataggaagtcttttgagctaggaatcttccaagggggtccaggac

SEQ ID NO: 34220 - DNA, 201 bp, Bos taurus
attctgggatacagctttaaaggtattctcttctatcaaaatcctatttaaaagtataaagtcaccccctaatcaaaagcaaaaatattttctaaaatacygcctgatttctactgagaatacatttgcttctgtagcatcttaaataaagtggggtgcttttcttaacttataaaactgtgtacatttgctacctccctg

SEQ ID NO: 34221 - DNA, 201 bp, Bos taurus
actaacgctaccttcccaagatcttgcaggccttcaagatcatccataacaccaccatgaaaccctcctttaccaagaagcagctcccttttccccatgayggccttcgccccccagtcaaggtctgcccctcctgctctttgttgtgtagatctgcatagggtcaccctggatgtgtgggaggaaattcctagaagacag

SEQ ID NO: 34222 - DNA, 201 bp, Bos taurus
aagcctttctcaaagagctatgttttattttcatgatatcccatctaggaacaatatctcatctactaatatctgggttcttaaaaatatgttttttcctrtgaaaatccaatccttttttaaaatttttagatggagtcagttatcctattaagactaaaattaaaaaaaatttctactgaggttaccttgtagccagag

SEQ ID NO: 34223 - DNA, 201 bp, Bos taurus
attttgtttataattcatgccgtactaaaactggtaactccttgtttctgatctgcttcagcaaatggtcacagaagcagagctagaagctagtgagcccrtcctcggctgccatctcaaacccagcccccaccacccactcgcctttgcacagccctcttcaaatcctgatgagctgagcccatcaaaagtctccagtgt

SEQ ID NO: 34224 - DNA, 201 bp, Bos taurus
tccaacaagaaatgattgattgctcggggcatgagattctattctattccatcaaagtgacgttcaggtgcagaaagctccacacatgtgacaaacagaartgagaaaggaatgaaatgtgagacaccatcgatctccccatgtggtccttcagccccctggaaaaactgacctccggcgtcgcagaagcccagcagagag

SEQ ID NO: 34225 - DNA, 201 bp, Bos taurus
gtagtatttttcaggaagttaagtagaacatgatacattctttgaccatggtgcagtaaaactagaaggacactagacatttgctggttgactgaaataaygaacaggtaacaaaaaataaaagtacaaaaccaactctggatattttattgtatcaaagagaacatttaaaatacagttacatattatctaggaaatggt

SEQ ID NO: 34226 - DNA, 201 bp, Bos taurus
aagcgcaaagcacgcgtggttctctgaatccactgctgtggtgttctctgcacttccttctgtgcgcactcctgtttgatctccactgctttgaggtggamgtcttcccatttaatttgtgactttgggcttcagctatgtcctggttgctctgagaatgaactttgcatttctgctttctgttctttttgcccttggata

SEQ ID NO: 34227 - DNA, 201 bp, Bos taurus
cagagattagaagagaccaggtactagttctcatcccagaaggttggagactgctccatgttttctgcttctgagttcatcatggcccacttcatgactcycgggaataggcccaagcagaacaattctggggtggtagtttgtttcctctcctgatcaaggtagcagagcagagaggggagatgtaacattagcagctca

SEQ ID NO: 34228 - DNA, 201 bp, Bos taurus
actttcagaaatgacacctgagttcttgtgttttgtaaaaattcctctgaggcttcagtaaatgtatgttgtccaatatggggatagtggaaatagagagraagagacagaaacatgaatgattttgaaagaagaattcacagaattttgtgattactgacttatctaaatctttcatggggatttatttttatttgtgtg

SEQ ID NO: 34229 - DNA, 201 bp, Bos taurus
attttaaaaagcatatttgagtagtcttaatgcagtctattcacttggcttgatgaagtatccaaaccagcacttagtaccagctacatacattccatatygcttttggtcactagaggttatggagagtaacaggcttaatatgaatcacagtgtacttgaggggagtctacttcctaggattttaaagcacttcaatga

SEQ ID NO: 34230 - DNA, 201 bp, Bos taurus
aagaaaagccaaagttctctttaaatctgcaggccagattcaaagtctcagctcaaagcagccaggcaggaggagctcccgcttcttctcgcttattctcrgaagaattggccttttgttttgtttagaccttcaactgattggatgaggtccacccacattagagagagcaatctgctttgatcagtttactgatccaaa

SEQ ID NO: 34231 - DNA, 201 bp, Bos taurus
cattggccttatagaggtcccctgtaatgagaaagggaagaaaaatagactgggaaagaaaagccccagactacagttagctgagagtcttttccaggctratggggagccccatagcaaaggtttcctgtcaagggagaccctggacttatttctattgctgtactctgtcatcagctgggagcagcccaggaagaatat

SEQ ID NO: 34232 - DNA, 201 bp, Bos taurus
acaagagttaagacagagatagtgtgaagaaatgacaacaagcctggtgtagaatctttgcggaatgaatgagatgactgggaggttgatagttgactgcrccagtagaagttctggttggtatagctgatagcaggcttccttggtggctcagatggtaaagaatctgcctgcaatgcaggagacccaggttcaattcct

SEQ ID NO: 34233 - DNA, 201 bp, Bos taurus
cctactttacaacacctttacttcgtttttaatgaacatcatttttgtaggacatttgttcttttataaacttgagatccagcatatatatttctttatcrctaaagatatttgtaaattctataaattaatagaacactgatgcacaatgaaatacatttgaaactttatgtattaccaataatggtaacaatttatttc

SEQ ID NO: 34234 - DNA, 201 bp, Bos taurus
ggcctttgcattggcttttctccttgcctctaacactcgtcccctagaaatcagcagagctcatgccttcgtgtttattgttcagatttcaccttttaaaygaggccttccacaactgccttgtttaattctgggattaaacctttccactcccccactcccataccctattcttctttacactgctctagttttcctttt

SEQ ID NO: 34235 - DNA, 201 bp, Bos taurus
acaagggagtcttgtcagtttatctaagatgacacaaacaccagagagcaaaagcaaggcccctcctccaactgctgagccaaataagcactggggccaarcaattagtgcaacacaaaggcaagcattacaatatcagagccaacctccattgtctccgtgcaccccacaggcttgacaagttttctcatgggccacagc

SEQ ID NO: 34236 - DNA, 201 bp, Bos taurus
actaataaaagtctacttatgttatactctttctgacaacctacagtaaaattaaggcaaatgttatttggaggagtctgcttactggtcacataaccaayattttagttaaatttctatcaactgaactgtaaaaaattaaagatcctagataaaatgtgctcccatgcttcaaatctgaccgattccattacgtgcact

SEQ ID NO: 34237 - DNA, 201 bp, Bos taurus
taacccttctggtgatcattattcccatttcctctgtgctttctatctccagactcagcttctcttctctcctcttcctctacttctttttgcttttcctytagaatctctgttccatggaaagcaaacgatccttaacattaacttttccatccaatactttgttttatctggctggaattaaaccttagtttttatcta

SEQ ID NO: 34238 - DNA, 201 bp, Bos taurus
atgtcaatgtaccagtctttcaaatactttttctaagaacctgtgtatcctcaccttcttctaatttgatgtgcatttctgtataaacacttctaaatagyttacaggccaatccctcagatatctataatggatttgacattctttgaacatgtgtattctcatactattaattagtttgtatatttttgagatgatgat

SEQ ID NO: 34239 - DNA, 201 bp, Bos taurus
tatactaattctcaatggcatcatcagcaagatggctgatagctctgtggttcttgtagcatctattgccggaattctaacaaatcttcaggttttaatayatgttcatatgtttatgtatttcttcaaatggcaattttagaacattaacttgaaatatttaaatataaaagctgataaaggcaacttgactatttcaga

SEQ ID NO: 34240 - DNA, 201 bp, Bos taurus
gtagcttgcaggatgttagttctctgaacctgagtccttggcaatgagagcatggagtcttaaccactggcccaccaaggaattcccaaaatttctttggmggtctactcactctgacctcatttccagctgcctcagaagtgtcctttattctgttcaagatgtttaccttagttataatatccttcccactaaccccag

SEQ ID NO: 34241 - DNA, 201 bp, Bos taurus
atcatcattacgctatcctattctacataccgtggcctttaatagtggatgtcattcaactttccacacaaggtctagggtatgggcctgtgatcacatasagctgtgggctgaacctataggaagaaaggcagtaactgctgctgtgtcattgcttccggccacatttaaactcagttaaaatttgtttcttcacttcga

SEQ ID NO: 34242 - DNA, 201 bp, Bos taurus
cagcgcaaagaacaaatgaatttttattcagtacacaaatatacagattttaggtagctctattactcagtatcatcaaacgaggtcatttaatggaaaaytagaaatgtgcaagtaaaaaaggtagaaaataagttatggttgatgataaccaaaaatgaggcgagatgtaagaggaatgttttagtaaaaggctttgtg

SEQ ID NO: 34243 - DNA, 201 bp, Bos taurus
cagaaagttgagagatttttaagaaaagggttaactgagatgaaattttaaattgtctgctgaataataaaccttttgtagactacagctgacaatacttyctgtagcaaaggaatagggaccgtgtcctgtagttaacgggtagaaatggagtcagagacaaagagcaaaatgtgaggcagagaataattttaaaagcag

SEQ ID NO: 34244 - DNA, 201 bp, Bos taurus
taataggcataggaaagggatggtgttaaacaatctatgatataaagaacagatcccaaaaggcccaaaatgttaacagttgtaacaatgagtccaactaycacccagatattggtttctaataaaaggaaccaagggtccttggaaaaaaggatgattttagatctcgggcaagaaatataattttaacaaacatgccat

SEQ ID NO: 34245 - DNA, 201 bp, Bos taurus
tgaatacaaattttaaattaagtttttctttatgtttaatatgaataataattcgttgcctatggtaaggggctttgtttttcctccttttcctgcctctyttattttggctcctcctcaaaagtgaaagtgaaagtcacttagtcgtgtccgactgtttgtgaccccatggtctatagagtccgagaaggcgatagcagc

SEQ ID NO: 34246 - DNA, 201 bp, Bos taurus
gcttctaccattgttaaggtaagccagtctcttgtggtcaaatctggaatgtgttctcatttcccttgtgctttggcacctgtgtgacatcgcattctctkttttcttctcatcccttcctcagcgataactgcttcttcctacatacacattttcccttcttctccccactggtaagatctggcccttcacctgctctgt

SEQ ID NO: 34247 - DNA, 201 bp, Bos taurus
gagtatggaattaagggaagaaatatcctacaattttagaatcttcagtctattgtaggcagattttcagacacaagcaaaacccatcttttaatgttgcygtatccctgatgggtgttttaaatatttctggtacatttacacattttaaagtttgttttgttttgttttaaagctgtttaatttgtaaacacgccctgg

SEQ ID NO: 34248 - DNA, 201 bp, Bos taurus
ctgtatagagtgataaccagaacatataaatgtctgtgctgtataccaaaagtataacaaacaccatcagcgttgggaaagagggtgacaaccaggatcakattcctcttcccaagaaagccaaacaactccagctggaaagcctgttctctctgctgacttctaatttcaggaactatttgtatacttgaaccatttact

SEQ ID NO: 34249 - DNA, 201 bp, Bos taurus
atcgttatgagattccgagtggcagagcctctggcctgtcaacatttcttgaatactgtagggagggggagcaagttaatgttcttcctctcagcagcccrgccacccccacactctccctcatagcaactcagggaatgcggattccagtgcctgtgacagtgtggccatcctagcccccccatctcttgctccaccggc

SEQ ID NO: 34250 - DNA, 201 bp, Bos taurus
cattaaaagcagacttgcctcctctttagagaatgtaatgatcatctgagacactgaacaagaaacagtctctctgtcatagctattgttttctgttaccrcactctttccggcccaatcctccttctggtaacagatccggctgccttgacctcgaggggtgggcctataactcaggtgagccaaacaataggccttccc

SEQ ID NO: 34251 - DNA, 201 bp, Bos taurus
gctgacactggcactccataatgccagatagcatctccttttgttggtaaatatatatatttatatgtatataaatagtatgtttcatgtataaagttggyggttgaacaaatctaaggattattttctgagtaccattgaatgtcatacccataaaatattttttttttcatttgctttgaattagcataaataatacca

SEQ ID NO: 34252 - DNA, 201 bp, Bos taurus
ccaaggcaaaaaggaggattccaagatgatagtaaagagatgcttcctgctggcttctgtgcaactgacccagtgtcactccagagaggcacataaagccsaatgaataacttcaagataaaatatgtagctgatatatctaaccttctgaaatatgatacttctagatgtaaaatctgtctggtagagcagattaaacaa

SEQ ID NO: 34253 - DNA, 201 bp, Bos taurus
gctttgtccacaagtggttcttcgagctaccctatcaccttgcgtcaggatgtctttttcctgtgatttttttgaaccaaagtaaaacaaaaggctatctygatcaaatagaactgacgagaattatcctaatttttctcctacagtggcataggaaagaagcagggtcatgatgagctcaggaagatgaaaagatataag

SEQ ID NO: 34254 - DNA, 201 bp, Bos taurus
gactgaagtgacttagcagtagcagcagcatgggacaatataaagtgtgccaatctatgcataacaggatctcagaagagaaaaggggactgaaaacaacrgaagaaattatggctgaaaatctcccaaatctaaggaaacagatatccaggtaaaggaagcacagaagctcccctccaaaaaagatgaacccaaacaaac

SEQ ID NO: 34255 - DNA, 201 bp, Bos taurus
taagtgtattggtaattttttcaatttggacaagtacaatcttcagttctgaaaaactttcttggtaaaaaaatattttttatgttcttgaagtgaagtcrcacagtcatgtccgactctttgcaaccccatggactgcagcctaccaggctcctccgtccatgggattctccaggcaagagtactggagtggggtgccat

SEQ ID NO: 34256 - DNA, 201 bp, Bos taurus
ttttcataatttcaaaattatttaaaagttatttaaaaatgttctttactgagcatgaaagaaaatatacatatatatatatatccaattaaatattaaasttcagcatcttaagtcaagattaattatattaattgccactaattaatataatttaatgtagacttattaaatattaattggtgttgttagtttgcttcc

SEQ ID NO: 34257 - DNA, 201 bp, Bos taurus
cagggattaactttttttctttttttttagtttgatcttttatctgctctcttctccctacttgtaatcactagttcttaatcactgtctcgattcccttyagaaactctatttaccagctttgtctgcagctaggacaatcagatctgactctgagcccaagtgtaacttggcccttgtgccacctaaacataagaacac

SEQ ID NO: 34258 - DNA, 201 bp, Bos taurus
gctttactttggaaatcttaacactcaaatatcctataacttcttagactcccacctttctcactttctcacttccactatatgtgctattgaatttgctygagctgtaaaccttctgatttctacttattccttcctttcttagacattatctcatcaaaactctcagctccttggtactatgatcctggagaaatccaa

SEQ ID NO: 34259 - DNA, 201 bp, Bos taurus
tttattttccccctaacctgtctttagggtctgattcctatattttgttcataatctctagcgtcacttgccactaaaagacatcagacattttggatttkttaagttataaaagctcttagcatttcagaaattcacctcatagcattgctcataaaaaggtagattttattaagaaacaaatgaaaatgaagaatgggg

SEQ ID NO: 34260 - DNA, 201 bp, Bos taurus
aacattattaatttgatccctatgcattgtttttgtctctgtctacatcatagcttctgtttcctgaatatttctataccatgtacttttccttaacccaygatatttttcaaatttgtaacagaaactaaatgagatactggggggaaatgagctctaaaaaattttgcacttctcagaaatttctgaccctgagcatgg

SEQ ID NO: 34261 - DNA, 201 bp, Bos taurus
gggatgggattggagagcattgacctctaaacataatcagtatttgtgatttcaattcagttataacactacatggatcactataaaaatttgtataaagytgggaaatctattcccaggagtttcatatatagttactataacaactaccttgagcctaaaggattaaagtaattcaaagtatattaatccctcctgagc

SEQ ID NO: 34262 - DNA, 201 bp, Bos taurus
ttgcctgtgattcaaaggtaaatgattttagggatagaattgggaaaatgcctgaaagaataaaggagagaaagagaactccaaaaatggcactggaagtstcagggagaaaagaattgccactgaggagccctctaggtaagctgtcgttccacatacttttgtgaagatgggcatatctatagggatcggctacctcta

SEQ ID NO: 34263 - DNA, 201 bp, Bos taurus
aagtaacatcatcaatagttaagatttataaaaatagactcacctcctaagaagtatcagcaatacccaaagcatcagtaggcagagaaaagtataaaatraagtgtttacagagatctttcaataactggcaagtaatacagttagggagggcctttgagtacctagtttgcagtgacatttatggttgttagtgctttt

SEQ ID NO: 34264 - DNA, 201 bp, Bos taurus
tttcaggaattttatggacttaagaagctcaaagcaccttgcgtgtatcaactgaagctgtgcctatatgacatcaggaaaaaataaattagcaaataatyggattaatataaaagtgaaaaatactatgttaaaatagaaaccagtcccatatttccccttgactttataatattctgcactactgagggagacttgctc

SEQ ID NO: 34265 - DNA, 201 bp, Bos taurus
gtgtaactacttatccaacctaatcctcatactgtagccagctactaaatattccaaaagatatttgcggggctttgtcacaaatagtaagaattaatttyactgtccctaagatttagtgatctaggaggaattatgattaatggggaaatgaggttaatagtcaactcatggtcttctaaatcttaatactgattgata

SEQ ID NO: 34266 - DNA, 201 bp, Bos taurus
tacagagagtcaattgtttagagctctttgtaatctgaatctattcctatctgtatcattataaatttttttatttgaaatagagttagtgaatagatatrctttgcttgtatggcctctattatctatcaaattaagggccttaaggcacaaaattacaaagtaaaaatgattatttgcagactagcttctccctagaat

SEQ ID NO: 34267 - DNA, 201 bp, Bos taurus
tgattttttcagttgcctagcgtgtggcactttgctacaacggtcctgagtgactaaactcctctggtctgtccgctgtcttagctcaagtggagaaggtraacacgattcttagtaatacagaaggtaaattgtttttaacaactgcatatagatttctttagcaaaaatgtggataacaagccatagcttgaataacat

SEQ ID NO: 34268 - DNA, 201 bp, Bos taurus
atattcttgaaatacaaaacttgaaatctcagatcttagacctggagatctgctttgggctcaactgtatgtaaagagatttttattttgtttgccaattrgaatacctgatctgaatcctagcatgattcttaaaactatatgggtagagtaatgataaagtaaataacagtaatatcaaataatgaaaaataatatatc

SEQ ID NO: 34269 - DNA, 201 bp, Bos taurus
gtcaataaagacaaaattggtggttcctttgtaaatacaaattgaatttcctaatactttaaagaaacactgtccagaagaaaaggaaaatgcagtaaagrggaatttaaacatgattaaccagaccttcaaataacccaattgttcttccctcttttttatacttgggatatgtggtgaatagtaaattaataattgagt

SEQ ID NO: 34270 - DNA, 201 bp, Bos taurus
gcatttaataaggatttcagaatatgtcagattcaaagttggtgtacatgagaatatggaaggagttgaacctacacagcaggatagtaagattgggtggyatgctgggctcaaagggatgagttttgtggagttccagatggaagttattaatataattgtggtacccagaagtatcaacatctcatatttcaaattatg

SEQ ID NO: 34271 - DNA, 201 bp, Bos taurus
tgtgaaatttgccttatctagttttacttgaattaatctgtggcaattttgcattttatggatatatatgtatttaatcaattttgggttgtgttaggtcrttagaataggaaaaacgaatctagaatggcagcagctaaaagacaagtaagggaaaagcctgcaaaaatagaacaaaggaagatccgaggaccagtgtga

SEQ ID NO: 34272 - DNA, 201 bp, Bos taurus
ttgtttcgatgttaatacatctgactgtgattccattttaaaacaatgatagtacacatttaaggactatatcattggtgaagaaggtgaaggagagttcraagtcaaaccatatataatccttcttccagacttctcatcatgtaagataaacatttatatcatataaatatttgaaattatttgaaatttctgtaattc

SEQ ID NO: 34273 - DNA, 201 bp, Bos taurus
ggatgaaattaagaattttcttgttcactattggggaaaatatggatctcatcctcgtagtttctatgatacactaaaggatggggaaagaaaaagcaaamaaacatgagtccttggcaaggttgatatagcaggatatgaaatcaaacactgaagaatctttttaggacactataaaatgttaaacttacaataaacttc

SEQ ID NO: 34274 - DNA, 201 bp, Bos taurus
ttggcaggcactcgtggaagatgatgaagcctgcaagaacagagcatctttccagatttttggaacaactgtccggagatgtcaatggccatcctttcctyattcctgttttggacaggggcgccacagagatacactgaccagtctccccgagtctgtggatgcctcgtgcctcctcttcgtgttcctccaagtctcatg

SEQ ID NO: 34275 - DNA, 201 bp, Bos taurus
gtcggatacgagtgagcaactgaactgactgactgaggttattttgagttaggaaatatctcaagagaagtataaaaaatatgctttgagcaaaattgagytatgagctgggccaaatattggtaataagttgagtgatacaagggcttgagtaacagctggattgtgaaggcttttatgttcttaaaaagaatagtttca

SEQ ID NO: 34276 - DNA, 201 bp, Bos taurus
ctatatgttatccctcaggaaaatttctgattagaattcagtcctatgcacattaatatcaggttgggatgccaagaatggtgactgtcagtgttccagtytctcaaaaaagcaaaatggcataatccactttaaagtagtgacttgcctgttgacttaaatctaagtctcccatgtgtttgcaattgggaatcagttcac

SEQ ID NO: 34277 - DNA, 201 bp, Bos taurus
gaatttttacatgttgttaagaggataacccttatattaacaagtatatactagttagaggttcagcagccatccagactatggaatgaccttaagattgraagcttccttttaaaaacaaactagaaggagcctcgtctgtatataaggaagcaccatttgtacttgtagactaacttcttccagttaggaaaacatttt

SEQ ID NO: 34278 - DNA, 201 bp, Bos taurus
aatactaagatcacattttttctgtaatgcacttctaaactctaaatcctcttagttctcatagacccttatctctgtgcaagataatttacattgagaaygttggccgtaatccatagtagtaaagggagtctctgccatggtttatgcagtacctttgaccttgaagaaatctcaaggatattcctaaaactggaattt

SEQ ID NO: 34279 - DNA, 201 bp, Bos taurus
gaaataatgaacacacatctaggattatggcactggctcttgaactatctgtatcagcatttctacttaagaacaaagaagatggccagaaaagtcaaaaygcaatattgtacactcctggagtcagagagttgggcacctatgctttgtccctgataaagtctaataataaaggttgttgttcactgaatttctatgcaa

SEQ ID NO: 34280 - DNA, 201 bp, Bos taurus
ttccctagtaggataatttgttcattctgtgaagttaatggactactgcagcatttgtaggtattcttctaatatcttaaaaattacatttgccttagctraacacagttcaaaagtacatgctcacaaatgacatcttcaaaatgttttaactttttataaaagtacgtagttactgagaaatgaaaaaaaaaaagccct

SEQ ID NO: 34281 - DNA, 201 bp, Bos taurus
gcactatttaccaaactttgctctaaatgttcagataaggagatatatttgtttatacacagtcagaggaaggtccctaacagattccaggcatctgcatrtaaatacagggttatgcacacaaatagggactggttgatgaaatgtgagtgaaccaggacaaagccttggaactattatggaagcaatgaaagcaacgtt

SEQ ID NO: 34282 - DNA, 201 bp, Bos taurus
tgatggacagggaggcctggcatgctgcaattcatggggttgcaaagaatcagacatgtctgagtgactgaactgaactgatacaaagaacagtatggagkttccttaagcctgggaacctgcggcctaacaggcatgtggccaatatagtgcagagactctgagaggttaaggtgagcccagaggtggagcaagagagaa

SEQ ID NO: 34283 - DNA, 201 bp, Bos taurus
aactcttaaaaacaaggggcttaaaaacccttcttgcatcaccaaaaacactaattctacaaagagaaagcagatgccagtagacacagagttctcagaayagcagggcagagacacagaagtatcagaatagaagggcagagaacagctggaaactactcctagagagcagttttcaaaatatattaaggggaagcacag

SEQ ID NO: 34284 - DNA, 201 bp, Bos taurus
gaatgttcatgattttttttttttttttaatctgatctgagtgcagagaggggagaagaaaagacctttggacaaggcggatgatgatccttattgtagcrttgaatcactgcaatttatggttaaaagtgtgactatgttagatatcatcattgttctcatggctgaaatcaacactgagtaaaattggctagttaccta

SEQ ID NO: 34285 - DNA, 201 bp, Bos taurus
tatattgtaattttctacctagatggccatctctttttgaagacttttctaatcttcttccactctcctctcttcctccttcttcacaagtgcatagacayactggccaggcaggcattcaacgtacatcagctttgctgtatgcacctcatgggattataggttactacaaagtaatggcttttccttatgttcttcaca

SEQ ID NO: 34286 - DNA, 201 bp, Bos taurus
attacagaccctcagggtacctctatatttcccttcaaaacacgtaatttgagcaagtatccacaatttaggacttacatataacaacccctccatcttakaatgcctattaagtctttataccttttcttagtggatcctgtgatttaatcagaaatttttccagtgttcttttcctttgagtgcagtgaaggctgtctt

SEQ ID NO: 34287 - DNA, 201 bp, Bos taurus
ctctgaatcaggcaggggaacagttgacctttcatggagggcaacaagccctggtctctttattcttgacaaaattacgcagcaggccatgttcatgttcytgttccgtgttcagaaatccctggagaaagttctgcttcgacaccctgataagagcagctaacagctcagtcttcactgaggggacagggagccggaccc

SEQ ID NO: 34288 - DNA, 201 bp, Bos taurus
aatacctataaaaagagatgggaccaagtatttatcaaacaaattcagttttatgtgaaaatactttataaaggagtttttattgaattttataaaatackcaacagtgacataaacctgaactcaaatactgaaagataccacagatttacaataccttaattcagaatttgtaattaattatacctaagctagataaaa

SEQ ID NO: 34289 - DNA, 201 bp, Bos taurus
ggtttatactttgtttatctgataaggcctgactttccattgagagaacaaaaactaacagtatattctgtgtcttttttgtagcctccattatcaacttwcttctatgaatggatggcacattgactttttcactaataaaacattacatgtggaaaggcagttcttcaataataacatatgttgtcttgttgtgttgga

SEQ ID NO: 34290 - DNA, 201 bp, Bos taurus
gccaaacccctacctactccagtgaagttacaagcaatgagggaaatacttgtcatgtttcgtctatagacatattttttattgttatggctgaacatggstatctttatacaaatggctttcatatcatttataagtaaaaggagaagcatatgttttttatcatctattagttttagctatttacaaaaactcccactg

SEQ ID NO: 34291 - DNA, 201 bp, Bos taurus
aacatcacattgtcagagaacacaaggaggcttgagaaacagtggatagaatccttgcttatacttttcaaatactgtagttcatttaaaagatctatggratacaggaacgtaagttcaaagctgtgtttgacgctctgtatcaggaacctgaaagtttcacagcagagctatagaacacctgcatagccagcagcctgg

SEQ ID NO: 34292 - DNA, 201 bp, Bos taurus
gtttttctaatttgatacaataatctaaactagtaacactgtgtgtacttggatgatcaacctgagtctgtctccatctgtttgtctgtctcttttgtttycctcttaattttaaactacataatattttgaaattgttatatattcatagcttcaaagtaaagtattacagattagattagttgaccagagaaccacttt

SEQ ID NO: 34293 - DNA, 201 bp, Bos taurus
gctcacgattgagtaccaccttaagcaagctagtgagagagcattgtactccaagttttagcagtgtattgttttgaacttaatttgcatattttgttcartagtgtgactaaacttcatgtgtattatcagtttgttttcttttatggggaattgctcatagtaacatttgctagttttccctaagaagttgttggcaat

SEQ ID NO: 34294 - DNA, 201 bp, Bos taurus
gaaagtttttggcaatataaaataaggaaaataaggcttaagagagaacagctactgatgggaggtataggtaatgtttcctagtaggaaaatatattatyataagaagaaacacttaccataaaacatttcagtggggagcagttggaattatgtccccttccattgtgttgacataatgtgaaaacagccagtcaaatc

SEQ ID NO: 34295 - DNA, 201 bp, Bos taurus
tcatatcatatttcaggggcccttgttggggcagaggggtgggtgggtgagtattcacagagcaggtattggacaaaagacaccaaacaatcccaaccaaratggaccttcctctctcggccttgcaaagtgtctggactggggaagttcttttccaccaaaccatgtttcttggctctcagcttaagacaaagtacaaca

SEQ ID NO: 34296 - DNA, 201 bp, Bos taurus
tggacaataaaattcattattaaatagtaagaaatgagaatatatatgtatatttctatatgtgcactagcaagtatgctcagtcaacttcttgcgacccygtgtactgtaacctgccagtttcctctgtccatggaattttccagctaagaatactaaagtgggttgccgttacctactctagggaatctttccgaccca

SEQ ID NO: 34297 - DNA, 201 bp, Bos taurus
ctatgacaaactcattgttaagcaacttgcctctctcatttcacagaactctcatgtcatgaaaatgtcacgaggacttacaggagaaagagcagactacycgttaaacagtagtgggtggatttggatcagacaagtgaaaaggggccagcagatgaggagatctgggcaaggggtttgtaccaagtgcacaggatagat

SEQ ID NO: 34298 - DNA, 201 bp, Bos taurus
aataatgattcatgtatatctgtgttcctgtactgctgaggtcttctgaacagctcacaattattgggagctatagaaactgtctcccagaaaatagagayacccagagacatttcaggatagtcaagtgttattttcatgagtcaacttaagtttcctttctggaggcatttcctcactttccagggtaacagatcactc

SEQ ID NO: 34299 - DNA, 201 bp, Bos taurus
ttatgaacgctgataatgcagtggctcataaacttatgttatttgctcccttgtttaggttgcagttctgagctctttagttgctatggtgacagtaatamtaaaggctgattggaagaagacatcttatctgggatttttgttgttgagagaggagaccacgctccatgttgccctattagagaagatactgggttacat

SEQ ID NO: 34300 - DNA, 201 bp, Bos taurus
gagagggaactggccataaattgtcagcaaccaacactctctggagcttgaagaataaggaccacagtcttgaaggctggtcagatcggcacatcacaacrtcttttctagttagtctgagattcggactattttcaatgaggtccctttctttttctgagagtgtcttcctggtctggttttgactcaatctcaactttg

SEQ ID NO: 34301 - DNA, 201 bp, Bos taurus
gtatatgctgaaaaaaatgcataatatgatgaaagttgcagtatagatgtgtcaatttggtttcataaacatacactggccatatacacagttatccagtkgttaagatgctgtgtttccactgcagggggcttgggtttgatttctggtccaggaactaagatcccacatactgtgcaatggggccaaaaaacagaagga

SEQ ID NO: 34302 - DNA, 201 bp, Bos taurus
tttatggaaaactgtaacaaattgttagttttaaagatggcctcaaattatttgactcttctcacgctaagacattaagtgaggtcagattccctgaacaytgaatagagcctggccttagaaaattacttgcatactgtagaaagaatgatgcatgattttccaaggctatgtcagaagaagccatgaaaattctgcctc

SEQ ID NO: 34303 - DNA, 201 bp, Bos taurus
gcttaagcttccatcagttcttttactagctttgtctgtttttgacatttttttcttttttgtttatgtaaggtgagatcatgaaattttactcagatttrcatcttttccccccaaatgtattttatgaatctaaccaggtaaccaatctaacagctttcatatcacaagcctccttgagttttttaaacaagtttatct

SEQ ID NO: 34304 - DNA, 201 bp, Bos taurus
ccaaaggagtaatagaaagatactaccttggccagctctgtggctcacaacttagaccctggaggagctataaatggatgattaattacaacaagagtctmggaagggaaagggttccactggaagtcctctctccccctgctgttagaaaatgtccatccaacttactctccaatcactagagatactggtaagtcatgg

SEQ ID NO: 34305 - DNA, 201 bp, Bos taurus
ttctatctaaagctgcttaaaggcatttatggcgctaagtgccctaatggcgttgatgatctctgtggtgtggagtgctctgagataacaggcaggtcacyttcggcaggcctgccagccaacttgggggataatctcctcaaagctcaggataagctcctgggcatcattcagttctctgcttttaggatcttcaagagt

SEQ ID NO: 34306 - DNA, 201 bp, Bos taurus
ttataaaaaacacagtctttagaataatttatgttctttacactgttttttttttctatatgtgactgctgatgtagttaatatcttatttgaattatttragacatgcattctcaatccataaatagtagaattataattgttatcaactagacatttttatattatttttaaaatgagatttttatcttcaaaatacta

SEQ ID NO: 34307 - DNA, 201 bp, Bos taurus
gctgtgtacctacgaaattagtatgttgaagtgttaactcctagtaactcagaatgtgcctatatttagggataagatcttttaaagtaagatgaggtcayggggtgggccctagtacaatatgactggtgtcccataagaaaaggaatttaggacacaggccatgcagactgaaggaagaacaagtgaggaccaggccag

SEQ ID NO: 34308 - DNA, 201 bp, Bos taurus
ctgctaactggctcacagctcacagctgatccttcactgggagttgccctttgcagtcagacaagttccatgtgcagggtcatgagccctcccttggggtrcttgttgacctgtgactgttatatgctgaaagacaaaggtgcatcccttttgcctaaatttttaagatcactcaagttccagagtttcttcaagaatatt

SEQ ID NO: 34309 - DNA, 201 bp, Bos taurus
agggggctggccagcctaagaattgactgggcttgggtatagaatgaccacacaccagctgtggctgggagagcaaaatcgtgtgattacaaaacatgacygcttaactacttccctttcatcaagggctgatgatggaacatggccatatagaagggctgaggcaggacagaacacttcctttgtaactcaattcttgtt

SEQ ID NO: 34310 - DNA, 201 bp, Bos taurus
gagcgaagcagaactacaataaatatcaaaggatatccttcaagcagaaagaaagtgatatcatatagaaacatggatcttcacaaagaaataaaaagcartggaaatgataaatgcatgggcaaatataaaggcttttattctcattaaatatccacaaaagataattccttaaagtaaaaatagtaacagtatgttgtg

SEQ ID NO: 34311 - DNA, 201 bp, Bos taurus
atctgggtgcttgataacttgataattaaatttacaaaaggttggaaatatttgccacagaaagatttaaaatcattcctgaaatcctaatgacagctccygcaatatgtgtatgcctcttgagggcccagtgaggataggtggtattaaaaatataattggttttaaagtacattagattaaatttttttcctatgattc

SEQ ID NO: 34312 - DNA, 201 bp, Bos taurus
attactttaaacactttctccctgaaatacttagaatagtgaagatgttacaagctattgtaacaaataaatttcaaaatttcatgggcccaacatagtcrtcgttcatctaccagtccagtgtgggtgtttctggatagcaagtggcttttcagccttcagatgactactgccctggccaacagcttggctgcaactttg

SEQ ID NO: 34313 - DNA, 201 bp, Bos taurus
ggagagtctggaggcagcgaaaccaccgaggacgtaaatgggaagagattagagtgttagggataagcgtctgaattagagagaggaagaggcgaatgaargagacccttcagaaaatggtggaaggataatgaggaagaaaaaagaaatgagcccaaaatgtctaccagattctgcccctaagagatcaatcaagaaacc

SEQ ID NO: 34314 - DNA, 201 bp, Bos taurus
ccaagaaatccttgattcagaacaaaataaatgatattctgataactagcaactgcactatgaagatggaccatgaaaacatccaaaacagggggcacttktgaggttgtaattctttgtctttgatttagttgggatttaatgtattttcacttattttgtcaaagatacatttgtgttgaagtcaaggaaaaacagtgc

SEQ ID NO: 34315 - DNA, 201 bp, Bos taurus
agtctgactcaggcccttgtgtgtatatatatttttgtgtgtgtgtgttttaataaaaatgtaactgtataaatgaaaagaaaatgggagtaccctttcayctctatgtgtgccctccactcccattactaacaaaaacaatccttttaaaaatatcaaaaaatgctttgtttgcctccaggtctgatgggagatggcaaa

SEQ ID NO: 34316 - DNA, 201 bp, Bos taurus
agggctggaactgacacttgctcagaaaataggcccagagagctcctaacaggagctaagtaagacactaagggcacaagaaaaggaagcaggagcttagrcaagggcccaggcagagcctcagacactgcacacagaccgtctgctcggtgactgtctttgctttacgcagatatcacaatcatcttcacccaaagccat

SEQ ID NO: 34317 - DNA, 201 bp, Bos taurus
aaccccgagtggggcctcagatttgccatttgaattctccctggcagctgcttcgctttgaatttagagagtggtgctttcaactttgtgaatgaaatgtrgggccagcagagtcagaagcccgggcctccttcctgctggcacccagtcttcatggtttcctgtgttagttgccttcgtgagcagcagaaactagaagga

SEQ ID NO: 34318 - DNA, 201 bp, Bos taurus
ccataatgataggaaagaactttgtaaatacattccacatagtattatttttctaattaccaatgtccatttatcttcaggtagatcattcaaggtgtaartgctatgttcaaagaactatgaaacacttaaagctgtgttatgacgcaggagctacctgagtcccctactaaatgatgctgatggacatgctgtagtgcc

SEQ ID NO: 34319 - DNA, 201 bp, Bos taurus
acggtaggaaatttctgagtaaagagaaggctctatataaatccaaccgtggagacagagaatatggacaagcagattagaatgtataaaccacagtattrcaaatatgaagagcagatgatttttaatgtgatagtatgtttgtcagaaagcatcatctttctcttgccagacacttgatctgattgcataaacctgggt

SEQ ID NO: 34320 - DNA, 201 bp, Bos taurus
aaaacacagtatttttcatttacaatccaaaatgttttgaattaaatttcttttgacctagtacataactagtacaaacagaactctttaaggttacaacytacctgtgacctgtaagattaattttcagttctttattgtccttagcatgtctgcaatagtagtagaggtttgttctgggattgattcatatatttgtta

SEQ ID NO: 34321 - DNA, 201 bp, Bos taurus
tggtagcgaactgggtactctgaactcctctaaagagctcaccctaaagtgccgctgaccacagagcaaatgcgctcacaaactcttgagtgcttatattygtgcacgccaaaagaaagagggatcttggcccaagcattgtaacaggcttggagtttacttgtaaaaatcatcaactctctgcttaccacctcctcagcc

SEQ ID NO: 34322 - DNA, 201 bp, Bos taurus
ctgtgtttttccagacttctttcctttcgtcaaccaattccaaattgacaagcagtactctggactgctgacatcccacaaattggtggaattcagaaatrataactttgttatcattttataggacagtgatctcctagttgcttatttttctcccttcaaattacattcatcagctcttacaagaacagatacctctgt

SEQ ID NO: 34323 - DNA, 201 bp, Bos taurus
aaagaaactgatccatcttcattttattatttttgatggcaagttttatgtaagcttggccacttaatctataaaaatgactcttgacccttctgtagaaraaacaggaacaacagcaaaataataacacttattggttactgaaataaatctgaactgcttcctctttttagcttctacactgctgtgaggaaagagtct

SEQ ID NO: 34324 - DNA, 201 bp, Bos taurus
ttatgggaagttcattcaagtgttttaaagttcctagtgtaaatcatggcacatgatccatgttcaataagtgttttttgcttgactgattataaaacccmtggataaaaagattagctacttttatttgggttgtttgttgtcaagatagattgtttccgatttttctcttgtcatgcgtgtcatcagttgttattgaga

SEQ ID NO: 34325 - DNA, 201 bp, Bos taurus
ctttttaagaaagtgcattctgtttttacttaattgtttgaaaatggatctaaattgtatgtccattaacatgctaatatcaaaagtatttttcctgaccrttgtacaatgacacgagttcctcaaatatcatccaatttacctcttgtgagtaatgtctttaactttcataactagagcaggaatatgtattatttagat

SEQ ID NO: 34326 - DNA, 201 bp, Bos taurus
tcgaacctgcacctcctgcattgaatggcaaagtcttaacctctggactgccagggaaatctccagtcaccgtgtttaattagaccctaagtgaaagtgamcttgttagtcgctcagttgtgttccactgtttgcgaccccatggactatatagcctgccaggcttctctgtccatggaattctccaagcaagaataatgg

SEQ ID NO: 34327 - DNA, 201 bp, Bos taurus
cccaccaggctcccccgtccctgggattctccaggcaagaacactggagtgggttgccatttccttctccaaactaaggaatacttgatgtatatattaayggttaccaggccactttctgggcagagctccaaaccaagtggaatagttacgaactgccactcaagctggaggaagctgcagtcagaggtggctcccagt

SEQ ID NO: 34328 - DNA, 201 bp, Bos taurus
ttcaataataaggtacacttttgatggctatcatggtttaaaatgagagagaaatatcttaaaagataacattccatgatgggacaaacatatttatcttstatatcatgactttaagtcaacagatataggagagaaaggtttgtgaaaaatccatggaactaagaataactgggccaatattttcagtctgcatgatat

SEQ ID NO: 34329 - DNA, 201 bp, Bos taurus
actcactccaaacttctggctttgactatttgcagacacgggaagagccagcaagtggctctagaatcctcaatgctttgtcacgactcttcctggcctcygaagaatgtgttggaaactacgtgcaggattttcacagctgcatgcagtcgcttcatttccccagcatttgctagctgtcaactctcttcaaacactgca

SEQ ID NO: 34330 - DNA, 201 bp, Bos taurus
agagaaagacaaatgctagaagaagtaggcctgcccgccctgttggagcagaagggaagtctgcaatgtataaattgggtaattgctggctgaccttgccyatgaacacatgcagcacctcctggggactcacagatcccatggggcatttggcagtcacccaagaagccgtgtgagcagatggagtgagatgggcaagtt

SEQ ID NO: 34331 - DNA, 201 bp, Bos taurus
aatttaaggttacaagggtaattcataaaacccaggggcatgaaggcagccaagcttcagaagggtctatagcaaagacccagaaaaccattgggggcctmtcgatttctccttatttctctaagtactcctgtcccttctctctctctctctctcaggtcatctttatctgggtgatttgcctctgcttgagctttcact

SEQ ID NO: 34332 - DNA, 201 bp, Bos taurus
tggtgagttacctaattttagaagaaatattgttggatggcagataatgcttcagctttttatttatttttttttttttgagatcatttccacttttgaasaaagtagctgtctcctactcgtccacttgcatttcacgtgctaaaacttctttagaggaacactcaagccatgaaagtaatgttataaaatttataaagg

SEQ ID NO: 34333 - DNA, 201 bp, Bos taurus
actgcttgctcttctgggcaaatggctcttctatcagaacagattacttccctgggctaagaggttgcttgcagcttaccagcagttcatttatcaatacytgcttcaggacaatctattatgttacagtttgcccgatctcaaccagattcctgcattggaaaacatttctcctaccacttgaactcagactccaagatg

SEQ ID NO: 34334 - DNA, 201 bp, Bos taurus
actgtgtgtactttgaacatatccaggtggatctaaatgttttctgatactgcatacttgttttcttaagtagaggtgtgtaaaatagggccttctaaccrtagacttgacagctagaaaaatcaagtagaaggacttctctggtggtccagtggctaagactcctgactcctaatacagggggcctgggtttgatccctg

SEQ ID NO: 34335 - DNA, 201 bp, Bos taurus
tcccctccttccctctgactcatggccattgtacctattttgtaaaaaagaaagaaaaaaaaagcctaaataacctctttcttgccccacccaccagtggrcacaaatcatattttcaaaaaagttatagccaactcctctaaatttgctctaatcatcctattattcaaagcctttgttttgtgaatcatttaactctta

SEQ ID NO: 34336 - DNA, 201 bp, Bos taurus
atgggggaaagaaatagtagattctaaagtgcaaaatattttgcctctgggcaaaattctacttttggatgagcatggtgttttcatctgtcaagtcttgyactacctacagacatactatcagcactgaaagtgagaagtcattcttaaagaatcttatactactgagctgtcccatgcttcctagctgcaaaaattatt

SEQ ID NO: 34337 - DNA, 201 bp, Bos taurus
ggcaacctaagagggcccagtgatctgtgcctcctgacactcatgcccccatgtaactccttcccctgatataggctggagctagtgtcttgtctgtaacraacagaatgcaggccaagtgatggaatgacacttctgaaattaggttataaaaagagtgtgacttccatcttggaatctttcactctcagccctcactct

SEQ ID NO: 34338 - DNA, 201 bp, Bos taurus
gaggcctgactccattctcaggcctctgtttaggcttggggtgaggtgggggcaagattgaagtgctacacttgcaccccaaaggttggtggatggctgtytgaatacatacagataggccttaagaaagagctttatgggaatggaaagaaatagagatgtggcagtggcagccctttgcctagaggccacagtagaatt

SEQ ID NO: 34339 - DNA, 201 bp, Bos taurus
tacctaagtcccacactaatctaatctttaactgatccactgagggcttagaagaaattgttgcattttgataatctgcctttctgaatccttgtccacaygccctagatatacccacatgtagatatgtgtttccatttttggagtgactataccctctggtctacatgttacacaaattccatattagaatttctggct

SEQ ID NO: 34340 - DNA, 201 bp, Bos taurus
ccaaggaaaaaagaagagaagaagagtctagaaagaagattcattcatctagtttttccttccaaactcggcaatcaaatggacactcctcctcctaataytatttgggccagtcattcagagtttaacaatatcccaatgtttttcacagtttcacaatctgcagtctcagactctccctaaaagtgcagtttatgaaat

SEQ ID NO: 34341 - DNA, 201 bp, Bos taurus
tctacatggggttagactcaactaccaccagcatcctgcttcaagcctgcgattctcatctttccacattctgcccatggaccctctcctaggaggccagrggtcacttggctctctttctaggtcagctgagaaacaaagacattcaagaggcaaccctcaaccaatgagggacagaagtagtggataaatgccctggcc

SEQ ID NO: 34342 - DNA, 201 bp, Bos taurus
tggatggaggcttagttttggtttcagtcttgtgggataggatgaatttcgggatcttccctgacatttccttgtcattttattcctggttggccttataygtggattgagtatgacagtcatgagtgtgtcacagagttgtgcctacattccttagcatctcattttaggcctatgtcaaggggctgcctggtgcctaat

SEQ ID NO: 34343 - DNA, 201 bp, Bos taurus
aaacatgcatttcttatgaacttctttgatggtgacctctgtgacttcatattttccaagttcataaactttatgagctgtttgatggcatttactctttytaattttatctttcattgtccccttcttaaatcctgtagctatttagtaagtttaagctggtccagtggaaaacatgttattgggtccagattaagtctc

SEQ ID NO: 34344 - DNA, 201 bp, Bos taurus
ggaatttgtgaccaacagtcaaatgttcctcagaggcatttttatcatcttgtagttgtgagacttcttgtaaagggactgaggaaggagccagaaccacrgggcatgatcaggtccgagaagagctgtaaggaagtaataatgactttcacactcatgggcgacctggatttccacgcactatcaaccaagtttgtcact

SEQ ID NO: 34345 - DNA, 201 bp, Bos taurus
gcacaccttgggatgcctggaaatctctgctctgaggataaagcggtcatttccacggtctccgtgctgccttggccgtcggcaccctctgctgaagacayacgtgtcatagaggtgagtggagcacacgtttcttatgcttcccgtgaacctattaatgctgcagaggagaactagacatatagaagcagctgggttcta

SEQ ID NO: 34346 - DNA, 201 bp, Bos taurus
gcttgaggaggatgcagaggtggagaggggagggttagagcttgaagtctcaggcaggccctcccaccctccgcctgaccctacaactcccactcttcttycctccaatacgaagagctccctgggggaagccagctgggggctgttctcctcttttttccctgtaggaactttctaaagtttggggcacctactgtgcag

SEQ ID NO: 34347 - DNA, 201 bp, Bos taurus
tcagaaaataaaaatagaaattagcagagcatcgggccttcaagttgttgctctatgtgaataaggacagtgcttggtggcttgttttcctcattcacaargtgggggagaacgttggttggcctcttcacatcctttccacaccaaaattcaaacaaagaaagcagaacaaaacaatggagtagaaaacaaatttttaaa

SEQ ID NO: 34348 - DNA, 201 bp, Bos taurus
caaagaatttggacaaatggagtggttcttgtcttagcaaaatagaccaatttaaatattaaagaactggtattcttcttctgcaaatcctttcagccatyccaccactgggactttcccactgactatataacctcacagaatacctccatctcctctctaccttcctcttctttgattcaagctccaaaggatactgct

SEQ ID NO: 34349 - DNA, 201 bp, Bos taurus
ccaatgtgttgacgagttttgtggcaaaccaggctgtaatcctttgatatcactgaaaaaaagatttggcttcctgaagaaagaaaataaagatcattttwaagcataacctgtgaacagatttagattcacagaccatgaaagctggaaaggacacagctctgcataacctctcacttctctcagagacagaaatgaggc

SEQ ID NO: 34350 - DNA, 201 bp, Bos taurus
gggtctctgcaattggttcctccctttgaaagcaattttgggtcatttgctctgagtttaggtagagaagttcctgcttagcactgaccaactttactctrtcttaaagacattcaatcagataggccctccattatattggaggaattctaatcagacagaggtcaggaaacaaagcagaaagtaagggatgttggatgg

SEQ ID NO: 34351 - DNA, 201 bp, Bos taurus
caggtgagctgacttcttagcttccatcggttgccaggtgtggtacaactgcattcggatataggaagtgtggagcatgcagccttgtttgtcttcatgayaacagcagcagatggccctactgggaactctcactggccattcaggttggacagctgaacccctgcattcacacaaagagagcaaatgacagagcttagg

SEQ ID NO: 34352 - DNA, 201 bp, Bos taurus
attcctgcaaatcgaaacctctcccctccctgaaccttgtccctttgtctgagtctttttcaaaacagatagattctaggccttcatggtgttaaatagcrctgtaaggaatttcagggggttatctccagcaatctgtcttttaggggttgcagtgcaaaggccaaaacccattactataaagtccttcttggaagacta

SEQ ID NO: 34353 - DNA, 201 bp, Bos taurus
caaatattgaaagatcacagcataagaaaatgaaatattgaaacatgatacttttaatctatgaccatcaatggataccattttgctttaaatcctacaayataatccattttcaagagaaagcatgttttatctgggaagtttcataaagtaacaccctcttccccagcatgcattttagtgtgtcagcaagtcagtgtt

SEQ ID NO: 34354 - DNA, 201 bp, Bos taurus
gatgggtagagaggtgaagattgggaggttggttttgatctgtgaatcctgagaagttgagagaaatttcaagggggtatgtttgatgtaagggtaagttycaacacagatgagatgagggccaaggaggagaatgttcacaaacatgggataagaacaaacagatgattgagaaaatggagaagatggagaagatctgtg

SEQ ID NO: 34355 - DNA, 201 bp, Bos taurus
tgcccaacgtagcataccacttttactctgtgggcacttagcaaatcctcgttgactaattggcaacaattcctggtctacttgtgggaaaacggggaggyaaaacaaattaaccaggccaccgtgcttcctcagtcacccgagggaagagttattagtggctacacacagtcactgaaaatagacatctggtcagaaaaa

SEQ ID NO: 34356 - DNA, 201 bp, Bos taurus
gtaattttaattttggaggatacatcatagtttgatagaatgatattaaagaaaagcatatggtaggaagagtgaagagcacatgcaaaaatatggaaacrtgcaagaaaacgtgcattcagagatgggctacagtaattcaggagggctgcagcatagtgaaggaggtactgagatggggttgaaaaggtaagcaaagcc

SEQ ID NO: 34357 - DNA, 201 bp, Bos taurus
aaaaaaagaaagaaaagaaatgttgctataaaaactgaattttaaccaactcttttagggccaagtatgccaatttaaaactccaagaggcccagacacawggggactctgcacccactcaattcttttttcatgatcctgtacctcatgagatgatcatgaaaaagtgtgaacagggaggatttgagaaaggcccatagg

SEQ ID NO: 34358 - DNA, 201 bp, Bos taurus
tgttttctggcccagggatcttctcactactcaacaagtctaactaatggagggtgagtcgtggcttgggtttaatataaagatgtaggataattagaatrtagttggagcttcaaaagcaaggaaatttcattagagaatgttgatcagaagagtataaaatttactcaatagagaacatttacgtagggtaaaaccaaa

SEQ ID NO: 34359 - DNA, 201 bp, Bos taurus
tttaaagactaaaatagtaaaagccactttctcagggaggaagggagtcctacagcagtgaacaagatcaattttcagacctcaaagcttgtttgttggaytcatacttgttcatcttggattggactgagttcaaattgaggacaagaaacaactttaggggaaaaaaagcaggggggtggggagccttgaaagtatttc

SEQ ID NO: 34360 - DNA, 201 bp, Bos taurus
tccccaatattcatatttctactgacagtctgttaaaggcaatccaagcttttcctgtcttgctcctcaaaatttttccaaacctctgctcaattccaaaytcatgtccatatttttcggtaattgtttcagtaagactcatcttccaggtaccaaaattgtattagttactttttatgctgtaacaaattgccatacatt

SEQ ID NO: 34361 - DNA, 201 bp, Bos taurus
gtttcctatattaatatggaaacttgaaatcagaaaatatacccattatagaaataaatagtacatataaaacaggccttgaagaaacaatgctaactaartaaatgttagaataattcattggctaatacatttgccatatagagcccacttttataacacagcataaactccagagctaactcctactaggataatttt

SEQ ID NO: 34362 - DNA, 201 bp, Bos taurus
aaaatatgataaactttgctgaataagttggttttgactgatttacctgatatttacttccacttaacatggcatcagtggtttctgtttctgtgtatttmctagtttgtgcttagaaagtcaggttcctgatgccatttcactagtaagcagaatgtggattagctagtttttaaaaagatgtgaacatctaacttgaaa

SEQ ID NO: 34363 - DNA, 201 bp, Bos taurus
aaaaatttgaatcattctatatctacttaaaacataaaatatgtaacaaaatattccaaaaaaatccccaaactgtgggcccagatgatttcactagtatkctcaataaaacactaagggaagaaattgtataaattctatgcaaacacattcaggaaggaccataatccaactaattatataaggccagcattactctga

SEQ ID NO: 34364 - DNA, 201 bp, Bos taurus
atacacactgccaggggtctgatttgctggcctcccggtttgtccccatgtcatatgttttttattaaggcaaaaaaaggaatcctgccaccatgggacartgaggagagttcatcattatcctactaagtataatatcttggtattgattggacactttttagagttgtttgcttgcatgcatgctaagtcacttcagtc

SEQ ID NO: 34365 - DNA, 201 bp, Bos taurus
ggaatgttgactcatagaaactcaaaagactggccagagcatagcagcgagacaaaacaagccaaagtcagtgctaactttagagtacatagaaattaagrggagaaggggcgctgtggggccactatgagaggttttgagaccctggtgaaattctgactttgatccaacttctgatcaccaactcagcacccaattcca

SEQ ID NO: 34366 - DNA, 201 bp, Bos taurus
gtcctgggccctatggttggggggggggggcatgtcctgggatggttgtgggctcaggaaataataggcagctggtctgctgataggtgggctgtgtcccygtccagctggctgcttggcctggcacattcccaaactgctgctgactggctggtgggcagggccagaacctggtgctaataagctagaaggaggattcca

SEQ ID NO: 34367 - DNA, 201 bp, Bos taurus
atgatagggagcaactttggggcttctgcagtcttagaattttctgaaaggtcatatatctttggatttgctttgctctttattctatacattaatataartttgcttttcttttaatttgagcattaataacctctagttgaaatatttctagatgattgtttactcaatttccatccaaaaaagaaataatatgtaatc

SEQ ID NO: 34368 - DNA, 201 bp, Bos taurus
attatatatttgatttttgtttattttaaagtaaatattgaattttagaatagtttcagattcatataaaagcttcaaagataagacagagagttcccatrtaccctgtactcagcttcctcctttaatatcttgcttcactgtggtacatttgtcagaacttgaaagtaaatgtttgttgttgttgttcagtcactcagt

SEQ ID NO: 34369 - DNA, 201 bp, Bos taurus
gctctctctctcacattaaaattctaagaaattttctacatctttcacggttacatcagaaacacaacctcacatacacttgtggggagagtttgagtaarcacctaccatgccccaaagtttccccttccactgtatgtgtacaaacctggatcataatgtgctaagcagttttgcaggtctcttaacagtgaaccatct

SEQ ID NO: 34370 - DNA, 201 bp, Bos taurus
atatttatctttccaaaaattatgggaataaaacttttaatttttttcatatgtcttgagcaaaagaggagtgagatgtacaaagctagccaataccaagyaagtgaaacacaccaaaaggaactgtcagtatatattaagttattgcctatagaatctggaactgcatcaccttaggtcaaacaatgaacaaggagggag

SEQ ID NO: 34371 - DNA, 201 bp, Bos taurus
aatctcttttaacagtgatttccctttaatatctattcacattgtttctctcttttgagtgtcaaagatgagcgcttgcataatgcatggggactttgacmggcacaacatcaattatttcttacactgatttggtagctaaacaataaaagtgaaatgtaccctttagatgaaaatttgccctgaattttttgtggacag

SEQ ID NO: 34372 - DNA, 201 bp, Bos taurus
tacccctttctctatggccctttttaagattattattattactattaataatagtattactattagtattactattgctgtctcctttcttcctgtgtccrtgaactataggccagggaaagacttgagttagtaagacttttagtttctagtcttgactatgttattaatcagtcatgtaagcttaatatatagaattat

SEQ ID NO: 34373 - DNA, 201 bp, Bos taurus
atactctgagaagctggatccttgttaatgtagcttgccttctgagagcatataatgctttgttaggtactagtctccactaatttggagaccaaaactcyataaacagaaagttggcagtaggctttatagtaaaatatggatattgattatccagtctcaaacccagggattgtgttctgtgatgagttgaaggtgtac

SEQ ID NO: 34374 - DNA, 201 bp, Bos taurus
cacatagccattataaacatacacacacctgacaacagagacctgaagtgtatgaaacaaaaattggaagaattaaagggagaaatagttctacagtaatrgttgagtgttttccatgccctgctttctataatggactgaacaactaaacagaagacaataaagaaattaaggatttggccagcactgtaaataaactaa

SEQ ID NO: 34375 - DNA, 201 bp, Bos taurus
tcaggctatagaaagaattgatggagacatttttagataatattacttcatttaaaaaaatgtgtgtggataatgtgtatatttgtatatcatgttacttyggtttataccagatccagctaccctcttcagaagtttctaggtagaagagtaaagaatttagaattaaaaataaaagacttgagttggggtccttgcctg

SEQ ID NO: 34376 - DNA, 201 bp, Bos taurus
gttatccagctgtggcagagaaatggggccttgattttgactttgttaattaaacacagagaagagaaaagagaatttgctccaagagattttagatagtmcttggaatttgagctaaattttgaaagataaaatcacccaagtgccagcttccgtttttccatatgtaatttccagagccaaattagtgtttggaacact

SEQ ID NO: 34377 - DNA, 201 bp, Bos taurus
tctggaggttttagtattgccaacgagtagaaaatgtttccatagaatttcattaactaagtagagtcagagtgactcaagacatgtctggagtttagacktctttgatggaaacttcgtaggctgcgttttcctctttccccactctgactttacaagccagagcccacatacttggaaacagtaactgggcgattacta

SEQ ID NO: 34378 - DNA, 201 bp, Bos taurus
gggacatgtccgcattcatgatacccaccaggagcatattctaggcctgcatcttgctctctgcaaagggctaggccccctcatcatctttgagcctgtgrttctgtcctagctccctattccagaatctatgggctctttccctgcttggcttcgtaccctagtcttggaggagaactttctccagggccacttctgagc

SEQ ID NO: 34379 - DNA, 201 bp, Bos taurus
cttttagttaatcctttttttctttccttttaaagaagaattttatttttttcttgaaacactgtatgcttctaatgtgtttagatgtggatttatttctrtcgtttctacattttacatggtgtgctttcaatatcagaactcatatctttttatctagtagttaccacatcaatagccctttagtcagtaatcctgatt

SEQ ID NO: 34380 - DNA, 201 bp, Bos taurus
caggactctgctttccgaagttttcatcacctccaacactgacagctttaaatccactattatacaacaactgtaaaagtaactctaaaccctccagttaygggtgaccctaaggaccctgattcgattacgcatgaatgagattggtagttcgagagaagaatggcattatgtcctccatctctttaggaaaatctgtca

SEQ ID NO: 34381 - DNA, 201 bp, Bos taurus
tgtctttaatgtcaaatggaattcagtcataaatctctcagttcccctcattcccatcagtactgctctcttccaaggccatcattacatttaaaatgtcyctgaatctcttctgctcctgctaacagacacacaagtagacacatgttatatggcaaacaaggctggagccaggatctgatccacatccatctggcccaa

SEQ ID NO: 34382 - DNA, 201 bp, Bos taurus
cacacccaggttctccatgttggccaagtgaataaattgcccatgttgctggtttacaattagtttattcatgaatattaagtattgcctctaattgtttygttcctaccaatcctgaaccaggcctatggtgagctgccacagcacccagacagctctgggtagcatctggtagcaagaaaaacaagggctgaggaaaca

SEQ ID NO: 34383 - DNA, 201 bp, Bos taurus
ccatcttggggagaaggaagagttgttaaagcatcatctagactcgtagctctctgggcatggtttcattgctgtgtctgaaattgtatattatttgtttyttttcattttttttttacaagtttcttatatcactgtctcttgagatatcagtttttgatacttatttccttttatttcctcacatatgtactacctctt

SEQ ID NO: 34384 - DNA, 201 bp, Bos taurus
caaaagaattatatgctatcagaacactgagttattatatatatgtgttcatcaaagaaaaatcattaatattcagaattatagtgtttaatgaatatacrgtatcacatcttatgtatatttcaaaaacaaaaactgaaatctgtaactatgatgctttctttcccaatgacccaaagagtttcagttttattatatgtg

SEQ ID NO: 34385 - DNA, 201 bp, Bos taurus
catgtcactcctgggccctccatgatatccacataatagtttggtgtatattcgtgtaaatttttatatgaccattctcaatctcacccttaatcatctayctatccatcagtctgtccatccatgtatcatttatctcttaaaagactgtgatctcactatcttgtaatgagacttgtttttttcttggagcttttaaat

SEQ ID NO: 34386 - DNA, 201 bp, Bos taurus
acacatcttcactcctgacttttgtcactccaaggggcatgaccgtgtttgacctagagtgttatcaaggtcaccctcgttcctttcttcacatttcccarcgtgggtccttcaggtagcctacgtatctcttccctgtgttcatctattgctttgtttttcaagtcttttttagaggaggaaggtcttctcttaaaatgt

SEQ ID NO: 34387 - DNA, 201 bp, Bos taurus
aaggctacccactccagtattctggcctggagaattccgtggactgtatagtccatggggtcgcaaagagttgtacatgactgagcaactttcacttttaytttcttacatattgtggcccataggcattagtttctgcaaaacagtcaataacatgttaaaacttagttcagaaatcacatcctttgttaccatcctctc

SEQ ID NO: 34388 - DNA, 201 bp, Bos taurus
ttagtctccttcaaaagtctgttgtgttgtatttgcctccacttcatcttccttcaatccatttgtcatagtgtagcttcagtggccttcccatataaackaatcatgtcaagtctgtctgcctcatgcctaagagattccaacggcttcagattgccttcaggataaagcccaaactccttaatgtggccctcaagactt

SEQ ID NO: 34389 - DNA, 201 bp, Bos taurus
ttaccttcgcttttagaggtggttggtcctatttaagacacaaggtacttagaaagccttgctcagacacacatgtcccacccactgagtcattcaacatkcttctcaggtcttggtcttgatttccagttctggtaattgggcttatggctattttagacatcaagctgtcccattcctccaggaagcaagactgatttg

SEQ ID NO: 34390 - DNA, 201 bp, Bos taurus
ctctgcactgaggtgcgcaggcctcccattatggtggcccctcggggcaaggagcatgggcttagggctcgtggacttcagtagctgtggctcccaggcaycgttgttttggcacacaggcccagatgctctgaggcacacgggatcctctcagacccaggatggaaaccccatcctctgcactggcaggcggactttcta

SEQ ID NO: 34391 - DNA, 201 bp, Bos taurus
gttgcttcttctaacctagggttgtggtcaagagcacgaattctggaggtgcattattcaagttcatatgccaaaatttcacttgcaagctttgagacctkggtcactttaccggtcctctgtgcctctgggtcctcatctgtaaaacagggaaagaaacagtgctaatctctcagggttgcttcaaggattaaatgattt

SEQ ID NO: 34392 - DNA, 201 bp, Bos taurus
gtgagttgagggagaacggcctttggtcaaatctgcatccatgagactgacatgtgaacccagaggagcttctagagaccacaagagacacagaaacagtraaatggcccccaggatgtctgtcggcaggaagcaggcaccttcacaaggcaggatccagatcctggacagggctgactccaaattccagagagaacagat

SEQ ID NO: 34393 - DNA, 201 bp, Bos taurus
tcaaatagatcaaaaactttctgtttaggcgtggattccctaaaaaggggcagatctagggaaaagattatttgcaagctgctccactgatgagcggggtsggggagggggtcatgcatggagaaagggagggaaattcccagctctggaggagaaagaagggaatacccacaaaaattagaggtactttggcatgaattt

SEQ ID NO: 34394 - DNA, 201 bp, Bos taurus
gctgggcctcagtttccaattctgtaatatggaaatcattacccctcatgtgattgcttggagaaataaagagcttccaatgaatgaataaagtacctggyacagtttatggccagtgcagaggaccaaacagatgacagataaaacataatgaaagacttaagatatcataatcttgttgtaatgaaactgtgcaatgag

SEQ ID NO: 34395 - DNA, 201 bp, Bos taurus
gttatgcttcctttgaggcaacaagtacagggcagtgaggtaaaaaaaaaaaaaaaaagaataactaacagctttcaagaaaacaatctaaaataagcacstgtgtagtgattataaaaatatacagatttcctttccttctactggtaatgtcaaagcccacacaatttgtgatgtgtctgcatgtgatgctcatctagc

SEQ ID NO: 34396 - DNA, 201 bp, Bos taurus
gatgctcataaatttagatgcagtgagataaacatgaaaggaatgattaatggaataattttcagtgccttccttgattacatgatttaccaaggagaagmaactcataaaaacactgtgtaaaagagaaataggccatgcaaacaactcacccaaatatttctataaccttgaagaatgaatgtaaaattaggtagatat

SEQ ID NO: 34397 - DNA, 201 bp, Bos taurus
ttgctgctttttcagtttttagggaaacattcttaatgaattttatagaactctgataaaagggttttttaaatactctcaagttttaaactgcttcattmtatacaagaagtctgagggtagctgtagcgtttcatatgctttctgagagaaatagactgttttcttggctactggaaatgtttcttatgaaatgaaacc

SEQ ID NO: 34398 - DNA, 201 bp, Bos taurus
acatggccagtgggagaggctaaagaggagtgaaacctgccagtcttgttttagcaaacaaggactcaccagagggaagggcctgaaacaaagcaggcaargaggaagccctggagggcatggtgattttatgcctacagccacttttcacctggggtcacttaccaattctgggcatatctagaggttgagaatccaggc

SEQ ID NO: 34399 - DNA, 201 bp, Bos taurus
tggtgaaatctactaatctttttaattttggaagtttagattattaaaaattaaaattatttgaaatggtttatgaatattagtactaggatattaaaatkgttatatttgtataaatcaagataaatgctccaagcaaaggaaaagcaattactaaattcttaaactgttcttcttacatctaaattctaaaaccaagct

SEQ ID NO: 34400 - DNA, 201 bp, Bos taurus
gaccagctgagccacaaggaaagccccagaaagtgagtgattaaggactaaatggaaagaaaaaacacaaaagatgctgaaacaatgcaattgagtggtayaagagtaagaaggggtggtacacaatgaaaggaccctgatgacataagcactgagccctcagctggtactaatagttagctggaagtcacctacaattga

SEQ ID NO: 34401 - DNA, 201 bp, Bos taurus
gactcgggaatcgagaagggtatggctgagtggttctggctcagagtctctgatggagttgcagtcaaggcagtcaactgaggccaccatcatttgaagcygggactgacaccacttctaaaatggcttacttatacagcagttgactggaggcctcaggtcctcacccttgaaactctcctcaaaccatgaaactggctt

SEQ ID NO: 34402 - DNA, 201 bp, Bos taurus
agaaattagtaggaagggagaaagaagctaataatgagaccgaaggtaaaaaaaaaacctatggaagatgtgtccgaaatatgaactcttggggaaaatgmaatttatcaatttgttgcatttttaaaaatgttctggatttggaagtcaacagaggagatccaggcactgagttatatgatcaaatgccttagatctcct

SEQ ID NO: 34403 - DNA, 201 bp, Bos taurus
aggcatgtgggatcttaacttctgaccagggatcgaacccacacccatacattgaaaagcaaagtcttaaccactggactgccaggggagtcccaattgtrtgatgtaatgtcgattataatctggctggtcatctttggttgaggaatggtgcagacataaacaaatacaagtgaacttcggtggatgactaaagcatgg

SEQ ID NO: 34404 - DNA, 201 bp, Bos taurus
gaggctcagagaaataaattttccaatatcacacaggtagcaagtatctgagctaagtttatccaaggtctaccttgttctaatgttgctgaagctgaagytccaatactttggccacatgatatgaagagctgactcattggaaaagaccctgattctgggaaagattgaaggcaggaggagaaggggacagcaaaggat

SEQ ID NO: 34405 - DNA, 201 bp, Bos taurus
gaacattacagaatgaaatcttaattgtctggctccctacataaccttatcaaaatgtacacagtaagtcgctggcttaactttttgctccttagagtcargttatctaacatcatcttataatatttaaatcgtatttcacatctaatgagagaatgcagacacatatactaacatttagaatcaacgtatccttttctc

SEQ ID NO: 34406 - DNA, 201 bp, Bos taurus
tgtgaaacatcaagtacatctaatggaccaattaaagtgataaaccatcacagcctgttcactgttatatccaaataagccattctaagaacaagtacagytaattgcaaatgaaaattccccctaaattctggatgtcagaaagactggggcagctatcagctcagctcatgaaaaggccatgagaaatccccaaaagta

SEQ ID NO: 34407 - DNA, 201 bp, Bos taurus
tatttgaatgaattctttaaagcatgttagtattacaacattaagctaacatttattggttattaacagtggcccaggtattatactagacacagtacttrggttcaaatataaataggaaagttcctgctctgttgatggtctttatcaaatacagttgaaatggctacttggggcttccccggtggctcagtgggtaaa

SEQ ID NO: 34408 - DNA, 201 bp, Bos taurus
aaggattcaggtaaggcttggcaaggtcacacagctgggctatgatgtgtctaggatgccaatccacggactccttttccagagggcctgccattattgcyagggggctgagcaccctcccgagtgtccttgacttgctggcacaccatctctttgcttcaggccaccttgcacggacccctgcatgagccaacttactgc

SEQ ID NO: 34409 - DNA, 201 bp, Bos taurus
ctggtgggtaacagaagtgaaggaaacggagaggtagggcgccgcgatctcgagccctcttccttgctcccaagccctggtcaagcctatcctgtttaagyagcacgaaaactaaactgtgctcactcttagcggtaacctcggctgggcgaacccctctgatgctgagtttactggtccggacgttactttacagaaaac

SEQ ID NO: 34410 - DNA, 201 bp, Bos taurus
tcctttgaatgtagtgactcattattttagagtctggatgtttaatgtgttatttgatcctaaatacagatgaagcacataatttcaagcattggcctagraacaccagtgaacctgactacagacttcataagggctcctgatttgtgatctatgacggaggactttgtgactcagagagcattatcagccgtttcactg

SEQ ID NO: 34411 - DNA, 201 bp, Bos taurus
tcagtgttcttgcctgggaaatcccatggacagaggagcctgctgggctagtccacagggccccaaaggaatcaaacactacttagggactaaaccacaaycctacatttaggaaaaaattgtaacaacttaccttctgtgttgttatcatcagaaaaggtaatacaaagttcatcagacttttcagttgtaacagcccat

SEQ ID NO: 34412 - DNA, 201 bp, Bos taurus
ggcctccatgccaaagcactcactaattctgtgtgatgagtgaggctggcagcagccgtgtgttccccagggacctataccaaggtgcaaacatattgagrtgggatgattgctggagcaggcctgcttttccagcccctcggttcatgaggggaatccaaggcagcctgccccgtgagcattgctaattatgttggcttc

SEQ ID NO: 34413 - DNA, 201 bp, Bos taurus
aaggaaatgttttaatcctgaatctgatcatttcatgcgactcctttctttaccctataattccaccagactttttagcatctgtggtaaatcgttctttkcctctcagatccattctctccttcttcctggatacacatgtcacacctgaaccccagttggagtccatatttcctagcttgcttgtgaccttgtgatcaa

SEQ ID NO: 34414 - DNA, 201 bp, Bos taurus
ttccatggagagagggacataggctgacagcagccaggcccaaggggggctgcattgggcgcagaaggggagccaggcctctgcctgcacggacaagatcyacttcatccccaaaaggtttttggctccagtatggaggcaatgcttggagtgtgtcctggcctgaggtcctctttcacagtctgggacgcgcgcgtcctc

SEQ ID NO: 34415 - DNA, 201 bp, Bos taurus
tattcagggacgggtccatgtgaactgggaaagcgtgtacaaaattaaatcattttctctgtgggcacgtgttcaacttctggccacctccgatgcttccraagttagcgattcatttccttgattctgccagcttgtcgctgtcagcatagggcccctctgtacatggtagagtatcctcaaccacagatttactgctac

SEQ ID NO: 34416 - DNA, 201 bp, Bos taurus
caggaatgttagaaatctcatcttttcccaaatttctcaattttcacaactctgaacttaacaaaatctattattttggcctttagtttattatttctggrttatattcaaggccctctgatactgttgccagccgccctttccaacctgtattatctctcttactcagcatggatcttccactccgtttagccatctgta

SEQ ID NO: 34417 - DNA, 201 bp, Bos taurus
gccttgttcttttcttcatttcactcatgataaatgtcagttggtccaaccagacctgcaagcgtccacagtctggccgtgggaaccattcttctgtagcrtaactcaaccaagaatttgcacagtttcctgtgcagtgatgggaaccccacgatgggtaccaggatgttactagctttccacggcccattctggagacct

SEQ ID NO: 34418 - DNA, 201 bp, Bos taurus
tcttaaacacacttgtggttctaggagtcactcagtcgtgtccaactctttgtgaccccaaggacagcagcccaccaggctcctctgcccatgggattctycaggcaagaatgctggctatagaacacacagaatacttattaggcagatgtgagcagacacaggttatgtgattctgcttaatgagagcactaatatttc

SEQ ID NO: 34419 - DNA, 201 bp, Bos taurus
tcatgggcaactcttgtgatttctggtcagatagaacagatgtcacaggaaagctcccagagaggttctgggaaggagtaaggtggaaaagagggcttccygtgtgattcagacagtaaagaaactgcctgcaatgcaggagacctgggttcgatacctgggatgggaagatcctctggagaagggaagggctacccactc

SEQ ID NO: 34420 - DNA, 201 bp, Bos taurus
actcaaattcacttcagctgatgggttgccttagaaatccatttcaactaaatacactaaaataagaattagttgaactcttagggaggaaaagatgtgargttctttcctgtttttaccttgtcaatttgatcaaatttgtaccaaccatataaacaaataactcaaactcagaattcaatattaaagacttgggtggct

SEQ ID NO: 34421 - DNA, 201 bp, Bos taurus
ctatgctttatattctttcttatatgcttatgacacataattcctatcctcttatctgagtttttgttaaatatttagacttatttgtctcaccaacttcytcagttcaacccccacatttaaacaaggcatggtggtagagtacaagaacatgggctttggattgcctggtttcagatcttggtaagcagccgtaaactt

SEQ ID NO: 34422 - DNA, 201 bp, Bos taurus
atgtgagaaccttaagtgcctcccagtgcccactgttactttgaacactgtgcatacttaagaggagaacattttgccaaggcctatctgtagtgctacamattataacagcctgccccctttccggataagagcattctctacaatgttgtgagttcaagaacgactgcgtgtttgcacgcatacttgaattatgggagg

SEQ ID NO: 34423 - DNA, 201 bp, Bos taurus
aactgaaggtcgcacattttggccaacagtctgtatctgaagcagttcactgatggagagagagatttatttttcagtttcaagtttatgacatgaagtayttgtttcatagacagtatttacctggttcttttttttttcctgtctttaattcttggatcccagataccaagaacaaagtgaataacacagttaaatcag

SEQ ID NO: 34424 - DNA, 201 bp, Bos taurus
ttttaattgaggaaaaaatatatatcatacacatacacactactcccttccctacactcctcccttcatctcccctccatcaaaaaaaacccaaaaaacawaaaaccccccaaaaaacccaacccataaaaaaaccccaaacaaatgaaaaacccaagcctctgctgtttagaagtctataagaactgctggttaaaggtc

SEQ ID NO: 34425 - DNA, 201 bp, Bos taurus
acttcatgtgagcaactgctagaagttatttgcaatccccattcctaaaatgcatcattaggaggaaagtaaagaatctagagatacccaacgtaatacasattactctaatatttttaaatgcaactagagtggtgtggagtacactgaatttttaaaattataatagatataatttgcacataaataattatttaattg

SEQ ID NO: 34426 - DNA, 201 bp, Bos taurus
aagaactcccttggtttgtagttggccacatttcccttgaatcatcatatggaaaacagagagagagctctagtatctttcttctaacaagatcactaatyccatcatggggcccaacttcatgacttcatctaaacttaattacctcccttccaaaggccatactctaaataccatcagattgagggttagagcttcaac

SEQ ID NO: 34427 - DNA, 201 bp, Bos taurus
ctatgctctatccttaacaaaacacattttaaaaagcagtcatgtaattcataggccaagcaaaatgtctctatccctacggtagttaatatagtagttayaggtgtatctgcctccttatgctaaaatagctactaaaaagtccataaagggattcctgaaacttaacttcagcaccatttgcacaactgcttcactaag

SEQ ID NO: 34428 - DNA, 201 bp, Bos taurus
aaagggaaaaaaccctcagaaagtgtatgctgccatagtttaccatcctggttggcataaatagagaggaaatggagtcctgacatctttttcaggttacrtggtatccctttctacatttccatatttttcctctagtcaaatgtttttcttgaaatactttattatttttttttaacgtagagatagaaggaatctttt

SEQ ID NO: 34429 - DNA, 201 bp, Bos taurus
tttttaaaaaacttattgagcaatttaaacctctgttaaatcagtttttgctccctccattttgaagctcaactatggtagttcacatttaagatcattaygccttcttagtgaattgatccatttatcatgatttatttttggtaatattgcttatcttgaaaccttcttttgatattaatatagctattccatctttct

SEQ ID NO: 34430 - DNA, 201 bp, Bos taurus
tcactgctgagtttttatcttcatgggagttgggttggcctcaaagtgtccgaatgtggcttggcattatagattttctctgaaaaatgcattccaaaatmtttctgatagatgtggcctgtgttcagttctacaggtaaaaacctagctgggaaagaaaattaatattttctgcagcattttcaagcagtgctctttact

SEQ ID NO: 34431 - DNA, 201 bp, Bos taurus
acagcagatttcataacctccgctgggagtggtgggcattccccaccgctggagggcttggtcccttttatccagaaaaatgacaggcgagggggcctgakacaagggcatggacgtggggagaactgggctggagctctgccaggcccctgctaacctgaacagagtgcctttgtgtcctccaccgtgtgggaatagaag

SEQ ID NO: 34432 - DNA, 201 bp, Bos taurus
cactccttgaagccagtgcctgacagttaaggagagagaaggtacttgtcggtctgtgctcctgtggctgcactttctggaagatgttcctgctcgtcctyattcgctccctcccatgtagaagcagcgggaaattcctaaagcataggagaagtgttaaatccaaaatgtggtacatcctggaaacactgttcctctggt

SEQ ID NO: 34433 - DNA, 201 bp, Bos taurus
gagatgtttgtccaggtgcaagcgctggtcccaggccccaggtttcaggtcccagcctatgtccgtgagggtggtagcctgaggtagaaggagtgaagaaygggtgggtttttccaggctctaaggcattcattctctacctgacgcctgtgggcacagtggaaggggcaagccagctctcagtctgctgaggcgggtgga

SEQ ID NO: 34434 - DNA, 201 bp, Bos taurus
aaggtgcagaataaacagaggcctcctttgcagtgatttcttagccagtccagtggataacctgtcccagtgaactagagtccttaaggactgagctaccygtgttaaacctaaaggtggccttaactgcaaaggatctgaggttaagagtcacaaagcggaacttttttttccccctctttagattttgacattaggtat

SEQ ID NO: 34435 - DNA, 201 bp, Bos taurus
aaacttcaatttactaaaggtactctcactccctgatgatataatggctttgtttttattgaatgctatatgtgccaggttctgctataaaaactttattycagttaactcacttaattctcaaaggttatgcagtttaaatgctactattatcccagttttactgatgaggacactaaggccagaacattcaaatgactt

SEQ ID NO: 34436 - DNA, 201 bp, Bos taurus
tgtgaggtgactgaggctcttgcagaggcaagtcctcaagcaaattggcactgcaaaatcctttagtatctgttttgaggggcaggcctgccagtggggcrtatgaggtagaaccagcgctgtacttgtgattctggaggggtgccgggggagagctgggggtggccatggggtggaggggagccaggagctctgacagca

SEQ ID NO: 34437 - DNA, 201 bp, Bos taurus
aaagttatctttaaggcctttatcttaaactctgaattgcttaaaaaaccaaaggagaaaacataagtctaccagggattagaaagtgagaggctgatgckgctagacttcttgaggcccaggacagccctgcttccgagcctggacatgcccccctagaccagcccactgggacagagtgggatgttggttcccagaaga

SEQ ID NO: 34438 - DNA, 201 bp, Bos taurus
ggtgtatttaggtaatggggttatttaaaaccttaatagttctttattcctgttaattgtgagaagaagaggtgctcaagaaccataggccctgaagtttkaattctttagtaataattaaagagatttaaaaaatctgcttcccataaatgaatatgattctggcctgcttctgatgtctttccaggaaaaattcagttg

SEQ ID NO: 34439 - DNA, 201 bp, Bos taurus
atatttcatgtgggtttgtctagcctcctcatttccactgtggtttccctgagtgcagagaattgccagagttaagggctcttgtaggtctctcagcctcytctgagttctaactattctgtgacttttgctgactatgaaaccatctgtcagagtaagtttgctggttactccttctgagtttgtggataccagacacta

SEQ ID NO: 34440 - DNA, 201 bp, Bos taurus
attatgctgttgcctatccctttgccctttactgagattgccaatcaaaagcattcctttctcatgccttcaattcccttgacgtgcttgctttgtcatarctgtcaagccccatccctggttaatctaagtctctacctattttctagcagtccccatgcagagaccttggctggaaaaaaacacatccttcattccttg

SEQ ID NO: 34441 - DNA, 201 bp, Bos taurus
gttgttcaggagatgtcgtgaaagattttccagcaaaactttacttttccttctcttttttactgagaagttctatttgaaacatcccaagctaagattakaaccagattgccatttgcatgcataatgttgctcaacctgaaaaccttgaatcagtatctggctgtgtcccactgcttccccatcactgtctgttctgta

SEQ ID NO: 34442 - DNA, 201 bp, Bos taurus
gattttcagcaataattctaataaatactttgttcaatgttttaacagcccatcataggccaacttgttaaatcataatcataagtcaaagtgccttgatrgtaaagtgtttggcttggcacctggtccacagtaaatggtggctggtctcatctcccataactgctgagaatctgtcttgatagttttgattatatttat

SEQ ID NO: 34443 - DNA, 201 bp, Bos taurus
cgttagaaataaaactggtttttatttaaaattatataaacctgagaatattttctagcattttatttttcatctttaaggcctttaaaatacaaagataytgattttaaaagccgaatcttatagtataagatcaccactgaagaaagcttgaaagatatgagttctgtaattattctcaaactgaatctgaggaaactc

SEQ ID NO: 34444 - DNA, 201 bp, Bos taurus
ttggcattttatgttccaaatagctacatcccttgtatgagtcatgcagatagatagatcttttaaattgcttttaagcaattttgataatttgcctttcrctgtcaaaataatgactgacgttaataattctgagtgattcagttaaaggaaaagagaacagaaaagtgtgtgccaaataattttgtgctatgatttttg

SEQ ID NO: 34445 - DNA, 201 bp, Bos taurus
taatatcttagatgctattggtatttagtcacttactctttcaaatcccctttcagcttcaagctcttaaataatgcgctttttatatatgcactggattytaccactctagcagaagtttaatccatttcaaagctaccccatgggaatgagtgctgagaatcatgttgcttgattctgaaagtaaaagtatgaaataga

SEQ ID NO: 34446 - DNA, 201 bp, Bos taurus
cacaaaagactgccagtttggagttaggcccacagcaagcaagagccttgtatcaagtccagtgtgcagtgtgaatgccttgccactgagctgtgtgatcygtcaggccatatagtggggtaatagatatttgtggtggaaaaatgcagcatgtagaatttatgccaagttcttctgggaaaagtgacagcacatgttcac

SEQ ID NO: 34447 - DNA, 201 bp, Bos taurus
acataaaccaatgcttgaaggcatgaatattttctcccttgtttatttttgcttttctagataacaatccatctctgattttatatcactccagataaaamttaatttatttctgggtaatgtaacctgtgaaatgatagcatgaagctgctaatgatacctcaggaagacatgataatgatttctcccaggtgtttgtct

SEQ ID NO: 34448 - DNA, 201 bp, Bos taurus
gaaacttactaaccatttaaaacggttctaaaagctttgaaattgagagtttcagtcatgtaatacagacttcactagatattccactttgattatggccrtattgaaattgcatttatgaaagtgaaagttacttagtcgtggctgactctttgtaaccccatgaactatacagtccatagaattctctaggccagaata

SEQ ID NO: 34449 - DNA, 201 bp, Bos taurus
aaagggaaacaacagatggtaaagtatttctgtttcatttggactcaagaacctatgttgaaaccatcagtattttggcctaagtttgggtcagatgaagmttggatcttccaattgcctatagaatttgttaatgacaagagtctggttgcccaggaagaaatagattatgttctttgttggagaaaggggccaatggtt

SEQ ID NO: 34450 - DNA, 201 bp, Bos taurus
gaaaaaatcttataggctcattaattagaactctttgacttcaagttacagaagccaaactaagctggcctaagcaaatttattttccctttgcataaatraatggaaaaatctatacagagtatagtgcagtgcttaacacacaataaaacctcaataactgttagctagtgacactaaagttatgaaaatgggggagga

SEQ ID NO: 34451 - DNA, 201 bp, Bos taurus
cctccaacgcagactccaggtcatggtgggcctggctaggccctcagtacttgaaaaggtcgatgaagtgctgcggggacacaggcgtgaagcagctgccrtgcaggggtggcccgagtcctcgagtaataaagcaaggcggcagtccttccagaagaggatgctgcagtgccggcagaagtgcagggtgtctccatactg

SEQ ID NO: 34452 - DNA, 201 bp, Bos taurus
attggtggttgccacagaggaggctgggggatatataaaataagtaaatgtggtcaaaagacacaaatttccagttacaagataaataacccccagggatrtaatgtacagcatatatgtttcttaagttcaaaatccagcacaggtggattttcagtatctgaacacagtagtataatttaagaactagaataatgtaaa

SEQ ID NO: 34453 - DNA, 201 bp, Bos taurus
ggtgctggaaaatctatttcttggcctgcctcaggctcttggctttttgccccacattcctgcaaaccttgctctcttttatccttcaagtttcaacacamatgtcctgatgttaggaggccttccctggccactttatgtaaaattgcaacactctcccccttagggttttctctcctcttctttgctttacttttctcc

SEQ ID NO: 34454 - DNA, 201 bp, Bos taurus
aatggcaacctactccaatgtctttgcctggaaaattacatggacagagaagcctggcggggtacagtccattcatgtctcaaagagtcagacaccccccracacacacacataccatcttatggaaaagcccaaaccaacttttcagccagcacagtgttaaaacagaccaaattctctaccctcatgtagctcacatta

SEQ ID NO: 34455 - DNA, 201 bp, Bos taurus
ttgtatgggccctccttcaattgcatgttcccaaatgaattgccatggtgtggaatatatgtgtgcacttagcttcctctgcgcaattacctctcagcgcytcttccttcatgctttcctgggcctattactcaatcctcctacctctgtcctgccagccgccctgagagctctactttcccccttttcaggtcatttcag

SEQ ID NO: 34456 - DNA, 201 bp, Bos taurus
ctcctttttcaaacttggttaaaaattagaagtggtctcctgggccatctggactctctcagatctcagctttctcaatttagaggatggctgtgatgaakttaaacagtggaggtaaagtcacctggctctgttgtgtgctgattccacatacacatgctggattatctctaaggcctgcagtggttcaagtggtggggt

SEQ ID NO: 34457 - DNA, 201 bp, Bos taurus
tgacttccccaagggctgtcagctgagcagggacacttgactggagctgcagctcatcctcaaacctggatggattccacagggctcagagcctgcctggycttccacactctggcaccttgaggtcctcggcacttcagagatagcttctagcttttagattatctttaaactgttgctgacatattgctttgaaaaatt

SEQ ID NO: 34458 - DNA, 201 bp, Bos taurus
tcaaaactctttatgttaccactatatggaaatcatgtgccccctcacagcttccaggggtttagaaaaggatactccgtgtctcctaaggcatttgttcrggctggggcagggcttggactgatggtgggaggtgaacctacacaaagagttttgcttgatactgcagagcatttgaggacaatgtttacatgcagctgt

SEQ ID NO: 34459 - DNA, 201 bp, Bos taurus
aggctgccctgcctgcaaacttggcttaaacctgagttacagaggactggcccccttaagcttctgtccaaggccagcatttatcttaaaggccaaagagygacctcccagcccaggcagaaaagagtttctaaggcgggaaactcggcagggtatgaggaagggcctgcagtcatctctcctgtgtttctgacttccctc

SEQ ID NO: 34460 - DNA, 201 bp, Bos taurus
agacttctcaactaagagaaaatactaagtttggaaagtttcgttctcgttcaataaagaagctttaaaaacaaagtgatcactggttaaaacatagtatytttgagtttccactaagatcaatcttgtggccgctatttgtattcaatcaacagagttgacattgacagatttgagaagtgagttttgactgtcctctgt

SEQ ID NO: 34461 - DNA, 201 bp, Bos taurus
gtttctggcagttttcataagctgacctcctgcgttgagagcgaagagtcttagccactggaccaccatggaactccaaaactttttaaacgtagggcccygatcggtcttctcagttttcttgaaatttccaaatcccaaatttctcatctgatcaattagaaaaggccttcagtgttccctctcccgcttcccgtgtga

SEQ ID NO: 34462 - DNA, 201 bp, Bos taurus
cttcctcagattctgccattcccactccaagcccaggtggaggtcctggcctctgtggttgtcacagtggcaagagggtgagaatcacgatggcaagatgsgggactcggggtttaaattctggccattgtacttagccggcgagttgtgtaacctatctaagtttcagtttccccttctataaaatgggataaaaatatc

SEQ ID NO: 34463 - DNA, 201 bp, Bos taurus
tttgtggcagcgctatcacgggcgtccctgacttctgagcctgtgagctccgagcctgtgcagtgtcggccatggccttggacttggttcttcatactccygccttgatcacttaggaaggtgacctttcagcaaaaaagccagaaagtacaggccaggaatagactgtgacatgaaagagaagcccgtatggagagtgtt

SEQ ID NO: 34464 - DNA, 201 bp, Bos taurus
atctttattcttttttaaacatttatttatttggctatgctggttgttaatcgaggtatgtcagatttttgatctttgttgtagcatgcgagatctatttscctgaccaggaattgaaccctgcccctcctgcattgagagtgcagtgtcttagctactgggtcaccagagaattctccaccatctttcatgagtgccaat

SEQ ID NO: 34465 - DNA, 201 bp, Bos taurus
atataaacccttttatttatcagaaatggggagagaacactcaaatttcaccaaattcttgttgcagaagtcaaaacaatgtaacaactattgtgcaagamatttacaaatgaagcacacttcagtatatgctattgatttttaattcactcacttaaaatgtaatagcttttcattgtttttagaatattcctagataag

SEQ ID NO: 34466 - DNA, 201 bp, Bos taurus
ggaaaattcctcattatttcagaaacatcatgctgaaacttggacttccatactcagcatttctgtcctaattttcaagtgtggatttcacacactcaccmtttcatcaagggaatgaaatagacacgaggagaaatattatgtaatattcaattatcactccaactctttcagactatccttttagacttttcgggtgtt

SEQ ID NO: 34467 - DNA, 201 bp, Bos taurus
atggcttccccagcctgccaatacccctctgtggcttcccttgactctcagaggtccttcaacacagagggaggggccctggcaggaccagctctgcctgmctctcctgcttctacatcactccttactttgatgtcctgactctggccaactgggcttcttgattttgccctgctccatcctcccacagagcttttgtag

SEQ ID NO: 34468 - DNA, 201 bp, Bos taurus
actccagtattcttgcctgggaaatcccatagacagaggaacctggaataaatgcttgtctcagtcccacagaacctcatggaaacttggctttcggccgyggcataacccagatgcactcaagggtctcctccttttgaaacaccaggcaataggagtttcggcaccacaagttccagttctgcagctagtggggcctct

SEQ ID NO: 34469 - DNA, 201 bp, Bos taurus
actaaggatgaagcagaagcgcaccaggcctccccgggacttagcctgaaagcggttccatgctgtcttccagtgtcctcaacgggtggctagagacctcygtggggccacaaatggcctcttgttctgtgaactccgtttctcccgtgtcaccccacaggtctgggcctctcaggtgcgggataaaaaatttacagagtc

SEQ ID NO: 34470 - DNA, 201 bp, Bos taurus
gtttaagtcagtaacacgttgggatcttgcttaaatgttgtgatcttctcttttacagcaggatcttagttttttaaacggctctaaatcttaaatacacrctctagaagttatcagaactggccctcccagcaaagcccttccctctgttgtgtgcaagtgtgtatgattctggcaggcagagccttagtgaggtgctga

SEQ ID NO: 34471 - DNA, 201 bp, Bos taurus
ttgcctctatctcagcccaatcagagaataatcatcttcttacaaacttaggaagaagggctagaggcacgaagaagcagcatataaaatccaaggggttragcaaacttagttgctgacagtgtgtagaaacatatgtagacatagaaatagaggaaatggggatgtctctggtggtccagtggttaagaatcttcctgt

SEQ ID NO: 34472 - DNA, 201 bp, Bos taurus
aacacccacgtcatcatcacccaggtatggcctccctctccagctgctcctgctgtaaaccagttgactcagagcagaaatcaggtgcaggaagggtcagygttgaggcctgcttccaggaatgtaggaccagtgatcagccagaattgtgcacccttaactgttttgtgtgtgtgataaaatacatatagcagaatctac

SEQ ID NO: 34473 - DNA, 201 bp, Bos taurus
cataaggtgaggaggaagccataagaagccacagctctgagcatcctctctgagctcctggtcctggggatgctgcttgtcttggagatcctgcttgtctygtgcagtgggaaccacgggcgggttctgagtgacaccagtccagggcagcccacttcaccagcaaagtgatgatggcaaccaaatccacttagaaaacaa

SEQ ID NO: 34474 - DNA, 201 bp, Bos taurus
tctggcctgggtccacagttgacttcctcagactcacagaagctcttattggacaagtgccggctatatagcaggcactgtgttaagcaaaggacatgccrttgaatccttgaaacggcccagtgaggtagactctctcgtccttattcccattttacggatgaggagactaaggagcagagaggttaagttgcacagcct

SEQ ID NO: 34475 - DNA, 201 bp, Bos taurus
agagcaatgttgaagttcaaacacagcagataaagcctggagtgataggtttacctgccaagtcttgttagtgcaagttgctatgcccaatgcacagtgargccaaacacaccaacatgtaggagtttggagcagagaaaggtttattgaagagctatgcaaggagaggggtggttcattccctaaaagccccctgagttc

SEQ ID NO: 34476 - DNA, 201 bp, Bos taurus
tcgagcatcgatagtgtcccttcctatggcacttgccaccctccttcttgacccaagctctctactagaccctcagctcttagagagaaggaaccaagctyggtgtcccctgggcacctggcacatggcctggcccacagtaggtgcttggtgattattgtctgatacgattcacattgcagggaagccctgcaatttgat

SEQ ID NO: 34477 - DNA, 201 bp, Bos taurus
tcactgctggagcacttttgagttctcttgcacttcctgtgacccttaagagtgttcatactcataacataaagcatggaaagtcagaatgcattttcacrtcacctttgccaaggattggctctccctctggctgaattaaccactgattcttagtctgctctcctaagtcacaagctaatctatcctgtgatcatttca

SEQ ID NO: 34478 - DNA, 201 bp, Bos taurus
cagatccactcccacaacatacatcttaagataacagggttagaactaacaatagaaagatcttaccagatccactgccacagtatacaagttttaatatracaagattagtcagaatgttcttgttaaggggaaacatatcctcgagcaagatacattgttatactaagacaaagcaatatagaaaaaaaaaaaaaaatg

SEQ ID NO: 34479 - DNA, 201 bp, Bos taurus
tggtttggggttaaagtatcacatttaaaagacttagttatgatcagtgggggaacacgttgtggccctatggctttgatctgttttctggagtggcctgygaaactttggactccctaacgatctatttctcaatgaggtcagaaagcaagcagcttttaaaatctagttcctctaccaggggctctggggttttgaaac

SEQ ID NO: 34480 - DNA, 201 bp, Bos taurus
tgtttattttcagttcaaagaccaaatagaaaactccatcatggaaaatgttacctgttcattcacactcttttaatccctcagcccccataaaataaacrttctaaagtgtaagcagtgggaaatcatgtaaactctacagaaatagaaaataaattagcttctttcaagacttgggggaggtccttttcctgaatgcta

SEQ ID NO: 34481 - DNA, 201 bp, Bos taurus
gagaggattctaaaattttcctgtaaagatattcagacccagtgcttttcttaggagaaagactttgaccaactttctaatttattctatggttactggtrtagttaagttcatttactcttgtaccaatattgataattcatattgtttttagaagatcagacatattatgtagatttcatttttcttactacccatttt

SEQ ID NO: 34482 - DNA, 201 bp, Bos taurus
cttcagaacctgtttctactctatataatcctttcctctttctccaaagcaaatgtttgctccaattttgttaatatcctatgaagattgccccctaggayttaatgcatgtgactatactattctagtggttagatataacacttacagggtattaggtttcaaagaaattaggaataaaaataacataatcatcagaga

SEQ ID NO: 34483 - DNA, 201 bp, Bos taurus
gtgccccaaagacgtttttgttgcttgctgacagttagtagtgtctgtttaaaacacatggttttattgggccttaaaaatatctttcagtttcgttctcrtcaggacaagagaagagctgaggaaggtggattgcggctcactattttgttggaagatttcaacttcattccacctctctccagatgagtgctctttgca

SEQ ID NO: 34484 - DNA, 201 bp, Bos taurus
gtaagcttagggtctttctactctgttgtctttgccaaacctcaggataggaacattttaagtttcttgatttgtattgtcaattaccctccagaaagatmgtctaaaattacattaatcctagcagccaacaagagagcatatttgcctggacactggatacttctaggctattattctccctattcttcttatttaata

SEQ ID NO: 34485 - DNA, 201 bp, Bos taurus
tacacttatcagttgtcaagaatcaaagaatttgatgaagttgattgtctgtgtggcactacccttcatgagaaagagcagaagtcctcctgtgttccctycaaaagggacaatatgcttctggagaagccctttccttactgagaaagcttggaaatcttctattaatttttcacctatatcttcctttgaaatatatcc

SEQ ID NO: 34486 - DNA, 201 bp, Bos taurus
aaattgaagtgtttacagtgaggccctcatgtacgtgtgaaaaccccactgtgcctgcttaaatgctccctcgaacacattttaaaatgaggtcttttttyccctctgtttcagtgtttcagccagtcattcgccccttattctgtctcagctctttgtgtagaaggtgccaaagactaaagaggcccagggaagatttac

SEQ ID NO: 34487 - DNA, 201 bp, Bos taurus
ccttggaattgggcaggcccataaacaaggctttgccatcaggtaggcccctggctgtgctcccctgttgggcaagattactggccagactctctgattamgagagccctccagctgaatcccacagtgagtgggtctagagactgtgtttcatggtcaagctgggttgttgtctaggctttcttgataagaaagccttgt

SEQ ID NO: 34488 - DNA, 201 bp, Bos taurus
acaagtatattcttactgatcttaaaattgaaccataaggacaataaatttaaaaaaaaactgaaaatagctcagcattaaagataaaaataattgtaacytttagaatatgatatgatagcatatgatcagagcagtagcctttgacaaagagcccataaatttaaaaaccctaacaatattgcctagtctattgagagt

SEQ ID NO: 34489 - DNA, 201 bp, Bos taurus
ccacctgttttggcctctagtgtctcccttcctttataaaatttgtggtgactcaaaataagacagtgtcagtaagaattaatacatggtgaaatgagagrttggagtccggttttggtttgggccagaataacactgactgaagtgagatattttcttctggaacaggagacatatctgctgatgacaagtgacttcttg

SEQ ID NO: 34490 - DNA, 201 bp, Bos taurus
atctttctgagcaatttgcttagctttatctttcaaccaacataattcatgctcatgagaattcaattcatcttctaactgattgaagactctcaacctgyaaattaaaatgttattttactattagtttactacaagtgttgaactactatttcctttctttaaataagggcttccctggtgactcagacagcaaagaat

SEQ ID NO: 34491 - DNA, 201 bp, Bos taurus
taccaagaggtttttggagagagatcctagaaaagacaagcctattgaatcctgtatctagacatgttatgctagtctccagtttttgctggactgtgagmttcccaaggcctgggaaagtgttttgcaattttctttcctgtctccaaagcctagcaaagacatacagtaagcagtaaatgtgtaccataccactgaaat

SEQ ID NO: 34492 - DNA, 201 bp, Bos taurus
ttccttcggtaaaaatcttcaaactattgattataaaactgatcatttatacagctgagtttctactgctggtctagggcaagaattaaaatccatttgtygggttcacttgagtcaagtgtattcacagatattattttattcataccaataggtcttctattgcttactcatcctaagaaagcaatgacaagcattaac

SEQ ID NO: 34493 - DNA, 201 bp, Bos taurus
tcttctaaaatgtattattgttttatttttatacatggaatatttatccctctttttctccattagtttttaagccaaagcacatgccctcaataaatctmtgctttgatatcatgctctcagaaatacctgctctgcctttcataaaccttataattatgtactcagtgtctctattttccactgatctttgctcccctt

SEQ ID NO: 34494 - DNA, 201 bp, Bos taurus
acaaccagtgcaaaaaagaaatttctattagcagtgcttcataaacctgactatacttagaactgcctgtggcacgcacttaagatttaaggatggcccaygccgtcacttgggtttagttggtctaaaatgggagccagggctcgagctccccccggcccccaaccttttaaaaagttcaccatcaagtaattctaagta

SEQ ID NO: 34495 - DNA, 201 bp, Bos taurus
ctagtttcacgatgcttttaaaattgtgtttttaaaaatttacgcttggtcttttgcttgtttccatcttatgtagtattcagttattattctaatactayactatttaattgctataatttatgtagccttttctctattgctgctgctgctgctaagttgcttcagtcgtgtccgactctgtgcgaccccatagatggc

SEQ ID NO: 34496 - DNA, 201 bp, Bos taurus
cactttaaagagggagatttgggagttggggcgggtccacaaagacggctgagcctcaggtcttctatggtttggacttggtggctggtaaatcatccacmgagctccagcgaaccacttcctattttcccttccccttatctgagcctctgcttacagctttctttaggagcagagatttctacacttggaagtcaatga

SEQ ID NO: 34497 - DNA, 201 bp, Bos taurus
acaaaatgaaatgtgatataaatacaaagagataataatagttgagcataggtcttatataaactacacaaataactgaattgactaatctctctgaatawaatgttgctgttttacaggttttaaaaatctttgattttaatttttgtaatctttgattttaattttcatcacaggaaaattgttcttagaccacttctt

SEQ ID NO: 34498 - DNA, 201 bp, Bos taurus
cacagaatgtaaagattgttccaggtattaaaatcaatgaagtttgtttaaaaaaaaagaacacttctgccaaattggcagaaaaaaagtgaatgtaaaayaatcaaactaccaaactctttatcgatttaactatgagttttaaaaaaccagatattaagaaaattcagagttcaaaaaatcgtgaccatgttttattga

SEQ ID NO: 34499 - DNA, 201 bp, Bos taurus
ctgattgctttttattcctctttcctagatgaggtagaatagaagtaagatgagaaaacttagactgtatgtttttgtgagtgagagatgagagagaaaaytttttagtttcatacttataaggtctaaaattaaatagcatacataattcaaactttaactatttttttcacttagcagtataaaattcttaacaccttt

SEQ ID NO: 34500 - DNA, 201 bp, Bos taurus
atctttttttccaggatcctttagacttttgtggagtgaactgggcagggcatattttccgtaagacaaatgtattggctcaattgtggctcaggttaagrtatcattatcttccttcaggccactatgttagacatttccaaaaggaatatgtattccatgtgtgactaattcatttctaattaagattattaaatcact

SEQ ID NO: 34501 - DNA, 201 bp, Bos taurus
ggataggtactttgaattacatcttcaaagatgcagtggtgttaaataggacaggggagcagggtgggcagtgtcatgccagtggagagaattccagatarcaggagacttggaacagttaatgctgccctcctatgaaatgagcaaaagatttgcttttttttccttcaggataacatttgtgatgaccaaagggaaagg

SEQ ID NO: 34502 - DNA, 201 bp, Bos taurus
cattctttgggatttttgtactcttgttaggcagcagaaataatgaataatattctttgaactgagaaagacctttgagactgataaacaaagcagcaatrccatatagtgcaattatgaagtttattgtagataactcacttacagacaggattgggcagatgaagatctaaaggcatttgtagctacacttcacattgc

SEQ ID NO: 34503 - DNA, 201 bp, Bos taurus
attatctctaaacatattagactcctcaaaatgtattcttagaaaggataaattgatgaattactattctcagaggcaacatgacacttgattcttgattrtctcttccagatgcagagtcaactgagaattaactacttgagtgtgaagaaggaaatatccaggtctcctttccatccaataatctccattccattgaaa

SEQ ID NO: 34504 - DNA, 201 bp, Bos taurus
aagatcacaaaactatctaatggaagcacttcaacaactcctttgtcctacttgatacgtcattctgcttttttatgtacttgatagaggcactcattttycttcaatactttaactggtgtctgttgaactatcctacaatttcaagttttcaaaggagagcatgtgatattaaataagaaattatggctaaattatctt

SEQ ID NO: 34505 - DNA, 201 bp, Bos taurus
aacttgatgactacttccatgatataactgtaggttatattttatcagttaaggttctgatatctagatgtatattttaaagctgaccaaaaaaaattctyatgttaagcaatggcataaattctaagcagaaatatgcttgatcactataaaaatgtattaagaacaaaaataaattgtagatatgttttcataacataa

SEQ ID NO: 34506 - DNA, 201 bp, Bos taurus
ttgatgcaatcatcaataaaactttgtccacaataagtttatgtgaaaaaattatattacaccacagtagaaattatattttaagatttcaactgcaattmtatttctttcttggcaaattaatgctgaaatttcttatggaaatatgaatggagtttgaaaaccaattcaacattttcaactcgactattccaaatgtct

SEQ ID NO: 34507 - DNA, 201 bp, Bos taurus
cacacaggaccatctccatgtcactccagtggccatcttcaactcctcatcttcatctaacccagacaatctacaatattcattaccactcttggccaggrattagggagtaagtgcttagaaaatagtggttctgaaaaattaccatctattggatatgctttgtggttatcttaaattggtgcaattttctaggccttc

SEQ ID NO: 34508 - DNA, 201 bp, Bos taurus
agatttacacacagcagtataatcactcaagaaatcaaaaaaaaagaaaagagaaaaacatctgtccctaggctactgttgcctgttcagcctctgatttygaaaatttggcctccaacctgttaagtaaatcagtcacttacttaccaatgtaagcaagtaaatttccaaataatggtgccggcatcccccaaatcatgg

SEQ ID NO: 34509 - DNA, 201 bp, Bos taurus
tgagtttttaacaatggtaaaatagtctagtctgtttttatgggctcaatgaactaatagctggaaacaatgagactgtgcctggccatgtcatgtagacrtcagcatgtagatgttagttaagcaagtaagagaaatttctcccactctgtccttggccacccagtttctctcccaaagtaatcactgtcccttgtgtct

SEQ ID NO: 34510 - DNA, 201 bp, Bos taurus
cccagtgtcttcagactgctgttggatctaccatatccatctatcatgctatcccctccctcccctaaatcatccaattgtggattatctgggtgagcccrgtgtgaccccaaaggcctttaacagtggaaaagggaactgaaaaccagagaaagcacatgacaaggacttagtcgaatgttgttaactttgaagatggag

SEQ ID NO: 34511 - DNA, 201 bp, Bos taurus
ccggtagactggaaggacattctgttacacgtcacacacagtgcctttgagtatttaaagcactgggcgtcaagtcaggggccaaggcccaaaatttctcytctgaaggaagtttgcagccaaatttagctggggtagaagtctgttacaggaagtttaggtctcaggccagcaggaattgaatggtctccatcttcttaa

SEQ ID NO: 34512 - DNA, 201 bp, Bos taurus
cagattttttgccactgcgccagctgggaagcccaaagctgctagtgagcaccctacgactcctgctttggtttccttccctgggcctccctggcttaccrcaatagctccttcctttcccacagcctcttcctgacctcaactctcaatgcccacatccactcttcttccaccagcctcctggctgaacaagcctctgtc

SEQ ID NO: 34513 - DNA, 201 bp, Bos taurus
gtattatccgcccggctcccagctccccagccggcctgcctctcccctctcctggcacatttacagctcccgatgtcagcaagtgctgggcactcatgtgktcagtgtcaacaacacaccaggaaatcagggctccgggcagcccagcgatgctggctttcggctgcctctggaagcgaagcgagctctcctccacgctgc

SEQ ID NO: 34514 - DNA, 201 bp, Bos taurus
agtgctaatggttctttcagttaaaagactgctgcccttgctcattaacatacacaagtcgggtatttttaaatccttcgttacttcaccatacccagggytgctgctgcaatggccaggaatacccaaatcccacggaatcttgggcaaaagatgtcagctcaagcccagctgtgggtctcagctacctacaaggattcg

SEQ ID NO: 34515 - DNA, 201 bp, Bos taurus
ccttgcactgcagccagacccagtgaccctggactgcagggcaggggttccctgtgtccttccctctggctttaatgccagcatccttgtagagtggagcygggccactgtgcttcattattgcctccaaagcaaaggtgttccacatcatccactctcctctgtagccacagaatcacggaatgatcttcggcctggaaa

SEQ ID NO: 34516 - DNA, 201 bp, Bos taurus
aatgtttagtaactaagtgtacatagttaaacaactagagagctgacatccagtaagtttggtgtgatatttggtttgtataatattatttcagcatactrttaaatcatgcagaattctttctggaaaagtattcaagaggatgccagaaaggccatgttaataataagtttctgtacttcagtagattttgagtgtgtt

SEQ ID NO: 34517 - DNA, 201 bp, Bos taurus
aaccacatgtggctaatagccaccataattaggcagtgcagttctagattatggatcctgtgtagtcatgtttttactccaaagtggatttggtgaaaatrataatgtgcttatttacattaaggcattcaagttcttggcatataaatcattgatttgcagtgcattctaaactagcatttaaatgtaactcattcgtac

SEQ ID NO: 34518 - DNA, 201 bp, Bos taurus
ggccttccttctctctaaattgtttctcattcatccttttgcttttatatcagcatgtattgttggtaatataatattctttagactaacagatccccccmaaacctcattttattaaagcagccgttttattatctctcactgtttctttgggtcacgaattcaggaagggtgaggttttggctaggcatctctcatgtg

SEQ ID NO: 34519 - DNA, 201 bp, Bos taurus
gaaagtagctcgatgtaatgtgcctgatatggattactgtctcatattctcttctccacccatcccccatacccactcccagcattaaggttaccattctraacagaaaaaaatatgtttaaggaattgtagcatacagtcaaatttatattattttataaaaatactgctgttgtgcagaggtagtgtgtcattggaaac

SEQ ID NO: 34520 - DNA, 201 bp, Bos taurus
tgcaagacccatgtaactaaaagcacccatgtctgtgtgtgttgagtgttcagttttaggggttacagtgtcagtctgggacttctgtatcataaggccayactgttaaaatcagtatttatatttttgctttgttctatttgcataaaggctgggttttttttaaagtttttttggccatctgactatgtacaagcagac

SEQ ID NO: 34521 - DNA, 201 bp, Bos taurus
cattactgggctccagcatcacagctgtctatggttaggggggaaaggattcagcttggtggtctaatttaaacaagcgtttgaaaatagaaatgtatatkttatatgttcattcagtgccattaaacattttctaggtttttacttagtgtttcatttctcattcctcttctgattgatgtttttatatttagaaaaaga

SEQ ID NO: 34522 - DNA, 201 bp, Bos taurus
tggaggcttaactcagggatactttgcttctagtctcattcagactgtttggaagaatttgtttctagtgtttgtagaagtgaggccctgaagttccagargctgccttgtccttgccgtgcagctcagttcccatcatagaagcttacttcgtcaaggccatcgggagcatccttcagctcaaagaaggcctaagccatt

SEQ ID NO: 34523 - DNA, 201 bp, Bos taurus
cctaaccactggaccaccagagaaatccctggagaaagaaaatcttgacatgagatcatctggaattatctggctgggccctgaatcctgacaagtgtccktagaggagaggggcagagggaggtttgagaccgaaggcagagggtacaaaggagacgtggaggccctgtggccgcagagtcagcgagtggagcgttgcga

SEQ ID NO: 34524 - DNA, 201 bp, Bos taurus
ccttcctagcagcgctctgaacgacagccagcgagggcagttttgctgagctgtcggttcccaggttccaatttccagaaactccatttccaggacaagaygcacacgagcgcttgccaaggccaacacgtttggctgcgtgtttaccgctgtgacacctgctgctcagacgggccctgtgctgttttgtacataatggtt

SEQ ID NO: 34525 - DNA, 201 bp, Bos taurus
gagcaggggcctctctcgagttgtggtgctcgggcttctcattgtagtggcttctcttgttgcagagcatgggctcgaggacttcagcagtttcggtatgygggctccaggcacaggcccaatagttgtggttcaagggcttagtggctgcagagcatgtaggatcttcccagaacacggatcaaacctgtatctcctgca

SEQ ID NO: 34526 - DNA, 201 bp, Bos taurus
tccacatgtggccattagcctggttaaaattttgctggtttttccttaactcctgtttatggtggattcctgttctccctgccatttggtaggaatgaaakctactcttggccttttttttctttggggatgggcttgacacatttatacttctttgcatcctcagctccctgatatattttaaaaactgtgcttttgtag

SEQ ID NO: 34527 - DNA, 201 bp, Bos taurus
tgtttggacttgttgagcttgggatgctcttgtctaacctgtgagtcacctgtgtctctcaggtagtgatgtatctagggagaaagtttaaaatgagggcraggccctctaggatttgagaggtcgagctggggaggatgtcacagttactgagaagtggcagagagggaggcggaggatgggaggggctggcgtgggaca

SEQ ID NO: 34528 - DNA, 201 bp, Bos taurus
cagcaacaggaatggtgtaagaaaggccgaatcagggagaaagaaggtcaggtctgaagtgcaatagagcaagaggactgagaggctagcagatgcagggrcactatgggccgtcctgggagcgtgtgagttaccagacacagggagatgcgtggagctgataaatgtctcaagccctgcaggtgcaacatcatcttccag

SEQ ID NO: 34529 - DNA, 201 bp, Bos taurus
gccagcccctgcctcactcagtccctgggaggcacacgtgtgtcggctcacccaggctgagctcctgccgctccatttctcgccttcaaccctccaggaargatgctgtgtgcggccagcgtcgcaagcagacagaaatcactgttttcgatgtccctctgttagacgctcgttcttggtgtctggatgctgaagtgtcct

SEQ ID NO: 34530 - DNA, 201 bp, Bos taurus
gtcatgaggggagacatctcactctgttctgtttctcaccagattgcgcaaaagctgaggcaggccctcggccgcttcccggtgatgtaggacaggtggaktgaacgtggagaaacgccgaagtgcttccttctgacttgggacaacgcaattggatttttttttccaccatcgtccaaaaagaaacaaaaaagaaaacca

SEQ ID NO: 34531 - DNA, 201 bp, Bos taurus
catgactactggaaaaaccatagctttgactagacggacctttgtcagcaaagtaatgtctctgctttttaatatgcagtctaggttggtcataacttttmttttgtgggggctgcatggctccaaaactttcctttaacctttaattgtgaaaattttcaaatgtacacaaaagtgaaaggaaaaatgaatctcctgtac

SEQ ID NO: 34532 - DNA, 201 bp, Bos taurus
ccactgccccaccctgctcacccagactgcctctgtgtgggtatggccctcctggttctggtgtagatgtctttttggtctgtgacccatttcttgccctygcctacacctcacctgactctggccagcatcctctgacccaggcatggtcttgctgctgctggagccctggaaccagagagttggagctgaaagggatgg

SEQ ID NO: 34533 - DNA, 201 bp, Bos taurus
gactgctcctctagtgttctaggatggcccagacaagagtccacagtctgctctgaaagcacagggtccgtgggggaagtaccctcttcctccagtaaccrgatttgggggggccccccattcctttccagcctttgtcataggtgtctggaaggccctggagccctgatgaaccaggtggtacacagactggcagcattg

SEQ ID NO: 34534 - DNA, 201 bp, Bos taurus
acctcccccaaaccacaactctattctccccacccagacaacctctcaggtcactccaattctgtcctgagttgcccatggtaaggggacacgttatttayatgcctgtcgcaggtaacaccatgtgtggtgtttgtcacagggtggggggttcaggctgtctctgtgactcttgatgtatcatgtttttttgtggtttta

SEQ ID NO: 34535 - DNA, 201 bp, Bos taurus
gcctcccaagtggacaggccctctttttttaaaaaaaaaagtttatttatttgcctgtattgggtcttcattgtatcgcgtgggatcttttcagtgttgcrctcggactctgtactcatggcatgtgggcttagttgctctgtggcatgtgggatcttggttccacaaccagacattgatgctgcatgccctgcattgcac

SEQ ID NO: 34536 - DNA, 201 bp, Bos taurus
ttagtcagtggaaaaaaataactattcatttaattttgaaatgtaaggtagcctggtaggctacagtccatgggatcgcaaagagtcgggtacaactgagygactttctctctttctttctaaggttatgaagtaccagcatacaagtcaagtagatttgcccactccttcaaagtattccaagtaataaatgattctata

SEQ ID NO: 34537 - DNA, 201 bp, Bos taurus
cattgaaaggacatcttattactaaggaattcatgtaaatttgataacaaaatggcattatagaaagtacactaattagatctgcattttctgcttttcaytgccatgttttatcaattcaataccatcttggttggggaaagaaacagatcaaaggtgctgtgtgtctagtgtcactgatggaaaaagtaagtaggagga

SEQ ID NO: 34538 - DNA, 201 bp, Bos taurus
ataaatggtatttgcaaaattatgaggccttccctggagtcaaagccttcagaactgactgtataggcactgcgtgagatgaaaggagctggggttatggrggatatccatatggggatatccggtccatatttctttctactctccaatgttgtttctcagtaaacattctaaaatctttgtaacacacctcttattagt

SEQ ID NO: 34539 - DNA, 201 bp, Bos taurus
tcttgtgggctctttctcagcactggtaggttcaactggagtgtgggttatcagttcttatcctgccttaatcctggggcccttgtatctgctgagatcaygagtgtaggaaaagcttgaagctatcataaatgtgagttgctattttcgtcctgagtggtaatgttgtagacggctgttcaggcctagcctgtgcagaca

SEQ ID NO: 34540 - DNA, 201 bp, Bos taurus
tgggaaacacatgggccagcaaccagctgcaagctggtggaaatgaatggaataagtagagcagatgggtgtgtaatgggcaagtagggaccgacagcagygaaggagctcctcaatggccagagagaagtggggtgggcctgggaatagcgccaagaacgcttgagaccaaaggatttctaccttgacacatgggctctc

SEQ ID NO: 34541 - DNA, 201 bp, Bos taurus
agcccagatgcgtcgcagcagctccagaggctctggaggccagagacagatccagggactgtctgtgcctccagaggggtgtgggaagacagcatcttgaygtttccatgggcccaaatgcagcatgggaattggggggtgagggggattgggggggaagcaggaggaggggagcgggaagcaaatggcaagcgcactggt

SEQ ID NO: 34542 - DNA, 201 bp, Bos taurus
tcaactgtttgctggttccaaaaccggggtgaccacgtgggcagggcagcccttcacgtcctgagccccctttctgtccctggaaggccttgatttttccrtggtgtgcaccctccagtgaccccgagtcactcccccacctctcctctccgcagagcaagtgtgtgggccccgtgacccccagaaacaggtctccccaga

SEQ ID NO: 34543 - DNA, 201 bp, Bos taurus
aaatgatggatttttatccaacaatataattgcctatggctctccaaacagaggtttcacaatgtttggctccggcatcatagcaatagagaaaataaaamttatcatacggatttcatgtattcattcattcaactatttattaagtctatctataaggcggtgtcgtgggttctggggacccatgctaaatgttaaagc

SEQ ID NO: 34544 - DNA, 201 bp, Bos taurus
gagttggtgatggacagggaggcctagcatgctgcagtccatggggtcacaaagagttggacaggactgagccactgaactgaactgaactgataatggtyaactataaaggaaaaacaggcccgtttactggatgtaagacattttcattacctcctgcagcccccaagccctggtctcaatcctggtcaatctcgtagt

SEQ ID NO: 34545 - DNA, 201 bp, Bos taurus
tcaagatcaaagaatctttataaagtgaaatgagttaaaaatgaacctcacaataaacctctctacatcctagacaaatactgtatgtatgtcaaagccaygaaactaaatcattcagcctctacctttacagaccttacactttaagacgtattaatacatagttagaaaatgtggtaagccccaggaagacaaactgca

SEQ ID NO: 34546 - DNA, 201 bp, Bos taurus
agcttaagaaatccaccctctccctgcccccatctctgtcttccctgcaccctgacagcggggagcagtggagccttttggtgccctggtatctgggcctygcctccttcatttcttttactcctcaccacctaaccaccctccttggtgtagaggggttccgcggcagcccaggccctcctgaccccatggctcctactt

SEQ ID NO: 34547 - DNA, 201 bp, Bos taurus
tcttttaaatcagagcctgcgtgcttaaggggatgggagcccactccagcattcctgcgtacagaatcccatggacagaggagcctggcgggccacaatcygtggggtcatgtgcaattcttcccacgtacgtgtgtgcgggaataaacacgtggtgtgcacgtgaagagctcttccaggagctgactggccactggatgt

SEQ ID NO: 34548 - DNA, 201 bp, Bos taurus
ttcagagtgacttcattaaacctgcaagagttgccggtcgctgtcacagagagggggaccaggtcaggcttggagaaggggccgcgatgtgtgatggaccrcacgatgccgcagagaagctgtcttgtctcccagtagagagcctgctgtccctccgtcgctgtgagcactcagcactcacctcgatgtctgcttgcctct

SEQ ID NO: 34549 - DNA, 201 bp, Bos taurus
agggctccccaggacccaggtggctgctggggcacacccattgtacccacacccactgctggggatggagccaggccccactgcaagggacagggcacatyggggaggacacttcctggaagaatgaggacttcagataaaaactaagtctgagaaacacaagattgcatttctcacacatttgaatttcgtggcctgaga

SEQ ID NO: 34550 - DNA, 201 bp, Bos taurus
tgagatttttgggccatatcctcttttctctgtgggctgattgagaacttagccattgaataagatgtggtccacagtgcacgtaagacctgcccgccccycgcccccgccctggcccccaaccatcatcctagagattcttggaaggtataaggagaaaggctgacaactgtccaaacggcacgtgagcacccctaatag

SEQ ID NO: 34551 - DNA, 201 bp, Bos taurus
gtaccactccccgcccccctaaccctggagataccagagcatccattgtctggatggtgctcacgtgaagtcggtgggcccgctcccagttgcgatcaagrctccccaccttgagcacagcgcacgccctctcatcattctctctgcttgacagcgtcatgtctcggccgcctttcccagtggtggcatatgcccctcgga

SEQ ID NO: 34552 - DNA, 201 bp, Bos taurus
aacccccagccggggtggggtgtcccaaatgctgacatgtaagacacactgtatgttttctaactgtgagatctgtcccacttaaaggatggccctgttcrcacagctgataccttcctgttttagagaatgctgaaatggcaaaagcagcttcctttttattggcgtccctgctggaacaaagtgttggcccagagtccg

SEQ ID NO: 34553 - DNA, 201 bp, Bos taurus
agacagctgagggaccagacgctgtctgagcatctctggagttttcatgagtacagcccagtacaagggaggggagggtggtatgaaggccacttcactcrcagatgaaacagccggaggatacacggaggtggctgagagctgtctgccccagggcaggagactggggccccagtgccccgcctccactcagctttcctc

SEQ ID NO: 34554 - DNA, 201 bp, Bos taurus
tcgactgactgtgagtatgtaaagaacacgctgggctcagaaggcaagacctatggtcgaactgcgggacactgggcctccgtaaaaacctgggggatcgmggctaaccagctcaccagcacataccccaaagggtccaggaaaggagtcctaagggagacccactcagtgtcagaaccatcctcctggactctcaccgta

SEQ ID NO: 34555 - DNA, 201 bp, Bos taurus
catgtacacactgctatatttaaaatagataaccaacaaggacctgatgtaaaaaacaacaacaataacaataaaaggcttcgagaagcacattctctttrcttgcaaggtcaggctttttagatgagagttctcatacttgcaacattcatttcttcattttacttctgacatcttactggtgggtttccttccacccta

SEQ ID NO: 34556 - DNA, 201 bp, Bos taurus
ttcttccaagatgccttacttaaaagcactaaaggagaaaaaaaatatatagcatttcttggaggggttctaactccttgttgtgagcaatgagatatgcytgggagtcagtttatcaggagttttacatgtttggagaggccagattctgtctcaaatttaggttactggagacaaagtcagagaggcaatatatttaac

SEQ ID NO: 34557 - DNA, 201 bp, Bos taurus
ctgttgttccagataacctttctgatcaagaggtggaaattcagtgaccgtcgaaaaggatgtaaaagaaccttttccctctcgctcagtatttacaacgrattaggctggcctagtaaactacaggaaataaatctgctgaacagttcccttttctgattgctagctaggttaacatgctttcataaacaaataaatacc

SEQ ID NO: 34558 - DNA, 201 bp, Bos taurus
ggtaggcggccaactgggaagccccacaaaacaatctatagggttgacaaaaagcatcagtggttgctacgagaagggaggaactcttaggccgaagagaytacagacgggaatgagtaagcatgtggaggtgaaggaaatgttcattatcttgactgtgatggtggtttcataggtgtgcacgtatgttacaacttaaca

SEQ ID NO: 34559 - DNA, 201 bp, Bos taurus
caacaaagttgcaggattaagaggtgtgcagtaggtagcctgtttcaagctaagccatggatactacttgtctaggctgcaaacagcatcgtccttcaacygggccacttctttggattaagctgatccggcctcatccagggtgtccaatgcttgcaacacccacttgacagaaagggaaagggactttgcttagctaat

SEQ ID NO: 34560 - DNA, 201 bp, Bos taurus
ctgatagaaaatatcttacggtttgaggcctacagtctctgtggcaactactcaactaccgctgtggctcaaaatcagctgcagaaacctgaaacaaacgygtggggccgcatccttccaaaccttgtttatgggcactgaaaatggaattttctacataggcacacctcgttttgtcatgctttgctttactgcacttcg

SEQ ID NO: 34561 - DNA, 201 bp, Bos taurus
agggcttgcacacagaagctgtcagagtggtcacaaagcataagctttcccagcccatctgaaagtaagaaagatgagtgtggaagaactctcttgggccyggaaacacgctctgcggaaagagatggacaggaaactctggatcacgcccttctgtattcctgggcattaagtgggggctccttgtgtctctggcagcct

SEQ ID NO: 34562 - DNA, 201 bp, Bos taurus
tttatttattactttgctatgatctgaatgtttgtcttttcctcaaattcatatgttgaagcataatcctcgctgtgatggtatgtggagcggcggccttyagaatgtgatatggtcacgagagcaggaccctgaggaatagggttagtgcctgtattaaaagacaccacagagctctttgccttggccaccacaggaaga

SEQ ID NO: 34563 - DNA, 201 bp, Bos taurus
gacagtgatcctactgcacacttaaaatatttttaaatgccttaggaaccatggagcaagcagtgttaaaaataataatgtaccaactaaagatatttagygctctgctaagacaggaggcgatgcagcagaatgagaaaatctgcagattgtgtccacaccatgcgtgttcaagctggagccccacctcacacggggtct

SEQ ID NO: 34564 - DNA, 201 bp, Bos taurus
aggagcctggtgagctctagtccaaaaggtcgcaaagggtcagacacaactcagcaactgtgcacatgcgctaagagagcacggctgaaccattctggccrgaacgctcttcacagctactcacctacagcagcagcttcccacccaaggggcaaatgtgtcacccagggtctccaggttggaggccagagggcagaaggt

SEQ ID NO: 34565 - DNA, 201 bp, Bos taurus
tgaggaaggagagagaaaattcacaaaggaaaatcctagagagatgctcagagacagcacaacagaggtctgcagcggccccttcctgtccagctacactygtgaggggaaactgtccaagggactgaagcaccacttggaggaactagagaacacagtgaccagggcccacacggggccaggagtagctcctcctcccac

SEQ ID NO: 34566 - DNA, 201 bp, Bos taurus
tattatggagagacagtttgccagcaaactgctgtatttaacccaatttgagttgctggaagaacccagaaggttgccttgtggaggatggatggtgattragaatgctgtggagggcgagaggtggaacttgaaagcagaatatacatcacgaaagcacaaataaatttaatgagagaccagggtgtgaaatatcaacaa

SEQ ID NO: 34567 - DNA, 201 bp, Bos taurus
taactgactctttttgtttattttatagtggtatttattatatcctctggattttccagatatttttattttgtacacgtaagaactcccaacttttcagygtgataatattatagcagtttaagtggcacccaaataatttctaacaatcactccaaggctataataatttaaatatctatttaacttcaaagcaaatca

SEQ ID NO: 34568 - DNA, 201 bp, Bos taurus
cgagggatcaggtgtgtttgtgggctttgcaaagaccctagcacgactggagagctgagtgcaggaaagactgaagccctttaaacggatggagtactcaytattcaataacttaccttgtacgtcatccaaagattgaatgagattcaacaagaaggaaatgggtctcctctgttctccgtgaggtgacgcgtgaacaac

SEQ ID NO: 34569 - DNA, 201 bp, Bos taurus
agcaggccactccaaagaaacagatcctcctctgctttttaacaaaggacagtgctgataagtttatctcaaatactgttagagacttcagacaaatactrtgtgagagcaaacaggcccaggcttgcttgcaggaggattagagaacagtcttgaatgacattgttcttcaggttcctctgggtctagaaagctgtgagt

SEQ ID NO: 34570 - DNA, 201 bp, Bos taurus
tccagggggactcctgagactcgatcccacctttgcgtatgtcgagcctccttcctcatgacctttgccacgggcggagcgcctcacgccggcccccgacragtggggactgacccagtcctcaaccacgtgtggaaagaactccgctctcttgtgcctcccaccggccttcccatagcaccagctgaatcatcccatgtc

SEQ ID NO: 34571 - DNA, 201 bp, Bos taurus
ctgagtcccacctgtgctatctccttagcaccccgtgtgcggcgaatctcttcctctccatcactacggccttggttcaggcgatctctcttccttggtcytcttccagaacaactgtgtttgttctcaattgctgctgtaataaattgggaaagttagtggcctaaaacagctccaacttattatcttacagctcagtgg

SEQ ID NO: 34572 - DNA, 201 bp, Bos taurus
cttgcccggtccagcagccaggccgcggccggggtccacgctccggctgcagccgcccccaggagccacgcggctggggcaatcccccgttctccaggccrggacattttaacagcacaccgctcctccctgccctcagttacagttcgccctgcaccccagggctaaccggaacagaaagcgcctggcacagggaaggcc

SEQ ID NO: 34573 - DNA, 201 bp, Bos taurus
ggggcccagaagctgtgcacttagttcgtaggctatgtgcctttactaaggtaaatactgactcccctgggctaggactgaaccgtagagtatttatgctstatcatatttcaacactggccactgtagtctcccccagcagaactaaccatgagttagtacttttatttctaaatgacattatgatggtcttcctatatt

SEQ ID NO: 34574 - DNA, 201 bp, Bos taurus
tgttacttcctcgaagaaacaggctgttctcctgggatgtcttctcactggatgttccaaggacttgactccaagatctgccctgtaactgactatggttygtatagttttttgggccttaattttcccatctctgaagctggaatttttttcttgtttattaacaatagcaacaatggaattatggttctgtgaagcctt

SEQ ID NO: 34575 - DNA, 201 bp, Bos taurus
ccttgcattacatcagggtccattcactggattgatggatactcccatgaccacccctaacttgcaaagggtcagcctcatactgaagatgcatcacatcmatggaccccactgcggccgttttcatcgcctccaccgggtggcttcgcttaaacagccaaagggaactcagatgtgctggcccgatttaggataagggga

SEQ ID NO: 34576 - DNA, 201 bp, Bos taurus
tttctttttcccataggaatctgaagaactctttcaggatacacagtttttaaaaaagcattcttgccgagggtctttatatcaaaaatacatagctcctytcttcaccagaaacaatggaagctttccaggaagttattgtcagtgaccactggaggtggaaaacctccaaagaaccatccatagtctttacgaaatgac

SEQ ID NO: 34577 - DNA, 201 bp, Bos taurus
cctcatccaagtggagggtaatgcatttttgattgattctttaaggttttttttttttttccccccaaaattcccaaatttttgtgtgtgcagacctgccytcctactatgactaattcaaaatggccataataggttacaactgaagcaaagttgacatgagttgaagcagtcagactaaataatggggaaaacatttga

SEQ ID NO: 34578 - DNA, 201 bp, Bos taurus
ccctctgtgaaatacagttctattttgcatacacagtggtatgcaatggcattttatataaatggtatttcatcaataccaattacttgtcagatagcccktttctttatgggccttataagatgatagtgataaaaataacaattggctggagttttcatgatgctgccaaaagtataaatcttgataacctaatgaatg

SEQ ID NO: 34579 - DNA, 201 bp, Bos taurus
cgttgcattagcactgagctaggaaggtgctcaaattaattgtgagtgaaaaatccatgcttgagactcataaaatgcaggaaatgacttgctttatactrggggaaaggcagagtcataaactggcaagaagagggagagataagtcatcaaagggcagtagcaatgccaaagtgcgtaattggagagaatctgtccccg

SEQ ID NO: 34580 - DNA, 201 bp, Bos taurus
ttcaccgggtggccccaggctccgagctgtgggcagcttttgttccttcatgaagcaccaggcacagatgagtaacaactgatctgaagtgaatcgggtgrggccatgttcacagcaaccccgacctgtcaactagctgctgaaactctgggttgcgtgtcgcctccagcactacgcaaaaggggccagcctgctggctct

SEQ ID NO: 34581 - DNA, 201 bp, Bos taurus
atggcaaatgcacacagatgtgaactcaccacccactcctgcactaagggagacatttctactgaagcacagaagtctgactcacctaccaaatccctctmaagacaggtctccagacagcctcgcccacaggataggcgttgatgttccagacggaactaggagtccccccgggacgtggttctcctccaggacttctcc

SEQ ID NO: 34582 - DNA, 201 bp, Bos taurus
tgataattctttgttatgagcggtgggttagagaaatggtcagttctgatggacacattcaactattaaagggagaatattttcattaatgtattagcttrcacctgtccagttttaagctaaggtcagcatagtgagatattcctgccgtgacagaacatcatggtttataaagactgtgcacacaccgccatacttgat

SEQ ID NO: 34583 - DNA, 201 bp, Bos taurus
gccggaatatctgctaaaatgcagattttcaatgtgatgtcaatagcattaaatgatgtcagtaatgaagtcagtgtggccccctaaataaacctaaaacraaaaacacggtccacacaggtatggacaggaagccttgtgctctgtatgcagtagcatgaaatagggctacaggggcgagggcaatgccaggcccagcgg

SEQ ID NO: 34584 - DNA, 201 bp, Bos taurus
tctctcccctagtttgtctccttccactgaagaaatttgctccaaagatgtaaacaatgtgaaggaaagaatacggagagcaggccacacgaataaccttktttataggtttctgagcacagtttccaactaatgatatatatatatatatatatatatatatttatctataggatagatcatgaaatacatcacccgaca

SEQ ID NO: 34585 - DNA, 201 bp, Bos taurus
ccattcggggttgtcagcgtgccagacttcggctgtttctctttttattggctgttgttaataggtgtgtagtgatttctcatcatggtcttcatttgcarttccttgaaggcatatgaaatggagcatgttttcacatgcttatttgctacttgtatatctcctttggtgaggagtctatcgtggtctttagcccatttt

SEQ ID NO: 34586 - DNA, 201 bp, Bos taurus
cctcttcttccagaaaggactgaaagcctatcaggtgacatcaagacacggaaccaagcgaaacgctcgaggatggaaaacctccgtgtgtgttagcagartgctttcagacgggccacagcagggctgctgctgtggtccaagggtcatcggcacgtgctgcgggtggaactgcgtcccttccaaaaatgtactgaaggc

SEQ ID NO: 34587 - DNA, 201 bp, Bos taurus
agaagggaacgtgcatacgcctagagaagggcaagaccagccaacacagtccggacaggcctcccagcacccagggcccagacaggcctcctcttgtctakgtctaaagactgtactgatggaagacatttttcatgctgctgtgaggggatgactgtgagtcagacaacaaggaagactaccacgtacttggggccagag

SEQ ID NO: 34588 - DNA, 201 bp, Bos taurus
ctccggcccctctccttgcccctccccctggtctgcgcacgccattcctctgcgcatgtctgtgccctggtcacctttctcataaggacgcaactcatccrggatcagggcccactctaacgatgtctctgtcatctaatcacgtctgtggaggccgcttctgcaaacacggtcacattctgagccccgggcagtcagggt

SEQ ID NO: 34589 - DNA, 201 bp, Bos taurus
ggcaccggctgagacgtgtgtggagggtgtggaccctccccgatacagagccaccctcggctggacacgctgcgggcttctctggccggcctgagcacatmtaaggcagagctgtgggtgcagcaatgggcactctctcctgctggatcaaggactttctctccctcctgctctcccagaagggcccgcctgctcctccag

SEQ ID NO: 34590 - DNA, 201 bp, Bos taurus
gttgtcatttccttctccaggggaatcttcctggcccagggatggaacccaggtctcctgccctggcaggcagagtctttaccgagcatttatttggccayagcttaaacagggaactcagtctaaatgctatcttgctttctaaaaatatagctagtcattaaagtactgtgcctctcccttggggctgattttggcctg

SEQ ID NO: 34591 - DNA, 201 bp, Bos taurus
gaggggaggccgttttccctgctgccctgtcacttcctgtttgccctgggtgcctcctcagtgctgcctaagctgtgctgagtgggcgtctgtaagctccktgggagctggcctgctaactggtgtgccccgcggtccctggagcggcgttgagtctgcagactgtgctcagtacgaggccagggcggcaggagcaggctc

SEQ ID NO: 34592 - DNA, 201 bp, Bos taurus
atgagtttgagcaagctcctggagttggcgatggacagggaggcctggcgtgctgcagtccgtggggtcgcaaagagatgagcacgactgagtgactgaaytgaactgaaccaaggtctatggcctgaaccacaggggttgaagggatttggttgcctggtgctgaaatgagcttgtggatgagcaactttatggaaggca

SEQ ID NO: 34593 - DNA, 201 bp, Bos taurus
tctaacctggtgtgtatttcgctctcgcgatttgtcacagcttgcatgagccgctttcacctgacaagtggccggcccactggacagctgagtctcagcayaaaaggggaaagctcggtgccaccgcgcattggaagttcagcagcaccgacccggtggcttggacggggtcggggtggggcctccagcatctggagctgt

SEQ ID NO: 34594 - DNA, 201 bp, Bos taurus
gaaaaaaccagattggccttaagaaaagagtttccaagtcaacaccctcctgcggcatccagatctcaacagaagggcctggtggttccaggccaagcacrcctgccctgagacccccacgggaatggcacgtgggtcctcgtgcagagcagcactttgccgagaaggaggtgggccgggggttggggggagcaggatgtg

SEQ ID NO: 34595 - DNA, 201 bp, Bos taurus
caaaaaagtcctgagaaaaacccttgtgaagtggctttgaataaaaccactacttacagtctggtacctgatggcttaggttcaaatcttggccctgacaygtcccagcttggggacctgtgaagacaggaatttccttctcccctccctgcctgggactgtctacagggccgggacagtaactgaatgtgggatgcaggc

SEQ ID NO: 34596 - DNA, 201 bp, Bos taurus
gctggggcctttggtgaccagcccccgccctgatggagggacagaagcacccagcaccgaacagcagggagcaagccacctcaccatcaggaggggagcckaggccgccagcaacaaccctccccagtttctgcttttgctcagaaggtcgagagagaaacacaccgtggccaaccctagaagcaagcagcagcccgggtg

SEQ ID NO: 34597 - DNA, 201 bp, Bos taurus
gccccctgcctgcccacctccccctccaccctctctcgggcgtcttcagatgcccagggccctccaggtgcagctcagcgggcagaggccccgcctctccrtgcagccaggtgcctgcactctgactctgcacatgaattcattcgggttcatctcctgaaatgctcccaggcgggccatcccaccgctccgtcctctgag

SEQ ID NO: 34598 - DNA, 201 bp, Bos taurus
tcttggcatcctgagaggcaaagagaagggcccgcttgagtagccccgagtcgccacggaggggagtgttggaaacagaaacgctgggtctccgtctgagyagctgcggggccagcaattactctgtttcaagagacttgctctcactttcgcccacagttaagagtcaagtggtcacgcgcagattccgaatctctgtcc

SEQ ID NO: 34599 - DNA, 201 bp, Bos taurus
gagatagtgctcccgctcgaggatgataacgctgagcagcgaggtgccagtgccaggagatgaagagggtccatttcggagaattctcctccaaggctccrggccttggctatctcctaacgtaaacacggactcttaaaaatgtgaagaatctgcttaatgtgtaaaccgaggtgatgggggcgtaggcctttccatttg

SEQ ID NO: 34600 - DNA, 201 bp, Bos taurus
gggtggggcaggctccttggagaccaggctcctccttgtaggagcaccttccttttcacttctgtggcttggttttgcagcttggccagagttatgaaaakattctactaatccccagctgtattcatgcttttattctgcagaaacatgggcagggaagcaggcgcctgtgctcagaatgtgtatggaggccgtgcaggg

SEQ ID NO: 34601 - DNA, 201 bp, Bos taurus
gaacctcattcactgcaacatctttttcttttatttctcctcaaagtatgtttcaggcttctttccttaggaaaacaaatctttctttgacccaatcatcmgtttaaataatctctcagttttcctttgccacggcaaactcctcaaaggggacctctctctgagcagtcttgctcagaagatacagtgccttacctttct

SEQ ID NO: 34602 - DNA, 201 bp, Bos taurus
ggaccctcttagctgaaagtctcttgcacgtgttcagtgggtaacggcagagctgagggccggcagcccatctccaggcccccgcaggggacgctatgccycttccgtcctgtgtgtttggagagtttggagcgggtcgggctgcggtctctctccgccttctgcccctcggccaggtggcacatggagagaccagggcgt

SEQ ID NO: 34603 - DNA, 201 bp, Bos taurus
gagtttccatgcccacggccgggcaggtccctccccccgacctcctagcgagcctcctgccagcgttatcacctcgtcactgtcattaggacgtttgctcracctgtcctccaaggacccagggccctgtggtttcctcaattcagcgtatgtcatcaggggaatattagaccatctgccaaccagtaggcaagagcagca

SEQ ID NO: 34604 - DNA, 201 bp, Bos taurus
agcctctcgaggcccttccccgggtctggcctcgtcctcctccatgtgcgcacaccctcctgttcaccacccaaatcaagctggatcttcgcctccacccrtaccctcgggaggcctttcctgcacccgaggcttcaaacatgctgtccctctgtccatctccccctgcagcccccacggttcccccctaactgaggccgc

SEQ ID NO: 34605 - DNA, 201 bp, Bos taurus
aggctgtgcttcgtacctacagcaggttgggaggcaggccctccaggggacactcttggcgtggtccccggaaacccaggggctcctacacaggccaacaygtacacggtgctgaaaacaaaaggagacgcagggtccctcctgcggatgcaggctcccacccggcgcccctccaccttcagtcacgtgaacgcaccacac

SEQ ID NO: 34606 - DNA, 201 bp, Bos taurus
tccttgccctctgcctgacatgagggggtggtcctcccaggccgtactcacacctgtccagccgcacccagcagcccacactgagccaggtgcgccctcaygggagcgtcggcaccgggcccctggcgtccccggactagacagccacaatggacgggaaacactctcagtctaaagcgcaaacacagaccctgccagcga

SEQ ID NO: 34607 - DNA, 201 bp, Bos taurus
atggggacctggaggagaagaagggcccacagctctgcagccctcggcccaggctggatgcactccccaagttcagctcgtgtcctggaacctcagcctgyagcctcacctgggcgtgggccgtcctgggggccgctctggagaaggctgtcccgaagaaggctgggaccaatcccgggactggcttcctcacaagagggg

SEQ ID NO: 34608 - DNA, 201 bp, Bos taurus
ttggggccctgcctgagctcatctgcgtgggcccctctgcctgcaggggggacccccacgacctttgctccttctgtccagcttgtcccccggggcactcrggcccactcggctggctcccctggtgcagagatgcccctcaggacttgagatggagcacgccggctcctctgcagtggcctcatgctgggctggccgctc

SEQ ID NO: 34609 - DNA, 201 bp, Bos taurus
gcgaactcctgaacctcttgctgcacgtcagagttgggtgctcgggcccaggaggcccacgtgtgggacaggttttgtttaaggcctgtggtcgcccacaygtcaggtgtgtgcttaaagctgccgtccagtggctcctagtagggacaggaaactgtgactgctctctggtgaagtgtccgtacagatggcagcctgggg

SEQ ID NO: 34610 - DNA, 201 bp, Bos taurus
ggtctttgaagatttcacaggccacagggcgaagaagcccatttgccacaatgactgagtttgtgcaccaaactacctgagtcactcaggctctagacccygtgctccgcaacaagggagtggcctctgttggccgcaactagagaaaggcttcacgtagcaaagaagacccagcgcagcaaaaaaaaaaaaagcgctcat

SEQ ID NO: 34611 - DNA, 201 bp, Bos taurus
acttgttattggaagaaaatcaagccttaagttaaaaagttttagaagtacctctaggagtatttaaatccctttccctataaatcaagtatgctttcttrgtggtaaaagaatgaaaattagcaacttctagcattcagactatataatcagactgttagtatacagaatatgtaacttttagtgtagaaaatataaggc

SEQ ID NO: 34612 - DNA, 201 bp, Bos taurus
ctcatggcaaagaagtgaggccttgtgccaaaagtcagaagcaagagactatgagtgagccatttagaagtgaatcctccagtctagtcaaacctccagaygactgcaggcctgactaacagcttaactaactttatgagagactgtgagccatataaccaattatgacattcctgaatttctaccccagagaaactctga

SEQ ID NO: 34613 - DNA, 201 bp, Bos taurus
attagtctccacattgcacctgatcatttcttttagggcactgaacatatttctcaattatctattcattgcttcttcaccattcagttcactaaactgamttccaccagggagggaagatgtttaacttactccatgcctagcaccatgcctggcatgagtgatcactcaatatgtgtgctgtttttaggaatgtccagt

SEQ ID NO: 34614 - DNA, 201 bp, Bos taurus
aagattaccagggccaagtgtcaggaatcataagcaagagaagccagggacagagctgaggatcttgctaacatgtgggttctgattcagtaggtttgggrtgaggcctgagactgcattcctaacaagactccggacactgcctttggtccagggaccacacttggaagaacaaggttctaaattcaggtctgctgttga

SEQ ID NO: 34615 - DNA, 201 bp, Bos taurus
ccccgttctcatcaagcagggttctgctcaggtgccactttctctgaaggctctctcctaatctgaattaagcctgcatttcattgcaggagtttctgtaygttcctgcccacctcaccctgggagcaatatcagaagatgatgagggcgtgagtcttggtcatagataactcttgcttcaggtctcgcttccatgtgtta

SEQ ID NO: 34616 - DNA, 201 bp, Bos taurus
ggtagcaaacatggcagagaaggccagcaagacacaggctgaaatgtatttagtgggtttgacatccaaaagaaattggtgtcctttgtgggaaccaggtrtagtagattgatggtgtctggccttggctcaagaaaaggaggggcgaggaggtaaagatgcagaaggccagaacaccggtattctttctagtgagaagga

SEQ ID NO: 34617 - DNA, 201 bp, Bos taurus
acagtcacccatgggggccctaaggctcccagtaacacttttcttaaggtccttcctgctacctcatcatcaaaacacataatggagagttgacaggagcrgggccagatcaggtagggccttacagatcatcataaggagtttggattttaatttgtataagaagggaaacaactggaggatgtagaggagagtaagctg

SEQ ID NO: 34618 - DNA, 201 bp, Bos taurus
tggaaggtattgtcatggggcaaagggataaggaggagcggagtcatttgtttggcatggtttattcaaggaaggcctcatggagtgggcagtgtgagagragatggtagaactctcaagacagaggagacaggcggcaacacacgcgatggcaatgcagatggctcagtgcagccactgcaggcctgagcactgcaggac

SEQ ID NO: 34619 - DNA, 201 bp, Bos taurus
cagtgtacatatgtcaatcccagtacgtcccagtccatcacaccctgccccttccccccactggtgttcatacatttgttttctctttcactgcagcactwcttacagtagccaggacatggaagcaacttaaatgtccatcaacagaggaatggataaagaagatgtgagacatatacacatgaaatattactcagccat

SEQ ID NO: 34620 - DNA, 201 bp, Bos taurus
gggataaatgcacataagtcaacttctgggttacagcctttaaaaaatggattccctcttctttatcttttccttcttcctattcactggattgtagatgygttactggccagcttcaatcaggtggatgaaaaccataccctgatgcagaggttggcagactttttctctaaccaggattctaatctctgttgaaactac

SEQ ID NO: 34621 - DNA, 201 bp, Bos taurus
agaattcaaatatatttttcatattatatttgtgattggagggagaagactagcacatgaactatcttaggtattgccaggcttttgctgtgaaaggccaygtagtgtttgaggctttgcagaccaaatggtatctctcataagcactcttttctgcctttgtcatgcagaagtagctatagatgataagtgatggatgga

SEQ ID NO: 34622 - DNA, 201 bp, Bos taurus
agagacaagaaatagattctcccctagaaactctagaaggagcacagtcctgctaacatcttaaattggcctgatttcacactcctggcctccaggactgygagaaaataaatttctgttattttaagccactaaatttggagtaattgtcactgcagccagaccttggtattttgatggttggcctgaatttagtgactt

SEQ ID NO: 34623 - DNA, 201 bp, Bos taurus
ttagcagctgaacagcaacaatgtgatcttggctacatcttctcaatgatatgttttgtacactttgtactacacatgtcatttccattcctctactttgycctctaacttgattgtccattctgcaggtattgtttgctcagctcagcatgctttctaggtccctagatgtgaccttgcttttctggactcttccctaca

SEQ ID NO: 34624 - DNA, 201 bp, Bos taurus
ccctctgagaatctatatttttggtcttagaacaaatcctaggtcctgtcccataggctaggataagatttcttaacaagtaccagatgccaatatcttargaggtcagcctgggcccacactcctcacattctctggtatatattgctttacaatgtcaagctgcctctaattccattccaaaaggcaaatatttaatga

SEQ ID NO: 34625 - DNA, 201 bp, Bos taurus
aggagcctggagagcatgtggcagtggattctagggtgctggaacaagggatttgaacaagggtgggagagatgagacatacagctcagatggccaaatgmattgctatgggcttaccatcaaagagctaggatctgaatgtgctggttcaagaagtggaaccctgagagacttaccctctgcaggcctaccaaatctaag

SEQ ID NO: 34626 - DNA, 201 bp, Bos taurus
cctgagcctggtttggcacgtcagtgagccccagtctcactttctctcagggggagtgcttgcagctctctaccttatgtgatgggttgaccagatatccrgaggcactgtggcacttacacctgtggaatcatctcaggaccttgtggtagcagggctcatatgaatgcgccctgatccggaagggtagcctggggggat

SEQ ID NO: 34627 - DNA, 201 bp, Bos taurus
agttggtgatggacagggaggcctggagtgctgcagtccatggggtcacaaagaataggacatgactgagcgactgaactgaataagaaaagggcttattktgggccttatgaattacgattctggagataaagatttcaggtaaaaccaaaagagtgttccagggatgagaaagaggggtttataaaggcagaagacatg

SEQ ID NO: 34628 - DNA, 201 bp, Bos taurus
ccccttaaatcgtttctccgttggggattacttattcccgtttgggggcctgggggaaatggggatctgtgtctatatctgtgttaaaactttgatccaakaagacagtggagtttcactgttggccattttctccgtaatcccagtgaccttcaaggagataaacaggctgataagaaaatgcgagatctttaaactctg

SEQ ID NO: 34629 - DNA, 201 bp, Bos taurus
atatttcctgagcgtagccttgtgttcagccaaaacaagtgacatcttgggaaacatttcttgggaaggagacgtgcattctagttgcctgtggccaatakgtttcctctcaccatcaactcctgttggttggttgtccatgtagcacagctttgagacggattctggaggccactttcactgtcttaggaagctgatctt

SEQ ID NO: 34630 - DNA, 201 bp, Bos taurus
gtatttgatatattgtctgaagagctctggtagtgcagagctagatgcagtctcagaactgcttggcaagtctgggttcatcagttagagcatctgcaatrttaaccttgccatttaacaaacaagcaaaaatagacttgttacgtaaatgggaggaactggagagggaatctattgtgaccttggtgaagaaaattccag

SEQ ID NO: 34631 - DNA, 201 bp, Bos taurus
cacccctagctcctctcccagtcctcacagaatttaaggttatgacacacactgagagaaagttaaacaaagccggggccgggtacctagccttagggackagagcctgccccggagatgagatggtggggcaggaagcaaggagaaggagccggtgtggaaaccctctcctttgcggccctttcagattcggcctcgttt

SEQ ID NO: 34632 - DNA, 201 bp, Bos taurus
gtcaccgagtattcttctgccgggcctgttcacctaagactatactctgttgtgtcactttttacccattgtgtgggctcataaagtacgttgtagttggygctgcttttggccccaacatagggatgctggcaatcagccccggtgcctttcacatttcgtttttcacaagaccaccagcacagatccacaggagtaaga

SEQ ID NO: 34633 - DNA, 201 bp, Bos taurus
cattgagcatggttcagctttagttggtccaacttcaactgcattggctcaccttttttcatctttgtgaggatacacaactctccaccttatctttcctrttagcttggccaatagagagtggattacatactttttgaccaacccactatttccccagatggctttggtagcctctgctggctttttccaaaatgtccg

SEQ ID NO: 34634 - DNA, 201 bp, Bos taurus
atatttctccttcactgtctgactgacttcactcagtgtgacactttctaggtccatccatgttgctgcaaattgctcatcatggatcctgtgatctatcrgttccattcctaggtatatcctataggcaaagtcacaggtgaaggtgttcttggccagtaccaggagtagggggaagtaagggaagatgcctagtgctca

SEQ ID NO: 34635 - DNA, 201 bp, Bos taurus
tttgtcatgtcctgagcccgccggcacacacaggcccggctggctttagcaaagtgcatgaatgcagcagggctcctgggaagcggccagcgtctggtctkactgcctgagcatcacccagagaccaaggagaaatgggaattctcagcccgaacccagacctcctgagtcagaatctctgtgatcagggccaaggtatct

SEQ ID NO: 34636 - DNA, 201 bp, Bos taurus
aatttggaaaaagtgcactgaggatggcagagcaataggacagggggagactggatccccaaaagtgtgaagccaccctatcaggcctgtactgcttataktcagatggcttcatgagagaaggtgaatttatatcttctttaagctactattatttgggcctttgttagcagccgtaccaatatcataagtaaaatatca

SEQ ID NO: 34637 - DNA, 201 bp, Bos taurus
cttggctcatggccgcttcctcacatcgcatcgccctcttgctttcactgttacatctcctcttggttctaatcctcctgcttccctcttacaaggactcytgtgaatacactggcccacccagataatcccacataaactccccacctcaagagcctcaacttaatcacatttgcacagttccttttatcacatgaggtc

SEQ ID NO: 34638 - DNA, 201 bp, Bos taurus
tatgacacaaatgaacttatttacaaaacagaaataaattcaccaacagagagaacagactgatggtggccaaggaggagggcctgggagagagatggggygggcggctgtggttagaagatgtaagcttttatatggagagtggataaacaacaaggccctactgtatagcacagggaactatattcaacatcctgtgac

SEQ ID NO: 34639 - DNA, 201 bp, Bos taurus
gaatatcctgttatcagaggaaaggggaaatggatgaaggatgctgggcagcaaaacctagtcaacaaaaatacgtttaacaaaactatcgggtcacctgsatcaacttacattgttggaagtgggtcagtcagcactttgctggaagtctccaagcccaggctttagaggttttcacggaggtttcactacataggcaca

SEQ ID NO: 34640 - DNA, 201 bp, Bos taurus
tccaagctccttctctacaccactccccctccaaaacatgctctcagctaccctttggacctgggagcataaacactgtggcctgatttgacctcacagcytggggcacggaatatccagataatgatctagaaaagaggatatgggatccaggtggacagaggtgaagccagagcaataaaagtgagtcctcttgcctcg

SEQ ID NO: 34641 - DNA, 201 bp, Bos taurus
atggctgcattgtatcggaagagagcgccctgctcctgcggtcctggtctggaggtttaagaatggaaagaaggcaaggtatggatgttaagtagccaaaygggcattctgtagcaggtacagcagacaggctcaaccaaatttatgccaacttccttttagtgaaccttcccgtactacaagtactaaaagctgtatttc

SEQ ID NO: 34642 - DNA, 201 bp, Bos taurus
ggattttcctgtgttgttattgttcacatgatcgagatgttggcttcaggtatagctagatctagattctcaaacaatgttatgatttctttcaatatgaytcaagtcttctttctctatggattatctcagaggatttggcccacaatggtcaccagcagcaatttattccccagccactccagaataacttacaagaaa

SEQ ID NO: 34643 - DNA, 201 bp, Bos taurus
gtcaggggtaaaccatgaagggcctctaatcttcatgcgaagtcagggagctggggcttctgacagctccacatgggcccccagaggtctacatcctcacrgtggaacttgagaacattatgtggcaaaaaagactgtatatgtgattaagttaaggacattaggatggggaagttatcttgggttactgcagagggccct

SEQ ID NO: 34644 - DNA, 201 bp, Bos taurus
ttcatatggtatatatgtatttgcctattcaaacaatatttactgaatatttacaatatacaaggcattagcaaactttctgtaaggggcctgatagtaamcattttaaactttgctgacctcatttgatctctaggacatagccttctttgttttccatataatcctataaatatgtaaaaatcacttttaggtcagggg

SEQ ID NO: 34645 - DNA, 201 bp, Bos taurus
agaaatgttaacacaaggtgctgcgggcacaattggacaaccatatgggaaaaaaataaaccttgtcctttatctcaatacatatacacaaaataatttgragtaaatcatgggataagcatcctataatccagtaatcctattcctggagaaatcttcacccaccggtaccaggacacacatacaacgttactcataaca

SEQ ID NO: 34646 - DNA, 201 bp, Bos taurus
aaactgtggttacttcttgaggcagtggtatggtatggagtaggaagaggcatgaaaaacctggggggttataaaagttctacattttgatttgagtagtkgttacaggggagtatacatatgtataaaactcatctaggagtacatttaagagtggtacacttcactgtatatatattaaaccttaattttaaaaaatga

SEQ ID NO: 34647 - DNA, 201 bp, Bos taurus
tgtgacacctttgaagccaaatctgaaatagtatcaaatctctataactttaaggtacttactaaatatgcaccctggtttcctcatctcttatgaaaatkaaatagggtaatgagtgttaaatactgtaagatcaaaacacttttacagttattgcatttaaaaagatttaacaagctgttaccattaattttattactt

SEQ ID NO: 34648 - DNA, 201 bp, Bos taurus
caaaacaggaaattgccagcgttcttcctgctggacagtgacttatattataaatgacatttttttattcttctttaattcaaagtaaagcagcagtgacygagaaggtaccatgtgccaagtgttggcttttgatgttattttgtttaatccccctccaacagcatttttattccccatcttacaggtaatgcagttgag

SEQ ID NO: 34649 - DNA, 201 bp, Bos taurus
actctggcctggagaattccatggactatacagtccatggggtcgcaaagagtcagacacaactgaacgactttcacttcacttcacttttatgaaataakgggcaggggccgctttaaacaatactcacctccagccatgaagggctccatctcatactctaaccctcactgaggctgctttgtgcttccactgccctgg

SEQ ID NO: 34650 - DNA, 201 bp, Bos taurus
ccaggggcaaaggaaaggaacggaagaaggaagagaggatatgagacacagggggcttctcaatgaggggaagtgagacaggctccctccctccccagagmaaaccttttcctggggccccagataaggtacagctcctgctaagatgctactgaagacagcagccaagtttcctctcattttccagtgtaagccccttca

SEQ ID NO: 34651 - DNA, 201 bp, Bos taurus
aaagagtcggacaagactgagcgactgaactcaactgacctgaatattccattgtctggatgtaccacagactgtttatccattggcctcctggaggacaycttggttgcttcagagttttggcaatgatgaataaagctgctataaatatctgtatataggttttcatgtggccataagttttcaactcctctggtacat

SEQ ID NO: 34652 - DNA, 201 bp, Bos taurus
ttactgcaactggagaaggcccacacacagccacaaatagaatgatccttaagataaagaaaagtcatttagaaaacataaaatattttttaaaccattayggccatcccattgtctgtctcataccctttgcttttgctttctagtctcagaatatagactgtgttgattcattcatcagtccttctaagacaatctcta

SEQ ID NO: 34653 - DNA, 201 bp, Bos taurus
cctggaaaacaatattttcagttgatctgaagccagggtccctacaggattaggtgtttgcctctgtctgcccacctgcctgctccttccttcaaccggtygactggccacagcaaagggcagaagggattgtgcttctacagagtgcagacccccaagaagtcagagctggaagcgtccggttgcccactcctcacgggc

SEQ ID NO: 34654 - DNA, 201 bp, Bos taurus
gctttgtagatggacataaagttcctaaggaaacattctgtttctctttaagctgccttttccctggttattgaggaataaatcagacttatcagacttamacttcaaaggagggaatttcaaatcaccttcttttctagcttcttttgtatgataatcagagaacggaggaatgatgataatggtaataatgtcaaaagg

SEQ ID NO: 34655 - DNA, 201 bp, Bos taurus
ctctgctcttcttgctccactccatcctgcacaggcttccggttcctcagggcctgggcggagagagtgagaggtaaaacctgggacacggggcctttttrggtttttaacttccttggtttaagtaccttctcttatggagtactttggttccctgctgcaaggtcctctgtagatgagcctccatggtatggggactct

SEQ ID NO: 34656 - DNA, 201 bp, Bos taurus
atgcaggcaaggcccagaagtagtggtaaacctagaaatctaacagttaaacacctgcaattgtttctccacccaaagcgtgagttgttatatacataacraaaatctgaaaggcctaaagagcttttagcagattcacaaaaattacagaagcaaaagctggtgatcaggatccaccaaaaagcaagatgcctaactctc

SEQ ID NO: 34657 - DNA, 201 bp, Bos taurus
tgcagcgaggccagcccgtccctggggcctttccatccccttgctttttactgcatcaaccttcagggtgtgcgtgggtttggagggtgacagagaaaackgactaggccagcgggcatctgcttttcttctgactggcctctcttcctggggcctggctgacctgcagcaggcccagctgggagggggaggaaaggcatc

SEQ ID NO: 34658 - DNA, 201 bp, Bos taurus
aaactggtgagtgttcatgagccatttcttcattgtcccttcaaaggtttgtcctggacacagtcctgcttgactggcaggtgaatccgttcacaaaccartgagccatcaccccagctccaactatgcagccacccgttgcttcaccgtcaccacatctgtgagctctttctttagttgccattaaaatgacccctttca

SEQ ID NO: 34659 - DNA, 201 bp, Bos taurus
aggcggttgtcttctgtaccgtccagagattttagctgtggtccatgacacagacaggctttttgtggctgcgccatgctgcccagcgccagaagggtacrtacatgactttaatgaggacaggcccatgggacctgtgatgtctgattttgggttttttggtgtttgttcttgttttgctgttgtttttagtttggcctg

SEQ ID NO: 34660 - DNA, 201 bp, Bos taurus
atatttcttagtcctcagttgacagcatcggccatgtattgcttcagaataggtgagacttaagggtaataacttctgataattgtaccagaactacctargcagaaatacacgaggccgggtattgtgatggtgggttatgaaaggtacccttgcgcctgatgattgtgggactggtgggcagtgggcaaggtgtggctc

SEQ ID NO: 34661 - DNA, 201 bp, Bos taurus
acagaacacttccttactctgtaagatggcccaccagatactctttctgtgaccgtgggattacaaataacaagagctggaaagtcaggtcttcttaaaakgggcagaatggcctcgaagcttctctgtgtttgttggcatgggaagagactgggtggtcaggaaacaacagctgtgacagaaataaaagagctggaaaca

SEQ ID NO: 34662 - DNA, 201 bp, Bos taurus
tgcaccggccctgagcaccctgtctcaaggacattcttttgaatctgatgggcagtgagggggcatttgtacattgcagaggtcacaaagtgtcagtggtrcattcacaaacagtacgtgtggccgtcccagtagttccaagctgctggggggcactggtctctgagatacaaacgccgcacattgcgcctctgcttcaga

SEQ ID NO: 34663 - DNA, 201 bp, Bos taurus
ctattcttgggccttgatagaaagtcaccacagcagccctgttgggccatgacttgggtctgagaacagaagatcaggagtaaagcagaaagagggcaggrtgctgtgtggtgacacgggcccggctgtgccacgtctctgggcaaggagatagttgcctggccacgggccccagagggctggggatggagcaggtggtac

SEQ ID NO: 34664 - DNA, 201 bp, Bos taurus
gagcatcttctcatgtgcctattggccatttgtatatcttctttagagaagtaagacagcaaactcaattgataaatatgtgtatgttctgactgcttcaycaaccagccctttgcctgaggcctccctgttccttgagacacaacagtgttgaaattagtccaattaataatcctataatggcttccctgtggctcagtt

SEQ ID NO: 34665 - DNA, 201 bp, Bos taurus
gaaatactggagaactgtaaacgcacaaaggcacacttaggtcccacaaaggtagcagattgttttgttgacactgtatctcccatcacatccatgctttycatggcattccttgtgtcgtttattactgaccaggaatagacagctggatttgatccaggaggcacatgtgggatcccaaggcagaaattcactactagg

SEQ ID NO: 34666 - DNA, 201 bp, Bos taurus
aaggaagggagagaaccagcaaaaaccagttttggtgtaagcaggctgctaacccctggcaatacgactcagggcagggcctctgtcgacactgggcactytccctgagccagagagtgagttcacgtggaagctttccacaaaggcacataccagttcttgttccatttatgtgcaaactccacaagcaagaggagctgg

SEQ ID NO: 34667 - DNA, 201 bp, Bos taurus
tagcacgtggtaggtgctgtgatattgtgatataatcaggaatatttatttggtcttctacttgggtatgggaggcccagaagacttaatgctgacagctraaatgtgtgggatgccagacagggaggagtgtggtgttgtgggattaggcccctagcctgggggatatctgacatccaggtaatgtcagaattaaactgt

SEQ ID NO: 34668 - DNA, 201 bp, Bos taurus
atttggccagtagagacgaaagtgcacaggagaaatgaaaacgataaagctagaagtgagacttgaacacagatggagttgtagaagaaatcactcattgwgcgaatgttggccctgctgctgttctagagcctctagatatgcagctagaggatctcagcacaggcaagcttatcatcgtaaacgaggaaggttgtaatg

SEQ ID NO: 34669 - DNA, 201 bp, Bos taurus
ggaagaaaggactgaagtaagtagaccagacccggccccggcgttttcggaggggaagaggaactcccggagccatggtcggggcagacggccccggagcragagactccgccccggggacccgagacgccctcaggaggcaacaggggtaccagtaggtgaaagctccgacggctggggcctggggtccgcccctcggcg

SEQ ID NO: 34670 - DNA, 201 bp, Bos taurus
ggccacaccatgaggcacataggatttcagtttcccaaccaggactggaacccagggtcccagcactgggagtacagagtcttaaccactggacagtaacrcaaggcccccagaatgcttgtttcaatgctaattcctgtggattctacccctaatccgttacatcaaaaccatgcagagagcttatgaatctgtaccttt

SEQ ID NO: 34671 - DNA, 201 bp, Bos taurus
gtgcttggttttaattttacaatgttactttgactcttgttaagcaaccacgtttattcttcatatatgtcatacaaagactcaagagctgccacattcargtatttgaattagtgaacatagattcagatactgagtttagacactgtacaaaagcatgcccattgtttagaggcttctaagctttaaaagtgtaagtct

SEQ ID NO: 34672 - DNA, 201 bp, Bos taurus
ttaactccctcttagttctgctcttaccttgacttgactagaacagactttttataacttctttaactgcctgcattttcccaactgggatccctacaaamgatttttctttaaacatagtagagcataaaagggtgtaggaaagtattcaaatagaatcacacaaactaacctctcctccctctcacctcccctctcttt

SEQ ID NO: 34673 - DNA, 201 bp, Bos taurus
agggagggagtagaaggaagggggaaagtgaaacaaacgtgtgcccttggttactggggcctctaatacacagacagcatatggcctggcttagagtcaarcttctggtggttatcaggcagtaaaaggattctttcaattacatctgttcttgatcctgtagtctataaacattttggtgcaaatcaaacaaacaacaca

SEQ ID NO: 34674 - DNA, 201 bp, Bos taurus
gcgctccggacagagggtcctccccagcccgttcctctgggctggcaggagggtttggatgttttcctgttacctgaggccaacagataagaaggaaagtrtcgggctcctggttcttgctgactgtgaaagtcagatggagcctgtttgccatcagcggccactcattcaagaggtcagtcaccccggagtgacaaagga

SEQ ID NO: 34675 - DNA, 201 bp, Bos taurus
agcaggccagtgaaaacagagtgagaactctggctgaagaaccaccatctgagccttaacgaagattccttacaggaagttcaccaacagaggaactgagraaaatcttttaagatatggccaccatcaaaaacattagttttccctagtacattccaagtaaaccaagtaaaataagtaatgtttgtctataagaattta

SEQ ID NO: 34676 - DNA, 201 bp, Bos taurus
ggcgttggccccgcgctgttccccgccgcggaccccttctcctgcagctctaacaagcaatcaaaagcagcctagggactccggcctcctccactgacccsgtgcccatcaccgacacagtccgtccacaaaaactttccgcccgctcgcagcacccggaactacagggccgcgcgacgaaacggaactcagcgcccggga

SEQ ID NO: 34677 - DNA, 201 bp, Bos taurus
aaaggtgcaaacttaaaaaacgttatagtgcgttcattcctcacatcatataccaggataaatttcaaatggattaaatatctaaatcaggagtcaaatcyacctttgtatgatcacaagaatgatttttacattttaaaagcactgttaaatatatatatatatcccacaaaacttaaactatttacaatatggcccttt

SEQ ID NO: 34678 - DNA, 201 bp, Bos taurus
catccgtctttgtcatcacaatccgggtgtctgccctgtgtgctgggtaccttgcagagccagcagaccagccccaggcatgccctctgggtacttagacygaagaggggactgtagagactacccgaactagacagtggagataaaagaggggcagatcaggtaaaggtaagcatttcatgtgtctaactgaaaccttgt

SEQ ID NO: 34679 - DNA, 201 bp, Bos taurus
tcttgcccttctcttcagtagactcccttgttacaggtccttgcgctggggtgaagagtactctctgaaaagcgtactagatgaacagtgagctggcgagmgctggcctccgagccctcctgcatttctactttccgtctcagcccaccggcgttttggatctcaataccaattttaccttttactctgagaaaccagaaa

SEQ ID NO: 34680 - DNA, 201 bp, Bos taurus
cagggctaaagaatcgctggctagagctctcggagggaggtgagaagggaccaagtcaacaactctcatttccatttcatctctgattggaaaggccaagyatcaaggtccagagagtaaacggagttccctttgactctctccttcacgtgtggctgagccccagagtggacgtgatttatacagggtgggccccagaga

SEQ ID NO: 34681 - DNA, 201 bp, Bos taurus
ctggtcaaggtggggagtggggccccggtgcagggagcagggattctggagcctccttttggtcaggtggtcagagaggcctctctgggaagaggccatcygatccacgaggatcaagaggagccaactctgcagattggagaaagctccttccaggcagagaactcagcaagtgcaaaggccccacagcagaaaaagtcc

SEQ ID NO: 34682 - DNA, 201 bp, Bos taurus
tggactctgaggcctcagccttcccattcccaggcaggcaacagctgtgcccccagcctccagcccctctaaagatgaagggagaaaacttactgtgttcrgaggccattccatttctcacagagcaattctctccatctttccatttctttgcaaatcagggcacactcatctggcctggccaacccagaggctgcctga

SEQ ID NO: 34683 - DNA, 201 bp, Bos taurus
gatggcctgctggaaagagtaaggcaggttcttcttggcttgatgaaatgcctgggaagaaaccagccccaactcatggtgtgatccggaagcacttcctrctgcctttggccactgaatgaatagggaggagccgcttcttatcccaccctctaggaggcacctggagcatggagaaataaagggttgggctttggaatc

SEQ ID NO: 34684 - DNA, 201 bp, Bos taurus
tattacagacctctgggaacagccccatcccaccccttccaagaggagaatgaagcatggatgcagaaaaaactggccctggtgaactgaggcatggtccmtgggaaaacctctgggctagggatcaagagagctggatcttcgcccaagccttcccggacctggcctcttctgtagaagggcgggttggatcagatgaac

SEQ ID NO: 34685 - DNA, 201 bp, Bos taurus
ccagctgaggaaggagagagagggacgagccagggccagagtcgggggcttaagaaacagctgggccggggggaaggctagaaggccaagaactcaagacrgtcaggactcttagccgcgctgagcagtgctgggtaaggaaacagacccagagagaagagggcagggactcgccttgctgaggtctactccagaggcaag

SEQ ID NO: 34686 - DNA, 201 bp, Bos taurus
tccgaggggcctgtgggcgctggggcgtccggcccccaggctcgcggtggcgaaacgaggaggtcccgagccgtgggccccgcagtgcgagtcggggcgckggagcaaacgttgctgctgcttctcgttgtactttgctctgctccccaccacttttctgacctaccagcaccgaggcctcagacatttacccagtggaga

SEQ ID NO: 34687 - DNA, 201 bp, Bos taurus
aagccaggaaaccaggaccataaaggaaaagacagattagaacatatcaggtatttaaatgtctccatggtcagaggccctgcaaacaagtctagagacartcatagatgagaagtgtttgttacatacagatagataagagcttcacttttctcataccttcaagacccctcatgcagaattcctacaaactaattggga

SEQ ID NO: 34688 - DNA, 201 bp, Bos taurus
aaaagataataataatgacaataataataggtttatacccatcttatagtcaagcaaactgcagctcgggcaaatgactcggccacgaccacatcagtaaytgggagatctggaattggagcccagatcgtcctgtcatagaagcccaggctgcttgctgccttcctgccagagcctccagagtaggagttgtggggaggc

SEQ ID NO: 34689 - DNA, 201 bp, Bos taurus
agggcacccggcgctctgcacaggtttattggatacctcctgttggtccacccggcctagaactttgcacagccattttgggtttgaaaactggccccccmaaaagggggatctctccgagggagcgagggagtgaccgcgaggccctgcagaaagcaggagggcggtgctttcccggagatgttccacctggcgtcggcc

SEQ ID NO: 34690 - DNA, 201 bp, Bos taurus
aagacctcccaaagacttgacccaaagaggggctcacacttctatcctcttcttcacgcctgaactcacccgaaccacttgaataaacctgaacacagctrtagcctctcctgccctctgctcacccagctcccatcatttttcttcatcatttaaccttttcctgaggctaaagcgaacaggtgaagttagaagcaccac

SEQ ID NO: 34691 - DNA, 201 bp, Bos taurus
gtgtaaatgtatagtgcctatcctagtttcccagtttgtcccaccccaaacgcttccaggttcacgtggaaaagatcagagaaaaataccctcttttgggyaggggaaataaacactttaaaatatgccgtgacaaaggcctacccctcaggagaaacatacattaccagagccttgtctgacctagaggaagggcagtta

SEQ ID NO: 34692 - DNA, 201 bp, Bos taurus
acagagtctccacccccaacacaaaggcccctgccagggactaggagctcccctgctgtctagactaaccagaaactcatgctcactaacggacagagaargaaacttggtggatgatgtggcccatacagttcaagtacataaatacctatgtggtgaaaaggccagacttaacctagaggatgattctctctaagcctt

SEQ ID NO: 34693 - DNA, 201 bp, Bos taurus
tcaaatatctgctgtaccccaccccccagctcctagggcctggcccctatcagaggagcccatttggtgtctgtggctgctctgaggcctcctctacactyggggtccagaaacctctcagttctttgttttcctaaatgaagctcaacctgaatctacatgcctcctaaacctgtttataaaggccaattttgtgtattt

SEQ ID NO: 34694 - DNA, 201 bp, Bos taurus
attaagtcttgcacagcttttgtcaaatttatccctaagtatttcttatttttgataacacgccatttttaaagaattatatcagcaaaaatactgccagytcaggctgaaagggacagagacagtaaaaaaatgaaaagaagtttttgcactcctagaattctgctggtagggagcaggctgataaaacggctcagcaca

SEQ ID NO: 34695 - DNA, 201 bp, Bos taurus
ataaaggctggtagtggagggcctgtcctaccttgggtccatagtgaggctgtggtccttgtaactagtcagctcccagttaagactggtgaagtgaaaayggggtctgggcctgggtctcctacctgggagaggaggctgaaggccagtgccccactggagatggccagtagtaaagatgagctccattcaggagacacc

SEQ ID NO: 34696 - DNA, 201 bp, Bos taurus
ccggtatttaaacaaaaatgcctagagactgacacactgttctataataagggaataaatatcagtagcaaaaataattataaacaacggtaaactactcrcgaagactttcttagatcttaactgaaaggattaatatgtaaactcattgcctttcttgtggtccctaggaaaggttaagattgtagattataagcatta

SEQ ID NO: 34697 - DNA, 201 bp, Bos taurus
cagaaagaaggatacaagaatgttatggctttgtttgacactgtttgaaatgaggtttaatgaataaaggtttcaaagcctaagcaataatgttgaatcartaggggagatcctggccagaaattcagggttaaacaaaaaactagcctttttttttttttttttactaagtttccaagtaagaacttcttagtattgcta

SEQ ID NO: 34698 - DNA, 201 bp, Bos taurus
agagtcctaactgaggagcagggcccagacgggtaagacaggactgaaaaccacttactcaggtgaaactacagagtgattttctgtcagcagttactcarttgggatttttcccagggccctaaagctcttcccatacatttctgaagtgacacaggacttccgttgatcatggtaggaacctggcctttttgcctacac

SEQ ID NO: 34699 - DNA, 201 bp, Bos taurus
aagagagaagaattaggcagattttataatcaggacaagaaagaattttaaaaaaccatacatctttatagatcatgactattgaaatgaaaatgtaaatrgaggcaaagttgattttttcacataggaagcaggagaggaaaatcaactgaacctctaccaaactggacagaatttctcagtcacttgtaaaatatcttc

SEQ ID NO: 34700 - DNA, 201 bp, Bos taurus
gtgaaaggatgcctggtgtatttaggaggcactgcctgtgatcagtgtggtatggacagtgcgggagggttgagatgaggttgcaaaggcaggtaggctcratcatggagggccctagcttgaggatatgagcagtggggagaatgtagagttagtaagaaggtgatggattagatgtggggaagaaggaaaggagtggtc

SEQ ID NO: 34701 - DNA, 201 bp, Bos taurus
aaatcaagaggtcccctgacaactgacataaagtctgaagggcattcctgtagacagaggagcaggtttttctgaaggcccacctcagattgcttgtcttraatgtctgtgtgacagtgcctttggttagagtgagccctgtactctttctgctactttacccaccggcctgtcctccctagaggtcatttgaatgatgtc

SEQ ID NO: 34702 - DNA, 201 bp, Bos taurus
agaagtctataaataggctattagaaaggatggccatatttcgcttaacttgtctggtttaatctactaatcacagcacaggtgacctcagaattcactaktgtggccaacaccttgagattcttgagaatttgtcctactatcttctttctgttttactccaagtaagtgtaaaatcttggtttggaggaatgtgtcttg

SEQ ID NO: 34703 - DNA, 201 bp, Bos taurus
gcacacacacacacacccactcctttcccttcacagtggcccactacaatttccctgtgccctctcctccaccacactgctctggtcctggggctgccctrtcagcataggccctagaatgactggcggagcctctgaaaacaccttgccctctcgatgggccatttcctggccaattaccctgtgtaggaacacttagat

SEQ ID NO: 34704 - DNA, 201 bp, Bos taurus
acgccgctgcactccaggcatttcttttttgctcctgcctccagagtcctccgttgccgatgtcagtcggaagactcgagtgagctggagggggcccaaamaccagtttcgagcctctggacctccagcgtttgcctggggaccgtgacccttccctttctgcggccctctggccctcttctctactccagacaagttgaa

SEQ ID NO: 34705 - DNA, 201 bp, Bos taurus
agtacattaattttctccttaggtttgtctaatcctaccattaattccatacattgagtttttgtttgtcaattatggtatttttcatcatatctagaatktctcctttgtccttttcatggtttctagttctttgatgaagttttgagggaatacaaagagttactcagtgcattgtcaagcaggtagactcttgcccta

SEQ ID NO: 34706 - DNA, 201 bp, Bos taurus
cgggtccactgaccatgatttccctgacgaggtctgaggaaaaggagagagaggcatagactaaaattaccaagaagtacactgaaagacatcactgactygatggacgtgagtctgagcgaactccgggagttggtgatggacagagaggcctggtgtgctgcgattcatggggtcgcaaagagtcggacacgactgagc

SEQ ID NO: 34707 - DNA, 201 bp, Bos taurus
gacttttcacagccaaggctttcttctccttcactgcagaatccagtgcaagctgggtggctttgttctgtgtcatgagtccttcatcctggagctagacrttctctgtctcctccgagggagaaaatagggctgctggaagacatggatatttttaaggctcaaggctgggatagctagcctcgcttccacttacattcc

SEQ ID NO: 34708 - DNA, 201 bp, Bos taurus
agaacctgagcggggctctcagggtggccccgggtgagagtgtcacaccccaacttgaccctaaactcctggaggatggcgtggtcgcatctccatgcccsctctggtgcctggcccccggccctcactcagttgctgagcagcggagtcagtcagcgatgagtactcacctttgcgttgtcaacttaaaaaacaatgcac

SEQ ID NO: 34709 - DNA, 201 bp, Bos taurus
tttgagcagaagcatatttattttttcctgtggggaattggtgtacagctcacttcaaattaagtaaaaccaaagagcagttaagaggccctgccttcccrggtcaaggaggaacgaccaagcaaagtggtactgatgctctactggctgctgggcatgtctgttctgggctggcccaggtttgagtggcaagggagatgc

SEQ ID NO: 34710 - DNA, 201 bp, Bos taurus
agtccctggcccactccctgagagcgtgatcctgcaggcctgccggggggcccaggaacctgaatttccacagacaccccaggtgacactttgaggatccrtgctctggagttcaagcttgcaggcctccaccccagcctcattttcaaaagttttcctcctccactccccatctccattggccctgaaccacccatctga

SEQ ID NO: 34711 - DNA, 201 bp, Bos taurus
ctctaaaagcaattgcagttctttgcatgagcacaggagtgggccggggccaggagagctaacaagaggaagccgttcccacgactggcctgactttttgrtgtaccactgagaacaatgagcaaagctacctctgagctagctatgattctgtgcccctgggccaggaataaatctgaacttaccggaaagatcatctca

SEQ ID NO: 34712 - DNA, 201 bp, Bos taurus
caagaaacactgtcaaactcattctatgaagtgacaattaccctgatatcaaaacagacaaagatatcatacacaaaaaaagaaaatcacaggccaatatyaccaatgttaccttactaattatgatgtttaagtaggaggatgtccttatttgtactaaatgcacactaaagaattagggggagttgaggcaccaggttg

SEQ ID NO: 34713 - DNA, 201 bp, Bos taurus
gccatggctggggttggggaggggcctggctgttaggacctgtgacgtgttccccagggggtgcaggcagggcaggcagtgagcgagccttggaccatgayggcctttacttgtgcctctattcgataccgtgcgttcagaccctaccaaagccttttcactctctcatggtcccaggtggtttcagctgtgtgtgtgtgt

SEQ ID NO: 34714 - DNA, 201 bp, Bos taurus
attcaaaaaccttcagaggccagagagataatagaaatgaatgaggtagtcaattcaaattagaagctgtggttccaatttaaataagaacatggggaggrggaacgtggtagacggcaaaggcctagcccttctggaaggggagcctcaattctgctcttgcctgttgttgccagggaagaatgtaggcccaggaatggt

SEQ ID NO: 34715 - DNA, 201 bp, Bos taurus
ttatcaggagggtttagtcagcattaaatttatccttatcctcatgattttaggaaaccaggtgaaaaaaagacaaggcttggccaacaagctcaagggcygatatacttaggtagctatggcccactcatccatccagccatttattttatacctcatcttcttccccaaattctttgaggcagatataacaaaactaaa

SEQ ID NO: 34716 - DNA, 201 bp, Bos taurus
acttgatttagtcattcattacagggaatggaactcagagaggggaggagttgtggggaccccaggggtctcgggggcctcactatgggcccctgatgtargagcagaagaaactcaggatctgggtgagaagacctgagctctgtcagcttccctgagcctttaagcctcactttccccatatgtgagcagaggttcaat

SEQ ID NO: 34717 - DNA, 201 bp, Bos taurus
ggacctggcctgcagtgagtcgctggagccttcaagtaaggtgaggactggggcacagccactggatttagagaccagtgacttggtcattctggggtcgyggaggaagggccaggagggaacagggacagctggcaaacagcctttccaaacgtgtcatcagaaggtgaggagagagagtagaaaccagaaggaaagtgc

SEQ ID NO: 34718 - DNA, 201 bp, Bos taurus
gcaccaccaagggggtgggagaccacctaagccgccccttcacctgacccagacccactgattcaccccacctttatgccacttaaggaaggaggccgccytcctcagagagtggagagcaagcaagggcgcctgttgcctgtttttgacccatctgcagcatgagtcccaggaaagccgagcctgaatttcttgtctggc

SEQ ID NO: 34719 - DNA, 201 bp, Bos taurus
cccctttctgtgacttccttacctttacacttttcccaaactcccagcgagcatgtacgtcattgcaaccttgacccttcctgggagggaggagagcttcygatccccattgggtttgagggcctgtgtggggtctcctttgcgagtgaggattcatctttgaaggcagactttcctggtggctcagatgataaagaatct

SEQ ID NO: 34720 - DNA, 201 bp, Bos taurus
ctctctctggaggttgagatctagagagccagactacaaggcctaaaccagtgcttctcaaacttgaatgtgcacacctgaaccttgttagaaaggaatcygtgggtctagggcagggcctgcatttctaaccatctcctgggtgatggtgatgctgttggtctgggggctgcactttcaacagtggatccaaggcagcgc

SEQ ID NO: 34721 - DNA, 201 bp, Bos taurus
atggctctgtcctggagctgctgctcctttcactggacgtgacctacctaggtgactccctgatcatccagtcactgtggtcaccacccttccttgctcayggcccccaaacctctctctctttagtcctgggtcccaccctgggtgtcatactcacgcctccactctccagtctagtgcgtttctccccacatggtccac

SEQ ID NO: 34722 - DNA, 201 bp, Bos taurus
ccaaagcctggggcactgagtcacccatggggctgaactgccttgtgactaggggcttgtgagaaggtggaaggggtgggcaatacagggaaggtgagagrcaggacccaaaaaggcctcaatagggctgaaatgaacactgggctacgctgagtgcctaccaagcttaacagcctcagagacctctgttcacactggggt

SEQ ID NO: 34723 - DNA, 201 bp, Bos taurus
ggttcaccccaggcttgtttgtgtctaatttcctgggggcaaatgggccccttattttcactttgaggtttagggtttcccctagagttggtggaggaggsgggtctgtggagacagtccaggatgttttgcataagtgcggaaagtcttggagttggaagttaaagatgaggtcgaagtgaaggggtgaaggtgagccag

SEQ ID NO: 34724 - DNA, 201 bp, Bos taurus
gggcctgcctgatggaggggtgccccatctccttcccacagaggctgcctggtgagaggctgcaagttcggtctatgcgatctgctgcacagaagctgagyggccctgggtgagccactgcccctctttcagctctcactgcctctctataaaatggcgctagttattcagacctctcagggtggtttggaggattaaaag

SEQ ID NO: 34725 - DNA, 201 bp, Bos taurus
ggggaagacatcagtctggggattatgagggatgggaacccagagacaggcagagccagcctttggaaaacagtcctgactctgtcccagttttcagctcmgggcccctccacggctcagctgagtctccggctcttcttagagtcagctctctcctcagccctcctgtcccaggatgcttttacaggtctcattcctgag

SEQ ID NO: 34726 - DNA, 201 bp, Bos taurus
ggccctcagatgggggcatggtgccatgatgggaaaactccatgggctcattgatgaacccatcattgaagctttctttttttttggtccctacagaaacygtgatggccttggtcacggcactgggccgttttgtaggcagcaaaggctgttacagcccttgacgtttctgttcctgtctggttctgttgggtgcttttt

SEQ ID NO: 34727 - DNA, 201 bp, Bos taurus
gaaatttgtggtgacccagagggccaggaccgagagggaactcagagttgctgacccaatctctccttgtccaggtggaaggatccaggacaagagaggtycacggtggccaccaagagggcgagaactccaatccagcctcctgggctctttctactcctccaagcttcctccattagtttattaatagaacaagggagt

SEQ ID NO: 34728 - DNA, 201 bp, Bos taurus
agtagcagcacctgcatcacagagatgaagtgagaagtagatgagtaaacaggtgcaaagctgctgcaacagtacctggggcccagcaggtacttgataaygggagctgtgatcatcgccctcttgacacagaccacagccccctcccaccaggtgccactcactggggcctgaacgcacacaccttggagagctcccagg

SEQ ID NO: 34729 - DNA, 201 bp, Bos taurus
agcctcagtgggccagctgttccatctcagccaacagagaaatgcggggagaaagaagtggcagtggtttgagcccaggccgaggcgtttgtgcagccgcycacagcagagtcccagccatgggttttagtaaagggtgcatgatgagatgatatgaagcaaattactgaggcagggccacaaaacaaatccccctctgtt

SEQ ID NO: 34730 - DNA, 201 bp, Bos taurus
ttatagatgagagaaagagttcagagaggttaagtaaccagcagaaggccacacagccaacagatgtggaagccaggattaaacccatgcctctctgactycttgctcctcctgtcctcaggccaggaactttgggtctcataagacttctgggaaagggcatttgaactgcagtgacaagtcatcaactcaatggacatg

SEQ ID NO: 34731 - DNA, 201 bp, Bos taurus
tcttgaatgaataagtgtgtttaggacttaatccctatctttaaatctagcaaagtatcttcagtagaatggtggatgaaggatttcaaccttaccttagygttataaccagcagagaaaccttctctgcagagaaaccttctctgctgtgcatacctatagctcagcagtacatatgtaacagcagggcgttaagcaaac

SEQ ID NO: 34732 - DNA, 201 bp, Bos taurus
ttctttgcccatgcagaaatatgaacatttgagcactgtttgccaatatagagcgaccagcacctgaggcacagcatttctggggcctcagccatttagcytgggtgcccccgtggtctctgtttggttggaactccagtgtctccgagctctctacgctaataggtacactttcacctcatggcccctcagtggttataa

SEQ ID NO: 34733 - DNA, 201 bp, Bos taurus
ggaatgcgttgttggagaagagtagaaaagaataaggagaggagaagaggagaggagatgagttgaagttattattgtgtggacatggaagttattgctgmtagaactaggtgtggaaccaagggccagagtattcaatggtgaccatcgttatctccttccaatctcagccatgcatcctatgcccgtatcacagagatg

SEQ ID NO: 34734 - DNA, 201 bp, Bos taurus
catatataatgactgtatataatgttacattttgggttggccgaaaaattcgtttgggttgtctgtaacatggaaaaatccaaactttttggccaacccartatctagtaacactgaaaccatctctaccgtgaactccaaaatctgtgtgggatcacaggggaaaccagctagccatggtcaacagctggccatgcaaaa

SEQ ID NO: 34735 - DNA, 201 bp, Bos taurus
ccactccaatattcttgcctggagaatcccatggacagaggagcatggagggctacagtccatggggtcgcaagagttgggtatgacttagcgactaaacytccactgaggacaaagcaaaatcctgagagcagcctctttgtgaaaacaaaacagtgattttggttttatacattagttgagtatgaatgaatggtagtg

SEQ ID NO: 34736 - DNA, 201 bp, Bos taurus
atgggcttcgggaactgacctgtggtctccactgtgcctcagtggatggagggccatggagcatggagcagtttagtgttaccgaccacgagtgagcaatrcattgaatgatgataccataccattactttgcctgggaaacagtgggtgcccagtgactgttttctgaattttgatatgagtaacagctgtgaacttgag

SEQ ID NO: 34737 - DNA, 201 bp, Bos taurus
aatttcttgacaagggaagaaaagcaaaggcctcattaaggtttagatgttctaagccagcttccgaggtgcttgggacacaagtgtgacaatggcagatrgaagtcactctggccacataaaggactcagtcctcctctttcccaagggcactagagtggaaacaaagcaaagaccccaaaaggctcctcaagcaccttt

SEQ ID NO: 34738 - DNA, 201 bp, Bos taurus
taaaaaaacaaaacagaagctgctccttctcttggtcatcctcatcacccttttagagcaagtaagaacagagtgcagggccagacctactccttaggaamcccaaaataatgttcagttcagttcagttcagtcgcttagtcatgtctgactctttgcaaacccatggactgcagctcaacaggcctccctgtccatcac

SEQ ID NO: 34739 - DNA, 201 bp, Bos taurus
agtttaaaaaatcagtaaattgcacttgtgtttttcaaaaattatctatttggtttgcaattctatttacttatttatctttttggccatattgtgtggcwtgcaggatcttaatccctgaccagggattgaacccgtatgctctgcattgagagcacagagtcttaaccactgggccgtcagggaagtggtttatactac

SEQ ID NO: 34740 - DNA, 201 bp, Bos taurus
aaacaccatttggaaagtgctttacatgtttactatacccatctcaagcacgctcctcactcaaaacaggctattttaagcaaatattctttggtctatcrattcttttctgccgctctaagatattaaacttacaaacaagaaaatctacctaaatacaaacaccccataactgaatcttaaaatgttatgtgactttga

SEQ ID NO: 34741 - DNA, 201 bp, Bos taurus
tggcatttttttctggcttaaagagtgttctgcccttgacttcattttcttctcattctatctaactctcctttgacattctcatattctacactggatgyaactctcacctggacactgcaatctatcttcaacctgtacctctccggtaagtatcaaatctacatctctattgagcagctccactgaatatcccaaagt

SEQ ID NO: 34742 - DNA, 201 bp, Bos taurus
ctctgagctactggtgccagtgccctgggggcagagcctggctaggggcccattcctgtctgaccatttgggaaccgaccactccaaccagaaaggacagracagaggaccccttcaggggcccagaaagtggtccagcagggcctggccctgctatggaaagtgaggactctgaaggacggtgactgcccactcccgcta

SEQ ID NO: 34743 - DNA, 201 bp, Bos taurus
ctgtaatcggtcttcaagcaggggaaaggggacgcagagatggctcaaggaaataagactggaatttttcataaaccaggcccagactacccatacacatytagatcacgctgagcttcttgggttcagctgcgagaagaggggctggtagaggccaagctatcttaggcccagggattccaaatggaacacaattatttt

SEQ ID NO: 34744 - DNA, 201 bp, Bos taurus
atggccaagtaatcaacaaaggaggcaagaatatacaatggacatggcagtctcttcaaatggtgctgagaaaaccagacagctacatgtgaaagaatgawaacattctctaacatggttatacaaaaataaaactcaaaatggactaaagacctatatgtaagactgaatactataaaatttctagaggaaaacatagca

SEQ ID NO: 34745 - DNA, 201 bp, Bos taurus
gaagcagaggaggcagcatacgttttagaaaaacgtggtgtgggcttgccattgaccatctccttgaaaccactcctttatttctctggtcctttcccatyaggcccttacatggcagtgcccacccctgccatttgccttcccttcttgttctcttcctgggtgatgctgtctagcctctggcctcaacctaggtgcagg

SEQ ID NO: 34746 - DNA, 201 bp, Bos taurus
tggccaacccagtgtttactcatcgtcctcttttcctccccagcgcttttatcccacccagtcctgtctgttctaatgtgttagccagtaactaccacctrtgtgtctaggacagggccctgccgtgttctgattagtcggaatgttctcatgtgaggtgcctgttgcagaccctgagctgacgggtcacatgcaagagat

SEQ ID NO: 34747 - DNA, 201 bp, Bos taurus
tttctagaaaggtttgtaacagatgggtttatcttaatggacaatgtcaccatcaaactccattagtctaaaagacccatttccacactagggccagtcarcaaaaccaggacacttgtgcagcctggttagatcattcccttctctggacaatatcaggaacacagaacacaaatgtttttggccacagtaattggaaaa

SEQ ID NO: 34748 - DNA, 201 bp, Bos taurus
aggtgcctactgagcgtaatttactgtcttcttatcaatgggcacgtgggtagtttcctaactaaatgttgctatttctgaatgctgctggcacaaaaacrtctcaaacatgcatagataccaatggaaaagcaacttggaaagcaacttatcaatttacaagtaaatttcacacacaaataaaaattatgtatatttctc

SEQ ID NO: 34749 - DNA, 201 bp, Bos taurus
gggatggaacccgggtcttctgcattgcagacagtttctttactgtctgagccaccatggaagcccatgaaaggatagctatcaaatttgggttgaagggraaaaaatcaatgaaaacaccaaagtgaacagtctaggtgactgtaaccatgatggtgctattaataaaaatactgaacacaggaaaacctgttcctagga

SEQ ID NO: 34750 - DNA, 201 bp, Bos taurus
tattttccatgggtgcaacctgtacgattttcagtattctcagcagccgtgtaaggataaactgctttctcctaagtttgggtggcctggttctacctcaygattactaagtggtttacaatcacaacctccagctcccggttcaccagcgaagagatgtgatttcctggtacgaaaacgcgaggtggcccgcaaacgcag

SEQ ID NO: 34751 - DNA, 201 bp, Bos taurus
ttgaatttctgtattaggacattatgaacttgaaaaagaatttctgatccagatttgattataagtggacatttgtttttttaaatgatatatctgtgccrtaaaagtttttcaaaacatgtgtttatgagttaaaatcatccatgtaatattaacagctagccacttatctaacttgaaattcccaggaaaggagttctg

SEQ ID NO: 34752 - DNA, 201 bp, Bos taurus
ttagtttcccaggccttgaggaggggagagggtggccctgctccagggtccctggctggctgtgccacctgcttgcttgaacgtggtgaggagaatgctgyagaacaaaggccctctattgtattgcctgggattttcctcacctaagtaatgttgagtgccccccccctgctgccaaagatcagggagactcttggtgac

SEQ ID NO: 34753 - DNA, 201 bp, Bos taurus
gagccctgggtgtgctctgcctttttacagttctccccaccccctctgcatcttaaccagaggttaagacactccctccacccaggaactccaggtcttcrgagggctacctcctggtccttgtgcagtttctgtatcccaggacctctccccttataggcttctaattccagcagcaaaacccctggcattgctcaggtg

SEQ ID NO: 34754 - DNA, 201 bp, Bos taurus
taccaggggcctggatgagggggagcacggggtgggggcaagctggctgggcccagggagtcagagaagcagggtcacaggcccaggcacaaggtctactrtgccttgtctccttgaaagtcagacaaaaacaaccctcggagggagtcacagcggagactagaattcgttttcaaaacactgaggccaaaagaggttaag

SEQ ID NO: 34755 - DNA, 201 bp, Bos taurus
ggccgaatctgcagccggggtaaaatagaacacttcccccagcccacccacaatagaaataaaggctgggtcccttaggggaccagccaggcacggcacaytgcggaggccatgggcagacagacacacggacaagaagttagccagagacagaaggatggcacagggcctctttgctcacagcactcgatgggtaccgat

SEQ ID NO: 34756 - DNA, 201 bp, Bos taurus
aactagaagcccttagaatctgaagatcctctgccccttgagtcttctcctccagtttgacattcccgtgtcctctttctggtcatggcctgttctcaccrtcttgatttctccctccggaccttgctgattgtccctgtccctcttaaaatggaccacacactcccaacagggtctgaccatcacagatctggggcctct

SEQ ID NO: 34757 - DNA, 201 bp, Bos taurus
aaacagatgtcctcaacctgtccagagaagccacttgctgaacttaatcctttggctcggtctagttgggacttggcctctgatagaaggaccattgatayaggaacattgagctgtgactggttctttatcccacagtgggaaagagggagagggaggggcctgcaccctcaggtggatggtctcgggcagaggctggct

SEQ ID NO: 34758 - DNA, 201 bp, Bos taurus
attccagctctttctgtagggcctccacgtgttagggttaatggcacagccatcaccatacagatggacatgcttagcatctttttggtactggtttactytttttattatggttttggccctcagtctaggttcccaggaagtgataacactttccacaggtgttatccaccatgggtcataggctccataccctacagg

SEQ ID NO: 34759 - DNA, 201 bp, Bos taurus
aagatgttccaattgcaacctttcactcactctaagagccggttaaagctgattgaggtaaagggtcagtggagatcctacagaggcccagcagaggccaraattttgcagcgaagttaagagtcggtaggaaaacaggacttctctggtagtccagtggctaagactctgagctcccaatgtagggggcctgaagttcta

SEQ ID NO: 34760 - DNA, 201 bp, Bos taurus
cccatggatagagaagcctagagggctatagtccatgggctacagacactaagcatgcatgcttgcttacttgctaggcttagtagctatatggcctaggrcagtgattctcaaagtgccttccttggtccaacagtattagccttacccaggaacttaggagaaatgcagattcttgggccacatcccagccttctggat

SEQ ID NO: 34761 - DNA, 201 bp, Bos taurus
tgtattttttaaactgaagttattacagcatgtttgcatgctgataggaatgatccaggagagagtaaaatacatgattctggaaagagaggagtaattgyaggagcaaaattcctgagtgggtaagaaaggacagagaagctagtacacaagtcagggagatacccaggaacacaccacatccatttctacaggagagaa

SEQ ID NO: 34762 - DNA, 201 bp, Bos taurus
ttccagcctgtgtaaaggggaggaagaccattggtcctggacccatttcaagaccacgttcccccgtccttgtcacagaggacgggcccttaccttgtttraagctctttaggaagccttctcgtggagctaacttgtctgggtcgtgcacaacacgttggggaattttcagtacagtgcgtacagcaggaatacggagac

SEQ ID NO: 34763 - DNA, 201 bp, Bos taurus
taaacccagagctaagactctgaacgctcagtgcaggggcctgggtttcatctctggtcagggagctggacccaccatgcctcaactaaatattccacacrctacaactaaggccagtacagacaaataaatattttttgtaaagttaatccaatgccattttaattggaatactaacttgggactttcctggtagtgcag

SEQ ID NO: 34764 - DNA, 201 bp, Bos taurus
cctccaacctctgacctacttaggaagggaaagaagacctgcactagaatctgttatgtgccaagtgggttaacaacctctgtataaccttgccttattcrggccataactatgccatgaactctgatactactatccttactttaccaaggaagaacagatgatgggctgagcacgtggaactagtcctgatatacaagt

SEQ ID NO: 34765 - DNA, 201 bp, Bos taurus
ttggggggttactgccttgggcctgacaagtgagggtggtattggcaggagggggtgggggtggagagaagtggaggcacttggagacacacttctgggtrgagctgatgggccttcctgatgaattgaaggtggggcacagggaaacagagggactccagagtactcctagaaacactcccaggtttggggagcaagttg

SEQ ID NO: 34766 - DNA, 201 bp, Bos taurus
ctctttgcatgaggtggccaaagtaagtttcttcaatatgtaataattctccttccattgctttccctccaatgtacttgtgttttgttccatcatattgrtttttgaaggaactgggccttttgtcctgaagaatatctcacttcctggacttgtctagttgttttttggaatctgacttgttgttctcctggctccctt

SEQ ID NO: 34767 - DNA, 201 bp, Bos taurus
catgtggaggccaaggacaaattttttcagggcaaccacaattagtaaaaacagcttctgtgtacacataccaaggggctgtggggtcatgtctacattayaatcagggcctctctgtatggtcatcctgacccccaacctactttagcagatcatcaagtgcacacaggctcttggattttctctagacaacccttagct

SEQ ID NO: 34768 - DNA, 201 bp, Bos taurus
cacaggactcctggcagcgcagtgtcttggggcagcccggggcctcgaggctgctgcttccccagggctcctgaagccaaagaatggaggtggagagttgrgttatggggaagtgatgggccccttggagaagcccggtgggaggcacaagtgccgcttctgcgccaaagtatttggtagtgacagtgccctgcagatcca

SEQ ID NO: 34769 - DNA, 201 bp, Bos taurus
tgaaaacctttgttctcaaactaataatgaatgtacagatatgatagtaacagttctctaagaggtaacctttaatgcaaccttttagcccctttagaagrgatgcacacagtgatgtttttttcctaggctcaaagctgagtactctatcattttaataatcttttaggtaatcctatgacaattctaccaacaagtttc

SEQ ID NO: 34770 - DNA, 201 bp, Bos taurus
gcgggagctccggggcactcctcccccatcgcatctcgggtcggctccggcatcgttacgccccctggcactgtgggccccctccccactctgtccactaytctgaggcaacatctctttctccacgggaatttccctttttgacgaggtccctggccccaacccagccgcaactgtggccggtcccccagggccggatgg

SEQ ID NO: 34771 - DNA, 201 bp, Bos taurus
ccctactccaggtggaatgtaactcaaaactggaccccacccagacttctttcctcaaggtcagtaaccctattccacattcagcctgactcttggccccyggtccagagccatagatcttctccagattcagctgctaggctggcttccagggtcctacatgggagcaagtgggtgggtggagtaaaagaaacagaaaac

SEQ ID NO: 34772 - DNA, 201 bp, Bos taurus
cataattacagcctttttcatttgttgcctgtgagaaaaatcaaagccttcatattgaggtattatttgcccctgggcattaacatttcttaatataggaraagcctgtattggcctcagagattcaagattgcaaagccagcaactcagagagcctccgtcgtgaaggagaatgagtagatagttttttctcataaatac

SEQ ID NO: 34773 - DNA, 201 bp, Bos taurus
tgctttcctccgcaagccggctcccacctcacccacgcatccatttgggtttcagtaacgcccccttttcctcaccctctttccagttttctggccacagrgggctgctgtcctgttctctctgaagaaagagcctaagggagagaaaatgagtcaacaagtggcggcctgggctcagattctgaaaatcgcttctccggg

SEQ ID NO: 34774 - DNA, 201 bp, Bos taurus
tgggggtgaggagtactttctgctttaagcaagcttgctaaattcaaggtattcactctttctctgccagtcatccctgcttccaaggcagacacacgtgktcttactactcccttcctcccttcctgatcctggaatctccctccctggtggaactcagatctctccagtttatctttaggatccctatgaaccgtcttg

SEQ ID NO: 34775 - DNA, 201 bp, Bos taurus
agtgggcgagtcaagggatgtggtctgggtatggaggtgttttttcatctagaggagttctctccatgacctcagtgactcagtactggtgagcaagccarttcccaaaggccaatgatacttcaggtaccagaatgtttcattttcaactgtggtccaaagagagggttgagttgggcctgaattgcaatcagccaaaag

SEQ ID NO: 34776 - DNA, 201 bp, Bos taurus
aaataaataaatataattttaaaaaatggagtagagtccagaaactctcccttccttttattttgcattgctttctggcccaatattgtccctggaggtcrcctctcaggaggagcaggggcaatcacagtacatcattcaatccccaaatgtgttttactttctgtgttgagcttaaagctgaaaaggccttcctgaatc

SEQ ID NO: 34777 - DNA, 201 bp, Bos taurus
acattgcatccagactaggatgaaaaatatgttgctatatttttttttgttgctatattttaatactcaaaaagagtaactcagtttatttcctttccctratttttcaatttcactaatcccaactgaaaaattcaaatctttcaattttactacctccttttgtgaaaatccaccctaggttacagaattccaaaggtg

SEQ ID NO: 34778 - DNA, 201 bp, Bos taurus
ccccaaacagttacatatttttccacatcactatttttaatataatttatcctccttactttgttatgtgaaatttgtaaactgctgttgttaggaggaayaatcttttccctctctcacaattttgctttccatcaacatatagtacggaagcatccatcttgatgttagcaagacttctttgcttttgcacttccttcc

SEQ ID NO: 34779 - DNA, 201 bp, Bos taurus
gttgcagaggtgctctgccttacccataaaaggaaaacagctgataattttagcaaggtagtcacttatattatactggcccatataatctgacctctcaraaaaaggaactcagaaaacaatattttctctataattgaaccttttaagaaatgtttccctctttgatctctgtggttagtactccttagaaccgctcca

SEQ ID NO: 34780 - DNA, 201 bp, Bos taurus
aagtatacagccctgttgaaacatgctgtactaaagaaactgtcctcggggcctattgtcaaaaaccatgtcttttagaagttgggatacacagccagtgrggctgggtcctgaacatggagatgacattccctctaggtactgcactgtccaggtgagttttactttactatttattagctaaatatttatctagctgtc

SEQ ID NO: 34781 - DNA, 201 bp, Bos taurus
ttatttctacctacaaatgacaggtacagtaaaggacaatggaatgattccaatgacttgatttttttgttaagttcaacaaataactattaggccttctrgatggcaggaaaggtctatatagtcaaagcgatggctggatggcatcactgactcgatggacgtgagtctgggtgaactccgggagttggtgatggacag

SEQ ID NO: 34782 - DNA, 201 bp, Bos taurus
tcaggctgtgtagcctctatatatttacagatgcagtattctttccacatgtaattatccaggctcttcctttcctttctgttggcatgagtattctgttrcatttgaatgacttgagtcattctttgcaagctaaattttagtttgggaagtgttttatatatgactatattttcttctatagaaatgaaggatttccat

SEQ ID NO: 34783 - DNA, 201 bp, Bos taurus
ttttttattgaaattaacatctgattcttccagaagctctatactcaacacagcctaacatcacatgtatttaatatgggctttatacacatagattatartatttgaattgaaccttcagaaatcatctatacctttcatttccaagattcagtgtcttccagtcaatcagaaatataaatgtcacctaatgcacaggta

SEQ ID NO: 34784 - DNA, 201 bp, Bos taurus
ttatccttgaatcctcttaacagccttttaattttgtaggtgtggtggggaccaactgaaagacatgaaagtgaggccactgatcctattaatcttttatyctctttcccttattggtatcttcatcccaccttgggctccaatcccatctcctgttcccactgtacttgtcttctgatccacaggggtggggtgatggcc

SEQ ID NO: 34785 - DNA, 201 bp, Bos taurus
tgtttttttctgttctttctgttccttcctcaatgaactttttttgccacagaggaaaaaaaaatagtagagtctgcagggtgtcattagtatgctgtctractaaagcaccctattaatgtatcacatgctgtcttttccattttgccagtttttttcttgttattaaataagaactctcttaaactgtatttcatgtgt

SEQ ID NO: 34786 - DNA, 201 bp, Bos taurus
ctccaccagcccctgccaacttcccagtaaaaggcataaagtcactgaaaaaactgtgagtccaaaactgttaataaagatgatgataaacaaaacacctrcttatcagaatttagctaactttgttttttcccattgttaatcttagttccttaatgtatgctgaggggggttaattattaaaactgaggagttggtggt

SEQ ID NO: 34787 - DNA, 201 bp, Bos taurus
agtttcatatttatgaacacttaaggtgctctggatatgaatatgactttggcaaggaacataagaattagtcattgaatgtgttttatatacagccatamatatgtgctagtaggtatttaatgaccttgctccaattacagaaaaatatttggaaaaaagttaagaacccaggttaggaaggcgtctgaaatggcaatg

SEQ ID NO: 34788 - DNA, 201 bp, Bos taurus
cagctgccttaagtggagcacctcacagagccctccattctctagcgcgcggaagttccgcaacactcgcatctcgctagtggattggccgagactcctgmgctgcggtttgagcccacagtgggcgcccgaacccggcgcgcggagatgacgacatcagcgcgccgctgcagcgactgcgagagacggggagggtttccg

SEQ ID NO: 34789 - DNA, 201 bp, Bos taurus
tatttgtttgtgtaaaaggaaaaacttccaattggtaaaagcaaaataattgactgtatagacctggtgatctttattagcagaatagaggccgctctgtrggactgggtgtgatggggttccagtgtccttccagacccgagactctgaggggaagggtggttctgtggggaccagcctggcctccgtgggtaccaggaa

SEQ ID NO: 34790 - DNA, 201 bp, Bos taurus
ttctatcttagggcataacatattttgggggaaagctgttcagatttgcagacctggaaaaattttaaatagccttaaaataaaaattggtcttgattttkattttggggtgggggttatacaaactcagacataaagttactttgttcacaaatctctaaagctgaaagtgctgaaacttcccccaggtttctgttacac

SEQ ID NO: 34791 - DNA, 201 bp, Bos taurus
agtgttattgttttcattttaccaatgaagaaacaggcttctgaggttcacttgttcaaggtcatagagccaataaaccgaggagagccaagatctgaacygaggtctgtcttactccaaatccatccccttaaaccactttttactgccccacgtgcctatggtatcccctgaggtatgaggtggcagtgacatgttaaa

SEQ ID NO: 34792 - DNA, 201 bp, Bos taurus
aaccaataccctggagctcgtcctagtagggatgcaggagccctctcatcaaattgtcctgatgagtcagaagtgctaaggaatcagcaaagaattttatyccattcatttactttctgtatcactttatctcttgagaaggtgaattcctttgcttattcaaaattttcaaggggaaaatttacaacaagggaagagggg

SEQ ID NO: 34793 - DNA, 201 bp, Bos taurus
actgcagcattagcttcacgaggctcttggactcagggtctgaagtgaacacaaagctcagggcaccaaaggccaagaacaacagcctggtttccaaatgktttgaatttttcttccaacacctccttcctactctcaaactgagtccaaattcctaatggaaacacagtttttattttttgtcccctctgtggaattttc

SEQ ID NO: 34794 - DNA, 201 bp, Bos taurus
gcccagaaaaatggccaacaaaatgtcaactatcattagaaaaggtacaaaatattatcctataattctggagaacaagggtgcttatgtatttggtacaytgtgtgccgttcaaattgttattcttaaagaaaaatgtaatggatctggagaagattcaaaaaaattaagtataatgatcaaggggatgaagttatacct

SEQ ID NO: 34795 - DNA, 201 bp, Bos taurus
aataatgaggatgaacttgagtgacaaaaagtttgtctaaacttgtaacaaatcattcccaacatcttgacatgtggtgaataattaatttccactgtagyggctacctgcctgttcagttcttctcagatgattccaatatagggagccttgggcttgtcaagtgctctgaagaagtgaagtgtcatgttcggctattta

SEQ ID NO: 34796 - DNA, 201 bp, Bos taurus
gatttccattcctacacttccctgaaagctatgctgccttgctcatcacatgggtttgttcctatggcataaaatcacacataaactcagtagaaaactgytgatggtgcttaaggttctgcacaggggcagctgctccatctctggagttctctcctgcctcctctgctctctgaacagtaagcagcagcaagcagctgc

SEQ ID NO: 34797 - DNA, 201 bp, Bos taurus
aaaattcaatactatataaacaataggcattatgcaaatatgcattgaatttaaatgagtttaatttgaattccaatacttagaatggtatgtgacagcartcataaaaatcgtttgtttatattctaaataaacacccaccaatcaacagtttggcatggtcaggtgaggaaaataagtataaaaacatttactaaatat

SEQ ID NO: 34798 - DNA, 201 bp, Bos taurus
gatactgaagctgagtagtggaggcatcttcctttggcagctccttcctcctatgcatttctgaggcccttgctttctggtgacttttctccttccaagaycattctcttgcaaaggttttaactgaatttcacttgcatagcaatgtcgaggtggaagagacacactgtgtgttcgctttggctgcagacatgaccctat

SEQ ID NO: 34799 - DNA, 201 bp, Bos taurus
tcactcagctagaaagtggcaggactcagagttaaacccagatctgaccggctgccactgttgtccctcatcagcctctctcattcctggcccttctgtcmttggtggcagggaagggagtgggaaactgcaaccagcgcagtagggcaagctcctgagtgggccatgtggtgggggaggggggtcctttaagaggctgca

SEQ ID NO: 34800 - DNA, 201 bp, Bos taurus
ccctcctatagaaatatgacctcaagtgacctcaggaatgatttgaatagatactgaagtcttagaccagactttttagcagactgaactctcagtgattmtgtttattaaatctaatgtgttgttttcctccatgtggtttttttttttttttaagtctttttgcatattggacttaaagatattttaaaatatttatct

SEQ ID NO: 34801 - DNA, 201 bp, Bos taurus
caaatgaatttacttatgaaacagaaatagactcacagacttcaaaggcaaacttacagttaccaaagggaaaaggtatggggggaggtataaattgggamtttggaattgacaacaacaaagaactactctgtagcacagggagctctgctcaatactctgtaataacctaaatgggaaaagaacttgaaaaagattaga

SEQ ID NO: 34802 - DNA, 201 bp, Bos taurus
taaatagttgaatcaaagatatatttcatagttcaattttaccatgttagctaaataagagggtattaaaagaaaggattatcatatattaaattaaaagyttgtcactttgcagctctaatccatttgaaaaaaaaagatgatttcgatacaatttaatcagttagaggtctttattgccttaagtattaattgattagg

SEQ ID NO: 34803 - DNA, 201 bp, Bos taurus
ataggtaaaggtcaaagtggtcaggattgatcactgcatcttctgttttgcttagcagtcatgcattcacagacccaaatttgaaacctggattaactaayagttaaattttactgaattttaaggggaaaatgtggatgacagtataaaatcaatggtaaacagtaaaaaaggcataaaacatcagtttgtccatgacat

SEQ ID NO: 34804 - DNA, 201 bp, Bos taurus
cctatggcctcttagaagcacaaaccaccaccagcctgtataaccacttcccttattttatatcatcaagcaccttggcaccaaactccttcatgggctargttagcatctatttcactgtcttccactgtgccatgacccctgtcatccttggcagtttccatgctgagacagataatccttctgaccctgtggactctc

SEQ ID NO: 34805 - DNA, 201 bp, Bos taurus
ctcgatcagttggtagggcaagatttccgtttctttccctctgtcaaaatcaactgtctaatgactgtttgggtagaatatttctgaatttatgaagcaayttcatatatattatcttgtctgacccttctcacaactaacctgtaatgaaattgacagtttatagtgttgctgtttttagattataataatatgatgagt

SEQ ID NO: 34806 - DNA, 201 bp, Bos taurus
gaaattttcagacatgctccttgatctataaaaaatataaatatttgtacaacctaatgtttaaaaattcaattaaatgaatctggtaatttccattctaycagacttaaagattttgttataaaaatataaatcatatatccaccctaaaatactttgaaaattactaatacctagtcttgagcaaggtgaagctgtttt

SEQ ID NO: 34807 - DNA, 201 bp, Bos taurus
gaattaattcagaacttgttgttttcataaatagcttaataggtaaagatttcatgatggatttcatcctgcatttatggcctcggggacagaaaataatytttctattgccctgaacttagagccttctcttatctgggtcaacttcttctttttttctcctttcaaaataattttctctaagtagctctcagagaagga

SEQ ID NO: 34808 - DNA, 201 bp, Bos taurus
ttacccaagtgcctagtttgttagttccaaacattacatctcagactttgtaaagatgcttcaaatctttttttatggttgcaaagactttttaaaactcrataaactaacagaacttgttttgagagccctcctaggtaatttaaaatttctatctccatgatgcatttctagaggtggaagaaattgaagaaatgacta

SEQ ID NO: 34809 - DNA, 201 bp, Bos taurus
ttctactaggttattgccacactcagatcatgtattaaccactattttggaacatttatcatgttagcgtagatcatatttctggcattccacaagtgagkatataaggtcaaacacttcaaaatgctgtgtctggccactggtacagcatagaagagccccaaattaacatgttcaggtacaacaaattctcttgctgct

SEQ ID NO: 34810 - DNA, 201 bp, Bos taurus
tttaatacaaatcttcatggttcaataaggcacttccatttgaactgaagatggaagagaaaattaacccaaacttgagtataagaaaaaaactacccatmagttacaactgtttatcattaagatacacttaggaaagtggtcatacaactctattctggatagatttctatctactggagttagttaatgcctaagctt

SEQ ID NO: 34811 - DNA, 201 bp, Bos taurus
actgaggatccagtattcctcctatcacttccatccaagagatcttggccactgttcactacctttggttctaaaaggaaggattttctgtagctctttaytgatttttgtttgtatctctttgaaatatttgcaaatatgaatctcggtagaattgtattttattcaatccctggtgtctttgaagctgggaacataaat

SEQ ID NO: 34812 - DNA, 201 bp, Bos taurus
tggctggagatagctgactatctctgctcagcaactctagtgagagaggtatcttctttctgggtctgtgctgaaagagccgtttctgtcagaggtaagcyttcttattgcagtggactaacaaaaccatgtggtggctctttagatctctgctttcgtttcattgtccaagtaagtcatatatgtcaactacaaattggc

SEQ ID NO: 34813 - DNA, 201 bp, Bos taurus
acttacaatctttaaggtttttcccagaaattgattttatcctaaatatctacacaactggtctctccttccattttgttaaaacttattcttttgtagtmcacaggaaattcttatttttttcttttcacacactgacccaagtataattcttgaccttcccatcatttcaaaaatgaaaaaaaaaaaaaaaaaattcac

SEQ ID NO: 34814 - DNA, 201 bp, Bos taurus
aggactctattgtttccagcatctgctttaaagttgctgaaattgcaaagaaaagttaactctatttaacatatgtctagtgcatacaagcccttttattktttcttaaacccttgagctacctttgtgaagataatactatcttcaaataagaagacaaaagtaaagtttcccctctgtttatataatttcgattgaaaa

SEQ ID NO: 34815 - DNA, 201 bp, Bos taurus
agggagggttcactcccatttcttaaattcttttaccaactcattttatcttgtaatgacaaaacagcatttgcttggtctatctatatattatggaaatrtaaaagtatttttttctgccatcatcactcataattatacctcaggaattcttttagccaatactctttcaaaagcaacaggagttgggtttggtggtaa

SEQ ID NO: 34816 - DNA, 201 bp, Bos taurus
acataattccagtcaaacaaacataccccacaatgcccttttgcatgactttgtgattgcatgatccagtgcccatattctccttgttttggcccattttmtttaaccttcccttcttctaaattattctaatgaaatgattcatcaagagtctagactgaagaaaacaagtattacatttgaagctaaagtcatgtttag

SEQ ID NO: 34817 - DNA, 201 bp, Bos taurus
tatacataattataaaatatatctattaaataggtccctactctaaattcactggcttttttaaacagaaaagcaaacttttatacagcatgtcaaagtcrtttctaaactggaaagccttcaggaataaatatttctcatcaatgttattaaagggtgacattaggtacaacaaagtattccattcatagcattctaatc

SEQ ID NO: 34818 - DNA, 201 bp, Bos taurus
tttatgagcttgatataactaacgagaagatttggagaaaggtatggttttgatttgtttggtttttaatgatcaatgggacacgcagtttatgagcaagycctaggctggcatgggatacaaagaggagaaaaacacaatcccagcctccaaacttaaaaactcaagtagagaaggtatgataagtatacgaataacagt

SEQ ID NO: 34819 - DNA, 201 bp, Bos taurus
ttccaacaataaatctcagttgcaatagccaactacacaactctaagcagtctacacaactacacagtctgagcagggtagggcctcattgctctaggcaygatcagacaatcctacaggaaaatgaaaataatctgctctgatgtcaggaaactttatagactcatagaataatagagctggaaatggcctcaactgttc

SEQ ID NO: 34820 - DNA, 201 bp, Bos taurus
aaaggaggccctgatggaggcattatgaactacaccatagccattttcttctctacctcccactccatcctggaagactcaccaagatgctctggctttcyacgggcacctggactctctgatgagagcacctagaaccactgacgagccatctgatgtttgtgtgcctgtgtgctaagtcgcttcagtcattactgactc

SEQ ID NO: 34821 - DNA, 201 bp, Bos taurus
cctggaagaagcaactttactgaaagagataatgagtaatagaggtgcctatatttggaagagcatcctatagccttggttcaccctttttctaaatctcygactttattctcctttagggggcaactgtactactctgtctgcactttggaggctcacttctgacatactccttgaccctctattctcattcctcagccc

SEQ ID NO: 34822 - DNA, 201 bp, Bos taurus
gtctcctatgttatcatagcacaatggggggctgagaaggaagatgctgcagacatggaaagtgtcctcaagaatcttacagtcaaataggataataaatragacgtgtaacgtgtaacgtgtaataagatgtgcaatgggactttagaggacaggaatcactttccactagatgagtctgaggctagtggcattttgtat

SEQ ID NO: 34823 - DNA, 201 bp, Bos taurus
atgtgaaagagagagggctcaagatgacttgcagttttcttggtttgaacaactgagtggtggttggcgacaattctcagataggaaagaagaattaggakaagttagggctgtgcatcagagtctagttttacccctgttaacttgaaagttaactaaaaagcctctagatgaaggtgaaagaggagagtgaaaaaactg

SEQ ID NO: 34824 - DNA, 201 bp, Bos taurus
aacatgaaacagctagaggaaaattttaaagcagaggtcagcatactgtattctgtaggccaaacctggccccatggcctgtttatataaggaaaattgtrttggaacacagccatgtccatttctttgcataattgtctatgactgcttcagtgctacaacagcatcggcgaatgattctgacagagaccatatggcccg

SEQ ID NO: 34825 - DNA, 201 bp, Bos taurus
taccttattcacttccaaggggactacaaataagcatgatcttccaagaggacagctacaatagatccatgtaactttaaaaatgtttgtacttcttgagytcaaaattccttttctagggatctaccttaggaaaataatcggtgctacaaaaaaaggtttatcatcaaggatgctcaccatagtgttttctaaaattca

SEQ ID NO: 34826 - DNA, 201 bp, Bos taurus
ggcacccctgggccagcaaccccaggcctgggtgtcaaggagttgttgtctttgctggatctagtgagatctgtgttataggaaagggtcctaacaggagytgtggccttttctagtagaacacaacttttacttttgtctagcttgtttcactttttctatttcatattcagtgctctcatttcatttaatctatgtttt

SEQ ID NO: 34827 - DNA, 201 bp, Bos taurus
tattactttattcggtttgacagtctctaggtccatccacattgcttcaaatggcattatttcgttctttttatggctaagcagaatttcattgtatataygtaccacatcttatttatccattcctctgttgatgaacatttaggttgcttctatgtcttggctaatgtaaatactgctacagtgaacttggggtacatg

SEQ ID NO: 34828 - DNA, 201 bp, Bos taurus
tgtattaagtctttattttttttataatatagtaactagtatcattgaaagttagcgtaagtttctcataaaaaaaggaatagttcatgaaaaatccttakagctctgtgcagttgataaccttcatctctgcccgtattacacccatgtgttatcatatgtacttcatactttgttgaaataaaatgtgcttagaaatag

SEQ ID NO: 34829 - DNA, 201 bp, Bos taurus
gagtatttaattactgacactattgagaactgctggtacatggagttgtagtatggttttagaacgctctgtagattagacatccatctattacctgtacytctcattatatggactcctttgaaggccactgaaatgccactgaaaacaccttctctgagaggtttataagcaggcttagggaatagattcagtcctgat

SEQ ID NO: 34830 - DNA, 201 bp, Bos taurus
gtcagcccgaggaggcctcggcctgaaaggaagacggcggcgggaccacggggcccagctgttcaggaggctgctccacctggggttctgctggggcctgyggctgagaaccaaccactgtgctgactcaccatgattgtggttgagaaaaacccagcaagatggtggctcccatgagctcaggagctgtaaaatataggc

SEQ ID NO: 34831 - DNA, 201 bp, Bos taurus
tctgttaagggccataatgagtgcttttaatcttgagagaagaaaaccaacaagtaaactaattgagaaaaaacatgatggacagagcagtgtcccgctgraggctgaagtcaatcaggcccttgtgcatcttcatgtctctcccagtcccagctttttccttttccggatgcttccatccatggtcacctttcccctgac

SEQ ID NO: 34832 - DNA, 201 bp, Bos taurus
atgatagaagcttgaagccacccttgtttgacattatgcatgccccatggggaaatccatttgattcaggttcctgagagatatgatttccaagactatcyccctgtacttgaagtatgacaagattaatttcctgccaatgccctgccttgagtcataatatcatctaatattcatggagcacttaatacattccaagtc

SEQ ID NO: 34833 - DNA, 201 bp, Bos taurus
atttcaattctaacagatgattgcaacttatcctatgattgctttatatatggctctttgtttacttatggattgtgacagccaacaggaaagttgtatgrccctcagcaaaaacacagttctcaggagaattaccaggacaactgggcttctcagtgaggtggctgagggcctcaagaatcagccaaggcacatgtgtgg

SEQ ID NO: 34834 - DNA, 201 bp, Bos taurus
agctaccaagtgtagcttgttgcttcggaggggaggagcagccttttttagtgtaaatgcctaactggtcctctgagaagctgtaagatgaccagggaacyaggagaatgccctgagcaaagattcatccattaggcagaaggaagataaagaagaattctgggtacttgctccagatctagaaacaagcatttagttctg

SEQ ID NO: 34835 - DNA, 201 bp, Bos taurus
aaagatttgtatgtttcaacttgtccttgtatacctggctccttgtgtacctgtatgtcagtcacagaatccatccttgaggtgaagcactcctattgtaygaattctcatgcttagctttctctcttttatgatgtgatatcaactttcttctaaattgattatttttccaaagttctatcttttaatattacatttaat

SEQ ID NO: 34836 - DNA, 201 bp, Bos taurus
acccttttagtgtctcctaatttcaatctgatacacaaacccaacaactcaattccttagttgatattgttgggccctttatagccaattaaaatcagtcyttcttactatggtagttaagggcccccacaacctgatctccgtctattctggtgatcctcaagctgcggggcagggggtggcagtggagcgtatctgtag

SEQ ID NO: 34837 - DNA, 201 bp, Bos taurus
cagaaactttgcagaccacaagagaatagcatgacatagtcaaagtgctgaaagaaaaactctgtaacctaggacactcctcagacaagcaaaatctaacrtcgtcactttctcaaaactaaacttgctcttaaagaaatgttgaagggtctcctctaagtggcaaagaaggcagaagctataagaaagggaaaatcctac

SEQ ID NO: 34838 - DNA, 201 bp, Bos taurus
tggccaggtgtgaatgctaaggagggaagtgaaccctagggattcccctgtccggtggctgagatccttatttggtgaagctactacctgcgccctgggtmccagggccagcctgatagtctgggatcacagcaggggaagtgcggctgctgacgtcccagccgaagagatgaatggaattccaggcagctggagtcatgc

SEQ ID NO: 34839 - DNA, 201 bp, Bos taurus
tgggaaaacccatccttccatggctgtggcactttggtgacaatgtcagagattgagttgactggtaaatcttagattttacaggcacagggcctaccctwtaccatgatatttaggcagtatctcagcttgagcctgattctgaaagagacatctcacgagagatttataagccaaatgcccttagccccctcaaactca

SEQ ID NO: 34840 - DNA, 201 bp, Bos taurus
actctcaactttaactggggctcaaattacaaccaccttaaaaaacaaagcacccactgccattccctccaagttactacctaccctcgattaacagtcaraagtctcaaaattaataaatgaatattttttaattaaataaattgttttatcattccaggactttcttggcagtccagtgcaagactttgccttccgata

SEQ ID NO: 34841 - DNA, 201 bp, Bos taurus
ctgtagagtagaccttggccccagctctgcccctcctcagggcagcttcctctggcaccgcctcctggcacccaccccaccagtgttactctgggctgtcrtgtccttacttgcaaatacagctccctgtatttgccctgaactgccctgcctgactccttgaggtcaggatggtttctcttccatcattctagcttttga

SEQ ID NO: 34842 - DNA, 201 bp, Bos taurus
tacggtgaaaggccgcagtcttccgtcttccatcccccgtgtgccaccctcttcccttttccagaagtgactgtattaccagctaattatctttgtatgtmtccttgaataaactgggatttttcctagggaactgcaatatcatgggggtatgacataaatactgccaaattgactaccagtttgcactcctcccagccg

SEQ ID NO: 34843 - DNA, 201 bp, Bos taurus
gcacagtggctgtactctctgccaggccgagtctactgagcactgcctagaaccatgagacaagtgctagggcaaaacggtggatgaagaacaaggggcarccatcagggggcaggggccccgggtcccttcaggtgcagaaccttctgttcatgctgtccagcccagcagagggggcagagtggagatcagagcagaggg

SEQ ID NO: 34844 - DNA, 201 bp, Bos taurus
tgttgtacttatctctgtgaccccagcacctaactcaaggccagacagagagtaagtgctcaacacggaggagccactacgaaccagagaaagagactggrtagcacatagcttcctattggccgagccaccatctctgccactttctggaaactggtgggtccctggatgtgggagaagagagcccaggaccgcttgcct

SEQ ID NO: 34845 - DNA, 201 bp, Bos taurus
agagggctcagtccagagcagttgccccagccctaggcaccatctgccccagtcttctgagaaggtaaaggagacagagaatggggctagcccaggcctgmaggcttctgggagcctggcaaagagaaggtgggaagccctcctggtcttatggagagccagagcaggcactctgactcatgtgtaatggcctcacccact

SEQ ID NO: 34846 - DNA, 201 bp, Bos taurus
cagacacatattataggacagaactagggaagaggaagacatgaaagaaggggtcaagaaagacctgaaaataacatttaacatccacatttttaaagtawacaatacatactcattgactcttagggaaataggtttaaatttatcttaagttaaagaaaaaaacccacactgggatcaacaagtccacattgctatttt

SEQ ID NO: 34847 - DNA, 201 bp, Bos taurus
gggctaattcattcggggctggagctaggaacgtcgacgtcggctccagcgctgagcgcagcctcactcccaattggctgggcctccggcctgcctatcgycgcgcaccacccctgggttcccttcccagtccgcagtagaaatactgccttctcccttctttgaccccggcccttcctccccttcgtccctccctcttac

SEQ ID NO: 34848 - DNA, 201 bp, Bos taurus
aaggcctgaaataaaatcttctatgcaactttgttactgctgaaagaacactttcctttctttttcatgatttatcttgagagggggcccaatactattcycaccatttgcttttctccttaaagcaccataaccaagcaaacagccagtggttgtggccactgccaggcacgggagcctggccagagcagccctgaaaca

SEQ ID NO: 34849 - DNA, 201 bp, Bos taurus
ccgaatagacgaacgatactgcgcagccccaccatggcaggtggctttctattcttcatgtcagggtggggtgagccttgttagggtgagttagccaggcrgggcctgggttctgaggtgtttgtttttgctgttccttcatacctcctgtcatttgttcatcatgtaagatattttgcctgtgttggaaggaaggggaca

SEQ ID NO: 34850 - DNA, 201 bp, Bos taurus
agcttgcttcctcccaggaaagcagtccttctactctttttgtttcctgcccactctgaggacacaaagcccttctctctggccaggtatctgttggtaaytccaggagagtgtatccatctcttcatctgcagcagctatactaggtatctgataccccatttgggagcacccctgagatccttagtttctgaaggtact

SEQ ID NO: 34851 - DNA, 201 bp, Bos taurus
cctgttgctttgaatcataactgttccttctatctaaagtagccttttcaccaaattctccacttatttttagatccaactctatatttactggagccacrgggccttctcagactagccctaccaccttggaatcagtctctaattgttctttatgtatgtcttcatttcttaaggtcagggccatgttctttatttcct

SEQ ID NO: 34852 - DNA, 201 bp, Bos taurus
tcagccattgaaattaatacattaagatatctcagaacttctggccaacagataagacatgactatttcatgatgacaagatataaaataaggataaataygacaagaaaatatcttcattctaacatgggtagtaattatgttcctagtgttgtcaacagatcctgcccttctttattctaataagaagatgttgaggtc

SEQ ID NO: 34853 - DNA, 201 bp, Bos taurus
ccacggagcctccgcttccaaatctctttgtctactcttacagactgcattgtgtccttgcccccacagcctcccgcggagatgagggggaggcccaacarggaggtaatatagattatgtgaggtgataagggtgggaccttcatcgcataggactggtgtccttgtaagaggaagagagagagactcccccaaaccctt

SEQ ID NO: 34854 - DNA, 201 bp, Bos taurus
cagaaaacttggaatgagctgcctgagagactcctggtcattgtaactattcaatcaaatgctgagagaccagggatttttataaagggactccagcaccrtgttaactggatgactcaacagccccttcactctaagtcaaacaattctctgtaggatacaaactctagatcctgctgacaaatggtatcttagctgtca

SEQ ID NO: 34855 - DNA, 201 bp, Bos taurus
gccactggcaaactaaaaagaagcactggggcccggtgctattcatgagccatgtgtttcattttaacctgagatgaaatagccagcaaccctgccttcaygctgtgtgttccacaagggccccactccccacctaccggttctgtggtcaggtccatgactgtcttgagggccctcggtttagaagagagaattggaaag

SEQ ID NO: 34856 - DNA, 201 bp, Bos taurus
ttcaaatacctggacttgtaagcagacgggagagaaagcagtgcagctgctgctgcctttccaagttgtcagccctggaattggtggcagatggggggacraggcttctgaacctgtagacccaaggagagaaagctacccctgtgacagctaaaaaatgtagccaaaattccattatttgagtcagtctataatatgttc

SEQ ID NO: 34857 - DNA, 201 bp, Bos taurus
aaaattaatctagaatgtcaaacctactatttcattgtattgttgcttaaaaagatgctaagggaaaatgtaagttaattttaaaatgtactagtaatttrgtagacagatgtgcagaaattatgaaggtgatatggttaaagtttgagaatcagttaacagtgaaactagaaaagcactatggatattttggaagaaaaa

SEQ ID NO: 34858 - DNA, 201 bp, Bos taurus
tcactttatagttattctttaagctgttaatatgctttatacaatcttttgtataaaagagatgtacttaaaaaaaaaaaattgtaaggggctgtctcttraggtagcagatgctccaccacatatgtttaatcagagctaaaggttcacatatcagatgtgttatagcaggaactcaagtactcatcaggaatttggact

SEQ ID NO: 34859 - DNA, 201 bp, Bos taurus
gaagcctattgatctacttggtttcatctgctgcaacatgcacaacttctaatatctctgccttctttcctccaatatgtctttgcttcatttcccctggratttccatttcccaaaaagtttgctataaaaatgacctgtaatacatccatttcagcacttttccatctgttcactaaaatccattcttcatagctcaaa

SEQ ID NO: 34860 - DNA, 201 bp, Bos taurus
tttgggctatttttaaattaatttttagcagtttttttttttttttactgtttttggatacttggtatatgtgtacttgcatctttatttgtcatttttaycatatctttagaaacaagaacttttcaaattttattataatgtccaaattattatcatcattttatttcttttatggatagtgctttctgtgtactaaga

SEQ ID NO: 34861 - DNA, 201 bp, Bos taurus
tatgcagaatcttaaaaaaatgatacaaatgaacttatttacaaaacagaaatagactcacagaaaaccaacctatagttatgagggggaaagggttgcarggagggatagattaggagtttgggatttacatgtacacacttctgtatttaaaataggtaaccaacaaggacctattgtacagcacaggaaacactgatc

SEQ ID NO: 34862 - DNA, 201 bp, Bos taurus
caggttcctctgtccatgggatttcccacccaagaatactggagtgagttacctcttccctctccagtgggtctcctttgtagcaaaagtggtgggtccaygctaagtaagttcctgtgtatgtattattttacgtgaagaagaggaaaacttttaaattgtgttgcttggtagcaatctctaagataagaaggattctga

SEQ ID NO: 34863 - DNA, 201 bp, Bos taurus
actttggggaggttcttaagtcataaattttgaaaattttctctgcataaatatacatatatatatttcccaaattcttaatgttgaaccttgacccttayactttcagagaagggcatgatctacttatagtcatagctcttattttttattaaagtttcaggttttgtttcatagatttgtatgaattttctgtatacc

SEQ ID NO: 34864 - DNA, 201 bp, Bos taurus
atatgtgtgtgtatgatgtgtatgtgtgtgtgtatgcacacacaaacatatatatatgtttgtatatatacactgaacttagcggaaatttttgaagccayaggaacaagaatgaaagatagaaggttagttaagatgcttgagtgcaggctagataggatgtgcagctttggatagaatgtttgctgtggaaagaactag

SEQ ID NO: 34865 - DNA, 201 bp, Bos taurus
ttctgttcttgtgatttatttgtcattaattccttgataatggcaaacactcaagttcagttttaaaaacagttccttatgcttgaaggcaggaagttgayttaaataacttgtagatcatatgatttcactttaaaattgtaaaatagttacattaaaatgtatgattcccattttactttcatcatacatttttttgcc

SEQ ID NO: 34866 - DNA, 201 bp, Bos taurus
cactaatcagtactactacgtaactgacgtgagcacaaagtcaggaatttcagaggatcctgggaaaccagtcacatccagctacaaaataaaatgaggaygtaaaagaagttaaggaaaaaggatagggcaaattattcaaattgcattactgttccttttaaaggtctctaggcaaacatctgatggtgggctttaatt

SEQ ID NO: 34867 - DNA, 201 bp, Bos taurus
aaacaaatataactcctggttagcttttattacatgggaacaagagcaattaaatcaaaacaattccacatagtaagggaaatagaaatgtataatgggcraacgagaagatgaccgaactttgaaacctcatgattagaaacaaatatttaggaaattgttgattttcaggaaatacttgtgtaattgtgttcttaggag

SEQ ID NO: 34868 - DNA, 201 bp, Bos taurus
caaaaatttgaatgcctcttcaagttttatttataattacctttgataagtaaaaccacaaaaacagaaggaaagagatgttctgttgttacagagtttcyaaaatgttggacaaatagtgaaatgtttttaataatatatattttctttaaaattacacttgagcttgctaagtggtttaatgtatgcaatagagcatta

SEQ ID NO: 34869 - DNA, 201 bp, Bos taurus
aagtacaaagagctatagacaaggaaccagaagtctcttcctactactgaagctgagagtctaggtgactgggagcaagtcacatacttttgatcaggttygattttctagtctattttgtgaattttaggtacagactcaattctgtctttgtcaatgagttcgcatgaagattgaatgaaatagatgtgaaagtggtta

SEQ ID NO: 34870 - DNA, 201 bp, Bos taurus
tttggctggtgttaaatattaaaatatgatattgactgaaacaattgataatatctaaagaaaaaattgctagcacataagctaaaattctgtatgagcartgttagtaagtggattaaatattggtaaatgcatctctcttgctgaagtcataggaaatcatgtcttcctgtgacaatatcagcctttgatttctcattt

SEQ ID NO: 34871 - DNA, 201 bp, Bos taurus
aggaatgtaatatatagctttatctgcctattcatatctaagattacaggaattcaagtattctcagcatgatgttgacacggtttgataggagtctctayattctcactgtagctttcactgaagggttttttgtgtgttattaagttcttttattagtaatgctaatactacttggggattagattggttatgtttccc

SEQ ID NO: 34872 - DNA, 201 bp, Bos taurus
ttgtccacattgtgataaggaagaattgttcagagtgtgtagtgtgaataagaagctcagggaggcaataaagaaaaaagagtctgaacatcaacctgggrtcttctcaccagccaaagaatagaatggtgaaggagagggaatcattatggtaaatgcattggaaacaaaaggagaactttgaggtgaggacatgggtat

SEQ ID NO: 34873 - DNA, 201 bp, Bos taurus
aatctgtgacagatcaatttaggggtgttatataagaaccaggaaaagttgcaggtgctggaagaaacacagactggattttcttctatggttttaggcayatttgttcctcaacctgattaaagttattatttagtgttaaaatgtgatcctttctgttccaaactggtatttgtaatagtatgtcttccaaaatatatt

SEQ ID NO: 34874 - DNA, 201 bp, Bos taurus
actatgaccactatctggagacccttacttcctattggtacataagttccttctatcacatttaactaaaccatgaaactatggccactctagatataaayttggatggttactgaaataaagaataaagtcaaattctgtgttctttttgctgttaaggcctttatttgttttacaaaataactctctcataatcagaag

SEQ ID NO: 34875 - DNA, 201 bp, Bos taurus
aacagcatcacaaagcttctcataagatttagctaggagtgttagggtaggagaaggatttgaaaaatactaaacctgctttgaaaatggaggaaaggccmtggaccaaagaacctaagcagactctagaagctggaaaaagcagagaaagaaaatctcctctagaacttccagaatgaatgctgtggaaacattgatttt

SEQ ID NO: 34876 - DNA, 201 bp, Bos taurus
tgacatcattactgctgactgcattacctgctggagaaccagaggctctgataatctgactctctgactgttcttgtaattccacacctttattttcctgraaggcaaagagcaaaatgttatcgacctaaaaaggtttatccaaattgttcaaagtcacctgtctttaggaggtctaagattttagtgaccaataattgt

SEQ ID NO: 34877 - DNA, 201 bp, Bos taurus
gagtgatggttgctataagctcctgtccaacagtggtctaggccaaaggattcccttaatgatctccactaggcaggtcctaattgggcctcctgagaatyctccctcactgatgggagagctggatgttcactttgggctcttcttcactactagataaagtttagatgtagagaagagctatagattcatgtctgtact

SEQ ID NO: 34878 - DNA, 201 bp, Bos taurus
atcttatttctgagcccagaagtctgatatagtttcactgagctaaaatccagctggcagggctgcattcctttctggaggccctaggagagaattcacayttttgcctttcccagtttctagaggctgctcttggttcttgatgtagctccttttcattttcaaagccagtgatggccagttgagtttttctcttgatac

SEQ ID NO: 34879 - DNA, 201 bp, Bos taurus
ttttattaaatcttaaggtaaaagaaccactttagaagctgaaactaccaagctcagttgacactagaataaatcccattgcttccaggttgactagtackgctaagttccaacccttctagaatgtcactagtactgaagcctgagtcaccatcgtctctgacttggaacactctactggcctcctaatgagcttcccta

SEQ ID NO: 34880 - DNA, 201 bp, Bos taurus
aaacattccaattgttcattctgatcgtctaagcaatctttcagttgaatagtacatgtgaattataacatcctatggccaaaccataaaatcaagaaccrgtggctctgttaatcagttttaatttaggatgtgagccagatatatattagagtgattgcctggactggccaatagcttcagatcagatcagatcagatc

SEQ ID NO: 34881 - DNA, 201 bp, Bos taurus
aagcagttttagtgccatgtgaatcgttaagtcagccctgaatgtcactggttactataggaacctgggtaatggaaaatgaaaacagctggatttatgaygcccataaatgtgttgaacagctgcctactcactgccaatgaatactgttgagtggtaaatggtaagacctttacatacaagtatgtgggaaggaaaatg

SEQ ID NO: 34882 - DNA, 201 bp, Bos taurus
ttgagcatcagtagtgtaaaggtgtttacacagcacctgggaatcaaagtgtggccaagcaggtgagatcttcttcagcgtacaccttgctaatgattttkctctcagttttattttaaggttatcacaatgagttaaagaattccacctaggtctagactgtgtgaaaggtagatttctgtagacttgaaaaccaaggag

SEQ ID NO: 34883 - DNA, 201 bp, Bos taurus
caaggcactaattcccgcacctgccaggagtgatggcggctcatagctcatagctgagttcctccacagacaatgcccttggccctagaaaattgtcccayctgacgttattccctctccttgaggatagtccacacccaatgattgtttgctacgggggttcagtggcctggctcccctgcctaagtttggacctactct

SEQ ID NO: 34884 - DNA, 201 bp, Bos taurus
agggccattaccaattcccagccctaatgctcaatagggatgtgtcaaactgccagatttgtgctatccagacacagccaagctctggtttcccctggaaygaaaacaggccccatatgggctccgagttacatgtaggataaacatctccccttcccatttggaaaaaagcactgctttagacttccctagcagctcaga

SEQ ID NO: 34885 - DNA, 201 bp, Bos taurus
tggcggaaacactggcggcacatattgaggccgtatttccggatcagaccgtgccggttggagcagacccggctgcaaaaagaaacggcgttatagctagycacagaaagtgaattatcggcactccgtggggccaccactcgccctgcaggtctccacggacccatcggaggcctgcaaatggcggcagccacctctccg

SEQ ID NO: 34886 - DNA, 201 bp, Bos taurus
ggccaggcaggctgcctccctgcaccctctaagttgcaggagaaaacgagcctacactgctctgatattgcgatactgaccagcgagtgccctgctttctrgttgggaacgcgcttccctatctcaggtgctttcttggaacccactttgcgctctcatcgctcccctccaccttccgtgactcccgtcgggctcatccgg

SEQ ID NO: 34887 - DNA, 201 bp, Bos taurus
ggtttttaattaagttacatacataattgtaacttagcagcaagtattttgcatactgagcataggaatgtaacttacagatgttttaagcctttgtgctmtgttttctgatctctgcttgcagggtggcattccaccacagccacgagccgcgcatacgtgtgcagttcttggaaataagggctatatctttggcggacg

SEQ ID NO: 34888 - DNA, 201 bp, Bos taurus
gcaggggcacaggttcagttccaggtcaaggaactaagctcctgcatgtcccacagcacagccagaaacaaacaaacataaagcttaacacagatgaagcratattaggagtagaagcccttgaatgtaatattaatattctgaatcttagaattaactttttgattcagattcacttttagacttagaatgagttaaaac

SEQ ID NO: 34889 - DNA, 201 bp, Bos taurus
aacctctggaactaatgagttaactctagtgtcctggcgtccacctgacttcttttagtaaacgtttcctgccagaccggggcgactcaggccggcaagcygacagccctgccaaagtgggacgcaagacctggcgagaccagcagcccacgagagccggggggtggcgcacgtggccgccggggtcccccgggtatcctc

SEQ ID NO: 34890 - DNA, 201 bp, Bos taurus
catgtgtaccctgagaggtaagaggtgagagataaagtgaaagtgttgttctaaatgtgggtgcctggcaagcctctgtccctgagctggaattgctatcrtaatctaaaatcaacagaagaagcaatccagggccaagtacggggcaggaaccagggtcatgggttacaaattgatctgggagtgaaattacaagcctat

SEQ ID NO: 34891 - DNA, 201 bp, Bos taurus
tgttcctgctgcagaccctgggcacccaggttccagctataggagctatgaaaacccaagccacactagagtatccaactgctgtggctttatcttttgtkggcaggcctcctccatcagtaccacaacctctgcccccaaacagaaagcggggaagaagccaaagagaggagcttaggacagtggtgaggaatgtattga

SEQ ID NO: 34892 - DNA, 201 bp, Bos taurus
atgtatatataaaattatgactggttcatgttgctgtatggcaaaaaccaacacaaaattgtaaagcaattttccaccaatcaaaaaaaacaaacacatargggatagagctagtttttcataggtttggtttagaggttatcatctccccatttccactgattatatggcttgtattaaatacccagagtctagaaaaaa

SEQ ID NO: 34893 - DNA, 201 bp, Bos taurus
gtaggcactcaagtcctcccagtccaactctcataactctctctattcaaagaacttaccccctttgttaaaaggaagcctgtactaacacactcaaatcyaaacccatgagaagagcccaacacccactcttgtagctgtaatgaatcatcttaaattagatctgatataagcaaagacagggcttccctggtagctccg

SEQ ID NO: 34894 - DNA, 201 bp, Bos taurus
ggccttgtgcaggccaaggaagcccattcagggacagaagcgggcatgagagaattaggcatgtgccatgttgtattatttgttcaaaatattttctgccrtcttctacaaggcccttctctggcacctctctattggaagagtgtatttcctacagcacggatgtcgatcttggccacatggtttgttttagccaatgga

SEQ ID NO: 34895 - DNA, 201 bp, Bos taurus
ggaataaataacttagaaccaagaattgaagtacttttacttttggggttccctttcccttttattgtagggccaaggcagggtcacatagcatttattcragttattcaaatattgtagtcttttctatttgagtatctccactccacctgccatgtgcggtgaaaaaaacccatgaatattgggatcaggtggatacag

SEQ ID NO: 34896 - DNA, 201 bp, Bos taurus
acccctggctcatctggctccaacgcagacctcggcaggggaccctggagctggtcagtggacagtccctctgagtgacatgtctcacctcaggcacatgmctggccatctctctgctttctgccttgggactttctccaaagtctgcttggtccacatggacgtgatgtagaagtgtgggagtgttaacgccttagggga

SEQ ID NO: 34897 - DNA, 201 bp, Bos taurus
aagtgaaatattagggaattggaattagagcatctgtatgaaattaagaatacatataccatagtattttttcccttagcttactgaatatgaagttaaaycttataaaaagcacctaagaaacaaaagaaacttgaaaagggtctagtatttctaataataggctgcttctattacaagttagttatctacgttaaatct

SEQ ID NO: 34898 - DNA, 201 bp, Bos taurus
acctgagctggcttttagggcctttttagctggtgtgcagccaggcctccacacatacctgggctgcattttgatgacttaggtttactaaaaaattcttyggggccatttacaagggaccctcttgaatcacagagtggatttaaagcattccagagcagaaaagcacagcagtaaagtcagctacagagtcccacctta

SEQ ID NO: 34899 - DNA, 201 bp, Bos taurus
acagcagagtattcacacatactctgagttcctgatcctctggttcaaccatggtgttgcctccacccttattctagaggcttgttgcgcctcttttcttygattgtgctataagacagaaatagacccacaccacacattcctcctcattcagcctcttccttcaatggtccaattctgataacaaaactctgccccttg

SEQ ID NO: 34900 - DNA, 201 bp, Bos taurus
ggaggagactgccaacattcttgacctagttcagtcaattggcaagtggatcagagagaagtcttaatatattgtgaataagctcttcttatttcaaaaargatccctgggaagacatcataaaagcctttcgatttaccttctcatggaggtctgctatagttaagagtctgtctacagcattttaaaaaggaagcaaat

SEQ ID NO: 34901 - DNA, 201 bp, Bos taurus
atgtagcttgactaaatataataaacctgagactcaaaaactttatactgaaatatcagtgacaccataaagaatatgaagtaaatgaataataggttcaygaagggtggatgaaagagaattatataaggagggatatttacaatccaacatgagggggcaaaagtcaaagagacttttgattgatgggcttaagccaaa

SEQ ID NO: 34902 - DNA, 201 bp, Bos taurus
tgttcccagcctcctagactggtgcttactcttaacactgacatgtgaatatggcccagtccttgaaattctatccttgacatgacaatggcctgtatgarcggtggtcttgagatacctgaggggtgaaacaaaagaaaactagccaaaaacataaccatttttcataaacttcactctatctctccttgccctgcatgg

SEQ ID NO: 34903 - DNA, 201 bp, Bos taurus
ctaatctcccccaaccccagagggtcttaccttcaaggccagatctagttaagagtgctacctaccaaccagcaccttattctcctggcctgtcaaaactkaacttcagagtctgaggtcctttgggaacaatctaaaatctgtgattcctaattccaactccagtctaactaccagtgttccttcttcaaagaactcgag

SEQ ID NO: 34904 - DNA, 201 bp, Bos taurus
attgaaattcttcccgagatatgcagctaactctctatgagtttgtttatctaaaacagggaatgcctccttctgttttttcatcctaaattcctttcagratgcattgttggttggttctgagttctgacttaactcttgtataacttgttgttacatatctttttaatcagtagtatgtggttattcacagtattttaa

SEQ ID NO: 34905 - DNA, 201 bp, Bos taurus
tcctcccttggccagactttctggtgttgtgggtgtggcctctgaggactgtgctgcttttggcgtttctccagctctggagagtttgcctaaagtgtgcragttccaaggtctttgaatagcaccaaagaaatgtgagatttttattttatgctgttatgtctgcctgtcacattatgctatatttattaggctctaatc

SEQ ID NO: 34906 - DNA, 201 bp, Bos taurus
aattggtaccatcccagaaaagcctcatggaaatagtacacagtggattgattgcttccttggttcattctcttccctcttggccccagagtgctttcgaytggtgtggcttccacaccagccctcattcgtcttagctctccctgtagctgcacagaccgtaaaaatcactattcgtttgtgaaaatggccaacctatgc

SEQ ID NO: 34907 - DNA, 201 bp, Bos taurus
accgccagcatagcacaagccaggaaactggtagaacagctgaagatggaagccaacatcgataggataaaggtgagcatggcgtcacacacaggctcagytggccttgtcaggagtataacttgtagccaagtgtcatttgactactcttctatggagagtgatgaaaccaaagatggtgggagagggcttccctggtgg

SEQ ID NO: 34908 - DNA, 201 bp, Bos taurus
gccacaactactgaagcccttgcaccctagagcccatgctccgcaataaaagaagccaccgcgatgagaagccctcacgcaactagagagtagcccctgcycaggacaactagagaaaatccagttaaggaccaaaggcccagtatggccaaaaagaaagaggaaaaaagggaatgggtcttggactctcttaagcccctg

SEQ ID NO: 34909 - DNA, 201 bp, Bos taurus
ctcagagttgttataaaagcttacataacatttaaaggtattttataatgtaaactattctatattagaagtgtttgagcactccttcagtcaatgaatgmattttaagcagtattcatttgtgggccatttgctatcactgggggaaaaaaaaaaaagatggttctctatggggcaaatttatacagataaggtcactgt

SEQ ID NO: 34910 - DNA, 201 bp, Bos taurus
atcctactaatacttgacccttcctctgtagctgtcaccccactattagggctgatggttgcatacatccaactggcttggaagaaattccgttcactctrtatgtatcttccccaatggagctgaagttccttgaaaacaaaggccacccccagccctattccttcatagttactttgcatagaattcactgcaaaatat

SEQ ID NO: 34911 - DNA, 201 bp, Bos taurus
atcaaagctatctataatctctaaaagatgtccttataatactaatttaatcaagctgcaaaaaaaaaaaaaaaccaaactaccatatagaaaggaatatrccatcatcatcactctttgaaattcatgcacttgttgcaagttgccattctagaccaatgtatatcccttgctctctgaaatgtatcaggtgtttcatct

SEQ ID NO: 34912 - DNA, 201 bp, Bos taurus
gtaggtagtataaaaggaagagagataagtgaaacccagttatcttttgagtaacagcatttttcctattctggaattttaaagcattgttttagagttgracttttatgtagccaaatatataaaattgatctaaaataatttcactacactgacttaataattgaatttggcccaggcttgtaggaatcctgtgggcat

SEQ ID NO: 34913 - DNA, 201 bp, Bos taurus
tgtcatcagcttagagactgtgacagatcgttttttaggctaaaatgttttatttttcatagctgttgaggctgtatgttattacgaagacctattgtaaragactttgccctctgaggggacagggcatgggagcttaagatgatttttgttgattacctctgctacttctgatgatttttcaaaagaagattgaaaaaa

SEQ ID NO: 34914 - DNA, 201 bp, Bos taurus
ggaaatcccatggacagaggaacctggcaagctacagtccatggggtcgcaaagaataggacatgactgagcgactaacacacacacacacacgtatgctrggcattctgcagcttgtgtctttgcaggcctagccagaaggactgttttaacagcctcagctactccatctgctgctcacttttcacaatggtaaccaaa

SEQ ID NO: 34915 - DNA, 201 bp, Bos taurus
caggtgaggggcccaagatcagagagatgagtctattgctaaggtcacacagctagcctggggcagaagtggagttcaaactcaattctaagacagggccytctcaagtgttggttccccaaacactgggtactctgattttgacatccttgcagaacttgctttagaaaaccagttctggagcctcactcccagtgagtt

SEQ ID NO: 34916 - DNA, 201 bp, Bos taurus
ctctctaatgaccgtgaaccaccctgcctggaaatgcgtgtgcaggcagcaccctgtcctcctcgacttttctgatggtctgtgggggtgcttatcccacmctggtcctcccatggcctggcgcatgcggtgaatgcagaggcggctggagtgccttccgcctgcaccttggagcagacatcaaattaactctggcccttc

SEQ ID NO: 34917 - DNA, 201 bp, Bos taurus
ttatttgagtttttgatgtctgcctcctcctgtgggctgtaagctccatgagagcagtatggtctgtctgctgttctgtgtatagtgcctgtgggtgttcmtaagtatttatggactgaattaataaatggcttgtttttctttggttgatgcaagatggcaaggaaagctgcaggacctcacattggcaagaagccaaaa

SEQ ID NO: 34918 - DNA, 201 bp, Bos taurus
gcatttggtgttgaggttgtctctattcttcagtttgacacttaatttgttaccggtttatttgtgttttgcatatttctaaaaatgattttgagatagcycaaaacaaggccaaagcctattaaaacaagaaaaaatataaggtccaaatggagaagagggaattagagatgaagaataggaggataattataattatat

SEQ ID NO: 34919 - DNA, 201 bp, Bos taurus
tggccattacccatataataagctagatttattgtacaaactttctgaatagcttacattagggattggcaaaccacacctggcccagctcctgttaaatwtaaatagccacaagcgttcattcaggtatatcagtgactgctttcacacaatgatgtcagggttgaaaagttgcagcagagactatgtggccttcaagtc

SEQ ID NO: 34920 - DNA, 201 bp, Bos taurus
agaagaaaataaaaaccacacgggcagacagagagcccccactttacacactgtggctcagactcagagaggttaaaggcctggcccccggtggcccagcrggctgcatgggtcccagaacagtactggtttagtggtctgctccctgcggcaggtaccatactgactaagttctagttctggactaggttctagacatgt

SEQ ID NO: 34921 - DNA, 201 bp, Bos taurus
cccctcctggttgccctggcaatggaacatcaccttacaggaatgaaataagattgagaagaaacccacaagcacaggggcgtttccgggtctacagactygctgtttctctctctactttggcctagggaaggcgggaaacagggaaggtagctgtgtatgtcttttactcattggcacctgcctgggaggaaacttcgg

SEQ ID NO: 34922 - DNA, 201 bp, Bos taurus
ggactcggagactcagacagttcttgtctacatgagacgcctgactaccctggaggctggcacggcatcctgccttgccattagcatgccggcctgatgcygatcaaatgacagcagggacaaccctcaggactgagcaatgggaattagatgatgctttcttggcctcagcccataaccgccaatcagaagccgacataa

SEQ ID NO: 34923 - DNA, 201 bp, Bos taurus
atggcaccaaggtgctgtgaaatcctcagacacccaagatcagagagccctctggttccaccagggggaaaggttgtgctaacaggtgggctggacgaggrggcctcacctctcactctcatctgctgccttctcggcctcctccagcttctgcagagctgttgccagacgctcctgggcacgatccaactcttcctcaac

SEQ ID NO: 34924 - DNA, 201 bp, Bos taurus
aggaaagtcagctagtatcgtcccggctaagagaaaaagagaagacaaagatcactgttgcctgttttcatctctgctcactctccatccacttcactgtytaagcagccatctggctgcaaaggctgtgtttctcccaggtgtatgttcagtgggggagccattactcacgtcgtctggggaggccaacttcccagacat

SEQ ID NO: 34925 - DNA, 201 bp, Bos taurus
ctgcaggaaaaaaaagagagagagaataaaagagggaggcactgggccttgccctggatgagtttaccacacggagaaaggaagctaaggagaggtcaagygagtccaccctcaggagctggcctttaacgttttaactctgcccactagccaaacagagcctgatgctgggcctcactagaagagctacttctgcccact

SEQ ID NO: 34926 - DNA, 201 bp, Bos taurus
gctgacgggcacacctgtcatcagtgtgcactctatcacacaggccagggtactgagctgctcactcctacacatggccagtccctctccttctccagackgactgcaacagctcagccacgacagagcaccaccctacccaccccaatcaacgccaaggcctttaccttgcaggccgtcaacatgtctgacacggccttc

SEQ ID NO: 34927 - DNA, 201 bp, Bos taurus
tcagagtgtggctcctggaccacatggccagacctgggaactggtcagaaatgcacaatcttgcccattttgggatgtactgaatcagaaacttaggggtrtgggtgtggcctagcaatctgtgttcaacaagacccccaggtgattgcaatgcatggctaggtttgagaaacacctgggcaaaggcaccacaagcctttt

SEQ ID NO: 34928 - DNA, 201 bp, Bos taurus
aaagaaactctcaagagagctgctatattatctggtaaaccaacacctgccttgggatgtggttatggaaactggaaggaaaggccttgacagacagccartcatgggtcagctgggttgttaaagggcacacctgcagtgggggctggagctgccaaccatgcaggagcctgggaaggtgggaaggcccatgtgtggggg

SEQ ID NO: 34929 - DNA, 201 bp, Bos taurus
atcaaggggctggaagactatgtgacatggcaaactgtgaaaaattcatccagctggattaatgtcagattcaccggcctttagttctaactcgtgagcasagcctggtcatcaatgaagggtattcctgtgagcactgaccaggactagacactgaaaccagggcaccaggaggaggcctttaactcacagccttttaca

SEQ ID NO: 34930 - DNA, 201 bp, Bos taurus
agccaaagacggcgaaggcgccaacacaaaccagccagcttcctgcctctccagatcccacagccctcagtcccggcgggatccctccctgggcaggaccrctttcccagggaggcaggccatttgaaaagcctcttctgccagtaaggctggaccaccaagtaagatggggcccagctcccctgcacagtcatccacccc

SEQ ID NO: 34931 - DNA, 201 bp, Bos taurus
tacatcaaactaggtcctggacacggatgccaagcaattaaatgggcagtcatgaagcatgcaaatagcgagagaagacagggccttgatttaaacacacraagtctggaggctgagagagtagtgcagagggaagcatagaacacttcacccatctgcaggaattcactctgcgagggcctcaaacactgtgcgagtaaa

SEQ ID NO: 34932 - DNA, 201 bp, Bos taurus
accagtaccaggccacggcccaggggttggggacccctgctctaaagaacataaactgggtgtagacgagataagctgtgtgatatccattccatagttcrtgaacctctttctcctttggccaaccaatcacaacctacaatatactatagaagcatacattagtatggagttgtgaactgttggggtttaaaaatatta

SEQ ID NO: 34933 - DNA, 201 bp, Bos taurus
aatccctagatgtccagcttccatcagacatttttacaaccctacattgagcaatcagatccccttcaaaagagatataagcaagagcaggttttgagatktgaaaggtagagagaggaccaggtggtactaggcaactgaaaggaagagggggcttggatgggtatgaaaagactgcaaatcaacttcccttttgaatag

SEQ ID NO: 34934 - DNA, 201 bp, Bos taurus
tgtatattttggcagatagtgcccgatttagttgtaataattcacagcactgcttcggggcttccatgttgctccaggcaaaaccctgtattataaattayagcacacaaagctgaatttgacctaccagttgatgcataatcaactgacttaattctgaatattaactacacattgtggcctaaaggttttatgctctct

SEQ ID NO: 34935 - DNA, 201 bp, Bos taurus
aagtccagccacatgtcttggaaagactcttgagaagagcatctcctgtcaagggagactaggtatccagcttacttaggagcagttatgacatcctctcrgtgtgattgtggtaccagatggtaccagaaggtgacatgacacataagggaccactgactccaaatctgcccccttcacatccactatacatagcccttg

SEQ ID NO: 34936 - DNA, 201 bp, Bos taurus
tggctcagctcccagggcaaggccaaggtagagcaaaatcttgcacccaggtccctgacttccggccaggattcccggccacgcctctcttcaggaaccakctcttggcgtagttcttggcaattcctcttcagctccatccaccacccctgtgcacactagcaggcctctttcttccaggaatgattacacagaaaatgg

SEQ ID NO: 34937 - DNA, 201 bp, Bos taurus
gcacacataccgatttaatatttcttatgttctctacgtttacttcctgactagcagtatcttctcctcaacttttacaaatttctacaaatttaagcatrcgaaatatgcttaaaatatcaagtgagtattttgcagccactctactttgagaatctgccaggcctactcagagcatgattctgaaatatttttgctttg

SEQ ID NO: 34938 - DNA, 201 bp, Bos taurus
cttgaatctaaataaaagcattggcttgttggggccacacattggtaccatactcagggtgaagcctggcccccagtaagaactcttagcaagtgggctcygacttatgtagggtgctaagtcacttcagtcatgtccgagtctttgcgaccctgtggactatagcctgccaggctcctctgtccatggaattctctcagg

SEQ ID NO: 34939 - DNA, 201 bp, Bos taurus
agacagagccaatatttcagggaaaaaagtggaaattggtgtgggcttatgcctcaaccagaccctgtgccaatagcttggaaaaagctctcctgtgtttmgagacaaatgtacatcaataataatcacaatgtgtgatggactttatgatctaagcactttcagagccttttgaagattcaggacttatgtattgctggg

SEQ ID NO: 34940 - DNA, 201 bp, Bos taurus
agattgcttattaaaaatgattttataatgaagttgcctcaaatagcagctcttttcctggttgtccttgaagctgtggtgaagaatctcagagacaactrtctagggttttcctccttgttaaaaacttctctctcaccactgttactcttgatttttaaggagacaaagtctaactgacacaagtccctctccagttga

SEQ ID NO: 34941 - DNA, 201 bp, Bos taurus
ctgaatgctagatacaaggaagctttgctgttacagtaagacaggcccattgactgcccactgcatggtattatccacccatcacggaagcctggctaaawatcccgaaggccaagtttgttaaacaaaatggttatttggtaaggcctgcaaaagggccaagggtggaaggacacacaccagttgaagcacaggatttgt

SEQ ID NO: 34942 - DNA, 201 bp, Bos taurus
agaatttcttaaaatttttataccaaatttttgtaccacaaccatagtcctagttgtgatatgactgactcagcacttaacccactaggtagtaaagcatraagattttaaattttgttttaatttctttgagatacatgacctaggctgtatcttttgaccatgtcatgaatggcctttgtgatgccactgtaatttttg

SEQ ID NO: 34943 - DNA, 201 bp, Bos taurus
gcgtgctgcgattcatggggtcgcaaagagtcggacacgactgagcaactgatctgatctgatctgatgccttctttggaaaaatacctatatttcttagrttgtagtcccttactccatctccaaagtacattattcacatttttgcttttgttgttacattgtgtccttaatcacatttacaagccattgatgggtaat

SEQ ID NO: 34944 - DNA, 201 bp, Bos taurus
gttaaagataatcatagaaactgtagggactagcaggccgccaagattcaggggagttttggtcccacaagatcagcaaacacggaaaaggccagaagccygcagtgtgtggtgtctatttcagatggaagtgttaaaccagcgtggtgtcttacctccaggcagtgctttcactcttgttcctggggccaggcccctagg

SEQ ID NO: 34945 - DNA, 201 bp, Bos taurus
tgcctcccaggtaatatccttacttggagttccctgagagtactggtctgttttgtttctatgtcctggacgctaagcacagtgttgggtaccaggcctgmtgcatgatttgcaggactcagtgcaaaacgacagtgcagggttccttgttcaaaaatgaagaaatggaagacagtggccacaggaccttaacccctgtgt

SEQ ID NO: 34946 - DNA, 201 bp, Bos taurus
agatctctgtgggaaaattaagttgaagacttagatttaattttttgcttgctttcaatttatctacatgatggaaacaaagccatttgtcttccctcgayccccatgcttctcatcctggaccgataaaaaaagacataagagaagaagacagaggaagagagagtgtctaaaagaatgcaaagagagaagttgtaagaa

SEQ ID NO: 34947 - DNA, 201 bp, Bos taurus
agtgatgtgtttgaggttaatggttcctggactttaaggactggagtttctttttcaaaggggttttgccttcaaatatggaaaacaggccctttgtggcrtgtgtgcttttcctggtacaaagactgaatttgtaaacatctgtttatgaaaagttgcatttctcaacatcatggcatgatcttctaaaccaatacataa

SEQ ID NO: 34948 - DNA, 201 bp, Bos taurus
gccttgcatagacttccccatgtgctcctacaatgcatcattaatgctgtatcctccacctcttataaggattcactcttctcacaaagtctgactgatgyaatacctccagaatgttcagagacatgtcttagcattgtcattgttaagagcacagcagacataagcatcagtatttccattttccgagaaagctgacca

SEQ ID NO: 34949 - DNA, 201 bp, Bos taurus
attactaggagcaaaatagccacagcaggctgggacactaaagctgagcatagttctttagagatacccaggctaggatgaatattctcttctaggagtarggtagtggatatccctgagcaaagtgagattcttggctggagagcagatgttcatttggatttaccaaaatcaagaaggagactgcctcaatgacatagt

SEQ ID NO: 34950 - DNA, 201 bp, Bos taurus
gcatttaagataggtatccgatgatgctcattaaatacttactgaagccatgtgcccttccttcttggcccatcacaacacgggcctgtcactggagacamtttatgacatactacctcttcccccttcccccaaacaagtcctgagagataccagagtaactgaaattaagccattctagaaaaatggggatgcatggtc

SEQ ID NO: 34951 - DNA, 201 bp, Bos taurus
tgaaactatttaatcaggtttggttgctcatctcatcatcttgctgcatcacaccccttctgacgagttcattaactggaagaaaaattgatgacctcgtkagttctgcacattggttcacttaggacaaattggagctttagaatgtcgctcaactctgacccatggcgggacaaggtgtcatgctcaggaatgtttgga

SEQ ID NO: 34952 - DNA, 201 bp, Bos taurus
atcaagaacctgagcttcattaggtcctgaagccaggtactgtgggttttggctcggttgagtccaaggccaatggatgttcaagtaccaaatagggtttkggcagggtttgagtcccagcacatgggttcaagtcccaaagtcccaagcaggattttggccgggtttgagtcccccctacaagggttcaagtcccaagca

SEQ ID NO: 34953 - DNA, 201 bp, Bos taurus
aggagcctggcgggctacagtccacagaggcacaaagagctgaacatgactgaagcgacttagccggcacacacacaacctagaaataagcgtccaaataytgttcaatgatcaaggcaacccactgctgctattcaatcacaagcatgatctttaatgaagataactaattctaataactttcacaattcaaaatgtcca

SEQ ID NO: 34954 - DNA, 201 bp, Bos taurus
tgtttggaagacactactttgggaaagattccctagcatactgcttgcttggtgcaagaaatcctccctgtgatctttagcttggttatcttttggctcartcctgactaagaggtgaacccagttttctgggaacaatttgagaagtactgttataaagctgttcacccaggacaattttaccaaactctaaggattttt

SEQ ID NO: 34955 - DNA, 201 bp, Bos taurus
gtaaattagaattttgaattcataattttaggaaaattaacatttatacataaacttctcatccaagaacatattgtgtactttcatatatcttgaacttygatgaattttattagatttttttttttaacatattactgatcccaagttttttctcaggacttgattccttcagtttatcagtgaaaacttctttccaga

SEQ ID NO: 34956 - DNA, 201 bp, Bos taurus
aacaagattaactgccttttcttttcttaaattttcacaaaatcaagagggcatattacaatgggcagagtgtgcagcaaaaatatagtgattaaaacaayacttatcaacagtccacaaatcaaaagaggaaattcaagctttctaaaggaatacaaacacaattgctcaattcatcaataggatgtttcctttccagag

SEQ ID NO: 34957 - DNA, 201 bp, Bos taurus
aaaggatatgggttaaaggaatacttctcttgagtatatctttttgaacagttttacccattggaagcatgataatgttgtatgtgttcaaaaaataaaaytaagcagctgagggtagagggaataaaactaaagacaaatagaaataaataaaccccactgtatttcaaatgagtgacataacccccctgaagatggcga

SEQ ID NO: 34958 - DNA, 201 bp, Bos taurus
gtcataggatattagcccttttgtgactggcttattgcgcttagcatagtgtccttgtggtagcatgtgtcagaactgtctcccttcttatggctgaagastatttcattgtatgcatacaccaggttttacttctccattcaactgtcagtggacacttgggctgatacaatctatacacaaacaagtctcaaatgccaa

SEQ ID NO: 34959 - DNA, 201 bp, Bos taurus
tataaatcccactagaacgtgcagcaggcctaaaagcaggggtcttgtatgcctgagtcacagctttagccccagtacctcacataaggcctggctccccrtagatggctgagtaatttattaattattttacctccatgttccagggtttgatcgtctacactgaaggctccaagactctatctagctggtgcctggagc

SEQ ID NO: 34960 - DNA, 201 bp, Bos taurus
agagctttactccatggcaccacaatttaggtgaccccataaatttttaagttctacctctgccacctccctctcctctacctctccaaggtggggcactygcccaacctggggccaggagagatggatgagtcatcaaggacaagacacctactgcccctccgggtgcataggccaccctcacctgcctccatccctctc

SEQ ID NO: 34961 - DNA, 201 bp, Bos taurus
tgcaggagagtggttaggcaggttttggtgatgtaaaggatcactgccagattaacatacagtaagaaggtttttcttgttcagctatgtaaaatttcttkagaaaggttttatctatcctggttgaaagaggagtatttaatgcctttgtttttcggtagtcaaactaaccactcaccttgcccaagtgggatcaggctt

SEQ ID NO: 34962 - DNA, 201 bp, Bos taurus
cttgctgcaggagttaggcctactctctagttgcggtgctcaggcttctcatggtggcttctcttgttgctggtacacaggttcagttgcttctcatcacktgggatcctcctggcccgggggtcaaacccctacatcctgcactggcaggaagattcttcaccactgagccaccagagaagccccaaggttcttttattt

SEQ ID NO: 34963 - DNA, 201 bp, Bos taurus
ctcttataccttggcttcattatattttctttgctagttgtaaggtagctttgaattctagttttggactacatttcggtcacctctcttgagaacagtgyattctaaagtatgatgaagtgactcagtagtttaaactgagtggtcttttcatgctaccctttctgctaagcagtttacttgcatttaaggtattcactg

SEQ ID NO: 34964 - DNA, 201 bp, Bos taurus
tgggatatcaggatacttcactctaagccctttagcctatattttttacataagtgaaatacacaaatcaactctaccatttgatgagctttgacaaataygtctgtgtaacctaagcacctgtcaagatgtacaacatttctgtcacctgaaaaggttctctcatatcctttccccaccaatctctgcacctgtcccata

SEQ ID NO: 34965 - DNA, 201 bp, Bos taurus
ccagtttcctgattttgatgattatattgtgattatctaggaaaaacacccatagattgtagaaactatgtgttgaattgttcaagtgtaataggacatcrtggaagcagcttactcttagatggttctagattttaaaaacttctttgtattgtacttggaacttttctgtaagtttgggggtctttcaaaattaatcac

SEQ ID NO: 34966 - DNA, 201 bp, Bos taurus
caggattagagtagatccagtgaaatgtgattatctgagaggcttaatcactccaggctgcactgccatttgaaagacgagctggttaactgaaatgagtrtctaattggcagtctggagtgggggatctccctgaagcaggaggccttccaaattccctcacctgctccgggggtctcaggctcctccacccctccagga

SEQ ID NO: 34967 - DNA, 201 bp, Bos taurus
ctggagcaagtattgggttttctttcctattctttaaagagggtatttgttgcacaaaagtggtgtaacagtagaaaacaaattctaaaaaatagactcayattctcaccaccctaatcgactgactttttattttcccatgtttgtattctataatcagaagcaaataacatttttaatgtaactgtgcagatataactg

SEQ ID NO: 34968 - DNA, 201 bp, Bos taurus
gaaaaaacattgctggaagttcaaaggaaagctttggctttgctgatgaaaagtccagttgtagctggtctcaatccctctctagatttcctgccgtgaaygtggccaggatgtccatggtgacatcttctggtcatgaggcaaagcaagagtggaatggaggtgggacccagagatccgaccctgtagctaaaccaaccc

SEQ ID NO: 34969 - DNA, 201 bp, Bos taurus
actgttccctcatttaattagacaaaggcaaatcccacatgcaaaaagaattttattcccacaagagaaaaagtgtcaccatagaaaggaagcaaattgcrgaggatgttcttaatgctctaaatttaagccttaaggccctatctaaggtgtcttggaactatgtttcctggattgaagcaaacaactctaggggtgtgg

SEQ ID NO: 34970 - DNA, 201 bp, Bos taurus
cttttcctcccatgataactccaaatatatcagtgtatgcaaacagacattgacagcggtggtggtgaagtgtcagctacattggtaaggtctgggaccartttatcctaagtaaatatttgatgatattcaattcaaggagttatgtaggtgaaatatggcaaaaccacatctccacctttaaaaagtagctgagaatat

SEQ ID NO: 34971 - DNA, 201 bp, Bos taurus
gtgagcttgcccaggggaatctttgattccttgtctgtcatgtcctctatgatctcagtttattgatcttctgagtacaaagataaagaacatctatttayccaaatgtttgctcagagagcgtttaagggaaagtgtgttgactaaatgaaggaaggtcacttttgtttttgctatttctgtgatatcaaaggatttgac

SEQ ID NO: 34972 - DNA, 201 bp, Bos taurus
gtcatggggtcacaaagagtcggacaccactgagtggctttcactttcacttttctcctgtttacttataaataaatgagttccagagaaattgtgtgatragtcaaaatactacagtagttactgcatggccggcccagctatgagcctcctaccagctaattttcctggggactgaaccacctcaaaggtggaggagca

SEQ ID NO: 34973 - DNA, 201 bp, Bos taurus
gaaggcctgtattctccagtgaggggctggctgtcaatcccgacagggcctggttggaaactagaggagtcaggtggggacccagacttgcagacaccgtrgatgtgcaggaatgagggcctagtggctctgagcctttcaagtgtaaagagaagccagaagcatgagaaggagaaaaatttatggtcagctaattattta

SEQ ID NO: 34974 - DNA, 201 bp, Bos taurus
tccaatgaccacagtgatgttgtctcagcctcattcgatattcacagctaatcagtgggtaagcaatgctgtggaaagcagaaaagcctgcccagactaaygcaacttgggaattcctctctctgcgtgagctgggttgagagagccagccctgcactaaccatccatcctgacttcaggaagggatatggatgagaggct

SEQ ID NO: 34975 - DNA, 201 bp, Bos taurus
ggccttggtgtaagtgtttatcaaatctgacacacacctcggggctgtgttcacaagtgcactgattggttgatcattggctgtggttggttcatggactmaacagaagatggccaggtgtgaataaaagacttggagctttagagtcaagctggttcatcccctcccagagcagaggccttagacaagacacccaattct

SEQ ID NO: 34976 - DNA, 201 bp, Bos taurus
gatgatgccctatgtctccacaaagataatatttatcagcagttatcattttggcattacaatcagcagcatagagtcaatttcagagaataaaaaagaayacggaatccagattttagaatgcctaacttgcagattccaacttcctgcctgttctttttcccctaatgttagataaggcaaaattagaacaagcaatgg

SEQ ID NO: 34977 - DNA, 201 bp, Bos taurus
gaaaaatgctgttatttctgactgccaacttcaaagagccttgacatattgtctcctatatcttactcctatagtaacagaaactgtcaaaaatcagctaycactatgttattactggtgtttcttcctccctagactgtcagcttcttgagagtaaaggccttgatcagcttcatattctcagacattgaatgaatgaat

SEQ ID NO: 34978 - DNA, 201 bp, Bos taurus
ggtcacgatgctgaaagaggggaggaaaagagaagagaatgatgactctttaggctttgtagaggcagctgtcatcacgggcccactgaacacggttatgyaggttgtgcccagcactgagatgcctggcaatgagggaggggtggcactgccagcagaaatccaacctggtctctactcaccaagtcatagttggcctgg

SEQ ID NO: 34979 - DNA, 201 bp, Bos taurus
tcctgcagaaagataagaggctcacagtcgagttgagcattttctgcatgtggaatggtgagctggggagccacggggccagttggcttgtgacttgcctrgattttagagatcatgatggtaactgcaatgaaaaatgcataatactctcctccaagcctggtgtgattgtagatgatgtagccacttgggccaacagct

SEQ ID NO: 34980 - DNA, 201 bp, Bos taurus
tgagctggtgggtcgcccagcgcagcaagaaaaggccagtggtccagaccccttctcttcaagcaacaagatacggcaaagtgggaaacaggcctcatgcraaagtggaggtaagactctaagacagaaaatcccactttttcaaagccaaattcagggtgtgaagtttgctgaagtgggctccaaaggccccattccatc

SEQ ID NO: 34981 - DNA, 201 bp, Bos taurus
gtagatgcaaagccttttactgtatggctgagcaaggcctccatcagtccgtattaacaataactatgtggcaggtgagcagaggggcttgagggaatggraggcttgatcagaaagaactggatctcagagcccttgacatatgttaaccgcggactgtgacaagcgtggcggctttcttcttctgtggtctcagtacac

SEQ ID NO: 34982 - DNA, 201 bp, Bos taurus
gaagagtctaaatcccaaatcaggtcacgtccactcttgctgaaatatgttgatggcttttcctgtgctcttgaggcaaagacaacaaacctctgaccccygtccacagggctaacatggtctacctaccttcccaacgctatcacatcccacgcttctcctcactcaacccatccttccactggccttttcatgtttcct

SEQ ID NO: 34983 - DNA, 201 bp, Bos taurus
gtcccagggctccctgtgccggttcctgacacctacctcagagctccacagggcacaggacctgagcagtctgttcagttatcttcccgaacaggagccayggcctcgacccagcacaggcctaactccttagaagacaggggacttgctcacaagggtgacgtcactggcaaaccatatacagtgacatagataaaaatg

SEQ ID NO: 34984 - DNA, 201 bp, Bos taurus
ggtcggatacaaagaggaggacacacggggagaagaggaggcaggcagggaagagagtcaggaaggagaaggggcagggtgcctataaccaggctagctgyggaatcattgagtcagcccagtgggcagaggtcccaggactcccagccctgcataggcagagtaggaggcaggggttacctccacacacacctcgcactg

SEQ ID NO: 34985 - DNA, 201 bp, Bos taurus
agaacctcatacaagtgtacttccaaaatcctccctcccatcttttgggtaattgttgttatacctctagcttttatgtattttatatatcccacatacartattactatttttgcttagacatatagttattttatagtgtgattaaaaatgagggaacacatgccttttgtatttatttttaccatttttggagtcctg

SEQ ID NO: 34986 - DNA, 201 bp, Bos taurus
gggggatagacaggtaagagcagtttacagtaacttggaaaccaaagcaaggcaattatataaagtaatttgtctctatgtccaattaataaaatggcccraccatcaccaaaaatacatctaatcaacaataggtaaagggaagcaagtattaatgaaatcaatgaagggcccaagggtagaaaaatggaccaaagttgg

SEQ ID NO: 34987 - DNA, 201 bp, Bos taurus
acgaacacaacaggcacatgcttccctaaatttttatatgggtacacatatgtatactgaatatcttttttatatatacacatcatctcagacatatatayggttcataaaactgaaaacataaagatcttcctctctgcataggaaaatgttctacagacctgtgggaatattaaaacaaagaggaagaggtccgtaatc

SEQ ID NO: 34988 - DNA, 201 bp, Bos taurus
atttttagatgacaggaaattggagactgttgacaacatattttgttatttcagaaataacttttgagtgatgagaaatatttatgacatactcactaatkaaatatatagtcctgaatagtttatttttcctgctttaggatactcaaaaatacttgatttttcagtcaaattgttttaaagatatatataatgacttga

SEQ ID NO: 34989 - DNA, 201 bp, Bos taurus
tgattcctattctccgtggagaggcagactcagtgttattgcctgaagattgttttatggattttagttttttaattcccatgagagcattcaaatggccrcagctgctgggcttatcaaagtgtagctgaagacatctgcactgtgtttcctgctgttttttatattctccatgcttatttaaatgtaatgtaactgacc

SEQ ID NO: 34990 - DNA, 201 bp, Bos taurus
ttaataaatgagaaaggggacatttcaaaggccactggcagcaaagaaaatttaggctgagagaacttgagttgctcagagctatatttaatagcagacargtataaaaaagatagcaccatccttactccaaatagcagccagtacccagtggagctaaaatttgtgaaaattacctacatcaacttttaagtagatgag

SEQ ID NO: 34991 - DNA, 201 bp, Bos taurus
aggttcacaagaaatgaaaacataaatccatttaatggatagaaaaatttgtctcaaatcagacaaacttcaatgttacgatgaccacacagaacttaaartactaaaaatgaagcaataagagtgaaagcttttgaagatgatgtatcagtatgaaagtaagaaaacaaaaattcaatatggcaagagttatatccatca

SEQ ID NO: 34992 - DNA, 201 bp, Bos taurus
aaaatgttgattggttggttttcccatcagcctaaatttagataacggatctgaggctatgtcctgtccagggtttaacaacttttatccccttcagcatyggcagtggtcaggtgggacggactagggattgccagtaagggaaactggaaacagctgtccaagtagctggactgggacaggagctgtgataaagaatgg

SEQ ID NO: 34993 - DNA, 201 bp, Bos taurus
aatcgatagtataaacaaatacagaatttagatgaatgagagattcagtgaggacataatagttttattggcaaaatgcaggatcacggccttaacaaaaycgaaggattagcttctgatccaaatacgtttaacagtttgcttactcagttcggttcagtcgctcagtcgtgtccgactctttgcgatcccatgaattgc

SEQ ID NO: 34994 - DNA, 201 bp, Bos taurus
gaatatggaaaaactaaaagctcacctggagttaggcatccaaaaattatcaggaccattccaaaaatggtcaacaggtgtcatgcacattcaaagtgtgktattgactcagatatagacaagtagattagtaataaaaatgaaaaaagcttgaaacagattcaagcatgtgtgtaaacatgtatgtaaagcatgtacaca

SEQ ID NO: 34995 - DNA, 201 bp, Bos taurus
cagccactgaaccactagggaggtccctctgacagtctcttgggattaatagtagcagataactcccacccagctgtggtaagtagtgtgatatacatggractggccactcagcatcctttcctcttcatttcagtggacttacctgttacacagaggctagaaagctaaacactgtgtttctcagactcttgcatttag

SEQ ID NO: 34996 - DNA, 201 bp, Bos taurus
tgcaacatttcatcctttcaaggggcccaattcacagagaaggaggtgcaagaatgagcccatgaccatgggatccattaatcatatcatctaccacaccrtctagaagcaggcactggaatggcccactgaaagcacaacccaagcaccaacatggagataatactctgtaaagatggcatgccagtttaatatttaagc

SEQ ID NO: 34997 - DNA, 201 bp, Bos taurus
ctcgaaaattccactaaaacgttgttcatccttagtcatttttcctaggagtccttcaaataccccaccaacttctccaacaagtacaggtactctttcargcaaaggatcctatcagacctcacaccagtttattatttctcctagtgaaattgcccacaatgaagatggcactagtgctaagggatttctttcaacagc

SEQ ID NO: 34998 - DNA, 201 bp, Bos taurus
ctgactctggcactatagcacaaagcagcacagaaaagtcataaacgtatggatgttggttgtggtccaataaaggtttatttatggaaactgaaattttwaaaaaatatttatttgtctgtagtgggtcttagttgtggcacctgggatctttggtcttcattgcagcatgcagactttctagttgctgcattcaaactc

SEQ ID NO: 34999 - DNA, 201 bp, Bos taurus
ttcttttgagttgatgttagagctagcttgaatttcccaggcagtgtgaagtcagtcattgcattccataattagtcatttgctttgtaatcatttatcargaacacactactaaatcattcagaacattcaccaaccttggcaccatgtaaatttggagtgtcatatctatgttggatggaagagagaactatttggaag

SEQ ID NO: 35000 - DNA, 201 bp, Bos taurus
aatattatgtagtgtttgaaatgtctcagagggtcctggaatgcttcatgacttgttcaaaagcattatgagacgatgtgatctggaaagcagagagtgcktagctgcagttgttcccggtgggatcctgctgccgtcagttatactagggaagagtgcaaagtcatggggcgtcattgctaaaaatagtgcagccagtgg

SEQ ID NO: 35001 - DNA, 201 bp, Bos taurus
ctgatttactgtggggctttaatgagctaatagctaactgcctggcaaagtattaataacttatctacaggaagtgctcagtaagtatttaaatggccttscataccgggagcaagtgaagttgtgtagactggaggaactccccatgctctcctccctcagagcccagggctggaggctggccttgggtgcgacttgtgc

SEQ ID NO: 35002 - DNA, 201 bp, Bos taurus
gcaagtctagtcctgaaaaaatgaaaatgttggcaaatgagttagcaaacatgggctgctagtgaggagggaaaaaatgactatctgtggccttgggaaaktttctctacttgggctgatgatcttggcagtggctgagaggagccagaagggaaaaggagaggcttcagtggtcatcactctggaatgtgatggctgatg

SEQ ID NO: 35003 - DNA, 201 bp, Bos taurus
tatagatgagaaatataatgttgtacacatgagacatataatgttataaatcagtgtcaacaattaaaaaaattcactcaaattcacatcactggagaagrgtttttctagtgagttattgagtagttactttacattctaatttaataattagataggcagaaaaattttgaaacattttaatgaggcatactaatgaat

SEQ ID NO: 35004 - DNA, 201 bp, Bos taurus
tatatattgtaaaagttagaacaatggctagtttgttgtattttgtttcatgccttccatttgacactgttctgaagattaggagctttaaaagaaacttrctaccaaatgtcagcatctcttaatggagactgtctcatcaatatattatatttcattttattaatgtaacaccatttgattcatgtgagtatattgctg

SEQ ID NO: 35005 - DNA, 201 bp, Bos taurus
atattcaagaactcaagcaaagttggggtgtcaaagtgatggtgaatgtggtggcctcaaggtccttcttgttcccaaacatcattttcactgcctggcayagcagttcccttctcatagcattggccccagttccaacatgatagatgagtcagacaaaatctggtattataatttccagaaatgtgcattaaagatatt

SEQ ID NO: 35006 - DNA, 201 bp, Bos taurus
aggttctaaaagttatcatcaaccatttcatcagtacagcctggtatgggtgtgataggccatgggatgctcaaagtctttctactgttttcagtcataartcttcagatgtcaagatattgttgaatcaagcctgtaaattcctcactatactgggtcaactcaagttacagatcatgttgtaatcattttttttctcct

SEQ ID NO: 35007 - DNA, 201 bp, Bos taurus
tcctactggcctggagcaaagagggttgtgacaggtctgtgctcttctctgaagcttctctgtttctctttgctattctctgtttctaccttctacttcamatggatggtagccttgggccaggaaggcagtgaagtgtagaacctccaaataaaatcagtcagacatgaactgagatgaggctatttggggaactcatct

SEQ ID NO: 35008 - DNA, 201 bp, Bos taurus
gtaataatgccataacttacatgtttgaaaataaggagcaaatccagtaatacatgtgaaatattaaaaccattgcacatggttgtgtcactgtcagtgaygaacagtatacttaaggtcatgcacttgaaacaaaagttacctataggtcacagaatacaggacaaaagtaactatggggcagagactaaggaaggggaa

SEQ ID NO: 35009 - DNA, 201 bp, Bos taurus
ggatgctctgaaccgggaaggggcctgaaaaatgccctcccttggctgcccttcctcatgaggcatattggtgtcacaggagggggacaactgcctgactrctgccaaagagagaagagatggcctttaaaatctaggctactgcaacctcctgggtagtcaatctggtgcctttcaagccatcagagagcatcttaaaga

SEQ ID NO: 35010 - DNA, 201 bp, Bos taurus
atggcctctgttgtttttttctacatattgttgtgacaggcataactgatgttctggttttcccatgtctgaaactgcattcctagtgctgcattaacacrcccatcacatttatctgaatggccaatcagtcagagaaaggcttctctattccattcatttcagtggacatgtgggcagctttgtgcaggacagattctg

SEQ ID NO: 35011 - DNA, 201 bp, Bos taurus
agaaacttgctttttataaacctagagtcaaggtctgagcattcacaccactcctatcactaaaagccaccactgagcctgcaaaaccttcctgattctayaggcctccagtcctgcagcaagaaatgctagaagcccacatactgaccttgacctatttccctggtcaggacatttttttccaccattcttggaagcact

SEQ ID NO: 35012 - DNA, 201 bp, Bos taurus
agcctccagggtccatgatagaggatgtacctgatgctatggaatgaggctaaaggacagtttgcatttccagtatgagacataggccagaaaactcttaycaggcatttctgggcttagttttgaaagatgcataagggcaaagcaagttgaagccaagaaagcagcatatgcaaaggccactgggaatcaaggatatgg

SEQ ID NO: 35013 - DNA, 201 bp, Bos taurus
ccaggctaattagaactctcctcaactcaggtatcacttcaactcattttttaaaatcaacactaatggacaaaatacaaggcaattaagttcaggactamatttctttaatatttaggtaaccagcttagtacaaacaacggttgttgtctttgactatttgaattcgcatccattcaagctgggatgacagacttgggt

SEQ ID NO: 35014 - DNA, 201 bp, Bos taurus
tgcaacccaggcagctatttctaagagccagtccaactcgaaagatagaagctaggaactgactgaatttccatccccagtgaatgtgtttggttaataakcatcctccctaggccccaggaccccataagacaagttattacaccaacctgaattaagcaaagaaggctactcagtcagaatctccaattaaaaaaaaaa

SEQ ID NO: 35015 - DNA, 201 bp, Bos taurus
agctacaaaagaatgcttgatatatgtggaatttatttctctgtcttttgttactacaagtataaatatgttaatttctatgtgtagagggtggcatgggyggaccaagcttcctaggaatacctgtttaaatggtgttaaattctgactagagctgggcagttggagaggttaaatgatgttatttcaccttgtactcaa

SEQ ID NO: 35016 - DNA, 201 bp, Bos taurus
gggacctaaatattgaaatgggactaagatatatcaagtctaaaaattttctatgtatttttggaagattatataaccttttctagatttttttttttttkatatttctttagtctttcacctgagagaatttgtgaaaataattgaggtaaactataagaaagtactcctgactcagaaaaattataatgtaaataaaat

SEQ ID NO: 35017 - DNA, 201 bp, Bos taurus
caagtgtgtggaaagggggcctgaattactttgctggggctgccataggaaagtgccatggactgtggcttaaacaaaagaagtttattttctcacaatcstagaggcctggaacaaaaaaggacactaggtaaaaactaaggaaacctgaataaaatacaggtgtttgtggtttccaggtgtcgtaacctatttaagctg

SEQ ID NO: 35018 - DNA, 201 bp, Bos taurus
ataaggcatgcagacctgctgcttcagaggttctagagtctactcagaacatctggagctgtgacactagtttatatttcaaggaggttgtggggtaggcrtctgataagcttcccatggtccctgtcaggaactgagggttttcagaatctgtcctacgtctagctggagatctttggatggcttcagggccatctaagg

SEQ ID NO: 35019 - DNA, 201 bp, Bos taurus
gagaatgaaataaaattcatcagacaggttttctgaatgggaagagtttccagatgttaaacaaagagatttgtaagacgtgattttgaggccgttttacyattcctatacatcactagccagcacatggttttcagtagcacactgatttgtttctaaaaacaaatctagattttcctattcctggattgagaatcagga

SEQ ID NO: 35020 - DNA, 201 bp, Bos taurus
agaagtggccttatataggaaacatcctgtggggctcagaagcacgctgccctctggtcgccagagctctgtgcccaggagtaccccctatgtgggttgtrtaggcccttctgttgtgacagggccacagtagttctactgtgggctccctagtgggcagggttggcccctggcctggttggctgccccaccctgcttcct

SEQ ID NO: 35021 - DNA, 201 bp, Bos taurus
agaaaataattttcattcatttgcatcaagaatgtgaaatattgggcaaattcaatctgaatgaagccatcttacattttaaaacttgctgcccctttgcmtttccccctatagctgggtgtttttgtctcagaaggttgggttcctgcttagaaggaaggaaaccaatggctcaaccaaacctcatagtcctgacatgct

SEQ ID NO: 35022 - DNA, 201 bp, Bos taurus
ttggcagtcttagaaccagtgctactagcctgcctgtcgtcaccatggaaaccacatagtcttctagggagaaggagaaaaactgcctccctatcagctgrtcccaggatctcaaagcagaaagcccatgtatagccttactcctcttctcctaagtgaccctccccagagcacaggagccgcctacccattcttttccac

SEQ ID NO: 35023 - DNA, 201 bp, Bos taurus
ctccctgctgaaaacccatggctcaccttcctaatgctattactcggagtcctgagcacgaccttgtgactggccaccttggcaggtttgggcagtggcarggggtgggggaggcgggggcagcattaccaggcctccaccccaggccagtccctggtgggcaggccctttcccattctttaactctctttttgtgacaaa

SEQ ID NO: 35024 - DNA, 201 bp, Bos taurus
ttagagcttcaacaagatgtgccgcctataagggacggactattacttggccagagaaaaccccactgagagatggggatgttattcccctggaagccacrgggatggaaattgaaggatcctatgctccagagactcagccagacagaggaagaccacagggcccatgatgtccccctctggactgaagaaaaataaacg

SEQ ID NO: 35025 - DNA, 201 bp, Bos taurus
ttttcgccttttgggccctgaggaccaggctgtccgtctgatccgttgtgtcctggtaatccactggctccgggaggccctgcatcaaaacacgagaagcrggaacactgaaaaaaatgttcactgaagttaacattatttcctttagccagtgagactgggcaggcatcaaggcctctcccagagcttctcctgcttctt

SEQ ID NO: 35026 - DNA, 201 bp, Bos taurus
ccaatacaaatacaacaccaactgggccacctccagcatccacatagccatggaggcatcattatcctcacttttcctaacaagaaaatgcaggcccaagyaggtggagtaatgtgtctagtgagtagcagggcccagattcaaactccagcctggatggcaacaaggcctttgccccaccccctgagcatcactgctttc

SEQ ID NO: 35027 - DNA, 201 bp, Bos taurus
tttaaaaccattcttgtggttattgatacaagtactttttagaaaagtcccttaaacttcagtagaaaaaataaaatgcattcaaaagttaaaatacacaygtgtgcacatgcccataatgttcatctctctccataagaccaacaaaatgtttaaaaattttaacatttcacatacactactcaaaataccagtttacct

SEQ ID NO: 35028 - DNA, 201 bp, Bos taurus
tcattctttaacacttgcagtgttatggtgggttaaaaacagacagaaaatccaagactaaataaatagctgttttgggagaccacagagaataacttcarcctacacattactgtcatattgggataaaataaaataatgaacacgaaagccctttgaaaaatataaaagcatgctatgtacatgtaatatttggcttga

SEQ ID NO: 35029 - DNA, 201 bp, Bos taurus
cccccctcctgtgtttctgcttcttcttagtgttcatttgatttcattctggggttttttggtaatataataattcaaaataattttttaagaaatacacyggagtaattcttttagtggttttcagttctctgcctagtttaaaggcaaggagagccagttaagaaataacaacaaatatgtgtcctcaagtttgttttc

SEQ ID NO: 35030 - DNA, 201 bp, Bos taurus
tctgggtttctgttctggatcacagtgttatcttcttcagaacattcaggtttcactggaacattccagtttcacttgaacttagaggtccagttgtgtcyggtgtcagatgggcaaggctcccactcgatcccagtgtgactcaccagagtcttctggtgtgctgaagtctaatttgctattaagcttatcgccgaatta

SEQ ID NO: 35031 - DNA, 201 bp, Bos taurus
cggttttgacactgtggatctcctaaaagttccctacaccactttgaaaatcttcgtgttcagtggcattgggcagtctcctaacttaatcagggcctcaractagtttccctatctgtaaactggaagctgttaatagcaccaaccgcacaggattgttgtgattatttaatgagtcaataacatctggcccatagtgtg

SEQ ID NO: 35032 - DNA, 201 bp, Bos taurus
atgcaagtaaaatagggctttgtaccattgctcttagaaacaccagtactgcggttgcataggagcctcctgagaaagcttagcgtgggcctcagagtgcrtctggctaagaagggattgagtctctatccttttttagtggggcagtcaatcacaagggctccatcatccatcatctttgggccttgaggttctccctgg

SEQ ID NO: 35033 - DNA, 201 bp, Bos taurus
tgccatgtgcttttaggtccctgaccagggattgaaccagagtcttggcagtgaaagcccagaatcctaaccaccaggccgcctgggggactcttaattarattgtggcatatagtcaaattatttccatggtctggctcttcactataatagttttcataattaccttttcttgaactcttttgggccagttctcagtct

SEQ ID NO: 35034 - DNA, 201 bp, Bos taurus
gttaaatcagtccttagttagatttttttgactgtcagaggcatgtaaaacaagtttcaacattttaaaactatccaagtattccttcccttgaatgataraacttttaaaattaaatattcccatagtatgttcaaatgacagattcctgtgagcaataaatttgcttttcttctgtagagttggaagcaagtttttcct

SEQ ID NO: 35035 - DNA, 201 bp, Bos taurus
attttaaattcttccaaatacaggtaaatatcttttaagaatgttttccaagtaattttgttcagctcattattgttcttcgcctacgctattcccacccygcttaccccacctttgctcaatcactgcagatgaatttgctacactctgtggaagtcaacggccaggctttgtcatcgacatctataccggtttacctgt

SEQ ID NO: 35036 - DNA, 201 bp, Bos taurus
tatgagctggctctctttttcttgactcaaaggccatcaatgggaagtattatcatttttagttggtctcctgtgaaatctgaaacacactttatccactyatttaagttcaggatcatgggcccctgctagtccttggtatatgaatgaaggaaaggggtcctgttctaaactgcattaccattctcctatcactgcaca

SEQ ID NO: 35037 - DNA, 201 bp, Bos taurus
caaattcactagcaaggaggaaatgaattgaagaaggcccagactgttaatgtctgaaggacagcacagaagtggaacacatggaacaggtgttcacaagwtcagcaacaccagaatggcccttgctgtgtgaatgtacccattgtagatttgctgattatattcagattctgcttccaatttggttatgtgcatagttct

SEQ ID NO: 35038 - DNA, 201 bp, Bos taurus
ctcttcggccagctctgctgtggagagctctggggatcactgagtagaatgtcaggattcaagtgacctcaaagccctattgtgaccaagtgtcccttggygtgaattggatgctcacactcaggcctgtgaccacaggaaaaggcccggaccctcccaccctagacaattgtggaggctttgcaaactagcatggtcatg

SEQ ID NO: 35039 - DNA, 201 bp, Bos taurus
gatggactatacttattttctcatctaacttgcattcatacctgttcttgttctcttccaggctaaatatctgcagtcttcggactctttgctcatgactrtgtaaggaagctggagagaatgatggttatgaatatgggctcctggggagaagcccatgatggtggagtagaaggatgtgtgctcttcttctttgagtac

SEQ ID NO: 35040 - DNA, 201 bp, Bos taurus
taagtaccagactctgagaatgggccactgttcacctgtgccttctactgatgtgtcaccaccccattacagaacgccgagcatgagggggtggaaacctytcagggagacttggacctccatggccgtttccagagtctgattgtggtggttgattcttcagttcagttcagttcagtcgctcagtcgtgtctgactctt

SEQ ID NO: 35041 - DNA, 201 bp, Bos taurus
actattgattttgagagtgcttttaagtcctggatttatgctctttatcagatagatgactgatctgtgtcttgtcttttcaatcccttagcactgtctgmtgaagatgcaaagttttaattttgataaaattcattttatcaatattttcttttatggattatgcttttggtttcatacctaagaaatcattgcctgaca

SEQ ID NO: 35042 - DNA, 201 bp, Bos taurus
agccttgacttatataaacagataaattttaaatggtattagaagaaccctaattcaagttcatcacaggagtggtgattcacagccccttactcagtttkcagacccacagttacttgattaaggaagaaacttgtccctttgtgatgcaggcacaaatgtatggtataactcttctcccaagcttgcatgatctgcggt

SEQ ID NO: 35043 - DNA, 201 bp, Bos taurus
tttgccacctagctctttcttccttgaagcacctacatgaaacactataatgagattcttcctagggaaaactttctccttttagtggactttgcctattkcctgcagtttctgagtggttaatgatattttcttcggatgtcttgagaatccatctctcagagttttctctgaaaatcttggcaaaagccaaccatttcc

SEQ ID NO: 35044 - DNA, 201 bp, Bos taurus
ttggagtgttttttaaatagatttaaaaggtataattgatatacaaataaatacacatatttattgtgtgtaactcggtgagtttggacataggcaaacayctgtgattgtgtcaccacaattaggtaatagatatgtccaacagagcgacttttaaaaaattctagcaagcacttaactagtcaaactgtcttctctatg

SEQ ID NO: 35045 - DNA, 201 bp, Bos taurus
tgtcagctacaggtcataaagctttatagactcatgacctctgatctctgaccctgtgatttattttctctgagcagaagtgtgacccctcctccatctgmgaaaaatgaggcaacgtggttgggtggcttctgccattcatcaggcagtgaaatgtgtctggttctcaattttccatctgcactcttgcttcaggccaac

SEQ ID NO: 35046 - DNA, 201 bp, Bos taurus
cactggagcaagatgggccatactgggtacttggcatgggtctgggcatatactgaagtagttctggcatgccagtcagaactccaaatcagtcctgatcygccaatgctaggaatggccaccctcaccctgttcaggtcctatccagctccatcccccttgattgtacattttcttctttggaaacagcagcctttgccc

SEQ ID NO: 35047 - DNA, 201 bp, Bos taurus
aatctctatatcttacaagtttgcttacatagttcttttgatttttgtgaagatttagaaacaaagaaataagggtggccaacaaagaaaaatttcattcyattggagcttagagtatgtgtattggtggggagaggacacagcaagtagtgataaatgggcaacaggcactgaatataaggcatagaaagaggcctgaac

SEQ ID NO: 35048 - DNA, 201 bp, Bos taurus
attcacccaaagatctggatttccttctgccagtcctggactacccgttgaatcaacaaagtgatacatatttaagctaaaactttacttgatggccaatmtattggtcaaatttctcagggtcttttacctccctgctttgcttaccacaaaggttaaatctcctaagggccctggaggtagagatctagagcatattta

SEQ ID NO: 35049 - DNA, 201 bp, Bos taurus
ctccatggactgcagcctaccaggctcctccgtccatgggattttccaggcaagagtactggagtggggtgccattgccttctcccctgtataaagctagractcttgaaaggctgtctcagtgcagtggggctggagatgagctccactcatcagctcagggagcactcccacaagaaacagcaggtccaggcctgtctc

SEQ ID NO: 35050 - DNA, 201 bp, Bos taurus
cagcttggagcattccggcatgaccaagaatcctgaagagaccccagactcaggtgctgaggatcactatacttggcctctgtctgagctgctggaggtgrgacaggtcatatagcctgtgtcaaccagggagaggtaagctgtttgagcacaccaagcactggccccaggctacagttggaaattactagactgttttaa

SEQ ID NO: 35051 - DNA, 201 bp, Bos taurus
gctttgtcttgtccggttttaactcacccctaagctagcagacaagccttgcacggaacatgcaggcggctgcagaatcacgggaataataattaaatcawaatctgtgtgccagacgctgtacaagaatcttttcgacattttcgcaagttttttaggctcagagatgctctagtcatataggcagtaagtggtggagat

SEQ ID NO: 35052 - DNA, 201 bp, Bos taurus
tacagaaatccactgcttcttgccttcgatccactcctccactccagagagacgcttgtttttgtactgagacagttgctgataggccacaaactcgttcrtgaagaatttcatccccaccatctcagccaccattggacagtctgcccactcgacacccatcatgaaaaccatgggccttaagacataggagcagatgac

SEQ ID NO: 35053 - DNA, 201 bp, Bos taurus
atagaagaattccttattcttagggaatggctgctaaagtatttagagctgaagcatcatgacaactgaaacttgcatcaaatcgttaagggggggaaaargctgaagggatagaacaaatgtggcaaaatgttaaaaagtggtgaatctaggtgaagggtatacagatttcccctgtactttcttacttgtacttacttg

SEQ ID NO: 35054 - DNA, 201 bp, Bos taurus
gtgagaaccacaaaccctgatctacaacagtggaaatggaggcccagtgcagtgaggatcagtgaggggtggtgaaggtagcaggaggaggcctgcagtgyggctcccagattcccacatgtggcatgccttcacgtgatggagaattccacactccccggtcagaaagggatgtgaacaggctggtttaggggggctgca

SEQ ID NO: 35055 - DNA, 201 bp, Bos taurus
cctccacggagctggaggccggacccgcgggtgaggccgggccgcacacatggtcgccgtccgggtcttgggcccgggctcgggcccccgtggcctgcagyagcgttcggaaggcaagctcgatgcggagcgagtcgtagccgatgaagggcttccaggtcttcttgtcctccttgtagaaccagcgcacctcctccgggc

SEQ ID NO: 35056 - DNA, 201 bp, Bos taurus
aagagggggaaggatcttggtggggaaggggacaggcttgagtgggatggtttcgtcagagggaaattcttcatccagcagctctgggtaatgggcctcargtaacggaagctggtttagtctcttacctgttttgttgagggagacagaagacagatttaggagagagagtggaggatgctgcccccttattctggcccc

SEQ ID NO: 35057 - DNA, 201 bp, Bos taurus
attttcctctcacatagattcagtctttgcttttttgaaagactttggattctggttatcaagttaccataggtctcctatagagaagaaaatctatatayatagcaattaaatatgatattttgtagtaagattttctgaattacagattaggattcattttttccccctttattcagggagtagaaacagaataaggga

SEQ ID NO: 35058 - DNA, 201 bp, Bos taurus
ccacacaactgagtgactcaggctggatttgaactcatctgtgtcaaactctgatcctcctaatcctaactactctctgcacctcagtctgcacctgttcyccacctctgtctttacttcctcattcccagcctgggttgacagggcagatccttccatgtgaaactctctcctctacagactcgactcttccaagcctgt

SEQ ID NO: 35059 - DNA, 201 bp, Bos taurus
tccttaagaatctagactatcatgtgatccagcattcacactcctatgcatatatctggagaagaacatggtttaaatggaagcatgagcccaaattttcrttgcagcgctatttacaataaccaagacatggaagcaacctaaatgttcattgacacaggaatggataaagaaaatgtggtatatacatacaatggaata

SEQ ID NO: 35060 - DNA, 201 bp, Bos taurus
atgactaaacacaacacaatagattcatctgttacataatacccccattaattgagttctgctcatacgccacgcttctgaagtgacttacagcgttatayattcacgtgggtcttacactatcccattttatgcatgcagagggtgttgttcagagacattaaacaatctgttcagcatcacacaactggcaataggcag

SEQ ID NO: 35061 - DNA, 201 bp, Bos taurus
cagtttcttcctccacatcactctcttcatcccctcgaatcctaattcaagccctggcaatcctctcctaggccttattacagggcttttgagagggcacrtttttgaagaatgaaaaagcctgtttatgaggcagacccaagatgtaaattagccaaattaacatactctgtgcctacaaagaaggaaaactatattata

SEQ ID NO: 35062 - DNA, 201 bp, Bos taurus
tgatgattgggttcctgttcacccagagaatgtggctggcaaagataagcacaccagaacatgcacttcatgggaaagcatgaatccatccacctccaacraataagaggctgtctttcctttcagtactcactctcaggggtttgatgttgatagattctgaagtatcctattctagagcataaaccaggtgctctcaag

SEQ ID NO: 35063 - DNA, 201 bp, Bos taurus
cacaagaggaattgctgggtcaaaggatatgtatatctgtgattttgagagatgtcgccgaacttccctccaatatgggtgtaccacctgaccccaggccycaccactggcaggaaatggaatccggggtctcctgactccacaaccaaggctcccacccctgccccacaccctacttcgacaaaccctcaaagttacaac

SEQ ID NO: 35064 - DNA, 201 bp, Bos taurus
tacaagagaaactcatcttttgtgtatttacaatcattgctatttaggggtttggattgtatgaagttaaacctaaacacaatgaataatagcagacaacytttggccatagtcctcttcactccaactcgagctcccatctccctccaaacattgtcgttctcctgcaacttccactcttctcaaggttagctctgtttg

SEQ ID NO: 35065 - DNA, 201 bp, Bos taurus
aatatgagctatggttaataaatgggaagcttaacaaggccagttactttgaatttctctttgtctgttcatcttcagaaataaggatcctcccttcctcyaggtatagggaaggcctttctcacaccagggtcttaggacctgcttcagagtccaaagaggtcagttagtccttcctgcacctgtcatttctcaaatttc

SEQ ID NO: 35066 - DNA, 201 bp, Bos taurus
aagactccagcgccaggaaaaggtgccagaaagtggagacaactggaagagaaggaaacccctcaagggcaagagcccgatggttcatcagaaaacaaacrgaactcctcagtggaagtttccacatctgtgtgatcagcagcatcatctggggaagtttaagaaacaaagcattccaagatggacaggaaggctggagcc

SEQ ID NO: 35067 - DNA, 201 bp, Bos taurus
ctgggcctacaaagctcaaagtgctgctactcacttcccagtttcccttgcaccttggatatggcatgtgatcaagactcacccatcacgtgcactctccrgtggccactgcagcaagatcaaatttcaggagttccagggtcagtactgctagtgatagactcgtgtccagtggtgccagggctgttgggggtcacaaac

SEQ ID NO: 35068 - DNA, 201 bp, Bos taurus
acacacacacacacacgggagggctgggagagggtttgatggcattaagccatcatattgggagtttgggattagaagctatggactgatgtgtatggaayggataaacaacaaggtcctactgcatagtgcaggaagctatgttcagtatcttctgatagcccatatggaatctaagaatatgaaagagaatgtgtatat

SEQ ID NO: 35069 - DNA, 201 bp, Bos taurus
gagggtctttgttattaatcacacaggtgagtgtgagtgtcaggcgcccaaggaagttacatggaactctacagctttaagagccccgaggaaactgcatytgtttcaaatgtctagtaataaactgtccagtactaggactcgctgtcctagtaaacagagtgccccatctagggacaagaattggaggtgactctctcc

SEQ ID NO: 35070 - DNA, 201 bp, Bos taurus
ccacgtccaaggtcatgcgtgtggttgctgttgggcctctgtctcttaccctgttagtctcgtcatggggctgtttcttaacttgccacctggcttcctcyagcacaggccatccaaggaagagagagtgatccttcaaaatgggagcaacagtttttaagtaacctaaacttggaattgatagcacaccactctggtcat

SEQ ID NO: 35071 - DNA, 201 bp, Bos taurus
atagctacactcagatttgtgttttggatggatttaaataatttcctcaaataaaagtacatttgctttcaaatgcattttattctttctttctcctcctyctctccctcttgctttttggtgctggagctcacaggctttgaagtgcttggtgttacacccattggaactgtgtgttctgagctaggttttcctcttccc

SEQ ID NO: 35072 - DNA, 201 bp, Bos taurus
gggtgaaggtaagagaagacgcctaacagccaagaggcagggcagtgaaggtctaggagctgcatcccagtttgccaccatcttgccatatgatgctggayaagtcccctcacccatctggtctccagcccttctgcgttctcagtgacaatctacagtccttttcccttctgtctggcagagatcccaaatctggggcct

SEQ ID NO: 35073 - DNA, 201 bp, Bos taurus
tgaggaaactcaagctggtatttcctggccaggcttaaagatatctctaaaatgacagcatgtgtctttggattcagaactgaattggcaacaggatagaytgtccaagagccccctggttcaggttggccacccactggtgacagtttccaaaatacaggtgctcacctgctcatctcactctctctttggccacatttg

SEQ ID NO: 35074 - DNA, 201 bp, Bos taurus
catctggcctgtgtttaaatgatcacattaggaaagcagcctgtgggatttcagcttaattacctataacatacactattcatgcaaagaggaatgggggraagtgagggaaactaatattaaaaatgaatgcaatgtaatgtattgctccccatcccccaaccttttggtacaaagacaagtaaagcaaagaggtgcaaa

SEQ ID NO: 35075 - DNA, 201 bp, Bos taurus
ctacctattcttagggtttttgtgtaaggatccattcagaataattcactgtggagtcttttgcttctcagtagtatggcatttggggaacataaatgagygatccagagcagctaaagtgctttggtttgactaaggagctttgggaactaatattgcaacatttgagcttgactttgcaaattccttctggacatgacc

SEQ ID NO: 35076 - DNA, 201 bp, Bos taurus
ccaagcaccttccaggcgccttcaaagcccgcctccccccacgtccttcagtctgtacctggcctgcttgtgcctcctgctacagggttgtggggcctctmtctgtcttcagaacttgtgatgggtgacaaggaggggtttctggagcgcttgattgataaactgattaccttgaggaaatctggccctttttgcgcaagg

SEQ ID NO: 35077 - DNA, 201 bp, Bos taurus
agttttaatgcttctatttctcactatcagttcccttcggggactgaagtctttgttcttgttcggtgcagtgtaatttcactgggccttctcttgacccygatgcttcattggcatagtaggtctgcctccattggtttcttgttagagctagatgatgaaaatgggaatagtttgcatcatcttgattctaaatgcaga

SEQ ID NO: 35078 - DNA, 201 bp, Bos taurus
aaattgtcctgactaatgtagaagactccggccacttcctttatttcttttactatgagttttatttccttcttttcctcacttacaatagccttcccccrtggcctacccccacacaactattccaaggcacttacgaatctaaagcagttgattttggatcactagagtctaaaatttgtttctatctagcgtagaaca

SEQ ID NO: 35079 - DNA, 201 bp, Bos taurus
tggcaatttggttacactgaagggaagctgcaaagtgcttcttttatgcaaaaaagtagaagttttcaacttaataagaaaaaaaaatcatatactgagaytgctgagatcagtagtaaaagcaaattttctgtccatgaaattgcaaagatgaaaaaagaaatttgtgctagttttgctgtcatacttcaaacaagtgtg

SEQ ID NO: 35080 - DNA, 201 bp, Bos taurus
acctttgctttgtgagtcctcctggcttcttgctggttcaggagcctttcagaagtaattacttgtggcaggtcaatgggttcaagcttctaaaagtccarcattgagagcagtcagcattcctcatgccaggagatgatgaaacataaaagcccgaacttaagctatcttaacactctgcacgtgttcccgagagcacac

SEQ ID NO: 35081 - DNA, 201 bp, Bos taurus
cagacctggttgagccccagaatagaccccaaagcaccgagtgatttgatgacattcccccgcgctttgctctcattaacatcctgcctgggctggtgagyggccctaccccatccacatgtgtcctgggggctggaactccacagggagagccccaggctgaattgctgccgctcctcctggggacctggaggcagtccc

SEQ ID NO: 35082 - DNA, 201 bp, Bos taurus
tgttgatctactgaagtaggttttgcatgcttttaacagatgcttcaagaaaatgatccagaacttccacagcaaaccttactgattgcttcacaatcagyaaattacacagcctgaaacatgaagggagcagagatgggtgtgtagggatctaagagacccagaaggaattagccacagtttaatttcctgcagaagcca

SEQ ID NO: 35083 - DNA, 201 bp, Bos taurus
tagccttattttaaggtcagttagagtcaaatgccctgaagggaacatgttttaattcatttttgctccttttttgctatgccctaagcagaaagctacakacctgaatagacctcaatcactctgggttttcataatggcattttgccccaccacattcttcttcatccttgtctgtagtgatgtttactccccaccaca

SEQ ID NO: 35084 - DNA, 201 bp, Bos taurus
acctgcagatggccatcttctctgtgtatctcttcacactgtcttccctctgcatgggtctacttctgtatcaaatttcccctttttcaaggacagcagtmatattgggttagggggcccattctattccagtatgacctcatcttaactaattgaatttatctgctgcaaacctattttccaagcaagatcacaatttga

SEQ ID NO: 35085 - DNA, 201 bp, Bos taurus
atctttctctaataatcttttcttaaagtgtcttctgagattttaatggtttttatactcattaacaaaattaaggctctttaggttttgtcattatataygaatatagttatacaagtatgaatgggcatacttaattaaaaaaaaaaacctttacaatataaattagagaattccctggtggtccatggttaggactcg

SEQ ID NO: 35086 - DNA, 201 bp, Bos taurus
agtctctcgtttcggcctgacaatattattaatataagggaagcaggcaatgcaagcccttgggaaggcttgctttctaacatttgcttgtcaccgtggtrtaaatgctcacaccatggccagttccaaactaccaatgacttaacaatctgaatttctagatatttaacttgggagtcactttgggagtcaggacataga

SEQ ID NO: 35087 - DNA, 201 bp, Bos taurus
aaaatcaaatatagtgatataataaattcaataaaatgcacatacttaaaacaagatgaaaacaaaagtagaagaaacagcttcaaaaagcttggggtttmtctgactttaatttatagctctttaggttgtggtagatatagaaggccagtaagtatcttaaatttcttacacaattctaaaatgttagaaagggtgtct

SEQ ID NO: 35088 - DNA, 201 bp, Bos taurus
aaggatcaatcggtagcatatgctgagggccaatcagttaattcaagtggttagaggtttgcacataaacctcttcagcagttatactttgggggttgtcrtctatcagccaatggccctcatcttgtggcttttctgaattctcctgtctgttttttctgagccaattccagattgcaaggggtttaccaaagatttact

SEQ ID NO: 35089 - DNA, 201 bp, Bos taurus
tttacaggtataaaagagttgatgctagggtgaagtattttatagcaacaggcaaagtggggggttgctggacctctggccctagagacctagcacatttwacttgagtaagtggaagcttcttttcactgcctttttgcctcctttttagccctgggcctgccgtcttcaccacactctctctattgagcttctccaagt

SEQ ID NO: 35090 - DNA, 201 bp, Bos taurus
tcacacaagagctgagtcaaggtttgttgaatcgatatttggaaaagaagtgatgactggatgctagtcaactggcttgggccactggaaggcctgccccygcctgtagtttctgtcagctgcagcctctcagggttgttactggcctgcaccaggcaatggtgtttgcatttgccgtatctgagctcaggataacaagac

SEQ ID NO: 35091 - DNA, 201 bp, Bos taurus
agagccaaggaaacttcatttagacccagtatctaccttctcagcatcactttctttttcccaatagtggatcccactctcttcccagctaacagaggccraagaaaagcatactggccacattagtatctcttgtggtctaataatgggaccctccctatacctgttcctctgccctcctgctttccgtatttactttac

SEQ ID NO: 35092 - DNA, 201 bp, Bos taurus
ccaagttctccaccactcagcccttctcccatcccatactaatttcacacagtcctcctttcccggcctgaatcctgcagtcaaattgtttagtaccctayctcctccttagattccccctttcttcctcatttgcttaatgctgattctcaggcacagaggactccagggcctttgtctacctgtatccttctctagctg

SEQ ID NO: 35093 - DNA, 201 bp, Bos taurus
ccttacacagggccataatctatctcctgctcagtttctgttgtgacatggaggagcctgagcaacccttctagtatgcaatgctttgattcacaatcttyttgaataatacacagcatattcagcgttgtgagtcactatgttcacacttcatatttctattatcaaaactggagacatatattaggcccaaagttgacc

SEQ ID NO: 35094 - DNA, 201 bp, Bos taurus
gtggaatcagccttttttctatatggaatgagctctccacatgaaagagcacttctgttataaaatgaagggggaagagaggcttcacccaggccaggtcyacctggtacctgtttcaaagcatgatgaaagcccccatctgcccctcctctatggcaacattggggcacgttgtccttcagatcaaacttgggctgtgtg

SEQ ID NO: 35095 - DNA, 201 bp, Bos taurus
aagtactacctagcaccttacatcaaactatgacacagcatccctgggaagcccccagaaatttctgtttgctttctattgaagccatcacctaagtgacyggatatgtgggtctctagagaccaggctgatgggattaattttctcttcctctttcctcacagtgcagcatgtacattggtgactactttttgtagaagg

SEQ ID NO: 35096 - DNA, 201 bp, Bos taurus
gaaatactgcatgttgatgataattagcagttggcctttaaaaataagttccaacagcttaaagagttgtagatataaaaataacctaatttaggtttcarttcctctgattaagcatgtgaaagtacgttttaaaatctgtcacattgaaaagactactgctctgtgctcttctgtatttttgtctctttgggttgaata

SEQ ID NO: 35097 - DNA, 201 bp, Bos taurus
cttactaactcgttgagccagggaatgaacccagaaagtctgcctacaaatccaggttcctaactactctgtggtccacacgggcaatctgctgagtgcaygaaccacaaccttttctttccttgccttaatctcagtttggcactggagcaaatcccccacttggagcttctgaccccagaaacttctcctgcaacaaga

SEQ ID NO: 35098 - DNA, 201 bp, Bos taurus
tattgaaagtcaatcagtaatgattataccatgataatatttacatttcacagggaagcaaaatacttgcagactcgccgtgtctctgtctagagatctgyggtttatttgcattcagataaattatttgttttcattcatccccagaatagttaaccagactaaataagttgcattcatgcattttaatgtcaatgtaca

SEQ ID NO: 35099 - DNA, 201 bp, Bos taurus
acagctgcctcttgctctctaaagttcggggccctcaccacctccacccacaacacctgggatcttagtggtgattcaaatgcacatgtctctttcaggtrggttgaaaacatcgttgcaggcctgtcctccaacctcgcccgctctgtatgtccccctggcagtgcacacagcacatgctggtttgttgactctggaaac

SEQ ID NO: 35100 - DNA, 201 bp, Bos taurus
acttggaacatgtatctccctgccagtgatcctgggatgagttgagtgtaaataaatataagtatctattcatcagagactgtttatctttttctggcccmtcattcaaagcagccacagttttctgaaagagctactcagaccatactccaaagcagagaattatttggttcagagtggggaatgctgaggccacagtct

SEQ ID NO: 35101 - DNA, 201 bp, Bos taurus
acatctagcaggaaagaggttaattgaaagggtttgggttgttatttacatgccatgtaaatacctaactggtcctggcctttgcatttggccatatctcracagggattataggatgaacctggcacttgtgggactcccaggagaagtcttgggatttgggaatatatgcttttgaagtttgccatccacttcaatctg

SEQ ID NO: 35102 - DNA, 201 bp, Bos taurus
taaagtgcagatttgatcatgtcacggcctaccataccacccttaagggtttccgttgcctctgagtacagctcaaattccctaacaaggttggcaacacycttcgtggctggcctttgcccagcgttgcagctttatttaccagcccactccatggctctctacatgcgtttcctcagtctggacctttaccccaactgc

SEQ ID NO: 35103 - DNA, 201 bp, Bos taurus
gcagttcatcgggtcgcaaagagtcagacacgactgagcaactgaactgaactgattcataagaaatattggtttctaattattttcttatgatgtgtttkcctggctttgatgttaggttagtactgcatgcatgtatgctaagttgcttcagtcatgtctgactctttgcaactctatggactgtagcctgccagcttc

SEQ ID NO: 35104 - DNA, 201 bp, Bos taurus
cgatattatttgaaatgttttctagtgattgagtgatgctcagtctgatgtcttcaggaactgctgtacacatgaaatgttggcctcaatatttaatgtcyccatcctgccatgttttgagtttgtataatttctcttgcctctcatctttcctccttcaatgtcagtggccacttatagagatgtctttgtactcaccac

SEQ ID NO: 35105 - DNA, 201 bp, Bos taurus
tttaaggcttcaggattagacacagatgcaaatttacagccaatcaaggcttttatcaataaaacatgcagcttcggcctcgtattggtcaaatgaattarcatttaggaaactaagctaaagaaaaaatttaagtaccttctggacaacaagagtttgtaactttctattacttcctttctactatatggcctaagaaat

SEQ ID NO: 35106 - DNA, 201 bp, Bos taurus
gaatcagctataaatacacatatctcccctccctcttgaaccaccctccagcacccacccccatcccactcctctaggccatcacagagtgcagacgagcytcttttgctgtacagcatgttcccactagccatctatttcacatgtggtatggtaatgtatatatgtcaatcctagtctcacagtttgtcccggccaccc

SEQ ID NO: 35107 - DNA, 201 bp, Bos taurus
aatatatgtataattaatatatatatataagtacatataattatataatagtacatataatagtggataattaagtaaagtttagcaatagatacttaaamattttttataatgaatgtgcaatcaagtttggtgattgttggatctggtgagtaataagtacttcacggacagaatgctctttaatcaaactctccaggc

SEQ ID NO: 35108 - DNA, 201 bp, Bos taurus
ccacttagtctagttttccaaagaatcctgctgaattggtttagtgaaagtcctccacctttggtatctgatcaccttgtatcagatcaaattcctcatcytgcattcttgatattttagggccagtcttcagcaggaatctcccttatccctaatgtgttctatccactgacctctatcttgctccttgaatgtaaatcc

SEQ ID NO: 35109 - DNA, 201 bp, Bos taurus
gccagcatgtctagatttcattgatctgcccttggtacatctacatcatctgattgggcctgaaaccccagtaacaggcctgctgtgggggcagtgcacamccttacctctgggtatagggcggtgaggttgtggggactggttgtttgtccagaaaagttggttaatatattttatatttagggccatacaggaatcaag

SEQ ID NO: 35110 - DNA, 201 bp, Bos taurus
agcatttatcccttctatttttagttcacttctttaattgagatgaacatgatataatctcactgagtcaaaggatggcatctagtcctgtgcttcccgcygaagaccaacaggtttccttgggcattgatgatctccatttttcattgcaaggtaattaagattggttggggtaaccccatggcaactatgcaaacctca

SEQ ID NO: 35111 - DNA, 201 bp, Bos taurus
ctagagggacatcaggagttgtctctttcgtctctgggtcacctctacacttggtccctctgctgttacccccgtggccgctgcgttagagcagaccctcrtctcacagatgcctgtgtttgttagatgtctgagtaggctccctgcctgcactgtcacccttgctggtgcagcttgcccatggccacctcgtatctatcc

SEQ ID NO: 35112 - DNA, 201 bp, Bos taurus
gccttgcttcagcagcacagactaaaactccgaaaataaggttcttggccatcaacaggactgatgccaaagaaagcttcagctcaacacataatctcacytatgggtacccttgatttcaaaatcccagtagctaaactccttaaaaatccacctccttttgtttcccagagcctccgtccccctttattaatcagagcc

SEQ ID NO: 35113 - DNA, 201 bp, Bos taurus
aatgaatattttctaagactaagtagtcctaggtttctgctgtttttcttccctttgtggtgtgatacatatttggttagaatgtattataattgagtgtytttgtgatgaaatgtgtactttatttgcattcattcttaaatggtttctcctccatcttttctattgagaatatctggtgaattaagtaagtaggattcc

SEQ ID NO: 35114 - DNA, 201 bp, Bos taurus
aataagtaaaaaatcacaggaaactctaggactgaaggatgacaaaaatgtaaaaaaacatgacttcatgagtcaggaatagtagtaattttatgtgggarcatttgaataactttgtacttacctatttgagaaaagaatgggtagacatctcatgaatcccagttaagctttatttagaaagttactatgttattttta

SEQ ID NO: 35115 - DNA, 201 bp, Bos taurus
aatggatgtggcactgagaaaccagaccagccctgcccacagcacataatcaccgggtttcttattcggatggcccaagccagtgccaggcctcttgtacrtgtaggagccaggacataaaatcccagcctttcttccaaaacaaacctagggagcctttattctgcgttgctttcctttgatgaggttttccggggcccg

SEQ ID NO: 35116 - DNA, 201 bp, Bos taurus
agcccagaacctgagaggtgatgcaattgatcgtgggaacaatctcaggtagcctcggcctgcagcagcttgaagtaggatttgttttcctggccaaagaytgaagtcaggcagcggcagggaacactgaatcctggtcactagaccaccagggacagtggctagtggcaaggccctagcccgtcagcggtgtagaagtga

SEQ ID NO: 35117 - DNA, 201 bp, Bos taurus
acccgagtctggttcctctctctttgccctccctgacccaccctggcccttccccaacctgctgtgggtgtccacctggcctgcttccccaaactccctcyttctccaacctcaataggagcagaaggtccttagagtgagctgaaggggctgggccaggggatttctgaccctgcttgttgcccaactgcaggtgcccac

SEQ ID NO: 35118 - DNA, 201 bp, Bos taurus
ttaggccctgccacagctcctccacgtatgcctgcctctgctcaatgtcctccttcagctcagggtgtgacgccatcaactgctgtgactcccgctccagygtgcccagacgggcctggatggcagccacgtcacgctccagccccgacaacttgcgctggatggcaatgacccccgccaggtcccgacccaggtcctttg

SEQ ID NO: 35119 - DNA, 201 bp, Bos taurus
ctcactaggccagccggaaagccacgtgggtaagagggacgctcttcaaatcaccccctgcccactcaactctctgggaatctgggagacaatcactgctycaggccaaggctctgcccttcgctaagtggaacacggagaaacctggtattatttcctggtgaacaaaacaaaagcactaccacaccccagaaacttgcc

SEQ ID NO: 35120 - DNA, 201 bp, Bos taurus
tgtcaccgcatcaaagaagagagatgtgacatttccccaacccccgaaagtgaaagaagaaagggttctttactttcagggccatatcctgaatgacagargtcatttttttgcaactgatctgtgtgggtgcaggcttctaattgtttcctgaattacctgctatctattagccatctggccgcttgccagaacatgcta

SEQ ID NO: 35121 - DNA, 201 bp, Bos taurus
gtaccccacagttgggtggagctggaggctatgctcagtggttgaggggttgctttttggactcactggttgggtggggccataggttatgctttatgatyaggtgaggtggttacctggacattcaaactgggtgggttttcaagccatgctcagcaaataaatgggttgtaggctatgctgtgctgctgtacagcacca

SEQ ID NO: 35122 - DNA, 201 bp, Bos taurus
atggacacagagaatgggagaggagatgacagaaagcaaaatgatgggaagtgaatggatgagtgataactgcagaccagaaaaccctggagctgaactgycttcagagaaatggctaaatgagaagcaaactgatttgtgctgtggtgcccctagaaggctttgggttgaaacctctaaaagggcctgaaggtagggatg

SEQ ID NO: 35123 - DNA, 201 bp, Bos taurus
ctcaacaccacagcataatgtcatacatgacaagtccacagctaacatcatactcaagagtgaaagagtagaagatttccccctagaattaggaataagayaaaggtgcctactctcaccattcctattcaacatagagttctagcagagcaatcaggcaagaaaaagaaataaaagcacccaaattgtctatttgcaaat

SEQ ID NO: 35124 - DNA, 201 bp, Bos taurus
tacataactccctgaaaatctaacacagggcatgaccctcagggctccagggaagactccagtaaccgcaagttcacagagaggcccggggagccagcagrataagtttctatgtggtgcattgtgcactgcagaggaccaagagccctgtactatggtacccaggcctggaacagagaagcagaagtagagacaggggca

SEQ ID NO: 35125 - DNA, 201 bp, Bos taurus
caacaaaccttttagtttacaactttcatttttataagagtggaaactgagacagggaatacagtaactcactcacagtcagtgcactgctcacagtgaarctgagattcaaaccaagatctgacaaactaaatcttgtttaattttcactacattttcactgcctttaaggtttcccaaaagacagaaagtctaagttac

SEQ ID NO: 35126 - DNA, 201 bp, Bos taurus
ctagtgaggatccttctgtaggtacagccttggagttgggaaatcctccggcaggtcgagtcgactaaaaaagcaagcgggaagatgaggcacgataggayacctcctccctcgctcaccgcgggctgtcacagtaattggcggttgtgccactcacgcagctttctaaggcacctccaggctccctggagccctttctct

SEQ ID NO: 35127 - DNA, 201 bp, Bos taurus
tagctccattttgtttgtaagtataccgaagctcagagaggtaaatattttgttctaattacaaagcaagtaagtgataaggccagatttcaaagctatakgggttcatttattcatcctctattcaacaaatatgatgagtatgtattctatatgtggccactatggtaggggcttcaccagatccagtcttactctcag

SEQ ID NO: 35128 - DNA, 201 bp, Bos taurus
catccttttcttagcatttaatgttcacagaattaatttatcattgaaactaagtataacttaactgtgaaatgtacaatcaccacattgaaatctgagckgcaaatgaaatttgattagctcgcctgagaatatatagttaacaagaaagtattagctaatagttaacagttttataggttagacagtctacaagtgcca

SEQ ID NO: 35129 - DNA, 201 bp, Bos taurus
acagaatagtatgcgtttgtgcacagcaggtacaccctccaacatgtggatgttgtcactttgtcagagtgattttttttaatgtgcactttatcacccayttctggatgagcaagagtcaactactacattttatcaaatctaaaatccattgtttataacatattattttatgggccaatgagaaagaaaaatgcagct

SEQ ID NO: 35130 - DNA, 201 bp, Bos taurus
tcaatatggtttgaaattttcttctaaaaaatactctggaaagtggccctaaagtgttctctgtggtactccagatctcttattcaacccaacacattttwaaaaatttagttgagggccaatgcatattctgtttcccctggagtataccacatgtgaaagttaggacttttccaggagaaagaagcttatagagtccca

SEQ ID NO: 35131 - DNA, 201 bp, Bos taurus
tttttttcctatgtaaactcttcatttgcaaagttaatacttgttcctaacaaattctaacaatatagatgtattttcagtgaaattgcctatcgtaactmatctcacctaggtaacccatcccatagagtctgctggctgagtcaggcacacaggagagtattttgtttttatttattgttagtgttaaaagtttttcaa

SEQ ID NO: 35132 - DNA, 201 bp, Bos taurus
ttttgattctgactcaaatgattcttttaagatgactcgagctggatagaatcccttgtttctattactgtaacactaattttattctgtgatatatttgycttgacctgcatttgcacctggcatgtaagatgaacagttatggtgtctttcctactaagctcattgaaggtaggaaccttgtcttagagactggggtat

SEQ ID NO: 35133 - DNA, 201 bp, Bos taurus
taccatggttccccatgtccatgccttagccctctattgaatttaaattctttctcgtttgttcggctctttcacattactgttctgctgcctctttcatsatccctctttcctgcttagccttctgttctcaacctaaattttacttcctcagagaggccttcctgcagtttggtgccctgtggtctgtcccatatcact

SEQ ID NO: 35134 - DNA, 201 bp, Bos taurus
gggtgttccatgaatgtgcatgaagtgaatgaatgaatgaatgagtcatcacacctgccctctacaatgggcccatagggcccctttctctatttttcttygacctgcttagttaaaaatcttctatcaggaagcttgggaaaagaaacacagatacacaattagaaaaacgtctaattaaggggtggccccagattgacc

SEQ ID NO: 35135 - DNA, 201 bp, Bos taurus
aaagcatccatattttctcctggttttgaatagttttaattatatttaattctagtgtgtccagatcttaccttgacgtgtggtgtgagctggggcttgtrtatttcagtcagtcagcgtccccagtgtgagggcatttctttaagaatttggaaaggacttgccttttccaagaagcctttgtagttagtgccacttcat

SEQ ID NO: 35136 - DNA, 201 bp, Bos taurus
tggagtccgagatggaggcgaagctcctccaaacagatgggggtgcagattcccaagaggagggacggggagggaagtgtgttgggggcccaggaactgtytcctgtgaccggcagttaagcttaccctgagggtctgtgtatgtgaaccctgaccggctgagccacaaccgctgcagggtggaaggccagcccagctgca

SEQ ID NO: 35137 - DNA, 201 bp, Bos taurus
tcacagtcctaacccagctccaaggggaggggaactgaagccatctgggccctgggataggaaggaagatagcctgagtgtggcagaaggcaatcatgatragtagacagatacacatcctagggcccaggagaagggtgaccctgcagatggcaaaggttgaagagggagaaagatgggaccttgaacccacttgatgaa

SEQ ID NO: 35138 - DNA, 201 bp, Bos taurus
tgctgtttgaaggccatcaggaaggaagaattctcatgcagaggaggtcaggtttttctactctatttggccttcaattgactggatgaggcccactcacrttaaagagggcaagctgcttcacttcgtcaggtcatttagatgttaatctcatctgaaaaacactttcacggacatctccagaataattcttgacaaatg

SEQ ID NO: 35139 - DNA, 201 bp, Bos taurus
ccttcctcagtctcccctgcactcagctgattcagggccactgtttcagctctagaccccgtggatgctgggtcaatgggaaagcagagctgagacctctrgagggagcaggcctgtgtttccttggcgcccttcttcacaaaggtgtgtcacgggtgaagggtctaacctcggaggagggtaggaccatcagaagtgatg

SEQ ID NO: 35140 - DNA, 201 bp, Bos taurus
cataaccacagccagtcccagctgtaggggtctgtaagtgacagaagcacgtgcaaggtgacctgttacctgggcttcatggtgatgcgcttttctaacakaagattcacccattcagccagtgcttactcattacatacaaatcatctatgccgagtcgtggtgtctttgttttttcacctgcaagatgcagagatgcct

SEQ ID NO: 35141 - DNA, 201 bp, Bos taurus
tgacaagaatgacttatttcagccagtctggtgcactgcacggggtcccacatcaggaattccatggggaagtttcctcaggcttgagaagggaagggagragaggggaggagcggctggccatgggcatgcaagtgtatccaagactggtcagctggtatccggccagtgcctggagctgttggggtgaggactctcctg

SEQ ID NO: 35142 - DNA, 201 bp, Bos taurus
tagcaaacgtgtattttgcatattttggttaaaatatatcattaagattaatgtgactaagaaaaatctaaaatgacctctgtggccgcattgtatttctrggggacagtattgtgctcggtgtttgcttcccatccattccttcctcccctttctatttttttgcacctgcttctctttgcctgggccctcaccttcctc

SEQ ID NO: 35143 - DNA, 201 bp, Bos taurus
gttcctcgcgtatatactgtcattgaatgctaaaccacttaactattacatgtagtatttgtatagaaatatttatatatatgtatgtataattttatttyttaatacaaggttttccaagaggagagccagggcctggctgctactgctgctgctaagtcgcttcagtcgtgtccgactctgtgcgaccccatagacagc

SEQ ID NO: 35144 - DNA, 201 bp, Bos taurus
gtcttgcctgttttttgatttgtgttacatgacgattagaatcaggagtgccggcggtgggggtcttcactgagcctggcccagtgctgtgtgttgtggaygctcagcagctgttagttgaaagagtgactgggatgcactgcctttgtcatcacctttctgctcttctttggtctgagtgtggaattgtacggaagaata

SEQ ID NO: 35145 - DNA, 201 bp, Bos taurus
ctgcagcctttctgccctgtgcctcatctggcctttgtcctgtttctttgaaaaatatgtatatcttggctgcttctctagctctgatggtgccttgggtkctgcttgtggtgtgctggccttccggtgccctgcgacgtccttcctgtgagtgttggaggatggaagaggaccattttggtctattgtggtaacctcctc

SEQ ID NO: 35146 - DNA, 201 bp, Bos taurus
ctactctggttctgtcactcagatcttctcaagatgttacagacgatgtcacccaagaaaaagaaaatcttctgttgcacctttcctccatgggttctttmtttaccattttttctagtgaaaagaacccaggtgatctttgtactgaaaattcacgtatgcgggagaatatcaaacctcttgcagctgcatttggggctg

SEQ ID NO: 35147 - DNA, 201 bp, Bos taurus
gtaaccaggccacaggcactcctgccatctcgacgggactctgcctctgggggatggccccttttgatgaaaaattggccccatttcctccactgagaatrtgcattcagactttcaaagagatgttccaggttgctgtagggaacagagttgtgaggtcatggcagtgcgtcagggccatgccagaccatgtacaagacg

SEQ ID NO: 35148 - DNA, 201 bp, Bos taurus
tgaacacatgttcctgagccagccttgcctgcagcaagccaaagcatcagctgtgtatattcctgatggtgaagtggccagacaaggatcccctgtgtacycacccgggcaagggtgggtctgagacaacagccaagagtgatgagtccagatttctgagctgagcattaaggagtctatttggcccttgccaaatcccct

SEQ ID NO: 35149 - DNA, 201 bp, Bos taurus
agtttgagcaagctttgagagatggtgaaggacagtgaagcctggcgtgttgcagtccatggggtcacagagagttggacgtggccgagtgactgaactgrtgctagaggaaatcttgccctaaaaattgaggggctctttttgcatacgtgtgtgtgtgtgctaagtcacttcagtcatgtccaactctttgcaacccta

SEQ ID NO: 35150 - DNA, 201 bp, Bos taurus
tttcatacctgtgaatatgatgctggatgataataaaagtggccagttttgagtaagaatgcaaggcaagaaaaggtcttggttcttgcttgcccattgaraacccaaagccataattagagctgtcaagtatggcacagctgatgtctttgaccctgttggaaactggtggtagtggtagatatgatgtgaaatctatga

SEQ ID NO: 35151 - DNA, 201 bp, Bos taurus
atttcacttttatgccaaccaacctgagaaatgatgccaagctaatcaggcatcctgtggccccctccttcacactgcctttaaaatcctatttctgaatktccttggggagctgggactcgttcaccttctcccttggcacacattatccctccaataaaaactattgcttgcctaaaaatcttttgggaacaatattca

SEQ ID NO: 35152 - DNA, 201 bp, Bos taurus
tttattgttccatcatgagcttgagttgatttaatattctattctggcttcctgcccttaacttgctgtatttatacagccctctccaaagcttggtgttyattctgaagcagatcctagctgctaaactcttctatgtccttttcattccaggcggttaccagggctacatgtgagaagaatgagggtggcactgaagct

SEQ ID NO: 35153 - DNA, 201 bp, Bos taurus
cctgttttttggttggtttgttttgttgtttttttaaacgtctcagaaatgttttacttgtttcttcattgaataaacccacctcccccgccccccgcccygccatgaaatcacaaatatcctttcaactctaaatacttgttacctctcatttctgtcagaaatacctgttatctcagttacagcattcagtgcttcacc

SEQ ID NO: 35154 - DNA, 201 bp, Bos taurus
gagtaggacacaactgagcaactttgactttcactctccagagcgtagtagaaacctcttctgacacaccgcttgagcaccgcggtctggcctctgtctcygaagtcatctctaggagtcctggaaacagcatggatgctgagctgttttttcacattggagaggggggttcagtggctgaagaaatggttcacgctgcca

SEQ ID NO: 35155 - DNA, 201 bp, Bos taurus
gtgaccacaggcaacgtgcttaacctttttacgcctcaaaactcaaatgtacaattgaggatgtgctaaaccactgtgctttgtggtttggtgaagcaccrtggtgtctgtcaagaaacttgtgctcaacgttgcaaattcacactaagcactggagccaggtcagtactcgaagttgctgggtgtccctctgggatccca

SEQ ID NO: 35156 - DNA, 201 bp, Bos taurus
agaaccccaaaccttgcaaagtagctttagggcccctgtgttgttcagagtggggttagtgaagcagggaaccttgcttgaggcctgacttgtacgtgacrgaattgagatttcttttttttttttggcttgtacagactttatttcaggataagcagatggccatgactgataaaatttttaacagaaaaattctactta

SEQ ID NO: 35157 - DNA, 201 bp, Bos taurus
caacctcagggtgctgttggcgctccagctgcgatgtctgcaagaggaggggaaggaaaaactgcagaggggctttctggaatctcctctctgacttgtasttggaattccttggccaccactgtcttcaaggaggctccagtgtggtgtttaagtgggcacattgccaggccaaataaaaccagctttctatgactaaag

SEQ ID NO: 35158 - DNA, 201 bp, Bos taurus
agaataaagagggagtctctttaaagacaagctgggctctggcctatcctggttaacttttgtttttaatgcttttagggagagagttttggtgtcgggtrtatttctctatgtaggcctgtgacttgtttttgtttgatttgtttaagtgaaggagccttgaaagtaagcttattatatggaacagtaggagaacactgt

SEQ ID NO: 35159 - DNA, 201 bp, Bos taurus
agtcgttgcgtcacatgggctcagtagttcaggctcccaggctctagagtacaggtttaggagtggtcatgcatgtgcttaattgcttctcaggatgtggsatcttcccggaccaggggattgaacctgtgtctcctaccttgacaggcaggttgtttacccctgagccaacagggaagccccatttgttagtacatgatg

SEQ ID NO: 35160 - DNA, 201 bp, Bos taurus
ctttactaaaaatatgggttgtaaactgtgagccacaatccagttagtgaatcttttatttagatgtgtttggttttggcaattgcatatttatttttagrtgtatttattaaatgctaatccaaagtgtccttctctcttttagagaaagcatgggattatggcagtcacagagtcccagtgatacaagttccattcagt

SEQ ID NO: 35161 - DNA, 201 bp, Bos taurus
tggcgggcggtcacatcgaaggccccctccagctcttctttcggaagtggcaatgggaagtctatcgctatttatttctgcctttaaactgtgcatgcggmtggccaaattcacaggatgacgtaacctggtggcactgacattccctagacatgttggttagacacctgctgtttccattcgcacctcctccttaggtgg

SEQ ID NO: 35162 - DNA, 201 bp, Bos taurus
tccctctcctttacaaaccgtggagtgactcagggaacaaacccagggtgctatgaagccgaggttctacagttactctgttccatctgagctcgtcggaygggcccgatacatagtgggtcttagaaagtggtagttgcggtcttgcttggtgtcattttgtgggtgctcttctaaacacagctgcctggggttgaaagg

SEQ ID NO: 35163 - DNA, 201 bp, Bos taurus
aggcaggcttggggagtcagggaggccacgatggctttctcccagcgctcttcagtgagggattaaacttgtatctaggggtaactgagatcagtaagtgraaaatcatagagaagacgtttggccccttgtaaggaggatattccagagctgtcagcctgccctggggaactgtagacggactcatgagggagaaggttc

SEQ ID NO: 35164 - DNA, 201 bp, Bos taurus
tatcagtaaacaaaagatatgaggccatcaagccatcagccactgcagccaccctcagtcatgcagcgtgaggatactcagatggaagagcataggctackggccccagatagttaaggtgcattcaagggaatcatttcaataaatccagactcttgctgggtttatttcccatataaagacattgagttcattaatgtg

SEQ ID NO: 35165 - DNA, 201 bp, Bos taurus
gattcatacttttagggaaaaatagtttagataatcactactaggctgcattttaaaaaaatgtttgtgcatataccctaatgttgattatagcacttttwacaacagccgggacatggaagtaacctaaatgttcatggatggaggaatgggtaaagaagatgtggtacatttttacaatagaatatcactcagccataa

SEQ ID NO: 35166 - DNA, 201 bp, Bos taurus
atggagaacagtgtgaggagcaggaaagcagttcgggggttgcctcaccacgaggactcgtgtagtttttttcagtctggcctcacctgtggtgagcaggrtggtctcctagcacctcagctgtaagtgttctgctttacagccaatagccttctgggcactcatgatttaagagtgttgctgggtatccttcggggccct

SEQ ID NO: 35167 - DNA, 201 bp, Bos taurus
aatgaaaatattcaatcttcatacaggctgaagaccaacttccagtaatcaggataggccagaaaaatctaaattcttgattttggtgaaaagtgattccrgatcattagtagccatgggcacttggatgcagcagatacaaatactttctagaagaagttaactttattctagtcctcaaattatttccaccaatgactt

SEQ ID NO: 35168 - DNA, 201 bp, Bos taurus
gctctcctacatttgaagagctagaagcgaccccccaacagcatccagagtccaatcacttcatgagaaatgtggggcccagaaagacatagagaccttcycagggtcacagagaaatttttcaaagtatttaatcggctcatagatgttctgctttcagaaaccctgaagtcaatccctggccctgccatgttttagcca

SEQ ID NO: 35169 - DNA, 201 bp, Bos taurus
attctaccataaaaaggaaaaacatgctacaatatggttagacattgaaaacatgttaagttaaagaccccagacacaaaaggccacgtatattgtctgaktccatttatatgacatattcaaaccaagggaattcatagatacagaaagcagattcatggttcccagggcctgggggagggaagaatgagaagtgactgt

SEQ ID NO: 35170 - DNA, 201 bp, Bos taurus
agaaaaaacaagaaccagactacatggcctcacccctgagattctgactttgaaggtccaggaggcagcccaggaatccacctttcaccactcacacccargtcccttgtgtacagggtcctcaggccatatgttgagttgctcaaaggatagttggagggagcagcaggcagagcagagggaaggagacagctccagact

SEQ ID NO: 35171 - DNA, 201 bp, Bos taurus
attttcttccactccagtgtcctcaaaagagttccattacttgagaggtcaggaattctcctcccatgtcttctaactaccagtggtgcctttgacatatracctcacagtgctgcctgcagctcctctagcaggaaagagaaatgtttctatgtagggatgatccacaaagcaaattcttttagacgggtcatttttagc

SEQ ID NO: 35172 - DNA, 201 bp, Bos taurus
gacgtcccaggaattcagctctttgtctctggatggcccttgggttagtggaagggtcggggaaccagtaattctgtccctgctctgaggatacaactccmttccaaggccaggctgtgtatgacagcccctgtcagccacagtaagcgttgtccatctcacatctcactcccacggaccagggtggggtgggcttggggg

SEQ ID NO: 35173 - DNA, 201 bp, Bos taurus
aagaggtgtatttggccctgacgtgccaatgacggggaaatggtaggatgcccgtggaggcacgtggcaaggtggccaagaaccggtggcccagagtcaayggctaactaatggaggggttcaaatctcccctctattgctgaccaggcgtgtgaccctaggcaagggtctctcctttctgatcctcccctggcccagctg

SEQ ID NO: 35174 - DNA, 201 bp, Bos taurus
ccagataccaaataactacagctttgcaggccatatagtctgtgtcatctactcaagtctgccttgctgtacaaaagcagccagacaatatgtaaacaaayggacatggatttgtaacaatacaactttataaaagggttttggaaggacaattcattatattgaaatattagatctgtttggaattgctcctgaattctt

SEQ ID NO: 35175 - DNA, 201 bp, Bos taurus
actttctcccacccactgtagatattcctcaaataattctccattggtgttctctttgcattatcactcttggagaaataatcaacacaaactattacccygattaggagcattttctaattgtactcttaactcttcctctcttacttaaatttctatatttgggtgcactgatactgcctcaattgcattaatttaaag

SEQ ID NO: 35176 - DNA, 201 bp, Bos taurus
gaatgccctagcaatttcctaggcctctttttttttaaggtttaaagagatctataaagaactgctacattttagaccccttcaaatggtacaaaatgaayagcttttaatcaaatcatttcaggtaattaaatattcatttactcccctacagcagttcagtctcctttttttaccctcttctttaccccaccgtatcca

SEQ ID NO: 35177 - DNA, 201 bp, Bos taurus
ccaaacataaacgattattggtttatagggtcgttaatcgagtaatcctaactatcctgtatcacattttttacagtgtgattttttgttttgattgtgcygggcctttgttgccgtgcacgggcccttggttgcagcagaggcttctctagttttggtgcccgggcttagttgccccgtggttcttagttccccgaccag

SEQ ID NO: 35178 - DNA, 201 bp, Bos taurus
cacctgtgtagtgataagttgccagcgggtggttatggggacgcaggggcttcttcagtagcagcttattcagcgtttcctgaaagggaagtgaggaaaargtcagggccctgacaggttctcagtggccaaaatccaggactctgagtagggtgattacttaactcttaactgcgaaggggcaagaggtctggcaggagg

SEQ ID NO: 35179 - DNA, 201 bp, Bos taurus
aaaataaggtttctatttcaccatcatcactacctctgacatttctagagggcactactgtgtgacaaggatggtgctgagcaccctacaccaggatcccrttaaatcctcaaaataaggtgggtatgacgacactctcccttctcagagaggcactcgaagagttgaggtcatggcagtacagaggccacgccaggactg

SEQ ID NO: 35180 - DNA, 201 bp, Bos taurus
ggcagttgcctcatctccctgggcctttacttctttaggattgcaagcctcttcagcagctttgaggaaaccataaaggcattcagcaccatgtgagtctygtgatagagaatggtgggccagtgcaacagtacatgtttattttaaggaaattacctttatccttctcaagacatgggaggcagctcaggaactgaaaaa

SEQ ID NO: 35181 - DNA, 201 bp, Bos taurus
agtgggatgactcacttacctggctggcctgagagtcgcctggggaggaaaggggagagcgtgagctcagggaggacacgtacggctgcctgctcccgccycccacggccagggctggttcactctgtgacctccctactttgtccacagcaggcccggtggcagagacagctctgactagtttacctgcccctgccaccc

SEQ ID NO: 35182 - DNA, 201 bp, Bos taurus
ctttcttggaagtttgcggtcaccgttgttattgtggccatcacttgtttctctaattggaactcaatgctaaggaccgcaagaatcctgagttcaaatcsctttagggccaatggttcaactttgcagagaagggggaaaaaaaaaaatccctagtcatagaaagacctgtctatacagaggagagaggataggatttgg

SEQ ID NO: 35183 - DNA, 201 bp, Bos taurus
atcagctctctctcctgggacttagagaggccttctccctccatcagttatccattaggtgaggcactgacttcagggtgggcggcttaagcccgcaccckcctccgaggcctccaggccccccacacgctgtcttgtctgggagataaatctagcttccagattagactctgggcccagcacccccacacccgaggctcc

SEQ ID NO: 35184 - DNA, 201 bp, Bos taurus
ccaaaataaaaataaaatgatgttgcttggctgctggtcagcaatttaatgtgaaagcaaaacaccctcccctttcatggacactgtattatatatgcagrcgtgaggtttacacaagtgatttcattaccttttacagcttttctgccttgttcatttctttattttcacaccttttagtgcttcctgcttcctttatcc

SEQ ID NO: 35185 - DNA, 201 bp, Bos taurus
gacgtcccatgtcccgtgacgacgcccccttttcctcccagcccctcctctccttccctttgtgtgtcccagctgccctggtgagaggggccaaggagacygtcctccttaggaacaatctcccctttctctctggggtgtaagtgatacaggagaagaggaagcaatttgtaactaatcggctgtgatgtggaacagagc

SEQ ID NO: 35186 - DNA, 201 bp, Bos taurus
ccaactcctttgggtcttgttgccttcgtagactccatggacgcagcgacgagagcgatcagcaggagtctctgcacaaactcttgacatccgggggcctragcgaggatttccgttcccattatgctcaactccagtccaacatcattgaggcaattaacgagctgctggtggaactgggtgagtcctgatccttaggtg

SEQ ID NO: 35187 - DNA, 201 bp, Bos taurus
tggatctgcctctaatataaattatgccccagagaaaaagctttattggcagtctcatattccccatattaaataaatttagagacaattctctctttttmatttccaataatctatgccgccccaaagtaggaaaatgccctaccttatgactcattatatgatttgccccttccttggggcctggggttttactttctt

SEQ ID NO: 35188 - DNA, 201 bp, Bos taurus
cttgtccattagcactttatagtttatgtgtgtatttgtggggcctttaaaaactcacatttatgtgaaggctgttaagagatgttttttgcagttagagytatttcttttagtatgggaaatgactacaagaaagtcatttctgtgtttatcgatgatctccctgaaatcctgttgccaatgagaagtcaacattttgct

SEQ ID NO: 35189 - DNA, 201 bp, Bos taurus
aatccctgacttccaagcacatacatattcagtgtatccaaatcccacctatctttccagccttaaccatgaagtctcctttaaccactactgtccacacygattccctcttctctaaagccccacaacactgagactgccacacaattaacactcgtaacactgtcatatccacgttgttttgctttttatccttccccc

SEQ ID NO: 35190 - DNA, 201 bp, Bos taurus
gaaaacagccacataacattgtgattaagttcatatttttaaagagattcatcctgaagtatgaaagactgaaacaccatgatactcagactttagtttamaacgactcagcataaaatgagaagggagaagcagttaagatgaaataagtgtgacacgattccgataatctgggtaatgtgtacacatggtggacagact

SEQ ID NO: 35191 - DNA, 201 bp, Bos taurus
actgtatggttcatggggttgcaaagacaggactgagtgactttcacttttctattcccatgcctaagattgagtcgctgctccctctgctggccacgcargggcatgacagtcattgactaagtagataaacagcatgtcagtatggtgattcagtggctaagactgtgctctcaatgcagggggcccaggtttgatacc

SEQ ID NO: 35192 - DNA, 201 bp, Bos taurus
tggattgagtaggggaggagaggggaacatgagccaggctggccccaggatataccctagattcatcccactaacaacacaggccagtgtctggtatgacrggcaggacctgaacaaaatcagttactccaggggactctgtagcagattctgtgcttctccagggggaaactgacagaaaatagacaaaggccagcctgg

SEQ ID NO: 35193 - DNA, 201 bp, Bos taurus
ctggtggccttggcaaatctctttgtgcttctgagtcgccgttatctcatctgtgaaatgggatcactgaccctggatgccctgggtaggtgtgagagtcrgatgacacaaaatggcctcagaggggcaacttgtttttcgaggaaccacttaacaagggcaagtgtatcaggttatgctctcagcacctgccacgagctg

SEQ ID NO: 35194 - DNA, 201 bp, Bos taurus
agggaaaaaggaaggagggaggggaggaaggagttctgatagtcttaaagtttgtctacttcaggtaaaaattccttatggccccctcagatgttggcctmttgtttatccccagggaggtaggaagaacaaggctgtaggaacccaggctgactggcttgatctggtggcctctagaagtttaaagtaccattagtatgg

SEQ ID NO: 35195 - DNA, 201 bp, Bos taurus
gccagattgagagagtcatcaagaaaaaaaaggggggcgagcttcatgctgtcttggatcaaacgctattgttctgtctccggactgtggcctgtactcakggtgccttcagcccgttccaggaggctgggaggatgggcaaggatgtgaggactgtgttatctccagggcctctggctgggaaaccccacctattgccct

SEQ ID NO: 35196 - DNA, 201 bp, Bos taurus
atacccctccagggggcacgactcatggctttgtttacacaagaactctttctgggttggtccagaaccaacttgcacaaccatgagtggccttcctgatragaaaccctccttgtctgttaaatatacatgaattcttatgagcttctccatccatcccttagaaaagaagtgcttcactcactagaatttcttttctat

SEQ ID NO: 35197 - DNA, 201 bp, Bos taurus
actcaagtggaggccaggaagaatcctagaaagaggaagctagagaaaactggggtgtgtaaagtcatcagtccagagagtaaaccgagtgagaagcctgractaaggccaaggtgaggacaactgagggatccagcaggaatgaagctgaaagggagaagcaaacaagacaggagacagtcaaacggctgagaagccaag

SEQ ID NO: 35198 - DNA, 201 bp, Bos taurus
aggatgtagtttcctttattttctaagtaaaactgagctgtaacacagagctgtaacactgtctgagagctctgatgcactgagggccttaatgtccatcrcttcaaatttttgttgtgacgaggagattacattcccctgacaattggatagttgctgattgtttatcaggccctgaacaagacaataccatagtgcttc

SEQ ID NO: 35199 - DNA, 201 bp, Bos taurus
cccatggactataacatgccagcctcccctgtccttcattgtctcctaagcttgctcagattggtgtttttgagtcattgagttggtcatgctattcagcygtcttaccctctgccacccccttctcttttctgttcaatctttcccaacttcagggtctttttctatcaatcggctctttctatcagatggccaaagtat

SEQ ID NO: 35200 - DNA, 201 bp, Bos taurus
ggaggcctcagctggcccccgaggatgctatagaactgaaatgacctttcagatttgtgagtcatggtgggggggctagggcacagtttacatacttcctytctgccaacctgtccttggatatgggctgcctgggacaagaatgtaaccttgagtaatggggccgtcgctagaaagggctgagggtagcagtggaggtag

SEQ ID NO: 35201 - DNA, 201 bp, Bos taurus
gttattagtgcacaagtccctttgatttggggacgaggtattaaggtcttctggctgtggaggagtgacttggatggtggtctttctgtttggaagctgcwgggttagcagttgccacggtttcagaatggaaagatgagaggaaccgtgtctttgtgtgacctctggacggaaaggattctcactcatcctcccaatggc

SEQ ID NO: 35202 - DNA, 201 bp, Bos taurus
cctgaagcctgttcctctcctctgatcccggtttccatacaagccttcctgctgctggtgacaggaccggctccttcggacagcaggtttatagcgttcakcttcaccacgacagtcagaggcagtggtcccagggtttactttacctttcccctctcggggagaattatttgcatttttgcagaaggtgccggttggtcc

SEQ ID NO: 35203 - DNA, 201 bp, Bos taurus
ggttggtgtgcttagaggggtcagcgtactgcagcctgtggcccaaatccagcccgccacctgcctgtgtaaagtttactggaacatggccacgtaccttyatttacatactgcctatggctaccttggggctacaggagcagaactcagttgtgacagagaccacgtggcctgcaaagcctgaattatttactctctagc

SEQ ID NO: 35204 - DNA, 201 bp, Bos taurus
ggagtcaattgggtgggagtgaaatcagggtgggaagaggcagggagtgagaaatataaaataaagcagccattcatgttttttaagaaagaagatggatwtttggagttaggaagcctggggttcaaatcctaactcagctgtttgctaacactgtaacctcaggtaaatcacttgtcagaatcactgtcttctataaat

SEQ ID NO: 35205 - DNA, 201 bp, Bos taurus
ctggtcaagggcagttcccaggagaaggctgtagtccttagaagctagagatggccaggcacaccaggggtgtgggggccaatggatctgagcaggacacsagcaccatctactacagagaggggctatgaggcagggtccggtgggggcctcagtctctgcgcctccttgtgggtctctctggaatttgatggtggattt

SEQ ID NO: 35206 - DNA, 201 bp, Bos taurus
attagaatgtagacacctttgagggccactattctgcttaccataggacctccatgtcccatcccagcagagattcagtggtcccataactggttggatcrttgggtcttttcaagtaggacaaagattcaggcaccattgggcacaacagtaacattcttcaaaccccctaagagcacaccacatgttaattgtttgctt

SEQ ID NO: 35207 - DNA, 201 bp, Bos taurus
aaatcccatggaaggaggagcacggtaggctacagtccatggggtcgcagagtcggactcgactgagcgactccactttcacttagttcgttacactgacytttgggggttcaaacactggcacctgcctcctggatcaaaacgagtgtctctagcagagtagccaggactttgaaaaaaactggagacctacaggaactg

SEQ ID NO: 35208 - DNA, 201 bp, Bos taurus
tgggagttgctttattaatgagagaactcttattggcaatgacaccaaaaaccagaggtcagtctaaacatctgtgtacagaccataatggataatagacyggccttagattacatcccagctatctgaaataagacttactggtccttcctcccaactcctccacacatataattcttcctaggtggccaaatgcaggac

SEQ ID NO: 35209 - DNA, 201 bp, Bos taurus
ttccatttggtcagacgggggcgccatgttaaagtattcagtactgaccccagcaccatcatgctgagaaaggaaagcagaattttccattaagtttgaamccatgctatacagcagtagtccttattgacagtaattgactgtcatgctatacagcagacagtccttattgactcctggtcttcctaaaagagtaacaca

SEQ ID NO: 35210 - DNA, 201 bp, Bos taurus
agggataggagtatctgttattcactatggaccctaagaccacgcctgaatttatactaaggcgatgactcgggatgtgggcctgtcaagctagaaagtgktatcaggcagggagaccgagttcaatcatgaccaaatcaatcacgctcaaggggcgaaactccaattacaaccgcgaacactaggcctcgggggagcttc

SEQ ID NO: 35211 - DNA, 201 bp, Bos taurus
tcgttcactctgaacaaagtatctactccttcctcctctttttgccttcatgctcatgttccttgggacggctgctatctgagggtcttttagagccaccrtgttgcttggcttcttccaaaaatttgtccaaaccgaaaggatcctcctcaaactgaactggtccttctcggcctctttgtctacggtctgaaccagaaa

SEQ ID NO: 35212 - DNA, 201 bp, Bos taurus
tctcagcctctatgatggtgagagataaattcctgttgtgtaagccacactgtctatggcgtttcgtatggcagccatgaagatttagacaggtggcttayctggccctgctgtaggacaggagagctcccttacactggtggaggaagactgcatggaggaggcagggttttggggcttcctgaatgaagacagggtgtg

SEQ ID NO: 35213 - DNA, 201 bp, Bos taurus
actctgatgggaagagaggctggaaaaaaatgagcatttatctgacagaatgctgttctaaacacagtctgaatttgcttagcaaggacaccagagaccaygagaaccacgtgggcaaggccagtgtctgccacataccttaattgctttgcattattttttctggttggttcaactaggtagtgagttactgaaaacaga

SEQ ID NO: 35214 - DNA, 201 bp, Bos taurus
gatggggactggggatggggttgggggtggggtttgtattcttgaaaagcacaccactgtcagggaactgaggtgcagaatcttaaaatcccggtgggggmgggaccatgaggccccagcagagggtctgagttacaaccctgccctcttctgcggctggagcacggtgtgtctgtgtgtgcgtggccgtgcacgcgcgtg

SEQ ID NO: 35215 - DNA, 201 bp, Bos taurus
cctgggcggcgttcccgccgacatccggccgtctgctctgacccttgatggggtgcaggccatgcccagcttcaagggattaatctcggatctcaagtacrgcaactcagagccccggcttctgggaagccagggtgtccagttggatgccgaggggccttgcggcgagcgtccctgtgaaaatggcggcatctgctttct

SEQ ID NO: 35216 - DNA, 201 bp, Bos taurus
ttctcaaagaaaagaccaagtcctagcctgattggccgtaatgagttgcttttctcttctgatgaagacccctatcaaggcaagtggactaattgtcgggrgtggggtgtctttggccctgctaagctgtgtgacaccctagctgggaggggagaggtagttactatttttgaatatcgtatactagatactgtgccaggt

SEQ ID NO: 35217 - DNA, 201 bp, Bos taurus
ctcaaacaagcagacggcagcattaggccgagaagggacaattcagatgggccgggaggtgacagggatgaatctatgcagaaacgaggcctgacctggaygagacgggggtgtgaggtgcagggagaaacagtgtctgagatgccacgggtgctctctgttcagacgcctgcactttcagataaagctctttggcttcag

SEQ ID NO: 35218 - DNA, 201 bp, Bos taurus
atcaaattagctttagttctgagctctcatctggtggaaagctgtataaaaaaatctattgcattctgtttgaggaaacgcatttcctagggttcttcaamaattttaagtgacactctcatgaggttaggaagataggagtggagggttgcatccttcccaggggaccctgctgtgattatttctctatctgccacgtgg

SEQ ID NO: 35219 - DNA, 201 bp, Bos taurus
ctgggcgctgcacgctccaggagtggacagggacatgaggcgatgtctgtggccaaggggaggacgtgtgctgagccccaggaggcaccgattggctggcrgtgaggtaatgcgatgcagtctaaatgtggaaacggcagccccggtgtccagggcatgcctgctccccgaccagcccagttggccgctggccctgtctga

SEQ ID NO: 35220 - DNA, 201 bp, Bos taurus
gcttttttccaaagtcttagcttctttcaggatatctattagacctttggtagtaggaaagtcccccaaataccatgtattccctaggatcctcgcctgtkttttgtttctttgaccattctagtttatcctgattagatggtactaagctttccagctactgatttggatttcaaggggcattggtaatggagtgataca

SEQ ID NO: 35221 - DNA, 201 bp, Bos taurus
taggaacacctaggccctttatttagatctgtgactttgagattcttacttggatcctctggcttccttgttctgaaaaaataaaatgaggcaattgtgtytcatgctctcccagggcccattcaattataaaactctgtgattctcaaatgtcatcagcttggcaatgtcttcccttatcctgagtagaggggtaaaggt

SEQ ID NO: 35222 - DNA, 201 bp, Bos taurus
ccagtgcgtttctcaagggcactgtaggacattgttgatggcgctagtctgtacctttgcctacacccctgggatgatcccgaaaaaatctgcctggcccrttgtgggcctcctgtcgagctgacccagcctgtgttctttgcagatggtgagtgccctcattcagactgtaggtagtcttgaggcttggagctgtagccg

SEQ ID NO: 35223 - DNA, 201 bp, Bos taurus
ggagcaaccaggaccatgtgccacagctactgagtcagtgctctagagcctctgagcggcagttactgagcccaagggccacaactgctgaaggctgtgcygtataacctgtgctccacaaaaggaaaagctaaggcaatacgaagcccatgcaccatagtagctggccacaactagagaaagcctacgcacagcagcaaa

SEQ ID NO: 35224 - DNA, 201 bp, Bos taurus
gagctgagaagtgaaaccctccccatggccaagggctgtggacctccctttgcccctgagaatccctttctccattgctgccatcctaccagcgacaaccygggtgtgggcaatgaatggcccctttcctcgattctgtatccacagctgagacggctgcagaagttacgatgctcccggtggatttggaatcatgggtgg

SEQ ID NO: 35225 - DNA, 201 bp, Bos taurus
tctttctccacactgcggagtcaagaaatagagacctgcagccataaaaatatgtaatgaaaagacagagaactgataaacagttataccctgctggtacmattcagtaaggcttacatttaataacacagtggtgggaggacttctgctttgtgtgaaagtgcagttgagtgaggccactaaaccgaagacaaaataaat

SEQ ID NO: 35226 - DNA, 201 bp, Bos taurus
gtgaatgtgaatagttatttctcctccgtttataagattagtgtgtcatcctagaaagctctggtgaatcgttttctctgggtttgttagatgtgaagccyagagctgaccaggcttatcagttcgtggaaaggctcctcctttgttcttcaagactgtttgatttatttcctgttacttctgttcgtattctctacttat

SEQ ID NO: 35227 - DNA, 201 bp, Bos taurus
aatggactttgctagtattgactattcattctttccttgtgaaatgtctgaatgtgctcattttcatactttaagtcatcatcaattacagagttgcaggygcttttcttgtgggctacctccagcagctgtcagtgaaaccgagcagctgctcggtagatagtgaagaggttccctcctcgcacgtcctcctgttttcgt

SEQ ID NO: 35228 - DNA, 201 bp, Bos taurus
gaaaacagatagtctatatgagatagcccatccttgagtggcttgatgtctggcaattaatgttagagcaaaaaattaagacccagttattttcatttctmaagggcatgacaatgagtctctcaatccaccatattaaaccactggaaatcatatataacagaatcttttcttcattaaaacttggtttaaggggacaaa

SEQ ID NO: 35229 - DNA, 201 bp, Bos taurus
aggaaatggcagcaacccactccagtattgcctgggaaatcccatggacagaggatactggtgggctacagtccatggggtcacaaaagagtcagatacgkcatagcaactaaacagcaacaccctgtgcttagtgattctagagaaagagatactactccctggtatgagtagcaggtattaagactatcatttttattg

SEQ ID NO: 35230 - DNA, 201 bp, Bos taurus
cctaagcatggaaatttcaggattatgggagaattgattatgaatcattgacatctaagacattggatttcatggagaattataaaaagatgagcaaaaargggaaaaagaaattgaaaaataaaatttatgtttttctaggtaatatatgttaacacaatccttgtctcttttcactgcaataattacaagttcaaaaaa

SEQ ID NO: 35231 - DNA, 201 bp, Bos taurus
caggaaaaaaaagaaacaaagacaaaaaaggcaagaggattccaactgaaatttgacaacaatgactatatgaagtattccagcttcttgaattggttaaygaggaaatgcactgggaaaaatgtttcagaagcaaattgattaggcatctcacagaataaacgatgtgactgttggaaatttaaaggtcaagagtaaact

SEQ ID NO: 35232 - DNA, 201 bp, Bos taurus
tcgtgctttgtgggcactctttcttttctggaagaatgtcattctctccattttcctccttctttttaataacagtaacttgtgtggaatgtgatcatggyccaatcttgctgctcacgtatcaaagtaagaatggaccaggaaaactgccccagcttcactctcatgttgttaacatgaagcacgaaaaaatatggctgt

SEQ ID NO: 35233 - DNA, 201 bp, Bos taurus
tatgagtctgtttctgttttgttatgtttgttcatttcttttgtttttctagattccacacataagtaaaaccatatggtatttgtctatctctgtctaasacttcatttagtgtgatacttttaggcccatctatgttgctgcaaatgacatttcttctttctttttaatgactgagtagtattccattgtatatgtacc

SEQ ID NO: 35234 - DNA, 201 bp, Bos taurus
agtgacctgtctgcctgtcaagtagccagtaggtgctgtgtacagtgatgtccgtgggcttggcaaggttgtttctcagattccaggaaggccctgacttyccaggaaccctctgaagaattcccgtccatttgtcttttgattcacacacacacatatatattggccatgccccactttatgggggatcttaattctcca

SEQ ID NO: 35235 - DNA, 201 bp, Bos taurus
cactaataaccatcttcacctggttggatcctgctcatcctttcaatcccagcatcactgtcactgcctcagagaggccctcaactgtcctcaccccatgrgaggttttattcccagtcccttgttgttgtcgcgaagttgtgtctctttggctctttgtaaccccatgacctgcagcatgccaggcctccctgttcatca

SEQ ID NO: 35236 - DNA, 201 bp, Bos taurus
tgacatcagagaggcagtaagggttcttaagcaaggaggatgaagtgacccgatcattttggttgtcctatggaaactgtgttaaggagggcaatgagatrattagctaagaatacatcaatgctttgtatgaccagtgaagaataaattacagtaattcagaggtggtggtctcaaccacagaagcttcaatgagaatgg

SEQ ID NO: 35237 - DNA, 201 bp, Bos taurus
agtgcaagggcctgggcctcggagccaaacccacgattatcaggttgattctacttccgtcggtcccccccatacactggctcaataaaaaatgtggagcygaggtaggagacggtgggcctctgccctggacacctggtgtttgtcaagtggagtaaaactgaacctctgttctcactcagacactccaaggacaaagct

SEQ ID NO: 35238 - DNA, 201 bp, Bos taurus
ggggaaggggccacggagaacaaaggagcttccccccagcacccatgagagggtgaccacaggagcctggcttgggatgggtgacttccagcgcctacccyggccgtacctgtggattctgccagggatggaacatctggcctgacatgaagaaaggggatagctctgcatacctttggacgctgagagtacttgagtaac

SEQ ID NO: 35239 - DNA, 201 bp, Bos taurus
taggccaaatgtatggtgcttttaaatgctaatcagtattgtaagaaatgatgttcatcctaaagaggtaagtccctatgctcccccagccccggaggtcyggctgcaaagtcctttctctgggccccttcattcacgtctgagcaggatggccaactgtctgggcttcgcagagtctgtcaccatatatgtgtcacacgt

SEQ ID NO: 35240 - DNA, 201 bp, Bos taurus
cctcgtctctggttttcctgtgtgggaattaggcccaagtctggtacccagcacagccgcctggtgtccagcccagcctcaggcagcccacatttcaacarcaggcatcctgagatggcccagggcggacttgactgtctacagtattctaaccacgctcctgccgatgtcttttgtccctagggttgtccttcgggatgg

SEQ ID NO: 35241 - DNA, 201 bp, Bos taurus
gctatcaaaaacgaaaggccagtaccacttgccattggtgaatgtcagcctaaaccataggatcaagtttaaattgaaaatgaccgcactgagacttccayggtggcccaggggctagcacttcacaccgccagtgcagggaacctgaggtgcatgtatctttttgaattagtgtctttgtttgtctgtttgttttgggta

SEQ ID NO: 35242 - DNA, 201 bp, Bos taurus
gagtggaggtttggttaccacagagaggattgctaagtgacaaagatattgggagaaggaaatgggagagacaggaaagggtgtgcatgtgggaatgaagytccttggtcttgagtaaagacacctagctcctgccctggaggatggttttcctgcaaacccttagtccacagtgcagggtatacactgaaacactatata

SEQ ID NO: 35243 - DNA, 201 bp, Bos taurus
tagaccatgtgcccaacacatagtgaggtcaagccaaaatgtcagagtttcgagcacagaaggcttcatagcagggccaggcaaagaaaatggctggctcrtgtccaaaaaacccaaactccccgaagggtttcagcaaagaacttttaaaggccagatgagggcagggcgtggcaggctgctgcatcttcttggtatagg

SEQ ID NO: 35244 - DNA, 201 bp, Bos taurus
ttgcccaagctaaccactgtaccacctggccttagtggaaccctggcctctcagtaggactacctaggtatccagtgaccatgtgatgtggctccagagtkgaaaaaggaagagtctgatgagtggatcactggccggggctggcaatggcgccaaaggaaaaaccgaggtcacctcctcgactggtcagctctaagggat

SEQ ID NO: 35245 - DNA, 201 bp, Bos taurus
ggagatgcctcaggcctgcagagtttgcctcagtggagttctgcaagggatcctcccctagcaaacctgggagagcttcacagagctccctggaggggagygtgaactgaatgggggtgggactgcccaacagtcccttgagcagtccttcagttacacctcttccttcagttaaacccacttagcccctgtggcaaggtg

SEQ ID NO: 35246 - DNA, 201 bp, Bos taurus
cggaagggtcaggccatgtcactcgctaggggacttcaaatttcaagaaagacttgtgtgtctgagttcctagaacatcatgagacagagaaacagccccmttgggccagaccacagtggtgaggggaggtgggggaggagggcttggccttcttccctccatgtctgtctgggatagcctatgcctttgggggcagcgtg

SEQ ID NO: 35247 - DNA, 201 bp, Bos taurus
tcatccttctgcctccggaagttaagcgccacaaggtcagaatttgttcacgttcgttccatcaaatggctatgggagttgaggaatctttcttgaataartgaatgaataaataaatcccttttctgtgtccagcatctcatctgatccattcaattccttaacaatttcctttaacttttgtcactatgtccacctttc

SEQ ID NO: 35248 - DNA, 201 bp, Bos taurus
tcccttcctgggcattcccaaagggcaatgccatcatctgggtcaggacaagcccatctcatttcttcctactgatgtatccctgcacatacttgaacatyaaaaagaaaataatctggcagctgttttctttacaaaagccatttccaaaattaacaatttattatgcttgtgacaaaaataattcatctgctttgcaga

SEQ ID NO: 35249 - DNA, 201 bp, Bos taurus
gtcattccataattcactgcaaatcagtaaagtaattaaacagcttatgttaatgaccccgtgtcccaggcacattgtgaggccctgggaatacagttcakttcagttcagtctctcagtcgtgtctgactctgcaaccccatggaatgcagcacaccaggcctccctgtccatcagcaactaccggagcttgcttaaact

SEQ ID NO: 35250 - DNA, 201 bp, Bos taurus
gctgcggcggcgctacctggactggaggaagaagaggctgcaagataagctagcggcgacgcagaagaagctggatctggcctgagatccccgccctgttkgtccccgccgactcccgcgcgaccacctcgagggcatctaccctgtcccgtgcggggcctcggccatagctaggcccgtctcacgccctgcgcccgcagt

SEQ ID NO: 35251 - DNA, 201 bp, Bos taurus
ctcattaaaaaaaaaaaaaaatccctagctctcaaagtccatatcaggcccagagaagtaagagttaaattggcataagctgcacctcacattgcgagcaygcgtgactgcatccgtggcccagcgcgtgtcgttgccaagcagactcgcagcgatcagtgtgcagcggctgactcctctagtccaagactgacaaacttt

SEQ ID NO: 35252 - DNA, 201 bp, Bos taurus
gcatcaaacctgagccccctgcattggaagcctgaggtcttaaccactggcccaccagggaagtcctaaggctgactgctttttacttccccaaaaacctyaatcaacttaaatctaacttaggcctgtccattttggtgttttcaaaatgagttcaggcaaaggtgagcaaaaacagggggcaggatgaaactggtacag

SEQ ID NO: 35253 - DNA, 201 bp, Bos taurus
aggcacctggtcgcatggaagttaccgtgaagctgtaggtggaggttgaagggagaagataatacagcaagagtagaggccatggtcatggcactcaagartagagggcacccagttcatgatggacagctcagattacaagggaatttggcccatagccaagcattcaggttctgctttgtttgttttttcttttatttt

SEQ ID NO: 35254 - DNA, 201 bp, Bos taurus
ggcagattctttacccactgggccacctgggaagccacctaggagacttagtttgcgcatctttaaaatgggcgggtgctgccaacctcctacagttgttrtaacaatgaggtgcccttaaggcccagaagtgcaggagtggggttctcggcccgccctgagggccctcccagcacggcccgtctcggtaggacagaaccc

SEQ ID NO: 35255 - DNA, 201 bp, Bos taurus
ctcttgaacccctgtggatgcatgatctttgtctgcccatccatccctccccagcatgacccctctgttcccctggcaagaaaaggcctttgggaacttcyctcctgctgacgtgggtgtctgggggcagtgaagaccagccgattggacatcagtcttcagcctccgcagacacgccctcttctcctggccacgcccctc

SEQ ID NO: 35256 - DNA, 201 bp, Bos taurus
ggccccccacccatcaggagatgaagagtgagtccctcatcatgccagggtcacatctggcaccaaagggaagggactttcatgggagtcactcagaggcraaccttggggacagcatggctggcctgggggctgagaattagccagtcccaccgtatccagagccataaatactccatgatctttgacccacagtaatcc

SEQ ID NO: 35257 - DNA, 201 bp, Bos taurus
gcctcagggcgaggctccccccgcccagccttacctggcagctggggcagaggcagtggggactggtccggcacccacccggcggagtcccctcctgtccyttcagaggcccagtcacagctgaacaaggaggtacacactctcctccttccgccccgaccccaggcgactcccgcccgcacccctcacgtcacaggggca

SEQ ID NO: 35258 - DNA, 201 bp, Bos taurus
ttgccgtcgatgtccatcattatctacagcacagagagggggggcaagtcagggccgggccccggcagcggagcgagacggcccgcactgccgacgggccyggacagggactcaccgtcagatgcctcttgacatagcggatcacaaggaaggtgtcgtaatggaggttgcggacgatggctgtgcagccccccagctctg

SEQ ID NO: 35259 - DNA, 201 bp, Bos taurus
agattatggagagcggctacacccgcatcccagtgtttgaagacgagcagtccaacatcgtcgatatcctctatgtcaaggacttggccttcgtggatccygatgactgcaccccgctcaagaccatcacccgcttctacaaccacccagtgcacttcgtcttccacgacaccaagctggatgccatgctggaggagttca

SEQ ID NO: 35260 - DNA, 201 bp, Bos taurus
cttgtggcctgcctgcatcatctcctctgagcctttccttcctccccagcagcctccctgctcgcctgtcctccgcagggcgactcctgggaggaggaggratttggtccctgggctccttggccttctgtttgtctcccctctttcccttaccttctctattcgcttggtccttaggaaaaaaagagaagccaaaatgtg

SEQ ID NO: 35261 - DNA, 201 bp, Bos taurus
gatgacaactcgtaatttgtcaggaagtcaagaacagcaggagtggctctgagatacacactaacaaacctctagcatagagggaggccagtggtgatttrgaaaaaccacatgtcatttcctcttttttctttcttctacattttcagctcttctcttgtgacacgtcgatacatagactagagcaaaggccgggtgtag

SEQ ID NO: 35262 - DNA, 201 bp, Bos taurus
tctactgctttgttgggaaaaacaagaaggggaattaagaaatatatctttatgtcgatcaatcacactccaatcaatttttttgcaaaaggaatatacayttggctctaagaagaaaacactgtgtgtatgtgtctgtgagtgatttaactttgtttattaaaaaggtttctggggaaaaccagtaatatatatgtttat

SEQ ID NO: 35263 - DNA, 201 bp, Bos taurus
attacttaatgaccaatcagatatggttcattggtagtaagtgtagaaacatgttgtctgaagatgtagtttaattagtatcctcctaaaaacatgtcccytgtgaccattggatgtaatcattattttatgtatttaactgtgaaattcatatttactcagcaggccaagagaacagcgttttacttctcaaagctgttt

SEQ ID NO: 35264 - DNA, 201 bp, Bos taurus
actgcaatgaagtcagataccgattcagtaagaaaactacaataggcagaaagaaaacaatgccagaattaaatctatgaggccattttatgtaaacagaycatttcaagcaaatagtttaataccaagtagtaatacctgatagaactattttttcagtaacacatcatttcaaattactgtacattttggtgggagtgg

SEQ ID NO: 35265 - DNA, 201 bp, Bos taurus
ttggactaataactctttccttcagaacttctctgactttatcattacttttgacctttccccttccagcgtaacagccctaaagacttcagctacactcrgtgtggcaatcagttccagctttcttgttttttgctgggttctggtctcacaataaacctagaattgccctgtcacaagctacaaatttctcttccattt

SEQ ID NO: 35266 - DNA, 201 bp, Bos taurus
cacttcacactggttataatggccgtcatcaaaaaaaaatctacaaacaataaatgctgaagaggatatggagtagagggaatcctcttgcactgttggtrgggatgtaaattgatccagctagtattgaagacagtatggaggttaaaaaaaaaaactaggaataaaactacaatatgacccagcagtcccactactggg

SEQ ID NO: 35267 - DNA, 201 bp, Bos taurus
aagctcactgtataaatgcatgttctttactgaggccatccgggagaaataacttccccacatgcttcactgaggtctgtgcccagtcaaccgaagacccrctggagcaagggaggccaatttaggagaatcaaactcttaagaagatcaaccaacttcccttaatagaccttcattctttttacactttctgcctattaa

SEQ ID NO: 35268 - DNA, 201 bp, Bos taurus
ctatgaaactgactttattctgagtcaaaaatggtcaaatacgggcaatttcatatggctcaacttacttctcacctcagagtggaggtagagcttggctytgggcttggattccatgcaggtaggtccacgttgtgaaactgcctccaaggtacacacagaggcctgcccagcctggagatcctgatcaagcccaataag

SEQ ID NO: 35269 - DNA, 201 bp, Bos taurus
ctctcacctctatttagttaccaactggcccacagtattcattttaaaacaaaatcaagccccacagctaaggagagggtagtgtgatgaaagtttacagkcagatacagatggccagtgggcacacaaagaggtgctcaacatcactaaatatcagagaattgaaaatcaaaactacaagaggtatcacctcacactagt

SEQ ID NO: 35270 - DNA, 201 bp, Bos taurus
agggaagccccccttggcccccagaggaaggaaaagaggacatggatccctagaaggcactcagagatgaagaggggactcccttcccagagatagagctkgggccgtggaccactggagggaccgccgggactgactatctttggaggagtcctcagctgagtgcagacttcacatcatctatgcagggggctcagcagt

SEQ ID NO: 35271 - DNA, 201 bp, Bos taurus
gtggacctggtctggccccaaacctctggactgtgctgtgctgcccagaccatgccccagcctggaaagaatatggtaagtgtggtgggtgtgggagtgayagggaccagcaccccggccccagcccccagatgcagggctgaggcagcaggtgaattcagggtccccctacccagccaggtctgggtctaacctgaatgg

SEQ ID NO: 35272 - DNA, 201 bp, Bos taurus
tctgggggaggagtgtgtagacagccagggggtcagcagggccaccaggagactcaggccggggcaggggtggtggtggttttctggcagggaggaggccyggacacgcatggaggatgagatctgattgtcagctggctgctgtgcggtggggagactacagaagggatgggggccgggtgactgccatggtatcccagc

SEQ ID NO: 35273 - DNA, 201 bp, Bos taurus
ggaaaagccttggcacccagtgaaggggctgcaggggcctgctgcaatggatgcatgaagggacagtgttggcaagacagacagacagaagtgagggaagraaggtgggaaggtggccagagcaagtgaaaggaagcttccactgggaaagtgggagagggctgctttagctgcttcatttttttaagacttttttttttt

SEQ ID NO: 35274 - DNA, 201 bp, Bos taurus
tacatacctgtcaataattgctttaaggaaagatggattaaatgctccaatcaaaagacatagaatggctgaatgggtaaaacacaagaatcatacacacwctgcctccaagagattcacttgagacctaaagatacacagagactggaagtgaaggtctggaaaaggtattctatgaaacagcaaaagaaaagttggggt

SEQ ID NO: 35275 - DNA, 201 bp, Bos taurus
ttaaggaaaggtgatattttaggtaaaacaaactatacaacagcaatatggaaataaaaagttgcgaagtatttggggagaatgacaggctgactcaattygagtgaattcacaagtgaatcaagaaatggatggaggagttggtcagaagaaaatgagtatagtttttgttggattttatgtgaaaatataatgataagt

SEQ ID NO: 35276 - DNA, 201 bp, Bos taurus
gaccagtggaagacagagtggacctggccagtccattggacctgggagatagctggacctgggagagaactcctttcctctttttctcacatatggactayttggaaaccctgaagatatcctatgaaaccaatcaattagatgtgcgtgttagaccctgagactagctaagtaaccatttttctctctttttaatatgtg

SEQ ID NO: 35277 - DNA, 201 bp, Bos taurus
acatccactggagaggtgacacacccctgtcctcacaggaacccaggacctactaaagctttctgaggcaggtatttccgctagccgcaaattggtgctgyctcataccattacaccaaacgcctgttcccaacttactggacactccccaagccctcttcgatgaaggacctcctaattaagaacatgcccctccaaaac

SEQ ID NO: 35278 - DNA, 201 bp, Bos taurus
agcatttcagaaactcaattctcccccagagagcgcctggggccctggctagccccgcccccactccatacccagaggcacagagagcgaggctccccggmgaggcaggaggcttgtcttacgtaaaagacctggcccgaaaaagagctcggatttgggggcactgctgagagagaaagtgggcagactggtcgaggccta

SEQ ID NO: 35279 - DNA, 201 bp, Bos taurus
ccaaaactgccatcccctttgctcttcaccctgctggccctctgccgggtgtcccaggctgttcaaaactgctagaggaaacttagcccttcagactgccrtcactgacggtttatgaggccctcaaagcggtccactatgcccactgctatcttctgagcctcctcaaggcttgctagctttcacaaactgctgtaaagt

SEQ ID NO: 35280 - DNA, 201 bp, Bos taurus
tgagtaggccaagaggagacgtgtaaggaagacacggacaggtatggggtaagcagggcttggaaagaggtgagatgcacagagaaagtgtaaggaagggyggggccaagtgaggaagttgagaagaggagagctggacacacggttttcagccccgggtggggactaggtagaaggtctgaccactggggagaagggggc

SEQ ID NO: 35281 - DNA, 201 bp, Bos taurus
aagccaagaagcctatgtagacaaaatttattatttatttactaatcttccacccaaacccaaactttgcttaaattcctaactaattaagcacccaaacytaagtttcttcttcctgccaattcctctcaaaattattgtttcttttctaaaaagtataaaagctgtcttctttggctacttcttaggtcccatttcaat

SEQ ID NO: 35282 - DNA, 201 bp, Bos taurus
gctctgggccggtcgcacccgtgtacctccgcagggcctggaccttggggaccgggagagccaggatcctcaccaatatcgtcatcccgtgcctcaagttytggaggccacgtcccaggtgacgtggaagcccgtgttgctgccgggagcattgaagctggctcctggtgtgagcatgtggaacccaagtacgcaggtgct

SEQ ID NO: 35283 - DNA, 201 bp, Bos taurus
gaccactcacacctccttcatccctgcttcttttacctgaagtctgggcaacctgcagcatcattttatatcagacttcctagaacacagtctatctcttyaggaagagtcatttcagctcgatcaggtcttgtcactcgcctgctctgtgctgggtactgtgtaagcatactacacaaagtagcctgctgctgcctcata

SEQ ID NO: 35284 - DNA, 201 bp, Bos taurus
tcggggaaatataatgattccgttcaccagggatgtaggatgtaaaggaaagagggtccaaagtgaagagggcctatgtgtcttgtaaaaggtcctggccyttattctgagggtaatgagttctcctgagaagtctgatgcgggcacatatcatgatcagaaataagctagaagagactgaatgactgggagcaagagatg

SEQ ID NO: 35285 - DNA, 201 bp, Bos taurus
tgatgtaacctgctttcttcttgactcctacacagagataagacaggcaaactctttaattatggcaaaggaactctatgtactttaacatatcatggaaraagcagtcaaagaaaaagcaataatatacataagcatctcaataaacctcaaactcattaaaaaaatatcacatctacaatacccaagaacaagggcttt

SEQ ID NO: 35286 - DNA, 201 bp, Bos taurus
gtagccctccactgcatgtggcctgaatatttaatgaacagacaaggaggaatccagactacacccaggcaaagtaacttagaaccataaaggggtgagasagaacagttgggcagagaaggccattgtggtagaacccacagagttggtagctaaactctaacagtgttccatgtctagaaggaacccacagagattatg

SEQ ID NO: 35287 - DNA, 201 bp, Bos taurus
atttttgagatttcatgataatgctgtttggccctctctctgagcagtgaggtcacattagaagtggagaagcttctgaacattacatcattacctcataygcataaacaaaccactcccaaagagtgtaagtcctagacatttgtttctaagcagctttagtcatgctgctggtgtcgcctttgcctgactgtaggagtc

SEQ ID NO: 35288 - DNA, 201 bp, Bos taurus
cgggaccatccacatactcatcgttgaggccgcatctccggctggtggggttcccgtacttccggagggtgtcggtgagctcctggtagagggtgtctccraggctgcgggggatgccctcccaggccaggatgaggatgacgatcacggcattctggcagtggtggcccgcccggtgccgcaccaggcagagcagcttct

SEQ ID NO: 35289 - DNA, 201 bp, Bos taurus
gacgcctggttcctgcacacactcctgccctggcccacacacacgtgcacacactcaggggttcgccacgttcagaggtgaggaaactgtggccctcggarctgaactgacctgctctagggcacacatctacccaggggcaacgctggctacagcgcagccacggggtcagagagctgcggcctgagagcccacgcagcc

SEQ ID NO: 35290 - DNA, 201 bp, Bos taurus
agaaagctgaagagaagccatcgctaggcaggagggggtgctttccggagtaaacaaacctgccagcagtccctcttctcagcagaaagggaagctctggyggacaaggccaaagacacagagaagggagggagctgccggctccgtgggcccatctgtcctcatccccttgtcctgctttccctacagtggggggcagag

SEQ ID NO: 35291 - DNA, 201 bp, Bos taurus
gttaaaacatttttatagagtctactctcttgctttatttgccaatttctgcaccagtatctcagcattttaaatataactccaggttttaatatctcctkaattaaatatttctttgttattttctttcaaacctttcttggttattatttatcatttattctccagaaaacctttaaaatcattttttgacattctctc

SEQ ID NO: 35292 - DNA, 201 bp, Bos taurus
gtgttcagatgagcagagtgtccacaaagaacaatgccagctaaggtagggctgagacaaggtgaaggagtgccttgaatactgagttgggggttacacgrtagttggcgataaacatgaccatacaaagtttctgacgaggggggcttcctggtggctcaatggtaaagaatctgcctgccaatgtagaagtagtgggtt

SEQ ID NO: 35293 - DNA, 201 bp, Bos taurus
catctccgtgactgtgctttgttagatggaagatcttagaaataagggaggggcaattctatcaagagacaggagccatctggtcattttacattctttaygtcactgaaatagtgacataagcaggcaatagggagtcataatgttgactaaactatgactaaccttaactatcaaggagaaataaggttaccttagaaa

SEQ ID NO: 35294 - DNA, 201 bp, Bos taurus
agtggctcatatttccctgagaaagatacccagaaaccaagcaaatgaggcgagcagagactcacagacaacttgagagaactcccaggagggaaagctgwctttctctgtgtatgtcctcagtgaatgaaattcccacaacaagattaatacaactgaaaaagatgctgcaaacatttctctctgactttattattaaga

SEQ ID NO: 35295 - DNA, 201 bp, Bos taurus
ccaaggctgaggctggcaggaagcaggcttggagcgggcagcttgtcgtatcaccaggaggatttggggggcagttgcagagactagttagcaagggtctractaaactctggcctcaaatactgacctgctcactttctgttgaacttaagcaagttagagcaatcaaccaacatgaaaagcaaatgtattaagtctaga

SEQ ID NO: 35296 - DNA, 201 bp, Bos taurus
gtttgagcatttgtcaggaggggaagctccgcctgtggcccgtgtttggtttttacttgccccaaatggtagggaggactgaccagccacaaggcaagatrggctacagctacaggccactggagtctcccctggggggggtccctcacctcctccccctctcttctcccacgtcccttccccctccccagttgtcaccct

SEQ ID NO: 35297 - DNA, 201 bp, Bos taurus
cttgctcatttgctggtggtagcatcaaggacagtcttgatactcctgaaggatgtatgttaagaatctgcagcttcagaacactgctaaatgttgatgcrgggtagtttcctgggctcatgcatgggctaaatgactagccttcacacttatgttaataccgactcatgtccatctggttggtgatgccatccaaccatc

SEQ ID NO: 35298 - DNA, 201 bp, Bos taurus
tctgatgggttctactttgcactgcaagcaacagcatacgcctcaggagaaggactccgctcttgtattattgatagggaagctgagagagggggaggaaygtctagtcaatatgttggatccttgttggtcagagaaatgatttggttaggggaattctcttatcaatgccacttatattggctaaagagacctcgtctt

SEQ ID NO: 35299 - DNA, 201 bp, Bos taurus
aatatattgagtgagattcccaaacatagaggtttaatttctgatctcatggatgcaaagcaaataaacagaatggccaataaatttgaaccaatacataragacatgtgatggttttgaagggaaaagaaagtggatattgtactattgaattaggatgaataggtttcattagaaacagcatcttgatgaagaatcagt

SEQ ID NO: 35300 - DNA, 201 bp, Bos taurus
gtttactgtccttaagcagcacattgcctggacagggatcataggatttaattattaaatctgtgactggctaattgcatagatgctagggttgggtggcytagataggccaactgactccctaaaatgtgagtttttttttttcatttcactgtctggaacagaagaaaatggctgtggttttatgtgagttgcatcctg

SEQ ID NO: 35301 - DNA, 201 bp, Bos taurus
taagtaattcagagtgtggaagagagggtcaagtaatgtggagatgcctccagaaggattagagaacaggccagtgtcccaaggccactggcaaacatagscaccaatagactcactgtctgattagattgtatattgttgtagaatctttagtgaaaggcttttcaggacaaattagcctgtcttgcattctctaggcct

SEQ ID NO: 35302 - DNA, 201 bp, Bos taurus
tctcatgcacataccaggacatggagttgcctgggatgggaggaggttgaatcccagattcttgtgcatgcggcctggccctggggtcctggggcgcatgyccttccagctcctagcgactcccctggttgcaaccgcccagtgggcggtgccagggcaggtttcaggctataaagggctcttggctcccagggcctgagg

SEQ ID NO: 35303 - DNA, 201 bp, Bos taurus
gcagccaagcgtcatcccaccaggccctgcagcagggttctcagcggtgtttctctggaaacacctacatgctcttttcctctacctttgagatcaaacaygcagttttgaagtggccagtggccaagattaggctcagtgaagctgaaggagttgggattaggtaagtctgaggacagatttagcggtgagtcttggcca

SEQ ID NO: 35304 - DNA, 201 bp, Bos taurus
catagatgtatccatgtgttcacttttagcaaatactggcaaacatctactgctaaggaccactgccaaaaataattcttacaaattcacactaccccagyagtgtctgagagttctagttgctctgtatctttgcaaaattttttatttttagcctgttgggtgtgtttttcatttgcattttccttatgactaatgata

SEQ ID NO: 35305 - DNA, 201 bp, Bos taurus
tgtgctttcttctgcctggaatctcacagttcgtgtccttctttcgagttttcctctacaagctcatctcaaacccagccttaccccagggaggatggcaygtttgaggcccctccccataccatgtgagtttcccagaccctcaacaggcagcctgagttcccaaggaaatggaaggtggtggggaagggctccaagggg

SEQ ID NO: 35306 - DNA, 201 bp, Bos taurus
aaatgcacccacatcccacattaaatagaatgattttgctataaaatacttggaaagaatttttataattttgcttttgaaattatttggctgaagtttaytcatttagtttacgatctgctctgacttcccagccctcctcacgcatactcaggaatctgtaaggcgagggaatcgaaggtacaaattgttttcaaatgg

SEQ ID NO: 35307 - DNA, 201 bp, Bos taurus
actgcctaatactcatccagacccatggtcagaatccaagcttacaccttgggacatagcctctcacagaccattttcagagttgctccctggtcctgccrtggttcatggttcaggcctctccctaaaggcttcccctttctgaccctaccgtttttttcacattttgaccttgtattgtctcctttcaaagccctcacc

SEQ ID NO: 35308 - DNA, 201 bp, Bos taurus
tctgggagcctggggcacctcttgtaatcccgcggcccgtgtctacatggaagagaatggggctgggactttggcacctgataggccaaggcccaggccarcccctcttccccaaggagaagctactggcacttgcagggacagacagaagtgggtgagggaatctggaagggtctgaggcctccaagtccacaaatcatc

SEQ ID NO: 35309 - DNA, 201 bp, Bos taurus
aggaactgctttactcagctgttggggcgcttctgggagggggttgagctgactctgcaggtggcagcctaggtggaagggaggggacagggcagagctayttctgtaggagtagctacagggaagaggctactgctggatccatccagcttcatgtgtgggctgaggcagagtccacacatgtccacagcttcatatgca

SEQ ID NO: 35310 - DNA, 201 bp, Bos taurus
gatatagtcctgcatggaaatcctcaccaagattcatgcaagaggggctgtaggtgaggaatacaggagaggggacactggagaaaatgattactagagaygatgattctagggtaagggctggcccaggtgctgaggagagacttccactctctagacatttgggggaagttacagtagctcagatgtacacatctagta

SEQ ID NO: 35311 - DNA, 201 bp, Bos taurus
tagctgacaacatagcagccattctgatttgtggtcccacttttgtaaccaagcattttccccatctctggaagctttggggacattttatttgtctccaytagactagaatttcacagtgatgtgacttggtgtgggaggatcaaagtcatgaacatgaaatatcaaaataagatggttagagaaacactgtgcttttgg

SEQ ID NO: 35312 - DNA, 201 bp, Bos taurus
gcgccaggagaggccaggccggatttcccttcctttgactcagaaaggggcttgaaagaaagattgagagaccgcagcgaagatatgtgtgcaaaagtgtrtgtgcgcgggggagggccctgaccccctcccctaaaacgctagaacagcagccggcttcccctttgtgcgccgcgtgcaactgtgagcaagggtgcgtcg

SEQ ID NO: 35313 - DNA, 201 bp, Bos taurus
aaagggttcatacctgtgagtagagagctgaacccaaagggaaaggggtcaaagggcctcacccatgaccagtgatggtcgctgtctatgcaaaagtgtgyttccagtcataaaataactcacacagggcatggcaggcttttctggagtgtttaactggttttcatacaaggcacctttttcatggagtgactttaatca

SEQ ID NO: 35314 - DNA, 201 bp, Bos taurus
gtcttttaattactaaagtgaagtcctgctatgtctgatgggggtggggaggggtctaggctatcactaagacatcagaaagacctggattctggagtatwtattgcctggagtttccccccagggcaaagggaataggatccattcccagcatctccttgttgctccccacacagcagttttgggaggctcctgaggtcc

SEQ ID NO: 35315 - DNA, 201 bp, Bos taurus
aacagactattcctatgctgtttaaatgtggcagagaagagtgagagaaggaaaccaagccataacaattataagacattcagacaaatctcactttgagytgatgaaaaatgctgcatgaaaactagtaaatagtatctggcataatattagaataataatacatgataaccaagtgagggttcattccttgtgttgaag

SEQ ID NO: 35316 - DNA, 201 bp, Bos taurus
caggggattgagagtggggacagaggaagaggttcaagaggtaaaggccagcacacagcctgctctttgtttacatggttggctcaggctgtgacaagtamgaaagatgacaatgtgtggtgttggcttggttggaataaaaccattcacatgttcatttgtttgctgatgcattcaaccattcatggattccacaatcac

SEQ ID NO: 35317 - DNA, 201 bp, Bos taurus
ttttatctgtagttaataattgccttggccctttgtttacttagggttttttttttttttttgtacttaattgctaactcaccccacaatttccaaaagcktctcagaatatttttctacaaggccatcaacatcagccaatctaattctttctttctttcttttccctttttttctgttgaagccatccgtcatgaagac

SEQ ID NO: 35318 - DNA, 201 bp, Bos taurus
tcctttgggcccagttttaaagaatccaggctaacccaggtttagaggctgcagagggctgaaggtcaaagagattaacacacccttgttggactgggtgmttgtgcgcttggccagtctccaccaacacacttgcaaacatcttttaattttttttatcatgtattttatcataaattgtgccacttatatattcatata

SEQ ID NO: 35319 - DNA, 201 bp, Bos taurus
ttctcagacatttgcttcgggtgggacattggagggatacatgcctcaggctggaggttgggagctctgcgtgttagacccatctggtctcagttctgccrtgtcctcaggcaagttattcatctggtttctgtttggatgttggccttgacttaggaatgacctgtgaagtttttcacatgaccactctgatggattgat

SEQ ID NO: 35320 - DNA, 201 bp, Bos taurus
cacattcagagggtcgtggtcccagggcagcaccttgagagatggttaaggacccagaggagtgagaaagagtgtccttggacataggaaggtattcaatrtgccctcaagttgccgggccagagacaaagaggttgacttcagctcagcagcgggtctttctcatggttagagccatcccctggactactgtgctcccta

SEQ ID NO: 35321 - DNA, 201 bp, Bos taurus
tattcctcactcatcttaattcctctgatttaggagcagacatttgccatgttacaaggatgtcaggatggcaaaagtctgacaatgagaagttaatttcygctgcagtagcatggactttatacataacataatcttcaagattcttttgctgttgccttcacatgtgagcaaactgggcacttccctgatgctcgagtt

SEQ ID NO: 35322 - DNA, 201 bp, Bos taurus
gtagaggatctaaatagacatttctccaaagaagacatacgtatggccaacaggtatatgaaaagatgttcaacatcactaattattagaaaaatacaaaycaagaccacaatgatatgtggcctcccacctgtcagagtagctattagtattattgaaaaaacaagaaataacaaatgttggataggatatggagacaag

SEQ ID NO: 35323 - DNA, 201 bp, Bos taurus
gccattgctctgatgacgttcggcactatgtatcccatgagcgtgtacagtgggaaagtgttactccaggtaatggtcatctttcagtatgcatgcttagrattagccatgttcttttaccagattataaaaataaacgtgttcatctgccagattatgaaatttttaggagggtcctgttggagatgaagccaaacagta

SEQ ID NO: 35324 - DNA, 201 bp, Bos taurus
aacaaaatagaaggccagtgcaagtgaaagtattaacgacccaattaattgataacatattgatgtattgccttctgtgacggttaactttatatgtaaayttgtctgggccatgtggagcccagatattagggtgtttctgtgagaatgttttttggatgagattaacatttaaatacagacttgagtaaaacagattgc

SEQ ID NO: 35325 - DNA, 201 bp, Bos taurus
ggttgccatgccctcctccaggggatcctcccaacccagggatcaagcccaggtctcccacattgcaggtggattctttaccgacttaaccatcagggaarcccaacttcattaggtatctgtttttagatgtggtgaaagggttttcagcggaaatctattcagatttgcattataaaaaaagatcgacttgcagcgtag

SEQ ID NO: 35326 - DNA, 201 bp, Bos taurus
atgagggcccaccctcatgaccttattttactttaattctttagagaccttgtccccagatacaatcacattttgaggggcttctcactgcgggtaagacktcaacataggaatttggaaggcctaccacaattcagtcataacatatagtgaggggttgatgtaaataataaacagtttacagtaggaataggaaggagt

SEQ ID NO: 35327 - DNA, 201 bp, Bos taurus
ggacatcaattgggtgtcctacaatttaattcaattctgacactacgtggagttagtacaaaccccatacatgaagagcttagtcctgtaagactgcctcmcttttctgattctgatttcaagtctgatacttctgactgaatggctataaactaggcgttttcatgacctccttctcagctcaggtttgatcatttgcta

SEQ ID NO: 35328 - DNA, 201 bp, Bos taurus
tctttttaattgatttttaagcctcagttcctttcttagttcatcaaacctgctgattctatttgcatcatcagtgtatttgttttgccgctagatggcartaatgtacctttgaaccctgtggcctctgagttctcagaatcggggatctgaaggagccttggaatttttgcttaatccccaccccccacccatttaaca

SEQ ID NO: 35329 - DNA, 201 bp, Bos taurus
ctctaataattagaggtacccatatggaacttctggaattgaacagggggttcaagtcctggtttaccgtgtggtgtcatggcctgctcattagggcatgygctgtggagccagcctgactgggacctacgttccggatccttatcttccttgttagaccttgggtagttcatgtaatcgtcatgagcctgggttttcccg

SEQ ID NO: 35330 - DNA, 201 bp, Bos taurus
ttttgcatttttttcccctctgcctaaattgaacccaccagattggttgttccaatctttttgtccccctctcagtgtaagtgcaggccagagagaaacaytgccagtgggctcagctttaaagaggagaccggacttgggaacagacaacacaaaagaagaaaggcgagatgagactgaggccgggttggcagagtgagg

SEQ ID NO: 35331 - DNA, 201 bp, Bos taurus
cagcgtgagtgcctgcaggtcagatgggcaccgggtcctggaagtgggggactgagtctcttctccagtgctcttggaggtggatattctgccaactggaygaagtacaaataatcaaaatcataaaatgaggttctgccatgacattaaaaaaaaccattcccagcactgtcccactctgccccacccaacgccagctgg

SEQ ID NO: 35332 - DNA, 201 bp, Bos taurus
tgcaggaggtggtgattttaggtgcatgtgggagatagaaaggaaaatggagcaacacctctgatggaacccaagactctgttgattctgattatgtttcrtatagatcatctgtatcattctgtatataagcatgccttgcttgatttttctctgtaccattgtcagcagaaattttccagagttattcctttaagatcc

SEQ ID NO: 35333 - DNA, 201 bp, Bos taurus
gtttaaaggcttttccaagaactatgtttccaaagagcgttaataataactttggaacatcctacgagtgaggcacagtgcgtagtcaccgcctttggttkgggcgggccagggatctcctcctgcttttggcactgcttctgtcaatcgcactggacgagttactgcagtttcctttgtcccaagttgagaactcttttg

SEQ ID NO: 35334 - DNA, 201 bp, Bos taurus
tggggtgccattgccttctccgagttctggccctagggagatttttttttcttccccctgaaagctaatccatggtagtagcttcagaagcaggggagagratgaaaggccacatgttttggggtcatcataaatttatatttacaacttccctttctataaagagaactaaaatattcttaacacctggttacattgctt

SEQ ID NO: 35335 - DNA, 201 bp, Bos taurus
aaaccacctttcctacccctggtctgtggaaacactgtcttccatgaagaaattggtccctggtgccgaaaagttttgggaccactgatttagagggaaayggttttgaaaataatgagaaagctcctttttggtggtgagagagaaatataccctttaaaatgatcgtctgtcctgtgattctaagaggaatgtagaact

SEQ ID NO: 35336 - DNA, 201 bp, Bos taurus
tacatcagatcgaatttattgtcttttaatactgttctggaaaggtaaggtttttggtagtattggtttttataaaatgctgattggagaggtttactatyctaacccttttaaattccattattgtacaattcaacatgctggggggtcagatcaaaatgtgtttttaagaaattgcagaaaggttttaatatgtctagg

SEQ ID NO: 35337 - DNA, 201 bp, Bos taurus
aggattcagcagatatcctagggagttctggacctggagttatcctttggagatgtcctgaatcaagataagaggactaggcctttatcctctctaagtcycagctgcccaggaaggggacaatgcctttgatgaggcaactctctttagctgagacaatctgtgtgtctctgtggggcctgaaggctgggggctgtctca

SEQ ID NO: 35338 - DNA, 201 bp, Bos taurus
gtatcctgaatagattgaaaaatgttaaatcaagtgaatttatgttaaagaaataagtgagttcacataatttaaaaattcctcaaccattaaaatgttckctggactttactatttagagttagatttagttcattgctagttgagttctttaaacccctcattcatttagttccataatatcagtatgaaaagtgcatc

SEQ ID NO: 35339 - DNA, 201 bp, Bos taurus
ctgttagaaaaaaaaatttagctccccaaaaatgtgttgtgaatcatgtaccatattctcaatgtttccatcaatttaaaatgtgttgctagtaatgcacrtaaatggcttaaacatgaaaaccaaatgacatgatgatatacagctgtgcctacattgtatatatcttttatgacatgtttcacttgctttactctatgg

SEQ ID NO: 35340 - DNA, 201 bp, Bos taurus
ttctgagtagtaaagaggttgtttatgcgaactcaaccaagccagtgtaaagtcccatctgattctgaaggccattgcctctcaccatctcattatgaccraatggctgggctctctggttcagatagcattgccttctgcatgtggtggggctttactagcctatcttttatggctagatattgggaaacagaatcttca

SEQ ID NO: 35341 - DNA, 201 bp, Bos taurus
atagatgtggaagattggaaaaccgttccaaaagatgtcaatatcttaatccccagaatctgtcagtatgttaccttaactggcaaaaggctcattaaagrtgagactaaattaaggattttgagatgtggagattatctcagattatcttgacctagtgtaatcataaagttcttataacaaggaatcagaaaagtcaga

SEQ ID NO: 35342 - DNA, 201 bp, Bos taurus
agaaattctaggttgctgcaaggtataaaataaaaatatctgacttagattggtcaagaaattttctctgaggaggtgacatttatattttatttactctktgattgctattattgatgaaagttagatctagttatttgactgccacagttgttgatcttaaacaaatagactgccaattatttctccagcaaaagtggt

SEQ ID NO: 35343 - DNA, 201 bp, Bos taurus
gttacaattataaacattaacagagtctaagaaaagtatttttacaagatattgtgctgtgtagtcattagttctggacctgaagaaaggccaattctccrgtaagatacattgttgcacaagacttaaggaaagcaggagggagaatgttcacctccttcttaaagggccctaagctttaactttcccacaatcagttat

SEQ ID NO: 35344 - DNA, 201 bp, Bos taurus
ataattctgaaaaaagcactaacaaccttgaaatcgttactcttaatatagaacagggtaaggagtatgcctgaatggtggatctgttcaggcagaaagaractgggccattctcaaagtattcctttctgatccagtaatgtgcaatggatatatgacatggattccaatagaaatgaatcacaattgtgaagatggctt

SEQ ID NO: 35345 - DNA, 201 bp, Bos taurus
gggaaaagattttatagacaaaagtcaatgaataatagtttgtaaaaatatgaggttataataaagtacatcatgcaaacaaaaaataaaagtgataacakaataagaaagactgcaggtaaagaaaaaatttcaggtgttgggcaagaaaatcatggtatagaacaaatgggccaaattggaaaagggacctttaaaaag

SEQ ID NO: 35346 - DNA, 201 bp, Bos taurus
aacttggttgtggcccatgacctaagtaacattttaacatgtttaggtacattttcaaatattcctggacaggctagatgaatattttttacatatactcygttcttccaaatctccaaaccaatatataaagtatattgaaatacaaacttaacaactctcagttcagagtatgactctgaatcatagtgcatttctttg

SEQ ID NO: 35347 - DNA, 201 bp, Bos taurus
tagagcaaacaactgaacaaattttggggatcagtaatccaaaataaaagattagtatatattacccaagtcacaaattctttatagatttcctatcctgraaaggaactgatctcaaaatatagaaaattcagaccagagtggggaaggaagaggaaacatctgaataaaatgaggagatgtgacatattctaaggattt

SEQ ID NO: 35348 - DNA, 201 bp, Bos taurus
ttcaacatcatggtccatttaacttttggaatcatgtgctaccaaaaagcttgactaaaataatgttttgtaaacgagactctactttgaatgtagctaartccattataagtggatttacttaaagctggtaaaaagaatctatacttgctaatgcaaagttgtcaacatagagcatatgcccaatcacaattcttgtga

SEQ ID NO: 35349 - DNA, 201 bp, Bos taurus
tgcccaaaatctaaaggcaaagactaaagaaatttcactttggagaagagaagtaaaaaagttcacatgtctggaagagaagtctcacagtgttgagtagyaggcatgatagactatcaacaataaagttgaaatgagagtttttattccttatactctttttaattagataaaatttatccatttgtgactgtttttcca

SEQ ID NO: 35350 - DNA, 201 bp, Bos taurus
taaacaaagaccctgaagaattgtcctgtatcagtgatttaaggcacctctttaccgtgcttctcttcattagagaggatgctcataccctttttctctgrgtgtgtatttctgcctagcttctatcctaaataaactatttctctgtgtgctctcctattcactgtactgggtctaataataaatgctgaacctgttttt

SEQ ID NO: 35351 - DNA, 201 bp, Bos taurus
accctagaatagctcaagccatgtagatagtgaaggaaaattcatttaaaggcaattatgtttcctctcattttgttttactttttcatgctgtcagcccyggaagtgtaaagagcttctaaatggctggtgctggtaagtagtcaaatatttagaagccaagggtctttaatcacctaagtgctttacaatgaatactga

SEQ ID NO: 35352 - DNA, 201 bp, Bos taurus
atcaattcaaggccaatcctgttttaatctgttgagaccttagccagtaaatcctctaggactagatgtgctggaaaggtcctgcaaagtgatatttgttrtattaaaagcacccttggcctgccttacgatgcatagtgattggtttccaaaccttaaactggtctcattaaatgggaaatttttttaaatttaaattat

SEQ ID NO: 35353 - DNA, 201 bp, Bos taurus
ccagttttttcacggtgcagtcaacacaggcttctcacacaagcgggaaaggacagtggcgaggccaggagcgatgtgtttctgctcggcgctccacggcrgggcctcgctgaatggcttgttgtttcagagggagcctagaaccagaaagcagacaaacagaagcccacacaaatgtaaatgttgtataaaatcagatac

SEQ ID NO: 35354 - DNA, 201 bp, Bos taurus
ttaagtttaacagggttcttctttttccgttttctttttaaagagtagtcagaatgtcttgacgtctaaggagcttcacaaatgctggggcatcaaaatgktttcatcaaaatgttatgggtctaaatattaataaataaaccacctaagtcaaatgaagtggctcaaatagtaaagtgtttgcctgcaatgagggaaacc

SEQ ID NO: 35355 - DNA, 201 bp, Bos taurus
gaatgcaaagttattcccactccaacatgaaagttctctgggcttttcgatcttgtcacatttgaaagccatgtgctccagtagaatggcccctggactgycctcagggtacccgtgttccggtccagctctgcccagaagatgtgtaacattaggcaaagtgcttaacctcttcgaatcctagtctctctgcctgtaata

SEQ ID NO: 35356 - DNA, 201 bp, Bos taurus
ttctacagacatgaaagctccctgtgcaggtggcttctgctcaggcagagaatggggcaagaaatgaacgagagaccagggccagtcgtgtctccccatcrgaaatggctttctgatagtgccagctcttaaagtttcattaaggcacaggactgcacacagacagccagggcctgattcctacattggcctggactgcgg

SEQ ID NO: 35357 - DNA, 201 bp, Bos taurus
ggaggggagagaaaccaatcacaaccactggtgacttagatggccagatcagctggtttctaagtcctgcgtagcagagactatttccaaaacttctctayctgcccctgcactgtggccagcttagcaccgcccacccagcagacctgactcactgactaccaggaggaatgtggaggagctggcgccttctcacactgt

SEQ ID NO: 35358 - DNA, 201 bp, Bos taurus
tcaccatactaaaaagctatgtaccatatgcctgaaacaatgatcacaatcttcaggctcaggaaatccactagcttctgttagcaggaatactatttcgrtcaaatagtgcagcttgagaccttaaatgctaaactccaactacagcgaagccttgatatttgataagaaccaaataataaataatagatgaattctaca

SEQ ID NO: 35359 - DNA, 201 bp, Bos taurus
aaaaaaaggaaagaaaacctacaacaattccctgatgtgtacagctggttcttctgcactcagcataacctgggctgtggaaagaagcatttacttacttyggtataaaaatcagattatcttgtttcttaaatttctcctttaacaagaggcagtgctttttaaaaaatctagaatatcttctttacacaacaatgttat

SEQ ID NO: 35360 - DNA, 201 bp, Bos taurus
tccttgagcagctgagcaacaggaatggcctgtgcaggagccatgctctgccagcaggtgtcatctttgcctcatggtttctgctctcatctattttcctyaggattgtttttgaaggccaggaatagaataaatttgcaagtcaatggagttcaactccaaattttaaagtctcctacaagagacacaaatcaacagtgc

SEQ ID NO: 35361 - DNA, 201 bp, Bos taurus
cgctgacggtcccaaatggccaaacaactcattttcccgagcaaactccagggctgtaaagagcattatgataaaatggcttttcatgtaactgtgcttckagtagagaaatatgcacctcaggccaaaatgaggattaaggcttgtctagaagttacattttaatggaaattaatatgctgacaattttagttcttacat

SEQ ID NO: 35362 - DNA, 201 bp, Bos taurus
cattacagtaaagcctgcttgaattgatgctttttagtactttctttttttctttttaaatgtagttgaacacacaaagtcatagctgaaggaactgataytttcaatgcctagtattgaggcattatgtaataggagaagtatgtgtctgctgtgtagctgatatgcctcataatggggagaggggctccgagagtgcag

SEQ ID NO: 35363 - DNA, 201 bp, Bos taurus
attgcccccacaatcagtattatataataaaaaggcaaaaccattagagagcctaaattaatctttcatcagttacacatttcaccaagttattagtcacyatttattttgatgccaatcatagaaatacaagttgtacaaataactttactaaactggtaaagggaatcccctagattctacttatactggccagaagac

SEQ ID NO: 35364 - DNA, 201 bp, Bos taurus
caaggccaagcagagaggagctctgcaaacagagtgatgagtgagaggaaatacccacatgcccccaccctatcctcatcccctaggagctgagagagacrtgaaagaaatggcctcacagcatgaaaactagaaaaggctagaagacaatgaagaaatagcatgccaccagtcatttctactcatgcaagatgagtaggc

SEQ ID NO: 35365 - DNA, 201 bp, Bos taurus
gttgggaactgcactttgagaactgcttctagggccttctctcagaggagcctttagccatgcacagaatagaaggtagagacaaaactgccttgcccagragaaacaaggcctatcctggtcatctggccattctcctggcctcctcaggccattcacatcttccagaagcacctcttcctccaggaatcttggacctcg

SEQ ID NO: 35366 - DNA, 201 bp, Bos taurus
ctgcattggaaggcagattcttaactactggaccactaggcaagtcccacacacatattcaatctttcaacacacatatatacaagcccttgctacatgcygggcactgcaccaggcactagagatgcagcaggaaacaacacagaaaaatttctgctcttacagagtttactttccagtgattacaaatgaacagacagt

SEQ ID NO: 35367 - DNA, 201 bp, Bos taurus
aagttttaggaacattgtgtgtgtgtgtgtgtgtgtgtgtgtgtgtgtgtgcattttcttgcagagagagcccataacttttagaatattctcaaaggagyccatgattcagagacacttaaaaaaccattgtttcagactaaaaaatcactaagagagaaagtttcaaaaaagagaaatcttttttaatgaaaatgtcag

SEQ ID NO: 35368 - DNA, 201 bp, Bos taurus
tgaaactgcatagcaattgtttatgaaattaacgtgcattgtgtcctgcctgtggcagctcttgaaaagctgtttttaaattatgaatttaggtaattttygaaagagaaaaatttaatatgtaaaaagcttattttacttacaattcctttacatttatactaatgtaatagaaggacctcaaaatataccaattggata

SEQ ID NO: 35369 - DNA, 201 bp, Bos taurus
aagagctcttagacagcatctaatccaatccccaaactgatttaagtaactcgtctttatcctacatccaactctaccctaacagttcacttaatgaattmttttaaaataatcttcatgtgaatgaggtaaaactattgtttttttgaggtaatgaggtaaaactattgaactttggaaacagaattagcgtgaaacctt

SEQ ID NO: 35370 - DNA, 201 bp, Bos taurus
tgagagggccaagctgggggcgtgcatgacggtgggctgagtgaaccccacccactcttatcccagaaatggctactgcgtgctgtggatgccccaggagraaacagctcaggccctcgtcttcagaactttagctttccaggttattctccctccaaacaagcaaataggttaaaaacgatcttgctcttcttctacaac

SEQ ID NO: 35371 - DNA, 201 bp, Bos taurus
aaggaaatgctcagtagataacaattctctttcccatttctttactagtctcctgaaataatattttctgatggcatacatctttaaagaagtcctcagtrtgaccaagtaccaattggggagttaagaataagtctacaggagaaagataaacccactgtttattgcttattaaatgcaaaacattcccaattattatgg

SEQ ID NO: 35372 - DNA, 201 bp, Bos taurus
ctagggatgtgtcatggcctgggatctggacaggggaaaaagatatcttctcttggaattcataaggttgcttcttcactgaggtttagagttcaaatatrtatcgaaaacaatgaggccattggagccctggggaaaataatccaatattgttgaaaggacactctttaaagtcatatggaactcccactgaagatgatc

SEQ ID NO: 35373 - DNA, 201 bp, Bos taurus
ttgcctttcctcacgttgtgatacctcttctctgttagacttcttgacactctgtcctctaatccgtatcttttttaagcacttctccaataaaataagayacccctctctaattctcaattctccatttaaaaatcttgaaatagttttattttctgattattgaaaaataaattcagagtctgggtaattccaaacgaa

SEQ ID NO: 35374 - DNA, 201 bp, Bos taurus
tgatgagaaatctaaactttgcccacatgaccaaaattgatatcccagactcacaggctcaagaccagggcacaacaattgagtcaaatgtccctgaacayggtgaattctacagagaggcatttgccctccttccctcagagagcaatgttaccaccctggatactctgtttttttccttcaatccttgacttggataag

SEQ ID NO: 35375 - DNA, 201 bp, Bos taurus
tcgtgcacaggcgagagaagaagatgcattttatttctgtatcatttccgacatgaaacagtattacctgcgactttatgattaaacaagtgctagctcayattacacagctcttaatgactagatttgtagatttgtgctgcagtgtcttggggctgaacatacctgagtgtgatatcctatgcttcaacacatcctatt

SEQ ID NO: 35376 - DNA, 201 bp, Bos taurus
atcacccttccacaaggctccccggaatgggttgattctccccaaggaaagatggaacgctgaccagaagggatagaaataggatgctaggcagccacaaktaagtacacaagtatctttaaatgactgctgaatcagctaagaataatgacagaattatcttcaggagcaaaagtctagcaaatagtacttgaagggaaa

SEQ ID NO: 35377 - DNA, 201 bp, Bos taurus
agcgtgccaaaagcatactttttgggggggttgccaaagccaaaagttatgcattctcagcttcgattttcatataaaaactgagagtgtgttaattgtaytattgtttctgaaaactgggagttgatcttccacaaggatagtagtagtagcagaaaacatgcatgacactaagtcaactccgtcacatccgaccctttg

SEQ ID NO: 35378 - DNA, 201 bp, Bos taurus
ttcacccactgtaaaagtcttcccagggccagctctgaagagatatgtctgtattggtttccttccaatccctcctgtcaagcaatgaaggatggtagagmaaggccaaaatcctcttttaattttgtatcttctgtcacagcaacatattttatttactaacagttgattttattgacttcaacccacagaattgctttg

SEQ ID NO: 35379 - DNA, 201 bp, Bos taurus
cccattcccttaaagaaagcaaaaaaaaaatcataaataatatacttctccttcaagattaccctgacatgtaagataaatgctgatactgtttctcatgrgtctgactttcagtttcttgtgactcagtcaaggtctggcaactatttcctcctcattcaatgctctttggctctataaccaaaacaaaactggatttac

SEQ ID NO: 35380 - DNA, 201 bp, Bos taurus
tgggggcactgtactacaggctggaggggtggacaacaggaggaagataaacattcctgaaatgaaaagcttaccatagaatatggctgtgtcctaagacrcagcaggccaggatggttgttagcaagcaatgagtccagttcaaagagtaaaagcaacatttaacagaggtggtagatcattaaaggtctaggtagaccc

SEQ ID NO: 35381 - DNA, 201 bp, Bos taurus
tatcacactaactggaaggccagtctggggtgtgctcactggatgcgtcaagatcaattacccctgcggagtttctcttctgcaggaaacaggggaacgcmaggccatcagtattctgtacacacactaacagcttgtgcttgcagagacaataatttttcagctcctttcagattctatttattggttattttccccttt

SEQ ID NO: 35382 - DNA, 201 bp, Bos taurus
gtttaccaggaccaaatagagttgaactaacccaaaggggcagagcagatttcatagaacataagcaagagataggacataactagagaaagaggaaagayagtacaatataaaggaggccaaggagtgcagttaagatctgaatacatggtgggaggccaaataagagagaaggagccatgggtgagatgaggccagtgg

SEQ ID NO: 35383 - DNA, 201 bp, Bos taurus
cacacagtgcagctgctacagctagcagcctcgctgagagctgagcatcactccccctcagcctcacaccagtgccaaaatccccatcgggaggcactgayggaacagcaactaggaaggcacacagaagctgtatggtgccccagccacatcagtgcaggactgcatatgtgcacagctacctcctcaaggccagcaaga

SEQ ID NO: 35384 - DNA, 201 bp, Bos taurus
cagtgataagagtgccctttggaaggaagaggggtgatgccagcttggcacccaggaagattgtgatgaactggcatgagttgagtctggctatccactcktcccttgttcctacccatgcttccaaacctccttttccagggatgctatgagcttcccaggattcttacaataaattatctttgcatagccatatcatag

SEQ ID NO: 35385 - DNA, 201 bp, Bos taurus
tatatctgattcacactcagatagatgtagaaacatggctcatttaaaatagcataattatatgttacaaaaatagcattcatttattctttgttttccayggttaagatactgttagagtcacaggattatgtgaggctctatgggaaacattttatagggatgcatgctgacattctggtttatccccagtatgtcctg

SEQ ID NO: 35386 - DNA, 201 bp, Bos taurus
attcattaatacccacatgaacatttactgaatactatttaggatggtttaatcttacttcttacagcaattcttttgtagtgtcaactttatttgtgatrttgagggaaaggtataatataaaataaagtggtactatatagcaactaatccttgacagttgaatacgcatgccctctttctgacttccccatttaagac

SEQ ID NO: 35387 - DNA, 201 bp, Bos taurus
tgaaataagataagactgttgaaagataaataattttcttggaatagcagaggcatgcatgaaactaacaacacagattataaattttttgaggcattaaratatatttaatagatagcaagggtttccctagtggctcaaatggtaaagaatctgcctgcaatgcaggagaccttggtttgatccctgggtcaggaagat

SEQ ID NO: 35388 - DNA, 201 bp, Bos taurus
gcttaagtcagagagagagagattaatttgaactccacaaatggcaaatcttgaagactgcagagaaaattatctgctggtataaatcttattaagtctakctgtttatgatgttttactttctaattattcactttaatgctttatctcctatgatttttttcaacatttgttcagtaaagcttgtagactcagactttg

SEQ ID NO: 35389 - DNA, 201 bp, Bos taurus
agtgggatttgagttgtactctgaagttcaaattacctgcttctctggcctacaacactctaaccctactgtggtgataaaaattcctcctatagtaattyctgagtgttggtctctgcttttaatgcttttgcatatcgctgcaggagagcctacattttaagaccttacaacctctttctaagtgagtttttcaaatat

SEQ ID NO: 35390 - DNA, 201 bp, Bos taurus
ttagataacagtagattagcaaaataaagaatgaagtcagtaatataaaagatccctaaatcaaatgcatcattctgattctgttaaggctgagaagacakcattaaaccttcacggaaaacatagcatttaattgaggctcagaaagaaggttaagtttgtctgatgcactgaacaaatgttttgaggaggtataacttc

SEQ ID NO: 35391 - DNA, 201 bp, Bos taurus
tctaggtgttagaatcttaatttcatttctcctcttctaagtttttggcctttgcagattcttagagagttgcctccatctgttaatatattttttgtagrtatggggcataatatagttgggctagatgctcttgcaagtatcaaaaacaaataccaaacttttaaacagcacctttaagttcttgttttgatgtctcat

SEQ ID NO: 35392 - DNA, 201 bp, Bos taurus
agtggtatccccagaaaactgaaagttcaactgaaaagtgtcaaaacatgtaattaagtagaatatttacaacttagtttcttcccaataatttgtaaatrctccacttacttggaataggttttaatttcctgtttaacaataactgattctaatcactttctgtttttcagttatgaaaaagagaaaagttatttgagt

SEQ ID NO: 35393 - DNA, 201 bp, Bos taurus
attgcctcacaaattgaatatacatatacaattgtatataattcacaggatggcaatacaaattgtataaatatttcacagggcaccatgtgaagtgaaakctataatttcctcctaaacacactcatattgcatgtctactgtagtgaatctctcctattcataatgaaagagaaaaaaatcacaaaggaattaatggga

SEQ ID NO: 35394 - DNA, 201 bp, Bos taurus
ctcatatcattttctcctcctcccttggctcttcatatgcagctccactccatcacttgcagagtaagataaccgtgttcacacgtctctctctcactgcrtaggcccaaagagagactttgtcttattcttctgtgaagtaaaagtcactcaatcatgtctgactatttgcaacccaatggactatatagtccatggaat

SEQ ID NO: 35395 - DNA, 201 bp, Bos taurus
agatcttgagtcccaagtcaacacctccctcctataagcccattctctttaccaacaggaaattcagtatttctaaaagtatcttccttcatcaagctcgmaattgcagctagttaagtgtttctacctctgagtccataagatttgaaccttttaatactttaatgagaaagcattaaaacacaggtcaataggaaataa

SEQ ID NO: 35396 - DNA, 201 bp, Bos taurus
cttacagtctgtggattggtagagtgctctgattcagcctgtggctcagatacagatcaattccacatgctactcattggggggccaccagctccctgagrctggctcatctcattatggatggaagaagcataagaaaaagctagtagaaatttcccatgacccttaaggccttcactcaaaactggatactgtccaatc

SEQ ID NO: 35397 - DNA, 201 bp, Bos taurus
cctacaagtggagactttgaaaaagaaactcctgtctcttcacctcttcctttaagtgccttctcagtgaaggatgctgcagtaccagatgtctgggacartacccaggccatttcatcagatttctgccattattggatgcagatgattaatagttctgcttgcctggccccgacatgtccactgttaacagaggccttc

SEQ ID NO: 35398 - DNA, 201 bp, Bos taurus
aaaacaaaactcctaaacttctttttaaagaaaaattgtaataaattaaattatagggttagtataagaaatgtaacattcttcagtgcagtaataatacrcttcagtttatcagatacatgaaaaaaacgattttttaacataatattagaacttaccatttctcatctcatatatactcttgctttcttaaaggaatag

SEQ ID NO: 35399 - DNA, 201 bp, Bos taurus
aggggacttctctgttggaaatttttttttttaagcagagatctgatttcttgttgttagtgacagtcatctagattaaaatgtatttcagggctgtccarttttttaaaatacaaaccaccccaacttctagaatatgtgtttttgacatcctctttgcttattttcagctgagaaaaaagccccgactgcccctgtttg

SEQ ID NO: 35400 - DNA, 201 bp, Bos taurus
agtgccctacccaagcacctccactccacccctgcctgcctgccacctgcctccatctccccctctccttcagagtgcaggaatgtgtgaagagccacagyatggccttcctgcctggcaaggtacccacaggaaacactcctatttctgagctgacttctttccagcactccacccagctctccttttctgagaaccccg

SEQ ID NO: 35401 - DNA, 201 bp, Bos taurus
gctcctcaaggatggggcacatcttccacatgtatgtgtagagcagagcagaaagaaatgaggcaaaaagaagaaaataaagccaagaaatgacagtaacktgttatatggacggggagtcatgtgcttatttcttctcttcctgttttccatattttctagcatgtggattatttttaaactttttttaacaaatcagtt

SEQ ID NO: 35402 - DNA, 201 bp, Bos taurus
aacccaatgtattccagagtaatgaacagacatgtaatgtgccatcatggagctatgcactaatgctaagggacccagaggaggagcaaccattagcctaygggcaagaagtacttgtaaggccagagtaggaattaccaggtggagtcaaaggggagatgatcagcatcagatactaaggtgcaagcaacataagggagt

SEQ ID NO: 35403 - DNA, 201 bp, Bos taurus
gcatttaatcatcacttgtcttcaacagttaatcaacataagcttatttcattgacaccctgctttgtccacctcagaccccaactcaaatctcagcacayactttgtttgtaaatacatcttttttaacctaatatttatttatatgaataggcttagtttgtctgatctattgattactaatgttaattatttctgtta

SEQ ID NO: 35404 - DNA, 201 bp, Bos taurus
tcgttaccagctgagccattgggggacgttcttacaggagccttggcctcagtgaaacacttgacgggcactgtcctctctcttgggacccggccatattygaacaaggctcagccacacaggtggaatcattgcagaggcaggaccagggtgggggcagccaagtgacagggtggccaccattcccacgccccagggagc

SEQ ID NO: 35405 - DNA, 201 bp, Bos taurus
cctctgaaacccactgcatactgtaaaccagaggtggcccaaagagatgcaaagtcagatgcaccggatagaaatataaacctggtgtgggtcttggaagraccctaatgtggcccactcaacagagcttccaggtaaactaaaaggatgagttacctgtccagcaatgaggatacagggaaagaagatcaggcatctgaa

SEQ ID NO: 35406 - DNA, 201 bp, Bos taurus
accagtgacttaaagtcaacaaaaattatacaccagtattgagttcctttggccaagtaaaccagtttgttgattctgagagatggatgtacagaccaggwgattgacactgctggcctgcagcagaggaggtgtccagtactgggatgatctgctccaggtcttgcaagctaatcattaaatacacagattcctttcctt

SEQ ID NO: 35407 - DNA, 201 bp, Bos taurus
cccccctcaggcctgttgtgttttgggaggaggatttctcttggagggagctgaacagaaggtgaagctttctgaggaacctttctatgtctccccacagrtggatatggcctcccaggtaccttggtttaagcagctggctcacttcaagatgccctggacatctcacaaggactcctgtgagcagggcattcagaacct

SEQ ID NO: 35408 - DNA, 201 bp, Bos taurus
agaggtctgtgggagccactgtggtagaagggaaggcttggagggagcaccctgaaccagcaagtctttcagtcttagcatctcactggaaatgacaagcratggatttgattaaacgtcagatgcctctggcgccaacattttacaaactggaaagtatgcggggtgtgtaagtaaagaatttcatagaatattaagcat

SEQ ID NO: 35409 - DNA, 201 bp, Bos taurus
agtccaatctttgctactatgaaccataaaagaggtatcatctataaacacacaacaaaatttttgtctttatgcatcaggggccttaaaaataataacayatgatccacttctgagaaatgatcctaagtaaataatctgaaaaacaaataggctaggaggtaaagatgtgaattatgatgactacttacaatagtgaaa

SEQ ID NO: 35410 - DNA, 201 bp, Bos taurus
taattcataagaaaaatgaaaacaattaagccagatgcttaataatttccagtatcccaactgaacagagatcataaaacatcactgctatcacacagcaytgatggatctacaaaataaaacttgacatgaataaatatcagagacaagggattagaggagtggggtgagaagagatctgtttaagacaaaagtttttaa

SEQ ID NO: 35411 - DNA, 201 bp, Bos taurus
aacagtttgaaaaattacttaactgttttttgtgtgtgtaaaaaaaaaaaaaaaaagtgtaaaactggtgatatctactctttcctcccaggatttttggrgaatgttagaacttgcataggaaactgtgaaaaattattgttgcttttcataatcaagtctaaacctcatgaatttgggttcttctccagtctctccttg

SEQ ID NO: 35412 - DNA, 201 bp, Bos taurus
cacgcgttctacgtaactcccaactagcacgagctctaagcagattccaccatatttattgtggtcaagaatggatttttctccttctgagatcattattrctcaaaatacaaatcttttggatctttgctagtcttcagaactcgagatgaaacaggagagaggagaacaaaaaggggcagggtcgcgctagatctgcca

SEQ ID NO: 35413 - DNA, 201 bp, Bos taurus
tatggaagtcaatttgccgagttcaaggctgtgttttttctgatctcaaatcacctagcaactttagattcaggcagaagttgaagtttattttactaaayatggaaaagcttttaaaccaacatttttgaggtaaatctgtagcaaaagtgaggccacctgctgttaaggagagtgcttacacatttgagcacatttctg

SEQ ID NO: 35414 - DNA, 201 bp, Bos taurus
tggtctcacctgaaaccatgagccctgatagcaggtttctcctgtggtaggcagaattctaaaaagccctcatgattcctggcccttggtgtacacatacrttttctcaggtattcaaacactactctagatgttgctgtggaaggattttgcactcataattaaggttccaaatcagttggccttcaggcagggaaataa

SEQ ID NO: 35415 - DNA, 201 bp, Bos taurus
cattgagggtcctctttgggaggatgaattctattaaaccttattttggcaaattgtatagaagcaacgaccacatgaacccatcactagggctccttgtrggcctggggaggggcctgtgggggggaggggggtctcaatatttaggcatcattagcttgacagtgggagaaggcaatggcaccccactccagtagttct

SEQ ID NO: 35416 - DNA, 201 bp, Bos taurus
tttttaacagaagttttaacagccagcactctgtttgccctatgctttttcctctttgcaacaacaaatccaaaatgttgacagaggctgtttcctcattyctgggccccaaactgaagccaagatatggcaaagactcagctggcagaggacatacattatgagcaagaaataaactttatcatttgacactactggaaa

SEQ ID NO: 35417 - DNA, 201 bp, Bos taurus
gaaagaagaccactgtctatgaccaggaagccctcagaagacactttctgctagcactttgatcttggacttcctacttcttgaaccataagaaataaatkcctgttgtttagaagccaccaagtctatggtattttactacttcagcccaaacacagctctacttagccttagatctcatctcattgtcacctcctcaag

SEQ ID NO: 35418 - DNA, 201 bp, Bos taurus
tggcctaacctggccagctccatgcaggtgggagacacacagctgtccccatcatatgattctagagccgtgctcagtgcacttcctggaaagggctaggyagtatatgttttaggctttgcgggccacttggaaactacttagactgctcctgcagcacccaaggacaatgggtgaatgaacaggtatgctccaggagaa

SEQ ID NO: 35419 - DNA, 201 bp, Bos taurus
tcaactcatggtacagtgtggctaccaactgaccagaacagggttcccgtcagacaactacatgctaagtcccttctaccatctagttttaactttcagtratgtctccacatgtggggaaggcagtcacccttaaacttagcttctttggatttctcctgtttgcagtgcctgcctctctgccctgaattccccctcaag

SEQ ID NO: 35420 - DNA, 201 bp, Bos taurus
tcataaaaaaaaaaaaacactatggggggatgtgggagggttaaagggtgggcagagggttagagtctttcattaaaaatgagcttacttctctgccaaayaaatatacacaaacagccaccagattttgaccatgcacttcacagacattaccacttatttgtttaaacctattaatagggctttctgttacttaaagcc

SEQ ID NO: 35421 - DNA, 201 bp, Bos taurus
caaaacacaaaaacagctcctgctgtttattttgatgaggccaagtatcttaaccccacttctatactctaagccccacttctttttataaactgaatttmaaagctattataaaggcctccccagaaattcttatttcatcttaccttgaatatattttctcataattagtcctcaatagaaatgaaaaatgacgttttt

SEQ ID NO: 35422 - DNA, 201 bp, Bos taurus
agtgttcccatgttgcctctgggtttccaaggaccgccttccagggctgccccagccagacccccttttcctgatctaggcctttccctcctaacttccayacttcagaacatactcatactgtgtccctttactcgtccaggtttttggtaggcaaacggtgaattagtctgacactgattaatgtcaccttgttgaaga

SEQ ID NO: 35423 - DNA, 201 bp, Bos taurus
ggtttaaaggtcctgctctcaccagggccaggctagaccgtgcagcgcctaacacaatggggtgggggaggcagtgaggtaacacaagcctgtgctggggktgggtgtagccaaggccaaatacttcatgtaggtgcaacctgcataactgcacacggagagcttggttctcctgcagctcatcctccacgtttgtgccaa

SEQ ID NO: 35424 - DNA, 201 bp, Bos taurus
cccccagagagttccagatgctgccaggcctcttaacaggtagacccagacctggcatagttagtatcacttctttgtatccagttgtccaaagtaagccrcaaggccagcccaggctcaaggggagggaagcagattttgtcttttgataggaggagcatgcccctcatggaaggagtaccaatggggccatctttggag

SEQ ID NO: 35425 - DNA, 201 bp, Bos taurus
ttaagtcccacaaacctgacttggagggagtagggaagagggggtgagagttgtttccagtcagaaaactgtgggaaagatgctaatgcaggacactgcaygtcatgtggtgaaagggaacttgtgcccccactgcagcaagacagacggaggcgctgccagttttccagatgttccaacagctttaccacttgccatgag

SEQ ID NO: 35426 - DNA, 201 bp, Bos taurus
tagaatttactcatcttgcataactaaactttgtagccctgaccaacatctctgcatttcctttgtcccctagcccctggtggccaccattctactctttstatgacttggacgatttagattccacatataagtgagatcatgcaatatttgtctttttgcatttggcttgtttcacttagcataatgtcctccagggcc

SEQ ID NO: 35427 - DNA, 201 bp, Bos taurus
gcggcggttcccacctcggggcaccgataagggtttgataaacaggagcaaatcgcgccctttctggcagagcgcccgggcccttcgctcccggattgccrggagtggaggggagaaggggaggggattgagcctaactccgagtttacggccgcagctgcccctcccgcgtcactgcggcacccccaggcctgagatggc

SEQ ID NO: 35428 - DNA, 201 bp, Bos taurus
tttgcagccgagcagccagcacagggcctagctcattcctggcattcagaaaattttcaatgaatgactgagtttgcaattcaaaagggcccacaaagatracatcttttaaggagtctgtccagctaacaaagacacccttttctcatagaactgaccctagacaccaactggactggagatggacatctgatctgagct

SEQ ID NO: 35429 - DNA, 201 bp, Bos taurus
gttactacctcccaccatcaggtgccactcactgccctgagcctcgcgcaggcgcagcctgtggggcggagacccaaggcctcacagccaatcgcagaagkggaggggcggaccaagaagccagccccgccttctcgctcgcgtttattcctcccgctgctttccaggtgcaggataggcggggcgaagagccgtggggcc

SEQ ID NO: 35430 - DNA, 201 bp, Bos taurus
ctagagccaggctgatggacaggagaaaggatcaggctggggaaggacccagcatgatccaggtctggatgcaaggccacacttgggggtcagggaggagrtggggttgctgggacacaggaacttgtaagagaataaacaataggacatagaattggatggatagaatagggaagaagaaaaactatttattatgtacca

SEQ ID NO: 35431 - DNA, 201 bp, Bos taurus
agtccaaggaggagcatgttgagtgttgtggggccaggttctgaaaacaagaatgttgttgtacatgaaaataattacacaaggggttaccatttttactrttatgttccaggccaagagatttgccatcgtgctttgatttaattctgttttaacggtttcgaaatgtaggtggcattcagttttatcaaagaggaagtt

SEQ ID NO: 35432 - DNA, 201 bp, Bos taurus
tacagaagcaggccacaggccagatttcctccctgggctatagcctgctgacccctgctctagatcagcactgtccagtagaaatataatttgaaccatgyatgtaatttaaaattttctagtggccacatttaaaaaataaaaagaagcagatgaaatgaattctactacaatattttaccagttatatccaaacttgtt

SEQ ID NO: 35433 - DNA, 201 bp, Bos taurus
ttagtccaataagaggtttgggactttcaaatcacaaccacagtacggctgaatggccaggcccgacagtttagtcacgctgcttttgtggccatcttccyactgagcactcgactcagttataccattaaaattagtacaattccaaagaggctttggtccctagggcccctccgttatggaaaggtgtgaacagaaaat

SEQ ID NO: 35434 - DNA, 201 bp, Bos taurus
agtccatcacatactataagggggctggcatcaatatgtgcactcactctggtccttgtgaccaagtccatcatcagccccacaaatagctgcttctcaaycatccctcagagcctagaagcaggatctgtgctatctgagcaaggaattctgtgatgctggagacctagaggagtcttgagtaggagagagtgtgggctc

SEQ ID NO: 35435 - DNA, 201 bp, Bos taurus
ggtgtggaaagcagggagggcagaacaacctctgagactctagccaactgcagtatatattaagggcagcccagatggccgctagccaacaacccgtgccrggtaatttgcaagctgcactttctccttttgaaggtctctttctccaggatacggggaggaggtctgtcccttcccacttctgcacctgccacctgagca

SEQ ID NO: 35436 - DNA, 201 bp, Bos taurus
ccatggggtggcaaaaagttggacacaactgagcaactagtgactgactgactgactcaaagaacagccttcccagaacaatgatccagccccaaatatcrgtacttctgagtgtttgatacgtgaattttaacatcttgaacatgtgcccttggacctgcctgctgcaggatgctgaaccaggaaagtataaagtcccag

SEQ ID NO: 35437 - DNA, 201 bp, Bos taurus
gctggaatgacccaggcaggagaggctgctttccagtgaagagtggggccgggtgcaggtgtgtgcagtgaagggtgggctcagcaggctggggtgctcayacctgcactttccaaaggcttggcccttgagctgctcctgggagaaaacctctgagccctgggaagatcctgctggatagcagtgtctttgttcacctgg

SEQ ID NO: 35438 - DNA, 201 bp, Bos taurus
tccattacaagaaaaagaaagttctttccgtatcaatatgaactggtttcaaggtgtttaaagtgaaaatgaaaataagataccgaacagtattttgtttyattatttgtgtaaacacaaaagcacacggacacctagaaagtggacactagtcacccccggggcagtctgcagcttagggacatgagaaggactgattct

SEQ ID NO: 35439 - DNA, 201 bp, Bos taurus
aaagaggcaaacatctagctatacaggaggcaagggagctggagtctaactgcatttcttaaagccttaaaaccagtactctgggatttagccttgtcctmcactcagccttcacaggtaccgtgctactaattcctgagttgtgggagggggaggggtgtgtgtggcgtggactggcctgatttggcttgttccttgtag

SEQ ID NO: 35440 - DNA, 201 bp, Bos taurus
ttgggcaattgtctttttgattaaaattaactgaaaggaaccaaaaggtaagctatttgttccctagctttcaaagagataaatattctattagaagagamgagtaaggcccagtagaactaagggcctcttaacccaactgaccaggagcagaataagtaaacccaacctgtgctgcaagtagggaggaggtttaattga

SEQ ID NO: 35441 - DNA, 201 bp, Bos taurus
gttaacatttaaatcagagggaaaatctgaaataattccagagaatggaagtagtttccccacagttgatatttatgctttattcaattttgaggagcagrtgcttggtgggtgttacaagggtggaaggactttggaaagtaggatatgacggagacccaaacctcacctcttaggctgtgttagatttccgtttccagc

SEQ ID NO: 35442 - DNA, 201 bp, Bos taurus
tttcttaaccttctctcctcccctgccccgcccgcagcgtcttgacgtagttgcacggacaacgtgcacccacattcaaagcccacagggggccgtcctcrgtgatgcgccgcaggtgctgcgcaggcgcaagcagcaaggtgctggagccggtgtcatggattgcgtcaactgggtggtaagtgaggatcatcagcatgg

SEQ ID NO: 35443 - DNA, 201 bp, Bos taurus
gtttgctgaattatgacaaagggagaaacatgcccttacaatgaagaggtctggcagtacctccatagccaaatggccaaggagtggcatcgcgtgacatratgcacctcctggtctgatgcagagagagacatttaacatctaatcaggacagtatagttggaggagtccagacaactggcctaagccctcaaaggaatt

SEQ ID NO: 35444 - DNA, 201 bp, Bos taurus
tcctcaccctttcatactactgtatatgctattcattaacctggaatgattttctcttccttttccatattctattaggtaaacttctggctgtccttcaraattcagcccaaagtcatttctaccataacaccttcttgaacccaacttagctgagtagttatacccatagcacttgatcttatagcccatgatataaca

SEQ ID NO: 35445 - DNA, 201 bp, Bos taurus
ttctttaccattttagccaccaaggaagccaattatcttctttattagttagttatcaattaagtacagaataaaaaaaatcatatataaatacaatgtgraacaacacacatacatgcattaacacacacagaaccatgaaggaaataaaggataaatcactctttgactccacttttccagtgctctcccaggcctttt

SEQ ID NO: 35446 - DNA, 201 bp, Bos taurus
acatacacttacatatatattattaagcttcaaacagtattaggacatggatattattgttcctgtcattgttttaggtgaggaaactgaggtttagagasgtgagagaactggttttaaacctaggtagtcttctctggcatctctgctttaatcatgcaaacatcccttctttcgtacatgttgcctctctgaaaccag

SEQ ID NO: 35447 - DNA, 201 bp, Bos taurus
ccaacgcagaggcaaaatctctcatgtgggccaaagggagtccttcatcactttggcaaattgcccgagtgctccgagatccttttcctctgtaagacgtkgctaaggccctctgtccctcagtacattttacacccgatcctttgtagttgtctgggctattgaagatcatatgaataatgtatgtcacacaggagggaa

SEQ ID NO: 35448 - DNA, 201 bp, Bos taurus
aaaaataagatttatttatttattttggcatctgtgtcagtacaggctggttcataaaagcacgtggtcgaaatggatatgctgtgactgaggaagctgartttcaaaaccagctgctctgtctctgggattattgctatgtcagctcggatcaaccttctgtcatcaaaggacgttctcatgggaggctaagcacccaat

SEQ ID NO: 35449 - DNA, 201 bp, Bos taurus
aaaggacttggaactgctccacatctcagttttctcctctgcaaaatgggcatatccccttctgctctaccttctgatcaagattttaggaaggccaaatkaaggaatatttggtaactatcaaataccacacaggtgtttttagagacaccttcctagtgtgatttcaggaatgcaagataaggctctctacctgcccac

SEQ ID NO: 35450 - DNA, 201 bp, Bos taurus
tggtagttggggtacggggccttagttacttagcagcatgtgggatcttctgactagggtttgaacctgtgtcccctgcactggcaggcagattcttaacractggcccaccaggggaaccccaaggtttattctttaaagggagcagagaatgtctgaactggagacaccagggaccacttatggatgctgggtgctgag

SEQ ID NO: 35451 - DNA, 201 bp, Bos taurus
cagtattcttgcctgggtaatcccatgaagagaggagcctggagggctggagttcatgtggttgcagagtcggacatggcctagcgactaaccaacaatgrcaatgtacatgttactttgactccctgagttatgctgtccaatacggtaagcactatcctcttggccactgggcacttgccatgtggctagtcttagttg

SEQ ID NO: 35452 - DNA, 201 bp, Bos taurus
caacataatgcagagaggtttatatgaagctgctctgtaccaacacattcctaaataacagaagaagaaaacagttctagaggatattctacagagtctakaagcatttcccctagtcacaggatgtcagtgtgataaaaggcacattaaggaggaaaggatctgcctttctcaaccctacagactgttcactgtaaaaat

SEQ ID NO: 35453 - DNA, 201 bp, Bos taurus
taattgaactgaaatcagaagacctgaattatcatcattgttcattctctgactaatcatgtcatttatattctctaggccccttcgttatttaagaaacrtatacaataaaaacgattgctttctatatcttttggagttgtttaaagattatgctgaaatgctttgaattataaaataagatataaaatatgagattca

SEQ ID NO: 35454 - DNA, 201 bp, Bos taurus
aataacactaagcaggctacgtaagttcttacagtttctgattagcaaataaaatttgcttaatttggtactactgtacattctagatttggaaaagttartaaaggccatctagtctggactcttcactttatacataaggaatcatgctaagagagagggtaaggaccttgcctaagatcacaaatgatgttgggcaat

SEQ ID NO: 35455 - DNA, 201 bp, Bos taurus
aattagaccttcttttttgacttctggggccaaattggcaccagttacacagagcaaaaagtctgcttagaatcatggatcattcagctgctgaaaaatayggggaattaatctgggtaatttaaatacagaaatagtctacactctactgtttggggcttttcttcccacttaaattttcttatatagatacaacttaaa

SEQ ID NO: 35456 - DNA, 201 bp, Bos taurus
cgtatcagctcttgtcaagctaactttgtctcgtgctcagtaaatttaccttttggttaaaaacagggttcaggtacttccactgtttttacattttcccrtccaagtgacagccagtttagaaactgtagctatcctttagcagcaaacaatcctgtcaccgctgcatgtttcgttttccactccctgggtgctgctctt

SEQ ID NO: 35457 - DNA, 201 bp, Bos taurus
gtgaaggccagggaagcctggtgtactgcagtccaaggagtctcaaagactcagatacaactgagcgactaaacaataacaatctaaatgggaacaaactrgatgtttttaaggccatccagtatgatgaagccatatcaatactgaattaatacatcaccaaagaaattatatatgcagaatatcaaactaataataatg

SEQ ID NO: 35458 - DNA, 201 bp, Bos taurus
gcagattcgcagttatatttgggtgtgggtccagggaatcccttaatctccacttccagaatacattcattttgtgtcttgaacaatccaccagacccatygcttctcaaatcaccacacttggcagtggtggggggtatgcagaggggctagagttggtaaaagacagaagaaaaatactaagtgggcagggaatgtcac

SEQ ID NO: 35459 - DNA, 201 bp, Bos taurus
tgtctacctggtctaccctgtgaaggggtagatctataattggaattctctcttaacacctttgtttttcatgctattctaaagctcctgtggatccaagyatctgctacaggaaaagaatcatgtcaaatcgttatggtactaatggtacagagaatagcatgacaaagatgtactgaggcattctcttatttgggactg

SEQ ID NO: 35460 - DNA, 201 bp, Bos taurus
aaagtgcattctcttttcactgttaattaaggcacagggccacaggcaataccatcgatcctgtctagtcataaggcatttctctgagttcttactaatayagagaactaggcttaaccaaaggaacttctgttatgcaaatccaagtcatgcccaaagtgtaatcaaatcctgatgaccaaaaatagtcttctcataaga

SEQ ID NO: 35461 - DNA, 201 bp, Bos taurus
taagagggcggagaggcccgaaacaggttttcacctggaccctacgcgacacaagctctccagagaaggaaggccgcatgcacaggccccggcctgcctcrcccttcctccccgtaccctgcccaggccaaggccccagggctccagcgtcatcgggccttaccttggctgcagtccttgccacggaagccagttcgcgag

SEQ ID NO: 35462 - DNA, 201 bp, Bos taurus
catagctaggattgcctttggcataatatagacataaaaatgatatacttttcaccttataaatagtttctatctaggtggaggagacaggctaattaacraggccagcgattcatagattaagatggaacaatatcatattggtcaaaatgtatattgtataattctgaattgagtgatctgcaaatcagaagcaaaaac

SEQ ID NO: 35463 - DNA, 201 bp, Bos taurus
gaatttcttcctgatatcctgacatgattaaaaatgcaattattctaatcaagttacaaaagtaagcatcatttgtggtgcccaccaagtcctagtaatamcttttcctctgagaacatatcctcccaacctcccactattggtacatcccagaaaaataaaaaatagcaaaactagggttgtcctacagagttctgcttc

SEQ ID NO: 35464 - DNA, 201 bp, Bos taurus
cataaatggtatgtgaaaacagttcattacctacatgaattttcgtttttccctggctatcatcatcacacttttcacaattacttaaatgttctatacartttaccatttacaaacaagcacatctttcgtattctgttatccaaattatttaactatttgtactatttacactgtggctaaaaggtgaactagattgcc

SEQ ID NO: 35465 - DNA, 201 bp, Bos taurus
ctggtgtgctgtggtccattaggtcatagggagtcagacacgactgagcaactgagttgactaagagagatagtcaatttcagttctagtgaaaggtaccragtaagcctgggacattgggatatgacataaagtacagagcttattgtatattaccatggccatgtcaaaaagaaacaagaacaaagttccaccatctga

SEQ ID NO: 35466 - DNA, 201 bp, Bos taurus
cagcaagttttaataatattaaatatgtgttggaatatgtgccatgttcagacacatctcagtctgaagcatcttgcatactgatgccaaaggagacttayttaaactttaaattttttatttcagttttttttttttttttggtttaccttaaaaaatagaattagtagacaaaatcaaccacttaatttacattttaga

SEQ ID NO: 35467 - DNA, 201 bp, Bos taurus
ttgtttacaacaataaactcaagatataaagggaaagctgagtgtcagaatcttttgggaaatgttttgacattgaactcttcaagcaggatggaatcttyccttttctcctcactcaaccccattatgcctctcccttcacctcaagatgatgtctttccctttcagtagctctgagaaggagtttgttaaaacttaatt

SEQ ID NO: 35468 - DNA, 201 bp, Bos taurus
gtgctgcagtccatggagttacaaagagttggacaaaactgagcaactgaacaacaacaaagagagtaagttggaaagttttccgtaaatcaagttcttcygttccctcctatctatgccaatactttcatttttattgcattattatatagaaaggttttgagatagcccacccccttttcctctacttatcttttttca

SEQ ID NO: 35469 - DNA, 201 bp, Bos taurus
agtatttctactaagagaaaggtgctaaaatcccaaatcagatatttggatttaatgaatttttatatatgttctgattcattagctgccattcccatctyctcattaatatgatatgagatactcagatttttttatttgctttctttttcttattggggccaagactgaataaagaatattgtgtcagatattttgcaa

SEQ ID NO: 35470 - DNA, 201 bp, Bos taurus
aggatgctagtaaagttttgaccaactggaaatgaacatgtgtccctgtgttagaatgatcaataatcactcatgctttcagttatgtatttacctcaagragcagaaatgatctttagcctagtgtcaaatattaagatgtaggcccatgaccttttccagtaaaatatgtacagttacttagaatatggttttgcacat

SEQ ID NO: 35471 - DNA, 201 bp, Bos taurus
gatgtcctcttataatctctacatatttgaagaaattaaaactagtgtaagatagtagcagaaatgttaacacagaaatactgtggagaagatttaatagkttgggtttatttgtttttagaaaatgatagatgatatagtcttcaagtataaattgtaaaattaaactgtgtgtattaattacaagtacttgttagatat

SEQ ID NO: 35472 - DNA, 201 bp, Bos taurus
agtagtcactggatgtcagcattgtttcactaaaatctgtttaccagtattatttttgactgggaaatttataattcttaagtataccaaaatcaccctayattgttttgatcttagagacaaagggaaaaagtcatgtgagcaaaggcaaaagcctcttaaaaaaaagtatgattgattatctttcagtagctaaatttc

SEQ ID NO: 35473 - DNA, 201 bp, Bos taurus
gaattctccaggccagaatactggcatgggtagccattccctttcttcaagggatcttcccaactcagggatcgaatccaggtctcccgcattgaaggccrattctttaccaactgaaggattagggaagccctatcactctctcagttcagttcagtcactcagtcttgtccaactctttgcgaccccatggactgcagc

SEQ ID NO: 35474 - DNA, 201 bp, Bos taurus
aaaaacaactgactgactctagggccctgggacctcgatttaagtcattaccaaagaggggtgtctccagctggtaagtgttggtgatgctttcagttccygttctggccctgtttataaaagtttcactctttcgctattcctgctttgcatgtaaaggtgatgctaaaactgagcttggtttgtaactacagacagctt

SEQ ID NO: 35475 - DNA, 201 bp, Bos taurus
aaacaagtggtctggggacacatgaagtttccaccattttatttgtagtttatttattaagagcaaaaaacagcaagtaaaatagggccctgtctgaaaayggacacccaagaatgccaagagactgagagcatgctcaataatgcagagtagcagtcgtgctcggcaaatccattccatggcccactcgtttctgtctgc

SEQ ID NO: 35476 - DNA, 201 bp, Bos taurus
catggaaactaatggacaggggccaaagatactgctaacatcctaaaatacacaggatattatcccccaccatgaagaattatctgcccctgaatatcaayagcatcaaggtcaagaaatccaggcctagggaaatacccatgtgtataaatgataggcagatgaaaagttaaagttagaaacacaatacagtaagttcaa

SEQ ID NO: 35477 - DNA, 201 bp, Bos taurus
catggactgtagtgcaccaggcacctctgtccatggaattctccaggcaaaagtatggagtgggtagctattctcttctccagaggatctttccaacccarggattgaaattaggtctccggcattacaggggaattctttactttctaggccatgagggaagcccaaagcctacatggttaactctgaatttagcatttt

SEQ ID NO: 35478 - DNA, 201 bp, Bos taurus
aatctttccacaacagtactatagacctgctagtactaagataataatcaaactgaaagtgcttcttcaaacaaatatttctatgaccaaacaagaaatayaattaggcgaatatacctccaacaatatagttgttgctgttcagttgctaagtagtgtctgactcttggcaaccgcatggactgcagcatgccaggctcc

SEQ ID NO: 35479 - DNA, 201 bp, Bos taurus
tgagccacaaaagatcaagagaattatgaatcatataaaacaagggtatagaaagtataaagaacgacagaaatgtcaaacctgctttggaaacttttaarattaacctacaataccaggttcactggtacagatatgaagatgctactgtcagcagcaaaagaaagctcacttcacccttcaagactagaaatgttcata

SEQ ID NO: 35480 - DNA, 201 bp, Bos taurus
caaaagaatgttctttagtattttctttaatttaggcctgctggtgattcaaaactgttttagattttttttgtctccatgtttttttattttaccttcaktcttgaaaaatatctttgctgtgagtagaattctaacttgccatttattttttcagttccttgtggatgccatgacagtgttttggcatccattgcttta

SEQ ID NO: 35481 - DNA, 201 bp, Bos taurus
ctctgtgtttctccactgcttccctttcctcacccacctgcttctccacttcaaccttctcctcctggttcgctgcttctgagaacatggggcccctttcsgtctttgctttcgcagccttccatccagccgtcagctcagactctgatctcccagtgtcacaggtttctagggccttctccccaccagtttcacactgaa

SEQ ID NO: 35482 - DNA, 201 bp, Bos taurus
gaaataacaaacaaggccctctgacaggagctggtttctagcaagtggtttcagggcaggcactctgctataggggtttagctagactaaggaaaaaatcrctttccacaggctagtggggccagcgtattccttcaggattacgtttatttttatctaaatcagaccatctaccccaatgcctaagcctcaaaactaggt

SEQ ID NO: 35483 - DNA, 201 bp, Bos taurus
ccagtgagccacatgatgtgtccagtttctgacacagatgctcggaaaccagaggccttcagctgtctggggtgtggccagtcattgtgcgaaaggcccckgactccagcatcagcacccctaccctttctggaagatgtgggagaattcagttaaggagggggacagggtcagtctaagcaaattctcaggtccacttgg

SEQ ID NO: 35484 - DNA, 201 bp, Bos taurus
gcttatcatatagttggaatctttcaaagtttgaaactttgttttgaaagcctcggggcatcattgctggatggtaagcaggagaaagataaaatcagctygggcctttccccatgtctattgtctaggaggatggggaggcgggaattaccaacttgaagctcaaggagccctgatgagattccactccccagtctgtcc

SEQ ID NO: 35485 - DNA, 201 bp, Bos taurus
ctctattctgcctggctttggggaaccatatgggccctagggcgctctcatctgcttccccacacacccatgcgcaggtcctcctagggcctgagcacccrgctactcctaggtttgaattcaggcatccagggctgcccatctccggtctgatgctgagacaggagagtggcttttgaggcctggagtctgggattaaat

SEQ ID NO: 35486 - DNA, 201 bp, Bos taurus
cttctggtggtatttctctctatgttgaattttcttagtgtctgaggttatttttagctgttacttcagtgagcttcaaggttgcacgacctgttttaacygcccgtgtctctgattactccttgccatgacagcattttcgtgtgatgctcgggaaagaaatgagatcttttcttccaggcctttgactcaaagcagaac

SEQ ID NO: 35487 - DNA, 201 bp, Bos taurus
atgaattaacagagttccaggcccagttaagagtcataacaacttgtatttccagaaaacctaaactagaaatcatttcccagtgtgagaatagagccacmaaaagggccagatctgaggtaaatatacaatcaattacattcctctatgtatgaaacagggagaaggcgagggcaccccactccagtactgttgcctgga

SEQ ID NO: 35488 - DNA, 201 bp, Bos taurus
actaaaatgttatagttcatcaaactagcaaacattaaaaaaaacaggtaatatccagtgttggaatttcagtttgacctaccaagaaaaaaagaagacaragaattcaaataaataaaattataaaggaaagaggagacattacaagtgataccacagaaatacaaaggatcctaagagactactatgaacaactgtgct

SEQ ID NO: 35489 - DNA, 201 bp, Bos taurus
gatcagcagaatcattagattccagaaaatgcagaacctctgaggcctctgtattcttccattctgatgtcagactactggcagcccacgctgagctgccktataagaaagtgcagctaggccactagaaagaagcagaggaaggaggggccagctggcattgctggggtttggaagctctgcactgcagattctgttaac

SEQ ID NO: 35490 - DNA, 201 bp, Bos taurus
gcacttaatccttaatgcacagttaaaaactaagtttggaaaaaaaaaacttaagtgtgagccagagggggctctttgggcttaataaagaggcccttatwtcctacagtgaaaaaaccgacatgggattagacagttacaagagctctgaagatacctagatcttcagcctagggaggtttgctatacagctagggccct

SEQ ID NO: 35491 - DNA, 201 bp, Bos taurus
atgtgtttattggaaatagtttctaacaaagtattaaattatcattatgattctgaaaatagtccttatggagcaaacttttaatacctattattagcatyattactatatgtactaacttgaaagttatgtacaattctttctcgaaaaactcaattttaagcaaatcaaactaacatatgccctctggtctcagttccc

SEQ ID NO: 35492 - DNA, 201 bp, Bos taurus
aacagtgttggctacctgtagtaggaggcagctaatgagttttagcattattatttaatattacaattgtagtcatcactacaccctttcttctaaatctkttgtgttgtttcttcttttgttaactttgctaagaacttcccaaatatgattgtaagctgactgcagggcacgaagatgaggtgataactgctgctgctg

SEQ ID NO: 35493 - DNA, 201 bp, Bos taurus
agatacttttttcccagagttagctggaagtttatttcaatatttgagtacagtagggactttgtacattttgttccttacagtatgctagcacagagaayggttcctggcacatgataggtactcattaaacacttatatactgaatggacattaattaggatttttttgtgtgtgcagattcttatgtatcattagaaa

SEQ ID NO: 35494 - DNA, 201 bp, Bos taurus
agggccacggaggagagtttcagagagacaggctcttttctccgtactactcagaatccagtgggtctctctgaatccaagatgaagtcctagaggaaatrtgtgatgcaggttgaatggaggcccctggtcgtgctaaggcagtatgactcctcccctggttttcttgggtaccataatcacgtcctgacctctctggac

SEQ ID NO: 35495 - DNA, 201 bp, Bos taurus
aaaggcatttctaaagattccctgataaggccacttcattatacacaaaacagctttcaacaaagctatgtcaagagtggggagtagggggtctggagggytctctccaggccaacctctcttccacttcatgaggtaggtagctcctaaggtatgttcatagattctttgaatttccctcgagattagtttcaaaatagt

SEQ ID NO: 35496 - DNA, 201 bp, Bos taurus
atccattgccaggcttgaagcaggaactggttctttatgacctgaggctctgagatctttgctcaccatcttaaatttctcagaaggtctaaatttgtaasggttcatgtttcacaattctagaagccttttcaatctggcttcgttgcttgccagagttccagaataaaccctcctacaatatggaccatgctctaccca

SEQ ID NO: 35497 - DNA, 201 bp, Bos taurus
gaaggttggggcccagagagtctcctgcagaatcttcaaactcctcctgttttctttggatgaagactatcatccggatgacactgtgttaactgtgagartctggcctgagccttggactactcatatataaaggggaatcaaatgcctggtcccatagttgatccagtaagatcgtgtaccttgcccatgagacttctc

SEQ ID NO: 35498 - DNA, 201 bp, Bos taurus
acatgtgctcttcatctggggcagccctgcatttaactggcttgttcacacttctgcttaagcttctgtggaacaaaggtgactttttacaaagtttgaamacccatgatctaacccagagaggccaacagaagcaacatttggatgcatgagctgggtttctggaccagagaatagatggtcccagatgacaccatttct

SEQ ID NO: 35499 - DNA, 201 bp, Bos taurus
ggagttggtgatggacagggaggcctggcgtgctgcgattcatggggtcgcaaagagttggacacaactgagtgactgatctgatctgatggtggttttgytattttggccgccatttagtctcaggctctgtttccttcacaattgctcatttacagtgggttctactgtttcttttcccttctctgttcttactgttgt

SEQ ID NO: 35500 - DNA, 201 bp, Bos taurus
aggtctgttaaggttaggactgctgtcttttgcagactctcactttaagccaagtctttgcccagcagaccacaatgcaacaaagaggatttggggcccartgtacttggttttgccaaatattcactgctctgataaatcatctattagctaagctaactttggggaattatctatggaatttaattctatttgctggcc

SEQ ID NO: 35501 - DNA, 201 bp, Bos taurus
gcctgtgcacggcaactagaaagcagcctccctctccatagctagagaagaagcctgtatgcagcaatgaaaacccagcatagctagataaagaaataaayaaaaattacatatatatataaagtacgtcaatagactgattgagtaactccttttttgctcttccctgtgttttatatatcctcaataacacccaaaagg

SEQ ID NO: 35502 - DNA, 201 bp, Bos taurus
cttagtaaagagggattgaaaatattatatttttattaaattaaataaaattcttatcaatccatctaatgtaacaaacagaaattaaatagcaaagcatrgattagtcacaccataagttcagtcatcaagtaagtcagttgtaggtgtaacatatttaacttaaaataatccttccaaagccgctgtgtatacaagccc

SEQ ID NO: 35503 - DNA, 201 bp, Bos taurus
acacataggagcatccctggtatcttattatttagaaagagaaaatacaccatttgtgcaacatgatagagtaagagtttgttctttttcctctggtaaaraagtttgattaaatttctcataagttggtctattttgggctgcagtcatgaaatttttgtgaagggcaagtctgggaaaaaaatgaacactgaatttgaa

SEQ ID NO: 35504 - DNA, 201 bp, Bos taurus
atatgagattcaatagaaaaaaattaatcaagaattatcatcaaatcattatctttggcagaaactaaagtttaaatttgcactattcacattattaggtrtaatcctaatttacttttaataatagcattaaaagcttagcaaaaacagttatcagactgaatggaaaaaatgcaacatacataacgttccaatacaagc

SEQ ID NO: 35505 - DNA, 201 bp, Bos taurus
cacccatgatggaactcaaatagtactttggtctttatttccattatcatctgggagttttatgtatattgtctcatttttcatcttcacaatgatatggyatctgtattttcgttattaaacacagagatctggatatcaagaaggattacattgcccatctattttccttagtaatataagatctgggattcaaatcca

SEQ ID NO: 35506 - DNA, 201 bp, Bos taurus
gtgttcatatttcatttcttccaatgttacacatgtgaaaaaacactagggatttcccttgtgatccagtggctgactctgcactcccagtgccatgggtyccagtttaatccctggtcagggactagatcccagatgccttaactaagagtttgtatacagcaatggaaagattccacaggccacaaggaaaatcgaaga

SEQ ID NO: 35507 - DNA, 201 bp, Bos taurus
tttatgttggtccattcaagtgagtgcattttctatgattctgcaggaagggctttatagtttttaaaaggggtcaaggcaggaacactgatttaaatacrctgctgtcaatttggcctcacatatctgcattcatatatcccaggagtttaaacaaataggcaaaggcttttcattgacacaatgtctgttcaaataaaa

SEQ ID NO: 35508 - DNA, 201 bp, Bos taurus
caataacttaattgtatctgttatgagccttctattctacaagaaggagtgagaaggtttgatatgcacacttgtgtgtagggagagatggatagtaaaaraagttagaaagaaggaatataagcggggaagttgactcaggcatgaagtgatttaattccatcttgtggcaagggagtatgtaaacatgaagctaagagt

SEQ ID NO: 35509 - DNA, 201 bp, Bos taurus
acacaggcccctgccctttgatttctccatccttagttttggcccttacactgtttgtctatttacagtcgtcagcaaaattgttctgagtgtctgtgtgygctgtgcttgagggcctggggtgtgcaaaaccccatgaggaataagaaggatgtgatggtgggaccttctgtggaccactctcataggtcaaacaggatt

SEQ ID NO: 35510 - DNA, 201 bp, Bos taurus
attgataataggtacctacgtgactttggaatacttggccatcgtgcctccttttaacacaaaactgagacaagtttaaagtccgatcaaggacttgacgmaggagggatggccacttgaggatcttaaatgaccacgtggatgtgaggtggaggtagttgatttcaacttggccattcctgcacctccatggttgaagtc

SEQ ID NO: 35511 - DNA, 201 bp, Bos taurus
actaagcatcaggtacgactgctcctctgtaaagtgtaacttcagaaaactgcccttttctaaatgccttgctttacagaagagggggattcctaggtggygctagtggtaaaaagcccacctgccaatgcaggagaggcaaaatttaatccctgggatgggaagatcccctggtagaggaaatggcaaccactccaatat

SEQ ID NO: 35512 - DNA, 201 bp, Bos taurus
ctctgtgtcaactaccactcagctgtttggcccttggaaattacacactggggtgtggctgtgttcttataagatgattgacaaaatagattaatgcccaratttggcctgtgggtcagggtttgccaacctctgatctataatcttccttgttttaaattctctaccctgagtatcaactctaccgactagtttgcaata

SEQ ID NO: 35513 - DNA, 201 bp, Bos taurus
tcttcctggcccagggatcaaacctgggtctcctgcattgcaggcagattctttaccatctgagccaccagatattctatggccccaaacaaattccaatmaatattattcatctgtcagcccttgaaatagaatgtgggctactccaccatatctttcttacctgtagggattagcaaggaaaacctcactctctgacag

SEQ ID NO: 35514 - DNA, 201 bp, Bos taurus
tctttttctccttttgaaaatttaaacaacaacaacagtgtccagaaccaccggaattccacaactccactggaaaacaactgaaatgtaatacggtatgrttagaccctggagcatttcattctatgtgaatggtgccttctgaagtcacaaaacacaatagtcctatcatgtctgatatttttacagagctgtactttt

SEQ ID NO: 35515 - DNA, 201 bp, Bos taurus
gagtccatttggaagagaatcacagtaaaaaagaaataagatggaggtccagattttgagggatgacatagaagagtgggagcaagaagcattgacaaatracatagatgaagttagggaggtgatggaacagttcttacatgtgactagccataagggataaaggtttcagacccctgcgctgcacaaaacattgcatat

SEQ ID NO: 35516 - DNA, 201 bp, Bos taurus
ggggaaatatcaatgaatatatagtcggccagattctccccagggcaaaacagaaaaggatcagcatgcaaatctgcccagattactctgtggatctcaayacagggatttgggggccattccaggagagctggggctagtagtagaaggaggaaacctgtcaccatcagcacctcccccccaggcccctcaggactaata

SEQ ID NO: 35517 - DNA, 201 bp, Bos taurus
ctaaggcaggtagaatattttattccattattagctataaaattttaaatactgagatcccttgagaattaatcaagaaaaatcatgtgtttaaaaaaaakcctagtacagtttctgacttgggtttaaatttatactaaagaatgtaagatcttttcttgcaagtaggttttgatgaaaatacagagcataatgcataac

SEQ ID NO: 35518 - DNA, 201 bp, Bos taurus
ctgacacctactgctgtcttacagatgggcccggccctgagatttcaaacattctacaggaaacacactgacacacatgcatactctgcccaggccccacrctacccagacactttttaaattgcttttccagtaggatcccaggaaaaggttctatttaactaccacctgcacatggccaggatatgactggtctgacaa

SEQ ID NO: 35519 - DNA, 201 bp, Bos taurus
ggaacacacagtgatctgctcccatccagactcctagctgatggggcccatgggcttctgtcaagagttctgggggtccccatccacccagagcatctgamagatactttgccccagaaggccaggtatagtcacaggagggtattttcaactaagacccaccccaaccctgccggcagaacgggtgcagggccatgacca

SEQ ID NO: 35520 - DNA, 201 bp, Bos taurus
tcccctgggcagaggagcctggcaggctacagtccacagcgttgcaaagaatgggccatgactgagcaacttttactcactcacaggccagggtaggaaaygacacacagtgcatgaacgcacgtgccactggctacagttcagtcacatggctacggttcagtcacatggctacagttcagtcacatggccacacctgac

SEQ ID NO: 35521 - DNA, 201 bp, Bos taurus
tacagggaagaaaaaaagtaaatgtagtatgaaagagcacatagtggggaaaagagcttataaagaggagggtaatcgaagaatgcttcatgaggaaggtrggacttgaagtgaactttgaaaaatagatggaattaagatagcagaaaggacagcaagcatttgaggcaaaagtgaaagtgttagtcactcaatcatgtc

SEQ ID NO: 35522 - DNA, 201 bp, Bos taurus
caaattcctgaccttgtaaaatttatagtcaagaaacagataacaagcaaaataaataaatgaatcacatgctatttcatgtgataaatgcaatgagaaaygatccatttattggttcagttcagttcagccactcagtcaggtccgattttttgcaacccatggactgtgtcacgccaggtctccttgtccatcaccaac

SEQ ID NO: 35523 - DNA, 201 bp, Bos taurus
gaggtgattttggttgggaatggccctgtgggaatcctggagtattggcagtattctgttttttagtgtggattgtgttaaatggatattagttaaggtaygcatttatgtttcatgcttttttctgtataagtaatattttttcttaagaaaaagttgtaaactcgttcatgggatggtgtgacagagcaaaaaagaaca

SEQ ID NO: 35524 - DNA, 201 bp, Bos taurus
actggaaccactttagcagttctaaaagagccagctctgatccatttccaagaatccacatctggtgatatatgggatgaggcaaactgatcaaagtaccygagtgccaacagtacagggaaaagcagagccaagtgaagagcaggctgtggcttgggggtaaaatgcagtgactaaaatgacaatggactgcacctcata

SEQ ID NO: 35525 - DNA, 201 bp, Bos taurus
cttatattctcttgaaaaggcccaggtctccagatcccaggatgagatttgagatttatgctgatttcctctgtgcgtccaccctctgtcctgtggacccyggccacaaccctcccctctgatggcagcgaggtccccgatgctgggcccatggcagctcagatgtacgtgcttctgcttatggaaggcgaggctcttcac

SEQ ID NO: 35526 - DNA, 201 bp, Bos taurus
gccaacacaatattgtaaaacaattatccttcaattaaaaaaaaaatagcctggctatacctaaactcagaatttgctgttactagagatgatcagtaaaygttcactgactagtttttacttactacaatgaaaacaatttactattcatcttgatggaaaacaaaacacggctctggagatttcaggacggtaaaggag

SEQ ID NO: 35527 - DNA, 201 bp, Bos taurus
ccaagaaacaattcacaaacacgctctccaagggagtgggtttagacccgaaggagccaggtaggcttggagacttggcagtggaattctgggcagaaagrgctgcaggtcctaagactaggggctggagcagctcttggaactataggagcctgagtctctgagtttgatgatcaggggcaaggtcagaaacgtaggtga

SEQ ID NO: 35528 - DNA, 201 bp, Bos taurus
aggatgtctgaggctgtgggaccccggcctccgtctcctttctgggagctcctgtggttggatttgggcttgttcatggacccagcccctgatgaacccgmaaggggccccaaaaccagatgctgtgctcagttcttcattttatttttaccaagacatctcagtcaagtgtcaggaacacttatcttatttaagataaga

SEQ ID NO: 35529 - DNA, 201 bp, Bos taurus
accacttcctgataacagtgacttcggtgggatttccggtggcatttcccacaatagttatgctgtttgacttattctttcggttgctatttatactcctratctttatgctttactgactgagtcactcgggtataaagcttttcttacctaaaatcagactaagagaatatccaatgggtgcctgagcccacgccaagc

SEQ ID NO: 35530 - DNA, 201 bp, Bos taurus
agacgttgcatgggtttcttgtactccccctggggtctgaggcagacacacatggggcaaactttgaatagcctcgacaagaatgtgtaaagggcattgtrgcaaagtgaacgcagggcctgccccctgctccacagcattaaaaggagcaggaaggaactgtggcagagaagggacaatggcgtgacctggggtaagcat

SEQ ID NO: 35531 - DNA, 201 bp, Bos taurus
cacttctccacaatttcctactgcttattccttgccaaccatcagacctatgtaacatacatggcctgctcttgtggatgctagaattcaaggtgctgacrgtcaaaggctttaagctttccattggatttgccacagatgaatcgtgtggtccattattttacagatatttaatgctatgcatgataaaattttactttt

SEQ ID NO: 35532 - DNA, 201 bp, Bos taurus
tactggcacaatttctctcataaaatagaaatgatagcactgccctcatagacatctctgtggtgaatctgattattttagctgccttgctggccaataayagcccctgtggcagctcaatcatgtggcatttggaattgattttaaaacaggcagaaacactgactgctgttcttaatttaaaattatttcatgcttaag

SEQ ID NO: 35533 - DNA, 201 bp, Bos taurus
catgaatgtattgctttattatcaaaggagagctaagagtgtgtcacagattggtgggttgatccctgtagatccaaatgaggtgtaggagaccctggccmctttcctttcccaagtgactgacacggacgggaagcaccctggcaagacacttgtcctcttctgaaccccattgtatggcctattgtcatctttacttcc

SEQ ID NO: 35534 - DNA, 201 bp, Bos taurus
actaggtaatttcacccagatggtgtaatcaaaatcaaaatgtttatgttgccaagttcaccaaaaggggagacagagctctcaggagaagagaatcccamacttaggcaacattagatgcaccgagaacaagtttcacttgtcacatgtccttcgagttggtgtccaacgacactaaactcattctttgtattaataatc

SEQ ID NO: 35535 - DNA, 201 bp, Bos taurus
gtgagagcctcgcttccagatttatggtaagggatggatagttctgtccagcctgccaactaatatccaagcagacatgaacaggccgcttttctccctcrtttcctgaagggatacagccctgtgcggtgttcagtgagtcctgacgctgcgaagtggctggtgcagggtgactggtccagtcaccctgggccctcccca

SEQ ID NO: 35536 - DNA, 201 bp, Bos taurus
cctgctgtgtgcatcggaatcacctggagggctttccaaacacaggctgctgcctcccatctcaagcttctgattcagtaggtctgggctgtggcccagcyaatagtttcacctcacatactgttggtgtgttctggggaccccccacttgagaaccactggcttagattgtgagttggccacaaattaggttctcaccta

SEQ ID NO: 35537 - DNA, 201 bp, Bos taurus
ttcctcaaaaagcaaaacaaattactttatgatccaataattctacttctgggtatgtgccccaaagtactgaaagtggggacagaaagaggtatttacaractgtgttcacaacattagtcacaccagctgggaggtggaaggaacccagtatctgttggtagataaacaaagagtggtctgcacacaaaatagaatatt

SEQ ID NO: 35538 - DNA, 201 bp, Bos taurus
gagcccagatgaggcctctttgttaccaccagcttaccactgctttaagtttccaatttcagcctcagctagctgcagccagaggaccactaagatctggycactttcttcaatcaatactgctgctaagtcccttcaattgtgtctgactctgtgcaaccccatagacagcagcccaccaggttcctctgtccctgggat

SEQ ID NO: 35539 - DNA, 201 bp, Bos taurus
ggccaatacccataacagctacttctttaggacaaaatacagcagtcaaaagtctctctctctctgtgttgctgtaatgaagaaataaaagaaccagactrtttttcaaggtaggcctcaactatccagcttccacaggtaaaatactgcttttgccatctgatcccatgatctaggctcactaaagcaactttctctgca

SEQ ID NO: 35540 - DNA, 201 bp, Bos taurus
tgcactccctgaatagaattcaatttagagaagttaacactcaggttatctcttagaggatattgggagttttccaggcagtcaggaaggacaacgcgtgmagaggtgatgaacagaaataatcacaaatgactctgcatatctaagacgaagaggtgtttggatataagagaaggtgagggcgatttacaaggttcagat

SEQ ID NO: 35541 - DNA, 201 bp, Bos taurus
tttgtctttttctgtctgactgacttcactcagtatgattatctctcagttgatggacactttgaatgtatccagtgttttctattacagtgctgcaagartgttctattacatttgtcttcatgccgtaaccttactgatgtttctgtaaaatatagtgtttccagtgggtttattggttataagcaacacacaaccttt

SEQ ID NO: 35542 - DNA, 201 bp, Bos taurus
cacgcatccagccttttggtagtgccttgacctccctcatcattcaccctgtactccagctaaactgccctatcctcctgctccctgaatggatcctgcakgttccaacctcaggtgagggcctttgcatttgccattttctctcctgggacacttgttcccggggctccctctctccccgtctcagatctttgttcagtg

SEQ ID NO: 35543 - DNA, 201 bp, Bos taurus
gctgcccattggactcatttgaagacctgaggcctgggtgccttccaggggcactgggacttttttaaagatattacttcttttataattaaaaaatttaktatttatgtatttttggccgtgctgggtcttcgttgctgggcgtggactttttctagttgcagcgctactgattgcgttgccttctcttgttgtggagca

SEQ ID NO: 35544 - DNA, 201 bp, Bos taurus
tccgggagatggtgatggacagggaggcctggcgtgctgcaattcatggggtcacaaagagtcagacaacactgagcgactgaactgaactgaactgaatmtttattgtagccatcttcaaggccagaaaccatctaagccatgacaaaagaggaagcagaagatgaggggactgcacagccactttggcagtaaggtgtc

SEQ ID NO: 35545 - DNA, 201 bp, Bos taurus
cagaactgtgagccgaggtaggaataggccacctggaaatccacctaaatgtcctcctgccccaagaatactgcgtgaagcctgtcagcctctaggatctmtccatggaaaagggattttgttggccaaattgaggtcaggtgaaagagatcagggaacaccagtgatggtttaagtgttacactaactggaaggttaact

SEQ ID NO: 35546 - DNA, 201 bp, Bos taurus
tggccaccctttcagccccagctcccaggagaaccaaggtcaaggccctgtgaagggatggcaaagaggcggctggttggcccatcactgtccttttctgracctgtggcagacattgttaatcaatcaccacactctgcctctgagccagaatggggtttctgctcctcaacctggccttgcgggtggatataacatatc

SEQ ID NO: 35547 - DNA, 201 bp, Bos taurus
ccagggccgtggagacctggtgttccaacctcttgtcccaccttccaccctaagtctacatactgagtccctccggtatctatgaggtttaggttacctgrgcacattaggcccttggactacaacaaggggccggtatgctgagaagcagcagtgtgcatctggttttaccctggacttgctgcgtgaccttggtctctg

SEQ ID NO: 35548 - DNA, 201 bp, Bos taurus
ccatctccaaacaaagatgaattgaggaaccccaatacctctttatgttcctcaagaccttttctcatccctagaccttattttcaacccaggcaagaaayctggaaagaaaacagtttcttggcttcctttgctcctttttaaaaccgagaggagggtatggggggctttccatctgtgatctaaggaagttagagaaac

SEQ ID NO: 35549 - DNA, 201 bp, Bos taurus
tactcttctgggcctcatggtggccttcagggttccttcaccgaggcagctcgatatgtcacaggtgccatactggtccctgagtatgcagaaacatgggygaggctgcatgcccacaaggagcctaatgttcagctcagaaacgtgttgttagcttaaaaattattatatatatatatgggcctccccagtggctcagca

SEQ ID NO: 35550 - DNA, 201 bp, Bos taurus
ggaaaaataaagaagctacttttggctaaaagggagttggttactgtaaggtgaattcctgtaggggatggcaggggtctcccaggcagatggcctcactmgtgctgatcaggcgatccttgattggctgggctaagattccatttctgggggagccaaaagcgtaattaagtatcagtttggtgacctgtggcttggcat

SEQ ID NO: 35551 - DNA, 201 bp, Bos taurus
ggactggagagagaggccttcacccagaagagggggcaaagggcctgagcctggtctgtgggagccagaagacacctcttgtccagtgattaagcctgggytggctcccaggagcccagggccactcttctgtcatcactctttagtgctgggtatggaaggatttctccaggcgctgttacagtgggaggctccctgtct

SEQ ID NO: 35552 - DNA, 201 bp, Bos taurus
tctttttgtccttccccgtgggtcacacagcttggacaaaaaaaggtaacttgccttaaattgcaaagttaaagaactgaggcactgagggtcaaacttcrgttgactttgccactctgcttcatggcctctgacactgctattgaattcagttcagttactgggttctgccagctgctgtctgtgccagctctgtgctgg

SEQ ID NO: 35553 - DNA, 201 bp, Bos taurus
tatcaatattctcaacaccatttgctataaagattatccttccttcattgaactgcttttgtacctttgttaaaattcaactggcaaaactttgtgtgtgmctatttctggactttattttgtgctgtgatctaagtgtctttccgtcttgatgctgcactgtcttaattactgaaacaatttcagtaaatatataggcct

SEQ ID NO: 35554 - DNA, 201 bp, Bos taurus
ccatggaccctctctattgactccctgttagcaccaagtcttaactttaatttaatctgagtttgttttcaatgcactaaggccactttcttgtctgtaarttcattgaatggatcaatactcctttttctttcccatctcctggcacatctcaaaatctgtcataccagccaccatgtgtaggcgctagctatacttcct

SEQ ID NO: 35555 - DNA, 201 bp, Bos taurus
gaatgaccaagaaaagaagggagtgtgaactggccccgcctcctctccagcatcaactatgcctcaatagccctgcggggtgctggcttccccagacacamtgagaggtgttttggcctcgtgcctcggcaacactgcctgcctgcagcttggctgcccacccccccaccccccaatcccatcacgcctgcttcttcgcct

SEQ ID NO: 35556 - DNA, 201 bp, Bos taurus
atgctcctgggttatcggtgagtttttatagtttgtaaagggagaattgtgaccgagcagctggcacaggccctggccaccccaggctagcagctgagggratgtgcagacactggtgaggaggctacgagcccagctgcagccctacaaggcatttcctttcttactgtgttctgcaaaaaatgcatgctcactgggaga

SEQ ID NO: 35557 - DNA, 201 bp, Bos taurus
atcagaatggccaagtaaaatgtttccaggtttaaaaataggcacttacacaaaggcatgttttttaatcccaacgtttttgatgacattatctactctaygtccagcacgacgatgcagaaggccacttatttcactacttcacaaatcagaaattatctcattatgcttctatttatgtcttcttccacccagactttt

SEQ ID NO: 35558 - DNA, 201 bp, Bos taurus
acacttctaagaagttcagggaagggcctcatgaaaagagtagccctggatctgagtgtagaataggggttctcagccaggggctctttggcccccagagracatttgccagtctctagaggcatttaaaaaaatttcatgtatttatttagctgtaccaggtcttagttgcagcatgtgggatctggttccctggccagg

SEQ ID NO: 35559 - DNA, 201 bp, Bos taurus
atttttacacaaatgagtcaccccgctcacttttacacaaatggttgcatcccactcacttctgtatttgatcccacagaagaattaagatacttgttcargtttcatggtggactctgttgaaatgagaatcaagaagtcttttttttaatttgtttttaaattggaggaaaattgctttacaatgtcgtgttggtttct

SEQ ID NO: 35560 - DNA, 201 bp, Bos taurus
gcatctccccagtgccggaactcagcctaccacgtgtgaggccctccatctgattctggcagatagtgactacttatgcccagcaaacctgtgcatgtgtrcacacacagcagaggggcagacctggtgtccactgcctagcaacccagggtaagtcaccggatggggaggggacatgtgggctccctctgcccacctctg

SEQ ID NO: 35561 - DNA, 201 bp, Bos taurus
acaacgctcatcacaggctgcaccaatgctgcgggtctggtggtggtgggaaacttccaggtacacccgcctgccggcctttcagcttcctctagagggayagcgatgggggcaggggatgaagaggtggaggggaggggctgatctgtgctccctctctgggcccaggtggaccacgctaagtctctgcactatgtcgga

SEQ ID NO: 35562 - DNA, 201 bp, Bos taurus
ggtcccctcacagcaaacaagttattaggtgtttctgccaggagcttccttccactccaagcccacctggcctggccagggccctgtcctttccacccccrggatgtctctccttccagtgactcagaactctcacctgcatggatgatgactctggccagggctgtggccacctcaggcctgacccttcaggcagccaaa

SEQ ID NO: 35563 - DNA, 201 bp, Bos taurus
tcctgattgctggactggacacctggctcactgtaacagggggagggcagtgccctccagttatagcagctcaggaaccaactctctctgtgtcctctggygcctcagcatctgcctccctttccactctttcccccttgaccttctcaagtgttctgcatatgacaaaacactcacacatcgaccaaccttgggaagatg

SEQ ID NO: 35564 - DNA, 201 bp, Bos taurus
atagagagttttgcttgattttgagcacacggattcacaccgtctgtctttgctgtaaagacatgtcttctgtgcagttttagttattctctgggtccaayccaggttcccaattcaaaactatcaacagtcaaaacttgaggttacatgatgagtgctctccgctacaccatgacacttggaattcctcttcctagtgcc

SEQ ID NO: 35565 - DNA, 201 bp, Bos taurus
taattatggcctggcactccataacagaaatgctgaaggctcttgaaggagacaacacttctcattcaagtctactgtcaggctctgtgagttggaagcaygcaccacaaggtttcaggaggaaggactcacgctgaggctgagcctccaatattctggccccctgatgtgaagcgaagagtccacttattggaaaagacc

SEQ ID NO: 35566 - DNA, 201 bp, Bos taurus
aaaggggcatctgatttctccctccctcgtggcctgaacaccagctcccatttatgtaactaacaatgtgagagggggctgcaggctgtctgggggtaatrggcccagggacaggtatcaggaaatgaaggttccaatcccagctgattcactatgtgccactgagacaagagctcaaagactgagcctcatcttcaaaaa

SEQ ID NO: 35567 - DNA, 201 bp, Bos taurus
acagtgtttggagggaacagacctagggccccatactctgaccaccctccaacctcctctccagccacaagtccaataccgccttcttggccattccctgyctctggaaccaaccaaccctgaggttagccctttattgcccaccaaccaggagctccaagattcattaggattattccactgagatggaggccattgtca

SEQ ID NO: 35568 - DNA, 201 bp, Bos taurus
cacatgctgaacttcatccttatttcttgaaagcaggttggctctccagattctgtctctgcctgaagaacctccaacctcaccctgctgtgaaatacccsatcccacaggccagtgtgacctggggcaggttatgtaacccttctgggtctcagggttcggttctttgtaaaatggggtaatgatagtgaattaaatgag

SEQ ID NO: 35569 - DNA, 201 bp, Bos taurus
tgctggaccccacacagacaacacggaaagcctactagagggcagtgacgaggccaagctgccgttcataaagccttcctgtcacacacagggccaacacrgtacaaggagcagtaggggactttctgccttcctggaaagataaactacacatatttgttagagagaagaatgtcacaactaaaggctgaaacatgctta

SEQ ID NO: 35570 - DNA, 201 bp, Bos taurus
ccatttactgctgtattcctggtgccacatgcctagagctgtgcctagtgcttggtgcgcacagcgtcagtagttgggaagcaaaggagcgttgaacaaaygcagggaaccatccatgtgccatgcctggatgttgtctggcacacagtcaatatcagccagctgctttcagtatcattactgtcagcgcgtggctagatg

SEQ ID NO: 35571 - DNA, 201 bp, Bos taurus
agtgatgtctctgttttttaatatgaaggtggaagaggggaggtaaacaggagggaaggattactgtggctgatgctgttctttcaacttcctgttaagcrggtgtcatggccttctccagaggtccacatcgtagttgagtggtacccaagttcttggctcatattagggcaaggaagcaacagattctattggcaaaat

SEQ ID NO: 35572 - DNA, 201 bp, Bos taurus
tctttgcatcctagacattttcttgaagaggggaagcagggaggtgttgaatgactagcagaagggcacacaggaagggcagtggcctggaaaattgtttycctactcactctctggtgaatggacactgattcccacctccccaccttggctgaccaaaccctgacacaaccctgcacaggcccagtgggctccatggat

SEQ ID NO: 35573 - DNA, 201 bp, Bos taurus
tcatgcaggtagaaaattgtcagcacagcatgctcaaaggggtgggaaggcagtaagaggcagaggctattccaccctacttgcaatcctcaggggcctayataaggaaaagggcttttgagcatacctccaaggctatcttctagagggacggagtccactaaggtcctgtccacccaccagggtcaaggacagattgct

SEQ ID NO: 35574 - DNA, 201 bp, Bos taurus
ctaaatgccaaactgaacaggggcataatgtgtgtattctgtggtcccagcaatttagtaattgtcagaaaaccaccctgagaccatctgttggcctcacycttgtactgccttccccgagaatgagagaaatgcagggtgttgggcaggtgagctgagaggctgctccactagggtggacctctggaccaacatctttgg

SEQ ID NO: 35575 - DNA, 201 bp, Bos taurus
acaacagagcaagacagttgccagcccagtttctaacttcttaatggcctagtctggtagagggaatgttccagcagaagtcatagatacaggtgcaaatmctgtttctattgccttgatttggccatggacaaaatttgcttttctcttagcattcttctttaaagaagcatatcatagggctgaattataaggatcaaa

SEQ ID NO: 35576 - DNA, 201 bp, Bos taurus
gtcatctgcatatctgaggttattgatattcctcccagcaatcttgattccagcttgtgcttcttccagtcagggtaccttattacatttaattgccatgkcttcttaggctgtgacaatctttcatatcttgagagaaatagtcaaatttgaactagctttcataggaaatgtttgacaatattgaggactattgtttct

SEQ ID NO: 35577 - DNA, 201 bp, Bos taurus
ttggccagatttagatatctaagtgaaagactcttcatcatcatcaatatcgatagcaatatcttcattatcccagctacaatttgataggtgtctccatkattccaggacttcttcaaggccattttcatattaagttttaataattataataataaaaacattattattatatgatatttcaatttaaaatatccacat

SEQ ID NO: 35578 - DNA, 201 bp, Bos taurus
gggctgcagattcagacacaactgagcacacaaacacatacattagagttgatccatttcattgtattagctattaactcccttatctctccactattttyccccatttcttctaataacaataacataaaacgagtattaaaattttgtctgtaagaacagaataagctcacatgtgaaaaagttgagtttctaaagata

SEQ ID NO: 35579 - DNA, 201 bp, Bos taurus
aatcatttcatttcttgactgatctacgttatacctctggcttaataaccaggtctggctgcaacatgttgctaaaggttatgtctataatgaaatttttyttgtgaaatatcttgctgagactctgctctctgctacacagaagttaatatcaagtgtcttgaaatagtattactgtacatgatattttatttataatat

SEQ ID NO: 35580 - DNA, 201 bp, Bos taurus
taatatttttgcaaagaactgagcattctgtgttataatgtggtaaatttggaagtatgatgctcacagtcctcagggattgctgcttttgcttgtgtagrcttgggaatgtccatttgtgtctatttttcccaagtgtgtactccttttgtacattgaaatttttggctcattttctctatcttcagacagtgatctaac

SEQ ID NO: 35581 - DNA, 201 bp, Bos taurus
ttgtaaaatatacagagaagctgactatagagaactaagtaaaataaaatgaggcaacattaccaataggaaagagtcagcatagactcagaatgaggttyatatttctaagagaaaataaagggggaataaactttcaaacttaaagttagcttaattttctatctctacattaaatattcaaatatggacatatatgtt

SEQ ID NO: 35582 - DNA, 201 bp, Bos taurus
aatgtaattaaaaaaaatgtaaatccaggagaaataataccaaaattacctatggtgtgttataaaacagaataatatgtagcagtcaaaatgaatctacyagagccatatatttcaaaatgtaaccatattgctgtgctttgtggttcggtttgtgtccaactttttgtgactccatggactgcaccacaccaggctcct

SEQ ID NO: 35583 - DNA, 201 bp, Bos taurus
ggaaataagtaggcttgaatttcaggccagatctaaccatatgaatttgaggaagcatttttatatgtatgtcctcagggatgagaggaactaccccaacrtccaagatcagggccggtggtccagaggagctactccacgcctgaggtcaggggagccggccaggaggaactacctcacgtccaaggagtggtggctgcc

SEQ ID NO: 35584 - DNA, 201 bp, Bos taurus
aacactgaacaggacactggacacagggctggtttcaacttgctagtgtgtaaggttggggcccaaagggtctcagggcccctgttgccaacctcctaatrggtgaggctgcatcctggggctattgacagcccagggaaataccaagtgccaggtcccaggacctctggctgcaaggccctagaggtcctagagttcgta

SEQ ID NO: 35585 - DNA, 201 bp, Bos taurus
ctaaattgaaggatatttgtaataaaaagatataagcctccaactcccatttttgccaaacattaataaaaatcaaattagaagcaagtgccttgaaaggmcactggcaaaagattttagtattgtagcaatgtgaatctgataagaaaaggaaatgctcttccttctttttttattttaggaataatataaatacaactt

SEQ ID NO: 35586 - DNA, 201 bp, Bos taurus
ccatgaagttttaatgctctattatatatcctttagttggatgtgaggtgctaaaatcccagaaaatagagggatctaccttgaatcagatagggataggktaggaaaataaagcttactggtggatatgatgtctaagctcactttgatggactgaacagaacattgttggtgcctagatggttaagaatgctgaagaag

SEQ ID NO: 35587 - DNA, 201 bp, Bos taurus
gaacacttagcagaggcagccagatttccccacctgtcagatctttctcttcccacttgcctccaacaggaactctccaatccaatcttgcttcccaaagyttcgtgtctcgacttggcagcctgaaacacagcgtctgcactcttcctgactacgtttccacatcctcctcaagaaagtgtcctgtccttaactcctatg

SEQ ID NO: 35588 - DNA, 201 bp, Bos taurus
ttcctgatcaccttggcctcctcctcaggtggtcccatgtgggattctgtgtctcctgtctctaggatccttgaatctaataaactttgtttttctcagcytctctttctgtctcttcttgtggccacccctgaatagccatctcataaaacgaaacacattcaatctattttgtgctttctctaagtcatggaccaaacc

SEQ ID NO: 35589 - DNA, 201 bp, Bos taurus
acttatgccttagagtcttgatgccagaagaagagaaaaagtaatttattaaaacagtcaacttttaaaaacagttttacaggaagggatgtagaatgtaytctcagcattacctcagttgaaataaaggtaaggtattaaagtgaggaaattttggaagatattttcctgctcatttgtgggttggtgggtttttgtttt

SEQ ID NO: 35590 - DNA, 201 bp, Bos taurus
aatgcccccacccttttcaaaaaatcatatgaggtaatatgggtggaaaaatcagtgtacatgtgggaattagagagaggctggggagactaaattcccartatatttgataaggcatcaagagttccactttcttaatttcctttcttctctgaaaccatatttggctttagtcctgaggacagaaactttctaattgca

SEQ ID NO: 35591 - DNA, 201 bp, Bos taurus
atgagtacatgagtataaaaaccctactcaaaatagcaattgcagtggtcagaggatcttgttttgcagaaattttctgtaaacttattaggatacccttmtctgtgtctgtctttgcttcttgaaaccagctgattgcttcttcccctcaagtacaatacttcatgcatgtcttcaactcaggatctcaaggtattctgt

SEQ ID NO: 35592 - DNA, 201 bp, Bos taurus
gacaggtaaggatatcttgggcctgtactgggatgatatggagaaaggacaagtttgagacagaattcccaggcagaattggagagtgtgacagagaccayctttttcacttggcctcagtctcttgagttctgctagagactcaggtgcctttcatatctttttttttttttttttttttttaacatataaagtataaac

SEQ ID NO: 35593 - DNA, 201 bp, Bos taurus
ggaagatcccctggagaagggaacaagtacccacttcagtattctggcctggagaattccatgaactacagtccatggggtcgcaaagagtcggacacgamtgaccgactttcatacttcatacatacataaagtcttagctgggcttcccagctggttcagtggtaaaaaatccatcagcaacgcaggagacacaggttc

SEQ ID NO: 35594 - DNA, 201 bp, Bos taurus
aaggagaggaggcctggggtaagcctttctgataaataactatgttgatttccacagcaaaagggagggttagaactgggaagggactgaacaagacgctyagtaaaatgtctttttcatggtggcctccctgcttacctgatgttgtagaaatcatgaagcaataaaaccctttgagaatccatgagccagtcataattt

SEQ ID NO: 35595 - DNA, 201 bp, Bos taurus
gcatgaggatgaaggctgagatggaagtactaaagatgcaagtcaaaaaaattaaaaaaaaataaagataaataaataaataaaaataaataaagcaagtmaaggaacaccaaacactatcaacaaaccaaccaccagagccaggaaggggtaaggaaggattctcatcttcaagtttcagaagaaccatggccctgctga

SEQ ID NO: 35596 - DNA, 201 bp, Bos taurus
atttttaggtgtgatgcattcccaaaggcatcatcttttaagtcacagcctgaattacacacactctcttttaacatcaaactaatagattaaggcagcargaactctaaagtagggtaaagtcagaactgatcattttttatccctgttaactaactgactcaggggaaacttgaaattttcagaattaatgaaccaatt

SEQ ID NO: 35597 - DNA, 201 bp, Bos taurus
gtgtcccctggtgtgtgccaatttcacatccaaataacagatccagtttaggaatctgttgaccattcactgtgcgtaaggcaccatcctaggactttacrtgctattacctgatttaatccccacaatgaccctttaagtgttgatattgtgatttttttttttttttttaaggaactggtaactgagttacatttctaa

SEQ ID NO: 35598 - DNA, 201 bp, Bos taurus
aactgtagtctaattatatttagacatatgtaacaggaaaaatgaaaatttgtttttatgaatatttcagaaaagaaacaaaccaatgtttcttgtataargcttgctgtaacaaaatctaactgcatgccacaccttgaatgataaatcagttcagttcagtcgctcagtagtgtccgactctttgcgaccccatgaatc

SEQ ID NO: 35599 - DNA, 201 bp, Bos taurus
tcataaactttctttttccataattcctggatgccacatgcataatttgggttcattttgataatattctaagttaatatccttaatattggttggaaccygtgattgccaaggtgaactaagtggcttgtagatatattggttagcacaaggaaatgaattgttaacacctttaatgctgttaaatcaaccaccaaaggc

SEQ ID NO: 35600 - DNA, 201 bp, Bos taurus
tgtcacataaggataataatttctaatttcagcaatatacatgattaaatgaatgttctgcatccagaaacaatgagaaattgtagttttaaacacatatrgaagatttcaacaatatcaacaagaaaagaatacatgtatatctgtgtgggagctaattttcaggattagaaataaagagagatctcaaagtcacaatgg

SEQ ID NO: 35601 - DNA, 201 bp, Bos taurus
cacacagacttgtcaagcatttgggtgttttcttcttggctggtgaattgtctttctttgaagggctgttcctttctgctcttgcccccagtaattgcctyagtgattatgcccttatgtctaagtgtttccaacctttactgccaaagaaaagattaggaaaggatagctctagagtttaggttttttgtaattttcttt

SEQ ID NO: 35602 - DNA, 201 bp, Bos taurus
accttaagttattttgccaagtccctgagacttagaccctgatcccacaggagatctgtgcatggttacacctcagccaccagtaccattaccacggtaaytgtaccttcaccctgggacccaggtgctatagcagttccagggtgctttatcccaggatccatgctccacagactctcactgcttgtgtgccaggactgg

SEQ ID NO: 35603 - DNA, 201 bp, Bos taurus
aatcacttgaaaaactagaaaagatataaaaagtaaatgagaattgtggagctgagtcacactgagaataggattatggatagacgaatcataattcctgmtactgcagtatctgaaaatggcctattttctttccatcccatgtttaattgagttactctatgaggttcctaaatacctgtcaacaaattggtctcccat

SEQ ID NO: 35604 - DNA, 201 bp, Bos taurus
tttaaattaatatgagaaattggagaaaacattccttgcaaaacagacatactgtaagaaagagttccaaaatctggataataattttaaaacttccaatyttcatctgctaatgagatttgaatgacatatttatgaaatgagaaaaatctggaatcagaaaagatggtattttagctaaaactcataatttcaacatca

SEQ ID NO: 35605 - DNA, 201 bp, Bos taurus
gtataatatattcagggtatgacatttatttttctctttattattaaaaatacacattttattaagaatcacatattgtcttctctcaattttgaaaacamtgaaatagtttattcaaatgcagtttctccactattttcctatactctccactttaaaaaaaaaaacaaaacactttttatatgaatgtttggagttttt

SEQ ID NO: 35606 - DNA, 201 bp, Bos taurus
taaatataaagaagcatggttttctttatattgtttaaataacttgatagaaataatatcactaaaacctacactaaatcaggttttcagtaacctggaamaaattatgcagctacagctatattgtttttcaattattagtgggtaaaatactatggtaagaatccctcctgaaccatgccaccacttggatacccagct

SEQ ID NO: 35607 - DNA, 201 bp, Bos taurus
catttgaggtggttctgttattcacatgcttgttatcaataatttaagtacttcctttctaagatgcaaactttgtgtagtgtataattcagaaaactctrtaatttaggtctataatgacacaatgctctgatttttaaaaatatataattttattttggaatttcactgggagaaattccggtactttaattattcatt

SEQ ID NO: 35608 - DNA, 201 bp, Bos taurus
ttcttatattaggactcacagagacacagaagaaactgtcaaagaattccttatttatccatatttatgatcatggaatttcaaagattccaatgtcagtygcaatatattaaaatgacttaaacttgccacttttcaaaaatatgaggttcatttcctattaacatgttcaacttaaaaaaattactaaaaataagaatc

SEQ ID NO: 35609 - DNA, 201 bp, Bos taurus
tcagttttttctcaggttataatttattacaaagaattatatataattcccagtgatatagagtaaatcattgttgcttgtacaactcatacaagaagttyatatagctcaatatataaaataggtattttgtatacagggtcttgtatctgtgaatctgatagccctaatttgtctctctctctccctctttctccattt

SEQ ID NO: 35610 - DNA, 201 bp, Bos taurus
cttccgggaggaaggtttctagggcacaaatgttaaggaggttctcataagggcagtacaagtggtggttcagccccctagtgtgaatgcaatcttaaatyttgccccctaagtgcctcactcacatcactctggtctctgcaatagcccatttttggaattacctcactgccttatcaattggcttccaaattttcagtg

SEQ ID NO: 35611 - DNA, 201 bp, Bos taurus
cttctcatcttttaattgtaaatagtgtataaaattttttcactgttgtcttttatttaggattaaccagttttttaaaaaatgtattctcaggaaacacrtgtgtaccataatatgtctcagtacagggttatcagcatatgtggcattgtgatataagagtgaactttcatgttcaagcttatccctttaattacctta

SEQ ID NO: 35612 - DNA, 201 bp, Bos taurus
ttaacaacaacaaaaaaaaagctatacacaatacatattacaacattacaaataaactactctgaacagtgtggggaaaagaagagaactgaaagaaaaayggctctaacgctattgcttgcaccttcctagtgttgacattcttgccgcttttcatttattttcttttccaaatttctgaaaagggattacaaagtaaat

SEQ ID NO: 35613 - DNA, 201 bp, Bos taurus
gactgagaagaataccattcttttcaagggcatatttatctgggaaaatcttctcttaagcaatttgaaaagaaagcttttcattcactgtcttcaaacaygctcagatctacttcatgtagaaaactcctcctctgcttgatttcaaagttctttctaaaaaagtccatctttctttctgtttcttactgccaaacttct

SEQ ID NO: 35614 - DNA, 201 bp, Bos taurus
cacctttaaaactgagatactagagtttcctggtggtccagtagttaggactccatgctttcactgtagtgagccttggttccattcctggtcaggaaackaagatcctgaaagccacatggcaaagccaaaaaaaaaacctgcgataccaatacctgctcctgcctatcacaaagggcagctaggaaagacaaatgaatt

SEQ ID NO: 35615 - DNA, 201 bp, Bos taurus
attgagaagatattgaaaactagggcttgaaattcccgggtagcccagtgggaggaaacagtcttcacaggggcctgatgacagaagcagatcctgctgtyactgcaccctcttcaccacataatgtggccagtcactgaaggacagaaggcaactaaatcagagattacatgttggctgtggggacagaaagggaggcta

SEQ ID NO: 35616 - DNA, 201 bp, Bos taurus
aaggcattgtccagtatcaaaagaaatttaaaaggcaattacttactggcaaaggtacttcctgactttagagacaaaacgttgacagaaccaatcaagamaaagtgttctggtagtgtaggccttcttattgtaaaaccaaaagactggtgttatcttttcccttcatggtttaggagttagcagctttatagataaggg

SEQ ID NO: 35617 - DNA, 201 bp, Bos taurus
ccacagccctcacaatctcctctgggctcttggctccccatcttttgaattctgaggatgcagcttgttggaggatctccggccactgcccctggtgccaycctctctcatcctcaaggcaccacctctcctggggtgctgctgcctatgtgtcaggagcacctgatgatgactcaggcccctcttcccttctgcactatg

SEQ ID NO: 35618 - DNA, 201 bp, Bos taurus
gcttcttggacagaaaggccacattgtcctgaaaatccagatgggtgaattctccaacctgatgatacagagtcagtgtcctcagaacatctgatgcagcyggaccgtctggcccccaaagtccatgtcagtggctttatggtcacaggaaatgatgactgtggggtgaattcctacaagatagtgttttgggggggtttc

SEQ ID NO: 35619 - DNA, 201 bp, Bos taurus
tataaaccaataaattttcaattattttaaaaaataaaatgttgcttgcaatgaagagagtatgtctaatacaaaggttaaaagactggcccagagttgcycagccagtaagagaaaatggctagagcttgaatccggggttgtctggttccaaagcctaggcccttacctttggcccacactatagctacactcatttag

SEQ ID NO: 35620 - DNA, 201 bp, Bos taurus
ttaataccacctgttcattcacacccaattcaaagccactttttccataagtcctttcttgatcacattccccactccagtggaaatctccttcccctctrggtacttatcacgctaacctgtgtgtaaaaagtgttagcaaagaaccacactccttcacttgagacatagtctgatcatgacttttgaagtccaagtaaa

SEQ ID NO: 35621 - DNA, 201 bp, Bos taurus
accgccatactgttctccatagtgactataccaatttgcattcccaccaacagtgcaggagggttcctttctctccacactctctccgacatttgtcgttkgtggattttttgatgatagtcattctggccggtgtgaggtgatacctcactgtagttttgatttgcatttctttagtaactagcaatgttgaacatcttt

SEQ ID NO: 35622 - DNA, 201 bp, Bos taurus
tcaaacaagctgtctctccacatctacagagcttttatgtttcagttgaaaataatctatttcagaacatgtgggtctctcagttcaggtaccattctggstgctaggagaagtctcttttgctctgtttgttcgtttggtattttctggtgtccttgtacttccttggggtcctggaatggtcctatcttattcccatca

SEQ ID NO: 35623 - DNA, 201 bp, Bos taurus
gtaagatattttaaagaggtcattgaatacctgacatggctccaaaccatatctagagcctggggccctggttttccatctctccctgggcctggatcccrctcccataaatgagtcttctggagcctgctcacacgtaggcagccctctgttctcttaccacctatctaatcattccttggcatatctcctatctagcac

SEQ ID NO: 35624 - DNA, 201 bp, Bos taurus
accatagtcaggttgtcttgaggacaagaatcagggctcagtgaggacccgtcaggccctaatgaggatgacaggtcccagtgaggcaaagagtctggccrtagtgaggaacagagtcaggtttcagagaagaccagagtcagtccatagagaggaccagagtcagggcacagtgaggcacaatgtcagtttccagtgagg

SEQ ID NO: 35625 - DNA, 201 bp, Bos taurus
gaagacaaaggcctaaaatcaaagagttccagcagaaaggaaagaaatgaggcattttgccagctgaagccacgtacccaaagggaaaaggattgtaaggkgaaaggtgtttctcagagatgggcccaacgctgcttctgttttctcatagcctcaggctgggtctatcttttagggcattgtgacccagagtgactaact

SEQ ID NO: 35626 - DNA, 201 bp, Bos taurus
gcacttctaattccctttgagaacttttcctttgcattcacaacctggctatctgtttggtacaagaggcctagattttggcctatctcaacttttgacaygtcttcctctctgtgctcaatcattcgtaccttttgatttaaagtgagagatgtgtgactcttcctctcacttgaacacgcagaggccatggtagggtta

SEQ ID NO: 35627 - DNA, 201 bp, Bos taurus
gggaactaaaaatgtagctttgaatttcccccaacacacacacagaaggaagtgagccatcatcggaagcttagaggggagggccctggcccccagcagcygcagaaccctttgctcaagtctgcagagctgctggcaattagaggatctcccccaagtgggggaggggccctcgcctccttccctggtgctgcttttctg

SEQ ID NO: 35628 - DNA, 201 bp, Bos taurus
gacaaatctatgaggaaatcatgtagagatagtcaactatcactacaataataataccatataacaaataaccctgaaatatcagtgacttattaaagccrttgttttttctctttcacaggtctgtatgtgaactgagactctgctgattccatctggttaagacttggttggactcagctgagttttgccccaggacac

SEQ ID NO: 35629 - DNA, 201 bp, Bos taurus
ttgtatagaaagtcacaatcagtgggagaattaaggaaccaatgaaaaaaataacatctcttttccagctcacaaagtcctagagagttgttttgagggcrcaggccactaggactaatgccagacattaagaggattctggtaattcctctagttcagccttcctgtttaccaagcaacttgctggcttccgtgtggctt

SEQ ID NO: 35630 - DNA, 201 bp, Bos taurus
cttaagagtaaagctttgtcagacctcttattgggagggtgataaggcttttgcatttgcctatccacccatccatcctttgtctcaacgtcaaggcctgygccgggtcaaggctttatcgcacgcaaccacacaggactagaggggggacttgacgcaggagtaagatgtggagggaggacctctggatcccccccaccg

SEQ ID NO: 35631 - DNA, 201 bp, Bos taurus
agcttgggttctgcagtcactcaggcctggatttgactctctgaaaggtttccccgctctgtgaaattaggataaaaggacccacctgctgtgggaaacckgcatgctctcaggccacaggtgggagtataccagatgcccaaggtaccggtgtgagtcctcttcacctcagcatttcttctgactcttgatactgtgggt

SEQ ID NO: 35632 - DNA, 201 bp, Bos taurus
tatcaggaaagcaacaaagattacacacattattttataaaccagcacacaaaggtttaaaacagttctgaaaatgaagttagctgtcttgagtcaagggrataaaaaaaaagtcagtattgaccatttacaatctctgacctttgtggagacggtaagaatctgttgtagtgcagctacatacagtacaattcaggcaat

SEQ ID NO: 35633 - DNA, 201 bp, Bos taurus
tgtgccacaagggaagcccaagatggtttaattgctgagtaaatgtacagtgaagtttctagatctatagaaaagcaaatcatggtcttctggtcacttaytgtctaatgtgaatatgacagtgtcgggcttttatcaactacaacactggttgacaaatctcagcaatggctcatcttatgggacgtgtcccagtgctgc

SEQ ID NO: 35634 - DNA, 201 bp, Bos taurus
taagtggggagagagttctggcaggcaagaggccaaagtctgaatctaggtttatgattttgcttttattgtctgctgcttcactgagcctggagttcagwggagttcataattaatcaagatcaaaggattaccaacttgaaacaaacaaaacgacccgctgctgaagaaccctttcttctcctacttttttctccgaaa

SEQ ID NO: 35635 - DNA, 201 bp, Bos taurus
aaggaaggcacgggtcccgcgaggggaggtggggccgccggacagcccctccagcgaagagccctgagctttgttcgcctcgggcccgcgggccgggcacrcactcttgtgcacgcgcgcacacacagatatacacaaagatatacacagagacacacagagatatacacacaagggccccgcagcgcgctgccccgcagg

SEQ ID NO: 35636 - DNA, 201 bp, Bos taurus
ggcctggaacaccacgcccgtcaccacccgggagaacacagcctcctccccatgctctaccggttcactgcagggagccccggccacagaaccgaccctcrgtgaacccagatttagaggcagaccgtgctcctgtgacctccaaccctcacagcactggagggcagggcaagacttacgggggcatctcgggagcctgct

SEQ ID NO: 35637 - DNA, 201 bp, Bos taurus
gtgccttacaacccaccccataaaatcaatcaagtagcagaagattttatatgcttctcatttattttccaaaatacattctgtgagtgccaactgtgtgstgggcctgggaaagagtggcaagtgcagtgtagaagggcaatacatttctctggacttcccttatgtgtttttaagggaattaagtgaactgaaagggaa

SEQ ID NO: 35638 - DNA, 201 bp, Bos taurus
agaggacattattttattagcgggtaactaacttgttggtcagttctgctctgcactgtcagctctgctttcaggacttgctcactggttttaccctttgycatctggtttgctgtcatggtgttgatacctggatcactgtgggtgctacaagagtgcagttctgtgaccaggagcttcagtcacctgggagcttgctgg

SEQ ID NO: 35639 - DNA, 201 bp, Bos taurus
gaagaatccaggaagtggggggtgcgacagtaatgggagacttgcctgaaatcaagacgactgagtatgaagacctgggacggacaggaggaaaaggagcrggaagaacgaggccaccacgcatggtagaaccacctcgtgatttcgtcagtgcagtaaaagctcagacagagggctctgcagcagggccgctgtgcctct

SEQ ID NO: 35640 - DNA, 201 bp, Bos taurus
aagtaattctctaaggtgaggggtgggccagggttcaaaaccaggttatcaaactctgaagttcacacttttaatggcaatgtctttgatgattattagayagggccatgggtttcttgcttgataacagaggagactgaaatggagtgtgtacttcttgcccatttgagggatggcatgggacacaggataaagatgggc

SEQ ID NO: 35641 - DNA, 201 bp, Bos taurus
atggggatagggaggaaaaacccagacccaaggaaagggctgagcagggccctggggcatagccttcgatggaagccaagttttatttagctagtccctcrtgtgaagagccagcccaccttatggccagccgaaagcagcacaagcatttctgctcaaactgcccaccgtcccctcatcagctcatgctcagcccctctc

SEQ ID NO: 35642 - DNA, 201 bp, Bos taurus
aggacagaggcttaggcctggaccaccagagaaaccagtgtcttgaaccagcccgtctccacacagaaggaaaagtgctctggaggcaaacaagccacttyaactgctctggcccagatattatgcaggtcacatttgtttacaattccttggccagaactagtcacatggcttcacaaaccacaagatgcctttgaagag

SEQ ID NO: 35643 - DNA, 201 bp, Bos taurus
ccagggaattccctcacttcagcttcagaacctggtctgggcactcctgcatttctcttctcagaagcctgctctgcttaccatcatccagatatccatgrggccaacatgggcagtgttgccagttccagaattgtggataacagagacctgggtctattatcaacctgaccccaaatcacaggcacaaatattatgaat

SEQ ID NO: 35644 - DNA, 201 bp, Bos taurus
gatagtaaatgaagtagaatcagagaaggaaggctcagcaaagggtctcactgcttctgctacagggagcccagtagcaccttttagatggcatttcataycttcatcttgctcttttaacacaactacgatagattacataaatcaattatttttgtttgttgtgggctcctggaatcaaagtaaactgaatgataatta

SEQ ID NO: 35645 - DNA, 201 bp, Bos taurus
agatgtttgctctctccacggggacctgagcaggcctgaagtcgctgcatttagtgttgctcgcagaggcatgcagagagactcagcattttgagcagagrgtggcccaaggggtgagtggactcaaaatcctagaactcacattctggaaggaacttgttaggaatcacggatgtttaacctagggagaagaggggagac

SEQ ID NO: 35646 - DNA, 201 bp, Bos taurus
cactgctgccacgcacacttaggccccctcactgtcctccgtctgcagggcaaacactcatgagtccagaaagccaccttaggctcagtgctcccaagatrctttcggatgagtgctgtgtggccacgtggaggcacgctctgtactcatgataaaacaaggtattgagttgcccggggcatatttagggctttttttttt

SEQ ID NO: 35647 - DNA, 201 bp, Bos taurus
tcgggctagggcgcagccgaggctggtgggccaggagcgggagacggagggcctccgtctgcaggtgctggaggtggtggctgctgctgcggcggaggggratacatgccgttaggtgccgtgaggggtacccggggtcctaagatgtttcctgggattggaggcataccaggaggggtggggccactcccaggggggtgg

SEQ ID NO: 35648 - DNA, 201 bp, Bos taurus
atacattgtgcaaataataggtccttaaaagcacagaggacaaagatatggagatcttagcaaaggctctgagagaccatgggactttagatttgaaggamagttgagagatatcaatagggaaagaacacagcagataggagggtccttccaaacaaagctcagcaggaaaacttgatctagtgcattccatcatgaaga

SEQ ID NO: 35649 - DNA, 201 bp, Bos taurus
atttttcaggcaagaatactggagtgggttgccatttcctactccagaaaatcttcctgacccaggaattgaaactgcatctcctgaatttaccactgagygaccagggaagccccagaagttaatgggaatggtcatgttaatcggggatagtatgacagtcaaaagagcactggatcagaagtttgcaaattaagaaat

SEQ ID NO: 35650 - DNA, 201 bp, Bos taurus
gcatgaagtgcctacagcagcagagatacaaaatgcctgtggcaacagagaccagtaggtggttgcaaggacaggtgcatcaagcactcccccagggaagytggcctcagctatggaatcctgggcagtggcaggctgtgcaggctccctgtgaggtgtgggccatgtgtggcatttgctcataggataatggcagcagca

SEQ ID NO: 35651 - DNA, 201 bp, Bos taurus
acgttgcaaaacagctctctacttgctgctctgggcttcaaagggatattatgttttaatgcactgctgtataattcatcagccctcacccctcccagtcraaattactgatggaaataagcaaacaccccaaatttgctatttccctttcccaatgccaacagtgaggaaatgttcccatgtaaatcaaagctgggtgtg

SEQ ID NO: 35652 - DNA, 201 bp, Bos taurus
cctagattcatcgtgctttctggacccctttccagcctccacccactcccatctgaacacgccttgctctgaagcttgcaagattacacagagctctgccktggcctgccctgcaccgcaagccccagacgcccagtctgttgtcatctccaccttgccttcatggcttccctcatccctgcagggctggtcttgacactt

SEQ ID NO: 35653 - DNA, 201 bp, Bos taurus
gaagctaaatgatgccatctgttgaggttgctcttccaaggcatggaacaaggaaggcagagaattgcagagagtggatgggggcaggcagctcatggagratggcccgcccactctctgccccactatcaacagggagaacatctccacccagggcaaaactttgagaaagttctagaaagagtcctggttccccagtga

SEQ ID NO: 35654 - DNA, 201 bp, Bos taurus
gggcctcccttcttccagcctgccacttccagagatgcccacagcttcctcatagagctaaaatcagagatgttttccagggctccctccctcaccccccmatcctggcccaaattatctattttgaaaacattgggcttcttctttagtacagtcttccatgaagcaggtgtcagactgtcgcagcgacccgcagtgcca

SEQ ID NO: 35655 - DNA, 201 bp, Bos taurus
catctcgggccaagtagtcagattccaaactgttctgagttttcgtgccaggtacccgggaggggtccgggtataggggaaggcctttaacacccgtcgaytctttaaagtgctctacagttattacaggagaggaaatgggctctctctggagacctagaaaagcacaaaatgcagaattaatgcactggtccattcaac

SEQ ID NO: 35656 - DNA, 201 bp, Bos taurus
cacagttccttgtaatttgattctatgtataaattagtctaaataccacaacaataatacacaactgttctatcagacaaaaatcttccctgtacacccastccttactcttctcctaatctaattttgtcattttgagaatatcattaaagtgggcttctaactaagcttcgttaaaggctgatggaggaagagaagggt

SEQ ID NO: 35657 - DNA, 201 bp, Bos taurus
gttaattcataccacaatcctatgaagccaggtgatattcttccctgtaagacaattactctctgaagaaaacagaggcttaaagagattagattcaaccraggacttctttaaaagaaaaaaaaaaaaaacacctaagtccaatacttaaacagagaggcttggaaattatttcaaaaaccgttttaagatagttggcaa

SEQ ID NO: 35658 - DNA, 201 bp, Bos taurus
tattcactcactgtcttcatcctgagtcctatagttgtccttggacaactccctctcccactcttctcagtgactaacccaaaccctcagctgcctcctcrcccccatcctcaccacaaccctcaaaagacaatcctgcttcctcattccataaaaccgagaccatctgccccgactacctttaaattcctatctccccat

SEQ ID NO: 35659 - DNA, 201 bp, Bos taurus
tattgtattgaagtattaattacatatgataaaatgcacagatcttaagtccttagttcagtgaggtgttttttcttaaggggttcacttttaaaaattgyttctttttattttatttttaaaattttctttctctttgttgtttgttgttgtcgtttagtcactaagtcatgtccaactctttcgcaaccccatggactg

SEQ ID NO: 35660 - DNA, 201 bp, Bos taurus
ggcacagatgaaggctgcttgattgagatcctggcctcccggacacccgaggagatccggcgcataaaccagacctaccagctgcgtatgtagcatcttcmggggccttggtggaggccctgtcctctgagaagtagactggagtgggagtttacccactgaaacactgaccacgagggagcctcagctacaagctcctct

SEQ ID NO: 35661 - DNA, 201 bp, Bos taurus
tgcagtgggttgagttaatcaagaacaagtgaccagggtcctcacagtgctaccaagaggctgctccttctctgctcacggccatagactgtgagacgtgrcacgtaaactatgtgtgagatcctgaaagcgccaaagaaaaacaagacttgagctgtctgctggcaggaattctaggaaatacagcaggccaggaatggg

SEQ ID NO: 35662 - DNA, 201 bp, Bos taurus
acatggaagaacttggtggggtgaaggcagagtcaacagtttgctgccaagagtatggaattcaggaggatggcggggagtgactgaggccaggcagaaamggttttacagaaacaggaatcaacagagggaataaggaatcaataataatgttattattaatcatggttaacatggaccaaatgctcaccatgtgcaggg

SEQ ID NO: 35663 - DNA, 201 bp, Bos taurus
atctttttttatcagtgaagttacagcttttccgaaagctccacctagtagacactcactgccaccttgtgaaccaggtgctctggtggccatcttatccrtcaagaagcccagggaaatcaagttttgcagctggacagccaaactggaattctaccaataagaaaaaagagcgaaaggctaggttcaggcaactcttgg

SEQ ID NO: 35664 - DNA, 201 bp, Bos taurus
tgtacttctgggccagtgaattctcacagagtctcagtgctagggaggcagtgttatctgctggtgaatgactttaccaagtgatagcacgtgaagtcctycagtggccctttcgtggtgatcttcggatttacctgactcagttttccaatttgcaagtcgattttcttctttcctgattctcccttttcctgctactcc

SEQ ID NO: 35665 - DNA, 201 bp, Bos taurus
cccctagctggtgcctggctatttctgtctctagagccctgactccttcttggactttaaggtgtgttgctttattcctggaaagatagaactgtggcccygggatggctgtttaatggtgaaaggggctgcaagatggctggaagtcttttctgtcctttgagttaaaatgggatgtaaggccaagggaaatggagagaa

SEQ ID NO: 35666 - DNA, 201 bp, Bos taurus
gctaagctcgtttcctgtgtttcctgcggctgaggcagttgtgctggtggttccatacttcctgaaggtctccagctagtgaatggcagatacacagacayagcacttgaacccagacacagcacttgaacccaagatggcctgactccagaatgactaaactcaactgtcaaccagcctcaggtcttcattcagctggca

SEQ ID NO: 35667 - DNA, 201 bp, Bos taurus
cctcctgataatagtagtgacataatataataacagctattactatctccgtcttacaagtgagtgacttgagagccaagaaggttaataagcaggggaartgagattcaagtccaagaaatccactccagggcttggggtttccaaccacaggactacgctgcttctcactaaagggacagaatagcagacattcctttc

SEQ ID NO: 35668 - DNA, 201 bp, Bos taurus
atggaatcagagatatagggcagcctccgtctttctggcttgtcctcagtctggcttctttttggttgccagggttgaatgttgcttgggtttgcctaatyatactctgaatgggcctcactggcttgggggccagttctgcagtgatggcatgtgacgtctcctggatgcttttcctgggtggtggcaatggcttggagc

SEQ ID NO: 35669 - DNA, 201 bp, Bos taurus
tgaatcataaggccttcaagggaaggaatcatgctgttgatgtttcttttagaacatccctaatatgctgaattgcatactattggtgcctaataagtgcrtggtaaccggccagtgctaaatcattggcactttgttattgtatcagtcctcaaagtcaaatggctgcagtggagattatagtcagagccaggggacctc

SEQ ID NO: 35670 - DNA, 201 bp, Bos taurus
gcctttccccagatggttgccccagccctgccctgcttctgcttctctccacttggtcagcagaggtgaactaacacagcagtcctctagcccagcagccyggggccaggcctcacatacatacacgaggagttctgagggtgcggaggcccttcctcaggctgagggccttggaataaagggagcagctgctggaaaata

SEQ ID NO: 35671 - DNA, 201 bp, Bos taurus
taggtaatatttacttaacatggcctgctggggccaagctgactctgcattgactccagccagcccgtagctcacctcgctcacctgcctgccgcggtcayctgcccagtggccaaggctccggggagctggaaggctccttgtttacaggacaagcacagataaggtttctcacagccccacctgagctcctgtgccaag

SEQ ID NO: 35672 - DNA, 201 bp, Bos taurus
catgactcttttagtcttagaaactagcttctgttctaaggaagcctggtttccccatcttgcacctggttctcagccccacatagctaggctccagcagytggccctaaagggaggtgcaaacacaggctccaacttgcagcttacccatgatctggacatgggctttggatcagctcagcctgcagggctttgtttaat

SEQ ID NO: 35673 - DNA, 201 bp, Bos taurus
gggttaaagatggcaccttacataatgaacttggccttgaagtctcctctagcaatagggacccgggcaaaagaagcaccttccccagttcatccatagtyattcaggccctgcctgaggagaggccaaatgaaaactcaggccatgtcaagtgacagagactgactgtctctaagccccaggggagccttgtggctgtga

SEQ ID NO: 35674 - DNA, 201 bp, Bos taurus
cttgctttggggagccttgaagaagcagagacagactccatggtagctctgcaatacccagctgggtggtccatccctggccaggacatcgtggtgggccyggcaggaagcagtttccctctggctcccatggggtaacgctgacatctgaagtaagtcagagcagcatggtggccccaggcagctgcctgcctcctgccc

SEQ ID NO: 35675 - DNA, 201 bp, Bos taurus
ttaatatattcccagtaaaccctgaatggtttcctcatctgttaagtaagtttggatgacatcatcgctaaggttatcttcccatccacacgtttggcctrtggttcaaagtctccatccgtccatctctcccgcctgtaggacccagatgtgatcaacaccgctttgccggtagaatacgggcccctcgtggaagaggag

SEQ ID NO: 35676 - DNA, 201 bp, Bos taurus
gcagagccactttggtgaagacaataaaataggacttgaagtttatgaagttcggtcttgtgtgttaactttgtaagtatgtaacttgatcgtgaaaaaayaaatttttcctttaagtcaattttaaaggtttactccattcttaaataggccttttttagactgtctgaaataaaacttctttccaaaagaatttaaaat

SEQ ID NO: 35677 - DNA, 201 bp, Bos taurus
caaggggagcagatggccgaagtggaagcacagacaggggccattgtgggtcttgtttgggaagtggctccattttctaggagcagagtcgtgtatctaargtgatacagggaggtgggcctccggtctggactttcttcggtgggacatggggaccagggaaaggtttcaagcagtcttgacaagattggaattccttcc

SEQ ID NO: 35678 - DNA, 201 bp, Bos taurus
gcaccaggaggcctcagtccgctagcctgaactccacccataacaccctgtacggtttctgccaagtctgtcatctgtcacctgtgttgaagggactagcycaaggcctcctacacaaagttcctcagcactggctgggactcccctctggctcagccagtccaagaaccagacaggggcagagccggaggcgcaggggac

SEQ ID NO: 35679 - DNA, 201 bp, Bos taurus
ctgtggtggctccccggtggctctgggccatggacagggcgggcaatgcgtggagccacacatgaagggtggcagggcacttccttctgccccactggacygcccaccatggcctgccctggagagtgcccagtcaggcagggcctccaccaggcactgggcacctttgtgtgaatgtgagtaaagcatccctctgtgcag

SEQ ID NO: 35680 - DNA, 201 bp, Bos taurus
tcagaccacttggccacaactggataatcacacagggtaccggggtgctttagaacaggaagatgaaaccactggtccatctgaaaattccccaggaagtrgcctacaaagtccactgcctggctcctacccgggtagaggccgagttacattaaacccttcccatctcccgatcacctgacctgtccccaggaggccagc

SEQ ID NO: 35681 - DNA, 201 bp, Bos taurus
tgcttttttggctacaccccaagctgaggtaccattagatcaatgtcactcaaactcctggagagccacattcccacagcaaaaagtcccaaactaagttmtttcgaaaagcattcctatcagtgatgaggcagtagatgccctcaagccaatcatccatgtaatctggcatttcaggagcttcatttgcccagccaaaaa

SEQ ID NO: 35682 - DNA, 201 bp, Bos taurus
cccagcttgtggaggagagaaaggtacagcaaccacagtggaagagctaacctttcacaggtgaggctagagttatctggatgggcaggcagcctgacccrggcggtcatttggttggggtccagcagtgtttcctctgttatctgccaggcagttttctgttgaggagctggaggacctggggcatcaggaatgggcagg

SEQ ID NO: 35683 - DNA, 201 bp, Bos taurus
aaacaaacctcggtttggcccaagggccccccactataacaaatccgagactgggagtcagacagactacaggaaataggagaaaaggcgggggcggagcrgggccgtgggggcccggcctgaggcagcctgcaacagagaaaagagaggaatcagggttgcaaactcagcccttcttctggtcttttagccaggggccgg

SEQ ID NO: 35684 - DNA, 201 bp, Bos taurus
ctcctcccgccttcaatttcattaactgtagggcagtgattatccactctgttattgtgagggtcaaaagaggcagaatgaaggcccagactttggaaggsaggggcactttttggacacctgcctgaatcattcacttagccgtgagatcaagtgatgctgcatctccaagtctcagtatccttcgctgcacaaggagga

SEQ ID NO: 35685 - DNA, 201 bp, Bos taurus
acaaaaaggagactgtgctcggtccctcagtctcatgacagccccaggtcatcaacccccaaccttctgagaactgtccttatgggcccatgagcaccacrccctctgacatcagagcagaaccccctctgcctgccctgtctgggttaacaacactcctgttctcccaggcagaagcccaggagtgactatttgaccctg

SEQ ID NO: 35686 - DNA, 201 bp, Bos taurus
cagattccctggtccccaagccaggccccacccctagtgcccagggttcccgcgtgaacaaatgttccactgagaaaggagagagaacaaagggacgggaytggcctgccaagcgccccagcccagcctcccaggctcccacccaagggctccatctcacagggcctaaggtcactctgagcctttcatctgtccctccca

SEQ ID NO: 35687 - DNA, 201 bp, Bos taurus
aggagagctgttgtctcagcctcactctgggcccatcccacatggcaagctgtgtctgcaatcccagagctgttggcacagggagcacggactcaacctcyccaccaggctcaggccaccaaggaccatcgcagcccccaagctgtaccctccccagtgagagctctgcccttgccttctctgcctcctggctgcgtgact

SEQ ID NO: 35688 - DNA, 201 bp, Bos taurus
aaggcctcttcaaggcactaaagtcactttagctgatgaaaacctattatgttgggggaaaaaaaaatgggagggttggggttgaaataagagactatctrgagaaattctggtgctcctggccagcctataatgcctcactcttcccaattgtatctacctggaaatgtcacaccaaaatccagccttgaccaggaagtg

SEQ ID NO: 35689 - DNA, 201 bp, Bos taurus
atttttgccagaattgtggcaacctaaaacagagaacacagtacttcaaaagactcttgagacatgctatgaaaagccagagccttcaggccaccctctcyttgtccctattcctcccgagtagtccttagtaaccaaattctgtagcaagaaaaaaaaattttttttgactgtgccacacagcctgtgggacctcagttc

SEQ ID NO: 35690 - DNA, 201 bp, Bos taurus
ccaaaaacaattgcttgaacttatcactgtgagagattctggtaactaaggaatccctgaaagaggagtaagctgtgattcttggaaagctcagaacaccrgaaaggcttaattgcaaagtattgaacaaaaggccacaaattttgctttcctaagaggagctgggaactagagatatcattgaatagtgcattgaaatgg

SEQ ID NO: 35691 - DNA, 201 bp, Bos taurus
ctgcactgggtctttgttgctgtgtgcaggctttctctagttgctgccagcgggagctgctttttgtttcgctgtgacggtttctcatttcggtggcctcytttgttgctcatgtggaatcttcctagaccaaggattgaacctgtgtcccctgctctggcaggtggattcctaaccattgggccactagagaagtctgtg

SEQ ID NO: 35692 - DNA, 201 bp, Bos taurus
agaagaaggttcagagaggcctccactgaggatggggtgggagtgatggacctgggctgtgagaaactctctgtgtcctcctggctcctgtggccacgacrgagccaggttccatgacaggcagagctcccttgggtcttgccagtatgtgctgctcctctgagccctgtcccctgccctggcctagaaacgccgtgagcg

SEQ ID NO: 35693 - DNA, 201 bp, Bos taurus
ccctgttatcagcaattccattttcatccctatgaggacttgtcatgcttgtctagatcattattttgagtttcaactgtataatgctgtcaactgctttrtaattatacaaatacgattaaaagtccttgagagcagagattctaccttttatttctgcaatgctggattcttaataaatatttgtaggattgaaatgaa

SEQ ID NO: 35694 - DNA, 201 bp, Bos taurus
gacaggagagaggactctgggtcaggccacagcagctgtgcaggagccattcttgggtgtggtgtaaagtaggagtctaggtttcctaaggacacttcacyggccttactccctaattaataacatttttttttaatgaatgtttattaagtgcctaccatgctccaggtatcatgttgaacattcgattcagattctctc

SEQ ID NO: 35695 - DNA, 201 bp, Bos taurus
tgaccccaccggtggcccttttagctactccactggctaaaaggaaattggaagggtcaaggtcctgcttccaaagtcttggggcccaactccaatcaccmcaggaaggctgggcagggaggcatgtagagcctctctcgggagtgggcacgggggacctctctggctctctctgcctcaaggccacttccggccaatcag

SEQ ID NO: 35696 - DNA, 201 bp, Bos taurus
gacccgcctggttcgggcgtgtctgatgccctaggagagcccccataggaggcttatgcctttccttgttgcagcatcatttgccaagacaggtgggaaakgcagggttgcgtctcaacagggggcctcccttcgcttcctcgtcagtgtgagctccccttccctcttctgttcctgccttgtctctcaaggcaccgcatc

SEQ ID NO: 35697 - DNA, 201 bp, Bos taurus
aatcatgggaaagacacagctcagattctctccagggttcaagctttcctggcggccaaaagtttgcaaaagctgggccaaagctgggtctgcagcttttmaactgtagtgtgagaggcaatactagcagatgagttagagagatgacagctgcccgccttgtccatcatcgtggcctcccctggacctagaccttctctg

SEQ ID NO: 35698 - DNA, 201 bp, Bos taurus
cacctcaattcctttaatttcgtttaataaattattcagtttaatctgttaaattcaatctgatttaagaatcacatgaggaaacaaggtgatagaaaaayacctataatgcacttaatatatagaaagagtaaaaaaggaaatctataaaacactcttcttcctttgttactctggagtcaggcagaggtacagggccag

SEQ ID NO: 35699 - DNA, 201 bp, Bos taurus
aagctggttttacataaatgtaatgggtccaagcccttaacgtcagcaagatataatagctacaacaacaacaaaaataacaataactatttttatacccrttatgggccttggttcggatgctggctccaccactcaccggggcagaatgggtatatttgacaagttatttaacctcccccagcttcaattttctccttt

SEQ ID NO: 35700 - DNA, 201 bp, Bos taurus
ccccatccagacaacttccttggttcagggtctccccgaccggaacacttcttaagcccaagtcccgccccttccggttcagagccggaagtgccttggaytttcgcctttcaaccttccggcctcgttaagtatctcagacctattttgctctggagtcttatttgtaagagtagctacgtcagcacgtttcggcgtgag

SEQ ID NO: 35701 - DNA, 201 bp, Bos taurus
tctgctctcttgaaatttgggacggttttatctatgaatttgtgtttggtaagtgcagtctatgggacagcagagctgaaactaacaagaggcccctggaygcttctcaccatggctcacagcctcatgtgagccatgaggacacgagggagggcaggttctcagcttcctactccctacttcttgccatcctatgcccca

SEQ ID NO: 35702 - DNA, 201 bp, Bos taurus
taaatcaatggggtggggctgctgccctggtcttgggctgaggagacaattggttctcaccaatcatcggggactcgatgaaactccatgtgttggtctgkgggacgtaagactggaggacgcccgcagctcggcctgcctcgttcacgcccccaaacacatagatcttcccaccacacacggtggctgctgctgagtgca

SEQ ID NO: 35703 - DNA, 201 bp, Bos taurus
caggatggtgaaagtggggttcccaagggcctggtgggagcccaaggcagatgatctgggagcagccaggggtcaggggttttggagggaaggtggccccytcaaggagctagaacttggttagaatttccttagggaggtggacactgggaggagccttggtccttgggatgaggggaggacaagattgggtctggccgc

SEQ ID NO: 35704 - DNA, 201 bp, Bos taurus
gaaaaggaaattctgccaccatcacaaatctgaaggactgtcatggagaacaggagccagctttgctctgatgggcccagagggcagaccatggaagttayaggaagacagctcttgaccatttaacatcataaaccatctagctgtgagtggccgcagcttagtccccagcggtggagggaaaattcttgcttctgctgg

SEQ ID NO: 35705 - DNA, 201 bp, Bos taurus
cccgccgaaaggacccagggaggagtcagcggatggcaaccctgagtaaggtgctcaccagagcctgattgtgctggcctcctaatctcagccttccactytgcagaaccacgagcaataaatacctgctgtttataagccgcccaggttacggtttttcattagggccgtctgagctaagacatacacacgcacctccca

SEQ ID NO: 35706 - DNA, 201 bp, Bos taurus
gagttgccgcctcagacgctggaataaccctgcatgactggccagctcctatcttattctccctctaaaacagaagatgcgctgatggctgtcagacttasagcccctctgccagccctggccggcactcagcactctgccaggggctgtgaggggtacagagatgctctcaagaagcccccatctgtaggggttggacca

SEQ ID NO: 35707 - DNA, 201 bp, Bos taurus
cacgtggagctgccacgggggcaagttttcagggactcctgggtctacttggcttttatccttgtcaagacttcccgagaggccacacagaagctgcagcmgcaacctagagatctttgcattgcatccgattctgaggtcccgggagaggctatgggtccagagtccggccacgcccccctcagtgccccagtccagccc

SEQ ID NO: 35708 - DNA, 201 bp, Bos taurus
ctgaggctaagtcaaagggattaacccctttcccccagccctgaccttccatgtaagaaatgcaccctcctgggtcaccacacagtgagaagagaggccayacacaaaggctgcagcagacagcccagcagagttggtgggtagccagcctccatgccagccactggagagatgtccctggctgattctagggcccgcagt

SEQ ID NO: 35709 - DNA, 201 bp, Bos taurus
cctcctgcagagcctgcaacatgagtgctggtgcccaggccatctctctcagcagcactgaagggcaaggacatgtcctacccagccagcctcttccccayaggactgatattacaggccactcagggagggctgtcctagtgctgggattctgggcacacttgtgagaaaggtgagtgaatttatgaagcaggaaaggtc

SEQ ID NO: 35710 - DNA, 201 bp, Bos taurus
ggttacctgaggctggaagctctgacaggcaaaggcagagctggagaaggatgtcctcttcctgctcggagccacatgacggcctcggcctccctgggcgrtgttctcctgtcaaatgtaggagccgggaccagagaagacattctgccactgttcagccgatccatgcagcatccatcaccaagcatcgagagcctttgg

SEQ ID NO: 35711 - DNA, 201 bp, Bos taurus
caggctgtttttctggagctctctagaggacgtgcaaagttcagtgtgtgctccaccaagtagtacacttttatcaaatgtctgttaggggctaggccccragctaagtggagaggtgataggatgtacttggtccctgctctaaatttagaaggaaactgtcactcttccaggcctcccagccttcatctacaaccatgc

SEQ ID NO: 35712 - DNA, 201 bp, Bos taurus
ttccaacccccctaatctgatggggttttctcagtgatgttatggagtcatagaggtgacagtcacaaactgggccacctcccagtggcctttttccctcraagggttggtggcagaggaagatcagccccttttcagtgtgtgcacttacctggtttaatttggagatagcagaggacagaggagcatggcatgctacag

SEQ ID NO: 35713 - DNA, 201 bp, Bos taurus
agctttgtactatagtctgaagtcagggagcatgattcctccagctccattcttctttctcatgagtgttttggctacttgagtattaggggtcttctgcrtttccatacaaatttaaaatttttttgctctatttctgtgaaaaatactactggtagtttgatatggatttcaatgaatatactcaagttcagtgaatgt

SEQ ID NO: 35714 - DNA, 201 bp, Bos taurus
gtaattagcctccaattaaataaacttataataaaaaaaccaactttttgataaaaagtatctacttaacccagaaagaaatgtattgtgagaaagtcagygtgactgcagacctccttactaaattaaccggtaatgtccatttctcataaaaaggtttatattttatttatacttgatagttcagtagatctaacataa

SEQ ID NO: 35715 - DNA, 201 bp, Bos taurus
ataaatatttcttaaatgacaataatcaaataatggagatctagaattggtggtacattttcaaaattgctatttgttaattgtatagtgggcttgaattraattttaatgggcttgaattgaaagtagtccaaagtgagtgtttttttccatagtaaagtatgttctaatcattaccacagtagttcatatttggtaatg

SEQ ID NO: 35716 - DNA, 201 bp, Bos taurus
tgagtcaccatattgaatcaaagttacaaggttgatttctggaggcatgtgcagaattttacacttgtatgtgctattccttttaaaaccacttttatctygcagaatgtagtgtggcaagttagcttacaaaacaatacgagtttgtcttatatctgctcaatcagtgtcaaacctcaaaaatcccaaataactgggaaa

SEQ ID NO: 35717 - DNA, 201 bp, Bos taurus
agtgtaagagtaattatggatttgttaatggattggctaccagaactagggagagagatccgtctcagagagttcttatctctgtgttgggcgactggatmtttcatccagatctttcactgtccagattcaatgtatgcttgagcttttgggaaaacccaggtcagagggcctgccaccagatttctgtccagaagcaag

SEQ ID NO: 35718 - DNA, 201 bp, Bos taurus
tcgtgatgttttttcgtgaccacccaaaggctgaaaggaaccagttagtgcatcttccagtgatctgttccctaggacctacaaaccaaaacagataaacyggttttcaaaggccattctccagtgacaagacagataaactggtgtcctgaggccatgctccacttgagaaactgcatcaaaatcggaagtgctgattca

SEQ ID NO: 35719 - DNA, 201 bp, Bos taurus
tgagtctcctctgttaaactgtgagctccttgaaggctaacattatgtggtattattcagctcagtaccacaaagcctggcccattacaggtgctctgtgrctgctttaagaataaaagaatgagatggatggatggatggatggatggatggatggatagatggatgatggatacaaggatggaatacaggccttcaggc

SEQ ID NO: 35720 - DNA, 201 bp, Bos taurus
ttctccagtaaaagtcctcagcattgttggatgtgctctgggtcccagaatggaaattattgttccttcttggtatttaaaatacacacaccacacaaacrgaaatcaagaccctagcacttctctggcacctcttgctccttttaactagagctctttatgatggagacacactattggcacctccagccttgttaacag

SEQ ID NO: 35721 - DNA, 201 bp, Bos taurus
ttctgaactaccagagaagcctgaatcctcaaatcatatagtctaaattcattataatttgtgaatacagaacaaagggtagtgaagtaaaacttttgacyaagtgttactaattaaatatttgcaacatgtcagacatttcatttatagaaaaatacagtattgaagtatttatataaaacaattttaaatataaaatta

SEQ ID NO: 35722 - DNA, 201 bp, Bos taurus
ataggaatccctctgttggctctagggtaaaatccttcttgacttcttctagcttctgatggcctaaggaattctttggtgtccttagctgtggccacaaygctccaatctctgactccatcttcatatctgttcttctctaaggatacctaccattgcatttaggggccacctagacaatctaggataaaatcttcacct

SEQ ID NO: 35723 - DNA, 201 bp, Bos taurus
tctttctccgtggctatacatggcgcacatggattggacaggcaccattaagcagccatgccctgggcagttgtattcctagtaattgtcgtgtcactgtycacagcaaggttcactttcctctggatcctgacagagattggctctcataacaaaaaggggagttaagcctttttaaccctgcatctcaaaagagcagag

SEQ ID NO: 35724 - DNA, 201 bp, Bos taurus
taaaggtcatttagatcaagagcctcaacttatgactacatctaaaaaataaaaaaatggcttgactgatatcccactctcagacaatggtagagctgatrattgtctataagtctatgcctccatcatcgcacatacagaccacggcacgtagcatagggcactactataaatattcaaaacaaattttaaggaaagaat

SEQ ID NO: 35725 - DNA, 201 bp, Bos taurus
gggagtcttcagggccctctgtgcccacactgatgcctatcgggaagatgaatgaagagtagtggacaggacttacctgggacgggacccactgccagccmacctgctccaaggccaaaaacagtgaggaccacttcagaatgcaggccttcttgccttgccagagcttttatttcacagagcatcccacagtgcaattcc

SEQ ID NO: 35726 - DNA, 201 bp, Bos taurus
caaacttaattaccgcctttactactaagggctctgtatttgccgattttcctactcactgaaatttatttgcaacccacaaatgcacccccaaatcaatrttctcagggcctcttgggatcactggtggacatgcccaatgtggggaaaagccaagccctcttctcaatccccctgctgacactcacattcccagcaaaa

SEQ ID NO: 35727 - DNA, 201 bp, Bos taurus
agaggcctgagttgttataccttatctctcctccatgtcacctcttaatctccaacaggttaacctgggcatttgctcatggaggaagcaagattcagagrtagcacacggaaatgcacaggcccttttgaggcctgggctcagaactggcatactatcacttctgctgcatcttattggctaaagcaaatcacaaggcag

SEQ ID NO: 35728 - DNA, 201 bp, Bos taurus
ttcctatctggaaagtcctgccatccccccgagggtccctagacaaaaaaaaaaaaaaaccaaactggccagccgggccagctatctcctgcttcttcctygccagctgcctctctccctgccatttgttccacccaaaaccaattcggaccatttgctccagccagtcaggccccaaatgggacctcagaactttccctt

SEQ ID NO: 35729 - DNA, 201 bp, Bos taurus
ctgcgaactcaccccaaggatggggtccttgcctgcccaacactaccacccagaaatagctcccagcccctcatgccagggccggggctgcacttactgcycaggattcctaaaagtgccttgacatctggaaaactgccttctgctcccttactttaagaagagaggcttaggccatcccaagatcagattcaatctaac

SEQ ID NO: 35730 - DNA, 201 bp, Bos taurus
ggagagatggcagagccagacgctggggtcggccgtaggggcaggagtggacacttttcttttgatcccactccagccgcatttcacagtcctttggggcyagggtgagctgggtgttccagcagggccacatctctgtgcctgattcatctttggagagctggttattgtaccgtttgatcgcatctgcatgcgacccct

SEQ ID NO: 35731 - DNA, 201 bp, Bos taurus
tgctttaaagaaagaaaccaacacaaagctttgctcagctacttatgaatcaacccagttctgacttgcattattgatttgttgcgtgaccttgaggtccytcagcctaagtttttgcttctataacatggggagaaatacaagcataccttggagatgctgagggtccctcaccacaccaccacaataaagccaatatca

SEQ ID NO: 35732 - DNA, 201 bp, Bos taurus
agtattggagtttcagctttagcatcagtccttccaatgaacacccaggactgatctcctttagaatggattggttgtagaaagtggtaataaagttccartgaaggaaagaagtcaatgggccattggaacagaacagaaccagcctgagaggagttagaatttgttaccataaaaaggtagaaattgagatggagggtg

SEQ ID NO: 35733 - DNA, 201 bp, Bos taurus
aggacacagcctaaacaaggcagatgcggcagagagcagcgcggacagaaatgctgtgtgtcactttctagacaggccatcgagctatcaccattccagtmgcagtccatcagtcagttctcagcttgctactcccctgtgcgttgctctcaagtacccaacccggaccctggcctcacatgatggaagggatcttaacag

SEQ ID NO: 35734 - DNA, 201 bp, Bos taurus
cacttacttaaccagcagctaaattaagagctggagttgaggtggttccttgtgtctgttcatgacaagctctgcgaggagaggcatgctgggttctagayggcagaggcctcagtgaagccaggattaaaccaagaaagaggctgagcttgtgcagttgctgagcttagcccgggagtccccgccatgaatggaatctgg

SEQ ID NO: 35735 - DNA, 201 bp, Bos taurus
cagggaggcctggcgtgctgcagtccacggggtcgcaaagaataagacatgactagcaactgaactgaactgatacctagcagaggaatcgctggatatgmagctctgctctcctatgtaggccaccctgaagcatagaaagttgaagtatagtaccctagggttcctgctcttggtttcctgcaaaggaaacgtttcagg

SEQ ID NO: 35736 - DNA, 201 bp, Bos taurus
cccaacacagaaatgcccagatggcctgctttgtcctctcccctcctcagccatcctctccccgctgcagggagtacttcactctgggtaccagcttgatyctttcctgactctagggcccattacccacacctagttcttggtgctttcgagctccaaaaggacagagacaatgtctgtttttctgcctgctgtgtcctc

SEQ ID NO: 35737 - DNA, 201 bp, Bos taurus
agatgcagaatcaagttaagaggagaagaaagcagttctgtcttgaatattatcgttaaatttaaaaaccctgggaaagaggatttacagttgcggcattyggcctctatgttacacactctccaattatggtgcagctcttctctggtggctcaggcagtaaagaatctgcctgcaataagggagcccaggttcaatccc

SEQ ID NO: 35738 - DNA, 201 bp, Bos taurus
tctggccacccctcctttatggaagaagaaaattctagattgtcagagccagagattcccctgaagaatccaaccccctgttcctagagatgaggagaccraggcctaatgagatgaaatatcttacctatggtcatacaaccagttaaagattgtagcacctgcccttcttcccctgtgttctaccacatactacccaag

SEQ ID NO: 35739 - DNA, 201 bp, Bos taurus
ttgagggtgtggtcagctacttccttttagttcatgggctcaagaacagacctgagatttcactaactctaactactgttaaactgggcacagggcctggyacagtggtctatcctcagcaaatgtttgactgaatgaaatagataagtggaacataaaaactttggccccagagttgttcaccttgattctaatcctagt

SEQ ID NO: 35740 - DNA, 201 bp, Bos taurus
aaaaaccatatcatctcttacctaccatactgcaatagatcctcatttttcctccttccaagcttcccctttccacctgtctcacatccacgaggtggccrtgatctgcttaaaactgaaatatgaccatgtcatgtttcctattaaggtcctccagtgtcttcccattgtttatagactaacatccaagatcttcaggct

SEQ ID NO: 35741 - DNA, 201 bp, Bos taurus
ttttaaccataatcatgaccaactgagataagggtttgtaaaccatggccttgattataggaagagctttctctttggtgttcttgatacttagagtattrgaataatcttttacttttacaaccctaacacgttacttttgaaatctctagacatttattagcattcaactttattttcaaataaacaacaatatatacc

SEQ ID NO: 35742 - DNA, 201 bp, Bos taurus
catgccaattacacaacatcatgcagttctttcactataaatggaatgaactggatattcctatcgtgagtgccttgatttcttgcccaaaagtcttgtcycactgttctcacttctggagtacttccctgtgttttaattaaatactattttactttcagaggtaattttgacacttgcatgcgaccatgcctccaagct

SEQ ID NO: 35743 - DNA, 201 bp, Bos taurus
ggggagagttcaaatcaatagaaagaaaccctgtttgtccaattgcttgacatcacacaaccacagcttcaactagatgagtcagtttgatcttactgagytttcccttccttttggttagaaaaagtttcaggacaaagatgtggaggtatggctacagctcagaaaagtaaaaccccagaacctgcctagataattcca

SEQ ID NO: 35744 - DNA, 201 bp, Bos taurus
agcgaccccatggactgtagcctgccaggctcctccatccgtgggattttccaggcaagagtactggggtggggtgccattgccttctccagtgccattgyctctccacacacaatagtgactctttctacactactgtggctcagtagcaaagaatctgcctaacaatgcaggagactcgggttctatccctgggtctgg

SEQ ID NO: 35745 - DNA, 201 bp, Bos taurus
taaagataacatgcaagtgagaatacactgtatttaggaagctagacaatctctcaaacacgtttatatattccaactctcatggcccactattagaaaaraaattatatctgggatgtttcagaaatatctaaattatacatgttcagttcagttcagtcgctcagtcatgtccgactctttgcgaccccatgaatcgca

SEQ ID NO: 35746 - DNA, 201 bp, Bos taurus
aaatgtaccaaagaaaacatgtgggcaccctgagggagaaggaaatagactccagagcctagactgagggatctagactcagccagcatctcagcaaacgracagcagaagcaaggtagtttaataaataaaatgtgtcccccccaccccgtcaaggtaagtaatactaatcctgactccaccaaaactgtagctatgtga

SEQ ID NO: 35747 - DNA, 201 bp, Bos taurus
actctacaggctgggttcatggtaagttgtgtccatagagaaatatgaccattcccctaaggcaggtttaccctgcaggcatgactggagccaatcgctcygtctggcccctcagaagaacttagatcccttagcccagagccaaatgggaaggttttgtgcagatgatattccagggagaaaacttcatttgtccatctt

SEQ ID NO: 35748 - DNA, 201 bp, Bos taurus
gcctttgtgaacctgaaacccaccacttaattctgagagccttggaagacagtagctcaaccatttgcacataggaagcaaagccaggaaaatcacatcakgccacttcgttgcttagtcccttacacttggaataccacctaaacttctgactggggcctgcgagacccagaatagccagccgcttcctcctgtcctgcc

SEQ ID NO: 35749 - DNA, 201 bp, Bos taurus
cttttcctgcgcttcttcactaaagagccactcgatggggtctcactgggaggggagacctgggctgatgtgttggtatccaggcctcttatccgatctgyggagttcctcttcagctgggactccatcctcgaggctccttccgacaggatcggggaggtggccaggtgcatggggatcacctcctgaagggcagcaaac

SEQ ID NO: 35750 - DNA, 201 bp, Bos taurus
ctgaaagcaaccttaacacaagtgatgattttattcagaggcaaaattaagttcttgtgggtactgaagaagcaagtgctaggcccagagcatccacacayggatatgttctcagagtttcagcttagagggaccaggtatgggatttacaaccagagggcctatcagtcattctcctctagacccctgggtgaagataga

SEQ ID NO: 35751 - DNA, 201 bp, Bos taurus
aattgtcgtagggccatgtccagacattcgagtatatagctgtttttaatgacatcatttctgttcatggggtctggaaggttattaatgtgagagagagrgggagcgagtataagcactggatcagagatgtgtcctgtgtgactttctgtgggattgttctgagagttgaagaaaatttatgtaaggtgtctagcacag

SEQ ID NO: 35752 - DNA, 201 bp, Bos taurus
ttgaagaccaggtagaggggctggggcagcagaggcacctggccagacacaaggcccctcacccgggcctgcactgggcaggccactgcccattcactgcytctccatttctgggcaacttcctgagaccagcatcgggctccgagagtccatctccaacacttctggccaccagttctgaccaccaggcctctctcaacc

SEQ ID NO: 35753 - DNA, 201 bp, Bos taurus
catttaccaaaaaagtaaccgaaaacaaacaaggccgctcaagcgtgacctgccagtgaaacctttctaaatccttgtttggattcccactcgttcctctytcagggttttcagaaccgtggcccgagagcctgctatctgtttgtctgtcctcatcgcagccttcactcttgtccgcatctccaccttcacaaggacggc

SEQ ID NO: 35754 - DNA, 201 bp, Bos taurus
tctctgccacgtgctagggacacacagaacagacagacgtggccgtgggtgtcgcagtcccgtggatggagggagatcacatacagtcacctcatcgtaakgtgggacatgctcctgggggcccagggctgggagtgtcaggggcccggcccagtggaggagtgagggacagctgggtgaggggcaggcagagccctgagg

SEQ ID NO: 35755 - DNA, 201 bp, Bos taurus
cctaaggccaaagtcaagagtctgcctgcagccccagggccagccctcagggaaccagcacctcctccttcccttgcttctgtttccccatctgggtcaakatgggtcatctgggcatggccaggcctccgggagagtgcaacatacatgcagtgtgtatgttagaggtgggctggcaggagatgccgtgtgtaggggtga

SEQ ID NO: 35756 - DNA, 201 bp, Bos taurus
aacccaattcaaaaaagccctctctcagacttccccagtagcagtggataagaatctgcctgccaatgcagggaacacaggttcgatccctggtccaagaygatcctaactgctgcagagcaactagaccatgagccatgactcctgagccagggctctagagctggaaaaccacaactgcttagcctgcccaaccactga

SEQ ID NO: 35757 - DNA, 201 bp, Bos taurus
acaatgctggctcaggccccccccccaccacgcccgtggcagtgggcaaaggtgagagccaggttagagcccagccaaccatcgcagggcatgacaagacrgcaggtgacaaggcccccccaagggaaatgacaacaggtgatacagacctccctcacaaaataacaacaggcgacgagagcttccaagggaaacgacggc

SEQ ID NO: 35758 - DNA, 201 bp, Bos taurus
ccaccagaccccgggagccctcctcccagcccagaccctcggatgcccaccctccctccatccctgtagtctgtggatccgtgccctggggccacccacayggagcctgcttcccatcgtggcatctccagctctcatctccatggcaacactcaccacccccgcgtgcgaggccactgtgcacagctaacccaaggcctg

SEQ ID NO: 35759 - DNA, 201 bp, Bos taurus
agaaataatgtaatttactgaaagggagaggagaggagcaggtgtggaggggaagatggcttctgctttaggcatttctgcctttgatgagtctgtgcaayatccaagtagcagtatctttggcctcatctttatgcatgaataattcagagatgagaatgatttgcttaattaagaacatgcatcaaaatagtggcagat

SEQ ID NO: 35760 - DNA, 201 bp, Bos taurus
tcacatacatccagagatgcaatcacacttgactcattccttcattcgagttcctgtcgtgtatctgatcctgtgttggactctgataatccagtagtgcragcaaggcacccacagtccctgataccctagagctggcaatcgaaggtggaggacagactttggacatgaaggtatatacttcattgagttcaacaggtg

SEQ ID NO: 35761 - DNA, 201 bp, Bos taurus
ggacttcccccatgtcctgggtctccccagatggctctctaggggtctggcggggacccaaccaccacaactgccatcacggcccagagtcacttgcaccygtagagacggagagacaagtgggctggaggtccctgtggggaaggggtgatgctggctgggcccttcagagcccttgccgcccccccacccccgaccgga

SEQ ID NO: 35762 - DNA, 201 bp, Bos taurus
gaggccttgcctgctgcattccatggggtggcaaagggtctgatacgactgaacgactgaactgatctgtattacagttattttctcctttaatattttaytttttattggagtataattggtttacaatgttgtgttagtttctgctgtacgacacagtgaatcagctgtatgtttacatatatcccctccctctctagc

SEQ ID NO: 35763 - DNA, 201 bp, Bos taurus
tttcataaagagccagatagtaaatattttaggcttcgagggccttgtagatgctgctgcaactattcagctcaggtgttctgaggcaaaagcagccatamacagtatacatgtaaatggccatgagtgtggtcaaacaaaatttgatggacagaagcaaagcagggagcaagatttatcctacaggctttggtttgatta

SEQ ID NO: 35764 - DNA, 201 bp, Bos taurus
gtaatggagtagtcttgtggtgtggaccgcgagcctctcccgcttttgcagcagtaacgactcttaatcgtgatgacagcagttcactaactctgcatttstggtgtgatgggctgctagtgtagagtagctgagtactaataattatagctcacggattaattaaaaagctaatgtttaactttacccttcatttcctcc

SEQ ID NO: 35765 - DNA, 201 bp, Bos taurus
cttgcctggaatagaagtaccaaatgtttatcatttaatgaaatagagaacatgaagcagtggtctctgtttgaagaaaactattcacatttctttattgkttggatttgcaagtgctttcccaggtacattatttcatcaagtcctggatttaaaaaaaaataaaaaatatgatttaactgttgttttcatcaagcccag

SEQ ID NO: 35766 - DNA, 201 bp, Bos taurus
tggggaagggtgagaattagtctctcactagtctttttttttaattcaaacttttcattttaattaattaatcaacggccataccgtgtggcatattgatytagttgcccaaccagggattgaaccctcaccccctgcactggaagctcagagtcccaactgttggacccggggaagtcctctctggtcctcctgagcggg

SEQ ID NO: 35767 - DNA, 201 bp, Bos taurus
tgggttgttttgcaggagggaccctggataagaaatgcgcgtgggccttcgcagccttgactttgacagggtagcccaaggccggctgttatttcatcacygaccctgccagccaggaccgttgcccttgctgctgctgaaggcagagcctggaactcccagtcaggggtttttctctgcttcctcctccttcctggccac

SEQ ID NO: 35768 - DNA, 201 bp, Bos taurus
cactgcatcccaggagcacaaaaagacaccaaacaaacaaactaaccaggcacacatgtttaaaacctttgctcccgtttgctcacatcccattggcagarcgagtagctggccagtcccctagtcagtagggtaaaaagaatgctctgtttcaagaagtaggggggagtgactacttcctaaaccatgattcaatttatc

SEQ ID NO: 35769 - DNA, 201 bp, Bos taurus
tacccagaagggcctctgagtctacagttctcacttatgtggagaagcttgccctgatgatccaggagagaagataaaggaccacggtgtttgaccctttstgttccatccacacatcgtacggccagctggatgctctcacagcagtgactgcgtttatccacatcacagccctctaaggtgtcatcacgggcttccttg

SEQ ID NO: 35770 - DNA, 201 bp, Bos taurus
agaaccaaagaaatgaggccaactggggaaaccagaaaactggaggaatattcagaccagttcacaaactgaaatcggggagttgagagaacactgcacakccctcccaggggcccccggatacttcccggtcaccgtgaacctcaaaccagctgcagcgtctgtggccaggacgacagacaaggatggtgggaaatccag

SEQ ID NO: 35771 - DNA, 201 bp, Bos taurus
ctcaggaagggaggtagtagtaggaggtcaaagttgcttatggtttttatacaggatgaaaggatttgacttcagcctccacatttatttcccttttattycttttcatttctactattttttggtagttttattatatatattatgtatatattatatatattatgtgtatatagtaataaaagtctaatttataaatat

SEQ ID NO: 35772 - DNA, 201 bp, Bos taurus
cctacaagcaggccagacaagtagatgttaagcttcccttttccagacatcactgtccactgagggagtagggagcatggacacagcatggtcccctcaartcagcagacaggggccaggtcctgagcaggacccgagtcttcctgaactcctatgctattccccatttgcacagcatcccttgatacatctggtctgtac

SEQ ID NO: 35773 - DNA, 201 bp, Bos taurus
cccttcaatgccaaggacaagcacgcagagctccacggagacccagaggtttcagagggtggaggagttatccctatgatgcctggtgatagtgtttgagrcagggggccattgctcagaggagttcacagccaaagcactgacagtctcttaactgggggagaggatgagaagttgcaagattacaggaaacaagaattc

SEQ ID NO: 35774 - DNA, 201 bp, Bos taurus
tcaggccctgtaggtggtcagagagggaaaagtagatggacccacttgaggcaggagcgctgttcaggctgcatgctgcatttacatgcagctgtccactygacacatggcctcagaaatatagtgcaagaccttgggggagtgctctgacagagtgcgctttttttcctgcttaatttctctaaaatgcaatgggtggtt

SEQ ID NO: 35775 - DNA, 201 bp, Bos taurus
gatgggagcctggtgttatccctttgttttttccctcttccaaaactaagaatagtttttgtatgtatgttcatgtttccagtcagaatgcacaaactacygtatttctcttttttcctcaagagaattaaaaataaactccagataaccaggaattggaggagcatacctggaaccgtagggatgagttaccgcccaccc

SEQ ID NO: 35776 - DNA, 201 bp, Bos taurus
tcattctaacctgaaaataggcctccttaaaactgtaaaggatcctacaaaaggatttcagtccaaagctgatggtgtgataacatgattaaatcattgaycttgctgagtaactgcaggccattaggaaagaaactactagtgaatggaatcagcaaaaccctttaattactgattaaagatacaagcaagtgacagggg

SEQ ID NO: 35777 - DNA, 201 bp, Bos taurus
ccaggcctttatccctccttgcccctaaaacaacctcaacctctttgccattcacatcttgagactctactgcccactccccgtccctgaagtagctacaycctgtctcctgggccagcttagcctgtggtccagggctgttagcagactttaggttcaggggcagtgcttaccatcctttgttccatgtggcaaacccca

SEQ ID NO: 35778 - DNA, 201 bp, Bos taurus
acatcgcatgtcatcagtgacggcgggtcatgtagccacacctgacttaaagtgaggtgactagtggccggactgatgctaatgctgagccccgagggccracagctcctgccagctgagcctggaagtgcagccctttgtttctgctcctgtgcaggagcccagcctcgagatcagcccctcggccagatcatctgtccc

SEQ ID NO: 35779 - DNA, 201 bp, Bos taurus
gtcgcttggccccttgggagcgattgattcccagccagcttgagacaggtttggtggagaacgtgacaggtactgtggggtgtgtgggggaaaggggggcrgggtaagtgccttgccaaggcccctgggctttgacttactgtgcttcccagggcttttcttgggatgaagagagtggttgctgaattaaagaggaagatc

SEQ ID NO: 35780 - DNA, 201 bp, Bos taurus
tgcagccaggcccttcccccgcccccgtcaggtttcctgggaggagggggctgaagggaatgaactttgtgcatctgactacccgtctgactacccttggrggcccccaagggctcatcagcacagcacctcctcctggtctgcccgtctgccccattagtgccctttgttggctaaggcaactcccgtggacagaaaagc

SEQ ID NO: 35781 - DNA, 201 bp, Bos taurus
gcaaaagactgatgcagggtaggccagagatgatgaggtctgagctgggaggacagacggaggacaaacaagagggatttgggagttctggggatggaggygcctgtctccgggaggccctgcctctgcacctggggtggggtccgttgggaccagtgttgcaaacagtccacctgcatccttcacaagcccctgcagcaa

SEQ ID NO: 35782 - DNA, 201 bp, Bos taurus
tgcactgagtgtcctaaccttcactcaaggcaggccctgggggacacctccaaatcctccaggaccagagtgtgtctgaccaggccagaccagctcaaggrggatgatggatggaggaggacctcagccaccagtcacagccctggaagtcttggacacacacacacacatacccacacatgaaaccgctgtggaacctgg

SEQ ID NO: 35783 - DNA, 201 bp, Bos taurus
agttctgtgaccaggaattgccacaagccctctcaaggagcaaaagaagctgcctttgcagggagaaaggatgcagaagcaacggaggccttgtagaatcygcttcctccggattcagtcacttgccccaggtcccacttgagcagtgtgcttcattggtttgcttttcacacatcagagccagtgtccgttagtcctggc

SEQ ID NO: 35784 - DNA, 201 bp, Bos taurus
agcagattctttaccatctgagccagcaggggagcccctaatttgtccccaagtgcttgctttttttctccccatcctgtccgatgggtctggccctcttyaccctggagatgaatgcagtgtctgtcatgatcaagagcccccccaacaggaattcctctttgctggcccttaagtcacagaatcactgattctgatggc

SEQ ID NO: 35785 - DNA, 201 bp, Bos taurus
gctcttgtaaaaacaacaacaaacaaaaaaaacccctgaaggatgttactgacataattggggaaatttcaatgtggaccacatgtcagataacatcgtgytgaaattaaattgagtaagataatggtgattttagacacggtccttaaccttaggagacacatgatgaagggtttagggctggagtttaatgatctctgc

SEQ ID NO: 35786 - DNA, 201 bp, Bos taurus
cagggctcttggcctggcatggtgggaggatgcacacgcatgcgggtcatgaggctcctggggcagaatgccgtagcacccaggggatcctccccaccccytttgctcccggggcccaacagaggaaaatgaggaaatccctgtgtcctcccgcagcttttggcccccaggctctgaggacaaagccacatgggggtggtt

SEQ ID NO: 35787 - DNA, 201 bp, Bos taurus
tttaggagctctgcacgtgctgactccttggcctggaagaacgactctcagacctttgcttgctgtctgtcagttctcaagctatggattttccctggccrgtgtgactaagtaacccttgccccacatcaagctttaacgcatcactggttttacttattcaaggtgataaaatgctatctttaagtgatttacggcctt

SEQ ID NO: 35788 - DNA, 201 bp, Bos taurus
gtccttttttcttagcagaccctttcctgccctggttcctgataccttctctgtgagataggttagtggggtctcttcttaatgaggccagaaggcgcccygtgagctaatcgctccccagaaaggatgctttcggagcagggtggtcccaggtcaggagtggccaggctctcttaggtctgtcccccgcccagagcaggc

SEQ ID NO: 35789 - DNA, 201 bp, Bos taurus
acaaatagatgtgttggcctgcctcataacagcacttaaacagcagtgacacagccagctatgtgatttccaacattttggccaaaagtgatcatctccartattgcaatcttgccaaattcttttattttaccataacctgtggagaaggaaatggccacccactccagtattcttgcctggagaagcccatggacagag

SEQ ID NO: 35790 - DNA, 201 bp, Bos taurus
gacgactctccagaaaggagttctcgtattgttttttctcatggatgcttctctgggaagcttatctttgcattacccagatggcctcccactgtacagcrtgcaggataagtgagagccgcacctgtgtgtgtgcctgcacacatgtgccaggaagtctggaggccaggtgaaccgtggttgaccagcatgtgccattaa

SEQ ID NO: 35791 - DNA, 201 bp, Bos taurus
ggatttatccttagtccagaggcatggcccttactgtagaggacattcttgatactaatgcttgacttttctggaatctcagctaaatgaaagaggtgttwagcaaggcctctccactctggaccggctgcacgtgcatgttctgggcgccgtgaagtcttggtacccctgttcacttctcacctcgcagctgatgctgcc

SEQ ID NO: 35792 - DNA, 201 bp, Bos taurus
gggatctcagactcggaagccctggtcttgcccttgagctgaccacggcatgccatgcgttccaggtcggcacaggccacaggtcatccgcaggtcctccyaggctcccaggagtgttttctctaactcggggttcagggtgaactgcagttgtggcttcaggtttttggaaaccagctgggctttggggaccctggaggg

SEQ ID NO: 35793 - DNA, 201 bp, Bos taurus
atttaacagatctttatattgaaggactctctgtgtgtctttaatatgcaaatttgctttgtaaatcaataagatgaaatagtcttccgttttccaaacaycgtgaccctggaacctttcttctggagccaggttccttggaactcaactttgcttcgtcttgggtgtctctggacaaaagcagagcttatttatttcctg

SEQ ID NO: 35794 - DNA, 201 bp, Bos taurus
gcttctcgtgcccactgtgtctacttcctctctggcctttctctctcacatcccctttcacctccagcaccgccctgaaactggtccaggtctccagtgartgccacggccctaaggccagtgctcaagtctcggtccttacgtgactagccccaatcagcatcgtctgtcagctctcgtcctctgcccctgacactgtct

SEQ ID NO: 35795 - DNA, 201 bp, Bos taurus
ggcccatcacttgccttctctggacgtcagtttcctccatctgatggagataccaagagtgccctctgagaacaaccccgaggagtcgattcactgatackggtgcggcagagggcccggcacagactacgttcctggggcagtcctcactgctcggcccacaccctcatctggactttgcagaggtgaaatgatctgaag

SEQ ID NO: 35796 - DNA, 201 bp, Bos taurus
acctcacgtcagcagccacggttctgaaaggcagccaggctgcgggagccctgctccctgctccaccattcaaacctaaaggccagagggtcccttaacgycccgcctcccaaagcccaccaaccctgcgccccacagtgcctggcaatctgctgggcttagaggcacagggctctgccggccagctctccctgttgggcc

SEQ ID NO: 35797 - DNA, 201 bp, Bos taurus
aagcggatatcgtcgtgcgtcacttccggcccgccctccggcaacgcgttgctatgacagcatgccggcctgctccaggctgtgattcttaggcctttgtkttctgcaggttttgtttcctaccgggatctttgggagttgggtgcgtcaggggaggggcttcccaggtggcgctcgtggttaagaacctgccggccaatg

SEQ ID NO: 35798 - DNA, 201 bp, Bos taurus
actaattccattaccaggaattgaacctgggccccttgcattgggagtgcagtcttagccactagccacctagtctttcttgtaaggacacttttcattcratttaggccccatcccctaaatctcatctcaagagccttcgtttaattacatctgtaaagacccattttccaagtaaggtcatgctcacaagctctgggg

SEQ ID NO: 35799 - DNA, 201 bp, Bos taurus
cgaggcatccgtgcactttgctgctcgctgccttctctgagtgtaatcaaacatcaagctaagtagcaaataaatctctcgatctcataagctgcacagcragatcatgtaaatgcaaatgaaggacctggtttcaagctgtcgaggggggaggggaggacacgccggggccctatcactgtgaccgcctcgcacaccaag

SEQ ID NO: 35800 - DNA, 201 bp, Bos taurus
cttcacacctgcgtcgatgtacttacacaagtatggccctttctccccagcttcttcctttattcttgacctacatcttggagatcttcctgagtcattamtcgtatggccacttcattcttgctagcagcttcattatatttcctgataaatgtgcacaagtgggaggggcaagggtcttcagaacgtgagcgtccttga

SEQ ID NO: 35801 - DNA, 201 bp, Bos taurus
acgcaggatagaccctggaaaaggccttttgtttacggctacttccgtcctgcacgaagtattggaccttctctcttctcagtaccttccgtgaggccacktggtaagttttctgaatcaggagaccaagctgagaacagcattgtggtgtgtcatgtagacactgctgtatttgagatggataaccaagccttgagcctg

SEQ ID NO: 35802 - DNA, 201 bp, Bos taurus
cctggcccagatctggaactgtctcatggctccaggacgcttagttaccaggtacatggcacatggtgtctagcagatactcaaatgtctaaaacaatatktgggcctcatattttgttctcaacaaatagcttcagatctacgtcccgccagcttttttcgtgtgtattgaaaccattttcttaaaactatatgttttta

SEQ ID NO: 35803 - DNA, 201 bp, Bos taurus
cacgggagggagccggctgtgatgccgtggaaggccagattccatctcacggggacgggtgccatcagctcaatgggatcagtccctggccttcctggcckcgggtgcaggctgcagattgccaccatgaccgtcctaaaatacggtgcacaggagaacgtgacgctgcacggagtctggatgcaaggctgccctggagac

SEQ ID NO: 35804 - DNA, 201 bp, Bos taurus
actggacacggcacagtggccagtggggatggaggcatccaagggcaacaaaaatggacagaaatgcacatcaaaactgtctgtctgcaaaggggaagaartgcaaatgctccgtgtcaaaactggccacctataggacacctggagatggatacgtagacaaccccacagcagggatgttaaggcccaggggaataaagt

SEQ ID NO: 35805 - DNA, 201 bp, Bos taurus
gacttatgatctgggtttttgaggttttgttcaaggatgccttttccaacacttactcataaaggacaggtggcatggcggccgtaggtgtgcagtgcacrcagcaggctgcctaggaggacagagggggaagggcagagcggagacccaggctctgcaaccctgctgtgtggcctgggccagtccccaagcttccttttc

SEQ ID NO: 35806 - DNA, 201 bp, Bos taurus
cgctggcccttggccctggtgagtcagagcccaggctggtccgaggccgcacccgctggcctccctgccccgtgagagggggaggcaggaacatcccatcyggaagtagccgctcttccaagtctggaatcaggaggagctcagtaaatgctggttgaatgaatgaatgaatggatggctgcaccatctcttctcacccag

SEQ ID NO: 35807 - DNA, 201 bp, Bos taurus
aagacccagcccccaagcagtgggaaggacggaagcacctttctgtgaccacccagagcagcggccatcccggccaggtgctggcaggggctgcaggccarcctgctcgatgtcccgctgtcactgctcctcatctgtcccctacctgtaaaatggggcacgcagaaggggcgaccccgtgggccccagtgaggatggagg

SEQ ID NO: 35808 - DNA, 201 bp, Bos taurus
gaggagctgggaggctggtcagcagagatcgcgggacttcggctggttaaggatgggcagagagccttcacccgcctctgagggcctgcaggtgcccctaycccaaatctcatccttgtccaggggcgttctgcctaagccagtgccaccactgacctaggagccaggggcatccccacacctcccaggcctgtctctgat

SEQ ID NO: 35809 - DNA, 201 bp, Bos taurus
aggttctgggtggacaggatttcaggggtcattgttggatcctctacaactaggccacttgcccctcgctgcagccctgggaggcaggccctgtcgggccrttttgcagatgagctgcgcacctgtgccatgtggggctgaaaggttgttgtcaaatcacgcgaagacactgggattcttggcccccggaggagaagaatt

SEQ ID NO: 35810 - DNA, 201 bp, Bos taurus
ctataaattgtaaggtacatgaataaaacgcaaaaagcatgccgccagtcttcgtaaccaacatcgccacatcatgaccaatctgttcattttggaactaygatgtaatggcctccagagagggacgggggtggcgggggtggggtggtgcttctcacctggggggtcctctccctgcaccgtcttctgctgcttctgtct

SEQ ID NO: 35811 - DNA, 201 bp, Bos taurus
gcctcacccagaggcaccgggcagtcggccccaggggccaccctccgcctccgaaagcagcaccagcaggggcagtggaaccccagacacaccacgaaacrgcaccgcaaaggccctgagcagtgcactgccgctggaaccgcagtccacacggtggcccgggacctgcgtgcggagcctacgcggggagactgcctacta

SEQ ID NO: 35812 - DNA, 201 bp, Bos taurus
gcacgcagtgagaggctgtggcctcctttgtcctaaattctgacatggagattctagaccgtgcaaaggatagagtttcctgaggcagcctgagtcacacrgacagatgtcttggcctgccttacagagtcgagaagcttaaagagataggcaaagactagccctctgaggaacctacaaacggtgcttcacctcaacaaa

SEQ ID NO: 35813 - DNA, 201 bp, Bos taurus
cacttaacttggaggccggtatggaaggacctgggtaggagaaacacagccccttctgagctccgagcggaccccacatctcagtttgagcaaaggccccrtgcgggcaaagttaaggtgccccttcactttgtgctacgtttgttccccaggacaggacaagggcgtccaagccagggagctgagcgggtgttgggtgca

SEQ ID NO: 35814 - DNA, 201 bp, Bos taurus
cccacagccacacatggctgctgggcgccagatcatacggcccagaacttagaacatctctgtcactgcagaaagttctgttgggctggcgctgctgccaktgggaaaggctgggccccagtccccgctctgccattcactgtcaggtggtgggggttatgcccctctgggcactggcttcctcttccgtgaacaggggca

SEQ ID NO: 35815 - DNA, 201 bp, Bos taurus
ggggtggggggtgctgggatggctggccacagggccactcacctgagatctggttcagggagaccctggaggcctcacgcccctggccaggggttgccttytcttcaactccactttcagttccactcaggatgcctgaagtgaaagtaaaagtgagtcactcatttgcatctgactctttgccaccccgtggactacgga

SEQ ID NO: 35816 - DNA, 201 bp, Bos taurus
cccacgtgtccacgtcctggtccatggccgggaccttctttgctggggacggcccagaggggatagcgcgtgaagctgcccacggccccacacagtaggcrctcagtgaatgcttgctacctgttccattcttaaagtacctactatgtgccgggttctctccgagtctgagggccgcagcggcgataaaaagtgacgcgt

SEQ ID NO: 35817 - DNA, 201 bp, Bos taurus
tccggacgtttaattcaccttgtcccctggccgccagcgggcaaatcgctccgtaactcgatcagccaagggacaattggatcagagagcgcttatccgcyggcccctctcaccgtgcgaatgtcagaggccccccgggcacagagacctgctctttccaaagtctcagctttgaaaagcaggtggtgaggctcgggcttt

SEQ ID NO: 35818 - DNA, 201 bp, Bos taurus
cagttaagccaggctcttgagtgaattcaggggtgggatggagcgacccggacccttccccagctcccaggaatcaaacgaggctgagaggctggccggcrtgctctccattacagtcctgtgggcaagcccagcatgcagggggctgaataaatacttcccggacggagtggggagacaggtgcagagggccaaagctct

SEQ ID NO: 35819 - DNA, 201 bp, Bos taurus
gctacgtccagctggaggccactggacagctgtcactttcagtgaacatcttcaggcgtcctctggtttttgcattttagaaaaaccagtgcattgttttyaggcccaaacatttgtggggcctcttagaaaggccgtggggaccgaggcaggttgtccacttgggtgaggggtctcatcttcagtttcaactcctcctgg

SEQ ID NO: 35820 - DNA, 201 bp, Bos taurus
agtgaagttgatgggccttcattcgaaccataaaaatctactgctgttgagtgaaagtctctgaaacggggaagcagagcgacgcgggcagggagggcttygtagctcacggtctctcggggggcctgggacacccagagaaggcggccttctctgacccggcctgacgcaccctcgccagacactgctcgggacacgacg

SEQ ID NO: 35821 - DNA, 201 bp, Bos taurus
gaaggctgaggctggaagccagtgatgaggacatagaaagaaaaatgtgagggcccgggtccctgatgattccgtgtcagggtcacaccggccctgaaccrcctacttcctttacgaaagagtaaacgcttctaactttaggctgcagttgtgtcggggttttggctacaaccagcagagtctcctctgatgcaggcccgt

SEQ ID NO: 35822 - DNA, 201 bp, Bos taurus
ctctggctctagggtcatagcgcctgcatcgtggggcaagggggggggtgctgggtgctgtcgaggccacccctcccaggccagagctgagcagatctgcrggaacttccagcatctcacagtttaaatctgaaaccacgagagactgcagccttactcccctgtcgcccccgaagtgccctccagtctggacaagggccc

SEQ ID NO: 35823 - DNA, 201 bp, Bos taurus
agggtgggagggcagtgccagaaggggctgggcacagggccagggaagaggagagcacagcccagcccatctcaggcggggaggagagaaagaaggaactrgggagcaggaaggccaaggccccgccaggcaggatggacaggccaggaagccaggagcaggctctggcctgggaaccaggacaggagagggctccctccc

SEQ ID NO: 35824 - DNA, 201 bp, Bos taurus
cacagcagccgggcctcctcttgtttactctcagctgattccatctcatttcctgcttggtatttgctctattacactgttaaattttgtgaaatcagacrccaacctcataagcttgcatatcctctcacacagcatctagaccagcacctcccggctccacgctgcctgcagacccctcggaaacggcactttaaacac

SEQ ID NO: 35825 - DNA, 201 bp, Bos taurus
tcccggagaggctgggctgggccgcgcctgcccccacgccctcctgaccccggtgtcacccccagtttgggatcgtgttcgacgctgggtcctcccacacrtccctctttgtgtatcagtggccggccaacaaggagaacgacaccggcatagtcagccaggccctggcctgccaggcggaaggtcagtggacagtctgcc

SEQ ID NO: 35826 - DNA, 201 bp, Bos taurus
tgcccagcgctgccccggggccccaggggacggacagacagtggacatgccagacaggagggcgaggggtatgagcggcacttgcccacgcacaggacgcrctcgtcctgttgcgccctggccgggccccagtgtgggcaggaccccgggacggcactgcctgcagaggggcccagagcccggctctggccttgcctggcc

SEQ ID NO: 35827 - DNA, 201 bp, Bos taurus
ctgtgagtccccggacagacggaccaacggacacagccagcctggcagcagagggcgggaggcgggaggcaggcccggcggggccgtgcggcctgaggacsgggtcctgctcagctgtcctctcctctctgtggagtgctgagcggggctggggcagacgcgcctgggggcctggaaggacacggcctggccccgagcctg

SEQ ID NO: 35828 - DNA, 201 bp, Bos taurus
gttcaacaaggaggacagaaaagttcccaaatgaataggaaaaacgccgttaacccaggtcccaagaactgtgcttctggaaggcccccagcagagaactsccccctggagaactccctgtgctgatcctggagctggcaaactcgcccccatggggtacgggccccgcggggagagtcggtccggcgtgccccgggcagg

SEQ ID NO: 35829 - DNA, 201 bp, Bos taurus
atcttttatgtctcctgcgttgcaagaaggttctctaccgctgagccacctgggaagccctgaggcaatatacctaaatgtattaaaaggcaagcaacgarcccttctgcccttcctctctccctccctccatttatctttctataagtgaaagtcgctcagtcgtgtctgactctttgcgacccatggactatacggtcc

SEQ ID NO: 35830 - DNA, 201 bp, Bos taurus
cggggtttcctagggccctggcccctcgtgccttactgggggaggtgggtagcaagatagccccgccggacacccttggcctcgtaggttgaagcccagcytgccgcacgctctgactcaaggcgcttccgctcgggaaatgcacacatggccccgagagatgtgtacagacagactcacgacagcgccttcgccagccaa

SEQ ID NO: 35831 - DNA, 201 bp, Bos taurus
ccgcggtggggaagcggtgctggaggctgggacgcggagcctcatcccctcggggcgggtgggggggtccgagtcagtgcagctcaggcatgcatggcccktccagactccctgaccaagactgccagtcagagttccctaagcttttcaaggtttctctttttgataagattgtctaggcaagagtgctggggtgtgtca

SEQ ID NO: 35832 - DNA, 201 bp, Bos taurus
gctgggccccaccgtcctcgcccgctgcatgggtgtcagtgagttatctcagaaggctgagctgctgcccaaaccagcgtcacatcaagagtcgaacaggyggctgctggggggccacctgtcgccagcagacacacgggttcaactcaaaagcctccctctgggatgccccaatgcagggactgaactcccccaaaccca

SEQ ID NO: 35833 - DNA, 201 bp, Bos taurus
ccagaggtgcaggtggaacagcggctgccccgccccaagaacacccagtagagcacaggacacagtttagtgggaatttggggccaggccttccccaaagrgacatgcccaccccaggagccaacctgatcctcgggcagacggggctgtcccgcgctctgggtgcccacgacccgccctgtcgtgtgtcagaggagtgcc

SEQ ID NO: 35834 - DNA, 201 bp, Bos taurus
ctgcgccctcctcccgggcaggcacagtactccttgcggggggcctcggtggggagtcaggagtctggcagggaggggacggcgggggtgggccctgggcragggggcggtgacaggcaaatgcacgaggtggactcacaccctctgaaaattacaaagagctgattgatgaacgctttctcggtggcccgtatcttgtgc

SEQ ID NO: 35835 - DNA, 201 bp, Bos taurus
gcccttgaggccttatatgctggtgataaatttcacaaaattcatcctgtactttcacgagctactcgttgagcctcctgcgtttatttagtgccgggttycgggccagcggctggggagagagtcagggaggagccaagtcaagggcttctgggccgggtagcctggcgtgggggagacctgagactgggggtcccacag

SEQ ID NO: 35836 - DNA, 201 bp, Bos taurus
caggggacatgatgggctggttggtctcagcagcgtgtaattggacgagagcttccctgggcaccaggggcagaggcgggccccggggacttacagctgtytaatgtttcatcgccctctgtcagtgtctctgccactcagtaacaaacactccggtcctcacctggtgcggcttttttgtcagcatcgcgggccccgggg

SEQ ID NO: 35837 - DNA, 201 bp, Bos taurus
aggaagacaaggagggttgccgcacatccagggtgaggcgggggccccatgcgtagaccccgggtctgggcactaaattctcatcaccaaatgccctcccrtgacaacaggaagaggttggtggccgggcagaagcttgctcagcatctggggctctggctgctccgaccgggggtctggccatcctgaccagcccgagtc

SEQ ID NO: 35838 - DNA, 201 bp, Bos taurus
tccatgggctcacaggaccaagggtgtctctcaggcctcagtccgctcacctgcaaaacagcagccgtcacgccttcgcatccaagtctgaggattcgacragaatggacgtcccaggccgggggcccctgcgacaatggttatgttaaggggacatgcctggctgggctgggactaagggctcagacgggcacccgcggt

SEQ ID NO: 35839 - DNA, 201 bp, Bos taurus
tgcagcagggggaggcaagaacaaacagctccccttgctcgcccgctgagggagttgagctggttccttacgtgcggtgagcaggggtgtgtccagggttyggcccagaggggtggttaggaggcttgcccaccccttaggtggtgttgaatgcaggggccatgcacactataccctgcttttctgctctttcggctgctg

SEQ ID NO: 35840 - DNA, 201 bp, Bos taurus
ggacggctcccacggcggggcccgcggtacggacgctcagcagagaatcaaagagctccctgaagctgcacagaggctccaggaggcttctcagacgacayggcctcgaaggtgtgggcgacaggcaggaatggctcctcatgtgtgatggaaattgggttgaactggcgtcgtcctgagccggctgagtgtcttgcccct

SEQ ID NO: 35841 - DNA, 201 bp, Bos taurus
cgcctctgctccccggtctgggccgctactgtgggcctcaggggtcccttgttttagccacttgacgcaaggcctctcgaggcctcctttgcctcactttyagtcttcatggggctggaggaggctttgagatagccccccaggggacacaggaaggagcacccgaaggtcttcttggccaggtgtgaaggtggggctcca

SEQ ID NO: 35842 - DNA, 201 bp, Bos taurus
caccgccactcctctcccaggtgacgatgaccaggccctgcgcccctgtcgtctcctttggcatcaaacactctgactacatgacgcccctggtcgtggaygtggactagccccggccccgcccccactgccggaagcctctgcacgtcgccccaccaacagattccccaagctgagggctgtgggtgcctcctcctccag

SEQ ID NO: 35843 - DNA, 201 bp, Bos taurus
aatctgaagtgaatacagacacaaaaagagggaagagagtatttattttatcatttgtgacacaggtaagaaataagcaccctaaaggcgtatcttcagakccaggccaggacaatccagagcttatcttccaggagtgtggtcctagctcactttgtttgcccgttgtctctggttttcctttcgctcctgcacaatctg

SEQ ID NO: 35844 - DNA, 201 bp, Bos taurus
agggctacagcagcatccacaaaggaggcttttgcctatggctggctccgtcgtcaatgacagtcctccgtggcaattggcccaggaagaacagtccataytccaaactgactcccacccccacccccgattaaacgcaggtcttcctgctgcctgggccacccgccatgcaacacctctccacggacgggctgaggcccg

SEQ ID NO: 35845 - DNA, 201 bp, Bos taurus
ggagatgagtgttaaatcattaccaaaaaaaaagaagaagaaagaaatctagaaaactgtctttcagttcttgtttcatgggcaattcattttcttgctaygtaagtcaatttaacttgagatatccagatacctacagcctcaagaatcctaaataagccattgttatgtgctctagaatgcctctagaatacctgtcat

SEQ ID NO: 35846 - DNA, 201 bp, Bos taurus
aatatctaaaacagatgaatgtggatcacaaggtttgtatatataattcttgaaggttaaaagaattgtacataaaaaggagatggacatttaagacagaraggtcatagaataacaccagtcaaacattctgttaaggaaatataaaacaatttcacagaactgaaacttgtgtatcatgaaaagaaaagctgagaaata

SEQ ID NO: 35847 - DNA, 201 bp, Bos taurus
ataattattaaaagatgctttgaacttaagatagctattgaactttatagtttaagtggtgttatacattataagctgatacgattttttttctctacackaaatccttaacctatgcatgatggaggctttgactagaacaatcttaaatagcattgaacctgtcttataggatatctaattcccacaggagctcaatgc

SEQ ID NO: 35848 - DNA, 201 bp, Bos taurus
caaggagatccaaccagtccatcctaaaggaaatcaatcctgaatattcattggaaggactgatgctgaaactgaaattccagtactttggccaccttatrttaagaactcatttgaaaaaaccctgatgcttggatgagatggttggatggcatcactgattcaatggacatgagtttgagtaagctctgggagttggtg

SEQ ID NO: 35849 - DNA, 201 bp, Bos taurus
gttaacaagctttaatccttacaaaactggaatcgacccttgaaaattggatttatacgtgtgatggttaattttatgtgtcagcttaactaggccacagrtatttggtcaaacattattctgtgtacttctgtgaagatattttgggaggcaattaacattcaaattgatagactgaaaagcaggttgcccttgttaaca

SEQ ID NO: 35850 - DNA, 201 bp, Bos taurus
gttggagggagggaggagggaatcctttggccaaaacaactgacaaaatttactactttgctttgaaggagtgcttcttaggaatctcttggagcctgttmcctctccgttttcttcagttaggccacagttatttctgtagaatcttaataagtggagtgggcatagggtggggaaaagtggttatcagtgctaactgac

SEQ ID NO: 35851 - DNA, 201 bp, Bos taurus
ctgttttggagaagcagtgaagatttccaggaattgggccaccacccaatttttggtctttgatagtaggcattggaactgtcatggtgtctctaagtgtrtcattttacttgctgaggtgttacaatgagtgtatactgaggctccaggagatagtgaaggatagggaagtctggcacgctgtagtcaatggggtcgcaa

SEQ ID NO: 35852 - DNA, 201 bp, Bos taurus
tttgcttggccatcctctatgtgcaaatgttctacaatgttttgaaacttgtgtggtctcagaaagcctcttccttagggaacagagctgcacagattgckggggaagagatggcctggcggaaacatggcagggaaatggaccactcttattcaaagtcctgctagggcttcctctgccttctaaaccagtaaactctcc

SEQ ID NO: 35853 - DNA, 201 bp, Bos taurus
taggatgtgtgcaaactaattactgaggggaagctcattctggagagaggcaagaaagccaactgcttattatgggttgctccagaactccagcctgtcamaccttggcgaaagcagagaatgcagacctgaaaatgcagtcttaaacctgcagccatttctatgcctagtggcaaagcagaatactgtaaagcaactttt

SEQ ID NO: 35854 - DNA, 201 bp, Bos taurus
aggagtacaggaatgcatttttaaggtagttgtgaagaatttctaggaagcagtcatgcaataaagctgagtattgcctctttttaaggttaagtaaagtyctaactggagaaggcaatggcaccccaccccagtactcttgcctggaaaatcccatggacggaggagcctggtaggctgcagtccatggggtcgctaaga

SEQ ID NO: 35855 - DNA, 201 bp, Bos taurus
ctgtttttgaacatgcaggcacaagtcagtgaagggcatggtgtgtgaagaggtaaccagtggagtctccaagcagagaaaagcaccttctcctgagagcrcccctgggtccatgccacacttgcaccattggcagtattgtcctctctaatacgtctcagggttctcatcatgtcctaaacactgctctccctgtttgct

SEQ ID NO: 35856 - DNA, 201 bp, Bos taurus
tctcttaaaatgctcagcacaggaaactccgcactctctctggagagccctcagtgcgggctgtcatagggacctgtgagggtgagaggaagacagagcaygccgtccctggaggcctccctcagcaccccagccccagccagacacaggcctcgggagccactcgggccccccgcccccgcccttatcaccatccccgcg

SEQ ID NO: 35857 - DNA, 201 bp, Bos taurus
ttgaacagtcgtccccccccccccgctttaaattcctaagggctttgaacacgaaggactttgaacaccgactctccaacagggataatgagatgtcttayggacaatgttttgaccacagttctatatcaaatgtaaaaccttctttatgtgattgtatctttattcagaaacatttgccttgcttttgttgtcaagtga

SEQ ID NO: 35858 - DNA, 201 bp, Bos taurus
actgccttatccttaatgtgacacacgtcacttcagctcagtcagagaccataactagtcacatggccccaccgtaaccgcagagcaggccagggagtatyggaaggcacctgaactacttggtgagcgccgtctctgctacacctttcagtactgcgttctttgtggacaagtgtcagcaaaaccatgtggtggcctaag

SEQ ID NO: 35859 - DNA, 201 bp, Bos taurus
cttgagacagctgtcagtgacagatagcaagactagtaatagtaaacagacgctttggttggttttggtatgtaaaagttaagagggagttgctttgcacrtgaaaatttgaattgaaaatgtgttctgtgattgtgcaaaacagcagtgctgtctttaaatttttattcaaaggacagtgaaatagaccaagactgaatt

SEQ ID NO: 35860 - DNA, 201 bp, Bos taurus
ccggggtcggcatcgtctgagggcctgacgggaagcttttgctcgctggggtgtgcgtgtcacagacactcacctcaagttagcacactgccagctccacragcaggtgaggggccaggccgcccctcccgtgacgttccccgtcgagaaagccccgtgtaactggatgactgaccacttaggggaccctgtctctctctt

SEQ ID NO: 35861 - DNA, 201 bp, Bos taurus
attcactttctctatttttgtccactggagggaagggctatgcaagcaaaatgacttaagccctacagtctaactgagttgggtgatgtagctctcttagygaacactagccctacccagtgggcacaaaggaatgaacttgtaaagtggtactgaaatttcagaggatatagtggatattccgtatcgaactgagctcaa

SEQ ID NO: 35862 - DNA, 201 bp, Bos taurus
agaataaccagaaagtgtgctgactgaggtctaatcactaaattttgggtaaaagcttgaaaatggcctgttgatagtacataataaccagaacgattatyctctcccttgccgagaattctaattaatggggaaatgcaaaagaaaagggtgagctgagaacagaaggtctcagccatcaagagcttgactctcccagca

SEQ ID NO: 35863 - DNA, 201 bp, Bos taurus
tgtttctgaccatccagcagattaacacagacttgctcagagggtcactggcagaggtcttgagagcagcaagagccacttttccaggctctgcttatgtygtatttttcctgtctcactggcctgagggagtcacatgcttggcccagagtcagcatattagtctgctcaggctgcctccacaaagcaccacagactggg

SEQ ID NO: 35864 - DNA, 201 bp, Bos taurus
cagtgacttgacaatttcatgccatttcaaaagggccaagtttatattcagacacaggaaaactctggagtgttacctgcatatatgttaatcagccgcckcctcgtgaagagcccacagtggccggcgcgctacggaaccagggcttcctaaggtgtggccagtgcctcctcaccgagctcccaggagcagtgacctctg

SEQ ID NO: 35865 - DNA, 201 bp, Bos taurus
caaccggggactcagcctacagaaggcagcagcaacgatatccctgatgtcagatgcagataacgtcaggacccaaggcaatggggcccagagcagctggratttgagagacagcctctccaaggacgtaacacttgaggtaaggggtgacaaaggagaaggaactggccatgcaaagacttggaggaacagccttattgg

SEQ ID NO: 35866 - DNA, 201 bp, Bos taurus
cagataaagaaatagacattcagagaaattggcatagtgttttaaggccatacactgcttaacagtaagactgtaaggtttgtagtaaacaacattctgayaagatgtgtaactattacaccttctcaggttctgaatttatctgtaggttatgttgaggtaaactgtcatatgtaattggaattaaaagcagaaatgcag

SEQ ID NO: 35867 - DNA, 201 bp, Bos taurus
cccatctagcagtaccaagaaagtcaaggccaagagggtctggacataaatacccaagggatcaaccgatgagccctgtgtacaggaactcaaggtcacarggacttggtaagtggggaaagagtgatctcttaccttttatagtttacagattgcttctgcgtgtgtttttggaaattgatgtttggaaaattctaggat

SEQ ID NO: 35868 - DNA, 201 bp, Bos taurus
aagtacacctttagaacatataaaaagcatatcaaaatgtggcgtaagagagatataaattaaaactccacatttgagctaaagagtcctggtaattttcrggataaactgaagttggaaaactggataaaatatgtctcccttctgagagtggtcagtgctattaggagctctctgacccttgagcctgaaaatcatgtc

SEQ ID NO: 35869 - DNA, 201 bp, Bos taurus
tgaggaacctcaagatctgcagtcaacgagtcagagacccagaagacccagaactgtagtttcatttgtgttcaaaggcctgagaaccagggatgctgagrgtgtgagttcccatctgagggcagaaaatggatgtcccagctccagcaatcaggaaggagaggttccctcttcctcagcatttctgttccactcaggcct

SEQ ID NO: 35870 - DNA, 201 bp, Bos taurus
gttgacactagatctaggacccacaggcctaaaactaggtaactccaaagctggccacacccaccagtggccagcagcctccacataaagcagggcctcaraactaacctgaccaggggttagccaagcatatcagatcaccaagagtaatcagcctgctacaatagaaggacccacacagcttacacagggggagaccct

SEQ ID NO: 35871 - DNA, 201 bp, Bos taurus
ttccttaagttccaaaatttactagagacatgatgaagaagcctgtattttacaactgtagcaactgtcaagaatctttttaggtcactatattatccttygtcaaagatcaatagaagtcacttattgtgctttttgtgggtgggattagaagggagaccactgatgggcataattcaaatcacatactgtgtgggtaag

SEQ ID NO: 35872 - DNA, 201 bp, Bos taurus
gttcattgtatatccgcttaagaatattgtgccagagagagaataacagaacaaaagttgcatttttaaagtgaaagaaagctgcattttgaaggttcatractaatatcacttggcatagaagtagttaaagacacatttagaaaaatggtgatgaaccaaatatttgaattcgtgtgtaattatggttattccaataca

SEQ ID NO: 35873 - DNA, 201 bp, Bos taurus
atatgagaaataacatattaatcattcaacagttgctgcttaacccatactaagtaatttacggcaaaggtgaaagaggagaaatgactcaaaactgcaaytgtaacctacaataaatattgagcaaatattacattctgtccttttcatcctttctttagtaggctatactctctatggtagctagttttggtggtaaat

SEQ ID NO: 35874 - DNA, 201 bp, Bos taurus
tatacataacattccctgacgagtatctgaagcaaaactagcccatgttgccaattaaaagggaagtagttaagttagggagagaccatcttgagtgagcygatgagggaaacagatttatgaagaggatgctccagctctattcagaggtagtatagatacatgcatttttttttttctaatttgaaaacaagcatgagg

SEQ ID NO: 35875 - DNA, 201 bp, Bos taurus
tttgttttaattcccaaatgtcgtattctttttcagaaggcaagtgtgtgataaattataaactcaaattatgtattaacatgtgcgggacactctggggwtagaatagagatagtaataagtttgaataatttcttgatttgggtctaaaaacatgatgagtttggaaattaaaaataaaaacccaaactgtatatcaat

SEQ ID NO: 35876 - DNA, 201 bp, Bos taurus
acacttctttttataaaaggtgatgagattgttttttcaaaaaatacatagatatgtatttaatcatataatagacatctgaataagtccataaataaggragtggtcaatgactggaacagtcagcataatttatttcagaatccaagatactaaaatagaaatttcctcccctaggttctagtttctcactctcttttt

SEQ ID NO: 35877 - DNA, 201 bp, Bos taurus
aaattgtaaagcatatgaagcttatatggcttttttctatttacattctgaatagaataatattcttaattttatagaacttatgtctctatagcttatayactagtgtgctagatttttctaaataaaacatttccttggctaataaaactacaagttgtattataaagctttagtgaaagtgactttaatttagaatta

SEQ ID NO: 35878 - DNA, 201 bp, Bos taurus
ttgttagggaccaagcaagaaacaaaacaaccattccagtcaggaggaaagagataggtagataataaatatatagtacacttgaaaatgataaggcctaytaaataaacacacagcactgattagtgttgggataaggatctgaggggtagagacaagaattagacattgtaactagagtggccagtagggtgaagacca

SEQ ID NO: 35879 - DNA, 201 bp, Bos taurus
ctccccgctcagtcttctctagcatcaccctggcagtgagttgaatcatcttgctacagcctggcaagagtggaagtctaggttcaacacttggcctttgmtgggatgcagttgcaacttggtctgtggtattcacccagaaaaaaagtggttaaaagtcccctgtcttgtttagctgcctctttcttggtcttttggcca

SEQ ID NO: 35880 - DNA, 201 bp, Bos taurus
caatttttcttttttcttaaatctattcatttgttattgggttgtatgagtctttatgcactttgaatataaacccctcaacattgtatattggaatatgrcatggataatacataaataaggatctctgcagatagcctgagtacctccaataaatcattgccacaaggtctatctggctaaatttagcagctttatatg

SEQ ID NO: 35881 - DNA, 201 bp, Bos taurus
agagttcccattcagataaagcaagctttgaacaagaagtgaggaaacttgcttggaagagtgaagacagacgtatggctttctactctttatttacgtgkggccagttaaaatctctgttccctcatatgtaaagtggacttgatatatatctttgaaggtattaataattagaaattacataatgtttgtgaagtacat

SEQ ID NO: 35882 - DNA, 201 bp, Bos taurus
ataaactcttggaggggacaaacagaaacttgtgtacaccaggacccaggagaaaggagtattgagcccacaagagatggacccagacatatctgtgagtsttcaggagtctccagtggaggcctgggtcagcagtggcctgctgcaggtcgaggtcactgagtgcagcaggtgtgcatgggaccttttgaaggaggtcgc

SEQ ID NO: 35883 - DNA, 201 bp, Bos taurus
aaaaatagggaatgacaacttagaagatggtattaatgacttgatattaatgatggtattaattgctttagcaaatcaataaggtggaccttgttttgagytgatatgacatgcactagtaataatagaggatactgtgcatattttttgtttgtttagtcgctaagttgtatccaactctgtgaccacatgggctgtagc

SEQ ID NO: 35884 - DNA, 201 bp, Bos taurus
taattgatatgttccaagaagacagacagaatgagctgagaataaaaatgagaataccattggcagtcactcatttttaatgataagaagtttaggctggrtgttttcatgaaaaacaaataacatggctattttggatcagtcagtttcttaaggatgagtatatctgcatttgagtgcatctgtgcatgtgtatatata

SEQ ID NO: 35885 - DNA, 201 bp, Bos taurus
agtttggtggaagatgccatctctggggccgcgactgcagcagccccttaacttcccactctggctgtcacacacctgcctctctgcctcccctgggagamgggcctatattgcagcctgatagctctcctttggtattcactcaatcgtttgttctgtgagtgcttcaggcttcattcagcattagagccttgtgcggca

SEQ ID NO: 35886 - DNA, 201 bp, Bos taurus
gagggatgaaacaaatccaacaaaaaattgtgtacttttgaaagaagaaaatataaaccactgcttagcaaagagaatgtgggcctcctctccagtatttyagaggttaataatgggcaaataaatggataagagataagatataaatgccatccagtaaagtatatgccctgattataggcctgtacaagtaagataaat

SEQ ID NO: 35887 - DNA, 201 bp, Bos taurus
gggatttcagatggttctttaagataacacagagaccatactttgtaggccttcaaatgtgcaggtctaaaacatttctttggagaatgatagcccagttrggttggagaagaccacacaggccaacccacagagcagcctctgctctagtacaatgtcacatggatgctgtctttggaattacaactcagtaggtctgga

SEQ ID NO: 35888 - DNA, 201 bp, Bos taurus
ttcctaagggccagccattttctggttgtccagacacaaaggtgcagagacaacactgtggacccagacagggctcacaaaaagagcataccttctggaaytagaaagctgatgactctcccaatacttttcagacagtggcataggtggggggtgagactagaggacgggaggaaaaataagtaggaagaatgtttgaag

SEQ ID NO: 35889 - DNA, 201 bp, Bos taurus
taatggctgaatgtgttccagattcagagaaaacaataaaccctgagactgatggaggtcagtaagatccaagcataggaaatatgagtaaaactaacccyaggcacatcttaattgaattgtttataaaatagtggaaatgtatgaatagaaaatgttaaaagtagctggggggtggaatatgtaaagagaaataatata

SEQ ID NO: 35890 - DNA, 201 bp, Bos taurus
gaaattacatctgaaaaaatattctgaatattaatctctttctcatcatgacatacttcaaaatgcttgtcatactatggccactgatctaaaattattayatcatgaattctggccaacatctactacctctatatcacttaactgggcttcacttgtggctcagatggtaaagaatctgcctgcaatgagagagaccca

SEQ ID NO: 35891 - DNA, 201 bp, Bos taurus
tttgctttctccccagaagaatgacactgaaagaaatatgcatcgccttgactgtacaggatgtgtaggaaatcttggccttgccagcttgttctttaagyaagagtcataaatatgaccaaagactcattagatcttttttggcagaagctaaagaaatacaaagaagcaaaatggctgtctggggaggccttacaaata

SEQ ID NO: 35892 - DNA, 201 bp, Bos taurus
tcatttagcatcactctctttttgacctccaaggggcctttctgtgcacatgtaattgggaagctctcctgatttcatcttctgtttgagcagggatcaamctcctcctttaattgcctgctctttttgtcttaaagtataggtctacagagaacaaacttcacatgttttccccagggccccatctatcttctgcctcaa

SEQ ID NO: 35893 - DNA, 201 bp, Bos taurus
ctgagcgactgagtacacgcacacacagatgttcataaaggtcactcccttcaccttgtcccagccaggcctgcaatgtggcctggggcattctctgctgrcagcatgaacaattagtcagaaatcagtacagaacttgcagagcctgaggacctgggactgctcaggccactggctttctactatgggtagttgtctctt

SEQ ID NO: 35894 - DNA, 201 bp, Bos taurus
ccgactccctcaccatcatcaaaggaaactgaagacctaagtaaatgaacaaatatttcatgttcctggaatcaacaccatcacactgtcaagatgaaaaygactgtgttttaaattccaggccccatggaggcaaaaccatgcgttctcacatctcttctgctccatccctcagctcccagctctgtgttcagctgacta

SEQ ID NO: 35895 - DNA, 201 bp, Bos taurus
tcaaaaattgtaagtaattttaccaaattaataaagcctttttagtgttggaattcagatttgtctcaactcacatgctatagcctccgttatattgcttrttatcctattttcaagtacaaaatattatgagaataagataatgtagttatgcataaggattttctcacttacagaaaatattatgtgggtttgtattga

SEQ ID NO: 35896 - DNA, 201 bp, Bos taurus
cttctaaaattttttgattgtttttctgagccaagtttttttttcctcaaatttgttgttatgtgactttgttttactcttaaatattattcagtgcttcmtagaacaaataaatccttagggagctgtctgtgaatagaaggcttgctaaagatctgaagaaatatttgatatcttaccatttacctgaatagcaaaact

SEQ ID NO: 35897 - DNA, 201 bp, Bos taurus
cttattctcagcaattaaccttagctcttgccttacagagaaattagacaccatcagatcccacccccctttctcattctgaaatcccacaccttcaaacrtgtcctaattttcacctaaatattttccttctctttcttcacaggagatgtttggaactagcacgcgtgccccacttccgtgccccgggtgatctctgta

SEQ ID NO: 35898 - DNA, 201 bp, Bos taurus
ggactcctgcatttgtccctttcctcagttgaaatccctcttctgagctagttcaagtgcattggtatgaaaaattcattcataccaatgaccagttgtgrgctaatcggtcacctcatttgaaaacagacctccattgtaagatatgatggatatagcattttcttaatcttcagattattgaattaattttaaacacaa

SEQ ID NO: 35899 - DNA, 201 bp, Bos taurus
ttatactttattaagctgtttataagataagattaagttttgctataattacctgccttttcctcctgtgtctaccataatattctttactgtttctactrgatcatttgtgaatgtttccttttgtttgataaatttgtattttattgtacagactgatgtgatcatcatcctttgatttaattgcaagcctgtcttaaa

SEQ ID NO: 35900 - DNA, 201 bp, Bos taurus
gcctaagtgctctgttgctttgtgctttattttattatattgtagggaaacgtatatagcttcaattagtttcatactattaggcttgtgataaagaccargttctgttctggttgccttacagttaatttatttaattttcatgatgacacactgagaaaggcactgttattagccccattttaaagatgaggaataaat

SEQ ID NO: 35901 - DNA, 201 bp, Bos taurus
tgctttttctgagggaaaatataagccaaagaacaatcaagtcacttgaaaagggacttttgtaaggcaacacaaatgtaaaggagagacgtcctttaacraaagtcccataggaggataattctattactttatattaactcttcatatatttcagaagactattcaaaattttaaaaggttttgaaatacatttctaca

SEQ ID NO: 35902 - DNA, 201 bp, Bos taurus
gcaacatctgtgttaaaggaaactctaagaaagttaagtctgcatagtttgacctgaaaacaccacagcttgcttgagttacatggccacctgtcacaacwgcgctccagattcttctaaaacagtaggagtttgtcacataaatggaatgtgcaggatttaaattattggagaccaggaggccaccccaacgagtgtgaa

SEQ ID NO: 35903 - DNA, 201 bp, Bos taurus
tgctgaggcgatcattaacatcatgcatcagatcgttcttgttctccctgctacaaggcagctggcagggctgtgctttctggttggccctcatattggartggaaccacgtgatgagtttttgctgataacctgagaatggaaatgaggtttggtcctcctggccagagtatcagctgtctggccacgattttctgggtc

SEQ ID NO: 35904 - DNA, 201 bp, Bos taurus
ccagaaatatctggcaatgtgtgaaaaggccgatagaatagcacagtgggaaagagcttggtctcacactccacccttttcaagatgaactaccttgggamgtttaacctatcttggcctgtgggggttgttgtgggaattaaataagatgttgacaaatactcaatttgaatacaccgttacttcccttggctgccacag

SEQ ID NO: 35905 - DNA, 201 bp, Bos taurus
atatatgcaatatatacaatgatccgtttaactgatctatccgttcagttaaaagttatgtcacggctttggtccaccgtcatggagtggcctgcaatttyctgcctagcactttaccattcttttggcagctcacaatctccatcttcctcctggctttgaaagaaactaggatatttgcaaagacctcatgatctggct

SEQ ID NO: 35906 - DNA, 201 bp, Bos taurus
ctattcaatatgtaggaaagtctctaaacactccgcatccattccctcactgctttaaagttttgtttcccctttatttaatgtgagggactggccatttmtggcagtgatttctttatcagtctcctaggaagcctatctaatcctgaagcaaataagcctatttgtacgatggccttactcccagagtccccatgagag

SEQ ID NO: 35907 - DNA, 201 bp, Bos taurus
ttaacaaaaacaataataatacagaaaagctcaagtttcccctaattcctccatctcaggcttatccccaccaccagcatttcaagattgaaaaacctctragctctgtattcctaaggaaaacctcactttcttatgcacttttaaaattaatagtttgaaatacattctctttatggatgtgatagaatagaaaaacaa

SEQ ID NO: 35908 - DNA, 201 bp, Bos taurus
cataactcttttgtgtaacacttaaccataaaatctcagtgacaggcaacaaatatacctgttgctcacacatctgtgattggctgggtttctgctgatcyaggcaatgcttgatcaggcggtggtttcaattcaggttagatctctgtgttactcagttttctgagacccaagaaatattcttctcatgctaatgtcaga

SEQ ID NO: 35909 - DNA, 201 bp, Bos taurus
agacaattcttacctactagcatgtctgctaaaggtatgtctgagactgttagagagtgccacattcctcctcgggtgatttattctgatgggccagaaakctccgggtcactaatagtgagaagactgtcatatgttttcaatgaaaaggaaaaagacctttggtgatttccctggtggcccactggttaaaacttcacc

SEQ ID NO: 35910 - DNA, 201 bp, Bos taurus
gcttcttaatgtcaggcctctcatcttcctcattcttatttctcccctgcaagaccataagcaaacaataggtgcttaataattaagaagagtgcttaccrtgtgtcaggccccaaactaaggaccttgcatttgttcactcacctactcttctccacaggcttgtgagatgggcactatttatatccttattttatagat

SEQ ID NO: 35911 - DNA, 201 bp, Bos taurus
ccaaagtgtgtgcgccgaacagctgacccggtcttgttccaaatccaagggcctgtaagacaaatgggatcggaatggaagccaaataaaaatggaaaaartgctactccggttacataaagaagtcggtgtttaattagacaggggctatgaatcgcagccttcaaaataaaattgaggggtgaaaaaaaacaataaaac

SEQ ID NO: 35912 - DNA, 201 bp, Bos taurus
taaaaaagggctttatgacagtagtgtggaatttttaagaactcagagacagctctcagaggaagtaatatctaagctgaggcctgaagaacagatgggtrttagccaaatagaatgagagccacggtaccaagcagggtgacagcacgtgcagaggcccagaaagtaaagggagcacacagagttgggaagtccagcccc

SEQ ID NO: 35913 - DNA, 201 bp, Bos taurus
agctgattaaaaacagtctttaaaaatctccccaaagcagggacttccctggcagtctagaggtttagactctgcacttccacagcaggggccacaggctygatcctgtgtgcggtgtcaaaagaaaagagattccccaatgaagacaatccttctcaaaggtaagatgcaaaatgagcacacttccaagttgcttgtacc

SEQ ID NO: 35914 - DNA, 201 bp, Bos taurus
aaataaagcagtcatctctcccagtctttttgtttttgtttttgctacttagcttgtaggatcctaattccccaaccaaggatcgaacccgggcccccagyagtggaaactcaaagccctaaacactagcccaccaggggattccccttcaccagtcgcgaaggagtggccatatgttcaagataaatcttgtcagtcagc

SEQ ID NO: 35915 - DNA, 201 bp, Bos taurus
ggctctggcgcctcctcgctctcttttcgctgacgccgagaccgctgtgtccctgaaaagactgccgcgctgatttaagtcagccctgctccgcggtgcckcctccctttatcgcgtagacagtgcctgactcacccggttccagttccacgccctttctccgcctcagctcgccctcacaggacctacaaactggaacca

SEQ ID NO: 35916 - DNA, 201 bp, Bos taurus
atgtatctttttatttttttctttttattatgaaaaatttcaaacaagctcaaaaatagaacagtaaaacaaccccctgtgcattcatcatgaattctcartgttaatcaactcgattttacttgccctcctccaccttttcatactaactggattaatttaaacaaataaaaaaatgtcataattttcatatgtaaacat

SEQ ID NO: 35917 - DNA, 201 bp, Bos taurus
ctcgattagatttgggttccatgtgaatacttcataggtgacactttgaacttcctgttacagcacatctgaaggccgaaggcattctcgttgtctctctytttgtgaaactaagattcatcagaatttagatgtttgtcagcctaatctggccatgcagtcagtgtttcttagtggtcacttacctgatgatttttgcag

SEQ ID NO: 35918 - DNA, 201 bp, Bos taurus
gcctctggcatgagtgtgttgctcccaaaacacaccacatgctgttctaattaggaagaagtctggaaatcatattccaagctgtgttagctttcacgaasatcacctacaaggtgttcaaagctgataacattctcaaagatgaaggccgaagcagggagtggggaaagaaaacaggacacgctggcctctgcatcagac

SEQ ID NO: 35919 - DNA, 201 bp, Bos taurus
gctgtgtatgtgcggccatgacctggtcacctggagatgaaaggggtcatcgaagggaactggagagaacatagcacagagtccagaaaccccaggttaaygtggggccctggggctgaactgcggggagctgggtggccgctatatttcctgtgtactgcccacgtctcctctgtctcctgcgatgtgactctaattctt

SEQ ID NO: 35920 - DNA, 201 bp, Bos taurus
gctgacagacagaaaaggcacatttttactttttcactatgtcaaatgatagacttgtcttttcctgagtccccacattattttagctgttttagcaaacwacatttgagtctctgggccagaagcttctatgaccgtggcatctgcaaataattgataacttaacgtgccccctcaagaggtaaggtcaattcaagcagt

SEQ ID NO: 35921 - DNA, 201 bp, Bos taurus
ctccattccatgagtgaccgctgcaggtgctcaaggccggtttcccaaagccggacacggcctcccatatcaacagtgacaacgccacctctgccccactyggccagcagtgcgtctgtgtccgagatagtagacagccatgtggtatatggtgagagagagtctgacctgaaaaagaatcacggcgttcaaccgattgaa

SEQ ID NO: 35922 - DNA, 201 bp, Bos taurus
atctaatggtgtaacatggtaactatagttagaaacattgtgctgtataactgaaatttgctaagacagtaaaacttaaatgttctcaccaaataaatatrtaaataaaaaggtaaatacgtgacataatgaatgtagtatataactcagcaggagaaatttttccacaatgtacctgtaagaaacatgtatattaccata

SEQ ID NO: 35923 - DNA, 201 bp, Bos taurus
atttatagttcagatgctaatgccaagagtgacatacaagtaacatgacaacgggtcacattacttacaagaaccactcatgaaacaaattaattttctcmcaggacacaaatttcccacttttcatgctatgctatttccttttggtggagctgcccacactcaaccaaatgaaaacatcctggacagatacagtcaagt

SEQ ID NO: 35924 - DNA, 201 bp, Bos taurus
tggcctccagctgttaactcttttaggtccagcttcacaaacatacgctctgctctggggctcccggaaacttcctcagatctgtgtcttgtctgatagcycatgtacccaatcccagggcccccctttgcttcccgcaggtcttattccctactaaactgtctgcacacaccaccccacactcccatttgcttccacaag

SEQ ID NO: 35925 - DNA, 201 bp, Bos taurus
ccaaagtggccccctgccctgtcaggcctggcagacacctttggccatcactcatgttgcctcaaagtgtctcctgccccagggtcatccacacacatcaragcatccatcacgttgcagttgggcctttcagtcagccacactggcgtccagtcctgcatgcgagcacatcctcagaaagtgctgccaagctgcatcagg

SEQ ID NO: 35926 - DNA, 201 bp, Bos taurus
taaggactagtcttcgagttactgctttgaattttctggccatgtgggagcagtttgtttctctggtctcttatgacctggtgttagctggataggagctwgtgctgataccattggccaggtatgtcttgtctgtctggatatcaaaaagtctcaccgttcatctctatcgatcacccatagtgaaagaaattatttctg

SEQ ID NO: 35927 - DNA, 201 bp, Bos taurus
gtgtgtagatgcttagctttatgcagtagatgcctattttatttatttttgatgcctattttaaaatgtaggtttaagttggatcttttgatcatctattrtaatttttgagctatacagcaacagtaattccattagtctaattcatttttaaatgttctatagcgttttctttttctgcttttgcaaaaaattaaactg

SEQ ID NO: 35928 - DNA, 201 bp, Bos taurus
ggaatgatacttatatttggggtgcattcatctgggatggtctgaagtaggaccttggatgaaaaagtgtgagtgtcctgctggttctggaggccacggtrcttgggatggcttctcagacttgctgtatcgccctcctgtggaaaagatgtgcagttcaggaaatctgtcctatttctgaacagagggatgggaagcatt

SEQ ID NO: 35929 - DNA, 201 bp, Bos taurus
acccgtctgcatttttcaccgaggcttacggtggagaagtaacactggtcacacgtcaccgtttgacatgcatgttattagacgaagggccgctgaaaaaygccaccctctggtcagttttaactcttctgttgccatacagttgctgttagtgtcaccttcagggagtgccttgtttagacagggccactttttgttttt

SEQ ID NO: 35930 - DNA, 201 bp, Bos taurus
gttcatgtccagtgctaggttgttttaaatgcttcatcagaacaacagtttggaatcccccttttaaaatacttgcatcttcacgatactggatgcttggkgctggtgcactgggacgacccagagggagggtatggggaggggggagggaggagggttcaggatggggaacacaggtatacctgtggcggattcattttg

SEQ ID NO: 35931 - DNA, 201 bp, Bos taurus
tgtctatggggtcgcacagagtcggacacaactgaagggacttagcagcagcatgacaacatcacatagaatctttagtcttaggattaaataagactacrgtcaatctatggccaacataggtagctgacaagtacccagactcagaacagggccatgagaaaagaattctctagccttgaaatccggagaaggcaatgg

SEQ ID NO: 35932 - DNA, 201 bp, Bos taurus
tggagaatcccatggacagaggagcctggtgggctgctgtccacggggtcacagagagtcggacgcgactgagcgcacggcagacacggcacatcttcacrtcagtctttggcctgcagcactctggactgcataaagagctctaaacacaggcattggtaatagaaatgctgacacggcccaactgtcacccctggcatg

SEQ ID NO: 35933 - DNA, 201 bp, Bos taurus
ccagtgggtggaccccagtgctttctggaagggcttccctgctgctcagaggacagaggtctcaccagaatcagtgggtaatcccgacctgttggcaagaygggccagattgccttcatgccctgattcacacacacacagaaggttttaatgcttttccctcattcacaagagtgcatcaagctttaaagatccctgtgc

SEQ ID NO: 35934 - DNA, 201 bp, Bos taurus
aatcagccaggaacttggcctcagggagcagagtcatgcaagaagagagacgacgtgcttagaaacaagaggactgggcagaaaataataagcggaaggcragtaaaagtcatgttagaggagatcaggcggagagatgtgtttggtgttttcagtgaaatgcatcttacgaatcaatacctgatcgtgtttacagagctt

SEQ ID NO: 35935 - DNA, 201 bp, Bos taurus
gtctgtgacacgcacggccgacacttggcaggttgaaacaggacccactcgttctcgcataggtctgtgagtcagaagtcctggctgggctctctgcctartgtctcgcaggccaaagttgtggtgtcggtcaggcaggctcttccctggagcctctggggaggatcctgcttccaaagtcattgagattgttgacagggt

SEQ ID NO: 35936 - DNA, 201 bp, Bos taurus
agacagatagatagatagatactttttaccttagacatgagtaaagaattgcatttgagccaggagatggagggctctctggaggagatgccatgtgtttyctctgtgagggtaacgctgtcttctaaaatgaaactatgaatctgagaggaaatggaattctccttctggaaaagtctgccatccaagggccagagacca

SEQ ID NO: 35937 - DNA, 201 bp, Bos taurus
aagggctgggacacagagtcggcaaacagtcagtggattttggccaaaagtatttctaatgagtgaggagctctggaaggtgtcctgggcccctggttacygcagctctgaagccccacttctctgcagggtccactgtggggagttacagggagacagagaatgcagagaccgtggtctggcaggactggcctggaattc

SEQ ID NO: 35938 - DNA, 201 bp, Bos taurus
aaaagaagtctgtatctatgctgtggttgagtctccatggaaaatcgacaacctggacaacactcttcataattaagagtactggtccctacaaagaactycgagtttaaatgaggtgtagttaaaatccaagagtgtctgtacattatgaaatggtttaagggttgtgtattaagcaagggctgttttagttttactttt

SEQ ID NO: 35939 - DNA, 201 bp, Bos taurus
tttttcagagaggttttgggtaccgtatttcatttacaccttagtgatccactccacggtggcatgtgtttcttatattatccccatgcttctagcagatrtttataacctgtcaggaccctctttcctgctaaaattgttgttgttcagtcggtcagtcatgtctgactctcttgtgaccccatggactgcagcacgcca

SEQ ID NO: 35940 - DNA, 201 bp, Bos taurus
ttctcgtagtgcttgctggaaaaggccaacacccgtgtgttttattgatgcacggcagaacctcagtctaaaagcaccaggtctgcctcgtggcatttgckgagggtgttttaaacgcatagttccagagtcaagaacattgtctcttcgactcagtgaatgcattattaaaggacttttgctgtgcccagcacggggtgg

SEQ ID NO: 35941 - DNA, 201 bp, Bos taurus
gtttaagccaacgtgggggatatgttatttctaatatccttgtaacatcccacagagtatataataataaacatgagaaacagcatatcaaatttcttctmatttctatctgtctcccagtgaaatcaaaggattacaatctgtacataatctacttccagagttcttattgcaatagagtaagactattacccatttaaa

SEQ ID NO: 35942 - DNA, 201 bp, Bos taurus
tagcccagcaaacagcaggcctacttgggcttaatctgtggcactttcttgtaaccagagctgtctaacaatgggactatttgtcctataaagtagtaacrtaactgaacaggactctacggggccttcctgggacagacctgctccatatcctctgctttagctcctctctgaagtgcttagataacagtatttgactgc

SEQ ID NO: 35943 - DNA, 201 bp, Bos taurus
cagactccctctctggggtccatctgcatctggattatgccttgcagacctgatcttctcccacttacacgtacaatgtgctactcttgttgcatgaggtrtgtttatcacctgaaacaactcgcaggttacaatcaatcacgattcagaaacacatatttctcagcgtcgttagtggaaacaaatgtctgcaacaactaa

SEQ ID NO: 35944 - DNA, 201 bp, Bos taurus
cactggggctgtctgtgaacacatcaggaagcatatctatcctctttcctttgaaactcagcactgaactctgactggggcccacagcaagtgctcaatawacagttgtttgattaattaattaatactatggatgtcctgtcggcaagattcaagaaataattattgaatccatagtgaggcctgtatctctgccatcaa

SEQ ID NO: 35945 - DNA, 201 bp, Bos taurus
tgttttcttattgctgagttttaaaattttactttatattttaaataatggttctttaccaggtttgtcttttgcaaatattttctttcagtcaatggctygtcttatcactctcttgacagtgtctattacagagcaaacatttttaattttaatgacgtctagctcttcaattatttctttcatgagttgtgcctttgg

SEQ ID NO: 35946 - DNA, 201 bp, Bos taurus
gcctccgagccatcagcacatgctcaactgactcctagacttcattttaaaaacataagtcggagataaattgaagagttttaagacaacggcattaaccrcaagcgtaaggcccttgtgggcatgcgacactgtgactgcaccagtagcatccccgtgaacctggccttggttagaaacgctgtgttcaaggttgtgcag

SEQ ID NO: 35947 - DNA, 201 bp, Bos taurus
atcatttatcaagggctggtaatcatactccataatgcctcccctatataagttgtcctctccattcccactgttcttcactgccaaggtcaagttctgaycctgcctcctgccttgagtattgaaccaccctataacaggactttttcccatgtaatacgtcacatacttgcagtcaagatttgcctgtgctctacaatt

SEQ ID NO: 35948 - DNA, 201 bp, Bos taurus
ttaaactattggcaaagactgaccgggccaagcccagagacacagattatatttaagatcaagattcagaagcaaggtaggtgaagaaggtccagggtcarggaggccacgggtttgaggtgatgatgaatgatcaccagcgcccacgagactctgctcagggctggcccttcagcctcttctcggttttctatgagcagg

SEQ ID NO: 35949 - DNA, 201 bp, Bos taurus
acagggaaggtatggtcctgtttgcctgggcaaggcaggaaggctctcagacaaagtagcctccaaaggatgagagcatcggagtggcattggaggagaakgtgatgtaatcagagaagagcaagtcaggagtcatacacagggctgggaaggagaagaaagtgtgaaaggaggtgggcagaggttagatcttgaagcatc

SEQ ID NO: 35950 - DNA, 201 bp, Bos taurus
gactaccagggaagtccataggccccatttttagacagggtcttccagtagtttctctggggcagccagcagcaacaggacacgtactgctggataaatayggttcctcccctgctggatggccaaggacccagagtccccagaacccactggctgctagcatatcagaccccctctcttcagcctgatgaccacctagta

SEQ ID NO: 35951 - DNA, 201 bp, Bos taurus
cctcctggcaggaggaagcatggctggagagcagagagatcaggggccgaaggtcacaataaaaccaaggtcaaaaatggggaatttagcccagagccacrcattccattctactaccaagccatcccagccaacaaacatcaccttctctccactcagaactttccacagagggagttccctggcagttcagtggttatg

SEQ ID NO: 35952 - DNA, 201 bp, Bos taurus
ttcaggaagaaagaatgcactctctcagcctgtcttcaagctgggacatttatcatctcctgccttcagatttggcctggaaattacatcatcatctctcytgcctctcaggcctttgaactcagactagaagcataccttcagctctcctggtcttcagcttgtcaactgcagattttaggacttctgagcctccatagg

SEQ ID NO: 35953 - DNA, 201 bp, Bos taurus
agtgtgcttgttatactcgttagtgatgcaaagattgatacacaaagataattgtttcagcatggtttgttatggagaaaaatgagtagcattctcaaatytcttagtaagggattaattaagtaaactggggacattttaaaattgcttaatatttttaatttgaaacagtctcaagcaggagaaaagttggaagaacaa

SEQ ID NO: 35954 - DNA, 201 bp, Bos taurus
agatctttattgacagtgcagtgagggaggaacacaaacgtggtggcactgctgatggcaagtggaaagacaggcggccgggtgtgggtgctgtcagagcrgaagtgtgtgagagcagagtcagcagctcggtgtttcagatgtcctgtactgtggacatttcacacattgagtcagagagttttagggccttcttttttc

SEQ ID NO: 35955 - DNA, 201 bp, Bos taurus
tcccatggccacttttcttgggcctggtccttttgtaaagaagtaaaagcttcctcagacactctcccttccccgcaagagtgccagctttgtcttggtgrttggaacttgtaacttggccatgcttagctgcagagggcctgggagaggaagtattaacattttctagcttctgtagcggagggctggcagtgcagagga

SEQ ID NO: 35956 - DNA, 201 bp, Bos taurus
ctgatgctctccagtggccacctgggatccagcttctgtggcaaggacgggagtatccccaggcagcctggtacagatacgtggggtcctagtcgctattstggccagaaaggagtgggccctgcatggctgtctcggtgttagggcgagccggccactggctctggagccccccggcacccgcccacctgctgcggccac

SEQ ID NO: 35957 - DNA, 201 bp, Bos taurus
gctggcaggtgcccgcggcctgaggagctgatgaggttggcgaaagaggaggatgttggaggaaaggagcgcagaactgagaggcctccaccctggaaggktagctgtcagggtgttgaaatcaccaagaatactcgcaggagtagttttagaaaaaaatgatagcgttctgagacctgcaaaaagtgcccggccaggtga

SEQ ID NO: 35958 - DNA, 201 bp, Bos taurus
tttcacaaggtcaaggccaaactcccgtcctcccccacggtctgctcttccctcagtctttgtcggctctgcaaatagcagctccaccactcagccaagcrtctcagaaccatcctggccatttactttctgcctcacctcccatgtaacctggtatgaagtcctgcctttgccttcaacacacatccagagtctgatcgt

SEQ ID NO: 35959 - DNA, 201 bp, Bos taurus
tttctgcctaacaggagacttgaaatacatgagtgttcccactgacagcctccagggacaaatgatttgacagaatggaggccaggagactagactgctcktttcatgaagcccaggtgtcaacaattgctacatgtgatctagtaaaaatatgtatttggtcttggcccccagttcctggcacagagtaactaaaacttt

SEQ ID NO: 35960 - DNA, 201 bp, Bos taurus
ctgtctacataaaccagatgtgtctccccctcccccgacttagtgtcccagccgggctgtgtggacgctcaccatacccctgttgggtagaggagtccttmagagcatcttggccaggtacctttcagatgactgaagactttaaagtgcattccagcccggtttgagacttccggtctcgtgggcattcccagctcacct

SEQ ID NO: 35961 - DNA, 201 bp, Bos taurus
aaccccacgtctcccgcattgcgggtagattcttcaccactgagccaccagggaagccctgagaaaaccacatctttgttcaacaggaaagaggagatgcktgaggtgaacctgaacccactgcacagcccaggccagttccagttgacccatgttccgaagcagtcatcccagctgacccaggaacctaggttccttgct

SEQ ID NO: 35962 - DNA, 201 bp, Bos taurus
gccttccaaaacagccgaattctcttttctttcacaacaggccttgacttgctcatcctaaccacaaccccatcattaccagccaaggctaatctgaaccrcctttccttgggggccaagaaggctggtcttcaaagacctttgaaaaccttcaaagagatccagagcctgatcctacaaacctgccgcttagaaagcttc

SEQ ID NO: 35963 - DNA, 201 bp, Bos taurus
atgtgtttatcagtggatgtgctagctttcaggagttgatgtgtgtcttctcagaacagagttttctgttgcctgtggccttttattttctgtcagtgccytgccagctgtagctgtgaaaacacgtggacttaactttcacttgtcctggttggacgaagctccttcctgcatggacagtccgattggctctgtggcctt

SEQ ID NO: 35964 - DNA, 201 bp, Bos taurus
cccatttcagatttctgacctccagaactgggaacggatacatgtatgttgttttaagctgctgagttttggtagtttgttacagcagcagctagaaaccratacagtcagcttcggaagaactttataatctccctattcctgttgggctatgagtgcccccagatgcttggactgaatgaaaagaagagaatctcacat

SEQ ID NO: 35965 - DNA, 201 bp, Bos taurus
tggatacagattgtccagacagggcaagtggccccagaccatccttccatccaaggattgtctctgaactatggacccagcaagggaccgagcaagagggygaaggtggcctggcccagagggtcctgtcagttattaggaagacagtggggcccgtatgcttgtctgtgggtcaggggttgagatttatgtgtgaaggac

SEQ ID NO: 35966 - DNA, 201 bp, Bos taurus
ctctggccttggtcatggcacccagggatcacgaagataatccttttggtttagttcagataccttgtgggttgtgagagacggtggtctctgagttgccrtgttaaagtcaggcctggggtcttcaggtgctggtccttattccctgaggatggtgctaggatggctgggctctatctaaacgaatgtgtccgagcatca

SEQ ID NO: 35967 - DNA, 201 bp, Bos taurus
ttcttcaccttgaggcatcagcagccttctaataaaacctgttgctttgaggagaaagatagtcattagcctggtgaatcaacccttaatatagaaatatrtttgctcatgggaaaaggtgatgtttatggtgtgcttttggagaaggcagtggcaccccactccagtactcctgactggaaaatcccatggacggaggag

SEQ ID NO: 35968 - DNA, 201 bp, Bos taurus
ctttgtctgtgggtaaggcaggattcccctctaaagagctctctctacttcccacactcatgctaatgggccacctaaatggccagaatttatggagtggytcctgtgagtccagaattttttctgaactttcagttcagtcgctcagtcgtgtccaactctttgcgaccccgtggtcagcacgccaggcctccctgtcca

SEQ ID NO: 35969 - DNA, 201 bp, Bos taurus
gccaaaacgccaactctgactttgggggattagtcttgctcaagagacattgcttacttattaagattgagattagttggcaacaaggacagaggtgaacragtagccagaggtggccacaaagtttatatcacatcatttgcagagtcgccaccttccatgtggggctcagcctgcctagagccccatgcttcatttgca

SEQ ID NO: 35970 - DNA, 201 bp, Bos taurus
tccacaaagtttgacagagggtgatgaatctgcactcctttctcctggcagtcactgacagcagagcccaccagtaacttcaactatcacctaaagaggtktcatgattttctgtattttctaatttcctatatccctaaactaagaggcaatggtaaagccttcctgtgagtaagctgatacacattttgtccttgtgta

SEQ ID NO: 35971 - DNA, 201 bp, Bos taurus
tccattttcacatggacctaattcatgtagggaatcaggttaaaaggccataaaagcctggattatgaaatgtatgtgaggttgagacgtaattcatcacyggagtggataaacccaaagaccatcctgaccaacgtcaaatccaggtcagcaactaagccaggcagaaatgctttcgctggccagttttggctaccatca

SEQ ID NO: 35972 - DNA, 201 bp, Bos taurus
gcccagtgtgacaaccacatggccagggccgtgaaacagactagtggttcttaaccaggggggtgcacctcagaatctcagggcgatcttttctaaaatayccatacccaggccttggtccctacagactgaattcagaggcaggctggaacctgggcatagacattttgttctgttttacgcacctttggtgaagcacca

SEQ ID NO: 35973 - DNA, 201 bp, Bos taurus
ggagaagggaatggctacccactccagtattctggcctgaagaattccatggactatatagtccatgggttcgcaaagagtcggacacaactgagcaactktccctttcatgaggaatggggcctcatagaggaaagaacatgggcctcatctagacagggttgttgttcccatgggggaatggagaccccatgtatgtag

SEQ ID NO: 35974 - DNA, 201 bp, Bos taurus
gctcttgggtgacacaactagacttcaaagacaggtagcccagcttgcaagtcgaggcctgtacgctgtgaccccccacactgcagcttctgtttctatcrggcatcattaaggaggcagcacttggcttgtttctgtagatgaagtatgagacaagatttttttaagttttgataaatgaactgtttttctactttctaa

SEQ ID NO: 35975 - DNA, 201 bp, Bos taurus
atagctcaagtaggcaggatttattaaagaggcagcagacagtgtaccctcaagtttcttgtctcgacagactacttacagttccagtaggcagcagatartgcaccgggactgaccccataggagtggctccctcttgcttcccatcttataggttctgtctcttctctctggaacccgattggttcagccttatgcaaa

SEQ ID NO: 35976 - DNA, 201 bp, Bos taurus
agaagcccagctcctgcctttaatgtggccggaagccatgcccttgggctggagcggggagctggaggaggtggagaaaatgaagcctgcactgggctgcrctcagactagggcagacggccacccactcagaagaggctggaaagaaactcgcagagtgtctggaggaaggcgggggtgggtccttttaaacagaaagtc

SEQ ID NO: 35977 - DNA, 201 bp, Bos taurus
aagctgagcaaggacaggttagcccccacattacaggagccaggatggattcggcaaaggtggtgctcagggagttatcctgctgatggctttgtcagggygcagccctggcccctgcgccagggtctgagacccctggtctcctttacgctcacagcaatcctgccagtacacgcagtaactgcacggtttcctggggct

SEQ ID NO: 35978 - DNA, 201 bp, Bos taurus
tgtaggtgccctcaacgaggtttgaaatgatcctggaggcaaagagaagccactgggggatgttaaaaagattgtctcatggctggatttgaagttctgaygatcacactggccacaatgtagagaacaagttggaggagccagcatcggcacgggaaaacagctggggtccattccagatacctatggagaaaagatgac

SEQ ID NO: 35979 - DNA, 201 bp, Bos taurus
ttctggttgtctggacctaagccacatgcccacatctaatagggtacaggagagcgaggtcctccttctaatttgctaatttccaactcatccctcccagyattatatacaaagcggaggtttaggccaaatgagacaccatggcaggcgtccagagaatggaaatcaggggtcccctgacctccaagatctaatgcctga

SEQ ID NO: 35980 - DNA, 201 bp, Bos taurus
ttcaactagggatcatcctataaagtgttctgaacataagcaggtaagaaaagtcctaaagcaaataagcatgggctgggggtgagttgtacattactcawtactgtgaagaataagaacttggggctgttcacagcaaggatgtggcagccccctccctactcccccgcctaactttcagggaacctcaagtcttgctct

SEQ ID NO: 35981 - DNA, 201 bp, Bos taurus
tcatgtcggattacaacacacaggtcgtggttctgctactgaggaccctgactgaggggctcttgcagaagcagctttccctgttggccacacctcctgtrgggtactcttctgtatgtggagttccggatgtgtatgagtggtgatggatggagaggacaaggagggcctccacatatccgctccaaccacctgcccagg

SEQ ID NO: 35982 - DNA, 201 bp, Bos taurus
gtcccccctacattgcaaggcaagactctcaacctggaccaccagggaagcccccgacactttaatctttattttatgtcttaggccaggccatcagctgygtttgagatcttagttccctgaccagggattgaacctgtacccactgctttgggaatgtggaatcttaaccaatggaccaccagggaaggcccttctctt

SEQ ID NO: 35983 - DNA, 201 bp, Bos taurus
aggctcccgtgtctgcccagcccatcagagaggttgctacactcttgtcgatgagtgtcatcagcaaacttggcaactgggccagctccctccagcctccmgaaggattcaatgaaggatccttctggaatagggggagcccagacccatgttccctttcaggaggccccctttctccgtcatttctgtgtcaccagggct

SEQ ID NO: 35984 - DNA, 201 bp, Bos taurus
ctcccacagtgattcatctggccacgttacagcacaaatgtgtcagttttcagggacttggagagctcttaagcaagcacaggtgtgttgttgaggatgcygatatgcaaaggagcaacagtagacagatccatgccccgaggaggctgccagccagtgaggaccagcccagtttccaactggacccccttgatgtggagc

SEQ ID NO: 35985 - DNA, 201 bp, Bos taurus
gcttcgcgctttctgtgttttttatttaatcctcacagccacccagtgaggtcagttctgctctttggctgatggggagggggcctggagaagggatgcargttgttaatgggcacaggtgtgggttgtaagcggcagagcgtggatttgcccctgggacctagccacagggtcctgacaccgaatgtgcccagggccgtg

SEQ ID NO: 35986 - DNA, 201 bp, Bos taurus
ctgagagtgaccttgggtcacgtatctttgccaggacctatgtgcatgtcttggaaaggagttgggattgatgcttggctcaggggaaaggctaccttgtmatataggggcccactgggtagtcattcatgaaaaagcagccattcgggtgaaaaagaagaaacaaggccaagcggtctgtactcctaagagcagacggct

SEQ ID NO: 35987 - DNA, 201 bp, Bos taurus
acaaataaaactttgtgtagcacacgtatatagccagactcaaggaggcagctgacttgggataactttttttttctgtctaaaaatcaaaatcatgacaygaggcaccaacatctgggaagatctctacatccttctgaacacaacagtccagtccttctaggttcctggcatcaatatcaactctgagagggtgactgt

SEQ ID NO: 35988 - DNA, 201 bp, Bos taurus
gatcatgatgaaaacatcaaagaacacacaaatatctcctcctcctgagccagcccagctatgttcatctagaacatgacactgaaggctctggacacacrggataacagcacagaaacttaagagaaggcagcagttggattttgtttttcaggacagaaagcttgagcagtctgtataaagcgcaatgctttgaaattc

SEQ ID NO: 35989 - DNA, 201 bp, Bos taurus
gcctagcgggcatgtcatcaggtggtactctctaaactgcctcaaccttttcctcgaagagacaaggtttgcccccagcagagatgaaggagtcggccacrcacaatgctttgcactgtgtccagaagaaaaacactgtctttagtgtcaggcttgggatgaagaacaagtcaccaggtgataagcagggtttgtctgacc

SEQ ID NO: 35990 - DNA, 201 bp, Bos taurus
tgtgatttcacaaacttctggggtaggttctactataatcccccacttacagaccaggaaagtggtgtttacagaggttaagaacttgctcaaggccacaycgctagaagatttcaactggatatcaagggatgctagtctggtgagagggaaataggatgaaggagagaggccagtgagatccttgtatctgcccccaca

SEQ ID NO: 35991 - DNA, 201 bp, Bos taurus
ctctaacaaatgaaagtaacaaatctttggtttttatgtaacagatatttattttttaaatgttttagaaattatagggagctaaggcatttagctgaacratgtgttgatagggacttctaaattttcttcaagcaaatcctggatataaatatggctggtggagattcccctgggaatccccctacatcctactgtact

SEQ ID NO: 35992 - DNA, 201 bp, Bos taurus
catccccgggcgtgcacttacttggcaaggactccatcctgatgggaaccttgtccccactcccccaccccctactctcccacccccatttcacctccctyggttatgcttcctttgtcctgaaacaacactctgtctctctccttaggagatgggttgccctggctcctcagagccagttattaaattttcaggtatttt

SEQ ID NO: 35993 - DNA, 201 bp, Bos taurus
cagcatcagaggacacttgaaatcagacaggagacaaggtctcaaatgatcccctagggtcagacgaagcaggtttgcccgttgggacaagccttggacgygtggccagtgtggtggaccattcaaggcccaatcccgtgggagacctggaacttagcaggtgtgtagtccaccccccggggatacgtagtagaggactag

SEQ ID NO: 35994 - DNA, 201 bp, Bos taurus
ctgagaataataaactatattgaagggaccctgcccaaccctagggtgagcccacctcttagagggacccccatataaatatgctcaggctaggacaagcrggaatccccagggccggatccaaagccctatttttagaggtgaggagctgcattttgctgggctcaggcaccatctggtgtctactattacactgttaac

SEQ ID NO: 35995 - DNA, 201 bp, Bos taurus
ctcggcggggagaactgtgttgcttgttcaatcacgcgagcactgtcctcgtgtggagctgtgggaagcttgggtttggggattagctgatctgtgcgtcrgttgtggctggtttcagagggcaggtgtggcgttggtgtgagatgcacacccagtgatgggggtgcctctgaaactttctgtgtggctgcatgcttgtgc

SEQ ID NO: 35996 - DNA, 201 bp, Bos taurus
catagagggctccagcttggggcatgctgtggacccgccctccccccgccacacacacacttcttactcaggctctgcagcaggagcaccgacggaggccrgttcacacacgacactaacctagggcgagggtatctgctcctcacaggggatggagccagagccctagatctgctgtggccactgccttcccaagaagag

SEQ ID NO: 35997 - DNA, 201 bp, Bos taurus
aggattcccaccagctgccccaccctctgcctccccacacttgttccggttagcattagcatctatgggggactgctgatggaggcgaggggaagggttcrggtcacaaaggcacaaggtacctttgtgcagagccttctcccacccttccctccccgggaagcagcaccgcacgtgggcagcacttaggggagcaagtgt

SEQ ID NO: 35998 - DNA, 201 bp, Bos taurus
cggcttggtgctatccggcagagacggggtaagagttaagcacacaacatggaatgaaacaaggcagtgatcttccagaggcaggccattcacaggacacycacagaggcgttgtgcctcgtaaccagccctccctcctaaccacctcaacctgttctctagaatgcaggaagaagaaattttaactacccatgggccctc

SEQ ID NO: 35999 - DNA, 201 bp, Bos taurus
gatctatcccactgaggctgattctgctggaggggtctcttgccgactccttggggcacggtgccatctcagggtctcagtgttgatcagatgccagcagkttggacattcagcccctgaagaagccagaccagagttggaaagggaataagctactggcgtgtacagcttccaccctgcctcctatgtcctttgttcatg

SEQ ID NO: 36000 - DNA, 201 bp, Bos taurus
gtgcttgggatggcaaagagtagactgagcaactacatatgcacacacacacacactctccataaatgaccagcgtgtagttcaggcttccttacagacarctttatcacatttgatttctgctccaaagttgatgaatgtcgggcaaattttttgccgcatgaatgcagtgagtgcttggatgacatttttatacacacc

SEQ ID NO: 36001 - DNA, 201 bp, Bos taurus
tccatggagtcacaaagagtcagacatgactaagtgactaacacattgggcatagggatttgggggtgtaattgtaaggagttaatctgtacaagatgcamatcctggcacctggcacttagtgagtaactgctgggggatgtcattgttgctgttgttacagcaccttacagtttacgaggcgcttctatcaatattaca

SEQ ID NO: 36002 - DNA, 201 bp, Bos taurus
ctgcagtccatggggtctcaaagaatcagacacaactgagcgactgaaccgaactgaactgtgctgggtctcgttgctgtgagggctttctctcgttgcarcgagcagggcctaactactcttcctgcagagcacaggctcaatagctgtgttgcatgggctttgttgctcatgggatcttctgggaccaggatcgaactt

SEQ ID NO: 36003 - DNA, 201 bp, Bos taurus
agcctcttgtagtcatcaaaactgggctccagtgtcccactaaatttggaacttcctggggcagagtgattaattaccctctgcatctgctggccctgtarctgtgggctttcaagcatagaccccagccagcagcctcagcgtctcctgggaacctgttaaaaacgcagagtctcaggcctcaccccagacctactgact

SEQ ID NO: 36004 - DNA, 201 bp, Bos taurus
gttaatggctcggtgaatccggcagacagaaacgctagctcggttccgaggaaaagtttcctcctgcggagctccctcctcctcaggggatgcgttcccckctcaccgggccccaagtcagtactgcaaagagggtgagcaccgagcagaggcagctgctctgccgggccccacctccctcccgcactgcagccggacaag

SEQ ID NO: 36005 - DNA, 201 bp, Bos taurus
ctgtggccctgcacactcacactcgaataagactgagtttggatatgggtctgtaaaggggggattcagttacaatgaggccttcaaggggtcctaatgcratctgtctggtgttcttaaaacacagagagaccccaggaccatggtgcacagaatgaccagctgaggacccagggaggaggcagccgtctgcaacccagg

SEQ ID NO: 36006 - DNA, 201 bp, Bos taurus
gtgatggtgaaaaacctcgggttctttccttgattctgcaaggttcctagcctagagcagagcctcatctgtggccgctgagtctggcccgcccggcagartccttgctgtcacatcccaggtggcacctctgtgggtgctttgctggtgaccctgagcgcgctgggcttcgggaagagaaagtgaagggtgagtagcggt

SEQ ID NO: 36007 - DNA, 201 bp, Bos taurus
tatttctgccacaacaactttcctttcctctgtgttacttggcaacgtctggttctccactcgccttttaaagatataatacgcgaatacactctgactayaaacaggccacatacagttaaaagattctaaagagtcagagactcttctaccacccgtcactcctccaccgcatcccgaacaccacgctctcctccagag

SEQ ID NO: 36008 - DNA, 201 bp, Bos taurus
tctgtatgtgaattttccagggctcttctttgactattcaactgagatttggctgtaaatgaaaacctaataacagaatcctgaaattctagttagcttcyatacacccttgcatctcagttcagttcttgcttctctaggcctcattataataattgttttaattggaatactcttctctgaggcttgctgctgctgcta

SEQ ID NO: 36009 - DNA, 201 bp, Bos taurus
agcatctatcattggagaatctggcagcagttcccagactcaggcctggtcagtggtccttcagctgcggtctcagccagaatggcatatacagttgataygtacacaagacctaccagttccggccagtctaaggatcacaactactgacattgttccacagttattcacatggagcaagtatgatacattcaaatgttt

SEQ ID NO: 36010 - DNA, 201 bp, Bos taurus
acaggttcgttggcacaggctagtcatacacactatagaatctacactgatgtcttggttggggtacaaatacctggtaagaaagctaaggccgggcccaygagtaccaccagttcctaaatcttcagcagctgatactcagtattttcatccagacttttaaggattcttcagttggcatcaggcaaacctcttccctgg

SEQ ID NO: 36011 - DNA, 201 bp, Bos taurus
gcagatctacgggccacctcctcctcgggtatgagcatgggttgctttctgcttgtcaaggaccaagcccgccaagctctgggggccgtgagaactgaatrtgcatctcgagagagtgctgagtgcacatcagttcccagcagcctagacgtctggccaggaatcagcctgccctgagtctgctgggacaaagcaaccaga

SEQ ID NO: 36012 - DNA, 201 bp, Bos taurus
tcttatctaaaagcgtgctcagagcccatgcccagggcctggtctgaaggatatgagcgggtccagaaccagtgggcctctgagtgatgccacatcctgargagtcacgtcagggaagccaccgagcctggtgctcaggcttccattttggccttgagtcatggagccaattatcctcagaagatccttctccttaatgat

SEQ ID NO: 36013 - DNA, 201 bp, Bos taurus
gggttttcacataggaaacattcgttggcaaaaacagagggaagctctcttgaggtaaaagtgaatcaaccccagacacattggttcaaatggggattgtkcggataacacttgccccatgggttgacgatcattccttccatttcccagatggttctgggttctgtttcctggtgtggctcttacagtggacagttgact

SEQ ID NO: 36014 - DNA, 201 bp, Bos taurus
tagtctggaagggcgacctctgtgagctctgtgcaccccctgacatgtgcgatgcagcccatgccatcctggttggctcgtcacttccccttgtggagagygtacatgtaaacttggagaaagctttaggcatcctcacaaaacctggtatcaacgctgtcttaaagcactttaagatcgttgtggattggtatacatcaa

SEQ ID NO: 36015 - DNA, 201 bp, Bos taurus
gcttcattgccccttggcatgtggaatcttcctggaccagggattgaacccatgtcccctgcatttggcaggcagatactttacattaaaccaccagagamgtctccaagtgtatgcattttaacaaaaacaattcatagtcccttcagagtctccaaatcaataaaaatgaaactactagactactgatggggtatctta

SEQ ID NO: 36016 - DNA, 201 bp, Bos taurus
catcaccaagtctacaaacaataaatgctggagagggtgtggacaaaagggaactctcctacactgttggtgggattgtgacctgatacagccattatggrgaacagtatggtgggcccttaaaaaactaaaaatagagctaccatgtgaccctgcaactccaccactgggcaaataccctgagaaaagcacaattccaaa

SEQ ID NO: 36017 - DNA, 201 bp, Bos taurus
ttccatgtcagtcatcacaagatgcccttcttacacacactctgtccaccttaccctgcactcgtcactgacatgctgtatatttatttcaggttttttcrctgtctttccctgacttgcgtaagagttctatgagagtaaagtctacaatagaagtacatagaatcactggaaaaaatttctcaattaaagatgtacttt

SEQ ID NO: 36018 - DNA, 201 bp, Bos taurus
gtgtctgtggagggcctttggcggccctcccctgccgtgtcctccatgtcagagatggagctcgtgtctctcccttctctgagaagggcatttattttgtyatggcctgatctaaccatgattctctcctgaaggcccctcccaatgttatggatttgagcagcacgtgcactgggggggatcatgagcctttagtctgtg

SEQ ID NO: 36019 - DNA, 201 bp, Bos taurus
actgccaggaattactgtcagaataaattaacactctctgagaaccaatgtcagtctctgcagtaggcagcatgcattggaggccaaggaaggcagaaacrcttgggaaaagggaaaatgaaaaagttttgaaaactctcccaaaatgcaagtttctgcaaatagagactttcgagagtacaggccgagattttggtaaac

SEQ ID NO: 36020 - DNA, 201 bp, Bos taurus
aagccagcctgaggccctcccccatggcatattagtttaggagtaaaaggaatgactggaaaaggaaatggtgaccccttccagtgttcttgccggggaartcccatggacagaggccaggctacagccccccagggtcacaagagtgggacatgacttagtgactaaactgacactaccaaaaggagcggcagggaagcc

SEQ ID NO: 36021 - DNA, 201 bp, Bos taurus
tacatgggatagaattgtaataaatctgtgggaagatggactacctacaaacccattcattgaacactgtttgtttccaaagttgcgtttttatgacttgyacatgtttaaaataattttcccttttgtcttcctcagctgactctgtaaactacatcagctactgttccaagtgctatatgcatcttatctgtgtattac

SEQ ID NO: 36022 - DNA, 201 bp, Bos taurus
cagattggtcatcagtggtgaagggggtcaacatattgtaactagacttgtcatcagtttgtagtgtatacaaataataaataatgctgtatacctgaaayttggaaggaaagttatgaccaacctagatagcatattcaaaagcagagacattactttgccaacaaaggttcatctagtcaaggctatggtttttcctgt

SEQ ID NO: 36023 - DNA, 201 bp, Bos taurus
ggctcaagcgggccaagatggacaagtccatgtttgtgaaggtgaagaccctgggcgttggcgcctttggggaggtgtgcctggcctgcaaggtggacacrcacgcgctgtatgccatgaagacccttagaaagaaggacgtcctgaaccgcaaccaggtggcccacgtcaaggcagagcgggacatcctggcggaggcgg

SEQ ID NO: 36024 - DNA, 201 bp, Bos taurus
ggcagccttccctctcttactacagagcacagagaagaggtccaaaccatctgcctgacactcacagcactatctaaagaccaaggggacaaaggccaagrttttggaaacaccccaggagtgagccgagctgccctacaggggataagccctcccagaagcctgtcaaccgtgggacaagaagcaagaggcctatgggac

SEQ ID NO: 36025 - DNA, 201 bp, Bos taurus
ccccacccctacccagaggaaggagagacagtctgcaggattaaaccagtccttttgcccaaaaaacgatgtcctggccccaaataaccctttctttcctyttgctatgacttccttgccccgccctacagcttataaaaagcttctgttctgcacagctccctcagagggccctgctgtctcctaaaatggatgctaccc

SEQ ID NO: 36026 - DNA, 201 bp, Bos taurus
tttcatttttcatggggaaaatacctaagggtggagttgctgagtgttgcgtatgaaacagccaagcagttttccagagttgcttggccttgcagcccgakcagtgatgatgcctacagctctgtatccatgccagcatcagtcctgttggtattcactgttgagatgcaggcacattatgtttccctagtaacttctcat

SEQ ID NO: 36027 - DNA, 201 bp, Bos taurus
cttgctttctagaactctctgcaatcaaacaaactagattatctctgggaaggtggtagaagagagactcctgccttttattacatctggtttatgttccrtgttatgaaatagaattaattttgtaaaatggcttttgggatgtacttaaaataatctttcttactcaaagattgtttttactgcttcattttaaatttt

SEQ ID NO: 36028 - DNA, 201 bp, Bos taurus
accaggagtaggtgactttaccgccctgccctgcctctggaggcttttagtgcaaaagaagttggaagtctaactctgccaagatggttctttacgggccyaagtacaccattttctctgttttctggcttttggaataaagttatcattccttgccccaacaactgtccattactgccctgtcctgtcctgcagggccag

SEQ ID NO: 36029 - DNA, 201 bp, Bos taurus
ctctccctcccatgcttaggacctatagtggaaaaggccagccctctctttctacttctggttccaccagtgttgggtgggggtaggggcgggggcgaggrgggcagagccagaccacacactggccatgtcacggcagacctctgctgggtgtcgctgcttctctggcataccctgacaggcatcactgtgggtgtactc

SEQ ID NO: 36030 - DNA, 201 bp, Bos taurus
acagacaaggtcagctagccagctggctgcccgtgagactcacctggtggagagaaggcagaactcccacagggcaggcagcctgcctggcctggctgggyactgaaggtgcctgaggggcagggaaggcactctcccacgctgtctgcctggttgctgttctggaaggttccaggtgggcagggcctggggctgggagtc

SEQ ID NO: 36031 - DNA, 201 bp, Bos taurus
gtgtgcctccccttctgaggggggtgggtgtgcgggggcccaacagcagggtggatgccagcagaattgaggtggtctctgagtatctccttggtctgtargtttccagagtctggaggaggggccaggatggaggctccgttctgctggcctgtaccccgtgtccctgactctaggactcccccactccagggccttgga

SEQ ID NO: 36032 - DNA, 201 bp, Bos taurus
agtgactaacacaacacacagattgtggttgaaagaaatggatgagaaacaactttggacacaagtgagcgactagcacaaatacttaggtggccagatgrgtaaagaagggagagagcaaatgtatactacttaaaaaaaaatttggatacaaagaggtagaggtacagtggacctacaacttaatatagggccaaagca

SEQ ID NO: 36033 - DNA, 201 bp, Bos taurus
aacttattgttgtttctagaggtcctatggccagtagcaagcagaagaaggaagaaagtcaattgcaagagtgatagagaagagatgtgttgagtccccartgaatatgaagcaaacagggcccagattgtctgctttctgagtttacaaaagaaggaaaaaaaaattttttttaatcttgtttagacagtttgcttttgc

SEQ ID NO: 36034 - DNA, 201 bp, Bos taurus
tgggggtgcagttcctaacacagctgagtatgggacttggtgtgtccttaaggttgggttagtttgctagtggccaaggccagggcccagctggtctcagygtagggtctgggatgctgtcattgggaacatagttttcttgtgtcttttatctgtcacctggtgaggctggtttagagatgaatgcaggcttcctggatc

SEQ ID NO: 36035 - DNA, 201 bp, Bos taurus
tgttctccgaattgataatttagtggagaccttcattaatcagttatgccaatgtatgatgagacgtattcttatgaaggtaagttggaattacttccttraggaagtgacaactgatgtgagatctgaagaaagagtaggaattaacagtgtgaaaatatatttttaaggcttcttcatagaagtagcaacctatataaa

SEQ ID NO: 36036 - DNA, 201 bp, Bos taurus
acctattggatagcaatttccatttctcccttctcctataccctgccaaccaccatcctatttctgcttctatagatttgactatttttaatacctcatayaagtagaataatacaatatttatttttctgtaactggtttaccttacttagcatgtcttttccaggtctatccatgattttgtaaatggtagaatttcct

SEQ ID NO: 36037 - DNA, 201 bp, Bos taurus
catgcttggaaaaattccacctggcacaaatcagtcactaggtggctgaatattgtgaatggaaatagctggcaagaagggaaattctcttggtaaaagayagaggcacataagcgctcgagggtaacatgaaaaaaaaaaaaaaaaacaatttgcttttgagaagctttgataatattttagtggaaacaatattccttt

SEQ ID NO: 36038 - DNA, 201 bp, Bos taurus
atgcagctgttgctttttcctttttacaggtgaagaatctgaaggctaacaaaatgggtaacttgcccaaagtcaggactctgggaaaagcacaggtcccyagggctgactctgaagcacacatctttacctgtaaagcagtgcttcccagaaagcatgttcatttttactctcacttaaacatttattgtttcatttcca

SEQ ID NO: 36039 - DNA, 201 bp, Bos taurus
acatttatagactaactctgagctaataacatgatcaggtcttttgaagaaatattaaggtgtatagttatgtggaaaaagtcctaagacagagagagatmtgacctcctagagtttgggatccttggaaacctacctatcagtgtgaagacagtaaacacaaactagcaaggatataaattcctgttgctgaccatttga

SEQ ID NO: 36040 - DNA, 201 bp, Bos taurus
ataatactccaggtccccagtcctccagccagtcatttcaagatccagacccaccaaccaatgggccaacactaaactcaagacctctcagaccttatgasccagtcccaccaaccagctgacttgcatcaggacagggattcccctggatatgtagttagccatggcaggaacaaaccctgttcaccagaggctggcagc

SEQ ID NO: 36041 - DNA, 201 bp, Bos taurus
cccactccagtattctagcctgggaaatcccatgaacagaggaacgtggtgggctaccatccacggggtcacgtagagtcagataggactttgtgattaarcaacaacaaattagagcctcaaaagtttcttccatttattttaggtgaatttatgagtttgctttgtttttattttattatcaagcatagggtctacata

SEQ ID NO: 36042 - DNA, 201 bp, Bos taurus
tcaattacatgccccattaaaaagtgaatgcaaaataataccattgaattccagcttccgaagcaggcttaagatcagatgcattgtgttaatttggaatktcctgtaattgaaatgttggacccatttatgacattgataatattcttttatattttcaaaatagttttttctcatgtctttattataaaaattgtcata

SEQ ID NO: 36043 - DNA, 201 bp, Bos taurus
ggcttcctggtaaaacatgagacagcttaacctttccttttttcaaatttatagttttgaaggccatttagacttagaatatcaaaaatgtattcataatmtactaacttgtttttgttgccttggagtttatagataacatattcaaacaagtgatgtcatgtttgagtaacagttaaaactcaggcttttttccattaa

SEQ ID NO: 36044 - DNA, 201 bp, Bos taurus
aatcttaccaaaatctatttaccagccaataaaatgtcacgaataactgcatcaaatgttcccaaaaggcccaacaaaatcatgaaagacaacatccgctkttgcaatcaaagggtcattatttactttcaatacagcagtctcagcactatgatgaggatgaaaccctgattgaaattgctcaaatgagtcaaattgcat

SEQ ID NO: 36045 - DNA, 201 bp, Bos taurus
tctagtattctagacatatattctatattataattatgccttacatgttaaggcataattatgtgctgttcttagttgctcattcgtgtctgacattttgygaccccaaagagggatctactctttgacagtctgccagggtcctctgtccatggggattctccaggcaagactactagagtgtattgccatgccttccta

SEQ ID NO: 36046 - DNA, 201 bp, Bos taurus
ccttaggccaagctatcagacaactgaagacatatcacccaccagaagacagtctgcctctcaacctcctgagtccacaactatcccaggataaagttatrtccaccagagggcccaggacccagctccacacaccatggggccagcactagctctaggacagccatagccatgcagccagagaccccaagactcagatat

SEQ ID NO: 36047 - DNA, 201 bp, Bos taurus
tgttttgacttttatctgaaagcaaagttacatttgatgtatttcataaactaactgaatccagagattttgatgcatagtggtccttggccagaacaaakactgaatgtcatggactgaattaaacacatttcccatctctctctgtgctttatttccttttgaccacaatggccttcttttttatgggaagggataagc

SEQ ID NO: 36048 - DNA, 201 bp, Bos taurus
actgataactgtcttacgagtcaccattcagctaaaaaattgcaggcggattctttaccagctgagtcacaaaggaagacctcagctaaaataatttgtgycaaaattaatattactgtcagatagtcattggcttataatggttcaacttaaaatttttgacattataatgatgtaaaattaatgcatgttcagtagaaa

SEQ ID NO: 36049 - DNA, 201 bp, Bos taurus
ccatactttttaaatcttttaccataaatgttcaacaaaagtatatttagtaggtttgacctaatataattcctcatcaattttctactttgtatgaagarcaattaaaggcctgaaaatttaccctattgctaagctaacaagttagtcagtatccaccagttctgttatactgcagataatagaacaacctttggtcat

SEQ ID NO: 36050 - DNA, 201 bp, Bos taurus
aaaagaaggtgaaaatatacaatgggaaaagtttcttaataaatgatgttgagaaaaccgtacatttacatgcaaaaaaatacaccttggacacttttttkgcactatatataaagaatcaacccaaaacattctaaagtcttaaatgtaagtcataaaattgtagattaaaacatagtaagtcaactatttgacattggt

SEQ ID NO: 36051 - DNA, 201 bp, Bos taurus
tattaagaataaaataactatattaccagtaaacaaaaggaaatgtactgtctttaaaacttcatgtcactgctgtgtgaaatgctctcactgccttcagygaagaataaaaatggcatgaataatttagaaaaataattttgtgttttgattttgaatatgcatctttgtactatttgaatgcattcagtaattctaaat

SEQ ID NO: 36052 - DNA, 201 bp, Bos taurus
ctgtatgaatacagtgtgcacagttatgaaagcagccattaacctttaagccgtatccagctccttctgagcacaatcatttactcggagacatcaagttracatcaactgagctgttatcatttcacagacctatgaaagtatttatttggcatttacagtctatggtctcttcacctgcggtttattttcctatggttc

SEQ ID NO: 36053 - DNA, 201 bp, Bos taurus
agtccctccttgctcaaggattaggagatctatctcccgtctactttggagtacaacccctgccaaactgaattggctttttagagctatcctgagaaatyttacccccagaaacttaatttgggatgttccttagaatggcactcatttgtagtcctgaataggtatctgagatctcccaggagctcacaagtggattga

SEQ ID NO: 36054 - DNA, 201 bp, Bos taurus
taagtccatttatgcattatgtagactcatcaataagtggaaaaatattgaaacagacttcactatgcctttctaaatttttttgctccattacctgtgtyatttgttctgtatagaattaggactgtcacatattcataaaatttgccttaaattattatgtaatgtgtcttttcaatgactttagtactctgaatatta

SEQ ID NO: 36055 - DNA, 201 bp, Bos taurus
tccctttcatgtgttcatctaagtatgtcctttcagagaatttcctgactctgtggataagcagaaacgagattctcacttgaagtatcgcttttttgcartagtgtctcattgaagcaataagaatccaagttcgtttttgtgtttgctttgtttctcctcattatttctgaataaaggaaatttcagattttgtaaaaa

SEQ ID NO: 36056 - DNA, 201 bp, Bos taurus
gggttccttacttattttgcaaatcttcataagaacaattcatttgctatcactgatatggaaagagaagaaaggcaggagaaatagggagcaagtaaaaragcaagtaaagtgaatggagaatgaagagagaaaaatagagatggacagccaactcccaattatccacagaagaaagaacacagcatatagtcatatatt

SEQ ID NO: 36057 - DNA, 201 bp, Bos taurus
catggtcttatttcaagtctgtcttgatcattctttcaaattacttcagcaatcttttgttacattctctctaatcccttcaacatgatgattgtcttttwaaaaaatgattttgttactttacattaagacctcccttgagtgtccattggttgcaaaataaaagctcagttcctgagtttggcatacaaagtcattcag

SEQ ID NO: 36058 - DNA, 201 bp, Bos taurus
agaactccttattttaaaactatgaattggttaaatctataagcagtaaaaattatgtgattaatgatataatggatatatttcattatatatatggtacraagagacgagaaaccatgtcctttaaaggttaagctcaggattcaaatcctgcactaagctatagctacaagtaaaaacaaaaaagttacagtttcatag

SEQ ID NO: 36059 - DNA, 201 bp, Bos taurus
acagaaaactagtatatgttattattcatactgtaatcattttatttacatatttggagtcgagtcagaaatacatgctcaaatactcttactactactaytaaatattcttaagtggtgcatttttcccatagtcccctgttatgatcactaaagtttttaatcttctgtatgcacaataaagatgttatgttacattat

SEQ ID NO: 36060 - DNA, 201 bp, Bos taurus
ctggaaaatatctttaatggccactgcctgtctgattttacagtattattcttcagatactcacatttctaataacattgatgctttctgtctgtgtactrtgtatttgaaacactggccttacacaatttcagctcagtggtacccatccaagaaccaatatccatggtctatagaagggaataatattttggtcaacca

SEQ ID NO: 36061 - DNA, 201 bp, Bos taurus
tgctatggttttctaaaatgactgatttttgatcgagcctataaggacaaggaagtgtagttaacaaagtgatgttataaaatgtaacattccaaatgtaktaatatctggatagcagtcagattctagtacttcattctgtttcctactcacaagttgttcctgatgaattatttttaagtgtgactaaattattcatta

SEQ ID NO: 36062 - DNA, 201 bp, Bos taurus
gaaaaacattgtatttgcaaaattacacatagaaatactctgagatctaagagagttctccagagatcatttgtgtttgaatcaataaaggacccacgacrattagttatctggataactttaaagcattgtcttagatggagattatttgaagccgaaccacacttcctgtgaaaccctatatttttgtttcatctttgc

SEQ ID NO: 36063 - DNA, 201 bp, Bos taurus
cagacacgtgggtctctgtctttcatgagtcccatggcctttagcaaattatttctttggagtcttctttatctcaaaatttttatctacttaataattcstaccttataaggccgatagtttgttactattattatcctgattttttaaatttaaattacttttgcaatcttaatgttttcctatctactttccctttga

SEQ ID NO: 36064 - DNA, 201 bp, Bos taurus
catactactactgatttcattcaagtggcttaagagttctctcctggactattaaaatcacaggataaatagccaccatatttacatttactttctattcyccaggttgctgctgcagtgaaatttttaacatccaatctacacatgatacttgcttgtctccatcatccttcttttgacagaatattgtccacacaattt

SEQ ID NO: 36065 - DNA, 201 bp, Bos taurus
ataaaaaggtgagaggagtatagatgaaatgtttaaagttcaacctgcttatcaaatatatagacatagctttgaaatttctaatccagagtaaagataayaaaggaaaattgatatttctcctcctcttttccaaaaaggacatttggtatgctcctgcttcagaggtactgtttaagaaaattagaatatttgatagag

SEQ ID NO: 36066 - DNA, 201 bp, Bos taurus
aggggaaactaggggcttacaaaattatgtgattttcatccttatacataattggtgtcaaatataaacattttagctccaagacttgtaatcctaacctygtactcagatcactaaactgcatgtacttcagaacattccaaacataaactcttacctggtaaggacctgaaagcttttctagtccagcccttggattgt

SEQ ID NO: 36067 - DNA, 201 bp, Bos taurus
cttcttttttgcttgactttgcctgttttctaatcacactgttttaagtccacagtcctaatcaagtccactttgtcacaacaataggactcagtctctgytttcagctgttctaggttcaggctttaaggagtggatttttcatgtctcagtttcatactgtttatcaatttcacttccctcaaaaatgctgttatttgt

SEQ ID NO: 36068 - DNA, 201 bp, Bos taurus
cagaaagtataattctggatgatatatgatttcagaaacttgggcccagagatgtccagtgactgggcagggtcccatatgccgcaggtggcaggacccaygatgcctgaatttgggccaggtgggacttattgaaatttggttctgtgagggaatactcctaaaaatctaatgtaaattttcttcattaagaaataagga

SEQ ID NO: 36069 - DNA, 201 bp, Bos taurus
tacctttggagaatgtatacccagattttacaaatcacctcttaaaaaatgtctcatttaaggaataataattcacgtgtagccctaggaaataaagacaycctctcatcgtgtcacatcctcccttccttctgtgcaccttgtaaacttcctgccagcctgcaaggcttatttcttgctgtgtacctgccttatcctccc

SEQ ID NO: 36070 - DNA, 201 bp, Bos taurus
acctatggtgctcattagtaaatgtgtagaaatgcttctcctggttattagtcatatctcggattcgtttgtataccggagcactcctatttctcacttcytggagaactgtctgtagcacgatgacattcctgatggcagggtcctcaaggacatcaatcttttaagtaaataaataaatggttattttttcccatgttc

SEQ ID NO: 36071 - DNA, 201 bp, Bos taurus
gtgttccaaaaatgccagtgaggcataatttgaattttcatttaaaacaattttgttttattgtaatgagaccctcttgaagtaattagtagaaacaaccmctggacatgaaactagttttgagattcactttctttgatataagtcagtttcttaagacatagatccataatgccagtttcccataaaaattagtttgaa

SEQ ID NO: 36072 - DNA, 201 bp, Bos taurus
tgcagatgagaagtgaaggggatcctcaggataacgtgagagaacagacaacaaggccagatcagagctaatgaaaaacctctaggagaatcttatccaarattatgaaatgaacagaatgttgcatacatctgaatgtctttcaaagagatttaagctggaggttaacaaattgtagtctgaagttcaaatccaacctaa

SEQ ID NO: 36073 - DNA, 201 bp, Bos taurus
caaatggaagctggaatggagaataccttcaaaatcccaaagcaaaataacgtgccaccctatgtgctgcagacccaaccacgccatcaatcaaatacaaragtaaagatatgctagatgtcaaacacgtacctctcctacaagactcttctcaggaaggaggagacgaaaagcaaaggaggtaaacaaaggaggaggaac

SEQ ID NO: 36074 - DNA, 201 bp, Bos taurus
cagccctttgacctttgggctctttacagaaccaaaaccaacctaaaataaatcactgggaacatacagatgacagaaaatgaccatcgcgttgtcttctyatataccctttattgttatatttagaaaatgaacttccctcaacttttgacatagccaccctatatctttttgatctttggttatattttgctatgcaaa

SEQ ID NO: 36075 - DNA, 201 bp, Bos taurus
gccccccacacatcaaccaagcactgcattctccctcacacagcatccatcaaacgacagtcatcaaggaaagagagtaggggaaaaaagaatcttcccaygtaactgggcatcttttcagacaaagctcatgcagcatcatcagacagtcatattagaaggcgctatataaacacaggcaggaagggtagtgctaacact

SEQ ID NO: 36076 - DNA, 201 bp, Bos taurus
aagctccaaaaaaagaaaacaaagaaacaaaacacattctagtcacataatttcatacatgaaagtgaaagaatggagaacaggccaatgacttgttctgytttttcaccatggagggaaagtagttctggggcgtccccaagagatttacattatgtctgattggccagaatgaaggcacatatccacttctagctggaa

SEQ ID NO: 36077 - DNA, 201 bp, Bos taurus
tctatttgatggccactcagtattaacatatgaaagatttaaatgctttttcataggatccatacgctcatggaacaaaagaccctaaaaccaaggctccycttccttagagcagcaggcagcactaaaaaaagtgttgcctcacctttcctgattaattctggacacctcctaaacccctactcctggattcagttcagt

SEQ ID NO: 36078 - DNA, 201 bp, Bos taurus
aatagtatcaggctggccaaatcactctttgaaaaacatttaatttgagtatcgtttggtcagtagataaccaaagacattcattttagagtgttttaggktttaaggatatatttatagtgcattttggcaattataagcaattagtttttaggttaaaaatagccttgaagacagctttacagtacttcagattctttc

SEQ ID NO: 36079 - DNA, 201 bp, Bos taurus
tcagattcctagggaagttttagaaaaaaatattcttgagcttccagaagaaggagcagaagagaacccttcttctgtattttgaaatacatcagagcackctttctcctaacattgcctgccattaggggagactagttaaccaaagcctaacacggtgtatcatcagagcctatttgacctggagaaacaatccaccca

SEQ ID NO: 36080 - DNA, 201 bp, Bos taurus
tggagctttgtttttggcaagaggaacagatttggaagaacccacaggcctaacagagctaatagagaaagcatgctgttgatccaatgattctccggcargaaccaaatctgccttggccagtggcacattgaaggagccaacacaccattaggcagaggctcaagtaagcaggtggtttctgtcaatggatggcctaca

SEQ ID NO: 36081 - DNA, 201 bp, Bos taurus
aattgggtgggaggcctctcttctctttgcgtcttttgggttggcatgccctcacaccacgaggatgtaatttcctttactttccaaataaaatgaagctrtaacatggagctgtaccactggtccatccaagggctgtaacactggtctgtcgcctcaaatttttgttgcaatgagacagaaccgaggaaattacaaact

SEQ ID NO: 36082 - DNA, 201 bp, Bos taurus
ggtttctgccatgcaacagtgaaaatcagtcataattatacatatatctcccagttacaaggtccttaaagaattatcccaaaaccaattccagcccccayccatgaaaaactgtctcccatgaaactagtcggagaaggcaatggcaccccactccagtactcttgcctggaaaatcccatggatggaggagcctggtag

SEQ ID NO: 36083 - DNA, 201 bp, Bos taurus
ctccaaaaacagatgaatgagaaagctgatggccaagtctaaggggctaaactctggaaactgctcccctcagcgctcacactcaagatgggaactcagaytgacaagaaactgctagacatgaaatcaaacttgagcagaacaggaaaaggaaagagaaggtccagagaaaagaagaaaagaataagccaggaaatctca

SEQ ID NO: 36084 - DNA, 201 bp, Bos taurus
tatatgctttctccatgttctttgtgtaaaataaaagtagtactattcgctgtctttaattatttaatgtttttcctttgtgtcttttctcgtccaattayaacataaaccccttaggccctggtcaactgtcacacttcttagacacatagcacagtcctactcaggaaagaaccactccaaacaacaacaaaaagtata

SEQ ID NO: 36085 - DNA, 201 bp, Bos taurus
ggttagtgttgtcttagaaggttattttgactgttgggtaagcagtgggtaaatcctgatttcaggtgtttgtacacacaatttaagatacattgtgtgtrtatgtgtttgtagttggcttttctggcccagtcagtgcggactgtgcaatgcagggagagactgtgtcaagttttatcttcattagatgtttaagaattc

SEQ ID NO: 36086 - DNA, 201 bp, Bos taurus
cgagcagatgtaaatcaggaaccactgcttgttagagaagtgttgtctttaccagcttggcagtcatttaggggttattgaagccaggtgctgggctattmaacgtatttaaatattcaaattaggattaaagatttttccatgggaaagacagcatattcaagaattccatagcaaacagtaccttaatttatttcttct

SEQ ID NO: 36087 - DNA, 201 bp, Bos taurus
gttttattatattccagagactggtatccatcaggctgatcattaatgagtattctcactacctacatcttcgttcccatatttcaactgctttatatgaygtctgatgaaaaaaaaaagtttctatattattagctatactgttttttttttttcttaaaaattctgtacccactcttgaagagtcagtaattatttctt

SEQ ID NO: 36088 - DNA, 201 bp, Bos taurus
acagacaatatttgaggacatatgctttgaaaatgtagattcttccacccctccttgtattaactctcccaatctctaggtgaccaatggcctacatatgyaggattactactttatcaagtgaaaacaagaacactggatggtttgtaaaatgttttcaaatctctttacgtttatttggccgtgtctggtcgtagtcat

SEQ ID NO: 36089 - DNA, 201 bp, Bos taurus
cctgggggcagcaatattctacctggctgtgtggttccacctctccaaagcttccctggaggtacaggactttattcagttctttaaaagatgagcgcctragctcacctcattcactgtggccttccatcgtcacaagatcagaccaacctctttgcagttaggactcttgattttccaagtccctgtaatttatgcgtg

SEQ ID NO: 36090 - DNA, 201 bp, Bos taurus
tctttgcttatgtaactcaaactgatcttttctaaaattccttagagagattcttccttacccctactttagttttttgatactgagagagtcaattcttygggaggttgataagaggtctggggtccccaaggaggagaaaggggtctggggctctccaaacagagttagggatctggaattctcaaggaggaggaaagg

SEQ ID NO: 36091 - DNA, 201 bp, Bos taurus
ttccattaaatcttattcttctagcaggctcttgtatcagctaattaacacaaaagttactgttctcatttttggaataccaacgagttgtcagaacacarccctgactgtgctgctaggttgggaaagacacagcataaacagcatcttctgccccatgagaaggtggatggggctgtttctgatcatgtctctatgttt

SEQ ID NO: 36092 - DNA, 201 bp, Bos taurus
gtttactgtgtaaggagtattgacatcacttctttttttctaaatgataacgaggatagaacagagtctatatcttatccttttctgatagtgggcttagytgggcagctgagaaaggaaataaaagagagaggctgaaaagcccaaatagaactttatctacttcacaatgttgaaaaagcccaaccctgtaccataaat

SEQ ID NO: 36093 - DNA, 201 bp, Bos taurus
atgcaatgccttaatatccaagcattaataattcttaccactgttttcttaactatagttaacttttaattatctgcaatacagagcaatttatcaacagygaaacttcatctcctctacagaagcattgtgctaagatttgattactgatcagcgggatttttaattaaaatacaatatgtgatgctggaggaatctgca

SEQ ID NO: 36094 - DNA, 201 bp, Bos taurus
ttatctgtcctttgttgtcaagctgtcttgtatcatctactttcagagtgcttaggcccatctacttttcaattcaattccatccaaaagacttttaaatraaatcaaactactttagtacccaattatgagtaagaaaatgatcctgcttttatagcttggtgcccaggggacacaagtcataaggtgcttctgattcac

SEQ ID NO: 36095 - DNA, 201 bp, Bos taurus
cagtttcttggtcttgaaacagtaattcataagggttttctgttattgctgcttcagtttatattgcttactttacagactggtgctgcatgttattaaaygttccttttgtaagtgcctgtgactgtactaccagaggagatttggagggagtcacgattgcatcgaagcagaaggaaatgccattcacttttggatttt

SEQ ID NO: 36096 - DNA, 201 bp, Bos taurus
gctaaagctggtgacttttggaaagtatctaggtcccctaaggatgggagctggttgccagtggagctcacaatgtgattagagggttggaattttcagtygctgatctcctgggagggaagaggggctggagattgaactcagttgtcaatggccaatgttttaatcaatcattgtatatttgattacatatgcttatgc

SEQ ID NO: 36097 - DNA, 201 bp, Bos taurus
ccattgtctccccacaaacaacctagaatgtctcccagtcttccaaccataaaacagatggttatgccaacttgagatgtagaccatgaagaaaatgacaygtgctttcagctaaagctatgagaaatttgtgctttatatgctcaggatagcaaccttcaggcacacaaacggatattattatagtatatcagtttgtat

SEQ ID NO: 36098 - DNA, 201 bp, Bos taurus
cccagcatatgtagtctaagagagaaaggaaaaatggcaacaagggggaaggtgggaaatttttaaataatgggtaacacatgataaggactattctaaaraccttgcatgtacagttcatggggtgttggaaaggaaggaattttcctttactttccctggttcttctggctggtttaagaattaaattgacatgagaca

SEQ ID NO: 36099 - DNA, 201 bp, Bos taurus
gacaaaggaaattgtctatttaaagaagctctgaaatgaattatttttaatgcaaatagatattatgttgggattttgaaataaattttgagtaataatayggttcaaaaatccaaaggtattattttaagtcaactacacatcaacttttaaaaaatgaaaaaaattattgaaaaatccaaagatattaaatggtctaca

SEQ ID NO: 36100 - DNA, 201 bp, Bos taurus
ccaggccccgtcaaaacctctaccagaagttctccagcagctcttcctgaactttatgggtaagttcaaggcaaaggttccaggaagtcatattttagccygcctctggcccaagccccagtgcagcatgatcagtagtgagccgaacactgcattttcatctccatctggcttgtgtgtcgaacacacaattgattctga

SEQ ID NO: 36101 - DNA, 201 bp, Bos taurus
aaatgaaaatatctcctgctatatcaataaacaagaaatgtcacagtcatcagtggtttctggcctccaaatgtgaatgagggcccccaaaactgtgatcygtcagatgctgccatgccccatgattgctgaagatctgggggaatgcaaaaagcaaggtaaacaaggaaaccggagtggccctagatagctgaggtgcat

SEQ ID NO: 36102 - DNA, 201 bp, Bos taurus
agaagaaaacaagcagcggtctccagcctccaggtcatgaactgatgcctcccgtcagatgaccgagggcattagattacagtgcacaatagatgtaatgygctaggatcatcccaaaaccaccccctccccctggtccatggaaaacttgtctcccctggtgtcaaaaagcctgggtaccactggtttaaggagttaaat

SEQ ID NO: 36103 - DNA, 201 bp, Bos taurus
ctcacctttgccacaactgaattcctcttcccttccctccacataaatgtctacaaacataaaagacaaactttactccaaatttttttttaaactacttytctattttttttatctccttacacaactcaagtcaactaatcccttagcaaatttcaactttatatgatactatttcactatccaccttcttatatttta

SEQ ID NO: 36104 - DNA, 201 bp, Bos taurus
agagccagcagtcatctgcccttgactgaagtcagggcccacgagcccagcaaagaagccctggtgagagggttcaccatgagaagaagaaagccaaggtrgagctcagatggcacctggcgaagagggctggcaaggaagagaagccacggggacatagagaaacatggttagagaggctggagaagaaccaggacagcc

SEQ ID NO: 36105 - DNA, 201 bp, Bos taurus
ctgttatagtctatacatttttttctgttaccttatgtcacttgtgaagtgaagcagccataaatcatttaaaatatattatccttctgtgtcagtcagckaagtcctctaggaggcggatgccaagataacattacaagggcaagaaatctgtgtgtgtgtgtggaggggggggtgcctatgacagagcaaggggtgggg

SEQ ID NO: 36106 - DNA, 201 bp, Bos taurus
aacagacaaaaggccactcacataagaagaatcagattttagcttctggtctagtttagaagtaggacatcatactggaaagatgatgccttcaacttacygtaacattaatgttaagtaaggaattaatactgtaaaattttaagaattaagtgatcagaaaccaaggtattaatggtcagtatgaattgtctctgctgt

SEQ ID NO: 36107 - DNA, 201 bp, Bos taurus
ataatacactattattatcaatacttttaagcacaattgcttaaattactacccaatgaagctggaaaataactaaatacagtcaagaaaaatcagctttmtgtactatttatatatttgtagaccatcagaatcacagtcctctctagtacgatttctcaaaaatgatttcataaaggtcccaattagtatacagtgaaa

SEQ ID NO: 36108 - DNA, 201 bp, Bos taurus
ttattggattgcttgtgtacctgtatccatctgtacatttttaaaattcccagagtttgataaaccggtatatttctctaccaatatgggaattttgttaygtacattcctaaagggcaaggttcattggttttatttattctgtactgtctttggcataatttcatctacacagttggtaataattagatatttacagaa

SEQ ID NO: 36109 - DNA, 201 bp, Bos taurus
gaatgaagggctgaggtgagactctgaaagatgaacttgagtggagaggtcaggtctggctcacgggtcaccaccaatctgagttacatccctaactgccmgtccagagctcttccccagagccgtgaaacgtcccatgatccatcatacaggccacacgctgaggccttcaaggaccaagatttggacacaggcacaccc

SEQ ID NO: 36110 - DNA, 201 bp, Bos taurus
tgatagtttcaaatgcatccaaagaaaaccatggaaaacttgactggctttgtaattcagaatttaagaagaccaatgtttttctaaaatctaaatacaayatgtctttgggcagaagctgtagaattgggtacaaactagtactttctggtgtttggccactaagaggaaacgaaagagaggccaaaagttgaaaatata

SEQ ID NO: 36111 - DNA, 201 bp, Bos taurus
gatcaccagtaactgtatctttgttcccattttcagccttgtcacacaatcacaagaatcaccttgaaatgtaactaatgtgcttaaccctaggacattcrttcatttatttataccttgataaactccagtgaaatttcaagtgaccagaatacacactctgaagctagatgatgtttgcgatcaaatcagtggaagaag

SEQ ID NO: 36112 - DNA, 201 bp, Bos taurus
tccttttggtagaggaaactgattctcttttattgcaagaagaagcaagtctaactttaaacctagcaataatacattcatatttcttatttgcagttttygtcattcagttagataacttaagggcaaaatctgagtattgaagacaaattatgcatgtaatcaaatctctctgattgcaaaaaaaaaaaaaaaaaggtc

SEQ ID NO: 36113 - DNA, 201 bp, Bos taurus
cctgcatagtaacatgtgaaaaagatatgagaaacgttagtctctattgcttatttaacaagttttattattcaaaacaatactaaaaacaatagttttcmcttactgagtgacagctcaatgacatatcagttgcctaatttttctatgtgtctgactttgttagaaccttatttttaaaaactctatgaagtaaatatt

SEQ ID NO: 36114 - DNA, 201 bp, Bos taurus
ggtgtcagtaagtttggtttctccagaggcctctctccttgacttgtggacaactgcttccttgttatgtcctcacacggccacctcatataacaacatcrgttctattggatcatggtcccactcttatgatagcatttaacattaattgcttacttaaaggccctatcggagaaggcaatggcaccacactccagtact

SEQ ID NO: 36115 - DNA, 201 bp, Bos taurus
gacatctcatataaattgtgatttcttcaggagatagaactgttaggcttggcaatagtaaacatattaatcctaaactcccagtccttccccctctaggyaccctcccatccattggcaaccaaaagtctgctctctatatatgtaagtctatttttgtttcatagatatgtttatttgtgtcatattttatacactagt

SEQ ID NO: 36116 - DNA, 201 bp, Bos taurus
acacatttatgagctggctccccttaagattctctgtagtctggaaagatgattggcctacacgtaactgactgccactgtggccttgttagccactccarctgaatgaactgtctgcagggaagctgctgctgctgctgctaagtcgcttcagtcgtgtccgactctgtgcggccccacagacggcagcccaccaggctc

SEQ ID NO: 36117 - DNA, 201 bp, Bos taurus
tacttaataggaacccttcttcttgaagtcttggaataggtcatctgcctcctctgggtttagaaaagatcagtatattctaactcaagtacctggcattyctctcttacagaaacttctgtgtgttctttaattttgggaattgtgcctctgaaaagagttcaaggcctttgataatgaaatgttaacactcgtcccttc

SEQ ID NO: 36118 - DNA, 201 bp, Bos taurus
ctggaggaggaaggatcccaggctcagaggtcagcaggtagaggacaatctcagtcagatttatcgttttgcctggggccagatttgtctaaaagcttcaygcttttgcacagatctcccccaggattatcagctcacggaggggtcacgtgcgtatggccccactctcacccctctgggtaaacatcagaaaatctggca

SEQ ID NO: 36119 - DNA, 201 bp, Bos taurus
cagagctatcaggcatttgatcattttactgttgtttgtattaccaaatgaaaggaaaacagtttggggctgagtattttcagtgttaccagtgactcagyaccaggtacaagactcattttacttaagattgtaggttgaactcaaactggagtccttgaaaagaaagaccagttctttatccagtgcattaaagaaagt

SEQ ID NO: 36120 - DNA, 201 bp, Bos taurus
tgtatgtgcttaagttttcatttctctggaataaatacccaggagtgcaattgctgggtcatatggtagttgtgttgcaagtgttgttttgtaaaaaaccrccagaccatttttcagagcagccatatcattttatgttcccgctagcaatacgtgaatagtccagtttctccatctcttcttcagcatgtagtgttgtca

SEQ ID NO: 36121 - DNA, 201 bp, Bos taurus
atcttagctgatatgcacttcctctttttcgggccgtgaggattccaagagcagtcatggggagacctctcctgccagctctgctttcttgagaaagaaaytgagcttcacttggtggcccgactacagggaactcattaatagatgtgtcagcatttatgccaggctgattaaaatgcagcaaacgaatcattcatggtc

SEQ ID NO: 36122 - DNA, 201 bp, Bos taurus
cggccacggggtggcccagctgctggcatcggggcggggggctgcaggggaggcagttaaaggcacagggaccgcaatgatgccctggacctgcgagggartagcctcgggccaggggcagggagcgtgggcattaatcacggtggtcctcgggctacagggaggtgcagaaaaagcagctccgactctagaacaaaggca

SEQ ID NO: 36123 - DNA, 201 bp, Bos taurus
aggttacaggaaacaatcttggttaaaacatggaggacctagaatctcaggcatttatctctggcacataatttggtttactgtagggatattgtcctctmctaaaatttaagagacaaagtccatgaaaacagcagtttgaactattaggtggcagttatcttcaaactgacatcaccgacccaatggacatgagtttga

SEQ ID NO: 36124 - DNA, 201 bp, Bos taurus
gtcttatgtgataaaatccagttatgtcccctgtgttttacattactatctgcattctacaaaagtattatccccatttcacaaatgagaaagtaaaatgrcttagttgagaccacatatttactaagttttgtaactatgtgttttaagctctataacatctccataggtaaaatttgaacttgagcctaattaaaaaag

SEQ ID NO: 36125 - DNA, 201 bp, Bos taurus
ctgtaaatcagtacatgccagcttctactgccttcaaaagaaaggggtggactgcttctcccttcttcaacaacgttccagttgcccctgttttcatatcmcatgcaattccacctctaaagaaatgtgggccaaccagctgaagggaggggtgaagctgtgatatttgtcctcacccaaactgttgtagaacttcatgaa

SEQ ID NO: 36126 - DNA, 201 bp, Bos taurus
ttcttttgtttttttcatgctgccgagacttggactctctcaggttgtgtgtgtgtgttttgcatgaccttctagcttaacatatgctgcttagtgttacrtgtctcttttcctctcccttcccccactccttctctacatgcacacgtgcacacacacacgattggttaacatatgctgcgtagtgttaggtgtttcttt

SEQ ID NO: 36127 - DNA, 201 bp, Bos taurus
tgtgtaagagcctggaagacagacttaaggagaaagatgcccacacaattcagtatcttaaggaaagaccttctcctgtgaatggtcactaaggaggactygtgctcagtcgctaagtcatgtccaactctttgtgacaccatagactattgccaaggaggactagacctgatcaaaggtctatcatggccccggctctgc

SEQ ID NO: 36128 - DNA, 201 bp, Bos taurus
aggatggactgcagaagataaagtataaatatccctttcttacttttcattgccagtcacattttctcatattcaatgtcattcttcccttccaagaaatygaagtagatattgattttgaaaatgtatttcttagcggtaagaaatagcaaattacacctgaattataactttaaatgtacattttatgtccttcagata

SEQ ID NO: 36129 - DNA, 201 bp, Bos taurus
tattccatccctgaagtctacctatttaaaaaaaatgtgtccaggatcttttaaaaatatgcctctctggtgccatgtctgattgaccgacatttgggcarttgtccaattgtccataagtaagaaaattgtcagtaatcggtgctgtgaatacacacgcctacctgattcatccacggggctcagcttggtaccagtgct

SEQ ID NO: 36130 - DNA, 201 bp, Bos taurus
gggactcattggccaaatataatttttccactgggtttatccgaagagtaaggcagtgtgtgtcttcatggctccttagcttgtccacatcaaacagtgtrtgaagccattggcggccattgaccctcctactagctagattacactggaatagtgtcacattttactaacactcctcagaaaactttccttgactgtact

SEQ ID NO: 36131 - DNA, 201 bp, Bos taurus
atgggagttgttgagagaggtaaaaatccaagtctaacggaccacggtgctatgctgagaagttaaaaacaatacaaaaagtaccatgactaacacagtcrgttgagttaacagtcttgtgatggaaaacagtagatcatcaattttattactgtaagtttctagttaaatgagcttttctcaatagcatgactgaacaat

SEQ ID NO: 36132 - DNA, 201 bp, Bos taurus
tccagtttccttttataaggtgtgatgataaaattagatattggcttcactggagcatatagagtctgggacactgagaaatttgctggtaggctttttaytaaaaaggaaaaaaagaggtctacgttagataactagtgcgtttgcccttttcctctcagtcactgcttttagctcaatgcaaattgtgttttactgcat

SEQ ID NO: 36133 - DNA, 201 bp, Bos taurus
atatttggccccatgtaaatcaaaccataaatttaataagtaaattgttcacctgtaactgtgtttatatttatcatgaaagagaagtgatatgtgagtascttaaaaaaagttttcttgatgttttgttatcctgtgcacactatcattaccaggagtggatccatcctcctacaaaatagaaaaccccaagtcaaggga

SEQ ID NO: 36134 - DNA, 201 bp, Bos taurus
aaagaagaaatgatttaaataactttcttttgcacacaccacttatgtctcttcacatcaatgttttctgactttgaagtgaccccttcaaaggaagaatyttccccttatcctcgcctctctcttacctctgccagatgaatactttttccagatatttaaaaataatgtatcactgatgttttatttcaaatatgcaac

SEQ ID NO: 36135 - DNA, 201 bp, Bos taurus
actatgtacctctcaagtctgaacaattcatccctctctttgtcaaaatgagaaagccagggccagtgctgagacccaataaactcttccctcgattggarcaaattcctggaggataagggaagcagaatgagatgggaagttggaatgagaaggagggaatagaataatgtcaaactcctcctagaggccaatatcttc

SEQ ID NO: 36136 - DNA, 201 bp, Bos taurus
aaatagtgttttttcctcaaattgtcttttgtaaaacttccacccaacatgtattaatgatgtctcctaaataaggtataccaggagagaaatgaaagcayagctccttgtaaaacaagtctgcctcattctctcccctagctagttagcttttttcctcacccttcatcttcttctgtgattctaaagagaataataaaa

SEQ ID NO: 36137 - DNA, 201 bp, Bos taurus
tttattatctgccaggaataaggtaagtgagcacaaagtgttcataaacagaagtgaacacaaagacttttttctattctcatttttaaatatgacaaaaycagcaaaagtctagatacggaaaaacaggcactatgatccacaactttggatataaactagtgccacaattttgagaagtagttttgtgatacacaataa

SEQ ID NO: 36138 - DNA, 201 bp, Bos taurus
ataatatcatttatgtatacataatatcatttaaaataaagtctgatataaaatttacactgattgtcccaatcagaaatgtattcatttctcttctctaygctgactttacccagcaaagtctcacatactccatttgttttttttggtttatggtttttttggtatatgttttatccaggaaaattgtgtgttcctcta

SEQ ID NO: 36139 - DNA, 201 bp, Bos taurus
aaagctcaccaatcacaggaaaaaataaaaccctgtagcattaaacaccaatgttcctagactttcttcacatatgagggctacacttaagagaggcaatkcaactctcagttgaactcataaactgaattaagttcctatttgctacattattttgatatattagctaatccttttaaatatgattttgataaggcgtat

SEQ ID NO: 36140 - DNA, 201 bp, Bos taurus
aggaggttgtcaggtgttgaatttgcaatttatgaagaagcacatttccatctttagtagcttgatgtctccagcaccagaagcaagcatcttcatggtgyccttaggttccaagttgatcctcagcacgtcctacatcccttgaacccctgcactgcactgatattgaccaccaatgctgcttgggctcaggccaccttg

SEQ ID NO: 36141 - DNA, 201 bp, Bos taurus
aatcctttggaagcagggaaccaacaaaaggcaaaaaagaagggatagttgagaaagagaccagtaccctaaagggtaccttagctcatgatcttagaaaytgatgtcttagagcctaccttgctcttagatttttaggtttctgatattatttttaaaattcaagtgaaaggaaaactctatataagcttccttaaggtg

SEQ ID NO: 36142 - DNA, 201 bp, Bos taurus
cacactataaatctttataaagtcctgctagctatgaaataagacattgaagactgactcagacatttaaaaattaatagcagagagacattcagttctcyctgtccacaaatgcctctgttttagagggcagcagaagggaaacaaaagaataatgagaatcatttggccagcggtattgctagcacattttagctgcta

SEQ ID NO: 36143 - DNA, 201 bp, Bos taurus
acttatttttccctttatcaatttcataattattggcagataaccatagaggcagctagaatattcatctttttatcacaaagatagtaatgccaacagargttctgaaatctctttatatcaagtattacatatgtagaccaaaaagactcttgtcacttcagtattatctcatcagtgcccttgaattcctcagcaggc

SEQ ID NO: 36144 - DNA, 201 bp, Bos taurus
gatattcagcactttattagaaaataggttttgtgttagatgcttttgccaaattataggctaatctaagcgtgtaagtattctgagtgtgtttaacgtasgctaggctaagctatgatgttctggaagttacatgaattaagtgcatttttaacatatactattttcaactttcagcgggttaatcaggacataattcca

SEQ ID NO: 36145 - DNA, 201 bp, Bos taurus
cttgaaaaatactgataaattagtaattatttactaacttactaatactgattagtatttacattagctctctgggtcaacacttgaattcacaaggaaarcaaaaccaccatgaaggaatttagtactaaataagggattcatgcctaattgatcaatgctcacaaaatagaagctatttttgagcttctccaaggacac

SEQ ID NO: 36146 - DNA, 201 bp, Bos taurus
gacattaacaatgcttagagaacagatgttcctagtactgttcttaatgaaagggtggccttcaaaaggtactagtggcctcaaggttgcacgagcctaaygtgcacatcttaaggaagatatccatctccttcatgctcactgtgtttgttctacgtgagttcacaacaaaagcaaacagatgttttcttaagcaattct

SEQ ID NO: 36147 - DNA, 201 bp, Bos taurus
ccaaactttgtgagaaatatgtgtatttggtaagaatatttggtaaggtatttggtaagaatcacattctgtttttggtggtatatctggaatatgaaacrcaacttagatgtatagatgaaaaaaggcttttcacaattcccttcatgtctaaattttggaatgcattgttttacagaactaataactcaaatctagctc

SEQ ID NO: 36148 - DNA, 201 bp, Bos taurus
cactgttctgtcgcttcaaatttttgtcgcgacgtgacagaaccgaggaaattacacactcccccaacatctatggtgccgtcattaggatttaacctggytgaaacaacctcggctgggccccatcaagcaggagcccaactcagcgaaagctcacacggaggaagctgaacacaaagaaaacccagcgcaggggaagtg

SEQ ID NO: 36149 - DNA, 201 bp, Bos taurus
actgctacagtctagataaattatcttgatagtgataagtatctgatatgtcactgaaaaaagtgacatatttatgtgattatcaccagctgaaacagccrtatctattgaaactatagccaaaaactaaataattggcctgtggaaaccaatgtacagacattattgaaagagtcagtcatgtttctaagtgaaatgcat

SEQ ID NO: 36150 - DNA, 201 bp, Bos taurus
cagactggaagacagtatcgctaaaagtattaatactgcccaaaaaaatctacagactcaatgctgcaagcatcatgctacctggcctcaaaatgtaatayaaagctatagtaatcaaaacggtgcagtaccagcataagaatagatacatgagacgatggaactggcccattctctaatgacacacagaaacacaccaaa

SEQ ID NO: 36151 - DNA, 201 bp, Bos taurus
ggtccaagggtaaggggttttaaaaaggactagaaaatatactttatgaaggtaaaggtttgtcatgaaatgattaaagaaaaccatgctgtttttgaaawaagttaaaaagtgacatgagcttgaactctgtcagaacttccctaggacatactttggtcagaactgagggtacaactttctacaaaaatgtcacagaca

SEQ ID NO: 36152 - DNA, 201 bp, Bos taurus
tcctactccaaggggcctatcttctcagcctagagattgaacctacctctcttgcatctcctgtttggcaggtagatttttttttttttttttaccagtarcaccacctggcctttactcatattggtgcttgatttgaatggattcatccagtttcttaccagtagtttcatatatcattagctctaggtaatgttcagt

SEQ ID NO: 36153 - DNA, 201 bp, Bos taurus
agtatatattaatacctggaagaatctagagattttatttcagcaaatatcataccctcaagcaattgaattcaatcaaacgttgagtccaaatttgtttyagagaaagaaacttttcaaattacttcataaaccaaaaatcgagctcctatcagttcttccctgacaatagcgatcaaattacccacataaaacagggaa

SEQ ID NO: 36154 - DNA, 201 bp, Bos taurus
agtgaccatggtatttgaaatccaggagtccctaaactctagaagtattggacaagtatctagaagtactaaagaatttgcctttataagacagatgtatraaatagtcaggagatattaaaaaagaagagcaaaatggacccgtgtcaaatgttagtatttatattattcaagttttagtttctagtatagatatatact

SEQ ID NO: 36155 - DNA, 201 bp, Bos taurus
aaatgtcattttttttttctggttttctgctttgttgaactactttttgaatttgtggaagaacatcaacaaagtaggcagtccttgaagcaaaacaactracaaatagctcctcttagcagctaacaaaggcaccgttgtgccaccatacagcagttggaaagtttcatgaagaagagaagtggagagccaaataattga

SEQ ID NO: 36156 - DNA, 201 bp, Bos taurus
ctgcgttgtaaggcccattgtgccagtaggaagagtcacagactgtctgtagggaattaatctcggacgccgaggagttggcgtcccttctcttggaccgytttcgattcctcaggataaacacgagcatgcccaccacagtgaaggcggaggtgacaaacaccagcagcagtcctgggaccaacacggagatggacaccc

SEQ ID NO: 36157 - DNA, 201 bp, Bos taurus
ttcattcccctaattctatctttgctactcatttgcctacaaattacaaatttccttaatcagaattttgtcacctcacatttccttttaatatataacaytgatgcctggtttctcacctaggctatgcatactttgaaatcaatctacgttttacacttcttcctagtaggttcacagtaaatattaattagttaattt

SEQ ID NO: 36158 - DNA, 201 bp, Bos taurus
ttctaaaagtttataagccacaagaaacattgcacaggatgagactgtatgggtaaaaactgaaaatctgcctatcactgatggttccagcatcaaaatgrttccagtatcaaaaggtattgtcagacgtgcagctatttcacccaattaaaataagttaacaaaatgaccttacgttcaatatagcttgatgtctgaaac

SEQ ID NO: 36159 - DNA, 201 bp, Bos taurus
ggatgaaatgttcccttggtatctctaattttcttgaagagatttctagtctttcccattctattgttttcctctatttattttcactgagtgcaaattcmagattcagaaaactaacatcatggtatccagtcccatcacttcatgacaaatacatggggaaacaatggaaacagtgacagacgttatttggcgggaggg

SEQ ID NO: 36160 - DNA, 201 bp, Bos taurus
caaatatactacatatgagaaatactgggttttaaaacatgtaacactttgtaatgagattagacatttggctatgatgacatagctttcacaacagatcrttacaattcaattgtgctgtgcactcagtgtagataatcattcactgtcatgtctattccagattataacatttcaagtctactgggttgatctcctctg

SEQ ID NO: 36161 - DNA, 201 bp, Bos taurus
aatggaaactttggaataagatttaattctacttctgacaattcatttctctcttaatggtgagaatacacagaatttatcaaacctgctggactgattcyacatctttaatctgaggccatgtctagaagaatgattgctaatgtaattcaagcagcaaaaacatatttagtcaagttagacatttgcataatacataaa

SEQ ID NO: 36162 - DNA, 201 bp, Bos taurus
gagcctggtgggctgctgtctatggggccgcacagagttggacacgactgaagtgacttagcagtagcatacctccttcctgttcactaccaaataaacartaggcctcataagaatgttattaaaaatagaatgttcaaagtatttttaaattaaaaccatacttatttatattttataagatactaatgctactattca

SEQ ID NO: 36163 - DNA, 201 bp, Bos taurus
atcacacttattcttaatatgctgaaagtcatttagaatgtgtgtgtgtgtgtttcttaaaattacatggcacctcaatcacatgctatggaagatctcaytgttgctgagtttctcaaacactccatcccactgtcatgatcttgccccttaaaacagtccccattgtccccactgtatgtttccattggtgttccttca

SEQ ID NO: 36164 - DNA, 201 bp, Bos taurus
ttagacaaaaagcaaactcagaggattttattattcgagttaaaaatgggtcgtaaatcagaggagacaactcacatcagtaacacatctggcccaagaaygggtaacaaacatacagcacagtggtggttcaagaagtattgtaaatgagatgagagccttgaagatgaggagtgcagtgtctggccattggaagttgac

SEQ ID NO: 36165 - DNA, 201 bp, Bos taurus
ctacctgacataggtgcagtggagtccaccaaacatttctaaagaggtaaaacttcaaaagagaactgacaaacattttatgaaacttctttttgcaggtrgatgttaaaggccgaacagggagtggaggtaatcctcccaggctgcatcagaaagcttgaacagatgaagtgaaaacacatcaatttgagattaaaaaga

SEQ ID NO: 36166 - DNA, 201 bp, Bos taurus
taattgctctctattataatgccattctgataacaaaacttcattcaataattgaataataattttcaagtgcagtactcataaggggtagtgcagaaaayacacagacaatgcatgcttcctcaacttcaaggtgttcattagtgagaaagatactaaccaagcttactccattgaaagcagaattatgtaaatggtatg

SEQ ID NO: 36167 - DNA, 201 bp, Bos taurus
ggaaacttaagttagccaaatatttggtctttaaatgattttctgatacttattctaatataattcagaaaaatgtatcatctcagtccattcaggccacrggaacagaatagcatagactgggtggcttataaacagccgcaatgtaacttacagtcctggaaactgagaagtccagtgtcaaggcactggcacatttgg

SEQ ID NO: 36168 - DNA, 201 bp, Bos taurus
ttggtgccatggcctgacatgtacttggtgcttcatattgagatgttacaaacatgttcagtgtcacacagctgttagtggccaccaggattttaatagcmgacctttgcctagggttactggatcattggttcaggacactaatctgtatctcattctatgttgaaagagtttgaggatatgtcacatctcaatttaggc

SEQ ID NO: 36169 - DNA, 201 bp, Bos taurus
gtggattgtttagagactgtttctgccctttttgttgttttttttccatctaaatattatttcttttaagaacttagaatcagatttataagatctcgctrcctttgctaatagggcaatccatcttaagatctctaaaaaaaatgtatcctttatgttaacagacaaaatttttcccaaatgtatccatgttctgatctg

SEQ ID NO: 36170 - DNA, 201 bp, Bos taurus
gaatattttatcagactgataatgtatatggaacaaagagaatgaaaatacccaagattgctcactggaaaaaggaaaaataaaaataatagtgaaagatkttttaattctgtttaggtctagttctacctcagaacatctctccaccttttttgtgccacatttaagtgggaaagtgaagatgtatgtcagatttatttt

SEQ ID NO: 36171 - DNA, 201 bp, Bos taurus
tggaaatagactaaatagcaaacaaatttgccccctgggtgggggggtggggaagaacagaagaaggtggggaactaagtcttgtctataaaaaaaaataytcatggtttgaatacaagactgtcatgggttgaatacaagactgacaagtagataaaagatatagaagcataaacccaataaaataaaccaggaatattt

SEQ ID NO: 36172 - DNA, 201 bp, Bos taurus
aaatgtaaaagcctggaaagaaatgagtattcgctcatgaattacaaagtgccataagttatccttaaaacaggctaatttgtaagtatattcttggttaraatgaagttggttgcctctcctaaaatatactagggttgtttaaaaaacgttcttcagttataattctgtattttatctcagtaatatgttcagctcgtg

SEQ ID NO: 36173 - DNA, 201 bp, Bos taurus
ttacagtctccataggccaaattgagagtttgctttgctttgttgaacccataccagaagatgtatttccccccatacttctatactttttacaagggtargaatgagaagtggatgtctctagttgctctggtgtatcaatctagacttaactaaagaaactgaaccaataaaatgtgtatatcaaatatatgttgttgt

SEQ ID NO: 36174 - DNA, 201 bp, Bos taurus
tatctcctaccatcatgtccatattacagaattacatagcaactttagttttctaaaaaataccttcatttccactaccttatgtgattgtagaacactcyatgtacagtgaccgctgaaatgaaaaaaaaaaaaaaaaaaaatgatgataggcatatttaaacaattttccaaaaactacatctgtagtaattgggagag

SEQ ID NO: 36175 - DNA, 201 bp, Bos taurus
tcaattattttgtccttgtaaggatgttctcccttatcctatctactgtaattttctaggaatctcacttgttctgaaaagttttgttgtatacttagttrattccctgatactaggtttctgtgttcaatagattcagcctattttgcatttgtattaatctctcttgatgtttgactacaaatttgatttgttcttgat

SEQ ID NO: 36176 - DNA, 201 bp, Bos taurus
catgtcattccatggcaaacaaatattgccttgcttaatatgtgagcaaacagtacaaagtacacatgctttctaaatccaagatctagactccattattractgaacaggggcctctgaggcctaccagctatctagaaggccccatgtcaggtatttctaatctatgtttctgaatcattggatgccactttaggggtt

SEQ ID NO: 36177 - DNA, 201 bp, Bos taurus
ggctgtgcagtttcatagagccaataagtgattgttatcagtaaattataatgtgagtcaaaatgccaggaattaattccacaggaatggccataatacarcagctcaacttttaatatgggatagcttccatgtcacactattgctctattttaaatatcatactttcatcttcatcattctcttataaaaatccataca

SEQ ID NO: 36178 - DNA, 201 bp, Bos taurus
ttaagctaagatcagagttgtagtgactaagatgttcaaacattgcaggatgaagttctaaagaagaagcagctgggcagaggaaaagagtaacagtcttycttcccttgagttttgggctgtatcccatacttgcctactctttgcatgaggctaaaaagagaacaactattggggaaaacgaaacaaaacaaatactgg

SEQ ID NO: 36179 - DNA, 201 bp, Bos taurus
cttccttctatatttttgcaaagtttttctaagttaaccattgtcccttttagaatcgttggaataaagatctaagtgctagattgttttgagatctgatmagagacaccatataaaacaattaaggaagcaaacaaacatataaaatagttaaagaacaatcaaaacatgggttatcaagcacaagttgcttaaatctaa

SEQ ID NO: 36180 - DNA, 201 bp, Bos taurus
tgaagatatttatattcaggtaaattccattagtttaatactgcttttcaaaagaaaaggtttaagatgcatactgaaattaaacctgaaatactgcatayagagcaatgtttttttgtgagccacgttgtgtttgacatacaagttgcaaaacctggttggtcgatatatttttattcagttcaggcccaccagattatt

SEQ ID NO: 36181 - DNA, 201 bp, Bos taurus
cattcttttatttctttttacaatttattgattataattatctagtctaactagactagtctaaatatctagtctaagtagaccatctcatctctaaagtraatagattttcggtttgctgtaaagtagacaatcctaggggctgctttggtaactcaattggtagagaatctgtctgcaatgctgaagaccctcatttga

SEQ ID NO: 36182 - DNA, 201 bp, Bos taurus
acattgcaggtagattctttaccgtctgagtcaaagagacccatgttgatgatagagatctaaaagaagcctagatctttgatgaatcatagaaattgacrttctcacattttaaaagtgatatcagtacagttcagttcactagttcagtcatgtccaactttgtttaccccatggactgcagcacaccaggcttcccta

SEQ ID NO: 36183 - DNA, 201 bp, Bos taurus
ccaacagccctacttgaagcacaatagggaattacagtcagctgaaaggcagcctaagttcagattgttaattagtgagagtaaaaaaattactaataaawaagagaaaggaacaaagggatagatagaatggtgatagaagcaaatttcacctaatttctctgagttacccctcatttctatttaaacagttgaacaaat

SEQ ID NO: 36184 - DNA, 201 bp, Bos taurus
tatctgtgacccaaaataaattctctgttccatataagaatataccagagaaaaatagggcactaaaaatcgtacaaagagatttataatcctttcttccmtacagactcacctcaaggaatatagaatttagaatcctgataaggccacaagactaaaataaagcccatctctaaagatcaagaataactactctccata

SEQ ID NO: 36185 - DNA, 201 bp, Bos taurus
atattcatcctaaagatagttgtaagaattgctttttgcctttagcatatcaaaatatttcacattcgcacctgataggttcccatacaatttcattacartatttcattatttatgatgttgtacatctaagatacaaaactgtggtttctcctctgttttgtcctccaaatcttttggaacaatgtgcatgcaggaatt

SEQ ID NO: 36186 - DNA, 201 bp, Bos taurus
cactcaccttcttatgatcctgaaaatatattcagtaggactacaaatataatgacatacctagtgactgaatttggtgatggctaggattatgctctagkctgcagtgttgtgggtgctgggtgggttggggacgtgattaaattccttgagtagatctaaaagaattaaggagtcatgtgggaatttgagagagagaga

SEQ ID NO: 36187 - DNA, 201 bp, Bos taurus
aaaaatgcatattctcaatgaaattgctatttttgtactcaaaactcagcaaaaattgttttgagattttttttttctcatttcaaaatatttttcttatrtatgttaattagaaattgaagcaaatacaagtcttagtttaagttcatgtgaaaattcaagatatttgttaaattccaacaaaatttataaagcagtcta

SEQ ID NO: 36188 - DNA, 201 bp, Bos taurus
attttgaacattcatctctgtctccttaacttggtgagactgtgctctgctcagaatgtttccatacattgccagttttataagggcttttaggttcatcygtgttctaatgtccaaaaagtgatccagtctcagttactctatcacatctaatgccagacttctctccaatacaattgtgcaaaattatctcacagtttc

SEQ ID NO: 36189 - DNA, 201 bp, Bos taurus
agtgaaaattatcttctgtaattggccccaaattcacaccgcctacctatgttgcctttttgtttcccctcacacagtctacttcatatattgtgtcaggrttctttgtcagggaaaaacaaatattttaaaatacataaagaatcatttgaatatatcagcaaaatggccaaattttacatatctacatttattaggatt

SEQ ID NO: 36190 - DNA, 201 bp, Bos taurus
actatatggcctttttcaaaacacaaggattacctactgttgtcaaacagaaaatgcttaataaatgtgtctgtgttcaataaaactttctttactaaaayaggccataggccaaatgacagagtgctctggtattagtattaaatatttttaatatcatataagaaattaatcgccagtccagttttgatgcaggataca

SEQ ID NO: 36191 - DNA, 201 bp, Bos taurus
aatttatgtataaaatatgctaatgcctatcttttagccagccaacagggagtacattttattaaagatttaaattagttaaatcaatgtatattttatayagatatattgaaatctcaaagttggaaatggaaagtaagaatgagggaattaagtacagaatagccgaatgcactgatactctttccaaaatgctctttg

SEQ ID NO: 36192 - DNA, 201 bp, Bos taurus
tctaatatggcctgagaatttcttaggtttttcacagcatgcttaaggttagaatcagttagtcctgagcctacatgtatgtgtgcatgcatgcaaagtcyccatgtttggccgaagcagacatctcacataaaatttcttataatcatgatcacctctatattaatcgagtgcagcagttaccttcctactcttcacttt

SEQ ID NO: 36193 - DNA, 201 bp, Bos taurus
tagtaacatcagggttttccaaaaatattgagaaccttaaaaaataaaaatatgccatcctggactcatgtattcatccatgttcttttgtacgtgtataygtgtgtatgcatggatgattgtggaaaattgcattctgctacacatgaaaataaagaagagtccatgatttcaaggacccaaactgagtggcagttagaa

SEQ ID NO: 36194 - DNA, 201 bp, Bos taurus
cagaacatactcaggaagaaatggaatttatattattctaggcttattgcttggaaatggttttgaaaagccagaatccttctgtgtgtgcctctgggaamttctgtttctcagttacggtaggatttagaacagagttttttcactcagacattagggaaaagactagtgttctcattccatttctaatagaacaacaaa

SEQ ID NO: 36195 - DNA, 201 bp, Bos taurus
gaccctgatgggctacagtccatgggatcacaaagagtccttcatgcctcatggacaaaaaatcaaaacataaaacagaaacactataataacaaaattcrattaagacttaaaaaataaaatattgaaaacagtaattcttgcaaaccttttcttctgaaataagtcggtccacttatagaacagaaaataatttataaa

SEQ ID NO: 36196 - DNA, 201 bp, Bos taurus
ccaattactctttagacattttagaagttagccttgagtggctgcagtgtaagttcatcctgacaagaaacttgatctatctgctaactccttccttgtayggcttctattgcttcactttcagccatgagaattgttaaataaactgtcgttactgacccttttaaagagctcatccattgcctggctgcgcattgatga

SEQ ID NO: 36197 - DNA, 201 bp, Bos taurus
tggcaggacactcagagctccccgttgttcaggggcctatatggagctattaccatttgtaactttatggacttaatccaagaggttatgacctggtaackgcactgagaatacaagggccagacaagagtgctgcaaagagcataaaaagagggcctgttaaagggagaagccacgatgcccagctccagatattatgcc

SEQ ID NO: 36198 - DNA, 201 bp, Bos taurus
aaggggattatctgtttcaggaaagccttgtagggtcttgcttggttatagaggcacctacccagtctgtaggcctgagctctggcctggatgcttgctgyaggcagacaaaggggtaagtgccttcctaggagatgacatgggagaagacccaaataggccaatgtaggagaaaaaaagcgaaaaacaaaacaaaaaacc

SEQ ID NO: 36199 - DNA, 201 bp, Bos taurus
agcaagacaaaggtcatgagagtcatcttaaaattctacctgtcccatctaccaattttttattcaatgatttatcgtgtgaccagttcttggaaaagctragagtcaactatattgaagttaaaaatttagaacaattgactttcatgatggatatctgattagatgactataagattaacttcattatcaactgactta

SEQ ID NO: 36200 - DNA, 201 bp, Bos taurus
atgttcctgttttaatcctccaaatttatgaatatgtaacttttcattgtaaagctacacaattaaataagtgtaattgagtcaatgaccttgaaatggaragattatgttggattgtgttaatttgtcatagcagcaaggggacactaatgtagaagttgtgagtggattaaatatgaaatgaattataatatgtaaaca

SEQ ID NO: 36201 - DNA, 201 bp, Bos taurus
agcaggaaatttagcttttaccaaatacagtattatattgtataatttttctatgctttaggttactggctacatataagttattacctcaggtaagataraaaggatattgaaaatattagaataatcaggcaaatagtatgattatgaatagtaaattatttaatgtctcttaaatctagtttcttagttctgcttttg

SEQ ID NO: 36202 - DNA, 201 bp, Bos taurus
ggtaccaggaggcctccgaggcacatgttagtactgagcagcgtccgtaactttgctagactccacagttgagaagccagctaggcagccactacgcagtracactggaggtctcagtacagaggcctgaaagtttccttccgcccaaccaccacgtcctattcctggacctgagccttgaagagcagcaggccagcgagg

SEQ ID NO: 36203 - DNA, 201 bp, Bos taurus
ttttatatggacagtacattatgagataacctgcttaaaaatatttcatctgcagatttggtatcattctattcctttaattcaaatgaattatattttcyggaagagacacctctacaagtccaatacaatcagaataaaattgacagggaataaggtcttggataacgcaaaggacaggtgatattcatagttacgatg

SEQ ID NO: 36204 - DNA, 201 bp, Bos taurus
atcaagagagtggatggagtaatttcagtctgaagttctgacaggctcaagatccaggaagttttagttctagtccaaaggcaagaaaaaagccaatgtcycagtttataggccatgagacaggaaatattctctattgcttggtggagggatggcctttttattctgttcaagcttttaactgattgaatgaggcccagt

SEQ ID NO: 36205 - DNA, 201 bp, Bos taurus
tggcattggtgattaatcctagaatcacactctagaaatgactgtgtgttaactggagcttaaagaaggagtgtgaggacttagattagtcatcagtaggytgtatgtagcgtgatttatagacggtgatgagttttcatttaacagttttatttttttaaatcttgcactatagaaccctttttgagactattaatggta

SEQ ID NO: 36206 - DNA, 201 bp, Bos taurus
agtctccaacaatttcactagtttggttcaacggtttctggagaaacagaagctattgctccaaatgactcctgacaatttttagtcactcaagcttcctrtaccgttgccccttcaattgctcagataagaaggggccagcaaagtcagctacggattgcgaagaaaggagctggcttttgctttttgtcacattaacag

SEQ ID NO: 36207 - DNA, 201 bp, Bos taurus
aggagagcccagttcgattcctgggttgggaagatcccctggagaagggaacagctatacccactccagtattctggcctagagtattccatggacacaaytgagtgactttcattttcactggcattgctcttctttgggattggaatggaaaattaaccttttccagtcttatggccactgctgagttttccaaatttg

SEQ ID NO: 36208 - DNA, 201 bp, Bos taurus
atttatcaaataccacattcttggtgaggactcacatagacctatttgagatttcatcctgtttattctctatcctaactggctgcttttaaaaatatctycatattatttatcacaatttaacatactgtgtattatgcatatttattttctttgttttctacctctctcctcaagtaatgttaacccacacaaatgtat

SEQ ID NO: 36209 - DNA, 201 bp, Bos taurus
gaactataacaaggcttgaacttgtagccactatgacaaagacgagtataaacatttgacatctgccagaagtttactttgtcccacaagtaaaagatacmttttgtgaggatttgttctctgtttacaaggctattggaaagattacaccatagttcttcctttgccagttatttataataactgaaatttaatatcatc

SEQ ID NO: 36210 - DNA, 201 bp, Bos taurus
cctcttggcaactaaatagtttctgaactcaaatgctctaacaacacaggctattatagccaaggaaagagtagaaaaatcagaagtctgctcagctcgtsaagactttctgtcagcacttgatattctgtccagtttccctcgagacagcatctaattgatttttaagtgaccgcagtatcagcctgtacctcaccttgc

SEQ ID NO: 36211 - DNA, 201 bp, Bos taurus
acatttaaatatatacagtgtcttctatatctaatgcacacctctcaagtaatagtattagctggcatttctgaaatttaatggtgagtttctatatgtcrcgcactagactaagagctgttcattcttatttccaaaacaaaacacaatagccttatgacaaggattctctttttatcacctgtttagaggcaagaaaac

SEQ ID NO: 36212 - DNA, 201 bp, Bos taurus
aatcaataaactgaaatataatcaggttggagaacatgttgaagtacatcagtgcagggagagaaaagaagaaaatggccacatcagattgaattatttgkgaaagttgaagggcaatgtagtttagcctctgctgtattacttagtatgggagaaatgagctccaccacagggcttgagggccaggggtctggacaacaa

SEQ ID NO: 36213 - DNA, 201 bp, Bos taurus
gagagtgtgtggtggggtatagggtcatgataaaaacaccacaaaaatctgtttttgacatcaatgtgtagaggggaccaagtctgatttttggtgtgagwatacattctgattttaaatatttaatacacatatataatattgactaaccatgaacttcctgatgttcaagctggttttagaaaaggcagaggaaccaga

SEQ ID NO: 36214 - DNA, 201 bp, Bos taurus
tgtttttggcagatgaagtccaagtgtttgctcatagagatctattttcgtaaaaataaagctgatcaaagaagcatgaaatggagagcattttgaggccmtgttgaaattgaagttagtgtactctgcttactcttgaaaatcttggttttgtgatttgtctaaaaaatgggggaaaggaacgagttcaagaagaattac

SEQ ID NO: 36215 - DNA, 201 bp, Bos taurus
actaccgaattactcagacttggtgaaatatataaatatgagactacttgttgcacacgttttaagaatttcaagatggccactgcagaatgtcaaaccartatggcacccttctaagcttgggtgttgagggattgtgtataggtcacacacccaagacgctggccctgccaccaaacctcagttcatcacttgtgttat

SEQ ID NO: 36216 - DNA, 201 bp, Bos taurus
aagcaaatcagcacatttttagccagtagaaaatataaatgaatttaaaaatcaggatgcattaattgaatgcactcaattataatttaagttcctaactraagttttccgtctttagatttgggtattccaggctaccctttacttcatggatgctaatattaatagatgaacttagaagcaaaatcaagaccttatcca

SEQ ID NO: 36217 - DNA, 201 bp, Bos taurus
gaaccaggtggttgttgctaccttctggcctcctctgcttctgaaatgctgagtgaggctacaaaaaaaagatgatgccaagtgcgatcagggagaaatgmaaagcacatgtatctggccaagcaagtattactttgcagtctattagctatggttaaatatttaacacttttgaaagctctgggttgatgacattctcaa

SEQ ID NO: 36218 - DNA, 201 bp, Bos taurus
cttttctttcaattcttaataatttttatcttgaaatgtgtaaaaaataacagacaagtacagtgagaaacataaagaacccttgtggagtcttccctggkgatccaggggttaagactcctcacttccactgcaggggtcacaggttcaatcctcggtcggggaactaagatactgcctcaaagaaaagacaagaaaaga

SEQ ID NO: 36219 - DNA, 201 bp, Bos taurus
cactgctaagctctcccatccccaaacaccccccttctttgaggttccatgctaatacctgctagctttcagtggttctctgcatgcagccaggccggtcrtgggatgaaatgccactctacaagggagtttataattccagcacatctcgagtagcgggaacaaattctagttgtgtctatctccttggtaacttgaaca

SEQ ID NO: 36220 - DNA, 201 bp, Bos taurus
tcactcattttcatggacttctacatgggaatagaatatattacaacgtgatgtagttcagaaaatacctcacactcaaaacccttatcaaaagaaacaarttgtagtaccgtttctgttatatggggaaaaaaagaaaaaaataaaaagagagaaaccatttaagatatgcatttatgtgctttataactaggtcttccc

SEQ ID NO: 36221 - DNA, 201 bp, Bos taurus
aggagttgacacatttccaagaggtgctcaaggccctctgctctcaggaggcagaaccatctcgcctttgaaagctgacctttccctctccaccccctctyttttccaggcccttctccagagctaacttattcacacatagcaggcagacccctgaagcctactttaaaaagtctcggtctgtaagctatgataggatca

SEQ ID NO: 36222 - DNA, 201 bp, Bos taurus
tgaataattcaccaattttgttttctactatgtgccttaaagatacctcactagtaaaactggtatctggcacaacagaatgacataggcagactgtaatrttgtagtgacagtaatgaggttgactgttacacttatttaaactctgagtattaaatgttgcatcctaattatttatatagaacattggtccaataacaa

SEQ ID NO: 36223 - DNA, 201 bp, Bos taurus
cgcgccgagcgcggagcccgggccagcctccgcgcggcgcggcgggccaggcacgggccgcttcccactcctcggtcctctgggcctccgcccgggacttrcaactaacttcgcccaagtttcctgcgccggcgccgccgcgcccctgtcggcgcgctagcttcggagcgtgcgcccgcgtgtgctccgcggccagagccc

SEQ ID NO: 36224 - DNA, 201 bp, Bos taurus
ctcttcaccgtccccaagcttcctggcatcagctcacattttttgcaaactgcccgagaccaagtgtcctacctcttccagctctagccctcagctggaarccgatttattaaatagctgcacaaggtttggaaggttgcccgggatgttcccatccggacaaaaaaagagaatccagtgagacaaaactgagatcctggg

SEQ ID NO: 36225 - DNA, 201 bp, Bos taurus
tagcccagtgcccccatccccctgcctccgctaggtcgcaacctgggcgcccctcactccctcgcctcctcgcgggggaccgcggctgccagcgaggccaytgccgaagttcggggacgaagactgcatgtcatctcgcttctccttctggcgcgtccacgctccaccggggcggggggacttgaggccctgcttccccat

SEQ ID NO: 36226 - DNA, 201 bp, Bos taurus
ggaaataagccacacttttctgaaatgaagagatcaagcaattattcagtaactattaagtgctgactttttaaaagcaaaaaactgaggctgggtcacakgaggaatatttaagaacctctgtatggtttagaaacctagaaagagtttctgccataagtagcttagaatcaattttagaactagggcaaatatacaaaa

SEQ ID NO: 36227 - DNA, 201 bp, Bos taurus
ccaagactatctaagataggattccttacttaagtgaactgattatgcactttaatcatttttacaaaatatctacacagtaacagcttgactactttttkactgagtaactgtggaatgctgcctggccaaaccgacacataaactgaccctggtagcttggtggttaggattccaagctttcactgccatggcctgggg

SEQ ID NO: 36228 - DNA, 201 bp, Bos taurus
tgtggttacttgtgtactgattgtccaccactaggttataagccctgtgaggacatgggttgaacaatttctatctctggcctagaagataaaaatctgtkaagtccatgttctataaggtgtatgttgaatttgggaggtttttgttgagatgaatgaatgggagcaaagaagactacagggcctgatctaccacccttg

SEQ ID NO: 36229 - DNA, 201 bp, Bos taurus
catgacatcatataccagaaacaaagtccatcctaaattatgtattacaaactctacttttgaaaatacgataggaaagagttcaatttaatctaccactragtgagtagataattgattgacccaaaccttttgggcaaactaggcttatctttgtgatacttatttgagtttgaattttcttgaaggaatgaagtcctg

SEQ ID NO: 36230 - DNA, 201 bp, Bos taurus
tattatttgtagactttttaatgatggccattctgccctgtgtgcagtcatacctcactgtcattttgatctacatttctctaataattagtgatgttgartaccttttcatattcatattggccatttgtatttctctttggagaatctctaggtcttcagcccatgttttgattgcaatgtttgcttctttgatattga

SEQ ID NO: 36231 - DNA, 201 bp, Bos taurus
ctgcattggcaggcagactctttacccctgggccacttgggaagctcaggtgacccacaggtacattcaaacatggaaagcactggccccaactacagacraatgaatggacagatgggggagaagaaacgtgacaagttaggaaggcttcttggaggaggcctctagcgatgaaagcagctgccatttgggaagaaatga

SEQ ID NO: 36232 - DNA, 201 bp, Bos taurus
tgccgatgatgtgaaaagaaaggataaaaatgatccagattgtaagatgattgctgtgatgcctgggtgacacaggataagtggtaaggattggcagcacratatgagaaacggaaaatgtaacagtgaggtttagaacttgaaaaatgacaaaatgattatatctttgcgggtatgaggaaggagggcaatggaaaggtc

SEQ ID NO: 36233 - DNA, 201 bp, Bos taurus
gacaattagaacaggtgcatcggagcccatggtgtgagagcctgataaaagaaatggtaagggtgtggactcaattagctgggcaggaatgagaactgacyggcccctagccatgacctcgaaagtggatcaagatggcatttaaaacaaagaaactatattacagcaaatatagggcctttataattgcttaagtaccta

SEQ ID NO: 36234 - DNA, 201 bp, Bos taurus
tacggttgacccttaacaacagggctttgaactttgagtccattcaaacagggatttttttccccccagtaataaatactatagtactagtcttcccaggmggcgctagcggaaaagaacctgcctgccaatgcaggagacgtaagagaggaggatttgatcccccggttgagaagatctcctggagaagggtatggcaac

SEQ ID NO: 36235 - DNA, 201 bp, Bos taurus
ggaaaggattttcacaaatgaaaggacgctcctcagaaggaggaaggttcagcatttgtgagaaacatatccatcctctataacgggatttcctccaatgyggccactctgctgatttctgtcatcacaatgatttttgtcaacttttgacattcccataagtggagctgcacggtacccgctcttgtgtctgccttcttt

SEQ ID NO: 36236 - DNA, 201 bp, Bos taurus
ccatggggtcacaagagttgaacatgacttagcaaataaaccatcatactagtcacccatcagcctcgcctaagcctccagtccgggggccaggtagtgcyaacaaagccagaaaggacagccctccaagtgacacttcacccgcataatcacctggactgtcggtggcaccaacctcccaaggaggccaatgttgtcctt

SEQ ID NO: 36237 - DNA, 201 bp, Bos taurus
aaagagttgtcaagatacctcctactaaaatcagatttcccagtggacaggcttgtgatatataaagagtcctcctactcagagagaatagggcccttccrgcactccttcttgtaccattgcatctacaaggacagaaagttgtatatttcagttcagttcagtcactcagtcatgtccgactctttgccaccccataaa

SEQ ID NO: 36238 - DNA, 201 bp, Bos taurus
ggtgggtttcagatgacctggtggccctctgctacctggggcggcaggacctggagggaggctgtggatgcgtggaaggaattcctgcgaggtcagtacayagcatttctccttccacatggccaggaggagcagagggatagaaaacaaagccagagccacagggaggcagcgaacagagcttgctggtgagcaaggcac

SEQ ID NO: 36239 - DNA, 201 bp, Bos taurus
cagttggcccagggtcacctgccctcgcggtgtttggcacaacccaggtcatctatactttgacaagtgcagccgcttcggccagtccactatgggagccrcacacacacgaaggggctacttctcaagagtctctgtcttcagtaaagcagcaaggccatgaaaagatggaggcggttgagaagccgtaaaccggagtgt

SEQ ID NO: 36240 - DNA, 201 bp, Bos taurus
gttggccaacacccactgcctgcagtgctcatgctctctccagcctgggtggttgcccctctgcttcattagagctgagctaaccgtatttattggcatcrgcttttcattctcaaggataaacaccttggaatgagaatcaggaatctgggctttccagacttgctcttaatagcttggatgcagccaaagatcagcttc

SEQ ID NO: 36241 - DNA, 201 bp, Bos taurus
caatgatgtggctgctgctgaatcacagctgtggggggcggggggagagaaaaatctcatctttactttctggattcgtctttctctttgataatggcccrttttgagccataaagctattataatagtagggatcacgtctctgggatttttgcccatgccactcattcagatgtcattggaagagccaccctggtgctt

SEQ ID NO: 36242 - DNA, 201 bp, Bos taurus
ataacagaataatatatatatatataatagaataataatataataacagaataaaccagtctttgagaattttctgggaaagttagaaatgagtgaggagktaacattttgaatacattcagattaaagcagaggcttcgtactgtctcaaggagggaggagtttaggggagttgattctgtctttgacagactttcagca

SEQ ID NO: 36243 - DNA, 201 bp, Bos taurus
gggcctttcagtgaattagagagggcaaatggtgcatgagggtgtcaggctatggtttgtgggtagaaggcatgctcaggtcatgaattacttcagagttyacctgccattgtcctggcccaatcactcattcctcaaagtgcaacagttcagtccaacaaaaccttgcctgagcagctactgaggaccaggaactgtgct

SEQ ID NO: 36244 - DNA, 201 bp, Bos taurus
tctctccccttctcccaccttccccgctaccacccttctctcacccaaattccctgctattacccttttctcacccagattgctgcaatggcctgttgccygctctttcttctaggactgccttcacaggggagtgaccagtgccaccacgtggagatccacgcatatggaggccccattctcagggctcactgctctgtg

SEQ ID NO: 36245 - DNA, 201 bp, Bos taurus
tatgggtacagacagctgattcacacaaactaacacagcactgtaaaagcaactatatccaataaagactaattttaaaaaatgcagataacatgaccatygggtttatctaccaggattaagtaacagaattcacgtgatgtgcttagcacagtgcttaggacacagtaagtcttgaataaatggaaggttttttaaaaa

SEQ ID NO: 36246 - DNA, 201 bp, Bos taurus
gacagaggagcctggcaggctacagtccatggggtcgcaagagtcggacatgacttaagaactgaaccaccaccaccatgccgtagggtatacagtagtakaaacggaacgttgtaacatgaaacttacataatgctataagtcaatgttacctcagtaaaacaaagtgtttaaaaactgaagtgaatattgaaataaaga

SEQ ID NO: 36247 - DNA, 201 bp, Bos taurus
acagagaaagacaaatactttatgttgtcacttatatgtggaatctaaaaaaatgcaacaaactggtgaatataacaaagcagaaacagatttactgatayagagaacaaaccagtggttaccagtgagaagagggaaaagggttagggttagataggggtaagaggttaagaggtaagaggttaagagggtaagaggtta

SEQ ID NO: 36248 - DNA, 201 bp, Bos taurus
aggcagcagatggtttgcagatttggagcgaggattccagaggggaccagggtgatgttggggagagagtggccaggggcccagtggcagatggacaaagsggagcggagagccactgggctctgcttacgcctccttgggccttttcagatggttacacaatgacagttgatagcaaattaaggatgaaatgttttaagc

SEQ ID NO: 36249 - DNA, 201 bp, Bos taurus
gtgtcgttatcgggctagtgtgtcggtttctgggcctggttttcctgttgttggaatgtgcaatgctcgaagctcagaacattgaaatgaatctaaaggcragtccagctgttggccggcaatgagccttttcctcctgcatctcactgggccttcatcctgcttagggagttggcagcattaaatcccgcccccccaccc

SEQ ID NO: 36250 - DNA, 201 bp, Bos taurus
gccaagcccaccctcctcctccagctgtggccgggtgtcaggaacctagttctcgagggatgggtgtagctccccttcggtgccaaggtcagaacctcgckctggcagaggaccaggcggccagttcccagggctcgcgttacaccgcagcgcccacagttggcagccgaacccattatcactcttgctctgagggtggcc

SEQ ID NO: 36251 - DNA, 201 bp, Bos taurus
ggcggaagaccagaggtcgtggatctggccccaagtgtccccccggccactcctcccccatgacacctgccactgttcaaagttttgtgaataaagtccamaacacccatggtggctcccagcagtattgattctgtttggaagaaatgggaagattaaagcaagtttattctgaaagaaagaaagaaaatgaagtcgttc

SEQ ID NO: 36252 - DNA, 201 bp, Bos taurus
tgggttgcccaggtatttggccaaacattattctgggtattcctctaagggtgtttttgggtgaggttaacacttaaatcagtagactgccctccctatayggtgggcctcgcccaatctgttaaaggccagaatagtacaaaaggctgaccctcaacctgagtaagaggggtagtcttcctgcctgccagctctgagctg

SEQ ID NO: 36253 - DNA, 201 bp, Bos taurus
ggtgaagtcgaatgatggcactcaagcctgtttcacattcccaaggaacagaagaactcactaagacatgtctcagcagccgatgggctggcctcagacaygcacacacaccccttctcctgacctctcccaactacacgggattttacagtataaacagaagcattctggcctggagagtaggtttggcaaaagttatgt

SEQ ID NO: 36254 - DNA, 201 bp, Bos taurus
ttggccattttgctttaaaaagaagaaagaaacttgttttataattacctagtctatgaagagatgccacatttcttcccacatcagaggagcaagacttkaacaaatccaaagctggcccacttggctgaagaatggaaacaactgacgacattgctcccaaaagctttacagacaagatggcatagcttgctgggagtt

SEQ ID NO: 36255 - DNA, 201 bp, Bos taurus
tgccacgaggtatacaggtacctatacccaggaaaacacagaagctgctgtttaagacacaggcacaagtctcctcgtccccagccaagtgactgaggccrgcagggtcccccgggggcagcaggggagcccagatggcaccctatgtccgcacgttcatcctctcaccagggcctgaggaggttgccccagtctctgcca

SEQ ID NO: 36256 - DNA, 201 bp, Bos taurus
tgggaaatccccatggatggaggagcctggagggatacagtccatggagttgcaaagaggcagacatgactgagcacacatgtgctctttaaaggccttgyctacaagtatggttgcattgggggggtcagggacttcagcatatgaacttgggggtggggggtacatgcttcagtctatagcagcaccccttcctgagca

SEQ ID NO: 36257 - DNA, 201 bp, Bos taurus
ttcccttctccaggggatctttgtcacccagggattgaacccctatctcctgaattggcaggcaagttctttgctgctgagccaccagggctcccagttaracatttaatttattagttactgtgtgacaactatgaaactgtattgttttcttttttattattacgtcattcattcttcacattcaaaattacttgccca

SEQ ID NO: 36258 - DNA, 201 bp, Bos taurus
aattgttttcgtgaagtcacataatgtatttggtattatctaaaaagcttttttttttttttcagctttttgactacagtagatattcctaatagtcacaygttttctcttaagttttaccagttaactctttccacattcacctgatttcctctaaagattaaactctccctaatattccagttggcagttggtctgttt

SEQ ID NO: 36259 - DNA, 201 bp, Bos taurus
tcttctcctctgagttggggatctctgcacatacaacagatggccggagtgttcgtgtgtctcagccaggaagtgagagggcggcgtgtcgttcaccagcygggcacgtccccatccttcagggccactgctgtaaagggctgtttttcaccttcgggttcctgcggctctcactccactcaggctcacacgtacctttac

SEQ ID NO: 36260 - DNA, 201 bp, Bos taurus
tttgcatggcatgttttttttttctctcttttgctagctacttatttcactgtgagctctgcaaacatggtgggccgcagaggtgccaggcaccatcatgrtgtccaaaaattggctttgtgcatatgctgaattagagattggctggcagaagcagttcacagatcctggattggcagggattcctcatgaaaggaggca

SEQ ID NO: 36261 - DNA, 201 bp, Bos taurus
tcttgaccttcagtgggcatccctaaccttctaaagctgaccttcaaagttccgtttcccccacagcccttcccaggccaaaccaccccacttgatggctmtttctgtagcttctaatcccttaagcaccacttacagatggactcgcttgcacttttaatggtaggtcatttgcacgagttaacctgaccccaacccagc

SEQ ID NO: 36262 - DNA, 201 bp, Bos taurus
agagatgggcctattgctggggaactaaatgtgattttagtagcttttattgaaaccgttaactctacctggtaaattgctactgtattctttattcagtycttgtagtcacaaggatattaaaattccatactttaatttgtctctttctctgaggtactggtgatctgtttcatgtccccttgaattaattgatatcct

SEQ ID NO: 36263 - DNA, 201 bp, Bos taurus
gacggcagctgttgaacgcagcctctatttcccaggagctgtgaatgcaacttctcttcagcgccagggccagtgtatgccaaccgaagggccaaaaccckccagtcagcaactggtgtacatgtctggcaaggagcagcattgaccttgaggtgtgctagtcaccttcaaccttaaaatccccaaagggccaagtgagcc

SEQ ID NO: 36264 - DNA, 201 bp, Bos taurus
gccagtgcagatttgagggtggcagaagggtgctgaggatttaacatcactgccgcatttctcattctggaggagaccaagccatggctgttggaagtccrtcaggtgggaatgagcacaggccaggagtccctggagcagccgaaggatgtttgcggaggtccacacttgcacaccctccagccttctcgacatgtcctc

SEQ ID NO: 36265 - DNA, 201 bp, Bos taurus
gtaaagctgaaaaattaaaataaagtaaaaagaatggccaattgtttattcagatggaaataggctaaaaattcaataatatcttgggcctgtttccttgkcattatttatagatgcaaggaaatctgttacaatctgggatgcagtctaaggtttaaacgacagattataaaaagaattaggccttggtcaggtcaattc

SEQ ID NO: 36266 - DNA, 201 bp, Bos taurus
acacgactgatgcgacgcagcagcagcagcagcagcagcagcgcgtatatgtggactccaaaggagcaaaacgaaaccactgaccccccaacgaaagtcayagaaaaaagggatcagactcatgactaccagaggcagggatggctaggcggggcagggagtggaggaatgtgggcagaggtacaaacttcctgttttaag

SEQ ID NO: 36267 - DNA, 201 bp, Bos taurus
agaaagtttgctctaagcttgtaaaaccgaacagatagttcttcctagctctagagacgttttgtctaaataaataagacaagaacctacccttctggacmgagttgggagcaaatgaaatcaattcttcagctgatatgttttagtgtccccttaacactggtagttttataaatgcttgtgattcaaagtccaatgaag

SEQ ID NO: 36268 - DNA, 201 bp, Bos taurus
ctggccacggctcccccaggctgtgtgagaaggaagtaggtgggtagaggagaccaaacccaagaaagacagcggagttgcggctcctcctccgtgggacrcgggcccgtgtgacgtaagcaccctctcctcctccatgggacgcgggcccgcgtgacgtaagcacgtgtgctctgtatgacgccacgcacacccgcctgc

SEQ ID NO: 36269 - DNA, 201 bp, Bos taurus
gagccacactactgagcctacgtgccgtcactactgaggcctgagcacctagagcccgtaggcgacaagagaagccactacagtgagaagcccgtgtgccrcaactagaggaggcccggcacagccaaaaagaaagaaataaattaaattttaaaaaagaaagaacacttgagggacttccccggtggtccagtggctaag

SEQ ID NO: 36270 - DNA, 201 bp, Bos taurus
atgttggaattttggcttttaggtggtgagcaggaagatttctgtctatatttttgttctcctccttcctgttccctttcactctgttctaatggtgcctycatcctgcacttctcaggatcacagttcataccaggattgatggcattgctggtattcacaagctccagtagtactcaggacactgcatccagttcccaa

SEQ ID NO: 36271 - DNA, 201 bp, Bos taurus
atttaaaaccacattttcaggcatctggaaatgatcctgggaacacgcagacaatggaggaacagcagttgctgaggccaagtcctgggtgaatttggttragaggcagggactccttcctgctcagcccctgattttgaagcggagggtctgcccggccgggcaccgctgagaccccgaggccctgcccgcgctgggaag

SEQ ID NO: 36272 - DNA, 201 bp, Bos taurus
agaggtgcagaagggatagaaacaaaagtccttgtcacgaccatacttggttcatctttatctttgtgtacttttccccctggctctttaataacattcarcacaaatttctttgtactaaggacatctggaattggtgaaatcgctgattttttgtgatgggtccgtagcctcatatctacatttttcacatcaagcttt

SEQ ID NO: 36273 - DNA, 201 bp, Bos taurus
agtgaaggggcagagacaataactggtcacattccaactggtaacccggggtgggttttatctatgacgtggtccccaggaaggtgggctcactctgctcyggcacttgcttcaggggatctcccatatcacctggaatggtttgattcacctaggtcttccttttgtttaaatcttcaacttcctcagataacctcggtt

SEQ ID NO: 36274 - DNA, 201 bp, Bos taurus
taaagatggctgccaagaatctcatccttggttactcaattgaacactaatctaggtgcttctgggaaggggctgtacagatgtaatgaaggccccaggtkagctaagcttagagtgtggagaccactactcagtcaggggagagtccttgacaagcacaggttgtctctggcccattgtggggaggtcctgataagggac

SEQ ID NO: 36275 - DNA, 201 bp, Bos taurus
ttgttccagtcactttcattccatgagggtttcatcatctacaatatgtgccctcacccatggatcctgtaatgcgaccaagcccttaacacatactcaaygggaagtagttttgcaagttacacatattttcatttttatgtaattaatgtttctttctatctacatttcaacaaggaacattttaaggacaggatgtca

SEQ ID NO: 36276 - DNA, 201 bp, Bos taurus
caggctggaagtaaaagctatccacaattctgcagtgctatccagctgcccaggataaaatccagaactgctgatcctgatggccctgggtgaggctccaygtgtgatcaggagctggaattccccgataaacagttccttcacagtcttgaggtccagatgccagggagattttcaggcctgctccatcctatttgggag

SEQ ID NO: 36277 - DNA, 201 bp, Bos taurus
caaggaaaaagacaaaagatcttctgatccccttggtgggggacagctgtttgaaggaaaccactcaagtgattcttttttccccaataataataaaaatytgttccaaggtgacttgttatgtgaaccttttaagaggttggcttattttttttaattctatttccccaggtgtccaattatttgaaggtataaaaataa

SEQ ID NO: 36278 - DNA, 201 bp, Bos taurus
tactcagcctcatctgaccctaaaaggtccgatttaatccagaaaagaatgaccttgacgttatgagattctattatctctatttccccactttttggtgmaccttgtaaatgaatgccactcacttctattatattttaaaaagacttccaccaaggaaaagtgagtcagttgaggaaaaagaaaagaaaaaaacaagaa

SEQ ID NO: 36279 - DNA, 201 bp, Bos taurus
aacacgtaaataaacgtgttttccttttgacaaactaaagcttgtatctatcacaccacaggttttcccaaaacccactagccccacactcacttctgtaratgtgaagtcagtttcccaccaaccggcagacctgcttcaggtcagccttatgaatggactctctatgccattcactcagccccttgcctttctggagca

SEQ ID NO: 36280 - DNA, 201 bp, Bos taurus
ttttgcaattcttactagaaatggagcctttgtttacctttagggctgtgtatgtatttttttttttaatttttggtgtggctctttacacaaattgaaarcaatttgaggggaaaacagtgaagcctcctgaacacaggacttgggaacaaatcccctggtttgtttactgagccccagttgggcctatcagttctccgg

SEQ ID NO: 36281 - DNA, 201 bp, Bos taurus
agttcagtcactcagtcgtgtccgactctttgcgaccccatggaccgcagcacgccaggcctccctgtccatcaccaactttcggagttacaacaagcgtrtttcataaacttgtccttcaaccttttattatgatcagatccatcagccagaacaaaaatgatattttgaaattagtagctatgactgagagctgcaatt

SEQ ID NO: 36282 - DNA, 201 bp, Bos taurus
gtgtgtgcttatctgccctctgaatattaggagataaataaagaagattctttgctggggacactgttcagagatttccccccattttaaaagctgtttgytttcttagacttcttttatattttggatataagttctttatccaatatgtgttttgttaatatttctccttgcctgtgcctttttttttaaatcctctta

SEQ ID NO: 36283 - DNA, 201 bp, Bos taurus
tcttgtttcagagtctgtgtgcaattagggaccctgcaacttataaactctgtaaattacctctgggattgcagcctcagtccagtgacgaagtgctttgygtcacacaccacctgtatgctcatggaatgtccaccccagagagggatgtgcatgccacaaatggtgggagagcaggagagctattcctagagtataaaa

SEQ ID NO: 36284 - DNA, 201 bp, Bos taurus
tttcaaacagccttgggatgcagggcctgaccatctcactgcaatgcagcttggttagttcccttaggctccaccagcgctgtgttatggagcacgtgacyggtcgtgggccatcaccatctgacatacgacagtcatgagctactagaaacattcagtcctgggctggatgggatctttgtgctggcaaagagttgggac

SEQ ID NO: 36285 - DNA, 201 bp, Bos taurus
gtaaccttgctctttggctcatcggattattcgtggtcttgaaatactattttatgcagatgccagccggtctgctggcatgccacatgtgcctgagtgayagagaatggtgactttgaaaggtgtttcacatgctaaatgaatgtcctcttcctaccggattctgaaataattccagtgtgatccaaatgctgatagtat

SEQ ID NO: 36286 - DNA, 201 bp, Bos taurus
taagacagagactttgacacatgtttgtagaatccattataggtgttttgggtcatgtttataggaaatagaaaggggtgatgttcaggtccacggcagaraactcacttttattaatcattatattaataagataaagatttgacagcaacagttccatctatgattttgagttgccaagagaaaaatctgtcttccatt

SEQ ID NO: 36287 - DNA, 201 bp, Bos taurus
atttttgtagatttgataaatgtttccttatccagggttttattaggaagaaaaaaaacacaggcttttatttagggaatctcactgttttcttttttttycccaaagatttaactggttccttcatcttcgtgaatgacagacatttataaataggaaactttagaatttccttgaatattgatatcttattgttagttg

SEQ ID NO: 36288 - DNA, 201 bp, Bos taurus
tagagcagatcactgtggttgaaacaaaactggggccggggggatatgttaggaaaggaagaatagcatctaaaaggctaagcctaatgagatgggaggarcttcccaggggcaaagaactggcctgccaatgcaggaaacataagagatgcaggttcgatccctggatcgggaagatcctctggaggagggcatgacaac

SEQ ID NO: 36289 - DNA, 201 bp, Bos taurus
gcacccaggactcccctggtggcccaggggttgggactctgagcttccactgcggggggcttgggtctgatccctgatgggaaaactaagatccctcatgytgcacggccaagaaaataactaaaatcaaataacaaaaagacatcaagacaataaagaaaataacaaaacagcatcctgtatgcctgcaatgattctacg

SEQ ID NO: 36290 - DNA, 201 bp, Bos taurus
tgcgtcctgtagatggttgggcaggaggctttccctctaccaccaggaatccagcgtcttcacggaccagcatctgcagagccaacgcatcacgagaaatyttaggtgttcaccacatgtgcatcctccctgagctcactagagctccaccagaccaccctccagtgtctccatcttgtccagaacttgtgtctgcctcat

SEQ ID NO: 36291 - DNA, 201 bp, Bos taurus
aaggagagtccccaggcctggccactgcggatccttcccgctgcacagagaccgagaggtggacaggctcctgcaaagcgcccgactctctcctagtccaygttttttattaataagacaatcaggccttaagttactcagggagagcttgtggctgcaggggagagagtccttctcagagaacaccgtgccccgagattg

SEQ ID NO: 36292 - DNA, 201 bp, Bos taurus
tgcatacagaggaaaccgttatctgtggtaaaaatcctcaagcccgagtaggaaatgcgggtaaaaacacatcaggtcggcagtcaggcccaggccgcacrggctgtcggtgaaaccagggcagcgagcgccagcattccaggaggcgccgtggtgttctcagaccactgtgtgtacagggaagaccctcaccacgcggca

SEQ ID NO: 36293 - DNA, 201 bp, Bos taurus
gaaagttacgctgacaaagacagaccaacaggaggaaagcatacatgttgacttaatgttttacatgaaatggaaaccttcacaaggaaacgaaggtctgyggaagtgtttggatggacgtgagggttttcacactggctctgatgaggaatggacagtcctggaggaatgcggctgatcaagcagtagcaggtaagtgtc

SEQ ID NO: 36294 - DNA, 201 bp, Bos taurus
ggcccctgactcaccgggctctgtgcccccttcttggtgccgtggagactgtcgcgggcgtgggagagtgggagggacttgagccctgcctcgttccttgyggccgctctcgcgctctgttctgtagattctctggttcacagtggtaagcggagcgccaggcctgctccatctgccaggacctgccctgcgtctgagacc

SEQ ID NO: 36295 - DNA, 201 bp, Bos taurus
gacacgttctatttatttttaattgtttgctttccttcttttctctttttctgccagtaacttgtttctttgcatcgatggtcggcctgtatgtggacacktctatgacgccttcatctccccccacccactggatcaccccctgtctgtattagcttggctgtctgactcctctccctctgacctcctgggtgagctggc

SEQ ID NO: 36296 - DNA, 201 bp, Bos taurus
agacaggaggggggagtggagctgcccaccctcatgcccagagccagtgcctggagtgcccagcaccctctgtggggaagcaggggggggccctccccacrgtctcagcttcccctcctgcagcttgctgtgcctggggctgaggtccactcctgatggcttccggaggccaggctgtccctccccgggtgccagcccagt

SEQ ID NO: 36297 - DNA, 201 bp, Bos taurus
ccgtggagtttaagccccgatttagtgagctctgcatcattcctgcaagttccgttttgacatttcctctcaaataaagtatcagacactctagggaagaygcacgttgtctccccagaacgatccccagggaggatcttgcttggccttggcaatcattcttgctggcgtgatttgtatccagaactaggactgtctgac

SEQ ID NO: 36298 - DNA, 201 bp, Bos taurus
gatggtctccagaataaagtaccgcgggagccagcatcctgtgtgcttttaataaagcagagagacggcccgggctccgacagcactttctgcatattcayatttggattgttgcatgtttaacgttaatgctgtctattttctgccttttaggtgcttaggcgattgtaacattttaacactgctctgaaataagtgctt

SEQ ID NO: 36299 - DNA, 201 bp, Bos taurus
caccgggcagccaggaacctgtctgtcggctggctttctggaaggttcccacctggtttatccccaaggcctccctctgtcttggcctcaacccacacctygagatgctgagtgtgagtccatgggggtcgtctcaggggggacccgggatcggtacccggcccctggcagacacacagaaaatacaggtggaatggaagg

SEQ ID NO: 36300 - DNA, 201 bp, Bos taurus
gacgtgggcagcgagggtggcccggagcctggtttccttagagtggctgcagtgtgcgcgtgtttcgggaatgcagccagcacgcgggtctctcccacagygggcctgtcgtttgtgagcctggttttcatccagcagtggcagacgccacggcaacggtcgtccagtttagctcctggagaacaggctgggagctggtgg

SEQ ID NO: 36301 - DNA, 201 bp, Bos taurus
ttaaggtctatttatttattcattcattttcggccgtggcgggtcttcacggctgcagtgaagttctctcttgtggcaggtgggccccctctcccttgccrtgctcaggcttctcatcgcagcggctcctcttgaggagcacagctctgggctcgtggactcagcagttgtggcctgagggtgctagagcgctggctcagt

SEQ ID NO: 36302 - DNA, 201 bp, Bos taurus
ctttcacgcggcgactttcaccgtcgccactgaagaccgcgcggcgcggagggcaggggccagcgggctgtctgccgccgggacgctgcgtctccggggcytcctcctggacgtttccatggagaacggtggttggtgaacgtgtctttcttgagtctgcggcacctggacggcagtgtaattccctgatgggaggctgcg

SEQ ID NO: 36303 - DNA, 201 bp, Bos taurus
gcaaggaactgccaggctctgggaggccctggcttgtccacgaggctgtgtggtgggatgacagctccctgtgtacctgcaccccccgtaccccatgaaayaagcaagtgaccgggtaggccttgcttggagggggcatccgggccagggtggtgggtcaccagcagcaatggtgggaggtgaggaccccacggagctgcc

SEQ ID NO: 36304 - DNA, 201 bp, Bos taurus
gcccacacggtgcagggcgacccctcagggcagacgtaaagctaacgtccaggtgcccacttatcagcgtgcagggtgactgatttagactgttgcttaayactaaagggccctgctctacagaagcgggagggactctgggcgaaccgccgtcccctgcagccaccctggcccccggctgcccaccccgcccgcccccct

SEQ ID NO: 36305 - DNA, 201 bp, Bos taurus
tgtgtcccagtaaacctatcgtgagcgaaaatatttaagtcaaaaatgcatttaatacacctcacctacttggtggcttggcctggcctacctcaaacatrctcaggacactaaagtctatttcataataaagtgttgaagagttcatgtgatttattgaacactgtactgaaagtgaaaatcagagtggccgtctgtaca

SEQ ID NO: 36306 - DNA, 201 bp, Bos taurus
gtgatcctcttgaaaggttctgaggcatacagtgttcatattcctttgggttttgccttccacccacctgctctgacagacctttaattttggaccgctgyggttgaagcccgtggatgcacagtccccaaagccagcactaacttgtttgctttggagaggcctgacgaaaataggctgctttttaacgcaaatagctca

SEQ ID NO: 36307 - DNA, 201 bp, Bos taurus
aatagaaatgtatattttatgtttcttcaagttcattagtacctttactagtgttgctgtttcctttcctccatgattgattatctgaaatatttttctayaaacatagacacacatgtatttgcctcaaatctggcccaaattattatacaaatggatcttcatttgttcccttcactcatttttatttcctttatcaca

SEQ ID NO: 36308 - DNA, 201 bp, Bos taurus
gcggccccctgcaggggtgacaagcgggtggtctgtgtccctgactttcctgaaggtcttcctcataggaacgtgatggaaggctcaggagcagagcctcyggccctagaggtaggcctcttgggtgcgtgtgggagctgagcgcctggagaagggggagcggggtgccgcctgtggaggggccacgtctgcaggccccgg

SEQ ID NO: 36309 - DNA, 201 bp, Bos taurus
ctccaggctgtttgtctttgactgatgactcatttggcataaactagccttattgaggtgaattcctcctgtaccaagtttaatacatgtcacgaaagatrggatgtgttggtgattatggaaaggtaggggggatgtggaattatatcttctgatgtcaggtggaagaatggggttgggtgggtgggggaaggagttgtc

SEQ ID NO: 36310 - DNA, 201 bp, Bos taurus
gcccaggaggaacagggggaattctggtcccttctcaccctgcgcagtgtggctcccggtccagctcaaactcttgcgtccagactcttgtgagacctcaygtttgcataatcttgaaagagaatggatgtacttaaaacaaacaaaccaaaagtttgaagacgtttatcccttgaaagcaaagtggtctgttgtccttct

SEQ ID NO: 36311 - DNA, 201 bp, Bos taurus
catataattctcagatccataacttgagccttgaccttacttttcctaagcactggtacttctaagagattttcagttaaacaaatggcccaagtgcacaytgtatgtaattgatcaaaaaatgaagacctttcctacatctgtcctccttgtttaacagtctgtaacaggtgctaaaccccagggccatcttgtatctgc

SEQ ID NO: 36312 - DNA, 201 bp, Bos taurus
aaggatggactgaggcccccgtttaagcggagaaactgaggctcagggaggtgaagtaaccagcccgggctgtgctctggtggctgccagcactgtgaccrgagcctgtctttgggtatcagatcctgtactcttagcatcttcaagtctctcagctgctcccgctgagagactgtaccaaacacatgaaagcaggggcca

SEQ ID NO: 36313 - DNA, 201 bp, Bos taurus
aggtagttaagtgtagtgggttttggtttttgttttattttcttttaaaattacactcggctattgttttttcaggagacacatcgaatttcagactcaartctgccccctggtgttgaaaatagtaaaagcacctgaagctacttagttctgttcagttcggtttagtccctcagtggtgtctgactctttgtgacccca

SEQ ID NO: 36314 - DNA, 201 bp, Bos taurus
tttgagcaagttccaggggatagtgaaggacagggaaacctgatgtgctgcagtccatggggtgacaaatgttcagatatgactgagtgactgaacaacarcgacatattagaacaaacagttgtgtccctgcagtcttctgattcaaagatgaaagcacatatgcagatgcgttttaaggtgatttccactcagaatgaa

SEQ ID NO: 36315 - DNA, 201 bp, Bos taurus
gttggttctaatgagtttatgtcacgtccttgggatatgtcattcttttaaaggttgtgccctgccctcttcctgtctcataaggacatattgtacaacayggtaaatatagccaatattctgaaataactataatggagaataactttaaaaattgtggattatggacttccctgatagtctagaggttaagaatctgct

SEQ ID NO: 36316 - DNA, 201 bp, Bos taurus
atacatatggcacagtggccctctaaaatttcacctacccattcacaggtccacagagaaaccccacagcatcgtgtagttgctccaaaactttctccatrgttgggcgtgtgcattttctttgatagctgctttcatgtttggtctatggtgtgcctgcatatcttttattgcacttatgttccctaagatgaactgaga

SEQ ID NO: 36317 - DNA, 201 bp, Bos taurus
ggcaaggatgtggctacaagtagtttatttgggaggtgacggaggaagtgcagcaagggagggggtactgaaatggggtgggaaaggcagtaagtatgtgygcgtgagcctattattggtgtctcagtcttgcaggaagtgtgccccactgagcgacagggaagctggggtgtctctgcaccagctccagttcattgggtg

SEQ ID NO: 36318 - DNA, 201 bp, Bos taurus
attatatttttataagagaagatggcagaaaccacattggaaacagagaatcaaatctgtcatttggccatagcatccaaaagagaagagagatctaaaarcattccatacacacggagagcaccaagcaaggtttactatggattcatggtctacatcatctgagtctattcagcaatttcctccaacagaatgacaaag

SEQ ID NO: 36319 - DNA, 201 bp, Bos taurus
actgttctagcactgtgctagaacagtgaattcaggtaacaacttgaactcaagtaacaactcagtgagatatgaactattatgatcacggtattacaaaygagggaactgaggcccagaacacttaagacccttggccaaggacccatagccaggaaagaaaatcaccaggattccagggcagagcctggcttcagaatc

SEQ ID NO: 36320 - DNA, 201 bp, Bos taurus
tgagtcacatctgctcatatcccattggctaaggccaggtaatatggataaaatcagagtcaaagggcaggggagcaagctcagcctgtggaaggaagacrctggaaagccacagggccaaaggcgtggataccagaagggctgaagaataggaagacagagcttttcaaaggactggcaatgctacattaacagctggga

SEQ ID NO: 36321 - DNA, 201 bp, Bos taurus
agattagggcatactaaagggcagagaaaaacatctagcagttcatgttccttgacctctcagaagcccattatgtaggcctttaggttataaagggtcaktttccttctcaacacatttcccttaaggcgtaaatgtttggtaatgtgctcattaaacattaaggcctcaaacaagcacaaacacccttttttggtacag

SEQ ID NO: 36322 - DNA, 201 bp, Bos taurus
agcgtgggcactgggcacagctgtgggatttctccatctgctggccttcaccctggctcatctgaaagccgtagggctgtgcctgtgaaatggcttttgtyctcacattttaggtgctctgagggccccaaatggcaaaatggagaggagtagccagggaagagggcccagtgaggctcccttagtctccagcaggtcttc

SEQ ID NO: 36323 - DNA, 201 bp, Bos taurus
gagattcaaacaagaccatggcttagaaatgctgaagcctgctataaatgagatgcaaacagctgtgcaagttcagagtcagtaggtcagaagttgaagaraagaaggaggcttggtggggaagggcagcccaactcctggagggcataacaggtgatagaaggttcaggaaagcagcatctggggaaggggtgggaactc

SEQ ID NO: 36324 - DNA, 201 bp, Bos taurus
aggcatgcaatgttttcttggttattttggtaatggcagcacctttagcagtttcattcatgcagtcaggaagcaggttagtgggaagctagaattggaamgactgatatggggaggagaaatagagaaacaaaagctaaatttctcatttttcctccaaccttaacagagccctcaagactactctggattgtgttagat

SEQ ID NO: 36325 - DNA, 201 bp, Bos taurus
agtgacacagtagtggcaaagtgatcacacatcattacatagtgcacacgtgattatttatgccttctcaaccacagtgtaagttacaagcaattattttyccgtctcctccatgtaattacactgtaatctgctgggacatgtaattgcatggacggcttctgcactgaattacgcagctctcagggaccatgtgagacc

SEQ ID NO: 36326 - DNA, 201 bp, Bos taurus
cacagaagttctcccctacatatccataacccttgtccttgaatcttgtcttagtctcacattatagtttccatttagttatttgctgctccactacatayaaactgttaagataaaatcattttttaaagtatttatttatttatttatttttatctgtctgtgccaggagaaggaaatggcaacccactccagtgttct

SEQ ID NO: 36327 - DNA, 201 bp, Bos taurus
ctctctgagacttttccatcatagctggaacttcatgccaacgtttcttaaccatagagacccatttctcatcttgcaaaacgtgccagaacagaactccyactgacttgcagaatggttctgacacaggcagacccctgagagctcagagcatgatgagcaaagggaagactgtgtccatctcctgattctcagctctca

SEQ ID NO: 36328 - DNA, 201 bp, Bos taurus
tgggtgatgaggagaagctggcctccctggtatagggaggtgcaggtggtctggcaaagcagtgggaagattccagtccttggggaaacagtgtggagacycaggcctggaggttctatatggcggggacataaataagttggtgatggggtgactggggtaatgtagagaagtagcctcgttgtgaaagaacctatgaac

SEQ ID NO: 36329 - DNA, 201 bp, Bos taurus
ttttagatagttaaaatgagaaggtcttatggagaacctgtacttgtagagctgtagattattttgttcaaaggagatctcaaacagaagcaaaattgatmaaaactgtcataaaataaagaattcttataatgtagtaggtttgtgcaaataacagaagcttttcctgggcccagttcaggtcatgtggtgtcaagacca

SEQ ID NO: 36330 - DNA, 201 bp, Bos taurus
tttttaacaggctgaggcccaggaatcatttcctattggatgcaaagctcttcatggaggaaccaaatctttggtctccccggaggtctcagcatctctcrtggccagtccttgtcctgggacattaggagtttttcttgtttgtggaagatctctgttttgagtgtgctctgcacacccccagcgcagcctgctggggag

SEQ ID NO: 36331 - DNA, 201 bp, Bos taurus
agctgtatacacttaggatatgcactctttttggtaggtatgtcatactttaatattttaaactatactttgaaaagtagaaagagcaatggccttgaagygaaaacctgatgctgccaccaactccttctgcaatactgaaaatgtccatttaattccttgggcctcagtttcctcatctgtaaaaggaaacctgatgaa

SEQ ID NO: 36332 - DNA, 201 bp, Bos taurus
tctgagaacagggccttcttgggagaaacaattgcaacacggctgagaggctgtgaggtcagggagggtcctgggtcacggagggttgtggtggggggggrttgtccaaatgtctgttcctggcctctgttccctcaggcagagtcttgcatggcggcacccctgcgagagtgggcaaatgagaaacttcaccatcactcc

SEQ ID NO: 36333 - DNA, 201 bp, Bos taurus
agagacccagagagaacgccagacgcccagagggccctgaccgtccaggcgcactagcctacagagcccgagagggctgccaaggccaacgcaagaacctyagaaaagaggaagccacacagttcccggcactcacagaggggagagtaagtcagctcccaccagcccgagtgaggacaccaggaaaagtctcagaaggta

SEQ ID NO: 36334 - DNA, 201 bp, Bos taurus
gagttggacacaactgacctctaacacttttacttttcatataatcgaacagacaagttatcttcattttaatagtatcaggacaaaaagttccaaattcrttcctgaatcttaaacataaggcaaaaatctcttcttataattacataaaaggtggacctataacttaaaatgtggaaacgttgatggtgtcatcttact

SEQ ID NO: 36335 - DNA, 201 bp, Bos taurus
acagtcttaagtagtgtgtcctaagtccaaataactgagccagcccaaaactcaaatccttaaggggtcagacagatgagaggaatacagaagtattagcrtgtaaggcttaaggaagggcaggttctgctgcgaaaggaaatgcactgtgttcttcccaccacccacccccgccccagggaatccatagtgtgctgtcca

SEQ ID NO: 36336 - DNA, 201 bp, Bos taurus
actcagtttgcctgaaatatcagatttatggtttcagagcagtaaaattggttatgtcacaaggaaacactgaggatttgcagattttcttcaggcattcmaggttttctaaagtttttgcaaagggaggtgacatgatcagagctctacttccaaataccagtctggtagtagtctttagtggagatcagagataagaga

SEQ ID NO: 36337 - DNA, 201 bp, Bos taurus
ggcaggaactagaatttactgagagtggtactccatgaagttgcagttagggaaggtctgtgtgccacaaaaagcagcagtttgatttcactgtgattgcrgtgggccaccattagacgcttttttttttttttctttctcttgaatattcgtgttttattttattttattttttttaattttattttatttttaccttta

SEQ ID NO: 36338 - DNA, 201 bp, Bos taurus
aaggaccagctgtttgagttaaatagaccaaaatttcaaaaaagaactcagcaaggataatagttcgcagactcttcttgttctctgagaggtgttttgtmtttggaggactggagggcagaggggcaagaagcacgggctgttgagactgtgtttaccgagagctgaaatacgccatgttcagagtgtggcgggaacata

SEQ ID NO: 36339 - DNA, 201 bp, Bos taurus
gaactctgggagttggtgatggacagggaggcctggcgtgctgcaattcatggggtcgcaaagagtcagacatgactgagcgactgaactgaactgaactrttggtcatgtgtagaggtatggcctttgaagtcaaacgatctggctctgtaagtgtctgtccctctctgcacacagctcacgtcctctcctgcccttagt

SEQ ID NO: 36340 - DNA, 201 bp, Bos taurus
cacaagggagattgaaaaaaaaatgtttttctttgctttcctcctggttcttctaatatctttaatcatcttggactcccaacccatccagtctcatccayactaatataatagatacttttaggacttgatggaattctcataaaactcagcatctcaagctagggagggaatatgggggctttcactggatgtttagac

SEQ ID NO: 36341 - DNA, 201 bp, Bos taurus
ctcgacctactggagtctgcattttaacactcctgttcctgatgcttgaattgactttctctccccaccccagctagctagtctctaaagaggctgagaaygaaggcctcgcttgtggagtggggaagtcatgccctggtgagctgactctgcccacagcaacaggaggagaaaggagaacaactttggaggtgagagacc

SEQ ID NO: 36342 - DNA, 201 bp, Bos taurus
tggaagactctgttagtttagatgtaatattcacttttagccttcttcatttataataatcccaattttatttggaatggcaattcacccagctattaaaraaagaagccacacatgtttaccaggactccaattcaattacgtgtgattgtgtgtctgggacatgaattctaaatgcaagtttgttggagattactatca

SEQ ID NO: 36343 - DNA, 201 bp, Bos taurus
taattctgtcacatttgaataatatttcatgaactgatccttaggaagcactggaggaagagtttaacagacaactcaattatacctattaaattgtttgyaatcctctgaggccttatcatctgaatagacggttctagaaaattcactcaaacatgtacacatttatacattcatcccacaaaatgtggtacaaactcc

SEQ ID NO: 36344 - DNA, 201 bp, Bos taurus
ccccttctgtcatctgatttaatggaaattctagtcagtgtcagcttgtacagtgattttagagactgattaatgagttgtcactgttttaaattggatakaggtaatcagaggcaggaataaaagtatcttagcatctgagcaacccagaacattcaacaagtgatgaatgaaaccatgagagcccttcagatgtgtgat

SEQ ID NO: 36345 - DNA, 201 bp, Bos taurus
gtgtgtgtgcacgcgtgtgtgctaaatccagggggcctggcaaatagaaagccttgatacaagcacactgactgaagggctgtttggtatcgtttctgatratgacagacctgagcgttcatgaaccctgctcatctgtctcctgcagaccttcttttctgtgtcagatggtgagcatgctcagtaggtttttatctgtat

SEQ ID NO: 36346 - DNA, 201 bp, Bos taurus
tactacattctgcctggccccttactacttttgagagcttatgtgtaatggcttaaaccttatttaagccattaatggttctcaaccaggagttactttcmccttccaaaggccttctggcaatgtctggaggcattttggtttgccaaaccagtgggtgggatgtggagaggaaggagccaccactagcttctaggggct

SEQ ID NO: 36347 - DNA, 201 bp, Bos taurus
gggacccacatggctgcagagggcctgtaatcctagtgataataccagtgcggttcacagactcacaggcattgcgtctcatgcttcagatctggtgcctmgcttaggtttgcccaccctgcaggccagtgcatggatcagctggaaacctctcttcctttgatttaaacccacatctttcaagactgtttaatgaaggtt

SEQ ID NO: 36348 - DNA, 201 bp, Bos taurus
tcttaatttataaaaattcatacaaatcagtaagaacaaaatatataaataacccaagaatatggcaagtcactgaaaaagaagtatacctttataaaaayataaaatgaccatcttcagtctcataaagaaacacaagtcaaacaataatgagatgccatattttgattaaatgtatattttgattgattatcagattga

SEQ ID NO: 36349 - DNA, 201 bp, Bos taurus
attgtcagaaaatgtccttgtgtcagatggggccacagcttatagtgaaaacaagcctcttagtgcttctgcagcatatgaagagacagctccactttatyagtgagattacactggccaaggatgactggctgtctcaatcacctgcaggccaatcatgaagcaattgccagggtcactgggcaacccagtccaattcag

SEQ ID NO: 36350 - DNA, 201 bp, Bos taurus
tgatgtggttgagaaggatggcgtggatgtggatgaaccacagaggggagagggaagggagtcagggccgtcctttttcctcaaatggcccttcttttggrgtcccgtagtcagtgagcttggtcatcaggtcgttcagagcctccttgtccaggaagcagtatgactgagggcctttttctcaaccctgcagttggctcc

SEQ ID NO: 36351 - DNA, 201 bp, Bos taurus
gagttggggctaaatttgtaagatatttgtgctcctggacccttgccagcccgaagtagctgtgttcctccagccgaggcctccccacccgtggatggtcygctccctctctagctcttgcttggtctctgagctggtaatggctcccctccatcactggcctgtggacttcactgtcctttagtgctgccctagcttctg

SEQ ID NO: 36352 - DNA, 201 bp, Bos taurus
gcttcatttcagatgtgtagtgatggcatcgctcagttttttccagacacctggtcaacggccatcatttccctacattttcccatgtcattccggcctcrtcttggagctaacgtgtgcccaggatgcctagctttgatcatgctgtaacccatctgtgggcagttaaggatgcgcaccaagcacatccctttgactaaa

SEQ ID NO: 36353 - DNA, 201 bp, Bos taurus
gaagagatggccccagcacgtctgcactcggagagccatgtggactgggtgtggctccaggtcaggaggctcaaggtctaagaggaccaaggaggtgggtraatgagaggccacagcttcagaagggagccactcaagcctcactccagtcaaccgaaggggaaccagtgcaatgcaacattgctcatcacctgcatcctg

SEQ ID NO: 36354 - DNA, 201 bp, Bos taurus
agctgtctagtttcgtgtggcatgtctcatgcaattcatccgatgtcagctgaggctgcatcatgtgaagattcggctggtttggaatattcaagttgatkcattcatgtggccagctgtggacagtgctgcttaggtgaggctgtgaactgaaatacctccatggggctttggcattcacagtgtggcagctggctctaa

SEQ ID NO: 36355 - DNA, 201 bp, Bos taurus
tgtgtctgaaggcatgggaaatcccttatgaatgtcaacttgatcttccccatcgacccacttacagatgataaagagccagcatcttaagattcctctgyagcggaaggcctgtgccctctgtgaaccgacttttcttattaaatccattgaaatcagggctcaagacaccataagagaagaagtcataaatgacagaaa

SEQ ID NO: 36356 - DNA, 201 bp, Bos taurus
ttagcgactgaacaagaacaagatcacgctttatcttacttgtaattagtaacatatccactgcatgtctcctcctccagtgaggagtaacaggatggggrtgcagctatgccatcatcatcaggggccctaaaggacaacctggctcccaagaagggactagaattttactgggacactcttttatctacactcaggaca

SEQ ID NO: 36357 - DNA, 201 bp, Bos taurus
aaagcggtgaccgatcgttatttgatcactagcttcacatgctgctctgacttctccctgaactgatacgtcctggaaatggccttaaaacactgcacacycttcactaaaattaaaaataaaaagagagaacaacattttccttttaatatccagtggcctgctgttttatttttttactctgtaactgtccaacatatc

SEQ ID NO: 36358 - DNA, 201 bp, Bos taurus
accccaaattcatatgttgaagccctagtacctcaaaatgtaactgtatttggagaggggaccttgagagaggaagttaagttataatgaggtcatatagktaggccctgacgctacataactggtatctttataagaaacggaaaccaggacgcagacgaacacagagggaagtccacatgaagccaaagggaaagacgg

SEQ ID NO: 36359 - DNA, 201 bp, Bos taurus
catggacatgggcatgaacagtcccatcacctggcattgacaatggcatgtggaggagctcagtgacgatttagtggctgaatggatggagaggttgagcmaagagtggcacccccaacattagctacactagaagccttccctgctgctgccaagtcgcttcagtcgtgtctgactctgtgcgaccccatagacggcagc

SEQ ID NO: 36360 - DNA, 201 bp, Bos taurus
gccccacctccaggtcttttgatttccatagatctggggcaggggggtgggaggctgagggaggaggtgaaggcttttcctccctaaaaagtctccagatrctgctgctgctggcccaggtcacactgagagcagaccctcagtacaagattgctaatacttcagacactcaccccaccctacaccttctctttttattct

SEQ ID NO: 36361 - DNA, 201 bp, Bos taurus
tcccatcatttcagatgtgaatttctctacctgaatccaaggcccatcctgcatctggctccaggcaacctgtctaacctgatatcccccgtgtgtccctytggtgccagctggccttttcaccaattataatatgctagccagttcctcttgatgttggcttctggaaaaccattcctttgccatcttccctgtgtcctt

SEQ ID NO: 36362 - DNA, 201 bp, Bos taurus
ctatgccaaaaaataacatttgggatagttgtctttaaaggactctgttatttatagctttcgttttgataacatttggtcagttcattttaatagttggraaagcggaagtgtatgtgagctttttgtaaaggatttaaaagattacctagtctctgtttagccttagtgaactgtgaaggccttaattttgtacaataa

SEQ ID NO: 36363 - DNA, 201 bp, Bos taurus
gaggctgccaacctgagatcaaggggctggcagtgaggggtggcgagggaggatctgtttcaggctctctccttggctcgttgacgatggccatcttcttyctgtgtcttttcacatcatcttccacttatgcaggtctctgtgtccccatttcctcttataaggacaccagtcatgtgggattagggcccaccccaaggc

SEQ ID NO: 36364 - DNA, 201 bp, Bos taurus
gaaattggatttcctccctatctagtgggaaagggagcttagattaatttttagaaagggaaacataaatagagcatttcttaaagtctgcctgttgttayatattcaaagctgctccataaggaatgaaaagcatttgcttgtatctgacagctaggaggtcataggtgcagtttcagcagagtttgggggtgaaatcta

SEQ ID NO: 36365 - DNA, 201 bp, Bos taurus
attgacagatgtggtgcttcctgtcaaggaagttatgaaggcaccataagagaacccctgaagatggtcctgaagaggccgctcctggactgacaagggamgagtcggcatggagaggagagtgccagctgaaggggattggatattcgctggcccagaagcagaagagcggaagggaggggaaggtgcccctcgaactgg

SEQ ID NO: 36366 - DNA, 201 bp, Bos taurus
ctctgtgatttgcagctgtaggggcttaatcacacttctccagcttttatagtttatttaaaatgttttagagaagaagtttggcttgtctgtgggcaacyggatggcccacttccagggggtaatgggatggttcctttctgctagtccagatactgtactgccaaggggcataggtggcaattcgaggacaaatcttac

SEQ ID NO: 36367 - DNA, 201 bp, Bos taurus
gggccccggggacagacgctttggctcttcttgcccctggcgctcctgtaaccagagggtctcacctgcagtgtggacatctcccctcccctcccgttcarggcaggggcttgggggcctggcggccccactgctagtgggaaaggcctcggacctcagctacgaaggcagctcaggaggctccgaggggacgcaccccga

SEQ ID NO: 36368 - DNA, 201 bp, Bos taurus
tattcttaaaattagaggaaaaatgaataggctcaaaataggaggcacagaacgtgaatgaaaaataattgttataacaaagtgcgagcgtaatgcttttygaagcatccccattgaagaaggatgttaatcctttcttaatttttcatggaactgttgtaagcatattacttagagaggtaaatctatgacactttttaa

SEQ ID NO: 36369 - DNA, 201 bp, Bos taurus
ctccatttcatccttgccaatggtgtcacctgctctgctgcaaatattttatccccaaaagacaagtctcttaaatgccaaaccaaatggaaacaaaggtragaggacatatattcacatttagagtctggacatctgaatcaatacgtatggctcagagcattaacccactttattgacatagcagccttcttctgagct

SEQ ID NO: 36370 - DNA, 201 bp, Bos taurus
cgcacagagtcagacacgactgaagcggcttagcagcagcagcagcatacatgtatatatttccttgctctgtcacctgagagggcctagatgcaatgacractcagtagtaatacgcacacctagtgccctgatcttgcttttatatatgtattttctggccacgccatgcaacttgtgagattttagttcctcaaccag

SEQ ID NO: 36371 - DNA, 201 bp, Bos taurus
ttggctcctgttactactgtttttgtggatattatggccatgtttccatagtaagaattgccctcagctaccgtatatagaaggcaggcaaatgataacayagcaagtagatgaaaggccaaatgcgggaaatttttaatttgtcacgtctattaataatctggtttcccaggtggcgctagaggtaaagaatctgtctgc

SEQ ID NO: 36372 - DNA, 201 bp, Bos taurus
actctgcatattttggcagcttccctaagtgtactaataactcatgccaagtacagttggaatgcttcatgagtccagactcagaaagcaactgaatcaarcagtgttcatcttaaaatgatggctgatttgtggtgagtcaagaaacactggactatatatcttaaggtctggaagatccaaaggataagctaatgtgat

SEQ ID NO: 36373 - DNA, 201 bp, Bos taurus
tgaagctctaactgtcaatgtgactgtatatggagatggggatatttaaagatacgattaaggttaaacaagaccataagggtggggcctaatctgatagkaataatgtccttataagaatggaaaaatatttcagggatgtgcatgtacagagaaaaggccatgagaagacagaacaagaagatggccaactacagctca

SEQ ID NO: 36374 - DNA, 201 bp, Bos taurus
gtgccattaattttactatgtattaccaaattcttctcccaagtgttttctcaatttatatttccatgaaaaaaaactctttcttgcatgctctacccaayaaaatatatgatcatattttaattttgttaaccaagtgggtatgaaataccaaaatattttattttatgtttttctaaaagttgtaatagatgtcagtta

SEQ ID NO: 36375 - DNA, 201 bp, Bos taurus
tcagcggaggtggccagcaggagcaagaacatctgcttttctctctctctgctgggcatccaccaggatggttgtgtgtgccagatgctgcatggatgctkatcagatagttggccaggcttgtgtttttgttttaatttccattttgctatagattgaatgtttgtcccacctccccacacaaaaaaattatatgttgaa

SEQ ID NO: 36376 - DNA, 201 bp, Bos taurus
gttaaagattgctggcgaggacaatatttttctcctacttgtacttcattatgttaacatgtgctttatggccagactgggattaatttattcatttgggytcacaataccaattttaattcattacagttcacttctttatttgttgagctaataatctacaaactctaaagaaattaaaagaaaaaaaatctgtgaggc

SEQ ID NO: 36377 - DNA, 201 bp, Bos taurus
catgagattgaatagaaaactacttttatttttcatctcaaataatataaaccaccccatttcaaatatgggaactagtattagatatctacagaattgtygttgctcagtcactaagtcgtgtctgaccctttgcaaccccatggactggagcacgccaggacactgcatttgaaaatcaagatacttcaagaagtagtt

SEQ ID NO: 36378 - DNA, 201 bp, Bos taurus
actaaatggactactatttgaaagaatactacattaatggtaaaacaattattctcaggaaagagaacatctgaataagactgggagaaaataaaagatartggggtcagggaggaatttacgtctagattttaatgctgtctttgaatgtcttaatctttatatctagtttttaatgctgtctttgaatgccttagtctc

SEQ ID NO: 36379 - DNA, 201 bp, Bos taurus
gaagaatctttaatatgattagtattattaaagacagggcaatttgttttattctgcttttcaagttaagtctaagagcatgtactattttatgatttcartagattggggcaaatctttaaaaatagggaaagtatgttgaatcctaagatttggcagtgttctaaatcatttgacatgattgaactcatttaattatct

SEQ ID NO: 36380 - DNA, 201 bp, Bos taurus
cattctcttggtgcaggcagtcctttccctcctgatttctgcagttctttggagctccaggttagagcatcagcttgaaaagtggactgtgggatataaayagatacttctcagggtccatcagagggccagcctctccccagccctccctctgcatacccacaggaaaacaaaatgaactctcagctgggttttccccct

SEQ ID NO: 36381 - DNA, 201 bp, Bos taurus
cacactgaaattttttcagagaactgactacctccagcagagtatctctaattaccttgggtcaatcagaagctccattgttccaaaagctggagagaccrcccctgagaagtccctacaagtcctcaccaacttgaacgatgtctgcccttgactctcttggaatctggtccaattatgatgaacattcatggaccacgt

SEQ ID NO: 36382 - DNA, 201 bp, Bos taurus
ttttataggtggcatggtaaagcattttacctcatgtcaactagctggttagtcaagcactggactacacgtgtggccgttattgtcagccagcctctcgrgtcttcagtctcctcatctgtaaagtgaaagctcggactacagcagggatggccacgtctggctccttgtgtaaacaaagctttgttgaaaccccgccat

SEQ ID NO: 36383 - DNA, 201 bp, Bos taurus
gataaatggacagatacaacatattactaagtaaatggtcttgcatggaaaagagaatatagtaaacagtctgtcatcacaaacgtttcatcagagaaaaygctttgcaaggatagacagcttgattcagcctacatgattcatcaccacacataccttccgaaacctttgcaactggaatcagaaaggccaagtgaacag

SEQ ID NO: 36384 - DNA, 201 bp, Bos taurus
atttcttgtacctcctgcatttggcaggcagattctttatcactgagccaccaggtaagtctcaccctgtttcatgtttgactacaaatatttataggccrccagcctggaggtcttcacatctctgtctctggcaggtaactgaaggtcggcttaactctccggggaagaagactgatggctcgtggggctgaaccgcag

SEQ ID NO: 36385 - DNA, 201 bp, Bos taurus
ccagcgtcacccacccgagcctggcgacaggcgcgcccaggcgagctccgcggggccgaggtgtctggagagcggccccgggcgcccgcgcgcggcccacygagggtaaccagaaaagccagcctcggggtcgaagtcataaagttactaatcctgtgcagggggagtaagcgtgcctcgggccgcctggggcggtcattt

SEQ ID NO: 36386 - DNA, 201 bp, Bos taurus
aagaagctatttagagacatgcgggagagtcaagggagctctaagtgaagaactgaggtgggggccggaaaccccagcatgcttcccaggtcaggggcctyggatctgccccctaccccctcctcggtttggtagttcaccaggactcaaggttgctgtaatcacggctgtagtttattacagtgagggatccagcaggca

SEQ ID NO: 36387 - DNA, 201 bp, Bos taurus
ctcagagaaacggccagttttcgagggacgtttgcctgttgtgactgtgtcattactgtgtttttgtccctcgtggcgggaagagttcatctcacatctgyagctgccagcgcaccacggcccctaggataaacgcttgttggttgaagtgctccacagcgatgcccccacccctcctcatccccagatgctgccgtctcc

SEQ ID NO: 36388 - DNA, 201 bp, Bos taurus
cttaaaattggccactatgcacacagagaacattagcactgtgacataatgggcatgtctgtgagcttgcttgtgatgctcacttcacagtgcacacctgygtcaaatcatcacattgtgatgattaaacatacacaatttttatcttaaacatacacaatttttatctattttatgccaataaagctggaaaaaaatctt

SEQ ID NO: 36389 - DNA, 201 bp, Bos taurus
taagatctttaaaagtaacagttaacatctttgtccttttcgtttggctctttgacctacagtgtgatcaaagtcaggttccggtgaatgtcagtagcaargtaacatgttttcaggacccagagtgaagttataaatcgactctttgtggtggtgcagatggaaagaagtgttcactgccccaaaactctgtgagaactt

SEQ ID NO: 36390 - DNA, 201 bp, Bos taurus
ggaagcctgctaacgtggtggagctgggagagaccgtgtcttccgccggggtctgtgcttcagggcacagctgctgctccctgagccctcttcccgctctyggcctctgagagagcccccctttcttggtgtcctggctggcgaccctggcagctctgtaacaccagccgtgcttcttctctggcatcttcagcttttcct

SEQ ID NO: 36391 - DNA, 201 bp, Bos taurus
actatcctgtcctaacccaggagtctctgggtgaggtggtgagccttctagcagcttttgagtgctcaatccatgcccaccaattttgtggcttttcttgygtctgaaattcccatcaacagtagcctttatttacataagacaaacaaatgtacaccttaacacaccaggaataaccaagagctgtcattgcatcctggc

SEQ ID NO: 36392 - DNA, 201 bp, Bos taurus
tttgtagttgcaagtacaagtaattaactgtgatcaaatcatcaaacctaaaatgaatatctccctgctagcatgaaacatcctcattaatcttatactamgtcaaccaaccatttgcatattgtactagaaaagtgctgctaaaaagaattctagttcctcatctgccttggcattgatgaatgaatagccttcctaata

SEQ ID NO: 36393 - DNA, 201 bp, Bos taurus
ctcggcctctttgggaatgggacccagatactgtgcattttttaaaatataaatttatttattttaattggaggctaattactttatgcattccgggccakgcacggtcacggtgaagacaggggtttcgggttaaaggttgggagaaagttaagaggggacgggggtgtgcgtctctgctaccctagagagaggccagaa

SEQ ID NO: 36394 - DNA, 201 bp, Bos taurus
ctccagctcggggcctccttgccatgccccaatcctcctttcagcacctgaaggagcaaactgttagctgataaatgatcaaaaagcttccagcaaaaacrggatttggacaaggagctcagaagcagcataaggtcccgcaggttcaagcttttgcctgcttcaccttcatctgctacttctccccgatgggaatcagat

SEQ ID NO: 36395 - DNA, 201 bp, Bos taurus
ctcttaataggtaactgggttaattctatgaccccactctctccctgaatgtacatccctaatcaattacgccaagatcacagacagaatgactctttcakcttggcatcactgactggcaatttcaatggaaaaccctgaaccactgggaatgatttctccctacatgtatctaggtcaggaatcatcattgtcatattg

SEQ ID NO: 36396 - DNA, 201 bp, Bos taurus
ttgtttcccaagtgcctgaagcaggtctctaatccactctaaataaactctaatccactcctattgttttgttttttttttcactcctattgttttgaatrggttttaataattcccaaatcatatctgcagtccccagctttttttcaggattctctctcatccagtgcaagaaacactagtagtcgactaagcagagta

SEQ ID NO: 36397 - DNA, 201 bp, Bos taurus
atcacacgtcttatcacagcccccaaggccaacagcaggggttccctcttaacttctgagccccttggaggaagggagtatgttgatcacaccacagagamtcactgaaaaagaaaagccacttctcccactgacgacaacactggtaataaggaagagctcagaagtcaagcagatgtcgattttgaaaaatctaaatat

SEQ ID NO: 36398 - DNA, 201 bp, Bos taurus
atccagaccatctctgaggagggtgccctgctagacgtggaggaccgtgtcatgtggactgttctgctcctacctgtggcctgactcatccatggcccccratggacacacggtgcagagcaccaactgcccggactctataatgtggtgacttggcttctcagggctttgcctgctctttctttattctcagtggatcag

SEQ ID NO: 36399 - DNA, 201 bp, Bos taurus
atgggataagaatctgtgtgtggctctcctataccattagacactggcaggcacctctgttccttttaatccccagatataacaggatgcctctgactctmgttacttccaactgccattcataaaactggtggccagacctctcagggggtggtggttctagtgcctttcagactgtcagagcccacttgcccttccctc

SEQ ID NO: 36400 - DNA, 201 bp, Bos taurus
ttaggaatgttatattacatctggctcagagacggttggctgttgatggttaaatttaggccgaaatccacgaggagctaattgatgatctgtactgaccsttaagcttggatcaaatctgtctagagaaatttatgcttagatagtgcatctagctgttgcagggctgagaataggagaacaggggatttctttataaac

SEQ ID NO: 36401 - DNA, 201 bp, Bos taurus
agctgccatgcgggaggaacctgtgtggaggccagaaggggaccctgggtcctcccccgcttagagccgtatgtttggtgaagatttagggtagagaaccrggcaggtacccgtgctggcccttgcctgcctccatctccttcacatcgggctgtctcccctgtgtttcatgatctttttgttccaagcaccacagcttca

SEQ ID NO: 36402 - DNA, 201 bp, Bos taurus
caggcacaaaaaccacctgcagttctattttgaccaagaattctcatgtggagatgattttcaaaatgatggagaatagagacaaaggccagtgtgccctraggaggctgggtttcacatttaatgcccaagggagagaggaaaggcacttcaggaagaagggatctggccactagggctcacagagaggcaagaatcagg

SEQ ID NO: 36403 - DNA, 201 bp, Bos taurus
gaatcggagtggccctggctaatacttcacccatgccttacatcagtgtgttttgtaaggatctccacctgcagatgagaaaaccctgcatgctgggtgaygtgtgtctgccctggccttctccacgactcagagcaagcaaactgctaggctcttttctgactccctgtcactgtcccctcagacactgccgttaatcat

SEQ ID NO: 36404 - DNA, 201 bp, Bos taurus
aatcttccgtggtgcgcccggttttaggccgtgcattatctgttctcacaaatcactctcttagttggcgccatagttttattttttgatttttctcaaayagtggccccaacacagtgcattgtttcagatggagtattcagaatgtgggtactgaatgatagcagctgcccatcctgaactagaaatggaggaaagcat

SEQ ID NO: 36405 - DNA, 201 bp, Bos taurus
aaacagatattgatcctacccctgaacgtggcccaggaagaaatagtagtattttctgttcggagaagagtgggcagtgctctccagtcccttgtgctgcrgtggcatagaagtggcctcgtcattaagctccaggctgtacccctggcgagcctaccacccagtcctaagaaatgaaagatgacatctcggaacatactt

SEQ ID NO: 36406 - DNA, 201 bp, Bos taurus
aaactgtacagcaccatataaacacagattattcctgttattttattatcatcaatctacacagaaaatctcaagaggctgggaggaaggcattattaacycacatttttgagttgacagaacacagaggaaagggaagaatatgcagttcacagactcagaaaagctgtggctgcttactgttccggaagaaaggaaata

SEQ ID NO: 36407 - DNA, 201 bp, Bos taurus
cagagacaggacggctgagtgggaagggaatcagggaaaagagctaagtcttcctggttttaaaaggccaagtctgaggacaggatgtgtacacactgttrgctgtactttgtgattacaacttttgagcatattttcaatataggtctctggaccattctctgctctgtacacatacctttcacaagtatttaaagcaga

SEQ ID NO: 36408 - DNA, 201 bp, Bos taurus
tcaccccagttcagtatcctctcctgaactgttggtctgcagggtagtaactatatctgtgactctggaaagaatctcatcaagtggcccatcaactctcrgttgtaaacaatagcagtggaaggtttgatggtccatgaatgggcatttgtaaggatcatctcatcatgatgcttttatctcaattatctggcctcatgg

SEQ ID NO: 36409 - DNA, 201 bp, Bos taurus
tgcatgaaaaatgggataccacagtcccaaagttctagtaaaatagtgtgaacacagtttataaaataggtggaatcagatgatcacttcaggcaaactartcacataggaaagaattttttaaattctgcgcggcactctcttgtgtgtgccctccaaaatgaattacttggaaatatgaccgaagaaaatgagcttact

SEQ ID NO: 36410 - DNA, 201 bp, Bos taurus
ttgaactgccagcttatcagaatttatcaagggaaggaaaggagagctgtttcaggaacccacacacatgtagaaacacagggcctaatgagaatatccaygttggcaccatcctaaaaataaaaaaaggaaaaagaaaaaatgagagcaaaagatcacagcttggaataggccaggcctacagtcagactccagcaccca

SEQ ID NO: 36411 - DNA, 201 bp, Bos taurus
ggagggggatgggcgagggcgtccgcgtcccctactcggccgcccgccttctctcctcggtgattccttccaggtgattcacatgggcaggtgattcacgygcgcaggtgcttctaggctttcggcctggagagctaaaacaccatcctctgtggtgctttgagagcttgggcttcactggcaaaacctgagtcccaggcc

SEQ ID NO: 36412 - DNA, 201 bp, Bos taurus
gagcccaagagaggctgcagggtatacctaatatatagatcaaccaagagaatccttgttctgtgtcagggcctcaagataggcctgtgactggtaaggayactgagaggaggacaaagcagtgactctttgatgctttctagatgcgccaggaaaactgagttagttatgtggggcccacagcaagaaagccaatctctg

SEQ ID NO: 36413 - DNA, 201 bp, Bos taurus
gcagaatgacattattgtcaggagccaaagcagcagttcttactaacgtatataaatgtttttagtgtttctctggggccatagagtctctcacctgtctktcttctgtatgtttgctttattctttatcttcataacaacttcagacccacatggtctcccacccaagtgtataagacacatactatatttggcctgtgc

SEQ ID NO: 36414 - DNA, 201 bp, Bos taurus
ggtagggctgtgggccaggcttcacgtttgcccttgggtgggtggggccttaggctgtgctccctgcctgcacatttccacagactggactccatgagctrgcagggttaaatggacagatgggtaatcaggctgtgccccaaagttgatcaaggctacagatggggctttgcaatcagataggccattggttgtgttctg

SEQ ID NO: 36415 - DNA, 201 bp, Bos taurus
tttgggtatttatcttgaatttaaatccatggtcatcaacatcaggatagataacagctttcctataaaactttgtttcaggcacatttttatgctgcctrtctctacccgtctatctctctgtctgtctgtctctccatccatccatctaatcagcgaatcctcttttctgtgagaaaatatcaatattattattatctc

SEQ ID NO: 36416 - DNA, 201 bp, Bos taurus
ttgcaccctttgtttggggggcctattcaaaaatatttctatcattttgtattctttccatgtagttctttcaataatttaaagctgtggatacacgttgycccaactgcttgttattttggccagaaatgttgctaataattgaggaaaataaaagcagtttaacaaattctgttgaaaacaagatgaaagggtgaataa

SEQ ID NO: 36417 - DNA, 201 bp, Bos taurus
ttcttgtattatagtttttgctgtatcagccataatcaaaagcacatatgcaagcatgaagatgaatttcagtaaatacagtcctgtcagtatccgaataygtgactcccacccttttctctcttgccttttcagtgttgtagagaatgaggtggttaagcagtcagcatgtctccctgcagtttcagttagtagcacctt

SEQ ID NO: 36418 - DNA, 201 bp, Bos taurus
tgctgtgattcatggggtcgcaaagagtcagacacaactaagtgactgaactgaactgaactgagtaccagacaacatgtgttctaatagattacagtgcrcctagaacaaggcctggtgtataatgtggattagccaaaaagttcattcgagtttttccataatatcttatgaaaaacgctatagaaaaacaaacgaggt

SEQ ID NO: 36419 - DNA, 201 bp, Bos taurus
ttgtccctggagttctctgctgtctagatattaccattccacaatgatgaccacagagatagcaacatcaccctgtaccactcaggccctttgagtgtgcrtggctgattaacacagacacactcattaggatgacatgttatggtgcatttgtagttggggccctggaattctctctttttctttaaactgaagtagagt

SEQ ID NO: 36420 - DNA, 201 bp, Bos taurus
acagggaggcctggcgtgctgcgattcatggggtcgcaaagagttggacacgactgagcgactgatctgatctgatctgatctgatatatatgtatgtatrtagtaatttgattacatgttccttcaatttcccctttgtccttttttgtttaaatatccccattgttctttttgagttaaataacaattcttaaatcata

SEQ ID NO: 36421 - DNA, 201 bp, Bos taurus
ttccctaccaagaccatcacagaaatcagaaaactccaacctaggagatcctcgagtgtgtgtatgaattccttctttaccactgtcatctcagatgctaygatgatacttaacgttttgactaagattttccagtttcaacttaaatttcaatgcgtgtgcctaattattgcctgcctgacatgtattttaaatcatcca

SEQ ID NO: 36422 - DNA, 201 bp, Bos taurus
gtctgaaggcccctggctaattgcctttctgcccatcatcctgcctgcttctcccttgtttttatatcaaggtgacaagctcaaatgccacagctctggtrggccatgaagatacacagacccatagtaaccaggtcctaaaaattttcaagagaagccagaactccaaaatctggtggaaacgtccctcatttttaaata

SEQ ID NO: 36423 - DNA, 201 bp, Bos taurus
gacactggggcagctggccatgtttgcagtcaacacgcttcatagttaattacatatctttatccatccattcatttggcaaatatttactgagggcagtwataggccaggcactgttttaggctttgtggttacagcagtaactaaaacaaattccttgctctctgagacagacaaaaatgcatgtatatcaggaagtgc

SEQ ID NO: 36424 - DNA, 201 bp, Bos taurus
gaagggtcagtttgccatgatcaagatgtttagtgaagggagtttgggggagaatgtatacctgtatacctcaaaggctgagttcctttgctgtgcacgcraaattatcacaacattgttaatcagctacactccaacataaaataaaaatttaaagaaatgcttactgaagatgaggaggtataagcaggatgaaagaac

SEQ ID NO: 36425 - DNA, 201 bp, Bos taurus
tcctaagaggtagccctcgacttcatgattcaaggaagcatttccttccaggtggcaatattgaaagagagaaggaaaaatagagatggccagcaggtgcygggtcttaaggaaggtttgtggacaccagcactcagttcttccattgggtcccattggttagaaccttgccacatggccatatctgagtacaaagagccc

SEQ ID NO: 36426 - DNA, 201 bp, Bos taurus
gttagtttctctttgtccagtttaattaaattagctggtcctctgcttaactaatagcctccaagacattgtaatgacctgcatgtaattttggaaagagycctggagtcaaatgatctggattcttttcacttgttggtcttgtgaccttcaagaggactttaagtaactgagccttgattttcacatggacaaaatgaa

SEQ ID NO: 36427 - DNA, 201 bp, Bos taurus
tcagatgttaagagcggtggctggcctaggattttcataatcaaattacatagcactagtggaactctttctgggaatccaggccaatctctgaaggctayaattccaagtaacatggagaaattagagaaagacgttttcattagcatgaagctttagacttgtggccaaaaatttgaaaggaaacgcaaaatccaatca

SEQ ID NO: 36428 - DNA, 201 bp, Bos taurus
aagaccagattcttcagcataatacatacacttggatttgacatttatctcattacatcaaggcacagaaataaaattaacatgaggtcatataacgtggyaggcatttttaaataggaatacacagtttttcagaagttcaaagtgaaaatcatacaattaaatgtctttgtcaaacatgtttttcccctattactctat

SEQ ID NO: 36429 - DNA, 201 bp, Bos taurus
ccccagaccgcagtccgcatagcccgcagccgcgcatcttcagcaccttggcttgtgtgttaggctagcctttccaagccaaccttcccaggccgtctccyccagcttttgaaataaaccccccaaacgggtgcagtcaactcaagatcgccttccaccgcgcccgccgagacccccccttctgcggtcatccccaggccg

SEQ ID NO: 36430 - DNA, 201 bp, Bos taurus
agagctggagagaattgtacctgctttgctactaaccccaaaaccaagtggcatccatattaaaatttcatattttaaaaatctaatcatggaagtttgcrttctggcctgatttctttcccctttttggtctcacagcaaagtgacttggaatcctagccaaaatatttagttaaaaactggagatgattagagttcgtc

SEQ ID NO: 36431 - DNA, 201 bp, Bos taurus
ccctgcgtgtccttgccatgtggctggataccccctggtgttacctctacccttcctgaagagcaagtgcaacagtgtcccttctctggtgactgttcttygtcctatgggcctaaataatcctgcagatgtgttcgtgtgtttcatcctaaatctccttattaagatttagctccccttttcttgtaacagaagtactag

SEQ ID NO: 36432 - DNA, 201 bp, Bos taurus
ccagctgcaaccaagaaattggaaggcctcagagaatgaaaggtaaactttccgaaagcctcagtctctttttcaaccccgcaggaagcggtttacgtctrgggtattggatagcagtttgggcccagttaacacatctctcccaccacaaatcaccctgtcgcatactcagatgacattggccaaataaactcggggatc

SEQ ID NO: 36433 - DNA, 201 bp, Bos taurus
gcaggcaacagagcatgggacaaactgctttgggtctaaccaaccgttccctatcataatgccaaatctgatgaagggacttcagggaaacctcgggtttkgggcttctccccttcatgctggaatgattcaaaactgtgtatacaaactgattattctgaccaaatgacgtgatatgaacttccatgagaatgacagctc

SEQ ID NO: 36434 - DNA, 201 bp, Bos taurus
ctgcatccgaaggtgaagtcttaaccactggaatgccagggaagtcctggcaaatccttttttaaacaaaatcggttattggagagttaagatccctctcmatgccatttggaggtagcctgacgggggaaacatggaatatctgagccggaatttctcgtggcgttcacaagcttcggtctaccagggaggcccccaagt

SEQ ID NO: 36435 - DNA, 201 bp, Bos taurus
ttacctggattttttgacaaggttgaatcaagtgaaaatagactccattcattgaacctttgattgagggtgggtggtgattcatacattctaaaggttaraaactcttaggacacttaggactttgcctctttgagatgttggctggcctctctccatttcaatggaaacagttgtggtcagtctaatactataaagaga

SEQ ID NO: 36436 - DNA, 201 bp, Bos taurus
acgtatcaccttttaagtttccagttatgaaggctgagctccgcagatttgccatgagattcccagtttccacaagcccctcaggcctttctcaacatccygctggtgccttcttgtcccctccagaccatgtcccttgtgacagccattgtgttctactggccgtggtcaccgcggcctcagccttggtagcccagcacg

SEQ ID NO: 36437 - DNA, 201 bp, Bos taurus
gggaagtccccccaaacagcaccttttaaattactaattgcctgcctctgttttgttatcttttgtttttttgttcactgggccgcgcttattgttgttgrctctttcttcttattgggtaaatgcagaggctggtttgatggtctatgtaatttctgggtcatagtgactcaaacttgtgtgaaatggatgagcttctcc

SEQ ID NO: 36438 - DNA, 201 bp, Bos taurus
gaaaaccctgtaagtttttttgtgacatgacacaaaaatgttttatttctcatgcatacaaagtctgttgtttgcgatgactttatgatttaggccacatycatggtgtggtgatgccatcataacatgtggattccaagtcgtcatgacaggggaagaaagagctaatggttcctcacagctcttacatatgttggccca

SEQ ID NO: 36439 - DNA, 201 bp, Bos taurus
tcacatcagagtccacacagccctccctcagtcagcatcagcaccgctaaaaacaaagagtgggtcctttgtcagccaggtggcagacctgggcctccccragaaacctcacctcacaccccagaagggtctcttaagccaaaccaatctactcctccccagctgctgcttccgcctccccgggcatggagggacccgcgg

SEQ ID NO: 36440 - DNA, 201 bp, Bos taurus
ccagtgcccagtctgggtctccaggccaccctccactctggcacagctccctccaggggtacccaaacctccaaactgccacgcccagcacacatctgagrcaggctggggcctaggaccctctgctctagcactgcaatgcttaccccaggcacccctctcctctagcaacaaaatacaaagaaactgaatgggactaaa

SEQ ID NO: 36441 - DNA, 201 bp, Bos taurus
ataaaacctcaccttcttctaagacaattataatccgaagaaatcattccttctttggatttctttaagctcaaggaacagtctcgtgtggaaaggccccygaccccctaaatgttcttccctggatgctgagcattaaaaaagagaacacaagaacaagttcatggtagagtagtaatataatgataaatgtaacttcag

SEQ ID NO: 36442 - DNA, 201 bp, Bos taurus
aaaaatgaaatgaatatagtgtctcccccttctttcgtattctgcactgtcacagagaaaaaagtctcaagcatccactctggccacatcacactcacacygcaacacgcagagaaggggctctggctggacaacagggtccagaagccactggcacgcgcccaaaaggatgctccccaaagcccttaattatgagacctg

SEQ ID NO: 36443 - DNA, 201 bp, Bos taurus
catcagcaggcctgtgctggcgtgtcacacaagactggctcctacagccgaccctgtctctgcctcttaaaggcattgtttgcgctgctccacaaatgttrccattgattaaactgaatctggccaatgcaaaggctggagggctgattcaatgcctgggagtatttcataaatactgcatctgaaagtgatagtttttct

SEQ ID NO: 36444 - DNA, 201 bp, Bos taurus
atattgtattttttttaagtttaaaataatattgtatattgtccttgtttacttgaagaggagcttgttttatggctagaacatcattacttacttttttytttacttactgtttttaatagtctcactgcttccccaggtctgtttctatttattgtatgttgtgggaaaacagctaaaaacacatttcttattgagtga

SEQ ID NO: 36445 - DNA, 201 bp, Bos taurus
ttctccatagatggattatatgtcatggcaattatgtgttgtagtatgccctgcagtctttacataatttttgttgagggagaaaagactgttttgctctmaactcttaaaaacttttttttaaattgtggtaaaaatacataggggcttccctggtagctcagctggtaaagaatctgcctgcagtgcaggagaccccag

SEQ ID NO: 36446 - DNA, 201 bp, Bos taurus
tctagggcaacagaaagttcttctcatgccccagccttagactcaacctctttcttctccaaggagctctggtgctttttagggggaaatggtagtaattygattctgggacagagtcacttccgttgtgacaaaagcagggcagaaagttcccagttttacaacttggccactgtttctcaaacctcagttatctaggac

SEQ ID NO: 36447 - DNA, 201 bp, Bos taurus
agacatgggccgatctggatcctacctgaacagcagtatcaattcagcctggagtgagcacagcttggatccagaagacattcgggtaacaccagcatttstacttttctgttttagattaggcccatttgtacatcatacgtgtgtgggcaggtgttcatgtgttctttgtgttatagaacttgtgtgattatgtaagga

SEQ ID NO: 36448 - DNA, 201 bp, Bos taurus
tccaggagttggtgatggacagggaggcctggcgtgctgccgtccatggggtcccaaaaagtcagacatgactgagtgactgaattgactgactgactgayaaggataatctttagtttgtcataactattgcaactattttgttcttatttgacattaaccttttaatttttaagaatattgatgtaaatgatcatctat

SEQ ID NO: 36449 - DNA, 201 bp, Bos taurus
taatcgttgagtgaatgagtgaatcttccttcactttgaatactgggaaatgaagcttagggaaagtaatcaagtcactttagaaatgaattgttttaatrtccaagtatgtgggtctctagtgatctggcttctcctaggaatgaacttcagagcatctagacaggaaccagagaaggcaatggcaccccactccagtac

SEQ ID NO: 36450 - DNA, 201 bp, Bos taurus
gattttgagaagggacgaatcagctgcatttccaattccaggcagggggcagatccattccttttacctgaaattggactttaatcagcctccttttatartttcctcaatggttaaaacagcgttgtagttgttgtaggtgttcacaggtcatattgtttacaaggacaaatctaccatataaatgctggctttgtgatt

SEQ ID NO: 36451 - DNA, 201 bp, Bos taurus
gggggggcggttcaggatgaatcaagcacactaccttcattgtgcactttttctctattattattattattacgacataataataataataataataatawtattattattataactcgaaggttgaggatccctgttctagagcaaagggaagagggaaagtgttggaaggagagcattctagagatggctatattttca

SEQ ID NO: 36452 - DNA, 201 bp, Bos taurus
cgggtaaaataaaactgtcaggtctctgcagagtgccacaagtaaatgcaccatgggccaatctgtctactagatcttagtgacgtttatcatcaaacccrcctgcttttctgaaaaatggaaacttatttaatcatcgtgaaaacagcaagaagccgaataattattgcaatgatggcaatcgttggaaatgcaatagac

SEQ ID NO: 36453 - DNA, 201 bp, Bos taurus
attttgtatgacagtcatgaaagaaaggtaaagaagtaatcacctggctgtcttaattaatgtacatttgagagagttcagctttctataattagatcccyccaccccagtgtcaaaagacacacatacacacagagctcttccctttctttcccaggactgccatagacaactttttggttaaatccatgttcagtggtt

SEQ ID NO: 36454 - DNA, 201 bp, Bos taurus
tgacacaaaaggtactctgtagataatactgaaaaacattgtcagggaaagtgcaaagttgatatttgtgtccctgttatgcagaaggggccctagagagytgaagactaactaaagctgtgtgcttctgggtaggacaagattcataccatctgcctgggtctgggcctcagtgctctctgcaataccatgctgtctcct

SEQ ID NO: 36455 - DNA, 201 bp, Bos taurus
cagaggacccattttcaaagaactaaacgagaaaaaaagcattaaatattgatgttgaggtgtttacaataagaagctgtggtccagccactatcctacarcgtaatcactaactggcaaactccggacctcacaaagtcttgctagtttccagcgccttttctactgcctctctcctaaatgcagcagacaaggaaggca

SEQ ID NO: 36456 - DNA, 201 bp, Bos taurus
aaggtccttcccttcatctctgcccttaaaaatcctaaccctccttctagacccatcccaaatttcacttcccctgcaatgtgcctttccagacactccarcctccttgaaccatctttcgtgtgtctctctttggggcacttacattcagccttgcagtgtgtgtgacggctggttccatcaaaagccctgcctcacctc

SEQ ID NO: 36457 - DNA, 201 bp, Bos taurus
tctggagcgaagcagggtgattgagcagatgtgcagtgaggaggcctaaattatgctagacctgactggcctgctaactggccatgtgaccttgattagaygacttcttttccttgactgtggtttccccggaagaaatgtaaatggatggggccaaatcagcgttttcaaaacttctaaagacaaagtggccagtaagct

SEQ ID NO: 36458 - DNA, 201 bp, Bos taurus
ctgttctaacctttcctgaaggaggaattcacctctttcctgaaagaggaattcacttgaattcaccatggcttcattcacatgttcacgcttctggccaytgaaactgtcttgctatcttaactcagtccagtcctgcaaaatgccatctgccagaaacagcagggaaagcagcaggccaggtttggattaagcctgcca

SEQ ID NO: 36459 - DNA, 201 bp, Bos taurus
ccacacggaggccagggcagagatgggagtgaagctgccacacgccaagggaaggcagagccacctgaagctggaagaggcaggaagaatcctcccccgtrtgtgtggaaaggagcacgacctggccgtcacaacttgacttcagatttccagcctcctgaactgggagagaacaaatttatgttctcagccacccaattt

SEQ ID NO: 36460 - DNA, 201 bp, Bos taurus
cacatgcaatatacacatgggcagaaaaagagctgtgggagacagtgaggctgggaaatagccccgactccatcatttcctgtgactgcatgctgaaattygcaaattcatcatattgcaggcaagatttaggttgaggcaaaggtagtggaacacctgaataggtagaaagtaacagcatattcttagacatgcacttgg

SEQ ID NO: 36461 - DNA, 201 bp, Bos taurus
aagtttacagattgctgtttactcactgatctatccaatcccaatgttttatagttgatgataccaagtccccaataattaaaaaccataagttaaaaccyctgtctccagaaacttaaaaccatttactttggattcaaatcacaattatgatccaatgtaactatacaaccttaagaaaactatttaatttgtccaatc

SEQ ID NO: 36462 - DNA, 201 bp, Bos taurus
ccatcaaagctgctcactttttttttcttaaatagagaataaccaggctgaagagttacaagtgatgctttccacagcgtagtatataaaaccttcatctyccagctgctagcatcaaccacatccaaatcatttaagtaaaaactgggtctgacttctgagtgatgcaaagcctgactcttggggaaatggcaaggtttg

SEQ ID NO: 36463 - DNA, 201 bp, Bos taurus
gggctcattgtgtagggccatcaagccctaaaagccaggggccggcactctgttctgtggacaacaagggcacatctcaggctttccagaagaagaacgaygagattagatctgtttatcaggccaagcgttcaagaagccatatgtggggtggatggcagctgggagtgacttgcctcgggaggccagttccagaaactg

SEQ ID NO: 36464 - DNA, 201 bp, Bos taurus
gttgatgctgttttgttttttatgaaggactcccaaagtacaaggttctgtttcatgtttctcatgaaatatctgtttacttaaacatgaaagtctgttamgaaatagagaaagaacatggaaacaccatacaataggggagaaaattttactctacacagatatgcatgttctcaacttagttttagctgtttttattaa

SEQ ID NO: 36465 - DNA, 201 bp, Bos taurus
cagggtggctggagaggaggggaatttgaaataagaacatggataagagaaggaaggggcagcagataacgtacagccagttgggccatcgtgaagactayggatttccctccaagtgagataaaaggtcattagatgattttcaaggaaagcaacatggcctgatttaggtttaaactcatcacacgggctgctgtgttg

SEQ ID NO: 36466 - DNA, 201 bp, Bos taurus
ttctttgcagagtgggattctctttgatggtttgcagaaaggcaaggctcacatctacagtgcagctttaaagatgcgcccacaaagaaagcccagattgkgggcccattttctcagagcaaatagaagatttgtgtgggccacacagaggcacattttgagagtgggtttatggattagtgggccacatgaatgacgtgc

SEQ ID NO: 36467 - DNA, 201 bp, Bos taurus
cgatgaggcccgtgcagagaaatattctgttctcaatatcagtgacagatgttcttcaacacataaatagatgacttttaccttgtaaatacccaatcacmgagccaggaaatggccctatttcatatccagctaaaagaaaacttaagacaaacctgttggatacacaaaatgtggtacatccatataatggaatattat

SEQ ID NO: 36468 - DNA, 201 bp, Bos taurus
attattgcttttggagtcatatttcagaaaatagttgaaaactttgttggctcaagtaagtttggttgctcagttttatgatttgaaaaatattaacttaygcatctgtttatttgcagtatttatgccctttcacagagataaatcatgaaatggcaccatttcaaatatgtaagcatcatgtagtaaaaaaattaacat

SEQ ID NO: 36469 - DNA, 201 bp, Bos taurus
ttcccccaagtatttgaagattttatactcatcagttgttcgagactgttcaaataagtttctaagagtagcttcccctaatttctttctgtaaaacatayccatcttcaccctgcgtccttgttccgttttgtttcttcactgtactcagctacctcccgttgattgatcgattgattctctcctgtgtagaatataaac

SEQ ID NO: 36470 - DNA, 201 bp, Bos taurus
atgcaaatagaaataaagagcacaataaatgtattgcatttgaatcacccccaaaccacccaccaccccagtctgtgaagaaattgtcttccacgaactgrtccctgatgtcaaaaagttggggaccgctacactaaaggataggttgattctttaactgggatatccgtctcaggggttatgtgtcatatactttctctc

SEQ ID NO: 36471 - DNA, 201 bp, Bos taurus
ggctgatgttggcccataaatcattcttactgtgaatttgggtaaagttagacacatatacagcacctggtttaacatcagactctttagaaatttttttkgggggggttcattagggcctgtgctttgtaactgctgctgctaagtcgcttcagtcgtgtccgactctgtgcgaccccatagacggcagcccaccaggct

SEQ ID NO: 36472 - DNA, 201 bp, Bos taurus
gagcacagttgagcacacataagcattcaggccttatttacagatgtatatacagagattccattgctttcaaatcccacagtttgatagaaaattgcacycaccatctgaagctgttcaagcacacagtgcagacacagtgacaagaacacatttttgagtgtggccttgatactgatccattggtaaagcaagacttga

SEQ ID NO: 36473 - DNA, 201 bp, Bos taurus
atcttagtatttatcaataagcatactatagcagaagaaaaatgtttttcatattaccttagtttgtaaatgccttagacagtgggagaatcctatccagytggaaatatctcctacctggccttttcagaagaatgaatcaacaggaatgtgttcattcaccttcaacccgaagatgaatttttattttaaaaaacatta

SEQ ID NO: 36474 - DNA, 201 bp, Bos taurus
aaaccccaagcatggttggccagacctccaggggctcaagaattccaagacccactctctatcttatctgtagtgccactcagcttactggtaacaactgrtacactggcaagcagacacatcatcagggcagtgtccaggcaggtcagaagcaaggtcagaggcctgctctgctttcttgtctctgagcagtgaagatgg

SEQ ID NO: 36475 - DNA, 201 bp, Bos taurus
tttacagcttggtagatgattttagcccagtggaacagtcagctgagataacttgttaaaagttggtctcttcttccttatcctgatggacctgctgtgtytctggactatggtgatggatacaggaagctacacatgggataaaactgcatagaactcagtacacatacacatgcagatgagtacataaaactcaggcag

SEQ ID NO: 36476 - DNA, 201 bp, Bos taurus
caaaaggcaacccaaagaatgggagaaaatgtttgcaaaccatgtgaccaacaagggattaatctccaaaatttacaaacaggccatatgactcaatgtcygaaaaaaaaaaaaaaaaaaaacttaatcaaaaaatgggaaaaaaaactctaaaaaaacatttatccaaggagacacacagatggccaagaggcacaggaa

SEQ ID NO: 36477 - DNA, 201 bp, Bos taurus
cacagccacctttgggactgttagaagtaggatccagccatcacaggccaacacttagatttagtagggttctcaccagacaaaatagtctcagacacttktctttctttaaactgttcttactggcccagtatacaatgttattaaaatcaagtttatgaagtagccaggtaggtattttttgtttttaattaggcgtta

SEQ ID NO: 36478 - DNA, 201 bp, Bos taurus
atctgccagaaaagacactcattaagtaacaatcactcaacagtatgagtgaccaccatagtaacacttaatttctgtgctgggccttggaaatacaacaragactaaaacagacatacttggttttgtggagtttattgtagtgggtttgttctgggccctaagtaaggacttttccagaaaggttctaagtgatgcata

SEQ ID NO: 36479 - DNA, 201 bp, Bos taurus
agttgtgagtcacagtgatttttgttggccgcggttcctgcaggtttggtggcacaggagtgactccatcagtgtgtttgtgtggttcccagaaaccagcrtccgtaggcctcccgcttccctgctcaggacctgccttgttatgtctgtcagggaggaggcggagatgacagacctgtgatatgtgaaaggggtttcagg

SEQ ID NO: 36480 - DNA, 201 bp, Bos taurus
cctggcctctgaagttccagggttggattgtatgtttccaggtattagtgggcgatatgagaggaagaagagggggcggcacaggaaaagggggtccctaygttaagcaagtggccaaagctgtccacggtggtgtgtggcagtaagggcattgatttgttcctggctctgacagctgggcggccttgcacaagtccccta

SEQ ID NO: 36481 - DNA, 201 bp, Bos taurus
ggggccagagggagggacttggggctgtggagacacatccagaggccaggccagagctggagcagcaggggtggtggggaaggcaggggtcgatggcccgyagaccacccattgggtgctgaacatggagggggcagcagagtcagggaaagaaggtgagttccacgttgttgaaccgtggttctgaggaggcagcaggac

SEQ ID NO: 36482 - DNA, 201 bp, Bos taurus
ctggcccctgtggtcaccacatgcttgtgtcaccaggaagattgcctgtccagctccttcctctccctctgctccccatgtccttctgccaggtcatcaarccactggcccctcggagtctggatttcacagaaatgtacgtgcatacggctcaggactggaagggacctctggaagtagttggtacatctgtcgtgcact

SEQ ID NO: 36483 - DNA, 201 bp, Bos taurus
aactgtctctgagccagtgatccatctgaagtgtaaacttaaggttttcttgagtcttttctgagccttttcctgagcatgtgaaattactttctaatttyctccatatattagttgttttaaatgttctaatgtctagctcccagagtctttattggtatggagatgtggaggaaaaggaggttagagttaagggtggga

SEQ ID NO: 36484 - DNA, 201 bp, Bos taurus
actgaatttttctttgctgagggatcttgaaagacagaaagaaggcagttgtgataggtaaagggttggtactaaggttatgaagttcaatatgctgctgyagatgccagggatctcaggattcagatagtctacatcacaggtaaggatgtgcaaacattcattcacaacctgcaaaaatcactcagtcatcgacacgga

SEQ ID NO: 36485 - DNA, 201 bp, Bos taurus
catccctggtggtccagtggttaagacttcatgctcccaatgcaggggacatgggtttgatccctggtcagggaactaagatcccacaaggcctgtctggrtaactagatttctctgaaggaggcaggtacttgtatttccagcccattttatatttagggccagagcccgggggccactgttttaataggcgtacatgaa

SEQ ID NO: 36486 - DNA, 201 bp, Bos taurus
gcccagattccctcctatttacctccctccccatcccccggccagtccaccctctttttcagttgtaaaaaaacacccacagatgcagctgtattgaggtragatgctcacctcagggcccatgagtgttgggaaaaggtgggttagaggccagtggaatgacatgaatatgagagaagagaggatttgcttttgcccaag

SEQ ID NO: 36487 - DNA, 201 bp, Bos taurus
agcttacaggataaaaccagttctgaaagcaaatgagcagccatcatgcctgagtgctaattgctcttctcccattagtggctgtggaattttctgcaccrctactttttatggaatccaacaagtttttaattctttcacttgcaggcttctttttcttcttggaaagagacatattatttgctacagaaggtagcagca

SEQ ID NO: 36488 - DNA, 201 bp, Bos taurus
caacacataaacttaaaactcctgctgttccagcccctgcaggtctgttaaccaggctgattttgttcaaactggccagaagaataaagcaaaaggcagtracttcagaagcagagcctccactggaggaccagggatcccagttactcattcatcaaggcatcgctcggcctccatgagcaacttgtgagcatcaaaatc

SEQ ID NO: 36489 - DNA, 201 bp, Bos taurus
tgtggaaaaacctgaaggaatgttttggccgaccctatataaaggcccaaaaggctaaacagacatgttggaaatcccgtctctgggtgtccctggggagyggtgacaggtaggggccagcagggggtttcagggatgctggtgaagttctgtttcctgatctacatggtggttacatgggtgtgttcggttgaaaattta
